United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 83

SEQ ID NO: 3797990 - RNA, 19 nt, Human
auucagacagcugccuggg

SEQ ID NO: 3797991 - RNA, 11 nt, Human
auucagacauc

SEQ ID NO: 3797992 - RNA, 14 nt, Human
auucagagaauauc

SEQ ID NO: 3797993 - RNA, 18 nt, Human
auucagauauauuuuuca

SEQ ID NO: 3797994 - RNA, 21 nt, Human
auucagauauauuuuucacag

SEQ ID NO: 3797995 - RNA, 20 nt, Human
auucagauaugauucaaaug

SEQ ID NO: 3797996 - RNA, 23 nt, Human
auucagaucacugaauuuauaaa

SEQ ID NO: 3797997 - RNA, 14 nt, Human
auucagauuucucu

SEQ ID NO: 3797998 - RNA, 20 nt, Human
auucagauuucucuuugaaa

SEQ ID NO: 3797999 - RNA, 20 nt, Human
auucagcaaggcgcuaacuu

SEQ ID NO: 3798000 - RNA, 17 nt, Human
auucagcacugauuuca

SEQ ID NO: 3798001 - RNA, 17 nt, Human
auucagccauguacaga

SEQ ID NO: 3798002 - RNA, 20 nt, Human
auucagcccauuucacaccu

SEQ ID NO: 3798003 - RNA, 15 nt, Human
auucagccuucuuuu

SEQ ID NO: 3798004 - RNA, 21 nt, Human
auucagccuucuuuuucugga

SEQ ID NO: 3798005 - RNA, 17 nt, Human
auucagcggaauauuga

SEQ ID NO: 3798006 - RNA, 22 nt, Human
auucagcuagaacuuugaagga

SEQ ID NO: 3798007 - RNA, 14 nt, Human
auucagcucaugga

SEQ ID NO: 3798008 - RNA, 12 nt, Human
auucagcugccc

SEQ ID NO: 3798009 - RNA, 17 nt, Human
auucaggaaaaggccug

SEQ ID NO: 3798010 - RNA, 18 nt, Human
auucaggaaccuggacca

SEQ ID NO: 3798011 - RNA, 19 nt, Human
auucaggaaccuggaccaa

SEQ ID NO: 3798012 - RNA, 16 nt, Human
auucaggaagaugaaa

SEQ ID NO: 3798013 - RNA, 21 nt, Human
auucaggaagcucagggccug

SEQ ID NO: 3798014 - RNA, 23 nt, Human
auucaggaagcucagggccuggc

SEQ ID NO: 3798015 - RNA, 19 nt, Human
auucaggacugcugguuug

SEQ ID NO: 3798016 - RNA, 21 nt, Human
auucaggacuuaacggcucca

SEQ ID NO: 3798017 - RNA, 18 nt, Human
auucaggacuugaaagaa

SEQ ID NO: 3798018 - RNA, 21 nt, Human
auucaggagaguagaacagau

SEQ ID NO: 3798019 - RNA, 20 nt, Human
auucagggaaggaggagccu

SEQ ID NO: 3798020 - RNA, 23 nt, Human
auucagggaaggaggagccuguc

SEQ ID NO: 3798021 - RNA, 17 nt, Human
auucagguaauacaaac

SEQ ID NO: 3798022 - RNA, 23 nt, Human
auucagguauguugccuuuaugg

SEQ ID NO: 3798023 - RNA, 14 nt, Human
auucagguuuuucc

SEQ ID NO: 3798024 - RNA, 15 nt, Human
auucagguuuuuccu

SEQ ID NO: 3798025 - RNA, 13 nt, Human
auucaguauguuu

SEQ ID NO: 3798026 - RNA, 16 nt, Human
auucagucuugccuua

SEQ ID NO: 3798027 - RNA, 17 nt, Human
auucagugcuguggccu

SEQ ID NO: 3798028 - RNA, 21 nt, Human
auucagugcuguggccugggc

SEQ ID NO: 3798029 - RNA, 15 nt, Human
auucaguuaagaaaa

SEQ ID NO: 3798030 - RNA, 20 nt, Human
auucaguugguaagcuucca

SEQ ID NO: 3798031 - RNA, 21 nt, Human
auucaguuguuagugugucuu

SEQ ID NO: 3798032 - RNA, 14 nt, Human
auucaguuucauaa

SEQ ID NO: 3798033 - RNA, 20 nt, Human
auucaguuucuaaaauugag

SEQ ID NO: 3798034 - RNA, 13 nt, Human
auucaguuuuuuu

SEQ ID NO: 3798035 - RNA, 19 nt, Human
auucaguuuuuuuccaguu

SEQ ID NO: 3798036 - RNA, 21 nt, Human
auucauaagccaauuuuucug

SEQ ID NO: 3798037 - RNA, 23 nt, Human
auucauaagccaauuuuucugca

SEQ ID NO: 3798038 - RNA, 11 nt, Human
auucauaauaa

SEQ ID NO: 3798039 - RNA, 15 nt, Human
auucauaaugacuua

SEQ ID NO: 3798040 - RNA, 14 nt, Human
auucauacuuaaaa

SEQ ID NO: 3798041 - RNA, 13 nt, Human
auucauaugcaua

SEQ ID NO: 3798042 - RNA, 20 nt, Human
auucauauuacaauauuugu

SEQ ID NO: 3798043 - RNA, 20 nt, Human
auucauauuggaaaaaucac

SEQ ID NO: 3798044 - RNA, 18 nt, Human
auucauauuuacuucuua

SEQ ID NO: 3798045 - RNA, 18 nt, Human
auucauauuuaugaaucu

SEQ ID NO: 3798046 - RNA, 17 nt, Human
auucaucucucuuuaau

SEQ ID NO: 3798047 - RNA, 17 nt, Human
auucaucuuguguuuua

SEQ ID NO: 3798048 - RNA, 17 nt, Human
auucaugaacuucgcau

SEQ ID NO: 3798049 - RNA, 13 nt, Human
auucaugacuaug

SEQ ID NO: 3798050 - RNA, 14 nt, Human
auucaugcuaccca

SEQ ID NO: 3798051 - RNA, 16 nt, Human
auucaugcuacugcca

SEQ ID NO: 3798052 - RNA, 18 nt, Human
auucauggaccacuguuu

SEQ ID NO: 3798053 - RNA, 23 nt, Human
aaaauuaaucugggccagaauuu

SEQ ID NO: 3798054 - RNA, 20 nt, Human
aaaauuagaaauuggcugga

SEQ ID NO: 3798055 - RNA, 22 nt, Human
aaaauuauacuaacuuauuuau

SEQ ID NO: 3798056 - RNA, 16 nt, Human
aaaauuauagaaguuu

SEQ ID NO: 3798057 - RNA, 13 nt, Human
aaaauuaucuaua

SEQ ID NO: 3798058 - RNA, 18 nt, Human
aaaauuaucuauuuguau

SEQ ID NO: 3798059 - RNA, 16 nt, Human
aaaauuaugaaucuga

SEQ ID NO: 3798060 - RNA, 22 nt, Human
aaaauuaugaaucugauuuuua

SEQ ID NO: 3798061 - RNA, 14 nt, Human
aaaauuauuucaga

SEQ ID NO: 3798062 - RNA, 19 nt, Human
aaaauuauuucagaaaugu

SEQ ID NO: 3798063 - RNA, 13 nt, Human
aaaauuauuugua

SEQ ID NO: 3798064 - RNA, 13 nt, Human
aaaauuauuuugg

SEQ ID NO: 3798065 - RNA, 18 nt, Human
aaaauucaacaaacauuu

SEQ ID NO: 3798066 - RNA, 18 nt, Human
aaaauucacuauuggcug

SEQ ID NO: 3798067 - RNA, 21 nt, Human
aaaauucagcaaaccauuuuu

SEQ ID NO: 3798068 - RNA, 19 nt, Human
aaaauucagcaaagugguu

SEQ ID NO: 3798069 - RNA, 20 nt, Human
aaaauucauaguaagauuga

SEQ ID NO: 3798070 - RNA, 16 nt, Human
aaaauucauuucacau

SEQ ID NO: 3798071 - RNA, 14 nt, Human
aaaauucauuucua

SEQ ID NO: 3798072 - RNA, 15 nt, Human
aaaauucauuucuaa

SEQ ID NO: 3798073 - RNA, 17 nt, Human
aaaauuccaaauucaug

SEQ ID NO: 3798074 - RNA, 13 nt, Human
aaaauuccacuca

SEQ ID NO: 3798075 - RNA, 12 nt, Human
aaaauuccagaa

SEQ ID NO: 3798076 - RNA, 16 nt, Human
aaaauuccagaaagga

SEQ ID NO: 3798077 - RNA, 14 nt, Human
aaaauuccuauugu

SEQ ID NO: 3798078 - RNA, 23 nt, Human
aaaauucgaccugauuuacaguu

SEQ ID NO: 3798079 - RNA, 22 nt, Human
aaaauucgcccgagcuguuuau

SEQ ID NO: 3798080 - RNA, 13 nt, Human
aaaauucuaaaua

SEQ ID NO: 3798081 - RNA, 20 nt, Human
aaaauucucagucaguaauu

SEQ ID NO: 3798082 - RNA, 17 nt, Human
aaaauucuugaaagaau

SEQ ID NO: 3798083 - RNA, 20 nt, Human
cagaggagagaggacccccu

SEQ ID NO: 3798084 - RNA, 18 nt, Human
cagaggagccaccaguuc

SEQ ID NO: 3798085 - RNA, 21 nt, Human
cagaggaggcagaauaagaaa

SEQ ID NO: 3798086 - RNA, 18 nt, Human
cagaggagggcagcagaa

SEQ ID NO: 3798087 - RNA, 21 nt, Human
cagaggaguacaggugaagca

SEQ ID NO: 3798088 - RNA, 15 nt, Human
cagaggaugagcucu

SEQ ID NO: 3798089 - RNA, 13 nt, Human
cagaggauggcca

SEQ ID NO: 3798090 - RNA, 15 nt, Human
cagaggauggccagu

SEQ ID NO: 3798091 - RNA, 16 nt, Human
cagaggauggccagug

SEQ ID NO: 3798092 - RNA, 13 nt, Human
cagaggcagcccc

SEQ ID NO: 3798093 - RNA, 14 nt, Human
cagaggcagcccca

SEQ ID NO: 3798094 - RNA, 18 nt, Human
cagaggcagccccauucu

SEQ ID NO: 3798095 - RNA, 19 nt, Human
cagaggcagccccauucug

SEQ ID NO: 3798096 - RNA, 21 nt, Human
cagaggcagcccgcacaccug

SEQ ID NO: 3798097 - RNA, 21 nt, Human
cagaggcaguaccugggcaag

SEQ ID NO: 3798098 - RNA, 14 nt, Human
cagaggccaacacu

SEQ ID NO: 3798099 - RNA, 21 nt, Human
cagaggccaugggccuccugu

SEQ ID NO: 3798100 - RNA, 18 nt, Human
cagaggcccaggcugccg

SEQ ID NO: 3798101 - RNA, 23 nt, Human
cagaggccccaauaccccaugga

SEQ ID NO: 3798102 - RNA, 15 nt, Human
auucuguauagauua

SEQ ID NO: 3798103 - RNA, 18 nt, Human
auucugucccuagguguu

SEQ ID NO: 3798104 - RNA, 20 nt, Human
auucugucgccuuagcaugu

SEQ ID NO: 3798105 - RNA, 24 nt, Human
auucugucucuggauuauauuaug

SEQ ID NO: 3798106 - RNA, 23 nt, Human
auucugucuucauccccucagaa

SEQ ID NO: 3798107 - RNA, 14 nt, Human
auucugucuugaag

SEQ ID NO: 3798108 - RNA, 17 nt, Human
auucuguggaacaagcc

SEQ ID NO: 3798109 - RNA, 16 nt, Human
auucuguuaaaaucua

SEQ ID NO: 3798110 - RNA, 22 nt, Human
auucuguuaaaaucuauucugu

SEQ ID NO: 3798111 - RNA, 19 nt, Human
auucuguucugauauuaau

SEQ ID NO: 3798112 - RNA, 13 nt, Human
auucuguuggaag

SEQ ID NO: 3798113 - RNA, 14 nt, Human
auucuguuggccag

SEQ ID NO: 3798114 - RNA, 12 nt, Human
auucuguuucuu

SEQ ID NO: 3798115 - RNA, 18 nt, Human
auucuguuuuagguuaaa

SEQ ID NO: 3798116 - RNA, 15 nt, Human
auucuuaaaaaaaga

SEQ ID NO: 3798117 - RNA, 23 nt, Human
auucuuaaaauauauuucagaua

SEQ ID NO: 3798118 - RNA, 13 nt, Human
auucuuaaaaugc

SEQ ID NO: 3798119 - RNA, 20 nt, Human
auucuuaaaaugcaauauuu

SEQ ID NO: 3798120 - RNA, 19 nt, Human
auucuuaaaguugaauuua

SEQ ID NO: 3798121 - RNA, 14 nt, Human
auucuuaaauaugu

SEQ ID NO: 3798122 - RNA, 17 nt, Human
auucuuacaaacaugug

SEQ ID NO: 3798123 - RNA, 23 nt, Human
auucuuacacugccuguauacuu

SEQ ID NO: 3798124 - RNA, 15 nt, Human
auucuuacauguuuu

SEQ ID NO: 3798125 - RNA, 20 nt, Human
auucuuacauuuuacuuuuu

SEQ ID NO: 3798126 - RNA, 17 nt, Human
auucuuacuaaaaagua

SEQ ID NO: 3798127 - RNA, 18 nt, Human
auucuuagccuguggcag

SEQ ID NO: 3798128 - RNA, 12 nt, Human
auucuuauaaau

SEQ ID NO: 3798129 - RNA, 20 nt, Human
auucuuauaaauaugaagcu

SEQ ID NO: 3798130 - RNA, 13 nt, Human
auucuuauuacua

SEQ ID NO: 3798131 - RNA, 18 nt, Human
auucuuauuuaaugaaag

SEQ ID NO: 3798132 - RNA, 16 nt, Human
auucuuauuuuuuaaa

SEQ ID NO: 3798133 - RNA, 14 nt, Human
auucuucaaccagu

SEQ ID NO: 3798134 - RNA, 21 nt, Human
auucuucaagagacccuucaa

SEQ ID NO: 3798135 - RNA, 18 nt, Human
auucuucaagaucccauu

SEQ ID NO: 3798136 - RNA, 20 nt, Human
auucuucagcguaaaauggu

SEQ ID NO: 3798137 - RNA, 13 nt, Human
auucuuccaucug

SEQ ID NO: 3798138 - RNA, 23 nt, Human
auucuuccaucugauugugaugu

SEQ ID NO: 3798139 - RNA, 22 nt, Human
auucuucccuuuuaaacacauu

SEQ ID NO: 3798140 - RNA, 19 nt, Human
auucuuccuaguuuucucc

SEQ ID NO: 3798141 - RNA, 22 nt, Human
auucuuccucccucccucuuuc

SEQ ID NO: 3798142 - RNA, 14 nt, Human
auucuucuagaguu

SEQ ID NO: 3798143 - RNA, 15 nt, Human
auucuucucuagcug

SEQ ID NO: 3798144 - RNA, 16 nt, Human
auucuucucuguuguc

SEQ ID NO: 3798145 - RNA, 13 nt, Human
auucuucugaacu

SEQ ID NO: 3798146 - RNA, 19 nt, Human
auucuucugcuucagccuc

SEQ ID NO: 3798147 - RNA, 13 nt, Human
auucuucuguccu

SEQ ID NO: 3798148 - RNA, 15 nt, Human
auucuucuguccuga

SEQ ID NO: 3798149 - RNA, 14 nt, Human
auucuucuguguuu

SEQ ID NO: 3798150 - RNA, 20 nt, Human
auucuugaaagaauuuuccu

SEQ ID NO: 3798151 - RNA, 15 nt, Human
auucuugaaggaaaa

SEQ ID NO: 3798152 - RNA, 14 nt, Human
auucuugaagucag

SEQ ID NO: 3798153 - RNA, 19 nt, Human
auucuugaucaguaguuug

SEQ ID NO: 3798154 - RNA, 19 nt, Human
auucuugauguaaaaucuu

SEQ ID NO: 3798155 - RNA, 22 nt, Human
auucuugauuuauuugcuucuu

SEQ ID NO: 3798156 - RNA, 12 nt, Human
auucuugcauau

SEQ ID NO: 3798157 - RNA, 17 nt, Human
auucuugguauuuggau

SEQ ID NO: 3798158 - RNA, 18 nt, Human
auucuugguugaggaaac

SEQ ID NO: 3798159 - RNA, 14 nt, Human
auucuugucaaaaa

SEQ ID NO: 3798160 - RNA, 17 nt, Human
auucuugucacaauaaa

SEQ ID NO: 3798161 - RNA, 12 nt, Human
auucuugugcuu

SEQ ID NO: 3798162 - RNA, 18 nt, Human
auucuugugcuuuuccug

SEQ ID NO: 3798163 - RNA, 20 nt, Human
auucuuguugcuguacaaaa

SEQ ID NO: 3798164 - RNA, 18 nt, Human
auucuuguuuucuuucuu

SEQ ID NO: 3798165 - RNA, 16 nt, Human
auucuuguuuugcuuc

SEQ ID NO: 3798166 - RNA, 15 nt, Human
auucuuuaaugauuc

SEQ ID NO: 3798167 - RNA, 19 nt, Human
auucuuuaaugauuccuau

SEQ ID NO: 3798168 - RNA, 21 nt, Human
auucuuuauacaacagugcua

SEQ ID NO: 3798169 - RNA, 19 nt, Human
auucuuucaagugaaucua

SEQ ID NO: 3798170 - RNA, 20 nt, Human
auucuuucaauacagauaua

SEQ ID NO: 3798171 - RNA, 18 nt, Human
auucuuucagcuaucagu

SEQ ID NO: 3798172 - RNA, 15 nt, Human
auucuuucaguucuu

SEQ ID NO: 3798173 - RNA, 16 nt, Human
auucuuuccauuauga

SEQ ID NO: 3798174 - RNA, 16 nt, Human
auucuuuccauuugca

SEQ ID NO: 3798175 - RNA, 19 nt, Human
auucuuuccauuugcauuu

SEQ ID NO: 3798176 - RNA, 22 nt, Human
auucuuuccauuugcauuuguu

SEQ ID NO: 3798177 - RNA, 20 nt, Human
auucuuucccagugagucuc

SEQ ID NO: 3798178 - RNA, 17 nt, Human
auucuuugauguuaaca

SEQ ID NO: 3798179 - RNA, 19 nt, Human
auucuuugauguuaacaca

SEQ ID NO: 3798180 - RNA, 20 nt, Human
auucuuugauguuaacacau

SEQ ID NO: 3798181 - RNA, 19 nt, Human
auucuuuuccaaaauaaaa

SEQ ID NO: 3798182 - RNA, 13 nt, Human
auucuuuucucag

SEQ ID NO: 3798183 - RNA, 19 nt, Human
auucuuuucucaguguugg

SEQ ID NO: 3798184 - RNA, 20 nt, Human
auucuuuucugcaaaauaga

SEQ ID NO: 3798185 - RNA, 12 nt, Human
auucuuuugcca

SEQ ID NO: 3798186 - RNA, 14 nt, Human
auucuuuugccaag

SEQ ID NO: 3798187 - RNA, 13 nt, Human
auucuuuuucuga

SEQ ID NO: 3798188 - RNA, 15 nt, Human
auucuuuuucugauu

SEQ ID NO: 3798189 - RNA, 22 nt, Human
auucuuuuucuuuuuuaaauua

SEQ ID NO: 3798190 - RNA, 16 nt, Human
auucuuuuugaaaugu

SEQ ID NO: 3798191 - RNA, 20 nt, Human
auucuuuuugcucuaaaaua

SEQ ID NO: 3798192 - RNA, 17 nt, Human
auucuuuuuuaaauuuu

SEQ ID NO: 3798193 - RNA, 15 nt, Human
auucuuuuuuauuaa

SEQ ID NO: 3798194 - RNA, 19 nt, Human
auucuuuuuuauuaaucac

SEQ ID NO: 3798195 - RNA, 20 nt, Human
auucuuuuuuauuaaucacu

SEQ ID NO: 3798196 - RNA, 21 nt, Human
auucuuuuuuauuaaucacug

SEQ ID NO: 3798197 - RNA, 15 nt, Human
auugaaaaaaauaau

SEQ ID NO: 3798198 - RNA, 14 nt, Human
auugaaaaaauaga

SEQ ID NO: 3798199 - RNA, 22 nt, Human
auugaaaaaauagagccugagg

SEQ ID NO: 3798200 - RNA, 18 nt, Human
auugaaaacuuuucucag

SEQ ID NO: 3798201 - RNA, 13 nt, Human
auugaaaaggaca

SEQ ID NO: 3798202 - RNA, 12 nt, Human
auugaaaaguac

SEQ ID NO: 3798203 - RNA, 14 nt, Human
auugaaaaugaaug

SEQ ID NO: 3798204 - RNA, 20 nt, Human
auugaaaauuauuaaucaga

SEQ ID NO: 3798205 - RNA, 22 nt, Human
auugaaaauuauuaaucagaag

SEQ ID NO: 3798206 - RNA, 18 nt, Human
auugaaaggcauucucug

SEQ ID NO: 3798207 - RNA, 20 nt, Human
auugaaauauaaugcaaacc

SEQ ID NO: 3798208 - RNA, 14 nt, Human
auugaaauguaagg

SEQ ID NO: 3798209 - RNA, 12 nt, Human
auugaaauguca

SEQ ID NO: 3798210 - RNA, 12 nt, Human
auugaaauuaua

SEQ ID NO: 3798211 - RNA, 12 nt, Human
auugaaauucua

SEQ ID NO: 3798212 - RNA, 13 nt, Human
auugaaauucuga

SEQ ID NO: 3798213 - RNA, 17 nt, Human
auugaaauuguacauau

SEQ ID NO: 3798214 - RNA, 19 nt, Human
auugaaauugugaacucau

SEQ ID NO: 3798215 - RNA, 22 nt, Human
auugaacaaguuguuucauuga

SEQ ID NO: 3798216 - RNA, 14 nt, Human
auugaacacaaacu

SEQ ID NO: 3798217 - RNA, 16 nt, Human
auugaacacaaacugu

SEQ ID NO: 3798218 - RNA, 18 nt, Human
auugaaccuuugugcccu

SEQ ID NO: 3798219 - RNA, 23 nt, Human
auugaacucuuugaaugacaaag

SEQ ID NO: 3798220 - RNA, 14 nt, Human
auugaagaaacaga

SEQ ID NO: 3798221 - RNA, 15 nt, Human
auugaagaaacagau

SEQ ID NO: 3798222 - RNA, 13 nt, Human
auugaagacaauu

SEQ ID NO: 3798223 - RNA, 18 nt, Human
auugaagagagagcugag

SEQ ID NO: 3798224 - RNA, 21 nt, Human
auugaagagagauauaucuga

SEQ ID NO: 3798225 - RNA, 23 nt, Human
auugaagagagauauaucugaaa

SEQ ID NO: 3798226 - RNA, 18 nt, Human
auugaagcagaguggcag

SEQ ID NO: 3798227 - RNA, 15 nt, Human
auugaagcccuccaa

SEQ ID NO: 3798228 - RNA, 18 nt, Human
auugcaacaggcugggcu

SEQ ID NO: 3798229 - RNA, 21 nt, Human
auugcaacaggcugggcuuca

SEQ ID NO: 3798230 - RNA, 12 nt, Human
auugcaauagaa

SEQ ID NO: 3798231 - RNA, 16 nt, Human
auugcaauaucugaag

SEQ ID NO: 3798232 - RNA, 16 nt, Human
auugcaaugaaggaaa

SEQ ID NO: 3798233 - RNA, 22 nt, Human
auugcacaauauugaacuuuuu

SEQ ID NO: 3798234 - RNA, 17 nt, Human
auugcaccuggauguac

SEQ ID NO: 3798235 - RNA, 16 nt, Human
auugcacguggccucu

SEQ ID NO: 3798236 - RNA, 23 nt, Human
auugcacguggccucuugagcag

SEQ ID NO: 3798237 - RNA, 15 nt, Human
auugcacuccagccu

SEQ ID NO: 3798238 - RNA, 17 nt, Human
auugcacuccagccugg

SEQ ID NO: 3798239 - RNA, 18 nt, Human
auugcacuccagccuggg

SEQ ID NO: 3798240 - RNA, 19 nt, Human
auugcacuccagccugggc

SEQ ID NO: 3798241 - RNA, 18 nt, Human
auugcagaaaauucugug

SEQ ID NO: 3798242 - RNA, 19 nt, Human
auugcagaauuguuuagau

SEQ ID NO: 3798243 - RNA, 20 nt, Human
auugcagauaacuuugacuu

SEQ ID NO: 3798244 - RNA, 23 nt, Human
auugcaguuuaucauucaagugu

SEQ ID NO: 3798245 - RNA, 14 nt, Human
auugcauaaagcau

SEQ ID NO: 3798246 - RNA, 20 nt, Human
auugcauacuauuaaacaug

SEQ ID NO: 3798247 - RNA, 15 nt, Human
auugcauacuuugua

SEQ ID NO: 3798248 - RNA, 18 nt, Human
auugcauauaacuuauau

SEQ ID NO: 3798249 - RNA, 22 nt, Human
auugcauauaacuuauauugua

SEQ ID NO: 3798250 - RNA, 16 nt, Human
auugcauauauacaua

SEQ ID NO: 3798251 - RNA, 18 nt, Human
auugcaucaccucuguaa

SEQ ID NO: 3798252 - RNA, 15 nt, Human
auugcaucuguauaa

SEQ ID NO: 3798253 - RNA, 19 nt, Human
auugcaucuguauaaguaa

SEQ ID NO: 3798254 - RNA, 19 nt, Human
auugcaugccgggugcagc

SEQ ID NO: 3798255 - RNA, 23 nt, Human
auugcaugccgggugcagcaucu

SEQ ID NO: 3798256 - RNA, 20 nt, Human
auugcaugcugcuuuaauug

SEQ ID NO: 3798257 - RNA, 17 nt, Human
auugcauggguuuugua

SEQ ID NO: 3798258 - RNA, 15 nt, Human
auugcaugugacucu

SEQ ID NO: 3798259 - RNA, 17 nt, Human
auugcaugugacucuga

SEQ ID NO: 3798260 - RNA, 18 nt, Human
auugcaugugacucugaa

SEQ ID NO: 3798261 - RNA, 14 nt, Human
cagaggccccagcc

SEQ ID NO: 3798262 - RNA, 19 nt, Human
cagaggcccccagcccagg

SEQ ID NO: 3798263 - RNA, 24 nt, Human
cagaggcccccagcccagggcucc

SEQ ID NO: 3798264 - RNA, 15 nt, Human
cagaggcgucccgca

SEQ ID NO: 3798265 - RNA, 13 nt, Human
cagaggcugccuc

SEQ ID NO: 3798266 - RNA, 14 nt, Human
cagaggcuggaggc

SEQ ID NO: 3798267 - RNA, 16 nt, Human
cagaggcuggaggcag

SEQ ID NO: 3798268 - RNA, 19 nt, Human
cagaggcuggaggcagggc

SEQ ID NO: 3798269 - RNA, 20 nt, Human
cagaggcuggaggcagggcc

SEQ ID NO: 3798270 - RNA, 14 nt, Human
cagaggcuggccuc

SEQ ID NO: 3798271 - RNA, 15 nt, Human
cagaggcuucuucag

SEQ ID NO: 3798272 - RNA, 21 nt, Human
cagagggagugacagaggcag

SEQ ID NO: 3798273 - RNA, 17 nt, Human
cagagggcagaggcugg

SEQ ID NO: 3798274 - RNA, 10 nt, Human
cagagggcug

SEQ ID NO: 3798275 - RNA, 15 nt, Human
cagagggcuggaggc

SEQ ID NO: 3798276 - RNA, 19 nt, Human
cagagggcuugugaacaga

SEQ ID NO: 3798277 - RNA, 17 nt, Human
cagaggggacucugggc

SEQ ID NO: 3798278 - RNA, 16 nt, Human
cagaggggcaggcccu

SEQ ID NO: 3798279 - RNA, 18 nt, Human
cagaggggcaggcccugc

SEQ ID NO: 3798280 - RNA, 19 nt, Human
cagaggggcaggcccugca

SEQ ID NO: 3798281 - RNA, 17 nt, Human
cagaggggccugccacc

SEQ ID NO: 3798282 - RNA, 22 nt, Human
cagaggggccugccaccuggac

SEQ ID NO: 3798283 - RNA, 23 nt, Human
cagaggggccugccaccuggacc

SEQ ID NO: 3798284 - RNA, 17 nt, Human
cagaggggguggccucc

SEQ ID NO: 3798285 - RNA, 20 nt, Human
cagaggggguggccucccaa

SEQ ID NO: 3798286 - RNA, 19 nt, Human
cagagggguaagagaggau

SEQ ID NO: 3798287 - RNA, 13 nt, Human
cagagggucacag

SEQ ID NO: 3798288 - RNA, 15 nt, Human
cagagggucacagug

SEQ ID NO: 3798289 - RNA, 16 nt, Human
cagagggucugggggc

SEQ ID NO: 3798290 - RNA, 17 nt, Human
cagagggucugggggca

SEQ ID NO: 3798291 - RNA, 16 nt, Human
cagaggguuaggagug

SEQ ID NO: 3798292 - RNA, 21 nt, Human
cagagguaaaagugugagcag

SEQ ID NO: 3798293 - RNA, 14 nt, Human
cagagguaacagaa

SEQ ID NO: 3798294 - RNA, 15 nt, Human
cagagguaacagaac

SEQ ID NO: 3798295 - RNA, 16 nt, Human
cagagguaacagaaca

SEQ ID NO: 3798296 - RNA, 19 nt, Human
cagagguaacagaacagcu

SEQ ID NO: 3798297 - RNA, 15 nt, Human
cagagguacccuggg

SEQ ID NO: 3798298 - RNA, 23 nt, Human
cagagguauuaaaacuaaauuuc

SEQ ID NO: 3798299 - RNA, 19 nt, Human
cagaggucagacuaagaaa

SEQ ID NO: 3798300 - RNA, 15 nt, Human
cagagguccacaaca

SEQ ID NO: 3798301 - RNA, 20 nt, Human
cagagguccacaacacacag

SEQ ID NO: 3798302 - RNA, 15 nt, Human
cagagguccagccca

SEQ ID NO: 3798303 - RNA, 16 nt, Human
cagagguccagcccau

SEQ ID NO: 3798304 - RNA, 15 nt, Human
cagaggucucugccg

SEQ ID NO: 3798305 - RNA, 15 nt, Human
cagaggucugugcug

SEQ ID NO: 3798306 - RNA, 16 nt, Human
cagaggucugugcuga

SEQ ID NO: 3798307 - RNA, 13 nt, Human
cagaggugggcag

SEQ ID NO: 3798308 - RNA, 16 nt, Human
cagaggugggcaggug

SEQ ID NO: 3798309 - RNA, 22 nt, Human
cagaggugggcaggugguggca

SEQ ID NO: 3798310 - RNA, 23 nt, Human
cagaggugggcaggugguggcac

SEQ ID NO: 3798311 - RNA, 18 nt, Human
cagagguugugcacuguu

SEQ ID NO: 3798312 - RNA, 13 nt, Human
cagaguaagacau

SEQ ID NO: 3798313 - RNA, 17 nt, Human
cagaguaagcugcuuuu

SEQ ID NO: 3798314 - RNA, 21 nt, Human
cagaguaauccaagcaaaugu

SEQ ID NO: 3798315 - RNA, 13 nt, Human
cagaguagaaaua

SEQ ID NO: 3798316 - RNA, 20 nt, Human
cagaguaggggucugucuuu

SEQ ID NO: 3798317 - RNA, 19 nt, Human
cagagucacaagccucgag

SEQ ID NO: 3798318 - RNA, 22 nt, Human
cagagucacaagccucgaggug

SEQ ID NO: 3798319 - RNA, 13 nt, Human
cagagucccccca

SEQ ID NO: 3798320 - RNA, 14 nt, Human
cagaguccccccac

SEQ ID NO: 3798321 - RNA, 14 nt, Human
cagaguccuuucca

SEQ ID NO: 3798322 - RNA, 19 nt, Human
cagagucucacuguugccc

SEQ ID NO: 3798323 - RNA, 15 nt, Human
cagagugagacccug

SEQ ID NO: 3798324 - RNA, 17 nt, Human
cagagugagacucuguc

SEQ ID NO: 3798325 - RNA, 18 nt, Human
cagagugagacucugucu

SEQ ID NO: 3798326 - RNA, 19 nt, Human
cagagugagacucugucuc

SEQ ID NO: 3798327 - RNA, 20 nt, Human
cagagugagacucugucuca

SEQ ID NO: 3798328 - RNA, 14 nt, Human
cagagugcccagaa

SEQ ID NO: 3798329 - RNA, 20 nt, Human
cagagugccccaccugccac

SEQ ID NO: 3798330 - RNA, 15 nt, Human
cagagugcuuuucug

SEQ ID NO: 3798331 - RNA, 12 nt, Human
cagaguggcagu

SEQ ID NO: 3798332 - RNA, 18 nt, Human
cagaguggccuggccagg

SEQ ID NO: 3798333 - RNA, 21 nt, Human
cagaguggucuuucuggagag

SEQ ID NO: 3798334 - RNA, 22 nt, Human
cagaguggucuuucuggagagg

SEQ ID NO: 3798335 - RNA, 15 nt, Human
cagagugguggggga

SEQ ID NO: 3798336 - RNA, 17 nt, Human
cagaguguagccagguc

SEQ ID NO: 3798337 - RNA, 16 nt, Human
cagagugugcuggagg

SEQ ID NO: 3798338 - RNA, 19 nt, Human
cagagugugggaagggaga

SEQ ID NO: 3798339 - RNA, 17 nt, Human
cagaguuaaaucucaaa

SEQ ID NO: 3798340 - RNA, 16 nt, Human
cagaguuacaguucug

SEQ ID NO: 3798341 - RNA, 12 nt, Human
cagaguucacua

SEQ ID NO: 3798342 - RNA, 17 nt, Human
cagaguuccugcggagu

SEQ ID NO: 3798343 - RNA, 14 nt, Human
cagaguugaagaca

SEQ ID NO: 3798344 - RNA, 19 nt, Human
cagaguugcugggagcuga

SEQ ID NO: 3798345 - RNA, 20 nt, Human
cagaguugcugggagcugaa

SEQ ID NO: 3798346 - RNA, 12 nt, Human
cagaguuguaaa

SEQ ID NO: 3798347 - RNA, 13 nt, Human
cagaguuguaaau

SEQ ID NO: 3798348 - RNA, 14 nt, Human
cagaguuguaaaua

SEQ ID NO: 3798349 - RNA, 16 nt, Human
cagaguuguaaauaua

SEQ ID NO: 3798350 - RNA, 18 nt, Human
cagaguuguuacauuuuu

SEQ ID NO: 3798351 - RNA, 23 nt, Human
cagaguuuagaggaaaaaaauga

SEQ ID NO: 3798352 - RNA, 20 nt, Human
cagaguuugccuuccuuucu

SEQ ID NO: 3798353 - RNA, 13 nt, Human
cagaguuuggaua

SEQ ID NO: 3798354 - RNA, 14 nt, Human
cagaguuuucauua

SEQ ID NO: 3798355 - RNA, 14 nt, Human
cagauaaacaguag

SEQ ID NO: 3798356 - RNA, 17 nt, Human
cagauaaagauugugug

SEQ ID NO: 3798357 - RNA, 22 nt, Human
cagauaacaaugcagcaaggcc

SEQ ID NO: 3798358 - RNA, 22 nt, Human
cagauaacugaaaauuauuuaa

SEQ ID NO: 3798359 - RNA, 20 nt, Human
cagauaacugaggaggggag

SEQ ID NO: 3798360 - RNA, 14 nt, Human
cagauaacuguuau

SEQ ID NO: 3798361 - RNA, 20 nt, Human
cagauaacuguuauuuauaa

SEQ ID NO: 3798362 - RNA, 15 nt, Human
cagauaacuuagcuu

SEQ ID NO: 3798363 - RNA, 22 nt, Human
cagauaagcaagagagauguuu

SEQ ID NO: 3798364 - RNA, 14 nt, Human
cagauaaucacaau

SEQ ID NO: 3798365 - RNA, 16 nt, Human
cagauaaucagccucu

SEQ ID NO: 3798366 - RNA, 13 nt, Human
cagauaaugugaa

SEQ ID NO: 3798367 - RNA, 14 nt, Human
cagauacacacaca

SEQ ID NO: 3798368 - RNA, 23 nt, Human
cagauacaggaaaagcugcugac

SEQ ID NO: 3798369 - RNA, 12 nt, Human
cagauacaucac

SEQ ID NO: 3798370 - RNA, 17 nt, Human
cagauacaugguuguga

SEQ ID NO: 3798371 - RNA, 15 nt, Human
cagauacauuucccu

SEQ ID NO: 3798372 - RNA, 15 nt, Human
cagauaccaagcaug

SEQ ID NO: 3798373 - RNA, 21 nt, Human
aaacauucuaucuacugauuu

SEQ ID NO: 3798374 - RNA, 12 nt, Human
aaacauugaaga

SEQ ID NO: 3798375 - RNA, 13 nt, Human
aaacauugcuuuu

SEQ ID NO: 3798376 - RNA, 16 nt, Human
aaacauugcuuuuaaa

SEQ ID NO: 3798377 - RNA, 13 nt, Human
aaacauuggaagc

SEQ ID NO: 3798378 - RNA, 15 nt, Human
aaacauuggauuauc

SEQ ID NO: 3798379 - RNA, 19 nt, Human
aaacauuguguugacauua

SEQ ID NO: 3798380 - RNA, 23 nt, Human
aaacauuuaacuuguuuccaaug

SEQ ID NO: 3798381 - RNA, 20 nt, Human
aaacauuuauuuugacauaa

SEQ ID NO: 3798382 - RNA, 18 nt, Human
aaacauuucauaauuugu

SEQ ID NO: 3798383 - RNA, 20 nt, Human
aaacauuucauuaugagguc

SEQ ID NO: 3798384 - RNA, 12 nt, Human
aaacauuugcug

SEQ ID NO: 3798385 - RNA, 14 nt, Human
aaacauuuuaaaaa

SEQ ID NO: 3798386 - RNA, 19 nt, Human
aaacauuuucagaaauauu

SEQ ID NO: 3798387 - RNA, 19 nt, Human
aaacauuuugucauauaag

SEQ ID NO: 3798388 - RNA, 19 nt, Human
aaaccaaaaguuauuaaaa

SEQ ID NO: 3798389 - RNA, 22 nt, Human
aaaccaaaaugacaucuuuuua

SEQ ID NO: 3798390 - RNA, 13 nt, Human
aaaccaaaggaca

SEQ ID NO: 3798391 - RNA, 13 nt, Human
aaaccaacaccau

SEQ ID NO: 3798392 - RNA, 12 nt, Human
aaaccaagaaga

SEQ ID NO: 3798393 - RNA, 18 nt, Human
aaaccaagagauugcuaa

SEQ ID NO: 3798394 - RNA, 16 nt, Human
aaaccaaucaagauaa

SEQ ID NO: 3798395 - RNA, 19 nt, Human
aaaccaauuuuuuguucuu

SEQ ID NO: 3798396 - RNA, 12 nt, Human
aaaccacaaagg

SEQ ID NO: 3798397 - RNA, 22 nt, Human
aaaccacaaaggccaaacugcu

SEQ ID NO: 3798398 - RNA, 21 nt, Human
aaaccacaacugacacaggaa

SEQ ID NO: 3798399 - RNA, 14 nt, Human
aaaccacaacuuuu

SEQ ID NO: 3798400 - RNA, 16 nt, Human
aaaccacagcaguuga

SEQ ID NO: 3798401 - RNA, 18 nt, Human
aaaccacagcccugucag

SEQ ID NO: 3798402 - RNA, 14 nt, Human
aaaccacagcugcu

SEQ ID NO: 3798403 - RNA, 14 nt, Human
aaaccaccagaagc

SEQ ID NO: 3798404 - RNA, 15 nt, Human
aaaccaccagaagcc

SEQ ID NO: 3798405 - RNA, 16 nt, Human
aaaccacugaaaaaau

SEQ ID NO: 3798406 - RNA, 12 nt, Human
aaaccagaagca

SEQ ID NO: 3798407 - RNA, 16 nt, Human
aaaccaggacccuguc

SEQ ID NO: 3798408 - RNA, 17 nt, Human
aaaccaggcuuucuaga

SEQ ID NO: 3798409 - RNA, 19 nt, Human
aaaccaggguuuaucuuuu

SEQ ID NO: 3798410 - RNA, 22 nt, Human
aaaccagguccaaugagcuuuc

SEQ ID NO: 3798411 - RNA, 24 nt, Human
aaaccagguccaaugagcuuucug

SEQ ID NO: 3798412 - RNA, 19 nt, Human
aaaccaguauacaagauaa

SEQ ID NO: 3798413 - RNA, 14 nt, Human
aaaccaguauugua

SEQ ID NO: 3798414 - RNA, 19 nt, Human
aaaccaguguagccuugcc

SEQ ID NO: 3798415 - RNA, 19 nt, Human
aaaccaguguuagggaagg

SEQ ID NO: 3798416 - RNA, 20 nt, Human
aaaccaguuuagauuucaag

SEQ ID NO: 3798417 - RNA, 15 nt, Human
aaaccauaaacuuca

SEQ ID NO: 3798418 - RNA, 18 nt, Human
aaaccaucauugaaaucu

SEQ ID NO: 3798419 - RNA, 13 nt, Human
aaaccaucucccu

SEQ ID NO: 3798420 - RNA, 15 nt, Human
aaaccaucucccugg

SEQ ID NO: 3798421 - RNA, 22 nt, Human
aaaccaugcucuggcauguuga

SEQ ID NO: 3798422 - RNA, 17 nt, Human
aaaccauuuuuaaagua

SEQ ID NO: 3798423 - RNA, 23 nt, Human
cagccuggugggccuccucuguc

SEQ ID NO: 3798424 - RNA, 19 nt, Human
cagccugguuuagccugga

SEQ ID NO: 3798425 - RNA, 16 nt, Human
cagccugugcugcccg

SEQ ID NO: 3798426 - RNA, 21 nt, Human
cagccuguggcaucuuugccu

SEQ ID NO: 3798427 - RNA, 21 nt, Human
cagccuguggcggugccuggg

SEQ ID NO: 3798428 - RNA, 22 nt, Human
cagccuguggcggugccugggu

SEQ ID NO: 3798429 - RNA, 14 nt, Human
cagccuucccccuc

SEQ ID NO: 3798430 - RNA, 16 nt, Human
cagccuuccccuugcc

SEQ ID NO: 3798431 - RNA, 23 nt, Human
cagccuuccccuugcccagggcu

SEQ ID NO: 3798432 - RNA, 18 nt, Human
cagccuuccucugcagcu

SEQ ID NO: 3798433 - RNA, 22 nt, Human
cagccuuccucugcagcugacc

SEQ ID NO: 3798434 - RNA, 16 nt, Human
cagccuucuacugcuc

SEQ ID NO: 3798435 - RNA, 23 nt, Human
cagccuucuuccaucccaggaca

SEQ ID NO: 3798436 - RNA, 17 nt, Human
cagccuucuuugcuugc

SEQ ID NO: 3798437 - RNA, 18 nt, Human
cagccuucuuuuucugga

SEQ ID NO: 3798438 - RNA, 14 nt, Human
cagccuugaacucu

SEQ ID NO: 3798439 - RNA, 24 nt, Human
cagccuugaccauucuccaccugc

SEQ ID NO: 3798440 - RNA, 16 nt, Human
cagccuugagcccugg

SEQ ID NO: 3798441 - RNA, 18 nt, Human
cagccuugagcccuggcu

SEQ ID NO: 3798442 - RNA, 17 nt, Human
cagccuuucucccaggc

SEQ ID NO: 3798443 - RNA, 19 nt, Human
cagccuuucucccaggcca

SEQ ID NO: 3798444 - RNA, 18 nt, Human
cagccuuuguuccccacu

SEQ ID NO: 3798445 - RNA, 22 nt, Human
cagccuuuguuccccacuggag

SEQ ID NO: 3798446 - RNA, 19 nt, Human
cagcgaaguagcuugcucc

SEQ ID NO: 3798447 - RNA, 14 nt, Human
cagcgaccaccccu

SEQ ID NO: 3798448 - RNA, 17 nt, Human
cagcgacuccguuggcc

SEQ ID NO: 3798449 - RNA, 19 nt, Human
cagcgagcccugguggcag

SEQ ID NO: 3798450 - RNA, 20 nt, Human
cagcgagcgcccagcuccug

SEQ ID NO: 3798451 - RNA, 12 nt, Human
cagcgagggccc

SEQ ID NO: 3798452 - RNA, 18 nt, Human
cagcgauguaugcagcua

SEQ ID NO: 3798453 - RNA, 16 nt, Human
cagcgccaagcaaccu

SEQ ID NO: 3798454 - RNA, 22 nt, Human
cagcgccaagcaaccugggucc

SEQ ID NO: 3798455 - RNA, 24 nt, Human
cagcgccaagugcgugccguguga

SEQ ID NO: 3798456 - RNA, 14 nt, Human
cagcgccagccuca

SEQ ID NO: 3798457 - RNA, 18 nt, Human
cagcgccaggcugaccac

SEQ ID NO: 3798458 - RNA, 18 nt, Human
cagcgcccaaaggacgca

SEQ ID NO: 3798459 - RNA, 21 nt, Human
cagcgcccaaaggacgcacug

SEQ ID NO: 3798460 - RNA, 19 nt, Human
cagcgcccgcugggcugag

SEQ ID NO: 3798461 - RNA, 12 nt, Human
cagcgcccuucc

SEQ ID NO: 3798462 - RNA, 13 nt, Human
cagcgcccuuccu

SEQ ID NO: 3798463 - RNA, 15 nt, Human
cagcgcccuuccucu

SEQ ID NO: 3798464 - RNA, 22 nt, Human
cagcgccuaguggggucucccu

SEQ ID NO: 3798465 - RNA, 18 nt, Human
cagcgccucccuccaccc

SEQ ID NO: 3798466 - RNA, 20 nt, Human
cagcgccucccuccacccca

SEQ ID NO: 3798467 - RNA, 21 nt, Human
cagcgccucccuccaccccag

SEQ ID NO: 3798468 - RNA, 23 nt, Human
cagcgccucccuccaccccagga

SEQ ID NO: 3798469 - RNA, 19 nt, Human
cagcgccuggccuacccag

SEQ ID NO: 3798470 - RNA, 12 nt, Human
cagcgccuuucc

SEQ ID NO: 3798471 - RNA, 23 nt, Human
cagcgcggacauccccugcuggc

SEQ ID NO: 3798472 - RNA, 20 nt, Human
cagcgcucugccucaccgcu

SEQ ID NO: 3798473 - RNA, 16 nt, Human
cagcgcuuugggaggc

SEQ ID NO: 3798474 - RNA, 22 nt, Human
cagcgcuuugggaggccgaggc

SEQ ID NO: 3798475 - RNA, 21 nt, Human
cagcggagucuguccugugac

SEQ ID NO: 3798476 - RNA, 16 nt, Human
cagcgggaauggcagc

SEQ ID NO: 3798477 - RNA, 23 nt, Human
cagcgggaauggcagcugccacg

SEQ ID NO: 3798478 - RNA, 19 nt, Human
cagcgggagccucccugcc

SEQ ID NO: 3798479 - RNA, 15 nt, Human
cagcggggacagcuc

SEQ ID NO: 3798480 - RNA, 19 nt, Human
cagcggggcgaagcccagg

SEQ ID NO: 3798481 - RNA, 15 nt, Human
cagcgguggccucuu

SEQ ID NO: 3798482 - RNA, 19 nt, Human
cagcggugggaccuaggga

SEQ ID NO: 3798483 - RNA, 22 nt, Human
cagcggugggaccuagggaggc

SEQ ID NO: 3798484 - RNA, 15 nt, Human
cagcguccuccucug

SEQ ID NO: 3798485 - RNA, 14 nt, Human
cagcguccugucca

SEQ ID NO: 3798486 - RNA, 21 nt, Human
cagcgugcccgcuuccgcugu

SEQ ID NO: 3798487 - RNA, 14 nt, Human
cagcguggccuugu

SEQ ID NO: 3798488 - RNA, 15 nt, Human
cagcguggccuuguu

SEQ ID NO: 3798489 - RNA, 16 nt, Human
cagcguggcucuaaaa

SEQ ID NO: 3798490 - RNA, 21 nt, Human
cagcguuccuagagaagacag

SEQ ID NO: 3798491 - RNA, 16 nt, Human
cagcguuucuaugaca

SEQ ID NO: 3798492 - RNA, 22 nt, Human
cagcguuugaggggcuggccuu

SEQ ID NO: 3798493 - RNA, 19 nt, Human
cagcguuuugcaagguaaa

SEQ ID NO: 3798494 - RNA, 22 nt, Human
cagcuaaaccaaggacugagca

SEQ ID NO: 3798495 - RNA, 16 nt, Human
cagcuaacacacagcu

SEQ ID NO: 3798496 - RNA, 17 nt, Human
cagcuaacacacagcuc

SEQ ID NO: 3798497 - RNA, 18 nt, Human
cagcuaacacacagcucc

SEQ ID NO: 3798498 - RNA, 15 nt, Human
cagcuaacauggaag

SEQ ID NO: 3798499 - RNA, 19 nt, Human
cagcuaacauggaaguacu

SEQ ID NO: 3798500 - RNA, 23 nt, Human
cagcuaagaaaagauuuuaauca

SEQ ID NO: 3798501 - RNA, 18 nt, Human
cagcuaagaaccuggaac

SEQ ID NO: 3798502 - RNA, 23 nt, Human
cagcuaagaaccuggaacuuggg

SEQ ID NO: 3798503 - RNA, 18 nt, Human
cagcuaagggaagacauu

SEQ ID NO: 3798504 - RNA, 14 nt, Human
cagcuaauucuacu

SEQ ID NO: 3798505 - RNA, 22 nt, Human
cagcuaauucuacucacagugc

SEQ ID NO: 3798506 - RNA, 17 nt, Human
cagcuacaacagccuca

SEQ ID NO: 3798507 - RNA, 18 nt, Human
cagcuacaccuuucuccu

SEQ ID NO: 3798508 - RNA, 15 nt, Human
cagcuacucagaagc

SEQ ID NO: 3798509 - RNA, 16 nt, Human
cagcuacucaggaggc

SEQ ID NO: 3798510 - RNA, 17 nt, Human
cagcuacucgggaggcu

SEQ ID NO: 3798511 - RNA, 15 nt, Human
cagcuacucucccca

SEQ ID NO: 3798512 - RNA, 16 nt, Human
cagcuacugauuuuug

SEQ ID NO: 3798513 - RNA, 17 nt, Human
cagcuacuuccuccucc

SEQ ID NO: 3798514 - RNA, 21 nt, Human
cagcuacuuccuccuccccac

SEQ ID NO: 3798515 - RNA, 16 nt, Human
cagcuacuugggaagc

SEQ ID NO: 3798516 - RNA, 19 nt, Human
auuuaaucuuuucuuauuu

SEQ ID NO: 3798517 - RNA, 17 nt, Human
auuuaaugcauuaaacc

SEQ ID NO: 3798518 - RNA, 12 nt, Human
auuuaaugcugc

SEQ ID NO: 3798519 - RNA, 14 nt, Human
auuuaaugcugugg

SEQ ID NO: 3798520 - RNA, 12 nt, Human
auuuaauguuga

SEQ ID NO: 3798521 - RNA, 17 nt, Human
auuuaauguuuuaaaug

SEQ ID NO: 3798522 - RNA, 19 nt, Human
auuuaauguuuuaaaugua

SEQ ID NO: 3798523 - RNA, 21 nt, Human
auuuaauguuuuaaauguaca

SEQ ID NO: 3798524 - RNA, 13 nt, Human
auuuaauuaaaaa

SEQ ID NO: 3798525 - RNA, 20 nt, Human
auuuaauuauuaacuacauu

SEQ ID NO: 3798526 - RNA, 12 nt, Human
auuuaauucaga

SEQ ID NO: 3798527 - RNA, 15 nt, Human
auuuaauucucuuga

SEQ ID NO: 3798528 - RNA, 18 nt, Human
auuuaauuuaggacacau

SEQ ID NO: 3798529 - RNA, 22 nt, Human
auuuaauuugaagguagaaugu

SEQ ID NO: 3798530 - RNA, 22 nt, Human
auuuaauuugauaucacagucu

SEQ ID NO: 3798531 - RNA, 21 nt, Human
auuuaauuugccaaaauaaug

SEQ ID NO: 3798532 - RNA, 18 nt, Human
auuuaauuuugacacuau

SEQ ID NO: 3798533 - RNA, 23 nt, Human
auuuaauuuuuuugagacagagu

SEQ ID NO: 3798534 - RNA, 18 nt, Human
auuuacaaaguguguauu

SEQ ID NO: 3798535 - RNA, 22 nt, Human
auuuacaacugggggaggguga

SEQ ID NO: 3798536 - RNA, 18 nt, Human
auuuacaagggaagauuu

SEQ ID NO: 3798537 - RNA, 15 nt, Human
auuuacaauguauua

SEQ ID NO: 3798538 - RNA, 14 nt, Human
auuuacacugggag

SEQ ID NO: 3798539 - RNA, 12 nt, Human
auuuacacuuuu

SEQ ID NO: 3798540 - RNA, 14 nt, Human
auuuacagaacaaa

SEQ ID NO: 3798541 - RNA, 16 nt, Human
auuuacagagaaguga

SEQ ID NO: 3798542 - RNA, 21 nt, Human
auuuacagugaaaauguaagc

SEQ ID NO: 3798543 - RNA, 13 nt, Human
auuuacaguuuca

SEQ ID NO: 3798544 - RNA, 15 nt, Human
auuuacauaugaaau

SEQ ID NO: 3798545 - RNA, 16 nt, Human
auuuacaucauuucuu

SEQ ID NO: 3798546 - RNA, 22 nt, Human
auuuacauguauuauuucauua

SEQ ID NO: 3798547 - RNA, 15 nt, Human
auuuacauuuaauag

SEQ ID NO: 3798548 - RNA, 19 nt, Human
auuuacccuucuuuucuga

SEQ ID NO: 3798549 - RNA, 15 nt, Human
auuuaccuaagauua

SEQ ID NO: 3798550 - RNA, 17 nt, Human
auuuaccuaagauuaca

SEQ ID NO: 3798551 - RNA, 13 nt, Human
auuuaccucagcc

SEQ ID NO: 3798552 - RNA, 13 nt, Human
auuuacuaaacau

SEQ ID NO: 3798553 - RNA, 22 nt, Human
auuuacuaagccacaagaaauu

SEQ ID NO: 3798554 - RNA, 23 nt, Human
auuuacuaagccacaagaaauuu

SEQ ID NO: 3798555 - RNA, 12 nt, Human
auuuacuauaua

SEQ ID NO: 3798556 - RNA, 20 nt, Human
auuuacugagcuucucugug

SEQ ID NO: 3798557 - RNA, 13 nt, Human
auuuacuuaagac

SEQ ID NO: 3798558 - RNA, 19 nt, Human
auuuacuuaagacuuaaug

SEQ ID NO: 3798559 - RNA, 16 nt, Human
auuuacuucuuauaca

SEQ ID NO: 3798560 - RNA, 20 nt, Human
auuuacuugccauuacucaa

SEQ ID NO: 3798561 - RNA, 22 nt, Human
auuuacuugccauuacucaauu

SEQ ID NO: 3798562 - RNA, 21 nt, Human
auuuagaaaaagaacaugcag

SEQ ID NO: 3798563 - RNA, 21 nt, Human
auuuagaaaauagagcuuuua

SEQ ID NO: 3798564 - RNA, 22 nt, Human
auuuagaaacuaauugacuuua

SEQ ID NO: 3798565 - RNA, 14 nt, Human
auuuagaacuguau

SEQ ID NO: 3798566 - RNA, 19 nt, Human
auuuagaagugucauguuu

SEQ ID NO: 3798567 - RNA, 21 nt, Human
auuuagaauggugauuuuaaa

SEQ ID NO: 3798568 - RNA, 16 nt, Human
auuuagagaggaaaag

SEQ ID NO: 3798569 - RNA, 17 nt, Human
auuuagagaugaauuaa

SEQ ID NO: 3798570 - RNA, 23 nt, Human
auuuagagaugaauuaaauuuaa

SEQ ID NO: 3798571 - RNA, 22 nt, Human
auuuagagaugcuguaacuuaa

SEQ ID NO: 3798572 - RNA, 16 nt, Human
auuuagaugcauauua

SEQ ID NO: 3798573 - RNA, 14 nt, Human
auuuagauuguaaa

SEQ ID NO: 3798574 - RNA, 13 nt, Human
auuuagcaaauaa

SEQ ID NO: 3798575 - RNA, 13 nt, Human
auuuagcacaaaa

SEQ ID NO: 3798576 - RNA, 23 nt, Human
auuuagcacauacuacacauuca

SEQ ID NO: 3798577 - RNA, 22 nt, Human
auuuagcaugacaagccccagg

SEQ ID NO: 3798578 - RNA, 17 nt, Human
auuuagccaaugcuuac

SEQ ID NO: 3798579 - RNA, 13 nt, Human
auuuagcccucac

SEQ ID NO: 3798580 - RNA, 18 nt, Human
auuuagcguagcuaagug

SEQ ID NO: 3798581 - RNA, 15 nt, Human
auuuagcuguaucaa

SEQ ID NO: 3798582 - RNA, 23 nt, Human
auuuaggaaguugacuuauagua

SEQ ID NO: 3798583 - RNA, 16 nt, Human
auuuagggaguauucu

SEQ ID NO: 3798584 - RNA, 18 nt, Human
auuuagggaguauucuaa

SEQ ID NO: 3798585 - RNA, 20 nt, Human
auuuagggaguauucuaaua

SEQ ID NO: 3798586 - RNA, 19 nt, Human
auuuaggguacuaaauuua

SEQ ID NO: 3798587 - RNA, 17 nt, Human
auuuagguuucugaguu

SEQ ID NO: 3798588 - RNA, 21 nt, Human
auuuagguuucugaguuccug

SEQ ID NO: 3798589 - RNA, 23 nt, Human
auuuagguuucugaguuccugca

SEQ ID NO: 3798590 - RNA, 19 nt, Human
auuuaguaauagccugggu

SEQ ID NO: 3798591 - RNA, 14 nt, Human
auuuaguaguguaa

SEQ ID NO: 3798592 - RNA, 16 nt, Human
auuuagucaugugacc

SEQ ID NO: 3798593 - RNA, 15 nt, Human
auuuagugaacuacg

SEQ ID NO: 3798594 - RNA, 13 nt, Human
auuuagugagcau

SEQ ID NO: 3798595 - RNA, 18 nt, Human
auuuagugaucuuagcau

SEQ ID NO: 3798596 - RNA, 19 nt, Human
auuuagugaucuuagcaua

SEQ ID NO: 3798597 - RNA, 15 nt, Human
auuuaguguauccau

SEQ ID NO: 3798598 - RNA, 12 nt, Human
auuuaguucuuu

SEQ ID NO: 3798599 - RNA, 17 nt, Human
auuuaguucuuuguuau

SEQ ID NO: 3798600 - RNA, 16 nt, Human
auuuaguuguaaacca

SEQ ID NO: 3798601 - RNA, 17 nt, Human
auuuaguuguuucuaga

SEQ ID NO: 3798602 - RNA, 19 nt, Human
auuuaguuuuuguaauuua

SEQ ID NO: 3798603 - RNA, 17 nt, Human
auuuauaaaaauaaaaa

SEQ ID NO: 3798604 - RNA, 17 nt, Human
auuuauaaacagacaau

SEQ ID NO: 3798605 - RNA, 23 nt, Human
auuuauaaacagacaauauguga

SEQ ID NO: 3798606 - RNA, 22 nt, Human
auuuauaaauauauuuaagaua

SEQ ID NO: 3798607 - RNA, 17 nt, Human
auuuauaaaugagcaaa

SEQ ID NO: 3798608 - RNA, 15 nt, Human
auuuauaaaugcuau

SEQ ID NO: 3798609 - RNA, 16 nt, Human
auuuauaaaugcuauu

SEQ ID NO: 3798610 - RNA, 20 nt, Human
auuuauaacguguucaauau

SEQ ID NO: 3798611 - RNA, 16 nt, Human
auuuauaacucaucau

SEQ ID NO: 3798612 - RNA, 20 nt, Human
auuuauaacucaucauaaaa

SEQ ID NO: 3798613 - RNA, 18 nt, Human
auuuauaauacagaaucu

SEQ ID NO: 3798614 - RNA, 22 nt, Human
auuuauaaucacuuuuuuccac

SEQ ID NO: 3798615 - RNA, 23 nt, Human
auuuauaaucacuuuuuuccaca

SEQ ID NO: 3798616 - RNA, 14 nt, Human
auuuauaauguuug

SEQ ID NO: 3798617 - RNA, 17 nt, Human
auuuauaauugcaucua

SEQ ID NO: 3798618 - RNA, 22 nt, Human
auuuauacaagauugaaaaucu

SEQ ID NO: 3798619 - RNA, 14 nt, Human
auuuauacuauuua

SEQ ID NO: 3798620 - RNA, 20 nt, Human
auuuauacucuuuuuucaug

SEQ ID NO: 3798621 - RNA, 16 nt, Human
auuuauacuggcaugc

SEQ ID NO: 3798622 - RNA, 22 nt, Human
auuuauaguuuguacaugcauu

SEQ ID NO: 3798623 - RNA, 18 nt, Human
auuuauauaugaaaacua

SEQ ID NO: 3798624 - RNA, 14 nt, Human
auuuauauauugaa

SEQ ID NO: 3798625 - RNA, 19 nt, Human
auuuauauauuuauaacuc

SEQ ID NO: 3798626 - RNA, 20 nt, Human
auuuauauauuuauaacuca

SEQ ID NO: 3798627 - RNA, 14 nt, Human
caggacucccuccu

SEQ ID NO: 3798628 - RNA, 17 nt, Human
caggacucccuccucac

SEQ ID NO: 3798629 - RNA, 19 nt, Human
caggacucccuccucaccu

SEQ ID NO: 3798630 - RNA, 20 nt, Human
caggacucugcagccucaga

SEQ ID NO: 3798631 - RNA, 13 nt, Human
caggacucugccu

SEQ ID NO: 3798632 - RNA, 15 nt, Human
caggacucugccucc

SEQ ID NO: 3798633 - RNA, 16 nt, Human
caggacucugccuccu

SEQ ID NO: 3798634 - RNA, 20 nt, Human
caggacugaauuguccccag

SEQ ID NO: 3798635 - RNA, 21 nt, Human
caggacugaauuguccccagu

SEQ ID NO: 3798636 - RNA, 17 nt, Human
caggacugagccccgca

SEQ ID NO: 3798637 - RNA, 12 nt, Human
caggacugaugu

SEQ ID NO: 3798638 - RNA, 16 nt, Human
caggacugggccacuu

SEQ ID NO: 3798639 - RNA, 23 nt, Human
caggacuguccccuugaaggaga

SEQ ID NO: 3798640 - RNA, 14 nt, Human
caggacugugacuc

SEQ ID NO: 3798641 - RNA, 21 nt, Human
caggacuuaacggcuccagga

SEQ ID NO: 3798642 - RNA, 22 nt, Human
caggacuuccccggagggcugc

SEQ ID NO: 3798643 - RNA, 19 nt, Human
caggacuuugaggcaagug

SEQ ID NO: 3798644 - RNA, 23 nt, Human
caggagaaaugcauccauuccuc

SEQ ID NO: 3798645 - RNA, 11 nt, Human
caggagaacca

SEQ ID NO: 3798646 - RNA, 17 nt, Human
caggagaaccacuacau

SEQ ID NO: 3798647 - RNA, 16 nt, Human
caggagaaccuaacau

SEQ ID NO: 3798648 - RNA, 21 nt, Human
caggagaagaaagaggugacc

SEQ ID NO: 3798649 - RNA, 14 nt, Human
caggagaagcucag

SEQ ID NO: 3798650 - RNA, 17 nt, Human
caggagaagcucagcug

SEQ ID NO: 3798651 - RNA, 13 nt, Human
caggagacgacag

SEQ ID NO: 3798652 - RNA, 21 nt, Human
caggagacuguggagacugcu

SEQ ID NO: 3798653 - RNA, 12 nt, Human
caggagagagaa

SEQ ID NO: 3798654 - RNA, 19 nt, Human
caggagagagaaagccagg

SEQ ID NO: 3798655 - RNA, 23 nt, Human
caggagagagaaagccaggcagg

SEQ ID NO: 3798656 - RNA, 19 nt, Human
caggagagaguugaaccua

SEQ ID NO: 3798657 - RNA, 13 nt, Human
caggagagccagc

SEQ ID NO: 3798658 - RNA, 19 nt, Human
caggagagccagcccuccc

SEQ ID NO: 3798659 - RNA, 15 nt, Human
caggagagcuuaggg

SEQ ID NO: 3798660 - RNA, 17 nt, Human
cagccccuugagaaacc

SEQ ID NO: 3798661 - RNA, 12 nt, Human
cagccccuuucc

SEQ ID NO: 3798662 - RNA, 20 nt, Human
cagcccgauccuccccugga

SEQ ID NO: 3798663 - RNA, 22 nt, Human
cagcccgauccuccccuggacu

SEQ ID NO: 3798664 - RNA, 15 nt, Human
cagcccgcacaccug

SEQ ID NO: 3798665 - RNA, 19 nt, Human
cagcccgcuaggcucgccu

SEQ ID NO: 3798666 - RNA, 18 nt, Human
cagcccggaccuuggcag

SEQ ID NO: 3798667 - RNA, 14 nt, Human
cagcccggccugcu

SEQ ID NO: 3798668 - RNA, 21 nt, Human
cagcccggccugcucccagca

SEQ ID NO: 3798669 - RNA, 14 nt, Human
cagcccggcugguu

SEQ ID NO: 3798670 - RNA, 19 nt, Human
cagcccggcugguuuugua

SEQ ID NO: 3798671 - RNA, 16 nt, Human
cagcccgggagccuag

SEQ ID NO: 3798672 - RNA, 13 nt, Human
cagcccgggcucu

SEQ ID NO: 3798673 - RNA, 19 nt, Human
cagcccuaaggaucucuca

SEQ ID NO: 3798674 - RNA, 21 nt, Human
cagcccuagagccugccugga

SEQ ID NO: 3798675 - RNA, 22 nt, Human
cagcccuagagccugccuggag

SEQ ID NO: 3798676 - RNA, 11 nt, Human
cagcccuagga

SEQ ID NO: 3798677 - RNA, 18 nt, Human
cagcccuaggguggagag

SEQ ID NO: 3798678 - RNA, 15 nt, Human
cagcccuauggaugu

SEQ ID NO: 3798679 - RNA, 19 nt, Human
cagcccucacacacccugu

SEQ ID NO: 3798680 - RNA, 18 nt, Human
cagcccucaccccugguu

SEQ ID NO: 3798681 - RNA, 20 nt, Human
cagcccuccccauggagcca

SEQ ID NO: 3798682 - RNA, 21 nt, Human
cagcccuccccauggagccag

SEQ ID NO: 3798683 - RNA, 15 nt, Human
cagcccucccugccc

SEQ ID NO: 3798684 - RNA, 15 nt, Human
cagcccucccugucc

SEQ ID NO: 3798685 - RNA, 16 nt, Human
cagcccucccuguccu

SEQ ID NO: 3798686 - RNA, 19 nt, Human
cagcccucccuguccuccu

SEQ ID NO: 3798687 - RNA, 20 nt, Human
cagcccucccuguccuccuc

SEQ ID NO: 3798688 - RNA, 21 nt, Human
cagcccucccuguccuccucg

SEQ ID NO: 3798689 - RNA, 14 nt, Human
cagcccuccucacc

SEQ ID NO: 3798690 - RNA, 22 nt, Human
cagcccuccucaccccgucugg

SEQ ID NO: 3798691 - RNA, 21 nt, Human
cagcccucggcgcuccgggac

SEQ ID NO: 3798692 - RNA, 18 nt, Human
cagcccugagaaagcccu

SEQ ID NO: 3798693 - RNA, 19 nt, Human
cagcccugaguuccuagcc

SEQ ID NO: 3798694 - RNA, 15 nt, Human
cagcccugcaccaug

SEQ ID NO: 3798695 - RNA, 15 nt, Human
cagcccugcagaggg

SEQ ID NO: 3798696 - RNA, 17 nt, Human
cagcccugcagagggca

SEQ ID NO: 3798697 - RNA, 23 nt, Human
cagcccugccccacaccuccucu

SEQ ID NO: 3798698 - RNA, 13 nt, Human
cagcccugcccuu

SEQ ID NO: 3798699 - RNA, 21 nt, Human
cagcccugccuggaggaccug

SEQ ID NO: 3798700 - RNA, 11 nt, Human
cagcccugcug

SEQ ID NO: 3798701 - RNA, 13 nt, Human
cagcccugcuggc

SEQ ID NO: 3798702 - RNA, 16 nt, Human
cagcccugcuggccgc

SEQ ID NO: 3798703 - RNA, 18 nt, Human
cagcccugcuggccgccu

SEQ ID NO: 3798704 - RNA, 20 nt, Human
cagcccugcuggccgccuca

SEQ ID NO: 3798705 - RNA, 13 nt, Human
cagcccugcuuug

SEQ ID NO: 3798706 - RNA, 14 nt, Human
cagcccuggagggu

SEQ ID NO: 3798707 - RNA, 20 nt, Human
cagcccugggccccaccacc

SEQ ID NO: 3798708 - RNA, 23 nt, Human
cagcccugggccccaccaccuag

SEQ ID NO: 3798709 - RNA, 14 nt, Human
cagcccuggggcug

SEQ ID NO: 3798710 - RNA, 19 nt, Human
cagcccuggggcugggccc

SEQ ID NO: 3798711 - RNA, 15 nt, Human
cagcccuggucucag

SEQ ID NO: 3798712 - RNA, 18 nt, Human
cagcccuggucucagcag

SEQ ID NO: 3798713 - RNA, 13 nt, Human
cagcccugucagc

SEQ ID NO: 3798714 - RNA, 16 nt, Human
cagcccugucagcaug

SEQ ID NO: 3798715 - RNA, 18 nt, Human
cagcccugucagcaugaa

SEQ ID NO: 3798716 - RNA, 11 nt, Human
cagcccugugg

SEQ ID NO: 3798717 - RNA, 13 nt, Human
cagcccuguucug

SEQ ID NO: 3798718 - RNA, 23 nt, Human
cagcccuuaugcgguuaauuuug

SEQ ID NO: 3798719 - RNA, 16 nt, Human
cagcccuuccaaacuc

SEQ ID NO: 3798720 - RNA, 13 nt, Human
cagcccuuccucu

SEQ ID NO: 3798721 - RNA, 18 nt, Human
cagcccuuccucugcucc

SEQ ID NO: 3798722 - RNA, 19 nt, Human
cagcccuuccucugcuccc

SEQ ID NO: 3798723 - RNA, 23 nt, Human
cagcccuuccucugcucccccuu

SEQ ID NO: 3798724 - RNA, 20 nt, Human
cagcccuugagcuccccaaa

SEQ ID NO: 3798725 - RNA, 13 nt, Human
cagcccuugcuug

SEQ ID NO: 3798726 - RNA, 15 nt, Human
cagcccuugcuuguu

SEQ ID NO: 3798727 - RNA, 20 nt, Human
cagcccuuugggaggcugag

SEQ ID NO: 3798728 - RNA, 23 nt, Human
cagcccuuugggaggcugaggcg

SEQ ID NO: 3798729 - RNA, 17 nt, Human
cagccgagcaggaggcc

SEQ ID NO: 3798730 - RNA, 19 nt, Human
cagccgagccgggccuggg

SEQ ID NO: 3798731 - RNA, 23 nt, Human
cagccgccaugcuccuggcccac

SEQ ID NO: 3798732 - RNA, 18 nt, Human
cagccgccuuaagcugau

SEQ ID NO: 3798733 - RNA, 14 nt, Human
cagccgcuccuguc

SEQ ID NO: 3798734 - RNA, 21 nt, Human
cagccgcucggaggccccaaa

SEQ ID NO: 3798735 - RNA, 20 nt, Human
cagccgcucuccugccacau

SEQ ID NO: 3798736 - RNA, 19 nt, Human
cagccgcugagcgaggaga

SEQ ID NO: 3798737 - RNA, 14 nt, Human
cagccgcuucugac

SEQ ID NO: 3798738 - RNA, 15 nt, Human
cagccggcacagggu

SEQ ID NO: 3798739 - RNA, 17 nt, Human
cagccggcacagggucu

SEQ ID NO: 3798740 - RNA, 14 nt, Human
cagccggcacccac

SEQ ID NO: 3798741 - RNA, 16 nt, Human
cagccggccaauggaa

SEQ ID NO: 3798742 - RNA, 24 nt, Human
cagccggccucucuggccucccac

SEQ ID NO: 3798743 - RNA, 12 nt, Human
cagccgggcccu

SEQ ID NO: 3798744 - RNA, 15 nt, Human
cagccgggcccugag

SEQ ID NO: 3798745 - RNA, 14 nt, Human
cagccggggaagac

SEQ ID NO: 3798746 - RNA, 17 nt, Human
cagccggggccugccua

SEQ ID NO: 3798747 - RNA, 18 nt, Human
cagccggggccugccuag

SEQ ID NO: 3798748 - RNA, 19 nt, Human
cagccggggccugccuagc

SEQ ID NO: 3798749 - RNA, 20 nt, Human
cagccggggccugccuagca

SEQ ID NO: 3798750 - RNA, 15 nt, Human
cagccggggcgagug

SEQ ID NO: 3798751 - RNA, 17 nt, Human
cagccgguaccugggaa

SEQ ID NO: 3798752 - RNA, 19 nt, Human
cagccgucagccaaaugua

SEQ ID NO: 3798753 - RNA, 17 nt, Human
cagccgugagcauguuu

SEQ ID NO: 3798754 - RNA, 17 nt, Human
cagccgugaugcucagg

SEQ ID NO: 3798755 - RNA, 13 nt, Human
cagccgugggccc

SEQ ID NO: 3798756 - RNA, 15 nt, Human
cagccgugggcccca

SEQ ID NO: 3798757 - RNA, 22 nt, Human
cagccuacuagggaccugggga

SEQ ID NO: 3798758 - RNA, 21 nt, Human
cagccuagggcugagcugggg

SEQ ID NO: 3798759 - RNA, 18 nt, Human
cagccuaggggucaggga

SEQ ID NO: 3798760 - RNA, 19 nt, Human
cagccuaggggucagggac

SEQ ID NO: 3798761 - RNA, 23 nt, Human
cagccuaugagcauccugagccc

SEQ ID NO: 3798762 - RNA, 17 nt, Human
cagccucaaccuccugg

SEQ ID NO: 3798763 - RNA, 20 nt, Human
cagccucaaccuccugggcu

SEQ ID NO: 3798764 - RNA, 19 nt, Human
cagccucaagucacuccca

SEQ ID NO: 3798765 - RNA, 20 nt, Human
cagccucaauaagccuuguc

SEQ ID NO: 3798766 - RNA, 21 nt, Human
cagccucaauaagccuugucg

SEQ ID NO: 3798767 - RNA, 14 nt, Human
cagccucacagaag

SEQ ID NO: 3798768 - RNA, 15 nt, Human
cagccucacaguccu

SEQ ID NO: 3798769 - RNA, 13 nt, Human
cagccucagacug

SEQ ID NO: 3798770 - RNA, 14 nt, Human
cagccucagacugg

SEQ ID NO: 3798771 - RNA, 21 nt, Human
cagccucagagacaucagccc

SEQ ID NO: 3798772 - RNA, 18 nt, Human
cagccucagcgcggcccu

SEQ ID NO: 3798773 - RNA, 20 nt, Human
cagccucaggacugggagcc

SEQ ID NO: 3798774 - RNA, 15 nt, Human
cagccucaguccucc

SEQ ID NO: 3798775 - RNA, 16 nt, Human
cagccucaguccuccc

SEQ ID NO: 3798776 - RNA, 21 nt, Human
cagccucagugacccuggcuc

SEQ ID NO: 3798777 - RNA, 13 nt, Human
cagccuccagccu

SEQ ID NO: 3798778 - RNA, 15 nt, Human
cagccuccagccucu

SEQ ID NO: 3798779 - RNA, 21 nt, Human
cagccuccauccuacccccug

SEQ ID NO: 3798780 - RNA, 14 nt, Human
cagccuccaugcug

SEQ ID NO: 3798781 - RNA, 17 nt, Human
cagccuccaugcugccu

SEQ ID NO: 3798782 - RNA, 18 nt, Human
cagccuccaugcugccuc

SEQ ID NO: 3798783 - RNA, 20 nt, Human
cagccuccaugcugccucca

SEQ ID NO: 3798784 - RNA, 15 nt, Human
cagccucccaaagug

SEQ ID NO: 3798785 - RNA, 22 nt, Human
cagccucccaaagugcugagau

SEQ ID NO: 3798786 - RNA, 20 nt, Human
cagccucccaaagugcuggg

SEQ ID NO: 3798787 - RNA, 19 nt, Human
cagccucccaaguagcugg

SEQ ID NO: 3798788 - RNA, 16 nt, Human
cagccucccacagugc

SEQ ID NO: 3798789 - RNA, 19 nt, Human
cagccucccacccccaucu

SEQ ID NO: 3798790 - RNA, 18 nt, Human
cagccuccccugccaggg

SEQ ID NO: 3798791 - RNA, 20 nt, Human
cagccucccgaauagcuggg

SEQ ID NO: 3798792 - RNA, 21 nt, Human
cagccucccucugaccugcag

SEQ ID NO: 3798793 - RNA, 14 nt, Human
cagccucccugaag

SEQ ID NO: 3798794 - RNA, 18 nt, Human
cagccuccgcuucccugg

SEQ ID NO: 3798795 - RNA, 20 nt, Human
cagccuccgcuucccugguu

SEQ ID NO: 3798796 - RNA, 16 nt, Human
cagccuccucaucugg

SEQ ID NO: 3798797 - RNA, 17 nt, Human
cagccuccucuggacgg

SEQ ID NO: 3798798 - RNA, 20 nt, Human
cagccucgaacuccugggcu

SEQ ID NO: 3798799 - RNA, 19 nt, Human
cagccucgcaggccucccu

SEQ ID NO: 3798800 - RNA, 19 nt, Human
cagccucgccccuggcaga

SEQ ID NO: 3798801 - RNA, 21 nt, Human
cagccucgccccuggcagaga

SEQ ID NO: 3798802 - RNA, 22 nt, Human
cagccucguuggaagaggaaca

SEQ ID NO: 3798803 - RNA, 14 nt, Human
cagccucuagggac

SEQ ID NO: 3798804 - RNA, 20 nt, Human
cagcuggugggaagcgucug

SEQ ID NO: 3798805 - RNA, 20 nt, Human
cagcugguguagcuacagag

SEQ ID NO: 3798806 - RNA, 21 nt, Human
cagcugguguagcuacagaga

SEQ ID NO: 3798807 - RNA, 23 nt, Human
cagcugguguagcuacagagaaa

SEQ ID NO: 3798808 - RNA, 20 nt, Human
cagcuguaacacagcugaga

SEQ ID NO: 3798809 - RNA, 16 nt, Human
cagcuguaaucuauga

SEQ ID NO: 3798810 - RNA, 19 nt, Human
cagcuguccccccacuccc

SEQ ID NO: 3798811 - RNA, 17 nt, Human
cagcugucuuuuggagg

SEQ ID NO: 3798812 - RNA, 20 nt, Human
cagcugugaacauggacucu

SEQ ID NO: 3798813 - RNA, 13 nt, Human
cagcugugagccu

SEQ ID NO: 3798814 - RNA, 16 nt, Human
cagcugugagccuugg

SEQ ID NO: 3798815 - RNA, 17 nt, Human
cagcugugagccuuggc

SEQ ID NO: 3798816 - RNA, 12 nt, Human
cagcugugccuc

SEQ ID NO: 3798817 - RNA, 17 nt, Human
cagcugugccucgcucc

SEQ ID NO: 3798818 - RNA, 16 nt, Human
cagcuguggcagaguu

SEQ ID NO: 3798819 - RNA, 19 nt, Human
cagcuguggcagaguuaca

SEQ ID NO: 3798820 - RNA, 23 nt, Human
cagcugugugacauuuggagagg

SEQ ID NO: 3798821 - RNA, 22 nt, Human
cagcuguuagaguccaacgugg

SEQ ID NO: 3798822 - RNA, 19 nt, Human
cagcuguugacucuaguac

SEQ ID NO: 3798823 - RNA, 19 nt, Human
cagcuguugucucuucucc

SEQ ID NO: 3798824 - RNA, 14 nt, Human
cagcuguuuaagau

SEQ ID NO: 3798825 - RNA, 21 nt, Human
cagcuguuuaugcauagauaa

SEQ ID NO: 3798826 - RNA, 20 nt, Human
cagcuguuuuaguuaaauuu

SEQ ID NO: 3798827 - RNA, 15 nt, Human
cagcuguuuuguuga

SEQ ID NO: 3798828 - RNA, 16 nt, Human
cagcuguuuuguugac

SEQ ID NO: 3798829 - RNA, 19 nt, Human
cagcuguuuuguugacauu

SEQ ID NO: 3798830 - RNA, 18 nt, Human
cagcuuagaguuggccau

SEQ ID NO: 3798831 - RNA, 15 nt, Human
cagcuuagggcccug

SEQ ID NO: 3798832 - RNA, 19 nt, Human
cagcuuagggcccuggagg

SEQ ID NO: 3798833 - RNA, 17 nt, Human
cagcuuaggggcugcug

SEQ ID NO: 3798834 - RNA, 16 nt, Human
cagcuuauacgaaaua

SEQ ID NO: 3798835 - RNA, 16 nt, Human
cagcuuaucucuuuua

SEQ ID NO: 3798836 - RNA, 21 nt, Human
cagcuuaucucuuuuauauuu

SEQ ID NO: 3798837 - RNA, 13 nt, Human
auuuuaaacaaag

SEQ ID NO: 3798838 - RNA, 20 nt, Human
auuuuaaaccauaaaaagcu

SEQ ID NO: 3798839 - RNA, 14 nt, Human
auuuuaaacuagau

SEQ ID NO: 3798840 - RNA, 16 nt, Human
auuuuaaacuagauga

SEQ ID NO: 3798841 - RNA, 12 nt, Human
auuuuaaagaau

SEQ ID NO: 3798842 - RNA, 22 nt, Human
auuuuaaaguaugcauuauuaa

SEQ ID NO: 3798843 - RNA, 17 nt, Human
auuuuaaagugcaaaag

SEQ ID NO: 3798844 - RNA, 22 nt, Human
auuuuaaaguuaaacauuuuua

SEQ ID NO: 3798845 - RNA, 18 nt, Human
auuuuaaaguuaguaucu

SEQ ID NO: 3798846 - RNA, 15 nt, Human
auuuuaaauaaaaga

SEQ ID NO: 3798847 - RNA, 16 nt, Human
auuuuaaauaaaagaa

SEQ ID NO: 3798848 - RNA, 21 nt, Human
auuuuaaauaaaagugaucaa

SEQ ID NO: 3798849 - RNA, 21 nt, Human
auuuuaaaucuaaaucuauuu

SEQ ID NO: 3798850 - RNA, 21 nt, Human
auuuuaaauuauaaggacugc

SEQ ID NO: 3798851 - RNA, 18 nt, Human
auuuuaacaaaagcaaga

SEQ ID NO: 3798852 - RNA, 21 nt, Human
auuuuaacaagaagaugaaug

SEQ ID NO: 3798853 - RNA, 22 nt, Human
auuuuaacaagaagaugaaugg

SEQ ID NO: 3798854 - RNA, 14 nt, Human
auuuuaacacacau

SEQ ID NO: 3798855 - RNA, 17 nt, Human
auuuuaacacacauaaa

SEQ ID NO: 3798856 - RNA, 18 nt, Human
auuuuaacacacauaaag

SEQ ID NO: 3798857 - RNA, 22 nt, Human
auuuuaacacacauaaaggaua

SEQ ID NO: 3798858 - RNA, 22 nt, Human
auuuuaaccuaugauauuuucu

SEQ ID NO: 3798859 - RNA, 13 nt, Human
auuuuaacucaua

SEQ ID NO: 3798860 - RNA, 13 nt, Human
auuuuaacucugu

SEQ ID NO: 3798861 - RNA, 17 nt, Human
auuuuaacuuuaucaca

SEQ ID NO: 3798862 - RNA, 19 nt, Human
auuuuaacuuuaucacauu

SEQ ID NO: 3798863 - RNA, 16 nt, Human
auuuuaagacugauuu

SEQ ID NO: 3798864 - RNA, 22 nt, Human
auuuuaagauuccuuuucuugu

SEQ ID NO: 3798865 - RNA, 22 nt, Human
auuuuaagcacucuuaaagcaa

SEQ ID NO: 3798866 - RNA, 21 nt, Human
auuuuaagcauuacucuugua

SEQ ID NO: 3798867 - RNA, 24 nt, Human
auuuuaagcauuacucuuguaaga

SEQ ID NO: 3798868 - RNA, 14 nt, Human
auuuuaagcauugu

SEQ ID NO: 3798869 - RNA, 13 nt, Human
auuuuaagccuuu

SEQ ID NO: 3798870 - RNA, 23 nt, Human
auuuuaagcuaggaaaagaaauc

SEQ ID NO: 3798871 - RNA, 14 nt, Human
auuuuaaguauugc

SEQ ID NO: 3798872 - RNA, 20 nt, Human
auuuuaaguauugcaucugu

SEQ ID NO: 3798873 - RNA, 15 nt, Human
auuuuaagucccugu

SEQ ID NO: 3798874 - RNA, 16 nt, Human
auuuuaagugcuuugu

SEQ ID NO: 3798875 - RNA, 15 nt, Human
auuuuaauaaacacu

SEQ ID NO: 3798876 - RNA, 16 nt, Human
auuuuaauaaacacuc

SEQ ID NO: 3798877 - RNA, 17 nt, Human
auuuuaauaaacacucu

SEQ ID NO: 3798878 - RNA, 18 nt, Human
auuuuaauaauguuucaa

SEQ ID NO: 3798879 - RNA, 14 nt, Human
auuuuaaucaaauu

SEQ ID NO: 3798880 - RNA, 23 nt, Human
auuuuaaugaagaaaguggaaaa

SEQ ID NO: 3798881 - RNA, 22 nt, Human
auuuuaaugcaguugcuuacua

SEQ ID NO: 3798882 - RNA, 19 nt, Human
auuuuaauggauuguuaau

SEQ ID NO: 3798883 - RNA, 22 nt, Human
auuuuaauguaaagauuugcuu

SEQ ID NO: 3798884 - RNA, 18 nt, Human
auuuuaauuagguuaacu

SEQ ID NO: 3798885 - RNA, 20 nt, Human
auuuuaauuagguuaacuau

SEQ ID NO: 3798886 - RNA, 14 nt, Human
auuuuaauugucau

SEQ ID NO: 3798887 - RNA, 19 nt, Human
auuuuaauuuaguaaaugu

SEQ ID NO: 3798888 - RNA, 18 nt, Human
auuuuaauuucaagcuua

SEQ ID NO: 3798889 - RNA, 19 nt, Human
auuuuaauuuuuaaaugca

SEQ ID NO: 3798890 - RNA, 17 nt, Human
auuuuacaaaagaugua

SEQ ID NO: 3798891 - RNA, 20 nt, Human
auuuuacaauaggugcuuau

SEQ ID NO: 3798892 - RNA, 15 nt, Human
auuuuacacagaaac

SEQ ID NO: 3798893 - RNA, 19 nt, Human
auuuuacacagaaacacug

SEQ ID NO: 3798894 - RNA, 20 nt, Human
auuuuacacagaaacacugc

SEQ ID NO: 3798895 - RNA, 17 nt, Human
auuuuaccaaguuauau

SEQ ID NO: 3798896 - RNA, 18 nt, Human
auuuuaccaaguuauaua

SEQ ID NO: 3798897 - RNA, 19 nt, Human
auuuuaccaaguuauauaa

SEQ ID NO: 3798898 - RNA, 23 nt, Human
auuuuaccaaguuauauaaagag

SEQ ID NO: 3798899 - RNA, 19 nt, Human
auuuuaccuagcuaauuau

SEQ ID NO: 3798900 - RNA, 18 nt, Human
auuuuacuacuguggaaa

SEQ ID NO: 3798901 - RNA, 20 nt, Human
auuuuacuguacagacagaa

SEQ ID NO: 3798902 - RNA, 16 nt, Human
auuuuacugucuuaau

SEQ ID NO: 3798903 - RNA, 16 nt, Human
auuuuacuuggaaaua

SEQ ID NO: 3798904 - RNA, 21 nt, Human
auuuuagaaaccccucuguag

SEQ ID NO: 3798905 - RNA, 12 nt, Human
auuuuagacaaa

SEQ ID NO: 3798906 - RNA, 22 nt, Human
auuuuagauggaauaagagaaa

SEQ ID NO: 3798907 - RNA, 20 nt, Human
auuuuagcaguucugcaaau

SEQ ID NO: 3798908 - RNA, 23 nt, Human
auuuuagcucuauugauacucuu

SEQ ID NO: 3798909 - RNA, 13 nt, Human
auuuuagcuuuug

SEQ ID NO: 3798910 - RNA, 15 nt, Human
auuuuaggaacuuca

SEQ ID NO: 3798911 - RNA, 17 nt, Human
auuuuaggaggaccaga

SEQ ID NO: 3798912 - RNA, 17 nt, Human
auuuuaggcacccaucc

SEQ ID NO: 3798913 - RNA, 20 nt, Human
auuuuaggcacucuuaaaug

SEQ ID NO: 3798914 - RNA, 22 nt, Human
auuuuaggcacucuuaaaugau

SEQ ID NO: 3798915 - RNA, 21 nt, Human
auuuuagguguugauuuucug

SEQ ID NO: 3798916 - RNA, 23 nt, Human
auuuuagguguugauuuucuguu

SEQ ID NO: 3798917 - RNA, 23 nt, Human
auuuuaguauauuuauauaauua

SEQ ID NO: 3798918 - RNA, 14 nt, Human
auuuuaguauucau

SEQ ID NO: 3798919 - RNA, 14 nt, Human
auuuuaguccaaau

SEQ ID NO: 3798920 - RNA, 15 nt, Human
auuuuaguuucuguu

SEQ ID NO: 3798921 - RNA, 19 nt, Human
auuuuaguuuuucauuaaa

SEQ ID NO: 3798922 - RNA, 20 nt, Human
auuuuauaaaauuaaagaaa

SEQ ID NO: 3798923 - RNA, 22 nt, Human
auuuuauaaaauuaaagaaaau

SEQ ID NO: 3798924 - RNA, 12 nt, Human
auuuuauaaagu

SEQ ID NO: 3798925 - RNA, 21 nt, Human
auuuuauaaaucgcuuuugau

SEQ ID NO: 3798926 - RNA, 15 nt, Human
auuuuauaaauguau

SEQ ID NO: 3798927 - RNA, 14 nt, Human
auuuuauaagaaaa

SEQ ID NO: 3798928 - RNA, 15 nt, Human
auuuuauaagaaaaa

SEQ ID NO: 3798929 - RNA, 20 nt, Human
auuuuauaagaaaaacuuuu

SEQ ID NO: 3798930 - RNA, 19 nt, Human
auuuuauagcuacuaauuu

SEQ ID NO: 3798931 - RNA, 18 nt, Human
auuuuauagcucaguuua

SEQ ID NO: 3798932 - RNA, 12 nt, Human
auuuuauaucuu

SEQ ID NO: 3798933 - RNA, 14 nt, Human
auuuuauaucuugu

SEQ ID NO: 3798934 - RNA, 23 nt, Human
auuuuauaugcuuacugauauau

SEQ ID NO: 3798935 - RNA, 15 nt, Human
auuuuauaugucaaa

SEQ ID NO: 3798936 - RNA, 14 nt, Human
auuuuauauugaaa

SEQ ID NO: 3798937 - RNA, 21 nt, Human
auuuuaucugccucucuugua

SEQ ID NO: 3798938 - RNA, 22 nt, Human
auuuuaucuguuuccugacauu

SEQ ID NO: 3798939 - RNA, 19 nt, Human
auuuuaucuuucgcacagc

SEQ ID NO: 3798940 - RNA, 21 nt, Human
auuuuaucuuugauucuccuu

SEQ ID NO: 3798941 - RNA, 23 nt, Human
auuuuaucuuugauucuccuuca

SEQ ID NO: 3798942 - RNA, 18 nt, Human
auuuuaugagaaauguaa

SEQ ID NO: 3798943 - RNA, 21 nt, Human
auuuuaugagaaauguaaugc

SEQ ID NO: 3798944 - RNA, 14 nt, Human
auuuuaugauccag

SEQ ID NO: 3798945 - RNA, 16 nt, Human
auuuuaugauccagca

SEQ ID NO: 3798946 - RNA, 14 nt, Human
auuuuaugcaaaua

SEQ ID NO: 3798947 - RNA, 17 nt, Human
caguaaagagaaacuuu

SEQ ID NO: 3798948 - RNA, 20 nt, Human
caguaaagagaaacuuugug

SEQ ID NO: 3798949 - RNA, 18 nt, Human
caguaaauaacuggaaaa

SEQ ID NO: 3798950 - RNA, 22 nt, Human
caguaaauaacuggaaaacaga

SEQ ID NO: 3798951 - RNA, 19 nt, Human
caguaaaugggggugcauu

SEQ ID NO: 3798952 - RNA, 22 nt, Human
caguaacacauagacugugcgc

SEQ ID NO: 3798953 - RNA, 18 nt, Human
caguaacgcaggggaaac

SEQ ID NO: 3798954 - RNA, 20 nt, Human
caguaacgcgucuuccugag

SEQ ID NO: 3798955 - RNA, 21 nt, Human
caguaacgcgucuuccugagu

SEQ ID NO: 3798956 - RNA, 21 nt, Human
caguaacgggucguaaugacu

SEQ ID NO: 3798957 - RNA, 14 nt, Human
caguaacugucagg

SEQ ID NO: 3798958 - RNA, 21 nt, Human
caguaagaccggaagcuccug

SEQ ID NO: 3798959 - RNA, 22 nt, Human
caguaagaccggaagcuccugg

SEQ ID NO: 3798960 - RNA, 16 nt, Human
caguaagaucacuguu

SEQ ID NO: 3798961 - RNA, 21 nt, Human
caguaagaucacuguuuagau

SEQ ID NO: 3798962 - RNA, 13 nt, Human
caguaaguuccua

SEQ ID NO: 3798963 - RNA, 13 nt, Human
caguaauaaaaca

SEQ ID NO: 3798964 - RNA, 18 nt, Human
caguaauaaaacaucuuu

SEQ ID NO: 3798965 - RNA, 20 nt, Human
caguaauauuuauauauuua

SEQ ID NO: 3798966 - RNA, 23 nt, Human
caguaauccuguaggaagguacu

SEQ ID NO: 3798967 - RNA, 21 nt, Human
caguaaugagcuuaagaaauu

SEQ ID NO: 3798968 - RNA, 18 nt, Human
caguaaugucauaaagug

SEQ ID NO: 3798969 - RNA, 17 nt, Human
caguaauuugaggacaa

SEQ ID NO: 3798970 - RNA, 21 nt, Human
caguacaaugugacuuugaaa

SEQ ID NO: 3798971 - RNA, 12 nt, Human
caguacaggcag

SEQ ID NO: 3798972 - RNA, 19 nt, Human
caguacaggcagcacagag

SEQ ID NO: 3798973 - RNA, 16 nt, Human
caguacagugguucua

SEQ ID NO: 3798974 - RNA, 15 nt, Human
caguacaugggaaag

SEQ ID NO: 3798975 - RNA, 12 nt, Human
caguacauuuaa

SEQ ID NO: 3798976 - RNA, 12 nt, Human
caguaccacaug

SEQ ID NO: 3798977 - RNA, 14 nt, Human
caguacccaccacc

SEQ ID NO: 3798978 - RNA, 19 nt, Human
caguacccauggggcuagg

SEQ ID NO: 3798979 - RNA, 14 nt, Human
caguacccucucag

SEQ ID NO: 3798980 - RNA, 22 nt, Human
caguacccucucagcuccaggu

SEQ ID NO: 3798981 - RNA, 20 nt, Human
caguaccuagcuggcucugu

SEQ ID NO: 3798982 - RNA, 15 nt, Human
caguaccugaggguc

SEQ ID NO: 3798983 - RNA, 23 nt, Human
caguaccuggguccccagcccuu

SEQ ID NO: 3798984 - RNA, 18 nt, Human
caguacuaacauuuauuu

SEQ ID NO: 3798985 - RNA, 13 nt, Human
caguacuggagcu

SEQ ID NO: 3798986 - RNA, 15 nt, Human
caguacuucagcaag

SEQ ID NO: 3798987 - RNA, 20 nt, Human
caguacuucagcaagagaga

SEQ ID NO: 3798988 - RNA, 16 nt, Human
caguacuuugugcauu

SEQ ID NO: 3798989 - RNA, 18 nt, Human
caguacuuugugcauucu

SEQ ID NO: 3798990 - RNA, 15 nt, Human
caguacuuuuuuaaa

SEQ ID NO: 3798991 - RNA, 21 nt, Human
caguacuuuuuuaaauauuuu

SEQ ID NO: 3798992 - RNA, 19 nt, Human
caguagaaauaauaugcau

SEQ ID NO: 3798993 - RNA, 14 nt, Human
caguagaacuccag

SEQ ID NO: 3798994 - RNA, 14 nt, Human
caguagaacugucu

SEQ ID NO: 3798995 - RNA, 15 nt, Human
caguagaacugucug

SEQ ID NO: 3798996 - RNA, 20 nt, Human
caguagaaggucggaggcuu

SEQ ID NO: 3798997 - RNA, 23 nt, Human
caguagaaggucggaggcuuggg

SEQ ID NO: 3798998 - RNA, 22 nt, Human
caguagacauuuuaacaagaag

SEQ ID NO: 3798999 - RNA, 18 nt, Human
cagcuucaugccuuugua

SEQ ID NO: 3799000 - RNA, 15 nt, Human
cagcuucauuuccug

SEQ ID NO: 3799001 - RNA, 18 nt, Human
cagcuucauuuccugugu

SEQ ID NO: 3799002 - RNA, 19 nt, Human
cagcuucauuuccuguguc

SEQ ID NO: 3799003 - RNA, 21 nt, Human
cagcuucauuuccugugucuu

SEQ ID NO: 3799004 - RNA, 13 nt, Human
cagcuucauuugu

SEQ ID NO: 3799005 - RNA, 14 nt, Human
cagcuuccagcagg

SEQ ID NO: 3799006 - RNA, 17 nt, Human
cagcuuccagcaggagg

SEQ ID NO: 3799007 - RNA, 18 nt, Human
cagcuuccccucucuccu

SEQ ID NO: 3799008 - RNA, 20 nt, Human
cagcuuccuacccacaccuc

SEQ ID NO: 3799009 - RNA, 15 nt, Human
cagcuuccuucagag

SEQ ID NO: 3799010 - RNA, 18 nt, Human
cagcuucucauccugcag

SEQ ID NO: 3799011 - RNA, 19 nt, Human
cagcuucucauccugcagg

SEQ ID NO: 3799012 - RNA, 12 nt, Human
cagcuucuccag

SEQ ID NO: 3799013 - RNA, 13 nt, Human
cagcuucuccagg

SEQ ID NO: 3799014 - RNA, 15 nt, Human
cagcuucuccugugu

SEQ ID NO: 3799015 - RNA, 16 nt, Human
cagcuucuccugugug

SEQ ID NO: 3799016 - RNA, 14 nt, Human
cagcuucugccacu

SEQ ID NO: 3799017 - RNA, 16 nt, Human
cagcuucugcccccug

SEQ ID NO: 3799018 - RNA, 17 nt, Human
cagcuucugcugggcug

SEQ ID NO: 3799019 - RNA, 18 nt, Human
cagcuucugcugggcugg

SEQ ID NO: 3799020 - RNA, 14 nt, Human
cagcuucugguacu

SEQ ID NO: 3799021 - RNA, 19 nt, Human
cagcuucugguacucuccu

SEQ ID NO: 3799022 - RNA, 23 nt, Human
cagcuucugguacucuccuagag

SEQ ID NO: 3799023 - RNA, 19 nt, Human
cagcuugaccgugaggcca

SEQ ID NO: 3799024 - RNA, 21 nt, Human
cagcuugaccgugaggccaga

SEQ ID NO: 3799025 - RNA, 15 nt, Human
cagcuugaccugagg

SEQ ID NO: 3799026 - RNA, 16 nt, Human
cagcuugaccugaggc

SEQ ID NO: 3799027 - RNA, 21 nt, Human
cagcuugaccugaggcugugg

SEQ ID NO: 3799028 - RNA, 22 nt, Human
cagcuugaccugaggcuguggu

SEQ ID NO: 3799029 - RNA, 19 nt, Human
cagcuugaggguugggcug

SEQ ID NO: 3799030 - RNA, 21 nt, Human
cagcuugaggguugggcuggu

SEQ ID NO: 3799031 - RNA, 18 nt, Human
cagcuugcacauuuggua

SEQ ID NO: 3799032 - RNA, 16 nt, Human
cagcuugccccggccc

SEQ ID NO: 3799033 - RNA, 17 nt, Human
cagcuugggcagaucuc

SEQ ID NO: 3799034 - RNA, 17 nt, Human
cagcuugggcccagcug

SEQ ID NO: 3799035 - RNA, 20 nt, Human
cagcuugggcccagcugggc

SEQ ID NO: 3799036 - RNA, 21 nt, Human
cagcuuggggccaccaaagcu

SEQ ID NO: 3799037 - RNA, 15 nt, Human
cagcuuguagccagc

SEQ ID NO: 3799038 - RNA, 17 nt, Human
cagcuuguagccagccg

SEQ ID NO: 3799039 - RNA, 21 nt, Human
cagcuuguagccagccggggc

SEQ ID NO: 3799040 - RNA, 15 nt, Human
cagcuuguaggagcu

SEQ ID NO: 3799041 - RNA, 13 nt, Human
cagcuuguauuuu

SEQ ID NO: 3799042 - RNA, 14 nt, Human
cagcuugugcacaa

SEQ ID NO: 3799043 - RNA, 15 nt, Human
cagcuuguggagccc

SEQ ID NO: 3799044 - RNA, 20 nt, Human
cagcuugugugcaaaagcag

SEQ ID NO: 3799045 - RNA, 23 nt, Human
cagcuuguuuuggacuuuguuac

SEQ ID NO: 3799046 - RNA, 17 nt, Human
cagcuuuaaacucaggg

SEQ ID NO: 3799047 - RNA, 21 nt, Human
cagcuuuaaacucagggacag

SEQ ID NO: 3799048 - RNA, 18 nt, Human
cagcuuuacacacacaga

SEQ ID NO: 3799049 - RNA, 15 nt, Human
cagcuuuacaugcaa

SEQ ID NO: 3799050 - RNA, 21 nt, Human
cagcuuuacaugcaauuuauu

SEQ ID NO: 3799051 - RNA, 13 nt, Human
cagcuuuauguuc

SEQ ID NO: 3799052 - RNA, 14 nt, Human
cagcuuucaagugc

SEQ ID NO: 3799053 - RNA, 16 nt, Human
cagcuuucagggccau

SEQ ID NO: 3799054 - RNA, 16 nt, Human
cagcuuucaugauuag

SEQ ID NO: 3799055 - RNA, 13 nt, Human
cagcuuuccagua

SEQ ID NO: 3799056 - RNA, 23 nt, Human
cagcuuuccucaaaacuucagac

SEQ ID NO: 3799057 - RNA, 14 nt, Human
cagcuuuccuguau

SEQ ID NO: 3799058 - RNA, 15 nt, Human
cagcuuucugaccuu

SEQ ID NO: 3799059 - RNA, 21 nt, Human
cagcuuucugaccuucagcuc

SEQ ID NO: 3799060 - RNA, 22 nt, Human
cagcuuucuugcucccuucagc

SEQ ID NO: 3799061 - RNA, 23 nt, Human
cagcuuucuugcucccuucagcc

SEQ ID NO: 3799062 - RNA, 12 nt, Human
cagcuuugcaaa

SEQ ID NO: 3799063 - RNA, 22 nt, Human
cagcuuugcccaacaccagccc

SEQ ID NO: 3799064 - RNA, 20 nt, Human
cagcuuugcucauauuuccc

SEQ ID NO: 3799065 - RNA, 21 nt, Human
cagcuuugcucauauuuccca

SEQ ID NO: 3799066 - RNA, 12 nt, Human
cagcuuuguuug

SEQ ID NO: 3799067 - RNA, 23 nt, Human
cagcuuuguuuguugucagcuga

SEQ ID NO: 3799068 - RNA, 16 nt, Human
cagcuuuuaaccaucu

SEQ ID NO: 3799069 - RNA, 18 nt, Human
cagcuuuuaguacccacc

SEQ ID NO: 3799070 - RNA, 19 nt, Human
cagcuuuuaguacccaccu

SEQ ID NO: 3799071 - RNA, 22 nt, Human
cagcuuuuaguacccaccugag

SEQ ID NO: 3799072 - RNA, 23 nt, Human
cagcuuuuaguacccaccugagc

SEQ ID NO: 3799073 - RNA, 15 nt, Human
cagcuuuucauugcu

SEQ ID NO: 3799074 - RNA, 18 nt, Human
cagcuuuucccaaaagcc

SEQ ID NO: 3799075 - RNA, 16 nt, Human
cagcuuuucucaacug

SEQ ID NO: 3799076 - RNA, 19 nt, Human
cagcuuuuuaaaguggguu

SEQ ID NO: 3799077 - RNA, 13 nt, Human
cagcuuuuugucu

SEQ ID NO: 3799078 - RNA, 19 nt, Human
cagcuuuuugucuuuucug

SEQ ID NO: 3799079 - RNA, 21 nt, Human
caggaaaaaaaaaaaaaagac

SEQ ID NO: 3799080 - RNA, 16 nt, Human
caggaaaaaaacuuuu

SEQ ID NO: 3799081 - RNA, 17 nt, Human
caggaaaaacccgucaa

SEQ ID NO: 3799082 - RNA, 13 nt, Human
caggaaaaagaac

SEQ ID NO: 3799083 - RNA, 14 nt, Human
caggaaaaaggaca

SEQ ID NO: 3799084 - RNA, 22 nt, Human
caggaaaaaggacaggcagaaa

SEQ ID NO: 3799085 - RNA, 16 nt, Human
caggaaaacacccagg

SEQ ID NO: 3799086 - RNA, 20 nt, Human
caggaaaacugacagaggag

SEQ ID NO: 3799087 - RNA, 23 nt, Human
caggaaaacugacagaggagggc

SEQ ID NO: 3799088 - RNA, 18 nt, Human
caggaaaagccucugugu

SEQ ID NO: 3799089 - RNA, 19 nt, Human
caggaaaagccucuguguc

SEQ ID NO: 3799090 - RNA, 15 nt, Human
caggaaaagcugcug

SEQ ID NO: 3799091 - RNA, 16 nt, Human
ccaucacaaacuuaaa

SEQ ID NO: 3799092 - RNA, 15 nt, Human
ccaucacaugaccac

SEQ ID NO: 3799093 - RNA, 12 nt, Human
ccaucacccgcu

SEQ ID NO: 3799094 - RNA, 16 nt, Human
ccaucacccucuuccu

SEQ ID NO: 3799095 - RNA, 20 nt, Human
ccaucacccucuuccuguga

SEQ ID NO: 3799096 - RNA, 16 nt, Human
cccagcccuggcucug

SEQ ID NO: 3799097 - RNA, 18 nt, Human
cccagcccuggcucugca

SEQ ID NO: 3799098 - RNA, 16 nt, Human
cccagcccuguggaag

SEQ ID NO: 3799099 - RNA, 19 nt, Human
cccagcccuuccucugcuc

SEQ ID NO: 3799100 - RNA, 17 nt, Human
cccagccgcugcccggc

SEQ ID NO: 3799101 - RNA, 15 nt, Human
cccagccggccucuc

SEQ ID NO: 3799102 - RNA, 16 nt, Human
cccagccggccucucu

SEQ ID NO: 3799103 - RNA, 21 nt, Human
cccagccucaaauccaggacc

SEQ ID NO: 3799104 - RNA, 12 nt, Human
cccagccucagu

SEQ ID NO: 3799105 - RNA, 22 nt, Human
cccagccucaguccuccccuca

SEQ ID NO: 3799106 - RNA, 20 nt, Human
cccagccuccaagcuccauc

SEQ ID NO: 3799107 - RNA, 18 nt, Human
cccagccucccugaagcc

SEQ ID NO: 3799108 - RNA, 11 nt, Human
cccagccugcg

SEQ ID NO: 3799109 - RNA, 19 nt, Human
cccagccugcgccugcugc

SEQ ID NO: 3799110 - RNA, 12 nt, Human
cccagccugcua

SEQ ID NO: 3799111 - RNA, 16 nt, Human
cccagccugcuagcua

SEQ ID NO: 3799112 - RNA, 18 nt, Human
cccagccuggaugccauc

SEQ ID NO: 3799113 - RNA, 22 nt, Human
cccagccuggccacgcagccag

SEQ ID NO: 3799114 - RNA, 18 nt, Human
cccagccuggcccagcuc

SEQ ID NO: 3799115 - RNA, 19 nt, Human
cccagccuggcccagcucc

SEQ ID NO: 3799116 - RNA, 11 nt, Human
cccagccuggg

SEQ ID NO: 3799117 - RNA, 21 nt, Human
cccagccugggcccaucuccc

SEQ ID NO: 3799118 - RNA, 15 nt, Human
cccagccugggccua

SEQ ID NO: 3799119 - RNA, 16 nt, Human
cccagccugggccuau

SEQ ID NO: 3799120 - RNA, 22 nt, Human
cccagccugucagauccaggag

SEQ ID NO: 3799121 - RNA, 22 nt, Human
cccagccuuuguuccccacugg

SEQ ID NO: 3799122 - RNA, 14 nt, Human
cccagcgagcccug

SEQ ID NO: 3799123 - RNA, 14 nt, Human
cccagcgauucccu

SEQ ID NO: 3799124 - RNA, 21 nt, Human
cccagcgauucccucucccag

SEQ ID NO: 3799125 - RNA, 14 nt, Human
cccagcggacacac

SEQ ID NO: 3799126 - RNA, 20 nt, Human
cccagcggacaguggcagga

SEQ ID NO: 3799127 - RNA, 23 nt, Human
cccagcggacaguggcaggacag

SEQ ID NO: 3799128 - RNA, 14 nt, Human
cccagcggccccuc

SEQ ID NO: 3799129 - RNA, 22 nt, Human
cccagcggcuggugcagggccu

SEQ ID NO: 3799130 - RNA, 17 nt, Human
cccagcuaagaaccugg

SEQ ID NO: 3799131 - RNA, 18 nt, Human
cccagcuaagaaccugga

SEQ ID NO: 3799132 - RNA, 20 nt, Human
cccagcuaagaaccuggaac

SEQ ID NO: 3799133 - RNA, 20 nt, Human
cccagcuaaucuguagggcu

SEQ ID NO: 3799134 - RNA, 14 nt, Human
cccagcuaauuuuu

SEQ ID NO: 3799135 - RNA, 22 nt, Human
cccagcuaccucaaccaaugcc

SEQ ID NO: 3799136 - RNA, 21 nt, Human
cccagcuacucaagaggcuga

SEQ ID NO: 3799137 - RNA, 19 nt, Human
cccagcuacucgggaagcu

SEQ ID NO: 3799138 - RNA, 20 nt, Human
cccagcuacucgggaggcug

SEQ ID NO: 3799139 - RNA, 17 nt, Human
cccagcuacuugggagg

SEQ ID NO: 3799140 - RNA, 22 nt, Human
cccagcuaggaagagcaggacu

SEQ ID NO: 3799141 - RNA, 17 nt, Human
cccagcuauaccugugc

SEQ ID NO: 3799142 - RNA, 11 nt, Human
cccagcucaau

SEQ ID NO: 3799143 - RNA, 14 nt, Human
cccagcucagaggg

SEQ ID NO: 3799144 - RNA, 15 nt, Human
cccagcucagagggu

SEQ ID NO: 3799145 - RNA, 16 nt, Human
cccagcucaggggcag

SEQ ID NO: 3799146 - RNA, 9 nt, Human
cccagcucc

SEQ ID NO: 3799147 - RNA, 13 nt, Human
cccagcuccaggg

SEQ ID NO: 3799148 - RNA, 21 nt, Human
cccagcucucccucuggcccu

SEQ ID NO: 3799149 - RNA, 23 nt, Human
cccagcucucccucuggcccugc

SEQ ID NO: 3799150 - RNA, 11 nt, Human
cccagcucugc

SEQ ID NO: 3799151 - RNA, 13 nt, Human
cccagcucugcuu

SEQ ID NO: 3799152 - RNA, 23 nt, Human
cccagcucugguccauagagagc

SEQ ID NO: 3799153 - RNA, 15 nt, Human
cccagcucuggugag

SEQ ID NO: 3799154 - RNA, 20 nt, Human
cccagcucuucuccccaggu

SEQ ID NO: 3799155 - RNA, 17 nt, Human
cccagcugacauggaaa

SEQ ID NO: 3799156 - RNA, 18 nt, Human
cccagcugcaccccuucc

SEQ ID NO: 3799157 - RNA, 20 nt, Human
cccagcugcaccccuuccug

SEQ ID NO: 3799158 - RNA, 13 nt, Human
cccagcugcucug

SEQ ID NO: 3799159 - RNA, 19 nt, Human
cccagcugcucugcccaga

SEQ ID NO: 3799160 - RNA, 11 nt, Human
cccagcuggga

SEQ ID NO: 3799161 - RNA, 12 nt, Human
cccagcugggag

SEQ ID NO: 3799162 - RNA, 13 nt, Human
cccagcugggagg

SEQ ID NO: 3799163 - RNA, 15 nt, Human
cccagcugggaggca

SEQ ID NO: 3799164 - RNA, 18 nt, Human
cccagcugggaggcaaga

SEQ ID NO: 3799165 - RNA, 12 nt, Human
cccagcugggcu

SEQ ID NO: 3799166 - RNA, 20 nt, Human
cccagcugggcucugccacc

SEQ ID NO: 3799167 - RNA, 22 nt, Human
cccagcuggggccaggcugggu

SEQ ID NO: 3799168 - RNA, 22 nt, Human
cccagcuggugggaagcgucug

SEQ ID NO: 3799169 - RNA, 15 nt, Human
cccagcugucugugu

SEQ ID NO: 3799170 - RNA, 15 nt, Human
cccagcugugagccu

SEQ ID NO: 3799171 - RNA, 19 nt, Human
cccagcugugagccuuggc

SEQ ID NO: 3799172 - RNA, 22 nt, Human
cccagcugugcuuaugguacca

SEQ ID NO: 3799173 - RNA, 22 nt, Human
cccagcuuaaaggggcuagagu

SEQ ID NO: 3799174 - RNA, 17 nt, Human
cccagcuucacuucuga

SEQ ID NO: 3799175 - RNA, 17 nt, Human
cccagcuuguaggagcu

SEQ ID NO: 3799176 - RNA, 18 nt, Human
cccagcuuguaggagcug

SEQ ID NO: 3799177 - RNA, 13 nt, Human
cccagcuuugccc

SEQ ID NO: 3799178 - RNA, 19 nt, Human
cccaggaaaggcaggauug

SEQ ID NO: 3799179 - RNA, 16 nt, Human
cccaggaaaggcccag

SEQ ID NO: 3799180 - RNA, 15 nt, Human
cccaggaaaggcucc

SEQ ID NO: 3799181 - RNA, 16 nt, Human
cccaggaaaggcucca

SEQ ID NO: 3799182 - RNA, 11 nt, Human
cccaggaacaa

SEQ ID NO: 3799183 - RNA, 15 nt, Human
cccaggaacugggcc

SEQ ID NO: 3799184 - RNA, 22 nt, Human
cccaggaaugaagauaccauca

SEQ ID NO: 3799185 - RNA, 22 nt, Human
cccaggaaugccaaggagacau

SEQ ID NO: 3799186 - RNA, 22 nt, Human
cccaggaauggagccugcacgg

SEQ ID NO: 3799187 - RNA, 21 nt, Human
cccaggacaagcaugguccca

SEQ ID NO: 3799188 - RNA, 23 nt, Human
cccaggacaccacacccagccuc

SEQ ID NO: 3799189 - RNA, 20 nt, Human
cccaggaccaagccacagca

SEQ ID NO: 3799190 - RNA, 21 nt, Human
cccaggaccacaggcucaggc

SEQ ID NO: 3799191 - RNA, 12 nt, Human
cccaggaccaga

SEQ ID NO: 3799192 - RNA, 15 nt, Human
cccaggaccagaagc

SEQ ID NO: 3799193 - RNA, 14 nt, Human
cccaggaccagcuc

SEQ ID NO: 3799194 - RNA, 17 nt, Human
cccaggaccagcucagg

SEQ ID NO: 3799195 - RNA, 20 nt, Human
cccaggaccagcucaggaca

SEQ ID NO: 3799196 - RNA, 22 nt, Human
cccaggaccagcucaggacaga

SEQ ID NO: 3799197 - RNA, 19 nt, Human
cccaggaccagcuggggcg

SEQ ID NO: 3799198 - RNA, 20 nt, Human
cccaggaccccauggcagug

SEQ ID NO: 3799199 - RNA, 16 nt, Human
cccaggaccccugagu

SEQ ID NO: 3799200 - RNA, 16 nt, Human
cccaggaccuggcugc

SEQ ID NO: 3799201 - RNA, 19 nt, Human
cccaggacgccacucauuu

SEQ ID NO: 3799202 - RNA, 16 nt, Human
cccaggacgcuucuga

SEQ ID NO: 3799203 - RNA, 17 nt, Human
cccaggacgcuucugaa

SEQ ID NO: 3799204 - RNA, 19 nt, Human
cccaggacgcuucugaaug

SEQ ID NO: 3799205 - RNA, 15 nt, Human
cccaggacggggccg

SEQ ID NO: 3799206 - RNA, 22 nt, Human
cccaggacggggccggccaggu

SEQ ID NO: 3799207 - RNA, 23 nt, Human
cccaggacggggccggccaggug

SEQ ID NO: 3799208 - RNA, 13 nt, Human
cccaggacuccuc

SEQ ID NO: 3799209 - RNA, 15 nt, Human
cccaggacugggcca

SEQ ID NO: 3799210 - RNA, 15 nt, Human
cccaggagacaguuc

SEQ ID NO: 3799211 - RNA, 15 nt, Human
cccaggagagagaaa

SEQ ID NO: 3799212 - RNA, 23 nt, Human
cccaggagagccagcccucccug

SEQ ID NO: 3799213 - RNA, 18 nt, Human
cccaggagcauccaccuc

SEQ ID NO: 3799214 - RNA, 22 nt, Human
cccaggagcauccaccuccuuc

SEQ ID NO: 3799215 - RNA, 18 nt, Human
cccaggagccccgaggcc

SEQ ID NO: 3799216 - RNA, 21 nt, Human
cccaggagccccgaggccuuc

SEQ ID NO: 3799217 - RNA, 19 nt, Human
cccaggagccugcccagcc

SEQ ID NO: 3799218 - RNA, 12 nt, Human
cccaggagcucc

SEQ ID NO: 3799219 - RNA, 21 nt, Human
cccaggaggcagggaggcagc

SEQ ID NO: 3799220 - RNA, 23 nt, Human
cccaggaggcagggaggcagccg

SEQ ID NO: 3799221 - RNA, 10 nt, Human
cccaggaggg

SEQ ID NO: 3799222 - RNA, 14 nt, Human
cccaggagggaggg

SEQ ID NO: 3799223 - RNA, 22 nt, Human
cccaggaggggaacacugcccu

SEQ ID NO: 3799224 - RNA, 17 nt, Human
cccaggaguucugcuca

SEQ ID NO: 3799225 - RNA, 16 nt, Human
cccaggaguuuggcca

SEQ ID NO: 3799226 - RNA, 14 nt, Human
cccaggcaaauaaa

SEQ ID NO: 3799227 - RNA, 15 nt, Human
cccaggcaaauaaaa

SEQ ID NO: 3799228 - RNA, 21 nt, Human
cccaggcaaauaaaauucccu

SEQ ID NO: 3799229 - RNA, 14 nt, Human
cccaggcaggccac

SEQ ID NO: 3799230 - RNA, 11 nt, Human
cccaggcaggg

SEQ ID NO: 3799231 - RNA, 21 nt, Human
cccaggcauuccccaggaggc

SEQ ID NO: 3799232 - RNA, 17 nt, Human
cccaggccaggccacca

SEQ ID NO: 3799233 - RNA, 20 nt, Human
cccaggccaggccaccagga

SEQ ID NO: 3799234 - RNA, 23 nt, Human
cccaggccaggcuccuuccuguc

SEQ ID NO: 3799235 - RNA, 16 nt, Human
cagauuuuaauuguca

SEQ ID NO: 3799236 - RNA, 18 nt, Human
cagauuuuaauugucaug

SEQ ID NO: 3799237 - RNA, 19 nt, Human
cagauuuuaauugucaugg

SEQ ID NO: 3799238 - RNA, 15 nt, Human
cagauuuuaauuuug

SEQ ID NO: 3799239 - RNA, 19 nt, Human
cagauuuuacaaaagaugu

SEQ ID NO: 3799240 - RNA, 12 nt, Human
cagauuuuaguu

SEQ ID NO: 3799241 - RNA, 13 nt, Human
cagauuuuaguuu

SEQ ID NO: 3799242 - RNA, 22 nt, Human
cagauuuuauuauguaaauccc

SEQ ID NO: 3799243 - RNA, 22 nt, Human
cagauuuucagcaaacucuuuu

SEQ ID NO: 3799244 - RNA, 12 nt, Human
cagauuuuccug

SEQ ID NO: 3799245 - RNA, 14 nt, Human
cagauuuuccugaa

SEQ ID NO: 3799246 - RNA, 14 nt, Human
cagauuuuccugug

SEQ ID NO: 3799247 - RNA, 13 nt, Human
cagauuuugauaa

SEQ ID NO: 3799248 - RNA, 20 nt, Human
cagauuuugauaacuguuua

SEQ ID NO: 3799249 - RNA, 23 nt, Human
cagauuuugggguuguguuguca

SEQ ID NO: 3799250 - RNA, 19 nt, Human
ccaucaccuacucacacag

SEQ ID NO: 3799251 - RNA, 21 nt, Human
ccaucaccuacucacacaggc

SEQ ID NO: 3799252 - RNA, 14 nt, Human
ccaucacuggagca

SEQ ID NO: 3799253 - RNA, 18 nt, Human
ccaucacuggagcaccag

SEQ ID NO: 3799254 - RNA, 23 nt, Human
ccaucagaaacacccucacacug

SEQ ID NO: 3799255 - RNA, 22 nt, Human
ccaucagaggacaccuguacug

SEQ ID NO: 3799256 - RNA, 12 nt, Human
ccaucagaugac

SEQ ID NO: 3799257 - RNA, 13 nt, Human
ccaucagccucca

SEQ ID NO: 3799258 - RNA, 21 nt, Human
ccaucagcuuaggggcugcug

SEQ ID NO: 3799259 - RNA, 17 nt, Human
ccaucaggacucuugug

SEQ ID NO: 3799260 - RNA, 20 nt, Human
ccaucaggguaggcuggagu

SEQ ID NO: 3799261 - RNA, 22 nt, Human
ccaucaguguacccccgcccag

SEQ ID NO: 3799262 - RNA, 23 nt, Human
ccaucaguguacccccgcccagg

SEQ ID NO: 3799263 - RNA, 16 nt, Human
ccaucaucaugugugu

SEQ ID NO: 3799264 - RNA, 16 nt, Human
ccaucauccucuggcu

SEQ ID NO: 3799265 - RNA, 19 nt, Human
ccaucauggggggagcacc

SEQ ID NO: 3799266 - RNA, 12 nt, Human
ccaucaugucug

SEQ ID NO: 3799267 - RNA, 13 nt, Human
ccaucaugucugg

SEQ ID NO: 3799268 - RNA, 17 nt, Human
ccaucauugaaaucuuu

SEQ ID NO: 3799269 - RNA, 22 nt, Human
ccaucauugcugucugcagccu

SEQ ID NO: 3799270 - RNA, 12 nt, Human
ccaucauuucug

SEQ ID NO: 3799271 - RNA, 12 nt, Human
ccauccagaggc

SEQ ID NO: 3799272 - RNA, 13 nt, Human
ccauccagcuugc

SEQ ID NO: 3799273 - RNA, 19 nt, Human
ccauccagguucagcuugu

SEQ ID NO: 3799274 - RNA, 16 nt, Human
ccauccauuaggccag

SEQ ID NO: 3799275 - RNA, 17 nt, Human
ccauccauuaggccagc

SEQ ID NO: 3799276 - RNA, 17 nt, Human
ccaucccaaccagugcc

SEQ ID NO: 3799277 - RNA, 18 nt, Human
ccaucccaaccagugcca

SEQ ID NO: 3799278 - RNA, 21 nt, Human
ccaucccaaccagugccaagg

SEQ ID NO: 3799279 - RNA, 13 nt, Human
ccaucccaccucu

SEQ ID NO: 3799280 - RNA, 17 nt, Human
ccaucccacugcucccc

SEQ ID NO: 3799281 - RNA, 15 nt, Human
ccaucccagccccaa

SEQ ID NO: 3799282 - RNA, 14 nt, Human
ccaucccaucccau

SEQ ID NO: 3799283 - RNA, 16 nt, Human
ccaucccaucccaucc

SEQ ID NO: 3799284 - RNA, 17 nt, Human
ccaucccaucccauccc

SEQ ID NO: 3799285 - RNA, 19 nt, Human
ccauccccccucaccaggg

SEQ ID NO: 3799286 - RNA, 20 nt, Human
ccauccccccucaccagggg

SEQ ID NO: 3799287 - RNA, 12 nt, Human
ccaucccccugc

SEQ ID NO: 3799288 - RNA, 13 nt, Human
ccaucccccugcc

SEQ ID NO: 3799289 - RNA, 17 nt, Human
ccauccccuauggacca

SEQ ID NO: 3799290 - RNA, 11 nt, Human
ccauccccucc

SEQ ID NO: 3799291 - RNA, 16 nt, Human
ccauccccuguagagu

SEQ ID NO: 3799292 - RNA, 23 nt, Human
ccauccccuugaggucucagccc

SEQ ID NO: 3799293 - RNA, 15 nt, Human
ccaucccucccucca

SEQ ID NO: 3799294 - RNA, 22 nt, Human
ccaucccucgugguccccaaca

SEQ ID NO: 3799295 - RNA, 16 nt, Human
ccaucccuggcccccu

SEQ ID NO: 3799296 - RNA, 23 nt, Human
ccaucccuggcccccucccugga

SEQ ID NO: 3799297 - RNA, 16 nt, Human
ccauccgccagggccc

SEQ ID NO: 3799298 - RNA, 22 nt, Human
ccauccuaaucauccaaugcuc

SEQ ID NO: 3799299 - RNA, 15 nt, Human
ccauccuaccaaugc

SEQ ID NO: 3799300 - RNA, 19 nt, Human
ccauccuaccaaugcaugc

SEQ ID NO: 3799301 - RNA, 17 nt, Human
ccauccuacccccugug

SEQ ID NO: 3799302 - RNA, 12 nt, Human
ccauccuacccu

SEQ ID NO: 3799303 - RNA, 16 nt, Human
ccauccuacccucggg

SEQ ID NO: 3799304 - RNA, 18 nt, Human
ccauccuacccucgggcc

SEQ ID NO: 3799305 - RNA, 15 nt, Human
ccauccuccagcagg

SEQ ID NO: 3799306 - RNA, 17 nt, Human
ccauccuccagcuucug

SEQ ID NO: 3799307 - RNA, 14 nt, Human
ccauccuccccuuc

SEQ ID NO: 3799308 - RNA, 18 nt, Human
ccauccuccuccuuccua

SEQ ID NO: 3799309 - RNA, 21 nt, Human
ccauccucuguacagagccca

SEQ ID NO: 3799310 - RNA, 16 nt, Human
ccauccucuucuuuua

SEQ ID NO: 3799311 - RNA, 12 nt, Human
ccauccugacug

SEQ ID NO: 3799312 - RNA, 20 nt, Human
ccauccugaggcuccacuug

SEQ ID NO: 3799313 - RNA, 18 nt, Human
ccauccugcagccuccuc

SEQ ID NO: 3799314 - RNA, 22 nt, Human
ccauccugcagccuccuccuga

SEQ ID NO: 3799315 - RNA, 12 nt, Human
ccauccuggccc

SEQ ID NO: 3799316 - RNA, 20 nt, Human
ccauccuggcccagggcauc

SEQ ID NO: 3799317 - RNA, 17 nt, Human
ccauccuggcccaucag

SEQ ID NO: 3799318 - RNA, 16 nt, Human
ccauccugucccacca

SEQ ID NO: 3799319 - RNA, 20 nt, Human
ccauccuucccugucugcca

SEQ ID NO: 3799320 - RNA, 15 nt, Human
ccauccuucccuuug

SEQ ID NO: 3799321 - RNA, 17 nt, Human
ccaucgccagcugauga

SEQ ID NO: 3799322 - RNA, 22 nt, Human
ccaucgccgggacuccagaacc

SEQ ID NO: 3799323 - RNA, 16 nt, Human
ccaucgcuguguguua

SEQ ID NO: 3799324 - RNA, 20 nt, Human
ccaucgcuguguguuaguuc

SEQ ID NO: 3799325 - RNA, 18 nt, Human
ccaucgugaagaagccug

SEQ ID NO: 3799326 - RNA, 20 nt, Human
ccaucgugaagaagccugua

SEQ ID NO: 3799327 - RNA, 14 nt, Human
ccaucuaaacugcc

SEQ ID NO: 3799328 - RNA, 16 nt, Human
ccaucuaagcugcagc

SEQ ID NO: 3799329 - RNA, 15 nt, Human
ccaucuaccccugga

SEQ ID NO: 3799330 - RNA, 20 nt, Human
ccaucuaugucccuugcugu

SEQ ID NO: 3799331 - RNA, 22 nt, Human
ccaucuaugucccuugcuguga

SEQ ID NO: 3799332 - RNA, 15 nt, Human
ccaucucacacauga

SEQ ID NO: 3799333 - RNA, 17 nt, Human
ccaucucacacaugagc

SEQ ID NO: 3799334 - RNA, 20 nt, Human
ccaucucacacaugagcauc

SEQ ID NO: 3799335 - RNA, 21 nt, Human
ccaucucacacaugagcauca

SEQ ID NO: 3799336 - RNA, 21 nt, Human
ccaucucaccuccugcugggc

SEQ ID NO: 3799337 - RNA, 23 nt, Human
ccaucucaccuccugcugggcag

SEQ ID NO: 3799338 - RNA, 21 nt, Human
ccaucucaggccaccugcccc

SEQ ID NO: 3799339 - RNA, 18 nt, Human
ccaucucaggccagagcc

SEQ ID NO: 3799340 - RNA, 14 nt, Human
ccaucuccccucag

SEQ ID NO: 3799341 - RNA, 18 nt, Human
ccaucucccugccuggcc

SEQ ID NO: 3799342 - RNA, 13 nt, Human
ccaucucccugcu

SEQ ID NO: 3799343 - RNA, 22 nt, Human
ccaucucgcucccucccaggac

SEQ ID NO: 3799344 - RNA, 23 nt, Human
ccaucucggagcaucccggagga

SEQ ID NO: 3799345 - RNA, 23 nt, Human
ccaucucuauauaaaaacaaaaa

SEQ ID NO: 3799346 - RNA, 17 nt, Human
ccaucucucccuccccu

SEQ ID NO: 3799347 - RNA, 20 nt, Human
ccaucucucuacuccuaccu

SEQ ID NO: 3799348 - RNA, 13 nt, Human
ccaucucucuggc

SEQ ID NO: 3799349 - RNA, 18 nt, Human
ccaucucugaacuucagc

SEQ ID NO: 3799350 - RNA, 12 nt, Human
ccaucucuggau

SEQ ID NO: 3799351 - RNA, 13 nt, Human
ccaucucuuccua

SEQ ID NO: 3799352 - RNA, 19 nt, Human
ccaucugcaccccccuggg

SEQ ID NO: 3799353 - RNA, 17 nt, Human
ccaucugcaccccuucu

SEQ ID NO: 3799354 - RNA, 17 nt, Human
ccaucugcauucccagc

SEQ ID NO: 3799355 - RNA, 12 nt, Human
ccaucugcccag

SEQ ID NO: 3799356 - RNA, 19 nt, Human
ccaucugccccacagucuc

SEQ ID NO: 3799357 - RNA, 21 nt, Human
ccaucugcgggggcagugcuc

SEQ ID NO: 3799358 - RNA, 11 nt, Human
ccaucugcucc

SEQ ID NO: 3799359 - RNA, 12 nt, Human
ccaucugcuccu

SEQ ID NO: 3799360 - RNA, 15 nt, Human
ccaucugcuccugga

SEQ ID NO: 3799361 - RNA, 23 nt, Human
ccaucugcuuuuauuaaauuugu

SEQ ID NO: 3799362 - RNA, 19 nt, Human
ccaucuggagagcccagag

SEQ ID NO: 3799363 - RNA, 22 nt, Human
ccaucuggagagcccagagucc

SEQ ID NO: 3799364 - RNA, 14 nt, Human
ccaucuggcagggu

SEQ ID NO: 3799365 - RNA, 22 nt, Human
ccaucuggccuggccuggcccu

SEQ ID NO: 3799366 - RNA, 22 nt, Human
ccaucugggaguccccuuuucu

SEQ ID NO: 3799367 - RNA, 17 nt, Human
ccaucuggguccuugca

SEQ ID NO: 3799368 - RNA, 18 nt, Human
ccaucuggguccuugcac

SEQ ID NO: 3799369 - RNA, 23 nt, Human
ccaucuggguccuugcaccccuc

SEQ ID NO: 3799370 - RNA, 22 nt, Human
ccaucugguuaggauggcagga

SEQ ID NO: 3799371 - RNA, 22 nt, Human
ccaucugugggcacgcuguggg

SEQ ID NO: 3799372 - RNA, 15 nt, Human
ccaucuguguccugg

SEQ ID NO: 3799373 - RNA, 16 nt, Human
ccaucuuaaaaacaac

SEQ ID NO: 3799374 - RNA, 14 nt, Human
ccaucuucacccag

SEQ ID NO: 3799375 - RNA, 16 nt, Human
ccaucuucacccaggc

SEQ ID NO: 3799376 - RNA, 16 nt, Human
ccaucuuccagguggg

SEQ ID NO: 3799377 - RNA, 20 nt, Human
ccaucuuuacucccaagacu

SEQ ID NO: 3799378 - RNA, 20 nt, Human
ccaucuuuuuaaccucuguu

SEQ ID NO: 3799379 - RNA, 17 nt, Human
cccaguguuguuuguaa

SEQ ID NO: 3799380 - RNA, 14 nt, Human
cccaguucacccug

SEQ ID NO: 3799381 - RNA, 15 nt, Human
cccaguucugcuccu

SEQ ID NO: 3799382 - RNA, 20 nt, Human
cccaguucugcuccucucca

SEQ ID NO: 3799383 - RNA, 23 nt, Human
cccaguucugcuccucuccaggc

SEQ ID NO: 3799384 - RNA, 20 nt, Human
cccaguugcacucaggugac

SEQ ID NO: 3799385 - RNA, 15 nt, Human
cccaguuggagcucc

SEQ ID NO: 3799386 - RNA, 21 nt, Human
cccaguuggagcuccagccug

SEQ ID NO: 3799387 - RNA, 22 nt, Human
cccaguuucuaaacuggagacu

SEQ ID NO: 3799388 - RNA, 17 nt, Human
cccaguuucugccucug

SEQ ID NO: 3799389 - RNA, 19 nt, Human
cccaguuuuguugccccag

SEQ ID NO: 3799390 - RNA, 18 nt, Human
cccauaaaaauuuuuccu

SEQ ID NO: 3799391 - RNA, 14 nt, Human
cccauaacucaaug

SEQ ID NO: 3799392 - RNA, 16 nt, Human
cccauacaaauaagca

SEQ ID NO: 3799393 - RNA, 13 nt, Human
cccauacucagcc

SEQ ID NO: 3799394 - RNA, 14 nt, Human
cccauacucagccu

SEQ ID NO: 3799395 - RNA, 17 nt, Human
cccauagaaacaugaca

SEQ ID NO: 3799396 - RNA, 20 nt, Human
cccauagauacucucuucuu

SEQ ID NO: 3799397 - RNA, 16 nt, Human
cccauagaucuucuga

SEQ ID NO: 3799398 - RNA, 17 nt, Human
cccauagaucuucugaa

SEQ ID NO: 3799399 - RNA, 17 nt, Human
cccauaggcccacacac

SEQ ID NO: 3799400 - RNA, 20 nt, Human
cccauaggcccacacacagg

SEQ ID NO: 3799401 - RNA, 20 nt, Human
cccauaugcuaccaccagcu

SEQ ID NO: 3799402 - RNA, 23 nt, Human
cccauauuggcauggauuucugu

SEQ ID NO: 3799403 - RNA, 15 nt, Human
cccauauuguaaaac

SEQ ID NO: 3799404 - RNA, 14 nt, Human
cagauuuuuacaaa

SEQ ID NO: 3799405 - RNA, 22 nt, Human
cagauuuuuauauuaguugcuu

SEQ ID NO: 3799406 - RNA, 18 nt, Human
cagcaaaaaaguccaauu

SEQ ID NO: 3799407 - RNA, 14 nt, Human
cagcaaaaagcaaa

SEQ ID NO: 3799408 - RNA, 18 nt, Human
cagcaaaaauauaaaaua

SEQ ID NO: 3799409 - RNA, 20 nt, Human
cagcaaaaccauugcuucac

SEQ ID NO: 3799410 - RNA, 15 nt, Human
cagcaaacacuccac

SEQ ID NO: 3799411 - RNA, 15 nt, Human
cagcaaaccaagaga

SEQ ID NO: 3799412 - RNA, 16 nt, Human
cagcaaaccaagagau

SEQ ID NO: 3799413 - RNA, 23 nt, Human
cagcaaaccaagagauugcuaau

SEQ ID NO: 3799414 - RNA, 21 nt, Human
cagcaaaccuaauugcacaac

SEQ ID NO: 3799415 - RNA, 15 nt, Human
cagcaaagaaaaaaa

SEQ ID NO: 3799416 - RNA, 21 nt, Human
cagcaaagaggacucgcuugu

SEQ ID NO: 3799417 - RNA, 13 nt, Human
cagcaaagccccc

SEQ ID NO: 3799418 - RNA, 13 nt, Human
cagcaaaugcaaa

SEQ ID NO: 3799419 - RNA, 22 nt, Human
cagcaaauuaauuggcagcaga

SEQ ID NO: 3799420 - RNA, 23 nt, Human
cagcaaauuaauuggcagcagau

SEQ ID NO: 3799421 - RNA, 13 nt, Human
cagcaaauuuuca

SEQ ID NO: 3799422 - RNA, 14 nt, Human
cagcaacacagagc

SEQ ID NO: 3799423 - RNA, 14 nt, Human
cagcaacacagccu

SEQ ID NO: 3799424 - RNA, 18 nt, Human
cagcaacacagccugggc

SEQ ID NO: 3799425 - RNA, 14 nt, Human
cagcaaccagagca

SEQ ID NO: 3799426 - RNA, 19 nt, Human
cagcaaccagagcacugua

SEQ ID NO: 3799427 - RNA, 16 nt, Human
cagcaaccccaggcug

SEQ ID NO: 3799428 - RNA, 14 nt, Human
cagcaacccuccua

SEQ ID NO: 3799429 - RNA, 16 nt, Human
cagcaacgaucacaaa

SEQ ID NO: 3799430 - RNA, 19 nt, Human
cagcaacgaucacaaauga

SEQ ID NO: 3799431 - RNA, 18 nt, Human
cagcaacgcuuguagaac

SEQ ID NO: 3799432 - RNA, 20 nt, Human
cagcaacggcacagcuaauu

SEQ ID NO: 3799433 - RNA, 14 nt, Human
cagcaacuccaacu

SEQ ID NO: 3799434 - RNA, 23 nt, Human
cagcaacuuguccuagcacagau

SEQ ID NO: 3799435 - RNA, 13 nt, Human
cagcaagaaaaaa

SEQ ID NO: 3799436 - RNA, 17 nt, Human
cagcaagaaaaaaaaau

SEQ ID NO: 3799437 - RNA, 22 nt, Human
cagcaagaagauccuaaaacaa

SEQ ID NO: 3799438 - RNA, 14 nt, Human
cagcaagaauaaaa

SEQ ID NO: 3799439 - RNA, 23 nt, Human
cagcaagacuucucuuugccuca

SEQ ID NO: 3799440 - RNA, 21 nt, Human
cagcaagcccuacagagcugu

SEQ ID NO: 3799441 - RNA, 20 nt, Human
cagcaagccgaauagcugau

SEQ ID NO: 3799442 - RNA, 17 nt, Human
cagcaaggagauuuaca

SEQ ID NO: 3799443 - RNA, 18 nt, Human
cagcaaggaggcuggcug

SEQ ID NO: 3799444 - RNA, 19 nt, Human
cagcaaggaggcuggcugg

SEQ ID NO: 3799445 - RNA, 16 nt, Human
cagcaaggcaccugca

SEQ ID NO: 3799446 - RNA, 20 nt, Human
cagcaaggccaccucuuccu

SEQ ID NO: 3799447 - RNA, 15 nt, Human
cagcaaggcccgagc

SEQ ID NO: 3799448 - RNA, 20 nt, Human
cagcaaggcccgagcagcug

SEQ ID NO: 3799449 - RNA, 22 nt, Human
cagcaaggcccgagcagcugag

SEQ ID NO: 3799450 - RNA, 19 nt, Human
cagcaaggcccugcugccc

SEQ ID NO: 3799451 - RNA, 18 nt, Human
cagcaaggcgcuaacuug

SEQ ID NO: 3799452 - RNA, 17 nt, Human
cagcaaggggcucugcc

SEQ ID NO: 3799453 - RNA, 22 nt, Human
cagcaagggugaugggaaagca

SEQ ID NO: 3799454 - RNA, 14 nt, Human
cagcaagguggagu

SEQ ID NO: 3799455 - RNA, 16 nt, Human
cagcaagugagagcug

SEQ ID NO: 3799456 - RNA, 21 nt, Human
cagcaagugagagcugggugu

SEQ ID NO: 3799457 - RNA, 14 nt, Human
cagcaagugguccu

SEQ ID NO: 3799458 - RNA, 23 nt, Human
cagcaaguuagaacuagccaaac

SEQ ID NO: 3799459 - RNA, 17 nt, Human
cagcaaguucacaugga

SEQ ID NO: 3799460 - RNA, 18 nt, Human
cagcaaugacaucucagg

SEQ ID NO: 3799461 - RNA, 20 nt, Human
cagcaaugacaucucagggg

SEQ ID NO: 3799462 - RNA, 21 nt, Human
cagcaaugacaucucaggggc

SEQ ID NO: 3799463 - RNA, 20 nt, Human
cagcaaugauguccagaaga

SEQ ID NO: 3799464 - RNA, 16 nt, Human
cagcaauuaugaaaau

SEQ ID NO: 3799465 - RNA, 13 nt, Human
cagcacaaggcca

SEQ ID NO: 3799466 - RNA, 13 nt, Human
cagcacacagggc

SEQ ID NO: 3799467 - RNA, 15 nt, Human
cagcacacagggcag

SEQ ID NO: 3799468 - RNA, 18 nt, Human
cagcacacagggcaguga

SEQ ID NO: 3799469 - RNA, 14 nt, Human
cagcacagagaaga

SEQ ID NO: 3799470 - RNA, 16 nt, Human
cagcacagagaccccc

SEQ ID NO: 3799471 - RNA, 12 nt, Human
cagcacagagag

SEQ ID NO: 3799472 - RNA, 17 nt, Human
cagcacagagagggggc

SEQ ID NO: 3799473 - RNA, 13 nt, Human
cagcacagcaagg

SEQ ID NO: 3799474 - RNA, 21 nt, Human
cagcacagcaaggaggcuggc

SEQ ID NO: 3799475 - RNA, 16 nt, Human
cagcacagcucccugc

SEQ ID NO: 3799476 - RNA, 24 nt, Human
cagcacauaggguucccacgaagc

SEQ ID NO: 3799477 - RNA, 18 nt, Human
cagcacaugcuggccagc

SEQ ID NO: 3799478 - RNA, 15 nt, Human
cagcaccaaaucaaa

SEQ ID NO: 3799479 - RNA, 15 nt, Human
cagcaccaccagguc

SEQ ID NO: 3799480 - RNA, 13 nt, Human
cagcaccacccua

SEQ ID NO: 3799481 - RNA, 21 nt, Human
cagcaccacucaagaccaaau

SEQ ID NO: 3799482 - RNA, 22 nt, Human
cagcaccacucaagaccaaaug

SEQ ID NO: 3799483 - RNA, 17 nt, Human
cagcaccaucucuccuc

SEQ ID NO: 3799484 - RNA, 19 nt, Human
cagcaccaucucuccuccu

SEQ ID NO: 3799485 - RNA, 14 nt, Human
cagcacccccacgc

SEQ ID NO: 3799486 - RNA, 15 nt, Human
cagcaccccuuccau

SEQ ID NO: 3799487 - RNA, 23 nt, Human
cagcaccccuuccauguggagaa

SEQ ID NO: 3799488 - RNA, 16 nt, Human
cagcacccuauaaauc

SEQ ID NO: 3799489 - RNA, 17 nt, Human
cagcaccgaggggccuu

SEQ ID NO: 3799490 - RNA, 15 nt, Human
cagcaccgccucuuc

SEQ ID NO: 3799491 - RNA, 18 nt, Human
cagcaccggaccagccug

SEQ ID NO: 3799492 - RNA, 12 nt, Human
cagcaccuccuc

SEQ ID NO: 3799493 - RNA, 15 nt, Human
cagcaccugccuccu

SEQ ID NO: 3799494 - RNA, 20 nt, Human
cagcaccuguaagaaacaga

SEQ ID NO: 3799495 - RNA, 18 nt, Human
cagcaccuugugccuggg

SEQ ID NO: 3799496 - RNA, 18 nt, Human
cagcacgauuucuguuua

SEQ ID NO: 3799497 - RNA, 19 nt, Human
cagcacgauuucuguuuag

SEQ ID NO: 3799498 - RNA, 13 nt, Human
cagcacgggggcc

SEQ ID NO: 3799499 - RNA, 16 nt, Human
cagcacguguggccug

SEQ ID NO: 3799500 - RNA, 17 nt, Human
cagcacuagccaaaccu

SEQ ID NO: 3799501 - RNA, 11 nt, Human
cagcacugaaa

SEQ ID NO: 3799502 - RNA, 12 nt, Human
cagcacugagga

SEQ ID NO: 3799503 - RNA, 13 nt, Human
cagcacugaggaa

SEQ ID NO: 3799504 - RNA, 15 nt, Human
cagcacugccugcuc

SEQ ID NO: 3799505 - RNA, 14 nt, Human
cagcacuggcucuc

SEQ ID NO: 3799506 - RNA, 18 nt, Human
cagcacuggcucucucca

SEQ ID NO: 3799507 - RNA, 21 nt, Human
cagcacuggcucucuccagga

SEQ ID NO: 3799508 - RNA, 14 nt, Human
cagcacugucccuu

SEQ ID NO: 3799509 - RNA, 23 nt, Human
cagcacugucucaguuucacuuu

SEQ ID NO: 3799510 - RNA, 12 nt, Human
cagcacuuccau

SEQ ID NO: 3799511 - RNA, 13 nt, Human
cagcacuuccaug

SEQ ID NO: 3799512 - RNA, 23 nt, Human
cagcacuuggggguucaggcccg

SEQ ID NO: 3799513 - RNA, 18 nt, Human
cagcacuuguccagcuga

SEQ ID NO: 3799514 - RNA, 14 nt, Human
cagcacuuuagaau

SEQ ID NO: 3799515 - RNA, 15 nt, Human
cagcacuuugggagg

SEQ ID NO: 3799516 - RNA, 18 nt, Human
cagcacuuugggaggcca

SEQ ID NO: 3799517 - RNA, 23 nt, Human
cagcacuuugggaggccaaggag

SEQ ID NO: 3799518 - RNA, 18 nt, Human
cagcacuuugggaggccu

SEQ ID NO: 3799519 - RNA, 22 nt, Human
cagcacuuugggaggccuaggc

SEQ ID NO: 3799520 - RNA, 17 nt, Human
cagcacuuugggaggcu

SEQ ID NO: 3799521 - RNA, 22 nt, Human
cagcagaaaacuugugugaaau

SEQ ID NO: 3799522 - RNA, 17 nt, Human
cagcagaaaugccuuac

SEQ ID NO: 3799523 - RNA, 19 nt, Human
cagcagaaaugccuuaccc

SEQ ID NO: 3799524 - RNA, 18 nt, Human
aaaguggccucuuugucu

SEQ ID NO: 3799525 - RNA, 21 nt, Human
aaagugggaggucaggaaacu

SEQ ID NO: 3799526 - RNA, 12 nt, Human
aaaguggugaga

SEQ ID NO: 3799527 - RNA, 19 nt, Human
aaaguggugcucaguugua

SEQ ID NO: 3799528 - RNA, 22 nt, Human
aaaguggugcucaguuguagaa

SEQ ID NO: 3799529 - RNA, 14 nt, Human
aaagugguuguuag

SEQ ID NO: 3799530 - RNA, 16 nt, Human
aaaguguaaagcauuc

SEQ ID NO: 3799531 - RNA, 15 nt, Human
aaaguguauuuggaa

SEQ ID NO: 3799532 - RNA, 16 nt, Human
aaaguguccauugaca

SEQ ID NO: 3799533 - RNA, 23 nt, Human
aaaguguccauugacauguacag

SEQ ID NO: 3799534 - RNA, 13 nt, Human
aaagugugcuuua

SEQ ID NO: 3799535 - RNA, 22 nt, Human
aaagugugcuuuaugcugaaac

SEQ ID NO: 3799536 - RNA, 23 nt, Human
aaagugugcuuuaugcugaaaca

SEQ ID NO: 3799537 - RNA, 19 nt, Human
aaaguguguauauauuuug

SEQ ID NO: 3799538 - RNA, 20 nt, Human
aaaguguguauauauuuugu

SEQ ID NO: 3799539 - RNA, 15 nt, Human
aaaguguguauuaaa

SEQ ID NO: 3799540 - RNA, 17 nt, Human
aaaguguguuguugcuu

SEQ ID NO: 3799541 - RNA, 11 nt, Human
aaaguguuacu

SEQ ID NO: 3799542 - RNA, 16 nt, Human
aaaguguucuguuaca

SEQ ID NO: 3799543 - RNA, 18 nt, Human
aaaguguucuguuacaaa

SEQ ID NO: 3799544 - RNA, 19 nt, Human
aaaguguucuguuacaaaa

SEQ ID NO: 3799545 - RNA, 20 nt, Human
aaaguguucuguuacaaaau

SEQ ID NO: 3799546 - RNA, 21 nt, Human
aaaguguuuauuuuucauauu

SEQ ID NO: 3799547 - RNA, 21 nt, Human
aaaguguuuucucugaacaca

SEQ ID NO: 3799548 - RNA, 23 nt, Human
aaaguguuuucucugaacacauu

SEQ ID NO: 3799549 - RNA, 20 nt, Human
aaaguguuuuguaccaguga

SEQ ID NO: 3799550 - RNA, 22 nt, Human
aaaguuaaaaaaaauaauaaau

SEQ ID NO: 3799551 - RNA, 12 nt, Human
aaaguuaaaagu

SEQ ID NO: 3799552 - RNA, 22 nt, Human
aaaguuaacaggcaaacauuuu

SEQ ID NO: 3799553 - RNA, 16 nt, Human
aaaguuaaucuucaug

SEQ ID NO: 3799554 - RNA, 17 nt, Human
aaaguuacagaaauacu

SEQ ID NO: 3799555 - RNA, 20 nt, Human
aaaguuagaaucuauuuucu

SEQ ID NO: 3799556 - RNA, 18 nt, Human
aaaguuaguaucuuuuga

SEQ ID NO: 3799557 - RNA, 21 nt, Human
aaaguuaguaucuuuugauau

SEQ ID NO: 3799558 - RNA, 23 nt, Human
aaaguuagucuacucuuaagcca

SEQ ID NO: 3799559 - RNA, 22 nt, Human
ccaugagaauaagagaaagaaa

SEQ ID NO: 3799560 - RNA, 22 nt, Human
ccaugagaauguuuuagcacag

SEQ ID NO: 3799561 - RNA, 13 nt, Human
ccaugagccucag

SEQ ID NO: 3799562 - RNA, 18 nt, Human
ccaugagccucagcaucc

SEQ ID NO: 3799563 - RNA, 19 nt, Human
ccaugagccucagcauccu

SEQ ID NO: 3799564 - RNA, 15 nt, Human
ccaugagcuccagac

SEQ ID NO: 3799565 - RNA, 19 nt, Human
ccaugagcuccagaccccc

SEQ ID NO: 3799566 - RNA, 21 nt, Human
ccaugagcuccuuaaggcucu

SEQ ID NO: 3799567 - RNA, 22 nt, Human
ccaugaggagaaaaaaagcaug

SEQ ID NO: 3799568 - RNA, 15 nt, Human
ccaugaggccucagu

SEQ ID NO: 3799569 - RNA, 18 nt, Human
ccaugagggagaugccau

SEQ ID NO: 3799570 - RNA, 15 nt, Human
ccaugaguccccugu

SEQ ID NO: 3799571 - RNA, 18 nt, Human
ccaugaguccccuguuug

SEQ ID NO: 3799572 - RNA, 21 nt, Human
ccaugaguuggggucuggcag

SEQ ID NO: 3799573 - RNA, 16 nt, Human
ccaugaucccuguguu

SEQ ID NO: 3799574 - RNA, 19 nt, Human
ccaugauggcaacagaucu

SEQ ID NO: 3799575 - RNA, 18 nt, Human
ccaugauguagugccucu

SEQ ID NO: 3799576 - RNA, 15 nt, Human
ccaugauguggagug

SEQ ID NO: 3799577 - RNA, 14 nt, Human
ccaugauucgccca

SEQ ID NO: 3799578 - RNA, 23 nt, Human
ccaugauucuauuuauauguaca

SEQ ID NO: 3799579 - RNA, 22 nt, Human
ccaugauuucauguacugcauu

SEQ ID NO: 3799580 - RNA, 22 nt, Human
ccaugcaagaacucaucacugu

SEQ ID NO: 3799581 - RNA, 15 nt, Human
ccaugcaagcagagg

SEQ ID NO: 3799582 - RNA, 17 nt, Human
ccaugcaagcagaggac

SEQ ID NO: 3799583 - RNA, 23 nt, Human
ccaugcaagcagaggaccagggc

SEQ ID NO: 3799584 - RNA, 18 nt, Human
ccaugcaauauuuccuca

SEQ ID NO: 3799585 - RNA, 21 nt, Human
ccaugcacccucauacacaga

SEQ ID NO: 3799586 - RNA, 13 nt, Human
ccaugcacuguga

SEQ ID NO: 3799587 - RNA, 21 nt, Human
ccaugcacugugaaggacccu

SEQ ID NO: 3799588 - RNA, 11 nt, Human
ccaugcagaaa

SEQ ID NO: 3799589 - RNA, 18 nt, Human
ccaugcaugacagccucu

SEQ ID NO: 3799590 - RNA, 20 nt, Human
ccaugcauuucauaaacuaa

SEQ ID NO: 3799591 - RNA, 21 nt, Human
ccaugccacguuccacaguug

SEQ ID NO: 3799592 - RNA, 14 nt, Human
ccaugccagcuggc

SEQ ID NO: 3799593 - RNA, 16 nt, Human
ccaugcccaccugccc

SEQ ID NO: 3799594 - RNA, 17 nt, Human
ccaugcccaccugccca

SEQ ID NO: 3799595 - RNA, 18 nt, Human
ccaugcccagcucagagg

SEQ ID NO: 3799596 - RNA, 21 nt, Human
ccaugcccggcuaauuuuugu

SEQ ID NO: 3799597 - RNA, 21 nt, Human
ccaugccucagcccugacccu

SEQ ID NO: 3799598 - RNA, 13 nt, Human
ccaugccugaggg

SEQ ID NO: 3799599 - RNA, 17 nt, Human
ccaugccugagggugga

SEQ ID NO: 3799600 - RNA, 18 nt, Human
ccaugccugaggguggag

SEQ ID NO: 3799601 - RNA, 22 nt, Human
ccaugccugccccccucaucuc

SEQ ID NO: 3799602 - RNA, 14 nt, Human
ccaugccuguccag

SEQ ID NO: 3799603 - RNA, 13 nt, Human
ccaugccuguggc

SEQ ID NO: 3799604 - RNA, 14 nt, Human
ccaugccuguggcu

SEQ ID NO: 3799605 - RNA, 16 nt, Human
ccaugccuguggcugc

SEQ ID NO: 3799606 - RNA, 16 nt, Human
ccaugccuuaaaccua

SEQ ID NO: 3799607 - RNA, 13 nt, Human
ccaugcgcucagg

SEQ ID NO: 3799608 - RNA, 18 nt, Human
ccaugcucaucugcuggu

SEQ ID NO: 3799609 - RNA, 16 nt, Human
ccaugcuccucacugc

SEQ ID NO: 3799610 - RNA, 15 nt, Human
ccaugcuccucuucc

SEQ ID NO: 3799611 - RNA, 18 nt, Human
ccaugcuccucuucccca

SEQ ID NO: 3799612 - RNA, 20 nt, Human
ccaugcuccucuuccccaga

SEQ ID NO: 3799613 - RNA, 15 nt, Human
ccaugcuccuggccc

SEQ ID NO: 3799614 - RNA, 14 nt, Human
ccaugcugcccugu

SEQ ID NO: 3799615 - RNA, 16 nt, Human
ccaugcugcccuguga

SEQ ID NO: 3799616 - RNA, 20 nt, Human
ccaugcugcuggggaagaca

SEQ ID NO: 3799617 - RNA, 22 nt, Human
ccaugcugcuggggaagacagu

SEQ ID NO: 3799618 - RNA, 23 nt, Human
ccaugcugcuggggaagacagug

SEQ ID NO: 3799619 - RNA, 12 nt, Human
ccaugcuggagc

SEQ ID NO: 3799620 - RNA, 13 nt, Human
ccaugcuggagcc

SEQ ID NO: 3799621 - RNA, 15 nt, Human
ccaugcuggagccug

SEQ ID NO: 3799622 - RNA, 17 nt, Human
ccaugcuggagccugug

SEQ ID NO: 3799623 - RNA, 19 nt, Human
ccaugcuggagccugugua

SEQ ID NO: 3799624 - RNA, 18 nt, Human
ccaugcugucuggcacag

SEQ ID NO: 3799625 - RNA, 21 nt, Human
ccaugcugucuggcacagccu

SEQ ID NO: 3799626 - RNA, 21 nt, Human
ccaugcuguugauugcuaaau

SEQ ID NO: 3799627 - RNA, 22 nt, Human
ccaugcuguugauugcuaaaug

SEQ ID NO: 3799628 - RNA, 24 nt, Human
ccaugcuguugauugcuaaaugua

SEQ ID NO: 3799629 - RNA, 17 nt, Human
ccaugcuuagucacugc

SEQ ID NO: 3799630 - RNA, 21 nt, Human
ccaugcuuagucacugccugc

SEQ ID NO: 3799631 - RNA, 22 nt, Human
ccaugcuuagucacugccugca

SEQ ID NO: 3799632 - RNA, 22 nt, Human
ccaugcuucucaucuugugaaa

SEQ ID NO: 3799633 - RNA, 17 nt, Human
ccauggaacuguuuccu

SEQ ID NO: 3799634 - RNA, 21 nt, Human
ccauggaagaggcuacagggc

SEQ ID NO: 3799635 - RNA, 23 nt, Human
ccauggaagaggcuacagggcca

SEQ ID NO: 3799636 - RNA, 14 nt, Human
ccauggaaugcuug

SEQ ID NO: 3799637 - RNA, 15 nt, Human
ccauggaaugcuuga

SEQ ID NO: 3799638 - RNA, 15 nt, Human
ccauggacaggcugg

SEQ ID NO: 3799639 - RNA, 19 nt, Human
ccauggacaggcuggcucc

SEQ ID NO: 3799640 - RNA, 21 nt, Human
ccauggacucuguccugaagg

SEQ ID NO: 3799641 - RNA, 13 nt, Human
ccauggacuuugu

SEQ ID NO: 3799642 - RNA, 15 nt, Human
ccauggagaaagcug

SEQ ID NO: 3799643 - RNA, 18 nt, Human
ccauggagagcuggagcc

SEQ ID NO: 3799644 - RNA, 14 nt, Human
ccauggagccagcu

SEQ ID NO: 3799645 - RNA, 13 nt, Human
ccauggagcccca

SEQ ID NO: 3799646 - RNA, 15 nt, Human
ccauggagccccagc

SEQ ID NO: 3799647 - RNA, 13 nt, Human
ccauggaggcaca

SEQ ID NO: 3799648 - RNA, 20 nt, Human
ccauggaggcacacagcugc

SEQ ID NO: 3799649 - RNA, 18 nt, Human
ccauggagggggcuugca

SEQ ID NO: 3799650 - RNA, 22 nt, Human
ccauggaguggcagcccagcca

SEQ ID NO: 3799651 - RNA, 13 nt, Human
ccauggccagcag

SEQ ID NO: 3799652 - RNA, 20 nt, Human
ccauggccagcagcaccugc

SEQ ID NO: 3799653 - RNA, 21 nt, Human
ccauggccagcagcaccugcc

SEQ ID NO: 3799654 - RNA, 14 nt, Human
ccauggcccugugc

SEQ ID NO: 3799655 - RNA, 21 nt, Human
ccauggccggcuuucaggagc

SEQ ID NO: 3799656 - RNA, 22 nt, Human
ccauggccggcuuucaggagcu

SEQ ID NO: 3799657 - RNA, 21 nt, Human
ccauggcgugucccucucgga

SEQ ID NO: 3799658 - RNA, 20 nt, Human
ccauggcuuccaaggugguc

SEQ ID NO: 3799659 - RNA, 15 nt, Human
ccaugggaccaaacc

SEQ ID NO: 3799660 - RNA, 21 nt, Human
ccaugggaccaaaccuagccc

SEQ ID NO: 3799661 - RNA, 15 nt, Human
ccaugggaccacaac

SEQ ID NO: 3799662 - RNA, 19 nt, Human
ccaugggaggccuuucccu

SEQ ID NO: 3799663 - RNA, 13 nt, Human
ccaugggauaaau

SEQ ID NO: 3799664 - RNA, 17 nt, Human
ccaugggauaaaugcca

SEQ ID NO: 3799665 - RNA, 16 nt, Human
ccaugggcacugcugg

SEQ ID NO: 3799666 - RNA, 14 nt, Human
ccaugggcagagcc

SEQ ID NO: 3799667 - RNA, 14 nt, Human
ccccucuuccucuu

SEQ ID NO: 3799668 - RNA, 18 nt, Human
ccccucuugccccaaccc

SEQ ID NO: 3799669 - RNA, 23 nt, Human
ccccucuuggagaagucucagcu

SEQ ID NO: 3799670 - RNA, 14 nt, Human
ccccucuuucucuu

SEQ ID NO: 3799671 - RNA, 18 nt, Human
ccccucuuucucuuucuu

SEQ ID NO: 3799672 - RNA, 16 nt, Human
ccccugaaacuuauuu

SEQ ID NO: 3799673 - RNA, 17 nt, Human
ccccugaaacuuauuuu

SEQ ID NO: 3799674 - RNA, 17 nt, Human
ccccugaauuuaaauag

SEQ ID NO: 3799675 - RNA, 20 nt, Human
ccccugaccugugagcccag

SEQ ID NO: 3799676 - RNA, 21 nt, Human
ccccugagacaaauggaggcc

SEQ ID NO: 3799677 - RNA, 18 nt, Human
ccccugagcaaugucugu

SEQ ID NO: 3799678 - RNA, 12 nt, Human
ccccugagccca

SEQ ID NO: 3799679 - RNA, 13 nt, Human
ccccugagcccca

SEQ ID NO: 3799680 - RNA, 16 nt, Human
ccccugcaaagcccag

SEQ ID NO: 3799681 - RNA, 21 nt, Human
ccccugcaaagcccagcuuga

SEQ ID NO: 3799682 - RNA, 13 nt, Human
ccccugcacucca

SEQ ID NO: 3799683 - RNA, 18 nt, Human
ccccugcacuccagccug

SEQ ID NO: 3799684 - RNA, 11 nt, Human
ccccugcacug

SEQ ID NO: 3799685 - RNA, 18 nt, Human
ccccugcacuguaaaaug

SEQ ID NO: 3799686 - RNA, 13 nt, Human
ccccugcagcccu

SEQ ID NO: 3799687 - RNA, 23 nt, Human
ccccugcagcuuguagccagccg

SEQ ID NO: 3799688 - RNA, 14 nt, Human
ccccugcaggaagg

SEQ ID NO: 3799689 - RNA, 15 nt, Human
ccccugcaggaagga

SEQ ID NO: 3799690 - RNA, 21 nt, Human
ccccugcaggaaggagcugcc

SEQ ID NO: 3799691 - RNA, 20 nt, Human
ccccugcaguuccccuggaa

SEQ ID NO: 3799692 - RNA, 12 nt, Human
ccccugccacca

SEQ ID NO: 3799693 - RNA, 16 nt, Human
ccccugccagugccuu

SEQ ID NO: 3799694 - RNA, 17 nt, Human
ccccugccagugccuua

SEQ ID NO: 3799695 - RNA, 14 nt, Human
ccccugcccaucug

SEQ ID NO: 3799696 - RNA, 12 nt, Human
ccccugccccca

SEQ ID NO: 3799697 - RNA, 16 nt, Human
ccccugcccccaggac

SEQ ID NO: 3799698 - RNA, 17 nt, Human
ccccugcccccaggacu

SEQ ID NO: 3799699 - RNA, 16 nt, Human
ccccugcccccugcag

SEQ ID NO: 3799700 - RNA, 14 nt, Human
ccccugccccguca

SEQ ID NO: 3799701 - RNA, 15 nt, Human
ccccugccccgucac

SEQ ID NO: 3799702 - RNA, 22 nt, Human
ccccugccccgucaccaucuca

SEQ ID NO: 3799703 - RNA, 17 nt, Human
ccccugcccggcugcgg

SEQ ID NO: 3799704 - RNA, 23 nt, Human
ccccugcccuccccucucugcac

SEQ ID NO: 3799705 - RNA, 13 nt, Human
ccccugcccucgu

SEQ ID NO: 3799706 - RNA, 23 nt, Human
ccccugcccucguggccagcccg

SEQ ID NO: 3799707 - RNA, 13 nt, Human
ccccugcccugca

SEQ ID NO: 3799708 - RNA, 14 nt, Human
ccccugcccugcac

SEQ ID NO: 3799709 - RNA, 15 nt, Human
ccccugccuccaucc

SEQ ID NO: 3799710 - RNA, 16 nt, Human
ccccugccucucugca

SEQ ID NO: 3799711 - RNA, 17 nt, Human
ccccugccucucugcag

SEQ ID NO: 3799712 - RNA, 12 nt, Human
ccccugccugcc

SEQ ID NO: 3799713 - RNA, 13 nt, Human
ccccugccugcca

SEQ ID NO: 3799714 - RNA, 14 nt, Human
ccccugccugccau

SEQ ID NO: 3799715 - RNA, 15 nt, Human
ccccugccugcccug

SEQ ID NO: 3799716 - RNA, 19 nt, Human
ccccugccuuugggagcag

SEQ ID NO: 3799717 - RNA, 20 nt, Human
ccccugcugcugucaccucu

SEQ ID NO: 3799718 - RNA, 21 nt, Human
ccccugcugcugucaccucuc

SEQ ID NO: 3799719 - RNA, 14 nt, Human
ccccugcuggcucu

SEQ ID NO: 3799720 - RNA, 22 nt, Human
ccccugcuggcucuucugccca

SEQ ID NO: 3799721 - RNA, 23 nt, Human
ccccugcuucagauguggagcca

SEQ ID NO: 3799722 - RNA, 20 nt, Human
ccccuggaagcagugcccag

SEQ ID NO: 3799723 - RNA, 16 nt, Human
ccccuggaccccagcc

SEQ ID NO: 3799724 - RNA, 18 nt, Human
ccccuggaccccagccuc

SEQ ID NO: 3799725 - RNA, 19 nt, Human
ccccuggaccccagccuca

SEQ ID NO: 3799726 - RNA, 15 nt, Human
ccccuggagagaagu

SEQ ID NO: 3799727 - RNA, 11 nt, Human
ccccuggagcc

SEQ ID NO: 3799728 - RNA, 15 nt, Human
ccccuggagggggaa

SEQ ID NO: 3799729 - RNA, 18 nt, Human
ccccuggaugcagccuca

SEQ ID NO: 3799730 - RNA, 19 nt, Human
ccccuggaugcagccucac

SEQ ID NO: 3799731 - RNA, 16 nt, Human
ccccuggcacuggcaa

SEQ ID NO: 3799732 - RNA, 12 nt, Human
ccccuggcagcc

SEQ ID NO: 3799733 - RNA, 14 nt, Human
ccccuggcagcccc

SEQ ID NO: 3799734 - RNA, 15 nt, Human
ccccuggcccagcgg

SEQ ID NO: 3799735 - RNA, 23 nt, Human
ccccuggccgcgcuccgggcuuu

SEQ ID NO: 3799736 - RNA, 19 nt, Human
ccccuggccuccggcguca

SEQ ID NO: 3799737 - RNA, 15 nt, Human
ccccuggccuuggga

SEQ ID NO: 3799738 - RNA, 23 nt, Human
ccccuggcugggacguggcucag

SEQ ID NO: 3799739 - RNA, 17 nt, Human
ccccuggcuguuuggac

SEQ ID NO: 3799740 - RNA, 20 nt, Human
ccccuggcuuuucacugcug

SEQ ID NO: 3799741 - RNA, 22 nt, Human
ccccuggcuuuucacugcuggc

SEQ ID NO: 3799742 - RNA, 18 nt, Human
ccccugggcuuggccugc

SEQ ID NO: 3799743 - RNA, 19 nt, Human
ccccugggcuuggccugcu

SEQ ID NO: 3799744 - RNA, 21 nt, Human
ccccugggcuuggccugcugu

SEQ ID NO: 3799745 - RNA, 15 nt, Human
ccccuggggccuaga

SEQ ID NO: 3799746 - RNA, 23 nt, Human
ccccuggggccuagacucuguaa

SEQ ID NO: 3799747 - RNA, 16 nt, Human
ccccuggggugcaggc

SEQ ID NO: 3799748 - RNA, 20 nt, Human
ccccugggguggccaccagu

SEQ ID NO: 3799749 - RNA, 21 nt, Human
ccccugggucagucugguggg

SEQ ID NO: 3799750 - RNA, 17 nt, Human
ccccugguccccuccuu

SEQ ID NO: 3799751 - RNA, 18 nt, Human
ccccuggucccucugcag

SEQ ID NO: 3799752 - RNA, 15 nt, Human
ccccuggucuuugag

SEQ ID NO: 3799753 - RNA, 23 nt, Human
ccccuggugcacuggccccaccc

SEQ ID NO: 3799754 - RNA, 12 nt, Human
ccccuggugguu

SEQ ID NO: 3799755 - RNA, 18 nt, Human
ccccugucccaugcaggc

SEQ ID NO: 3799756 - RNA, 22 nt, Human
ccccuguccccgcacugggcuu

SEQ ID NO: 3799757 - RNA, 14 nt, Human
cccaccucccugcc

SEQ ID NO: 3799758 - RNA, 17 nt, Human
cccaccucggucacucc

SEQ ID NO: 3799759 - RNA, 19 nt, Human
cccaccucucucacuccuu

SEQ ID NO: 3799760 - RNA, 17 nt, Human
cccaccucugugaccuc

SEQ ID NO: 3799761 - RNA, 18 nt, Human
cccaccucugugaccuca

SEQ ID NO: 3799762 - RNA, 21 nt, Human
cccaccucugugaccucaggc

SEQ ID NO: 3799763 - RNA, 17 nt, Human
cccaccugagcuuugga

SEQ ID NO: 3799764 - RNA, 19 nt, Human
cccaccugcaucuggggcc

SEQ ID NO: 3799765 - RNA, 21 nt, Human
cccaccugccacuaggcuggg

SEQ ID NO: 3799766 - RNA, 13 nt, Human
cccaccugcccau

SEQ ID NO: 3799767 - RNA, 13 nt, Human
cccaccugccugg

SEQ ID NO: 3799768 - RNA, 12 nt, Human
cccaccugcuga

SEQ ID NO: 3799769 - RNA, 15 nt, Human
cccaccuggccucug

SEQ ID NO: 3799770 - RNA, 17 nt, Human
cccaccuggccucugca

SEQ ID NO: 3799771 - RNA, 19 nt, Human
cccaccuggccucugcacu

SEQ ID NO: 3799772 - RNA, 21 nt, Human
cccaccuucaauuccugggcc

SEQ ID NO: 3799773 - RNA, 22 nt, Human
cccaccuucaauuccugggccc

SEQ ID NO: 3799774 - RNA, 12 nt, Human
cccaccuuggcu

SEQ ID NO: 3799775 - RNA, 22 nt, Human
cccaccuuggcucaaguccucu

SEQ ID NO: 3799776 - RNA, 21 nt, Human
cccaccuuuauuaaaaucuua

SEQ ID NO: 3799777 - RNA, 20 nt, Human
cccacgaaacugcccuggcu

SEQ ID NO: 3799778 - RNA, 16 nt, Human
cccacgacacugcagc

SEQ ID NO: 3799779 - RNA, 13 nt, Human
cccacgagggcug

SEQ ID NO: 3799780 - RNA, 16 nt, Human
cccacgagggucagga

SEQ ID NO: 3799781 - RNA, 17 nt, Human
cccacgagggugccgug

SEQ ID NO: 3799782 - RNA, 20 nt, Human
cccacgauuuucuccagcuc

SEQ ID NO: 3799783 - RNA, 13 nt, Human
cccacgccacagc

SEQ ID NO: 3799784 - RNA, 16 nt, Human
cccacgccacagcccu

SEQ ID NO: 3799785 - RNA, 17 nt, Human
cccacgcccccacuggu

SEQ ID NO: 3799786 - RNA, 14 nt, Human
cccacgccuuaucc

SEQ ID NO: 3799787 - RNA, 16 nt, Human
cccacgcucacccccu

SEQ ID NO: 3799788 - RNA, 16 nt, Human
cccacgcugacuacag

SEQ ID NO: 3799789 - RNA, 20 nt, Human
cccacgcugacuacagggcc

SEQ ID NO: 3799790 - RNA, 20 nt, Human
cccacgcuggagugcaguga

SEQ ID NO: 3799791 - RNA, 17 nt, Human
cccacggccgcuccagg

SEQ ID NO: 3799792 - RNA, 15 nt, Human
cccacggccuuucua

SEQ ID NO: 3799793 - RNA, 15 nt, Human
cccacggcuccucga

SEQ ID NO: 3799794 - RNA, 19 nt, Human
cccacggggccucgggacc

SEQ ID NO: 3799795 - RNA, 15 nt, Human
cccacguccugucag

SEQ ID NO: 3799796 - RNA, 18 nt, Human
cccacgugucuuccacuu

SEQ ID NO: 3799797 - RNA, 17 nt, Human
cccacguucucucugcc

SEQ ID NO: 3799798 - RNA, 23 nt, Human
cccacguucucucugccugugag

SEQ ID NO: 3799799 - RNA, 13 nt, Human
cccacguucuuuc

SEQ ID NO: 3799800 - RNA, 17 nt, Human
cccacuaaugcaaacug

SEQ ID NO: 3799801 - RNA, 18 nt, Human
cccacuacugcagcaccu

SEQ ID NO: 3799802 - RNA, 15 nt, Human
cccacuagcucuugu

SEQ ID NO: 3799803 - RNA, 22 nt, Human
cccacuagcucuuguugagccg

SEQ ID NO: 3799804 - RNA, 18 nt, Human
cccacuauccuucgugaa

SEQ ID NO: 3799805 - RNA, 17 nt, Human
cccacucaagccaagca

SEQ ID NO: 3799806 - RNA, 20 nt, Human
cccacucaagccaagcagcc

SEQ ID NO: 3799807 - RNA, 18 nt, Human
cccacucagcuccgugaa

SEQ ID NO: 3799808 - RNA, 18 nt, Human
cccacuccaagccagcaa

SEQ ID NO: 3799809 - RNA, 13 nt, Human
cccacucccugca

SEQ ID NO: 3799810 - RNA, 20 nt, Human
cccacucccuggcucucaga

SEQ ID NO: 3799811 - RNA, 19 nt, Human
cccacucccuugcuggccc

SEQ ID NO: 3799812 - RNA, 21 nt, Human
ccccuuuauguacaggaugcu

SEQ ID NO: 3799813 - RNA, 15 nt, Human
ccccuuucacaggca

SEQ ID NO: 3799814 - RNA, 16 nt, Human
ccccuuucacaggcag

SEQ ID NO: 3799815 - RNA, 21 nt, Human
ccccuuucacaggcagccagu

SEQ ID NO: 3799816 - RNA, 13 nt, Human
ccccuuucccggg

SEQ ID NO: 3799817 - RNA, 14 nt, Human
ccccuuucccgggc

SEQ ID NO: 3799818 - RNA, 13 nt, Human
ccccuuuccuguc

SEQ ID NO: 3799819 - RNA, 20 nt, Human
ccccuuugggcccagggaca

SEQ ID NO: 3799820 - RNA, 16 nt, Human
ccccuuugggcccugc

SEQ ID NO: 3799821 - RNA, 16 nt, Human
ccccuuugugcugugg

SEQ ID NO: 3799822 - RNA, 16 nt, Human
ccccuuuucagcuucu

SEQ ID NO: 3799823 - RNA, 17 nt, Human
ccccuuuucagcuucug

SEQ ID NO: 3799824 - RNA, 15 nt, Human
ccccuuuucuuuucu

SEQ ID NO: 3799825 - RNA, 17 nt, Human
ccccuuuucuuuucuac

SEQ ID NO: 3799826 - RNA, 17 nt, Human
ccccuuuuucuuccuca

SEQ ID NO: 3799827 - RNA, 24 nt, Human
cccgaaagaggcacccuuccaucu

SEQ ID NO: 3799828 - RNA, 19 nt, Human
cccgaaaggucaccucacu

SEQ ID NO: 3799829 - RNA, 21 nt, Human
cccgaaaggucaccucacuca

SEQ ID NO: 3799830 - RNA, 20 nt, Human
cccgaagaauggagaggaac

SEQ ID NO: 3799831 - RNA, 22 nt, Human
cccgaagguuauggucaauccc

SEQ ID NO: 3799832 - RNA, 14 nt, Human
cccgaauacaaaca

SEQ ID NO: 3799833 - RNA, 20 nt, Human
cccgaauacaaacaccugga

SEQ ID NO: 3799834 - RNA, 18 nt, Human
cccgaauagcugggacua

SEQ ID NO: 3799835 - RNA, 15 nt, Human
cccgacagagggaag

SEQ ID NO: 3799836 - RNA, 18 nt, Human
cccgacagccuggcacag

SEQ ID NO: 3799837 - RNA, 23 nt, Human
cccgacauggacccggagcuaac

SEQ ID NO: 3799838 - RNA, 22 nt, Human
cccgaccaccugcccaaccugc

SEQ ID NO: 3799839 - RNA, 15 nt, Human
cccgacgccacagcc

SEQ ID NO: 3799840 - RNA, 16 nt, Human
cccgacuccagccagc

SEQ ID NO: 3799841 - RNA, 12 nt, Human
cccgacuccuca

SEQ ID NO: 3799842 - RNA, 13 nt, Human
cccgagcagcuga

SEQ ID NO: 3799843 - RNA, 22 nt, Human
cccgagcagcugagcagggccg

SEQ ID NO: 3799844 - RNA, 14 nt, Human
cccgagcuccucuu

SEQ ID NO: 3799845 - RNA, 16 nt, Human
cccgaggacccagacc

SEQ ID NO: 3799846 - RNA, 19 nt, Human
cccgaggacccagacccag

SEQ ID NO: 3799847 - RNA, 22 nt, Human
cccgaggacgcucccugcucca

SEQ ID NO: 3799848 - RNA, 13 nt, Human
cccgaggcccugc

SEQ ID NO: 3799849 - RNA, 20 nt, Human
cccgaggccuucucugaagg

SEQ ID NO: 3799850 - RNA, 21 nt, Human
cccgaggccuucucugaagga

SEQ ID NO: 3799851 - RNA, 21 nt, Human
cccgaguagcugggacuacag

SEQ ID NO: 3799852 - RNA, 22 nt, Human
cccgaguagcugggacuacagg

SEQ ID NO: 3799853 - RNA, 23 nt, Human
cccgagucauucguucuguggag

SEQ ID NO: 3799854 - RNA, 19 nt, Human
cccgauccuccccuggacu

SEQ ID NO: 3799855 - RNA, 15 nt, Human
cccgaucgccagcaa

SEQ ID NO: 3799856 - RNA, 15 nt, Human
cccgaugcugcuuuc

SEQ ID NO: 3799857 - RNA, 22 nt, Human
cccgauggaggacuccaggcag

SEQ ID NO: 3799858 - RNA, 23 nt, Human
cccgauggaggacuccaggcagc

SEQ ID NO: 3799859 - RNA, 19 nt, Human
cccgcaaacccccuuugug

SEQ ID NO: 3799860 - RNA, 22 nt, Human
cccgcaaugugcccccagacgc

SEQ ID NO: 3799861 - RNA, 19 nt, Human
cccgcacagagcuggggcu

SEQ ID NO: 3799862 - RNA, 11 nt, Human
cccgcacagca

SEQ ID NO: 3799863 - RNA, 14 nt, Human
cccgcacagcagcc

SEQ ID NO: 3799864 - RNA, 15 nt, Human
cccgcacagcagccu

SEQ ID NO: 3799865 - RNA, 15 nt, Human
cccgcagacaccuug

SEQ ID NO: 3799866 - RNA, 18 nt, Human
cccgcagaccuccccagc

SEQ ID NO: 3799867 - RNA, 20 nt, Human
cccgcagaccuccccagccc

SEQ ID NO: 3799868 - RNA, 14 nt, Human
cccgcagaccucug

SEQ ID NO: 3799869 - RNA, 15 nt, Human
cccgcagaccucugg

SEQ ID NO: 3799870 - RNA, 22 nt, Human
cccgcagagcgcgccccuagcc

SEQ ID NO: 3799871 - RNA, 13 nt, Human
cccgcagcccugg

SEQ ID NO: 3799872 - RNA, 16 nt, Human
cccgcagcccuggcag

SEQ ID NO: 3799873 - RNA, 15 nt, Human
cccgcaggacauggc

SEQ ID NO: 3799874 - RNA, 18 nt, Human
cccgcauccccugccucc

SEQ ID NO: 3799875 - RNA, 20 nt, Human
cccgcauccccugccuccau

SEQ ID NO: 3799876 - RNA, 15 nt, Human
cccgccaaaagcugc

SEQ ID NO: 3799877 - RNA, 14 nt, Human
cccgccacacagac

SEQ ID NO: 3799878 - RNA, 16 nt, Human
cccgccagccgcuccc

SEQ ID NO: 3799879 - RNA, 12 nt, Human
cccgcccacugu

SEQ ID NO: 3799880 - RNA, 17 nt, Human
cccgcccacuguccugg

SEQ ID NO: 3799881 - RNA, 13 nt, Human
cccgcccagcugc

SEQ ID NO: 3799882 - RNA, 17 nt, Human
cccgcccaggcuggcca

SEQ ID NO: 3799883 - RNA, 20 nt, Human
cccgcccaggcuggccagcc

SEQ ID NO: 3799884 - RNA, 22 nt, Human
cccgcccaggcuggccagcccc

SEQ ID NO: 3799885 - RNA, 20 nt, Human
cccgccccccacacuucccu

SEQ ID NO: 3799886 - RNA, 23 nt, Human
cccgccccccacacuucccuggc

SEQ ID NO: 3799887 - RNA, 16 nt, Human
cccgcccccugcccuc

SEQ ID NO: 3799888 - RNA, 15 nt, Human
cccgccccugcagca

SEQ ID NO: 3799889 - RNA, 20 nt, Human
cccgccccuuccccgaggga

SEQ ID NO: 3799890 - RNA, 14 nt, Human
cccgcccucuuccu

SEQ ID NO: 3799891 - RNA, 15 nt, Human
cccgcccucuuccug

SEQ ID NO: 3799892 - RNA, 20 nt, Human
cccgccgcuuuucuccucuu

SEQ ID NO: 3799893 - RNA, 12 nt, Human
cccgccucuccc

SEQ ID NO: 3799894 - RNA, 13 nt, Human
cccgccugcccac

SEQ ID NO: 3799895 - RNA, 15 nt, Human
cccgccugcccaccu

SEQ ID NO: 3799896 - RNA, 18 nt, Human
cccgccugcccaccugcc

SEQ ID NO: 3799897 - RNA, 12 nt, Human
cccgccugcccu

SEQ ID NO: 3799898 - RNA, 13 nt, Human
cccgccugcccuc

SEQ ID NO: 3799899 - RNA, 17 nt, Human
cccgccugcccucaugg

SEQ ID NO: 3799900 - RNA, 19 nt, Human
cccgcgcgcgucccccugc

SEQ ID NO: 3799901 - RNA, 21 nt, Human
cccgcggggacauugggaagg

SEQ ID NO: 3799902 - RNA, 13 nt, Human
cccgcuaaggaag

SEQ ID NO: 3799903 - RNA, 15 nt, Human
cccgcucagcccucc

SEQ ID NO: 3799904 - RNA, 20 nt, Human
cccgcucaugggccccucug

SEQ ID NO: 3799905 - RNA, 15 nt, Human
cccgcucccaguguc

SEQ ID NO: 3799906 - RNA, 23 nt, Human
cccgcucccagugucuuccugug

SEQ ID NO: 3799907 - RNA, 14 nt, Human
cccgcucugcaugc

SEQ ID NO: 3799908 - RNA, 16 nt, Human
cccgcugcugugcaac

SEQ ID NO: 3799909 - RNA, 13 nt, Human
cccgcuggaggau

SEQ ID NO: 3799910 - RNA, 21 nt, Human
cccgcuggaggaugugggcag

SEQ ID NO: 3799911 - RNA, 19 nt, Human
cccgcugucagccauuccu

SEQ ID NO: 3799912 - RNA, 17 nt, Human
cagccccuagcccagga

SEQ ID NO: 3799913 - RNA, 22 nt, Human
cagccccuagcccaggagagag

SEQ ID NO: 3799914 - RNA, 17 nt, Human
cagccccuccaucugua

SEQ ID NO: 3799915 - RNA, 21 nt, Human
cagccccucccaccacagcag

SEQ ID NO: 3799916 - RNA, 21 nt, Human
cagccccucccccaucuccca

SEQ ID NO: 3799917 - RNA, 22 nt, Human
cagccccucccccaucucccac

SEQ ID NO: 3799918 - RNA, 18 nt, Human
cagccccucccuccucug

SEQ ID NO: 3799919 - RNA, 21 nt, Human
cagccccucccuccucugaga

SEQ ID NO: 3799920 - RNA, 14 nt, Human
cagccccuccucug

SEQ ID NO: 3799921 - RNA, 17 nt, Human
cagccccuccucugcca

SEQ ID NO: 3799922 - RNA, 20 nt, Human
cagccccuccucugccaccu

SEQ ID NO: 3799923 - RNA, 22 nt, Human
cagccccuccucugccaccucc

SEQ ID NO: 3799924 - RNA, 17 nt, Human
cagccccucuugccccc

SEQ ID NO: 3799925 - RNA, 22 nt, Human
cagccccucuugccccccaccc

SEQ ID NO: 3799926 - RNA, 21 nt, Human
cagccccucuuggagaagucu

SEQ ID NO: 3799927 - RNA, 23 nt, Human
cagccccucuuggagaagucuca

SEQ ID NO: 3799928 - RNA, 11 nt, Human
cagccccugcc

SEQ ID NO: 3799929 - RNA, 23 nt, Human
cagccccugccccagcccaaguc

SEQ ID NO: 3799930 - RNA, 13 nt, Human
cagccccuggaug

SEQ ID NO: 3799931 - RNA, 17 nt, Human
cagccccuggaugcagc

SEQ ID NO: 3799932 - RNA, 19 nt, Human
cagccccuggaugcagccu

SEQ ID NO: 3799933 - RNA, 21 nt, Human
cagccccuggaugcagccuca

SEQ ID NO: 3799934 - RNA, 22 nt, Human
cagccccuggaugcagccucac

SEQ ID NO: 3799935 - RNA, 13 nt, Human
cagccccuggccc

SEQ ID NO: 3799936 - RNA, 13 nt, Human
cagccccuguccc

SEQ ID NO: 3799937 - RNA, 14 nt, Human
cagccccuguccca

SEQ ID NO: 3799938 - RNA, 21 nt, Human
cagccccuguucuggcagagu

SEQ ID NO: 3799939 - RNA, 16 nt, Human
cagccccuucugaccc

SEQ ID NO: 3799940 - RNA, 17 nt, Human
cagccccuucugaccca

SEQ ID NO: 3799941 - RNA, 21 nt, Human
cagccccuucugacccaugcu

SEQ ID NO: 3799942 - RNA, 23 nt, Human
cagccccuuucccuuguagcucc

SEQ ID NO: 3799943 - RNA, 17 nt, Human
cagcccgauccuccccu

SEQ ID NO: 3799944 - RNA, 23 nt, Human
cagcccgauccuccccuggacuc

SEQ ID NO: 3799945 - RNA, 21 nt, Human
cagcccgcaucagcugcucag

SEQ ID NO: 3799946 - RNA, 15 nt, Human
cagcccgcaugcagc

SEQ ID NO: 3799947 - RNA, 21 nt, Human
cagcccgcaugcagcagcuug

SEQ ID NO: 3799948 - RNA, 17 nt, Human
cagcccgcugaguggac

SEQ ID NO: 3799949 - RNA, 15 nt, Human
cagcccggcgccacc

SEQ ID NO: 3799950 - RNA, 15 nt, Human
cagcccggcucccac

SEQ ID NO: 3799951 - RNA, 14 nt, Human
cagcccgggagccu

SEQ ID NO: 3799952 - RNA, 15 nt, Human
cagcccgggagccua

SEQ ID NO: 3799953 - RNA, 21 nt, Human
cagcccgggagccuaggacca

SEQ ID NO: 3799954 - RNA, 15 nt, Human
cagcccgggcucugc

SEQ ID NO: 3799955 - RNA, 16 nt, Human
cagcccgggcucugcc

SEQ ID NO: 3799956 - RNA, 21 nt, Human
cagcccguguggccccuucac

SEQ ID NO: 3799957 - RNA, 18 nt, Human
cagcccuaaggaucucuc

SEQ ID NO: 3799958 - RNA, 20 nt, Human
cagcccuaaggaucucucag

SEQ ID NO: 3799959 - RNA, 22 nt, Human
cagcccuaaggaucucucagga

SEQ ID NO: 3799960 - RNA, 15 nt, Human
cagcccuagagccug

SEQ ID NO: 3799961 - RNA, 23 nt, Human
cagcccuagagccugccuggagc

SEQ ID NO: 3799962 - RNA, 14 nt, Human
cagcccuauggaug

SEQ ID NO: 3799963 - RNA, 17 nt, Human
cagcccucacacacccu

SEQ ID NO: 3799964 - RNA, 15 nt, Human
cagcccucaccccug

SEQ ID NO: 3799965 - RNA, 18 nt, Human
cagcccucauuggcucuu

SEQ ID NO: 3799966 - RNA, 22 nt, Human
cagcccuccaucuaaacugccc

SEQ ID NO: 3799967 - RNA, 20 nt, Human
cagcccucccgccccuuccc

SEQ ID NO: 3799968 - RNA, 13 nt, Human
cagcccucccugc

SEQ ID NO: 3799969 - RNA, 13 nt, Human
cagcccucccugu

SEQ ID NO: 3799970 - RNA, 14 nt, Human
cagcccucccuguc

SEQ ID NO: 3799971 - RNA, 22 nt, Human
cagcccucccuguccuccucgg

SEQ ID NO: 3799972 - RNA, 13 nt, Human
cagcccuccucac

SEQ ID NO: 3799973 - RNA, 16 nt, Human
cagcccuccucacccc

SEQ ID NO: 3799974 - RNA, 18 nt, Human
cagcccucggcgcuccgg

SEQ ID NO: 3799975 - RNA, 15 nt, Human
cagcccucucacugu

SEQ ID NO: 3799976 - RNA, 22 nt, Human
cagcccugaggugaaagggagc

SEQ ID NO: 3799977 - RNA, 18 nt, Human
cagcccugaguuccuagc

SEQ ID NO: 3799978 - RNA, 13 nt, Human
cagcccugcagag

SEQ ID NO: 3799979 - RNA, 20 nt, Human
cagcccugccccacaccucc

SEQ ID NO: 3799980 - RNA, 21 nt, Human
cagcccugccccacaccuccu

SEQ ID NO: 3799981 - RNA, 17 nt, Human
cagcccugccuggagga

SEQ ID NO: 3799982 - RNA, 20 nt, Human
cagcccugccuggaggaccu

SEQ ID NO: 3799983 - RNA, 14 nt, Human
cagcccugcuggcc

SEQ ID NO: 3799984 - RNA, 21 nt, Human
cagcccugcuggccgccucac

SEQ ID NO: 3799985 - RNA, 23 nt, Human
cagcccugcuggccgccucaccc

SEQ ID NO: 3799986 - RNA, 22 nt, Human
cagcccugcuuugggcugcccu

SEQ ID NO: 3799987 - RNA, 17 nt, Human
cagcccuggaggugcca

SEQ ID NO: 3799988 - RNA, 22 nt, Human
cagcccuggaggugccagcaaa

SEQ ID NO: 3799989 - RNA, 15 nt, Human
cagcccuggcucugc

SEQ ID NO: 3799990 - RNA, 20 nt, Human
cagcccuggcugaaggacug

SEQ ID NO: 3799991 - RNA, 13 nt, Human
cagcccugggccc

SEQ ID NO: 3799992 - RNA, 21 nt, Human
cagcccugggccccaccaccu

SEQ ID NO: 3799993 - RNA, 13 nt, Human
cagcccuggggcu

SEQ ID NO: 3799994 - RNA, 12 nt, Human
cagcccuggucu

SEQ ID NO: 3799995 - RNA, 16 nt, Human
cagcccugucuuccua

SEQ ID NO: 3799996 - RNA, 13 nt, Human
cagcccuuagcag

SEQ ID NO: 3799997 - RNA, 16 nt, Human
cagcccuuccucugcu

SEQ ID NO: 3799998 - RNA, 19 nt, Human
cagcccuucuuuccacaga

SEQ ID NO: 3799999 - RNA, 11 nt, Human
cagcccuugcu

SEQ ID NO: 3800000 - RNA, 12 nt, Human
cagcccuugcuu

SEQ ID NO: 3800001 - RNA, 14 nt, Human
cagcccuuggccag

SEQ ID NO: 3800002 - RNA, 14 nt, Human
cagccgacccccuc

SEQ ID NO: 3800003 - RNA, 15 nt, Human
cagccgacccccucu

SEQ ID NO: 3800004 - RNA, 16 nt, Human
cagccgagcaggaggc

SEQ ID NO: 3800005 - RNA, 18 nt, Human
cagccgagcaggaggccu

SEQ ID NO: 3800006 - RNA, 23 nt, Human
cagccgagcaggaggccuaggag

SEQ ID NO: 3800007 - RNA, 22 nt, Human
cagccgagcucguguauccugg

SEQ ID NO: 3800008 - RNA, 21 nt, Human
cagccgagcuuuuacucccug

SEQ ID NO: 3800009 - RNA, 21 nt, Human
cagccgaguggauagaugccc

SEQ ID NO: 3800010 - RNA, 18 nt, Human
cagccgauucaccugagc

SEQ ID NO: 3800011 - RNA, 13 nt, Human
cagccgccacauc

SEQ ID NO: 3800012 - RNA, 18 nt, Human
cagccgccaucagcccaa

SEQ ID NO: 3800013 - RNA, 22 nt, Human
cagccgccauugccaccaggag

SEQ ID NO: 3800014 - RNA, 22 nt, Human
cagccgccuuccuugaccuucc

SEQ ID NO: 3800015 - RNA, 22 nt, Human
cagccgcuccccagcccugccg

SEQ ID NO: 3800016 - RNA, 12 nt, Human
cagccgcuccug

SEQ ID NO: 3800017 - RNA, 21 nt, Human
cagccgcuccugucugccagc

SEQ ID NO: 3800018 - RNA, 12 nt, Human
cagccgcugccc

SEQ ID NO: 3800019 - RNA, 12 nt, Human
cagccgcuuggc

SEQ ID NO: 3800020 - RNA, 23 nt, Human
cagccggcacagggucugcucuu

SEQ ID NO: 3800021 - RNA, 19 nt, Human
cagccggccaauggaaacc

SEQ ID NO: 3800022 - RNA, 20 nt, Human
cagccggccaauggaaaccu

SEQ ID NO: 3800023 - RNA, 15 nt, Human
cagccggccucucug

SEQ ID NO: 3800024 - RNA, 16 nt, Human
cagccggccucucugg

SEQ ID NO: 3800025 - RNA, 17 nt, Human
cagccggccucucuggc

SEQ ID NO: 3800026 - RNA, 22 nt, Human
cagccggccucucuggccuccc

SEQ ID NO: 3800027 - RNA, 15 nt, Human
cagccggggccugcc

SEQ ID NO: 3800028 - RNA, 19 nt, Human
cagccgguaccugggaagg

SEQ ID NO: 3800029 - RNA, 21 nt, Human
cagccgguaccugggaagggg

SEQ ID NO: 3800030 - RNA, 18 nt, Human
cagccgucagccaaaugu

SEQ ID NO: 3800031 - RNA, 14 nt, Human
cagccgugccuuca

SEQ ID NO: 3800032 - RNA, 17 nt, Human
cagccgugggccccacc

SEQ ID NO: 3800033 - RNA, 16 nt, Human
cagccuacaggccuca

SEQ ID NO: 3800034 - RNA, 15 nt, Human
cagccuacucuccuu

SEQ ID NO: 3800035 - RNA, 18 nt, Human
cagccuagccgaccucag

SEQ ID NO: 3800036 - RNA, 19 nt, Human
cagccuagccgaccucagc

SEQ ID NO: 3800037 - RNA, 13 nt, Human
cagccuaugagca

SEQ ID NO: 3800038 - RNA, 18 nt, Human
cagccucaaauccaggac

SEQ ID NO: 3800039 - RNA, 19 nt, Human
cagccucaaauccaggacc

SEQ ID NO: 3800040 - RNA, 18 nt, Human
cagccucaauaagccuug

SEQ ID NO: 3800041 - RNA, 12 nt, Human
cagccucacaga

SEQ ID NO: 3800042 - RNA, 20 nt, Human
cagccucacaguccuuacca

SEQ ID NO: 3800043 - RNA, 16 nt, Human
cagccucacccuugcg

SEQ ID NO: 3800044 - RNA, 13 nt, Human
cagccucacuugg

SEQ ID NO: 3800045 - RNA, 20 nt, Human
cagccucagcgcggcccucc

SEQ ID NO: 3800046 - RNA, 19 nt, Human
cagccucaguccuccccuc

SEQ ID NO: 3800047 - RNA, 22 nt, Human
cagccucaguccuccccucaca

SEQ ID NO: 3800048 - RNA, 23 nt, Human
cagccucaguccuccccucacag

SEQ ID NO: 3800049 - RNA, 12 nt, Human
cagccuccagag

SEQ ID NO: 3800050 - RNA, 14 nt, Human
cagccuccagccuc

SEQ ID NO: 3800051 - RNA, 16 nt, Human
cagccuccagccucug

SEQ ID NO: 3800052 - RNA, 18 nt, Human
cagccuccauccuacccc

SEQ ID NO: 3800053 - RNA, 19 nt, Human
cagccucccaaagugcugg

SEQ ID NO: 3800054 - RNA, 18 nt, Human
cagccucccacccccauc

SEQ ID NO: 3800055 - RNA, 20 nt, Human
cagccucccauccagggccc

SEQ ID NO: 3800056 - RNA, 23 nt, Human
cagccucccauccagggccccca

SEQ ID NO: 3800057 - RNA, 22 nt, Human
cagccuccccugccagggcagg

SEQ ID NO: 3800058 - RNA, 22 nt, Human
cagccucccgaauagcugggac

SEQ ID NO: 3800059 - RNA, 23 nt, Human
cagccucccgaauagcugggacu

SEQ ID NO: 3800060 - RNA, 14 nt, Human
cccagagggcccag

SEQ ID NO: 3800061 - RNA, 18 nt, Human
cccagagggcccaggcag

SEQ ID NO: 3800062 - RNA, 15 nt, Human
cccagagggccugca

SEQ ID NO: 3800063 - RNA, 20 nt, Human
cccagaggggccugccaccu

SEQ ID NO: 3800064 - RNA, 23 nt, Human
cccagagguaacagaacagcuuc

SEQ ID NO: 3800065 - RNA, 16 nt, Human
cccagagguccagccc

SEQ ID NO: 3800066 - RNA, 15 nt, Human
cccagagugugaaac

SEQ ID NO: 3800067 - RNA, 23 nt, Human
cccagaguugcugggagcugaaa

SEQ ID NO: 3800068 - RNA, 14 nt, Human
cccagauaccagcc

SEQ ID NO: 3800069 - RNA, 15 nt, Human
cccagaucagccaga

SEQ ID NO: 3800070 - RNA, 20 nt, Human
cccagaucauguuuugguga

SEQ ID NO: 3800071 - RNA, 12 nt, Human
cccagauccuca

SEQ ID NO: 3800072 - RNA, 20 nt, Human
cccagaucuggucccuugca

SEQ ID NO: 3800073 - RNA, 21 nt, Human
cccagaugggggaaagcacag

SEQ ID NO: 3800074 - RNA, 19 nt, Human
cccagauguuuuacgucug

SEQ ID NO: 3800075 - RNA, 22 nt, Human
cccagauugcaacaggcugggc

SEQ ID NO: 3800076 - RNA, 17 nt, Human
cccagauuggcucacac

SEQ ID NO: 3800077 - RNA, 20 nt, Human
cccagauuggcucacacuga

SEQ ID NO: 3800078 - RNA, 21 nt, Human
cccagauuuugcuguauauuu

SEQ ID NO: 3800079 - RNA, 21 nt, Human
cccagcaacccuccuaucacc

SEQ ID NO: 3800080 - RNA, 16 nt, Human
cccagcaauuaugaaa

SEQ ID NO: 3800081 - RNA, 18 nt, Human
cccagcacaugaaaccuu

SEQ ID NO: 3800082 - RNA, 15 nt, Human
cccagcacccagcaa

SEQ ID NO: 3800083 - RNA, 22 nt, Human
cccagcaccucagccugcacag

SEQ ID NO: 3800084 - RNA, 16 nt, Human
cccagcaccugccucc

SEQ ID NO: 3800085 - RNA, 13 nt, Human
cccagcacugagg

SEQ ID NO: 3800086 - RNA, 15 nt, Human
cccagcacugaggaa

SEQ ID NO: 3800087 - RNA, 24 nt, Human
cccagcacugaggaagaacggggc

SEQ ID NO: 3800088 - RNA, 21 nt, Human
cccagcacugcuugaggaaaa

SEQ ID NO: 3800089 - RNA, 15 nt, Human
cccagcacuuuggga

SEQ ID NO: 3800090 - RNA, 12 nt, Human
cccagcagccag

SEQ ID NO: 3800091 - RNA, 15 nt, Human
cccagcagccagcca

SEQ ID NO: 3800092 - RNA, 17 nt, Human
cccagcagcccuaagga

SEQ ID NO: 3800093 - RNA, 19 nt, Human
cccagcagggccucaaagu

SEQ ID NO: 3800094 - RNA, 16 nt, Human
cccagcagguggggag

SEQ ID NO: 3800095 - RNA, 17 nt, Human
cccagcaucacucccca

SEQ ID NO: 3800096 - RNA, 17 nt, Human
cccagcaucgcacucug

SEQ ID NO: 3800097 - RNA, 22 nt, Human
cccagcaugacauaacagugca

SEQ ID NO: 3800098 - RNA, 19 nt, Human
cccagcaugcaccacgggc

SEQ ID NO: 3800099 - RNA, 18 nt, Human
cccagcauuccagccccu

SEQ ID NO: 3800100 - RNA, 16 nt, Human
cccugcuccucccugg

SEQ ID NO: 3800101 - RNA, 19 nt, Human
cccugcuccucccuggcug

SEQ ID NO: 3800102 - RNA, 18 nt, Human
cccugcuccugcagcaug

SEQ ID NO: 3800103 - RNA, 22 nt, Human
cccugcucuccgaccagacacc

SEQ ID NO: 3800104 - RNA, 13 nt, Human
cccugcugccaug

SEQ ID NO: 3800105 - RNA, 12 nt, Human
cccugcugcucc

SEQ ID NO: 3800106 - RNA, 13 nt, Human
cccugcugcugcc

SEQ ID NO: 3800107 - RNA, 18 nt, Human
cccugcuggccgccucac

SEQ ID NO: 3800108 - RNA, 13 nt, Human
cccugcuggcucu

SEQ ID NO: 3800109 - RNA, 13 nt, Human
cccugcugguuca

SEQ ID NO: 3800110 - RNA, 20 nt, Human
cccugcugguucaggguugg

SEQ ID NO: 3800111 - RNA, 20 nt, Human
cccugcugucauugcuucuu

SEQ ID NO: 3800112 - RNA, 13 nt, Human
cccugcuguuuau

SEQ ID NO: 3800113 - RNA, 23 nt, Human
cccugcuucuccagccuggaccc

SEQ ID NO: 3800114 - RNA, 22 nt, Human
ccccaggugguuauggagaggg

SEQ ID NO: 3800115 - RNA, 17 nt, Human
ccccaguaaaauugcca

SEQ ID NO: 3800116 - RNA, 16 nt, Human
ccccaguaagccacug

SEQ ID NO: 3800117 - RNA, 16 nt, Human
ccccagucagccucuc

SEQ ID NO: 3800118 - RNA, 11 nt, Human
ccccaguccca

SEQ ID NO: 3800119 - RNA, 17 nt, Human
ccccaguccccuucccg

SEQ ID NO: 3800120 - RNA, 16 nt, Human
ccccagugcacccacu

SEQ ID NO: 3800121 - RNA, 16 nt, Human
ccccagugcccacagg

SEQ ID NO: 3800122 - RNA, 21 nt, Human
ccccaguuccucccaggaagc

SEQ ID NO: 3800123 - RNA, 21 nt, Human
ccccaguucugcuccucucca

SEQ ID NO: 3800124 - RNA, 23 nt, Human
ccccaguucugcuccucuccagg

SEQ ID NO: 3800125 - RNA, 16 nt, Human
ccccauaacucaaugg

SEQ ID NO: 3800126 - RNA, 15 nt, Human
ccccauacucugucu

SEQ ID NO: 3800127 - RNA, 13 nt, Human
ccccaucacugcg

SEQ ID NO: 3800128 - RNA, 19 nt, Human
ccccaucaggacucuugug

SEQ ID NO: 3800129 - RNA, 13 nt, Human
ccccaucagugcu

SEQ ID NO: 3800130 - RNA, 16 nt, Human
ccccaucauccucugg

SEQ ID NO: 3800131 - RNA, 17 nt, Human
ccccaucauccucuggc

SEQ ID NO: 3800132 - RNA, 17 nt, Human
ccccaucauugguaccc

SEQ ID NO: 3800133 - RNA, 16 nt, Human
ccccaucccacacccu

SEQ ID NO: 3800134 - RNA, 14 nt, Human
ccccauccuccagc

SEQ ID NO: 3800135 - RNA, 18 nt, Human
ccccauccuccagcuucu

SEQ ID NO: 3800136 - RNA, 17 nt, Human
ccccauccuccccuucc

SEQ ID NO: 3800137 - RNA, 19 nt, Human
ccccauccuccccuucccu

SEQ ID NO: 3800138 - RNA, 13 nt, Human
ccccauccuggcc

SEQ ID NO: 3800139 - RNA, 16 nt, Human
ccccauccuggcccau

SEQ ID NO: 3800140 - RNA, 17 nt, Human
ccccauccuggcccauc

SEQ ID NO: 3800141 - RNA, 19 nt, Human
ccccaucgccagcugauga

SEQ ID NO: 3800142 - RNA, 18 nt, Human
ccccaucucccugccugg

SEQ ID NO: 3800143 - RNA, 14 nt, Human
ccccaucugcccag

SEQ ID NO: 3800144 - RNA, 19 nt, Human
ccccaucuggguccuugca

SEQ ID NO: 3800145 - RNA, 21 nt, Human
ccccaucugugcauucuccug

SEQ ID NO: 3800146 - RNA, 17 nt, Human
ccccaucuucacccagg

SEQ ID NO: 3800147 - RNA, 14 nt, Human
ccccaucuugcuuc

SEQ ID NO: 3800148 - RNA, 13 nt, Human
ccccaugcacugu

SEQ ID NO: 3800149 - RNA, 19 nt, Human
ccccaugcacugugaagga

SEQ ID NO: 3800150 - RNA, 13 nt, Human
ccccaugccaaag

SEQ ID NO: 3800151 - RNA, 15 nt, Human
ccccaugccugucca

SEQ ID NO: 3800152 - RNA, 22 nt, Human
ccccaugccuguccagccuggg

SEQ ID NO: 3800153 - RNA, 14 nt, Human
ccccaugcuggagc

SEQ ID NO: 3800154 - RNA, 19 nt, Human
ccccaugcuggagccugug

SEQ ID NO: 3800155 - RNA, 20 nt, Human
ccccaugcuggagccugugu

SEQ ID NO: 3800156 - RNA, 22 nt, Human
ccccaugcuggagccuguguaa

SEQ ID NO: 3800157 - RNA, 15 nt, Human
ccccaugcuggaggu

SEQ ID NO: 3800158 - RNA, 13 nt, Human
ccccauggcccug

SEQ ID NO: 3800159 - RNA, 19 nt, Human
ccccauggccggcuuucag

SEQ ID NO: 3800160 - RNA, 22 nt, Human
ccccaugggaagacgaggcccu

SEQ ID NO: 3800161 - RNA, 15 nt, Human
ccccaugucucucag

SEQ ID NO: 3800162 - RNA, 23 nt, Human
ccccaugugccugcaccaggaga

SEQ ID NO: 3800163 - RNA, 14 nt, Human
ccccauguguccug

SEQ ID NO: 3800164 - RNA, 23 nt, Human
ccccauguguccugguucccguu

SEQ ID NO: 3800165 - RNA, 21 nt, Human
ccccauguuguaaugcugcac

SEQ ID NO: 3800166 - RNA, 17 nt, Human
ccccauuagagucagcc

SEQ ID NO: 3800167 - RNA, 23 nt, Human
ccccauuccugggaaauauuccc

SEQ ID NO: 3800168 - RNA, 15 nt, Human
ccccauucugccugc

SEQ ID NO: 3800169 - RNA, 16 nt, Human
ccccauucuuccuagu

SEQ ID NO: 3800170 - RNA, 22 nt, Human
ccccauucuuugcuugaacaca

SEQ ID NO: 3800171 - RNA, 15 nt, Human
ccccauucuuuugua

SEQ ID NO: 3800172 - RNA, 17 nt, Human
ccccauugccuccuccu

SEQ ID NO: 3800173 - RNA, 17 nt, Human
ccccauuuauccaccuc

SEQ ID NO: 3800174 - RNA, 21 nt, Human
ccccauuuauccaccuccauc

SEQ ID NO: 3800175 - RNA, 17 nt, Human
ccccauuucccaucugc

SEQ ID NO: 3800176 - RNA, 22 nt, Human
ccccauuucccaucugcacccc

SEQ ID NO: 3800177 - RNA, 13 nt, Human
ccccauuucuauu

SEQ ID NO: 3800178 - RNA, 20 nt, Human
ccccauuucuauuuauuuac

SEQ ID NO: 3800179 - RNA, 20 nt, Human
cccccaacacugugcccugg

SEQ ID NO: 3800180 - RNA, 23 nt, Human
cccccaaccaaguggcucccaca

SEQ ID NO: 3800181 - RNA, 20 nt, Human
cccccaaccauuuccucaga

SEQ ID NO: 3800182 - RNA, 18 nt, Human
cccccaaccccugaggaa

SEQ ID NO: 3800183 - RNA, 14 nt, Human
cccccaaccucagg

SEQ ID NO: 3800184 - RNA, 15 nt, Human
cccccaaccucaggg

SEQ ID NO: 3800185 - RNA, 18 nt, Human
cccccaagggaggcugcu

SEQ ID NO: 3800186 - RNA, 20 nt, Human
cccccaagggaggcugcugc

SEQ ID NO: 3800187 - RNA, 16 nt, Human
cccccaaggggcaguc

SEQ ID NO: 3800188 - RNA, 18 nt, Human
cccccaagguucuccaac

SEQ ID NO: 3800189 - RNA, 13 nt, Human
cccccaauccaug

SEQ ID NO: 3800190 - RNA, 12 nt, Human
cccccacacaca

SEQ ID NO: 3800191 - RNA, 14 nt, Human
cccccaccacacau

SEQ ID NO: 3800192 - RNA, 15 nt, Human
cccccaccacuagga

SEQ ID NO: 3800193 - RNA, 17 nt, Human
cccccacugccuuugac

SEQ ID NO: 3800194 - RNA, 13 nt, Human
cccccacuggcug

SEQ ID NO: 3800195 - RNA, 14 nt, Human
cccccacuggcugu

SEQ ID NO: 3800196 - RNA, 15 nt, Human
cccccacuggcugug

SEQ ID NO: 3800197 - RNA, 21 nt, Human
cccccacuggcugugggcucc

SEQ ID NO: 3800198 - RNA, 13 nt, Human
cccccacugguga

SEQ ID NO: 3800199 - RNA, 22 nt, Human
cccccacuugccucuuccuuga

SEQ ID NO: 3800200 - RNA, 20 nt, Human
cccccagcaaagcccccaga

SEQ ID NO: 3800201 - RNA, 12 nt, Human
cccccagcccaa

SEQ ID NO: 3800202 - RNA, 15 nt, Human
cccccagcccaaagg

SEQ ID NO: 3800203 - RNA, 21 nt, Human
cccccagcccagggcuccugc

SEQ ID NO: 3800204 - RNA, 22 nt, Human
cccccagcccccuccuggugcc

SEQ ID NO: 3800205 - RNA, 12 nt, Human
cccccagcccug

SEQ ID NO: 3800206 - RNA, 14 nt, Human
cccccagccugggc

SEQ ID NO: 3800207 - RNA, 12 nt, Human
cccccagccugu

SEQ ID NO: 3800208 - RNA, 13 nt, Human
cccccagcuaaga

SEQ ID NO: 3800209 - RNA, 15 nt, Human
cccccagcuccggcc

SEQ ID NO: 3800210 - RNA, 14 nt, Human
cccccagcucuggu

SEQ ID NO: 3800211 - RNA, 11 nt, Human
cccccagcugg

SEQ ID NO: 3800212 - RNA, 23 nt, Human
cccccagcuuugcuaccaaagca

SEQ ID NO: 3800213 - RNA, 14 nt, Human
cccccaggacaggc

SEQ ID NO: 3800214 - RNA, 13 nt, Human
cccccaggacugg

SEQ ID NO: 3800215 - RNA, 17 nt, Human
cccccaggacugggcca

SEQ ID NO: 3800216 - RNA, 18 nt, Human
cccccaguaucucuucag

SEQ ID NO: 3800217 - RNA, 19 nt, Human
cccccauccuccccuuccc

SEQ ID NO: 3800218 - RNA, 18 nt, Human
cccccaucuucgggacca

SEQ ID NO: 3800219 - RNA, 23 nt, Human
cccccauguuguaaugcugcacu

SEQ ID NO: 3800220 - RNA, 17 nt, Human
cccccauucucaucugc

SEQ ID NO: 3800221 - RNA, 16 nt, Human
cccccauuuccucggg

SEQ ID NO: 3800222 - RNA, 11 nt, Human
ccccccacucu

SEQ ID NO: 3800223 - RNA, 12 nt, Human
ccccccacucuc

SEQ ID NO: 3800224 - RNA, 14 nt, Human
ccccccagcacuga

SEQ ID NO: 3800225 - RNA, 14 nt, Human
ccccccaugcacug

SEQ ID NO: 3800226 - RNA, 14 nt, Human
ccccccucccagag

SEQ ID NO: 3800227 - RNA, 12 nt, Human
ccccccucuguc

SEQ ID NO: 3800228 - RNA, 13 nt, Human
cccccgagcuggg

SEQ ID NO: 3800229 - RNA, 12 nt, Human
cccccgccacuc

SEQ ID NO: 3800230 - RNA, 13 nt, Human
cccccgcccaggc

SEQ ID NO: 3800231 - RNA, 14 nt, Human
cccccgcccccugc

SEQ ID NO: 3800232 - RNA, 22 nt, Human
cccccgggaggggcccgcuugc

SEQ ID NO: 3800233 - RNA, 18 nt, Human
cccccgggccgacggagc

SEQ ID NO: 3800234 - RNA, 15 nt, Human
cccccggggcugggu

SEQ ID NO: 3800235 - RNA, 19 nt, Human
cccccuaaaccccuguccc

SEQ ID NO: 3800236 - RNA, 20 nt, Human
cccccucaggacccucgcug

SEQ ID NO: 3800237 - RNA, 16 nt, Human
cccccucccaccccca

SEQ ID NO: 3800238 - RNA, 15 nt, Human
cccccucccagaggc

SEQ ID NO: 3800239 - RNA, 13 nt, Human
cccccucccccac

SEQ ID NO: 3800240 - RNA, 13 nt, Human
cccccucccugga

SEQ ID NO: 3800241 - RNA, 14 nt, Human
cccccucccuggau

SEQ ID NO: 3800242 - RNA, 16 nt, Human
cccccucccuggauga

SEQ ID NO: 3800243 - RNA, 19 nt, Human
cccccuccgcccugccacu

SEQ ID NO: 3800244 - RNA, 17 nt, Human
cccccuccgccuccagg

SEQ ID NO: 3800245 - RNA, 12 nt, Human
cccccuccucuc

SEQ ID NO: 3800246 - RNA, 13 nt, Human
cccccuccugcug

SEQ ID NO: 3800247 - RNA, 17 nt, Human
ccccuccucugcuugcc

SEQ ID NO: 3800248 - RNA, 20 nt, Human
ccccuccugaaccgcacagc

SEQ ID NO: 3800249 - RNA, 12 nt, Human
ccccuccugcug

SEQ ID NO: 3800250 - RNA, 14 nt, Human
ccccuccuggggcc

SEQ ID NO: 3800251 - RNA, 15 nt, Human
ccccuccuggggcca

SEQ ID NO: 3800252 - RNA, 13 nt, Human
ccccuccuucaga

SEQ ID NO: 3800253 - RNA, 18 nt, Human
ccccuccuugccuccugu

SEQ ID NO: 3800254 - RNA, 20 nt, Human
ccccuccuugccuccugugu

SEQ ID NO: 3800255 - RNA, 14 nt, Human
ccccuccuugcucu

SEQ ID NO: 3800256 - RNA, 13 nt, Human
ccccuccuugggc

SEQ ID NO: 3800257 - RNA, 14 nt, Human
ccccucgcccaguc

SEQ ID NO: 3800258 - RNA, 15 nt, Human
ccccucggagaagag

SEQ ID NO: 3800259 - RNA, 19 nt, Human
ccccucuaaugcucacgcu

SEQ ID NO: 3800260 - RNA, 12 nt, Human
ccccucucacca

SEQ ID NO: 3800261 - RNA, 17 nt, Human
ccccucucccaguuguc

SEQ ID NO: 3800262 - RNA, 16 nt, Human
ccccucucccuucccu

SEQ ID NO: 3800263 - RNA, 15 nt, Human
ccccucuccuucuua

SEQ ID NO: 3800264 - RNA, 11 nt, Human
ccccucucugc

SEQ ID NO: 3800265 - RNA, 13 nt, Human
ccccucucugggc

SEQ ID NO: 3800266 - RNA, 15 nt, Human
ccccucugaccugca

SEQ ID NO: 3800267 - RNA, 18 nt, Human
ccccucugcacccagaac

SEQ ID NO: 3800268 - RNA, 12 nt, Human
ccccucugcccu

SEQ ID NO: 3800269 - RNA, 12 nt, Human
ccccucugcugg

SEQ ID NO: 3800270 - RNA, 12 nt, Human
ccccucugcuuu

SEQ ID NO: 3800271 - RNA, 18 nt, Human
ccccucuggcuccagcug

SEQ ID NO: 3800272 - RNA, 19 nt, Human
ccccucuggcuccagcugg

SEQ ID NO: 3800273 - RNA, 12 nt, Human
ccccucuggucg

SEQ ID NO: 3800274 - RNA, 23 nt, Human
ccccucuggucgcuccugcccac

SEQ ID NO: 3800275 - RNA, 11 nt, Human
ccccucuguag

SEQ ID NO: 3800276 - RNA, 12 nt, Human
ccccucugucca

SEQ ID NO: 3800277 - RNA, 19 nt, Human
ccccucuuccucuugaccc

SEQ ID NO: 3800278 - RNA, 17 nt, Human
cagcuguuuuguugaca

SEQ ID NO: 3800279 - RNA, 22 nt, Human
cagcuguuuuguugacauucug

SEQ ID NO: 3800280 - RNA, 23 nt, Human
cagcuguuuuguugacauucuga

SEQ ID NO: 3800281 - RNA, 21 nt, Human
cagcuuacacaaaucuauuua

SEQ ID NO: 3800282 - RNA, 17 nt, Human
cagcuuagauuucauag

SEQ ID NO: 3800283 - RNA, 19 nt, Human
cagcuuagauuucauaguu

SEQ ID NO: 3800284 - RNA, 14 nt, Human
cagcuuagggcccu

SEQ ID NO: 3800285 - RNA, 18 nt, Human
cagcuuagggcccuggag

SEQ ID NO: 3800286 - RNA, 21 nt, Human
cagcuuauacgaaauaauugu

SEQ ID NO: 3800287 - RNA, 18 nt, Human
cagcuuaucucuuuuaua

SEQ ID NO: 3800288 - RNA, 22 nt, Human
cagcuuaucucuuuuauauuug

SEQ ID NO: 3800289 - RNA, 23 nt, Human
cagcuuaucucuuuuauauuugu

SEQ ID NO: 3800290 - RNA, 13 nt, Human
cagcuuauuguuu

SEQ ID NO: 3800291 - RNA, 13 nt, Human
cagcuucaccaga

SEQ ID NO: 3800292 - RNA, 22 nt, Human
cagcuucacuucugacucuucc

SEQ ID NO: 3800293 - RNA, 15 nt, Human
cagcuucagccagga

SEQ ID NO: 3800294 - RNA, 17 nt, Human
cagcuucagccaggagc

SEQ ID NO: 3800295 - RNA, 14 nt, Human
cagcuucagguuau

SEQ ID NO: 3800296 - RNA, 19 nt, Human
cagcuucaugccuuuguaa

SEQ ID NO: 3800297 - RNA, 15 nt, Human
cagcuuccagcagga

SEQ ID NO: 3800298 - RNA, 16 nt, Human
cagcuuccagcaggag

SEQ ID NO: 3800299 - RNA, 18 nt, Human
cagcuuccccaguagcug

SEQ ID NO: 3800300 - RNA, 18 nt, Human
cagcuuccugucaagcaa

SEQ ID NO: 3800301 - RNA, 18 nt, Human
cagcuuccuguccccauc

SEQ ID NO: 3800302 - RNA, 16 nt, Human
cagcuuccuucagaga

SEQ ID NO: 3800303 - RNA, 20 nt, Human
cagcuuccuucagagagcag

SEQ ID NO: 3800304 - RNA, 20 nt, Human
cagcuuccuuuccugugugu

SEQ ID NO: 3800305 - RNA, 20 nt, Human
cagcuucguuuauuuucaag

SEQ ID NO: 3800306 - RNA, 20 nt, Human
cagcuucucauccugcaggc

SEQ ID NO: 3800307 - RNA, 15 nt, Human
cagcuucuccaggcu

SEQ ID NO: 3800308 - RNA, 12 nt, Human
cagcuucugcca

SEQ ID NO: 3800309 - RNA, 19 nt, Human
cagcuucugccacuuccca

SEQ ID NO: 3800310 - RNA, 14 nt, Human
cagcuucugccccc

SEQ ID NO: 3800311 - RNA, 19 nt, Human
cagcuucugcccccugcag

SEQ ID NO: 3800312 - RNA, 14 nt, Human
cagcuucugcuggg

SEQ ID NO: 3800313 - RNA, 15 nt, Human
cagcuucugcugggc

SEQ ID NO: 3800314 - RNA, 21 nt, Human
cagcuucugguacucuccuag

SEQ ID NO: 3800315 - RNA, 22 nt, Human
cagcuucugguacucuccuaga

SEQ ID NO: 3800316 - RNA, 14 nt, Human
cagcuucuucaucu

SEQ ID NO: 3800317 - RNA, 18 nt, Human
cagcuugaaacugagaug

SEQ ID NO: 3800318 - RNA, 18 nt, Human
cagcuugaccgugaggcc

SEQ ID NO: 3800319 - RNA, 17 nt, Human
cagcuugaccugaggcu

SEQ ID NO: 3800320 - RNA, 15 nt, Human
cagcuugaggguugg

SEQ ID NO: 3800321 - RNA, 18 nt, Human
cagcuugaggguugggcu

SEQ ID NO: 3800322 - RNA, 19 nt, Human
cagcuugaucaaaggcaca

SEQ ID NO: 3800323 - RNA, 16 nt, Human
cagcuugcacauuugg

SEQ ID NO: 3800324 - RNA, 17 nt, Human
cagcuugccagaugcug

SEQ ID NO: 3800325 - RNA, 16 nt, Human
cagcuugcgaauaaca

SEQ ID NO: 3800326 - RNA, 23 nt, Human
cagcuugcucuucagugggagaa

SEQ ID NO: 3800327 - RNA, 14 nt, Human
cagcuugcugcccu

SEQ ID NO: 3800328 - RNA, 17 nt, Human
cagcuugcugcccuagg

SEQ ID NO: 3800329 - RNA, 14 nt, Human
cagcuugggagagc

SEQ ID NO: 3800330 - RNA, 20 nt, Human
cagcuugggcagaucuccca

SEQ ID NO: 3800331 - RNA, 13 nt, Human
cagcuugggccca

SEQ ID NO: 3800332 - RNA, 14 nt, Human
cagcuugggcccag

SEQ ID NO: 3800333 - RNA, 22 nt, Human
cagcuugggcccagcugggcuc

SEQ ID NO: 3800334 - RNA, 20 nt, Human
cagcuuggggccaccaaagc

SEQ ID NO: 3800335 - RNA, 22 nt, Human
cagcuuggggccaccaaagcug

SEQ ID NO: 3800336 - RNA, 19 nt, Human
cagcuuguaaauagcucag

SEQ ID NO: 3800337 - RNA, 12 nt, Human
cagcuuguagcc

SEQ ID NO: 3800338 - RNA, 18 nt, Human
cagcuuguagccagccgg

SEQ ID NO: 3800339 - RNA, 19 nt, Human
cagcuuguagccagccggg

SEQ ID NO: 3800340 - RNA, 16 nt, Human
cagcuuguaggagcug

SEQ ID NO: 3800341 - RNA, 19 nt, Human
cagcuuguaugcaauggau

SEQ ID NO: 3800342 - RNA, 20 nt, Human
cagcuuguggcaagugaauu

SEQ ID NO: 3800343 - RNA, 22 nt, Human
cagcuuguuuuggacuuuguua

SEQ ID NO: 3800344 - RNA, 22 nt, Human
cagcuuuaaaaaauuaaucugg

SEQ ID NO: 3800345 - RNA, 19 nt, Human
cagcuuuaaacucagggac

SEQ ID NO: 3800346 - RNA, 15 nt, Human
cagcuuuaaccauua

SEQ ID NO: 3800347 - RNA, 14 nt, Human
cagcuuuagccaag

SEQ ID NO: 3800348 - RNA, 21 nt, Human
cagcuuuauggagauauaauu

SEQ ID NO: 3800349 - RNA, 17 nt, Human
cagcuuucaaagcauuu

SEQ ID NO: 3800350 - RNA, 14 nt, Human
cagcuuucagggcc

SEQ ID NO: 3800351 - RNA, 21 nt, Human
cagcuuucaucuuuguggaug

SEQ ID NO: 3800352 - RNA, 17 nt, Human
cagcuuucaugauuagc

SEQ ID NO: 3800353 - RNA, 23 nt, Human
cagcuuuccccaugucucgacuc

SEQ ID NO: 3800354 - RNA, 23 nt, Human
cagcuuucuccccgcuaaggaag

SEQ ID NO: 3800355 - RNA, 19 nt, Human
cagcuuucuugcucccuuc

SEQ ID NO: 3800356 - RNA, 14 nt, Human
cagcuuugauauuu

SEQ ID NO: 3800357 - RNA, 17 nt, Human
cagcuuugaucccugac

SEQ ID NO: 3800358 - RNA, 23 nt, Human
cagcuuugcccaacaccagcccc

SEQ ID NO: 3800359 - RNA, 15 nt, Human
cagcuuugccuucca

SEQ ID NO: 3800360 - RNA, 16 nt, Human
cagcuuugcucauauu

SEQ ID NO: 3800361 - RNA, 13 nt, Human
cagcuuugcugcu

SEQ ID NO: 3800362 - RNA, 14 nt, Human
cagcuuugcugcug

SEQ ID NO: 3800363 - RNA, 19 nt, Human
cagcuuugugacuguauau

SEQ ID NO: 3800364 - RNA, 21 nt, Human
cagcuuuguuuguugucagcu

SEQ ID NO: 3800365 - RNA, 11 nt, Human
cagcuuuuaac

SEQ ID NO: 3800366 - RNA, 20 nt, Human
cagcuuuuaguacccaccug

SEQ ID NO: 3800367 - RNA, 11 nt, Human
cagcuuuucaa

SEQ ID NO: 3800368 - RNA, 23 nt, Human
cagcuuuucauugcugugacagu

SEQ ID NO: 3800369 - RNA, 23 nt, Human
cagcuuuuggauuggacaaaaug

SEQ ID NO: 3800370 - RNA, 16 nt, Human
cagcuuuuugucuuuu

SEQ ID NO: 3800371 - RNA, 19 nt, Human
cagcuuuuuuuuccccccu

SEQ ID NO: 3800372 - RNA, 17 nt, Human
caggaaaaggccugggg

SEQ ID NO: 3800373 - RNA, 19 nt, Human
caggaaaaggccuggggug

SEQ ID NO: 3800374 - RNA, 17 nt, Human
caggaaaauccucuggc

SEQ ID NO: 3800375 - RNA, 23 nt, Human
caggaaacaguugcauguaguaa

SEQ ID NO: 3800376 - RNA, 21 nt, Human
caggaaacuccacaucugccu

SEQ ID NO: 3800377 - RNA, 18 nt, Human
caggaaacuccugugacc

SEQ ID NO: 3800378 - RNA, 19 nt, Human
caggaaacuccugugacca

SEQ ID NO: 3800379 - RNA, 16 nt, Human
caggaaagagaacuuc

SEQ ID NO: 3800380 - RNA, 20 nt, Human
caggaaagagaacuuccaga

SEQ ID NO: 3800381 - RNA, 16 nt, Human
caggaaaggcuccagg

SEQ ID NO: 3800382 - RNA, 21 nt, Human
caggaaaguggcaccugucug

SEQ ID NO: 3800383 - RNA, 14 nt, Human
caggaaaguucaga

SEQ ID NO: 3800384 - RNA, 22 nt, Human
caggaaaugcugacccaugggc

SEQ ID NO: 3800385 - RNA, 13 nt, Human
caggaacagaagg

SEQ ID NO: 3800386 - RNA, 15 nt, Human
caggaacagaaggau

SEQ ID NO: 3800387 - RNA, 16 nt, Human
caggaaccacaccaca

SEQ ID NO: 3800388 - RNA, 15 nt, Human
caggaaccgaggcag

SEQ ID NO: 3800389 - RNA, 18 nt, Human
caggaaccgaggcaggga

SEQ ID NO: 3800390 - RNA, 18 nt, Human
caggaaccucgaguacug

SEQ ID NO: 3800391 - RNA, 21 nt, Human
caggaaccucgaguacugugg

SEQ ID NO: 3800392 - RNA, 16 nt, Human
caggagaagaaagaac

SEQ ID NO: 3800393 - RNA, 19 nt, Human
caggagaagaaagaacuau

SEQ ID NO: 3800394 - RNA, 13 nt, Human
caggagaagcuca

SEQ ID NO: 3800395 - RNA, 22 nt, Human
caggagaaggccaauuccuaua

SEQ ID NO: 3800396 - RNA, 15 nt, Human
caggagaauugcuug

SEQ ID NO: 3800397 - RNA, 13 nt, Human
caggagacaaaag

SEQ ID NO: 3800398 - RNA, 14 nt, Human
caggagacaggaag

SEQ ID NO: 3800399 - RNA, 23 nt, Human
caggagacagguuagcugcuccc

SEQ ID NO: 3800400 - RNA, 16 nt, Human
caggagacccacaggu

SEQ ID NO: 3800401 - RNA, 23 nt, Human
caggagacuggcgugaacccagg

SEQ ID NO: 3800402 - RNA, 13 nt, Human
caggagagagaaa

SEQ ID NO: 3800403 - RNA, 14 nt, Human
caggagagagaaag

SEQ ID NO: 3800404 - RNA, 16 nt, Human
caggagagcuuagggu

SEQ ID NO: 3800405 - RNA, 14 nt, Human
caggagaggagagc

SEQ ID NO: 3800406 - RNA, 16 nt, Human
caggagaggagagcca

SEQ ID NO: 3800407 - RNA, 21 nt, Human
caggagaggagagccagagaa

SEQ ID NO: 3800408 - RNA, 18 nt, Human
caggagaggauggcccag

SEQ ID NO: 3800409 - RNA, 23 nt, Human
caggagaucgagaccauccuggc

SEQ ID NO: 3800410 - RNA, 23 nt, Human
caggagaugcugugccccuggcc

SEQ ID NO: 3800411 - RNA, 17 nt, Human
caggagauugagaagga

SEQ ID NO: 3800412 - RNA, 19 nt, Human
caggagauugagaaggaga

SEQ ID NO: 3800413 - RNA, 15 nt, Human
caggagcacacccag

SEQ ID NO: 3800414 - RNA, 16 nt, Human
caggagcacacccagc

SEQ ID NO: 3800415 - RNA, 21 nt, Human
caggagcacacccagccccca

SEQ ID NO: 3800416 - RNA, 16 nt, Human
caggagcacaggcagc

SEQ ID NO: 3800417 - RNA, 17 nt, Human
caggagcacaggcagcu

SEQ ID NO: 3800418 - RNA, 19 nt, Human
caggagcacggcucugucc

SEQ ID NO: 3800419 - RNA, 14 nt, Human
caggagcagccaca

SEQ ID NO: 3800420 - RNA, 15 nt, Human
caggagcaggcacgg

SEQ ID NO: 3800421 - RNA, 17 nt, Human
caggagcaggcacgggu

SEQ ID NO: 3800422 - RNA, 18 nt, Human
caggagcaggcacgggug

SEQ ID NO: 3800423 - RNA, 16 nt, Human
caggagcaguaucaug

SEQ ID NO: 3800424 - RNA, 12 nt, Human
caggagcccauu

SEQ ID NO: 3800425 - RNA, 16 nt, Human
caggagccccgaggcc

SEQ ID NO: 3800426 - RNA, 21 nt, Human
caggagccgaagcccaggggc

SEQ ID NO: 3800427 - RNA, 16 nt, Human
caggagccucacuggg

SEQ ID NO: 3800428 - RNA, 17 nt, Human
caggagccuccugcccu

SEQ ID NO: 3800429 - RNA, 20 nt, Human
caggagccuccugcccuuac

SEQ ID NO: 3800430 - RNA, 16 nt, Human
caggagccugcccagc

SEQ ID NO: 3800431 - RNA, 13 nt, Human
caggagcgcaaga

SEQ ID NO: 3800432 - RNA, 16 nt, Human
caggagcgcucccuug

SEQ ID NO: 3800433 - RNA, 17 nt, Human
caggagcuaccugugug

SEQ ID NO: 3800434 - RNA, 18 nt, Human
caggagcuaccugugugg

SEQ ID NO: 3800435 - RNA, 22 nt, Human
caggagcuaccuguguggacag

SEQ ID NO: 3800436 - RNA, 23 nt, Human
caggagcuaccuguguggacagg

SEQ ID NO: 3800437 - RNA, 21 nt, Human
caggagcuccaguguccugag

SEQ ID NO: 3800438 - RNA, 22 nt, Human
caggagcuccaguguccugagc

SEQ ID NO: 3800439 - RNA, 13 nt, Human
caggagcuccccu

SEQ ID NO: 3800440 - RNA, 16 nt, Human
caggagcuccccuccc

SEQ ID NO: 3800441 - RNA, 21 nt, Human
caggagcuccccuccccaacu

SEQ ID NO: 3800442 - RNA, 22 nt, Human
cccgagcugggggccaugagcu

SEQ ID NO: 3800443 - RNA, 23 nt, Human
cccgagcugggggccaugagcuc

SEQ ID NO: 3800444 - RNA, 14 nt, Human
cccgagcuggugca

SEQ ID NO: 3800445 - RNA, 22 nt, Human
cccgagcuggugcauuacagag

SEQ ID NO: 3800446 - RNA, 14 nt, Human
cccgagcuguuuau

SEQ ID NO: 3800447 - RNA, 15 nt, Human
cccgaggacccagac

SEQ ID NO: 3800448 - RNA, 19 nt, Human
cccgaggaggugucucagg

SEQ ID NO: 3800449 - RNA, 21 nt, Human
cccgaggaggugucucaggcu

SEQ ID NO: 3800450 - RNA, 12 nt, Human
cccgaggcccgc

SEQ ID NO: 3800451 - RNA, 13 nt, Human
cccgaggcccgca

SEQ ID NO: 3800452 - RNA, 15 nt, Human
cccgaggcccgcaug

SEQ ID NO: 3800453 - RNA, 14 nt, Human
cccgaggcccugca

SEQ ID NO: 3800454 - RNA, 15 nt, Human
cccgaggcccugcau

SEQ ID NO: 3800455 - RNA, 15 nt, Human
cccgaggccuucucu

SEQ ID NO: 3800456 - RNA, 19 nt, Human
cccgaggcugcccacuaug

SEQ ID NO: 3800457 - RNA, 23 nt, Human
cccgagggcugagccugguccca

SEQ ID NO: 3800458 - RNA, 15 nt, Human
cccgaguagcuggga

SEQ ID NO: 3800459 - RNA, 16 nt, Human
cccgaguagcugggac

SEQ ID NO: 3800460 - RNA, 17 nt, Human
cccgaguagcugggacu

SEQ ID NO: 3800461 - RNA, 14 nt, Human
cccgagucugggac

SEQ ID NO: 3800462 - RNA, 19 nt, Human
cccgaguuuggucccuggg

SEQ ID NO: 3800463 - RNA, 14 nt, Human
cccgauuguaacuc

SEQ ID NO: 3800464 - RNA, 20 nt, Human
cccgcaaacccccuuugugc

SEQ ID NO: 3800465 - RNA, 18 nt, Human
cccgcaaugugcccccag

SEQ ID NO: 3800466 - RNA, 12 nt, Human
cccgcacaccug

SEQ ID NO: 3800467 - RNA, 16 nt, Human
cccgcacagcagccug

SEQ ID NO: 3800468 - RNA, 16 nt, Human
cccgcacccccacccu

SEQ ID NO: 3800469 - RNA, 19 nt, Human
cccgcaccccccaagcugu

SEQ ID NO: 3800470 - RNA, 15 nt, Human
cccgcaccuguacag

SEQ ID NO: 3800471 - RNA, 17 nt, Human
cccgcagaccucuggau

SEQ ID NO: 3800472 - RNA, 21 nt, Human
cccgcagaccucuggauuagg

SEQ ID NO: 3800473 - RNA, 13 nt, Human
cccgcagagcgcg

SEQ ID NO: 3800474 - RNA, 22 nt, Human
cccgcagguaccccagcucugc

SEQ ID NO: 3800475 - RNA, 16 nt, Human
cccgcaugcagcagcu

SEQ ID NO: 3800476 - RNA, 19 nt, Human
cccgcccaaaccuuucccc

SEQ ID NO: 3800477 - RNA, 16 nt, Human
cccgcccacuguccug

SEQ ID NO: 3800478 - RNA, 18 nt, Human
cccgcccaggcuggccag

SEQ ID NO: 3800479 - RNA, 19 nt, Human
cccgccccacauuccgaca

SEQ ID NO: 3800480 - RNA, 14 nt, Human
cccgccccccacac

SEQ ID NO: 3800481 - RNA, 17 nt, Human
cccgcccccugcccucc

SEQ ID NO: 3800482 - RNA, 17 nt, Human
cccgccccugcagcacg

SEQ ID NO: 3800483 - RNA, 16 nt, Human
cccgccgauagaggga

SEQ ID NO: 3800484 - RNA, 14 nt, Human
cccgccuccaaccc

SEQ ID NO: 3800485 - RNA, 21 nt, Human
cccgccucucccgucagggcc

SEQ ID NO: 3800486 - RNA, 12 nt, Human
cccgccugccag

SEQ ID NO: 3800487 - RNA, 13 nt, Human
cccgccugccagu

SEQ ID NO: 3800488 - RNA, 17 nt, Human
cccgccuggccaggagc

SEQ ID NO: 3800489 - RNA, 12 nt, Human
cccgccuuggcc

SEQ ID NO: 3800490 - RNA, 14 nt, Human
cccgccuuggccug

SEQ ID NO: 3800491 - RNA, 17 nt, Human
cccgcgccacaggaccc

SEQ ID NO: 3800492 - RNA, 22 nt, Human
cccgcuaagagggagggagggc

SEQ ID NO: 3800493 - RNA, 23 nt, Human
cccgcuaagagggagggagggcu

SEQ ID NO: 3800494 - RNA, 21 nt, Human
cccgcuaggcucgccuucccu

SEQ ID NO: 3800495 - RNA, 14 nt, Human
cccgcucagcccuc

SEQ ID NO: 3800496 - RNA, 19 nt, Human
cccgcucagcccucccugc

SEQ ID NO: 3800497 - RNA, 13 nt, Human
cccgcucugcaug

SEQ ID NO: 3800498 - RNA, 15 nt, Human
cccgcucuuuuccua

SEQ ID NO: 3800499 - RNA, 19 nt, Human
cccgcugaguggacuggag

SEQ ID NO: 3800500 - RNA, 22 nt, Human
cccgcugcccaggggagcccuc

SEQ ID NO: 3800501 - RNA, 12 nt, Human
cccgcugcugcu

SEQ ID NO: 3800502 - RNA, 13 nt, Human
cccgcuggcuggg

SEQ ID NO: 3800503 - RNA, 15 nt, Human
cccgcugggcugagc

SEQ ID NO: 3800504 - RNA, 21 nt, Human
cccgcugggcugagccccuac

SEQ ID NO: 3800505 - RNA, 20 nt, Human
cccgcugucagccauuccug

SEQ ID NO: 3800506 - RNA, 12 nt, Human
cccgcuugccuc

SEQ ID NO: 3800507 - RNA, 19 nt, Human
cccgcuugccucggcuccu

SEQ ID NO: 3800508 - RNA, 21 nt, Human
cccgcuugccucggcuccugc

SEQ ID NO: 3800509 - RNA, 16 nt, Human
cccgcuuggcuucuuc

SEQ ID NO: 3800510 - RNA, 20 nt, Human
cccgcuuucuugcugguugu

SEQ ID NO: 3800511 - RNA, 14 nt, Human
cccggaacaagccu

SEQ ID NO: 3800512 - RNA, 17 nt, Human
cccggagcugccccucu

SEQ ID NO: 3800513 - RNA, 17 nt, Human
cccggaggggccuggca

SEQ ID NO: 3800514 - RNA, 14 nt, Human
cccggaucagagca

SEQ ID NO: 3800515 - RNA, 21 nt, Human
cccggaucagagcaggaccuc

SEQ ID NO: 3800516 - RNA, 13 nt, Human
cccggaugcugcu

SEQ ID NO: 3800517 - RNA, 14 nt, Human
cccggauucuggga

SEQ ID NO: 3800518 - RNA, 22 nt, Human
cccggcacagaugcuccaggga

SEQ ID NO: 3800519 - RNA, 13 nt, Human
cccggcacccccu

SEQ ID NO: 3800520 - RNA, 16 nt, Human
cccggcacccucuggc

SEQ ID NO: 3800521 - RNA, 13 nt, Human
cccggcaggcccu

SEQ ID NO: 3800522 - RNA, 16 nt, Human
cccggcaggcccugca

SEQ ID NO: 3800523 - RNA, 17 nt, Human
cccggcaggcccugcag

SEQ ID NO: 3800524 - RNA, 12 nt, Human
cccggcagggcg

SEQ ID NO: 3800525 - RNA, 14 nt, Human
cccggcagggcggg

SEQ ID NO: 3800526 - RNA, 21 nt, Human
cccggcagggcgggcagaggg

SEQ ID NO: 3800527 - RNA, 17 nt, Human
cccggcaugggaaagcc

SEQ ID NO: 3800528 - RNA, 14 nt, Human
cccggccaccucug

SEQ ID NO: 3800529 - RNA, 21 nt, Human
cccggccaccucugcggaccc

SEQ ID NO: 3800530 - RNA, 13 nt, Human
cccggccaccugc

SEQ ID NO: 3800531 - RNA, 14 nt, Human
cccggccaccugcg

SEQ ID NO: 3800532 - RNA, 17 nt, Human
cccggccaccugcggug

SEQ ID NO: 3800533 - RNA, 11 nt, Human
cccggccagcc

SEQ ID NO: 3800534 - RNA, 13 nt, Human
cccggccccagcc

SEQ ID NO: 3800535 - RNA, 15 nt, Human
cccggccccagccag

SEQ ID NO: 3800536 - RNA, 22 nt, Human
cccggcccuaccagcgcccgcu

SEQ ID NO: 3800537 - RNA, 22 nt, Human
cccggcccugggcucggaggcu

SEQ ID NO: 3800538 - RNA, 22 nt, Human
ccgguucacucuucucagccac

SEQ ID NO: 3800539 - RNA, 16 nt, Human
ccgguucuuccagugg

SEQ ID NO: 3800540 - RNA, 21 nt, Human
ccgguuucgaaguugaugcaa

SEQ ID NO: 3800541 - RNA, 21 nt, Human
ccguaaacacgccugcaaacg

SEQ ID NO: 3800542 - RNA, 18 nt, Human
ccguacaacguguccuca

SEQ ID NO: 3800543 - RNA, 16 nt, Human
ccguaccccacccuca

SEQ ID NO: 3800544 - RNA, 20 nt, Human
ccguagaaaucccccuuucu

SEQ ID NO: 3800545 - RNA, 16 nt, Human
ccguaguuauuuugca

SEQ ID NO: 3800546 - RNA, 12 nt, Human
ccguauuucaga

SEQ ID NO: 3800547 - RNA, 11 nt, Human
ccgucaacaaa

SEQ ID NO: 3800548 - RNA, 17 nt, Human
ccgucaacguuguacug

SEQ ID NO: 3800549 - RNA, 22 nt, Human
ccgucaagagugaauucccuca

SEQ ID NO: 3800550 - RNA, 16 nt, Human
ccgucaccaccacccc

SEQ ID NO: 3800551 - RNA, 20 nt, Human
ccgucaccaccaccccuacc

SEQ ID NO: 3800552 - RNA, 20 nt, Human
ccgucacgugcgcugggcac

SEQ ID NO: 3800553 - RNA, 17 nt, Human
ccgucacuaccuggcug

SEQ ID NO: 3800554 - RNA, 12 nt, Human
ccgucagggccc

SEQ ID NO: 3800555 - RNA, 20 nt, Human
ccgucaguaucaggccugcc

SEQ ID NO: 3800556 - RNA, 21 nt, Human
ccgucauggcuuaauguuuau

SEQ ID NO: 3800557 - RNA, 16 nt, Human
ccguccaggagccugg

SEQ ID NO: 3800558 - RNA, 18 nt, Human
ccguccauaucagaacug

SEQ ID NO: 3800559 - RNA, 23 nt, Human
ccguccauaucagaacugugcca

SEQ ID NO: 3800560 - RNA, 16 nt, Human
ccguccccucccaggg

SEQ ID NO: 3800561 - RNA, 14 nt, Human
ccguccucaccccu

SEQ ID NO: 3800562 - RNA, 20 nt, Human
ccguccucaccccuguccuc

SEQ ID NO: 3800563 - RNA, 14 nt, Human
ccguccucccgggc

SEQ ID NO: 3800564 - RNA, 16 nt, Human
ccguccucccgggccc

SEQ ID NO: 3800565 - RNA, 20 nt, Human
ccguccuggagguuccccag

SEQ ID NO: 3800566 - RNA, 23 nt, Human
ccguccuggagguuccccagccc

SEQ ID NO: 3800567 - RNA, 21 nt, Human
ccgucgaggggcucucagcuc

SEQ ID NO: 3800568 - RNA, 15 nt, Human
ccgucuaccugaggg

SEQ ID NO: 3800569 - RNA, 21 nt, Human
ccgucuccaggggcugcuucc

SEQ ID NO: 3800570 - RNA, 13 nt, Human
ccgucucucuccc

SEQ ID NO: 3800571 - RNA, 19 nt, Human
ccgucucucucccauggag

SEQ ID NO: 3800572 - RNA, 13 nt, Human
ccgucugugaauu

SEQ ID NO: 3800573 - RNA, 20 nt, Human
ccgugaagauacuuuguauu

SEQ ID NO: 3800574 - RNA, 23 nt, Human
ccgugaaggcuucucuguucuac

SEQ ID NO: 3800575 - RNA, 19 nt, Human
ccgugaaugggugcccaca

SEQ ID NO: 3800576 - RNA, 18 nt, Human
ccgugacagacuccugag

SEQ ID NO: 3800577 - RNA, 16 nt, Human
ccgugacgucugggug

SEQ ID NO: 3800578 - RNA, 12 nt, Human
ccgugagcccuu

SEQ ID NO: 3800579 - RNA, 20 nt, Human
ccgugagcgccugugcacac

SEQ ID NO: 3800580 - RNA, 14 nt, Human
ccgugaggauguca

SEQ ID NO: 3800581 - RNA, 14 nt, Human
ccgugaggccagag

SEQ ID NO: 3800582 - RNA, 18 nt, Human
ccgugaggccagagacac

SEQ ID NO: 3800583 - RNA, 20 nt, Human
ccgugaguucucagggcucc

SEQ ID NO: 3800584 - RNA, 23 nt, Human
ccgugaguucucagggcuccugc

SEQ ID NO: 3800585 - RNA, 19 nt, Human
ccgugcagacuggagggga

SEQ ID NO: 3800586 - RNA, 19 nt, Human
ccgugccaaagucucccuu

SEQ ID NO: 3800587 - RNA, 20 nt, Human
ccgugccaaguccagguccu

SEQ ID NO: 3800588 - RNA, 14 nt, Human
ccgugccgccugca

SEQ ID NO: 3800589 - RNA, 17 nt, Human
ccgugcucgccccagca

SEQ ID NO: 3800590 - RNA, 16 nt, Human
ccgugcugggcagccc

SEQ ID NO: 3800591 - RNA, 14 nt, Human
ccgugcuuccucag

SEQ ID NO: 3800592 - RNA, 21 nt, Human
ccgugcuuuuaaggaaaggca

SEQ ID NO: 3800593 - RNA, 14 nt, Human
ccguggaccuuccu

SEQ ID NO: 3800594 - RNA, 17 nt, Human
ccguggaccuuccugcc

SEQ ID NO: 3800595 - RNA, 23 nt, Human
ccguggaggaggaaggcaagagg

SEQ ID NO: 3800596 - RNA, 11 nt, Human
ccguggaggcu

SEQ ID NO: 3800597 - RNA, 16 nt, Human
ccguggaggcugcucg

SEQ ID NO: 3800598 - RNA, 21 nt, Human
ccguggauggccguggaugcg

SEQ ID NO: 3800599 - RNA, 17 nt, Human
ccguggccaucccugug

SEQ ID NO: 3800600 - RNA, 19 nt, Human
ccguggccaucccugugag

SEQ ID NO: 3800601 - RNA, 14 nt, Human
ccguggccccagcc

SEQ ID NO: 3800602 - RNA, 19 nt, Human
ccguggccccagccuggcc

SEQ ID NO: 3800603 - RNA, 20 nt, Human
ccguggccccagccuggccc

SEQ ID NO: 3800604 - RNA, 21 nt, Human
ccguggcccuuccuggacagc

SEQ ID NO: 3800605 - RNA, 22 nt, Human
ccguggcccuuccuggacagcu

SEQ ID NO: 3800606 - RNA, 16 nt, Human
ccguggcugcuguggg

SEQ ID NO: 3800607 - RNA, 17 nt, Human
ccguggcugcuguggga

SEQ ID NO: 3800608 - RNA, 20 nt, Human
ccguggcugcugugggaaau

SEQ ID NO: 3800609 - RNA, 21 nt, Human
ccguggcuucccgcucagccc

SEQ ID NO: 3800610 - RNA, 15 nt, Human
ccguggcuuugguuu

SEQ ID NO: 3800611 - RNA, 19 nt, Human
ccgugggcacugaaggcuu

SEQ ID NO: 3800612 - RNA, 13 nt, Human
ccgugggccuggg

SEQ ID NO: 3800613 - RNA, 18 nt, Human
ccgugggcggggccuugc

SEQ ID NO: 3800614 - RNA, 13 nt, Human
ccguggggcaggg

SEQ ID NO: 3800615 - RNA, 17 nt, Human
ccguggggccgccgccu

SEQ ID NO: 3800616 - RNA, 20 nt, Human
ccguggggccgccgccucuu

SEQ ID NO: 3800617 - RNA, 14 nt, Human
ccguggguugcuaa

SEQ ID NO: 3800618 - RNA, 15 nt, Human
ccguggguugcuaac

SEQ ID NO: 3800619 - RNA, 17 nt, Human
ccguggguugcuaacug

SEQ ID NO: 3800620 - RNA, 20 nt, Human
ccguggguugcuaacugaac

SEQ ID NO: 3800621 - RNA, 14 nt, Human
ccgugguccuuugg

SEQ ID NO: 3800622 - RNA, 16 nt, Human
ccguguaaaccaaagc

SEQ ID NO: 3800623 - RNA, 18 nt, Human
ccguguaggaaccugcac

SEQ ID NO: 3800624 - RNA, 18 nt, Human
ccgugucaagcugcucug

SEQ ID NO: 3800625 - RNA, 23 nt, Human
ccgugucaagcugcucugagcca

SEQ ID NO: 3800626 - RNA, 18 nt, Human
ccguguccacccccauac

SEQ ID NO: 3800627 - RNA, 16 nt, Human
ccgugucugucuggca

SEQ ID NO: 3800628 - RNA, 21 nt, Human
ccgugugagugugacagggcc

SEQ ID NO: 3800629 - RNA, 13 nt, Human
ccguguggccccu

SEQ ID NO: 3800630 - RNA, 20 nt, Human
ccgugugggagaccggccug

SEQ ID NO: 3800631 - RNA, 21 nt, Human
ccgugugguaagcaacauggc

SEQ ID NO: 3800632 - RNA, 14 nt, Human
ccguguuccccucu

SEQ ID NO: 3800633 - RNA, 21 nt, Human
ccguguugcagguucauggau

SEQ ID NO: 3800634 - RNA, 22 nt, Human
ccguguugcaugaaggagcagc

SEQ ID NO: 3800635 - RNA, 14 nt, Human
ccguguuugucucu

SEQ ID NO: 3800636 - RNA, 19 nt, Human
ccguguuugucucuucugg

SEQ ID NO: 3800637 - RNA, 13 nt, Human
ccguuacucucca

SEQ ID NO: 3800638 - RNA, 22 nt, Human
ccguuacucuccaaccuggaca

SEQ ID NO: 3800639 - RNA, 13 nt, Human
ccguuagcuccug

SEQ ID NO: 3800640 - RNA, 15 nt, Human
ccguuagcuccugug

SEQ ID NO: 3800641 - RNA, 20 nt, Human
ccguuauuaaaaaucucaaa

SEQ ID NO: 3800642 - RNA, 21 nt, Human
ccguuauuauaauuguaucag

SEQ ID NO: 3800643 - RNA, 18 nt, Human
ccguuccaccccaagaga

SEQ ID NO: 3800644 - RNA, 23 nt, Human
ccguuccugacaucacagcagcc

SEQ ID NO: 3800645 - RNA, 18 nt, Human
ccguucugcuggccugga

SEQ ID NO: 3800646 - RNA, 13 nt, Human
ccguugccaaccg

SEQ ID NO: 3800647 - RNA, 17 nt, Human
ccguugcugacuuagaa

SEQ ID NO: 3800648 - RNA, 11 nt, Human
ccguuggccac

SEQ ID NO: 3800649 - RNA, 16 nt, Human
caggccuccagcucag

SEQ ID NO: 3800650 - RNA, 12 nt, Human
caggccucccuc

SEQ ID NO: 3800651 - RNA, 13 nt, Human
caggccucccucu

SEQ ID NO: 3800652 - RNA, 14 nt, Human
caggccucccucuc

SEQ ID NO: 3800653 - RNA, 17 nt, Human
caggccucccucucucu

SEQ ID NO: 3800654 - RNA, 22 nt, Human
caggccucccucucucuucugc

SEQ ID NO: 3800655 - RNA, 13 nt, Human
caggccucccugu

SEQ ID NO: 3800656 - RNA, 13 nt, Human
caggccucuccau

SEQ ID NO: 3800657 - RNA, 13 nt, Human
caggccucugugu

SEQ ID NO: 3800658 - RNA, 15 nt, Human
caggccucugugucc

SEQ ID NO: 3800659 - RNA, 15 nt, Human
caggccucuuggcag

SEQ ID NO: 3800660 - RNA, 18 nt, Human
caggccucuuggcaguca

SEQ ID NO: 3800661 - RNA, 22 nt, Human
caggccugaaagaggcugaggc

SEQ ID NO: 3800662 - RNA, 20 nt, Human
caggccugccuguucccauu

SEQ ID NO: 3800663 - RNA, 17 nt, Human
caggccuggcaaguggg

SEQ ID NO: 3800664 - RNA, 17 nt, Human
caggccugggccagagu

SEQ ID NO: 3800665 - RNA, 22 nt, Human
caggccugggggcugggcagag

SEQ ID NO: 3800666 - RNA, 23 nt, Human
caggccugggggcugggcagagg

SEQ ID NO: 3800667 - RNA, 15 nt, Human
caggccuguccaaca

SEQ ID NO: 3800668 - RNA, 18 nt, Human
caggccuguguagcugug

SEQ ID NO: 3800669 - RNA, 21 nt, Human
caggccuguguagcugugacc

SEQ ID NO: 3800670 - RNA, 22 nt, Human
caggccuguguagcugugaccu

SEQ ID NO: 3800671 - RNA, 12 nt, Human
caggccugugug

SEQ ID NO: 3800672 - RNA, 11 nt, Human
caggccuugcg

SEQ ID NO: 3800673 - RNA, 18 nt, Human
caggccuuugagaaaggg

SEQ ID NO: 3800674 - RNA, 19 nt, Human
caggcgauccaccugucuc

SEQ ID NO: 3800675 - RNA, 20 nt, Human
caggcgauccaccugucuca

SEQ ID NO: 3800676 - RNA, 13 nt, Human
caggcgcaaggga

SEQ ID NO: 3800677 - RNA, 23 nt, Human
caggcgcaagggaggcccagcgc

SEQ ID NO: 3800678 - RNA, 22 nt, Human
caggcgcuagcacagcucccuu

SEQ ID NO: 3800679 - RNA, 17 nt, Human
caggcgcugaguaugga

SEQ ID NO: 3800680 - RNA, 17 nt, Human
caggcgggacagugcug

SEQ ID NO: 3800681 - RNA, 21 nt, Human
caggcgggagcgguggcccug

SEQ ID NO: 3800682 - RNA, 16 nt, Human
cagggacacgggcagc

SEQ ID NO: 3800683 - RNA, 19 nt, Human
cagggacagagacaccugc

SEQ ID NO: 3800684 - RNA, 21 nt, Human
cagggacagagacaccugcac

SEQ ID NO: 3800685 - RNA, 18 nt, Human
cagggacagaggccccag

SEQ ID NO: 3800686 - RNA, 18 nt, Human
cagggacaggauaagagg

SEQ ID NO: 3800687 - RNA, 22 nt, Human
cagggacccacuucacacacag

SEQ ID NO: 3800688 - RNA, 14 nt, Human
cagggaccccagaa

SEQ ID NO: 3800689 - RNA, 21 nt, Human
cagggacuaugaaugggcaaa

SEQ ID NO: 3800690 - RNA, 12 nt, Human
cagggacucagg

SEQ ID NO: 3800691 - RNA, 21 nt, Human
cagggacucaucuuucccucc

SEQ ID NO: 3800692 - RNA, 23 nt, Human
cagggacugaaaaccucuccuca

SEQ ID NO: 3800693 - RNA, 22 nt, Human
cagggagacuggguaggaaaga

SEQ ID NO: 3800694 - RNA, 13 nt, Human
cagggagagccca

SEQ ID NO: 3800695 - RNA, 16 nt, Human
cagggagagcccagga

SEQ ID NO: 3800696 - RNA, 20 nt, Human
cagggagagcccaggagcuc

SEQ ID NO: 3800697 - RNA, 23 nt, Human
cagggagaggagugacugagcuu

SEQ ID NO: 3800698 - RNA, 17 nt, Human
cagggagaggccaugau

SEQ ID NO: 3800699 - RNA, 19 nt, Human
cagggagcaagggcaggga

SEQ ID NO: 3800700 - RNA, 14 nt, Human
cagggagcagggaa

SEQ ID NO: 3800701 - RNA, 16 nt, Human
cagggagcagggaagg

SEQ ID NO: 3800702 - RNA, 18 nt, Human
cagggagcagggaaggcc

SEQ ID NO: 3800703 - RNA, 21 nt, Human
cagggagcagggaaggccuga

SEQ ID NO: 3800704 - RNA, 23 nt, Human
cagggagcaugagaggaggcagc

SEQ ID NO: 3800705 - RNA, 18 nt, Human
cagggagccuccugccca

SEQ ID NO: 3800706 - RNA, 16 nt, Human
cagggagcggaaagca

SEQ ID NO: 3800707 - RNA, 17 nt, Human
cagggagcggaaagcag

SEQ ID NO: 3800708 - RNA, 17 nt, Human
cagggagcggccggcca

SEQ ID NO: 3800709 - RNA, 23 nt, Human
cagggagcggccggccagccccu

SEQ ID NO: 3800710 - RNA, 19 nt, Human
cagggagcugggcccgaca

SEQ ID NO: 3800711 - RNA, 19 nt, Human
cagggaggacgcucucugg

SEQ ID NO: 3800712 - RNA, 21 nt, Human
cagggaggacgcucucuggcc

SEQ ID NO: 3800713 - RNA, 12 nt, Human
cagggaggagag

SEQ ID NO: 3800714 - RNA, 20 nt, Human
cagggaggagguggcagccc

SEQ ID NO: 3800715 - RNA, 24 nt, Human
cagggaggcaccauucaggaaccu

SEQ ID NO: 3800716 - RNA, 13 nt, Human
cagggaggcagcc

SEQ ID NO: 3800717 - RNA, 14 nt, Human
cagggaggcagccg

SEQ ID NO: 3800718 - RNA, 16 nt, Human
cagggaggcugguccu

SEQ ID NO: 3800719 - RNA, 22 nt, Human
cagggaggcugguccuauggcc

SEQ ID NO: 3800720 - RNA, 12 nt, Human
cagggagggccu

SEQ ID NO: 3800721 - RNA, 14 nt, Human
cagggaggucaggc

SEQ ID NO: 3800722 - RNA, 18 nt, Human
cagggaggucaggcccug

SEQ ID NO: 3800723 - RNA, 23 nt, Human
cagggaggucaggcccuggaacu

SEQ ID NO: 3800724 - RNA, 16 nt, Human
cagggaggucauuuug

SEQ ID NO: 3800725 - RNA, 18 nt, Human
cagggaggugaccccagg

SEQ ID NO: 3800726 - RNA, 17 nt, Human
cagggagguggcugggu

SEQ ID NO: 3800727 - RNA, 12 nt, Human
cagggaguguuc

SEQ ID NO: 3800728 - RNA, 18 nt, Human
cagggauaacaaagaacc

SEQ ID NO: 3800729 - RNA, 19 nt, Human
cagggaucuugcauuccca

SEQ ID NO: 3800730 - RNA, 19 nt, Human
cagggaugagcauggagcu

SEQ ID NO: 3800731 - RNA, 23 nt, Human
cagggaugccaucugugggcacg

SEQ ID NO: 3800732 - RNA, 13 nt, Human
cagggaugcccug

SEQ ID NO: 3800733 - RNA, 14 nt, Human
cagggaugcccugg

SEQ ID NO: 3800734 - RNA, 22 nt, Human
cagggaugcccuggagguggcu

SEQ ID NO: 3800735 - RNA, 17 nt, Human
cagggauggggccacag

SEQ ID NO: 3800736 - RNA, 19 nt, Human
cagggauggggccacagcc

SEQ ID NO: 3800737 - RNA, 18 nt, Human
cagggauguacaaggcga

SEQ ID NO: 3800738 - RNA, 21 nt, Human
cagggauguagauuaagguga

SEQ ID NO: 3800739 - RNA, 21 nt, Human
cagggauguggguuccacaga

SEQ ID NO: 3800740 - RNA, 22 nt, Human
cagggauugauuuuaaaaugua

SEQ ID NO: 3800741 - RNA, 18 nt, Human
cagggcaaagccaggucc

SEQ ID NO: 3800742 - RNA, 13 nt, Human
cagggcaagcucc

SEQ ID NO: 3800743 - RNA, 15 nt, Human
cagggcaagcuccgc

SEQ ID NO: 3800744 - RNA, 20 nt, Human
cagggcaaggguuaaggccu

SEQ ID NO: 3800745 - RNA, 22 nt, Human
cagggcaauaaaaugaccaugg

SEQ ID NO: 3800746 - RNA, 17 nt, Human
cagggcacaccgggcac

SEQ ID NO: 3800747 - RNA, 19 nt, Human
cagggcacaccgggcacuc

SEQ ID NO: 3800748 - RNA, 21 nt, Human
cagggcacaccgggcacucag

SEQ ID NO: 3800749 - RNA, 14 nt, Human
cagggcacaggagc

SEQ ID NO: 3800750 - RNA, 16 nt, Human
cagggcacaggagcua

SEQ ID NO: 3800751 - RNA, 18 nt, Human
cagggcacaggagcuacc

SEQ ID NO: 3800752 - RNA, 12 nt, Human
cagggcacaggg

SEQ ID NO: 3800753 - RNA, 15 nt, Human
cagggcacagggccu

SEQ ID NO: 3800754 - RNA, 16 nt, Human
cagggcacagggccug

SEQ ID NO: 3800755 - RNA, 17 nt, Human
cagggcacagggccugg

SEQ ID NO: 3800756 - RNA, 19 nt, Human
cagggcacagggccuggcc

SEQ ID NO: 3800757 - RNA, 20 nt, Human
cagggcacagggccuggccc

SEQ ID NO: 3800758 - RNA, 19 nt, Human
cagggcaccaagcccacag

SEQ ID NO: 3800759 - RNA, 13 nt, Human
cagggcagaguga

SEQ ID NO: 3800760 - RNA, 22 nt, Human
cagggcagauuuuaguuuuauu

SEQ ID NO: 3800761 - RNA, 13 nt, Human
cagggcagcagau

SEQ ID NO: 3800762 - RNA, 15 nt, Human
cagggcagcagaucu

SEQ ID NO: 3800763 - RNA, 14 nt, Human
cagggcagccaggg

SEQ ID NO: 3800764 - RNA, 15 nt, Human
cagggcagccaggga

SEQ ID NO: 3800765 - RNA, 20 nt, Human
cagggcagccagggagagcc

SEQ ID NO: 3800766 - RNA, 12 nt, Human
cagggcagcccc

SEQ ID NO: 3800767 - RNA, 19 nt, Human
cagggcagccugccuggag

SEQ ID NO: 3800768 - RNA, 17 nt, Human
cagggcagcgccaggcu

SEQ ID NO: 3800769 - RNA, 14 nt, Human
cagggcagcugggc

SEQ ID NO: 3800770 - RNA, 20 nt, Human
cagggcagcugggcccaacc

SEQ ID NO: 3800771 - RNA, 21 nt, Human
cagggcagcugggcccaaccc

SEQ ID NO: 3800772 - RNA, 13 nt, Human
cagggcaggacca

SEQ ID NO: 3800773 - RNA, 18 nt, Human
cagggcaggaccagccca

SEQ ID NO: 3800774 - RNA, 19 nt, Human
cagggcaggaccagcccac

SEQ ID NO: 3800775 - RNA, 14 nt, Human
cagggcaguaccug

SEQ ID NO: 3800776 - RNA, 22 nt, Human
cagggcagugcuagugagcugg

SEQ ID NO: 3800777 - RNA, 15 nt, Human
cagggcaucuccagg

SEQ ID NO: 3800778 - RNA, 19 nt, Human
cagggcaucucugggcugg

SEQ ID NO: 3800779 - RNA, 24 nt, Human
cagggcaucucugggcuggaugag

SEQ ID NO: 3800780 - RNA, 15 nt, Human
cagggcaucuugcug

SEQ ID NO: 3800781 - RNA, 23 nt, Human
cagggcaugaaaugaacacaaau

SEQ ID NO: 3800782 - RNA, 15 nt, Human
cagggcaugccacgu

SEQ ID NO: 3800783 - RNA, 21 nt, Human
cagggcaugccccggccaccu

SEQ ID NO: 3800784 - RNA, 23 nt, Human
cagggcaugccccggccaccucu

SEQ ID NO: 3800785 - RNA, 17 nt, Human
cagggcauggcugggaa

SEQ ID NO: 3800786 - RNA, 22 nt, Human
cagggccacgcuccagcugccc

SEQ ID NO: 3800787 - RNA, 16 nt, Human
cagggccacgugccag

SEQ ID NO: 3800788 - RNA, 17 nt, Human
cagggccacgugccagg

SEQ ID NO: 3800789 - RNA, 12 nt, Human
cagggccacucu

SEQ ID NO: 3800790 - RNA, 17 nt, Human
cagggccacucugccuc

SEQ ID NO: 3800791 - RNA, 18 nt, Human
cagggccacucugccucu

SEQ ID NO: 3800792 - RNA, 14 nt, Human
cagggccaggacug

SEQ ID NO: 3800793 - RNA, 15 nt, Human
cagggccaggacuga

SEQ ID NO: 3800794 - RNA, 18 nt, Human
cagggccaggacugagcc

SEQ ID NO: 3800795 - RNA, 16 nt, Human
cagggccagggcccug

SEQ ID NO: 3800796 - RNA, 17 nt, Human
cagggccaguggggccu

SEQ ID NO: 3800797 - RNA, 18 nt, Human
cagggccaguggggccug

SEQ ID NO: 3800798 - RNA, 22 nt, Human
cagggccaguggggccugugga

SEQ ID NO: 3800799 - RNA, 17 nt, Human
cagggccaugccugccc

SEQ ID NO: 3800800 - RNA, 18 nt, Human
cagggccaugcugaggcc

SEQ ID NO: 3800801 - RNA, 22 nt, Human
cagggccaugcugaggccuggg

SEQ ID NO: 3800802 - RNA, 17 nt, Human
cagggccaugucagaca

SEQ ID NO: 3800803 - RNA, 19 nt, Human
cagggcccaagucccuguu

SEQ ID NO: 3800804 - RNA, 13 nt, Human
cagggccccagaa

SEQ ID NO: 3800805 - RNA, 14 nt, Human
cagggccccagcac

SEQ ID NO: 3800806 - RNA, 15 nt, Human
cagggccccagcacu

SEQ ID NO: 3800807 - RNA, 20 nt, Human
cagggccccaggcauugcca

SEQ ID NO: 3800808 - RNA, 21 nt, Human
cagggcccccaucucaugccc

SEQ ID NO: 3800809 - RNA, 21 nt, Human
cagggccccucacccugccuu

SEQ ID NO: 3800810 - RNA, 22 nt, Human
cagggccccucuccccagggaa

SEQ ID NO: 3800811 - RNA, 20 nt, Human
cagggcccgggaagcaaaug

SEQ ID NO: 3800812 - RNA, 16 nt, Human
ccuaccugugccugac

SEQ ID NO: 3800813 - RNA, 22 nt, Human
ccuaccuguucagugucccggg

SEQ ID NO: 3800814 - RNA, 15 nt, Human
ccuaccuucaaagcu

SEQ ID NO: 3800815 - RNA, 13 nt, Human
ccuaccuugcuuu

SEQ ID NO: 3800816 - RNA, 20 nt, Human
ccuacgucaaacaugaagug

SEQ ID NO: 3800817 - RNA, 14 nt, Human
ccuacucacacagg

SEQ ID NO: 3800818 - RNA, 15 nt, Human
ccuacucccugcaga

SEQ ID NO: 3800819 - RNA, 11 nt, Human
ccuacuccuga

SEQ ID NO: 3800820 - RNA, 13 nt, Human
ccuacuccugacu

SEQ ID NO: 3800821 - RNA, 19 nt, Human
ccuacuccugucuucugcu

SEQ ID NO: 3800822 - RNA, 22 nt, Human
ccuacuccugucuucugcuuug

SEQ ID NO: 3800823 - RNA, 18 nt, Human
ccuacucggcucugcagu

SEQ ID NO: 3800824 - RNA, 23 nt, Human
ccuacucugugucagguggggca

SEQ ID NO: 3800825 - RNA, 18 nt, Human
ccuacucuucucucugcu

SEQ ID NO: 3800826 - RNA, 15 nt, Human
ccaaguccagguccu

SEQ ID NO: 3800827 - RNA, 16 nt, Human
ccaaguccagguccug

SEQ ID NO: 3800828 - RNA, 23 nt, Human
ccaagucccuguuuucugagccc

SEQ ID NO: 3800829 - RNA, 21 nt, Human
ccaaguccgcagaagcccuga

SEQ ID NO: 3800830 - RNA, 15 nt, Human
ccaaguccugaagag

SEQ ID NO: 3800831 - RNA, 18 nt, Human
ccaagucggaacagcaga

SEQ ID NO: 3800832 - RNA, 14 nt, Human
ccaagucuacagag

SEQ ID NO: 3800833 - RNA, 16 nt, Human
ccaagugcaggcuggc

SEQ ID NO: 3800834 - RNA, 14 nt, Human
ccaagugccagagg

SEQ ID NO: 3800835 - RNA, 16 nt, Human
ccaagugccagaggug

SEQ ID NO: 3800836 - RNA, 18 nt, Human
ccaagugccagagguggg

SEQ ID NO: 3800837 - RNA, 13 nt, Human
ccaagugcgugcc

SEQ ID NO: 3800838 - RNA, 20 nt, Human
ccaaguggaccuugagacca

SEQ ID NO: 3800839 - RNA, 22 nt, Human
ccaaguggagccugacagccag

SEQ ID NO: 3800840 - RNA, 14 nt, Human
ccaaguggcagagc

SEQ ID NO: 3800841 - RNA, 17 nt, Human
ccaaguggcagagcuug

SEQ ID NO: 3800842 - RNA, 14 nt, Human
ccaaguggugccua

SEQ ID NO: 3800843 - RNA, 17 nt, Human
ccaagugugugugcgug

SEQ ID NO: 3800844 - RNA, 20 nt, Human
ccaaguuauauaaagagaaa

SEQ ID NO: 3800845 - RNA, 22 nt, Human
ccaaguuauauaaagagaaaau

SEQ ID NO: 3800846 - RNA, 11 nt, Human
ccaaguuccuc

SEQ ID NO: 3800847 - RNA, 20 nt, Human
ccaaguugugcuugagccag

SEQ ID NO: 3800848 - RNA, 22 nt, Human
ccaaguugugcuugagccagga

SEQ ID NO: 3800849 - RNA, 18 nt, Human
ccaaguuguggugcugac

SEQ ID NO: 3800850 - RNA, 16 nt, Human
ccaaguuuccauagca

SEQ ID NO: 3800851 - RNA, 16 nt, Human
ccaaguuuugugaaau

SEQ ID NO: 3800852 - RNA, 20 nt, Human
ccaauaaaccaaugaacgaa

SEQ ID NO: 3800853 - RNA, 17 nt, Human
ccaauaccccauggacc

SEQ ID NO: 3800854 - RNA, 18 nt, Human
ccaauagcaaauucaaag

SEQ ID NO: 3800855 - RNA, 18 nt, Human
ccaauaggcaaauuaauc

SEQ ID NO: 3800856 - RNA, 22 nt, Human
ccaauaguuguugauuggcagg

SEQ ID NO: 3800857 - RNA, 19 nt, Human
ccaauauccucgcucccgg

SEQ ID NO: 3800858 - RNA, 20 nt, Human
ccaauauccucgcucccggg

SEQ ID NO: 3800859 - RNA, 22 nt, Human
ccaauauuggagcauaucaaaa

SEQ ID NO: 3800860 - RNA, 15 nt, Human
ccaauauuguacagu

SEQ ID NO: 3800861 - RNA, 17 nt, Human
ccaauauuuaccagacc

SEQ ID NO: 3800862 - RNA, 19 nt, Human
ccaauauuucugcuuucuu

SEQ ID NO: 3800863 - RNA, 21 nt, Human
ccaaucagagaccaggcccug

SEQ ID NO: 3800864 - RNA, 13 nt, Human
ccaaucagcacug

SEQ ID NO: 3800865 - RNA, 18 nt, Human
ccaaucagcacugaaaau

SEQ ID NO: 3800866 - RNA, 15 nt, Human
ccaaucauauuaaua

SEQ ID NO: 3800867 - RNA, 12 nt, Human
ccaaucauuuua

SEQ ID NO: 3800868 - RNA, 20 nt, Human
ccaauccagguacgcacaga

SEQ ID NO: 3800869 - RNA, 23 nt, Human
ccaauccuaugcaugguuucagc

SEQ ID NO: 3800870 - RNA, 18 nt, Human
ccaauccucacugggugg

SEQ ID NO: 3800871 - RNA, 13 nt, Human
ccaauccugcccc

SEQ ID NO: 3800872 - RNA, 14 nt, Human
ccaaucuuacuuug

SEQ ID NO: 3800873 - RNA, 15 nt, Human
ccaaucuuacuuugu

SEQ ID NO: 3800874 - RNA, 16 nt, Human
ccaaucuuacuuugua

SEQ ID NO: 3800875 - RNA, 15 nt, Human
ccaaugaaaaaaugu

SEQ ID NO: 3800876 - RNA, 12 nt, Human
ccaaugaauaau

SEQ ID NO: 3800877 - RNA, 18 nt, Human
ccaaugaauuauuauaua

SEQ ID NO: 3800878 - RNA, 16 nt, Human
ccaaugagacuugccu

SEQ ID NO: 3800879 - RNA, 18 nt, Human
ccaaugagacuugccuuc

SEQ ID NO: 3800880 - RNA, 16 nt, Human
ccaaugagcuuucuga

SEQ ID NO: 3800881 - RNA, 19 nt, Human
ccaaugaggucugaaaugg

SEQ ID NO: 3800882 - RNA, 19 nt, Human
ccaaugcacauccauuccc

SEQ ID NO: 3800883 - RNA, 18 nt, Human
ccaaugcaccuaaagaaa

SEQ ID NO: 3800884 - RNA, 22 nt, Human
ccaaugcacuuuguucuggcuc

SEQ ID NO: 3800885 - RNA, 23 nt, Human
ccaaugcacuuuguucuggcucu

SEQ ID NO: 3800886 - RNA, 14 nt, Human
ccaaugcagaacuc

SEQ ID NO: 3800887 - RNA, 17 nt, Human
ccaaugcaugcagccac

SEQ ID NO: 3800888 - RNA, 21 nt, Human
ccaaugcaugcagccacugug

SEQ ID NO: 3800889 - RNA, 18 nt, Human
ccaaugccccacuggcag

SEQ ID NO: 3800890 - RNA, 19 nt, Human
ccaauggaaccuccuuucu

SEQ ID NO: 3800891 - RNA, 22 nt, Human
ccaauggaaugugauguucaug

SEQ ID NO: 3800892 - RNA, 17 nt, Human
ccaauguaggagcugcc

SEQ ID NO: 3800893 - RNA, 16 nt, Human
ccaaugucuggagacc

SEQ ID NO: 3800894 - RNA, 19 nt, Human
ccaaugugaacagcggcug

SEQ ID NO: 3800895 - RNA, 14 nt, Human
ccaauguuuaaaaa

SEQ ID NO: 3800896 - RNA, 16 nt, Human
ccaauguuuaaaaaag

SEQ ID NO: 3800897 - RNA, 18 nt, Human
ccaauguuuuccacccau

SEQ ID NO: 3800898 - RNA, 18 nt, Human
ccaauuaaggauuuuaug

SEQ ID NO: 3800899 - RNA, 16 nt, Human
ccaauuaguuuccuuu

SEQ ID NO: 3800900 - RNA, 15 nt, Human
ccaauuauguuaaac

SEQ ID NO: 3800901 - RNA, 14 nt, Human
ccaauucagacagg

SEQ ID NO: 3800902 - RNA, 20 nt, Human
ccaauuccuugcacauagua

SEQ ID NO: 3800903 - RNA, 12 nt, Human
ccaauuccuugu

SEQ ID NO: 3800904 - RNA, 14 nt, Human
ccaauuccuuguag

SEQ ID NO: 3800905 - RNA, 11 nt, Human
ccaauucuuac

SEQ ID NO: 3800906 - RNA, 15 nt, Human
ccaauugugcugcca

SEQ ID NO: 3800907 - RNA, 19 nt, Human
ccaauuucaaguuccaagu

SEQ ID NO: 3800908 - RNA, 22 nt, Human
ccaauuucccacccccacccac

SEQ ID NO: 3800909 - RNA, 20 nt, Human
ccaauuucggauuuuuucca

SEQ ID NO: 3800910 - RNA, 10 nt, Human
ccaauuucuc

SEQ ID NO: 3800911 - RNA, 20 nt, Human
ccaauuugcacauuaaauga

SEQ ID NO: 3800912 - RNA, 22 nt, Human
ccaauuuuaauuuaguaaaugu

SEQ ID NO: 3800913 - RNA, 17 nt, Human
ccaauuuuuuuuuccuu

SEQ ID NO: 3800914 - RNA, 22 nt, Human
ccacaaaaacagguauauacuu

SEQ ID NO: 3800915 - RNA, 16 nt, Human
ccacaaaacaaagcaa

SEQ ID NO: 3800916 - RNA, 23 nt, Human
ccacaaaauaaccaauccuggac

SEQ ID NO: 3800917 - RNA, 12 nt, Human
ccacaaaauaua

SEQ ID NO: 3800918 - RNA, 18 nt, Human
ccacaacccuguuuuaua

SEQ ID NO: 3800919 - RNA, 16 nt, Human
ccacaacgugcaacug

SEQ ID NO: 3800920 - RNA, 22 nt, Human
ccacaacuccugucuaacugcu

SEQ ID NO: 3800921 - RNA, 12 nt, Human
ccacaacugaca

SEQ ID NO: 3800922 - RNA, 15 nt, Human
ccacaacugacacag

SEQ ID NO: 3800923 - RNA, 19 nt, Human
ccacaacugacacaggaaa

SEQ ID NO: 3800924 - RNA, 14 nt, Human
ccacaacuuuuaac

SEQ ID NO: 3800925 - RNA, 16 nt, Human
ccacaagacccuugug

SEQ ID NO: 3800926 - RNA, 21 nt, Human
ccacaagccugagggaaaggc

SEQ ID NO: 3800927 - RNA, 22 nt, Human
ccacaagucuuccagaggaugc

SEQ ID NO: 3800928 - RNA, 13 nt, Human
ccacacacacaca

SEQ ID NO: 3800929 - RNA, 15 nt, Human
ccacacacacacaca

SEQ ID NO: 3800930 - RNA, 21 nt, Human
ccacacacacacacaugcaua

SEQ ID NO: 3800931 - RNA, 16 nt, Human
ccacacacacagaaaa

SEQ ID NO: 3800932 - RNA, 20 nt, Human
ccacacacacagaaaauaua

SEQ ID NO: 3800933 - RNA, 21 nt, Human
ccacacacacagaaaauauac

SEQ ID NO: 3800934 - RNA, 22 nt, Human
ccacacacagaggaagagcagg

SEQ ID NO: 3800935 - RNA, 13 nt, Human
ccacacaccccaa

SEQ ID NO: 3800936 - RNA, 23 nt, Human
ccacacacgcaggaacucccagc

SEQ ID NO: 3800937 - RNA, 15 nt, Human
ccacacagaaugcaa

SEQ ID NO: 3800938 - RNA, 15 nt, Human
ccacacaucccagcc

SEQ ID NO: 3800939 - RNA, 17 nt, Human
ccacacaucccagccca

SEQ ID NO: 3800940 - RNA, 18 nt, Human
ccacacaucccagcccaa

SEQ ID NO: 3800941 - RNA, 14 nt, Human
ccacaccaagcugu

SEQ ID NO: 3800942 - RNA, 20 nt, Human
ccacaccaagcugugccacc

SEQ ID NO: 3800943 - RNA, 13 nt, Human
ccacaccacaucu

SEQ ID NO: 3800944 - RNA, 21 nt, Human
ccacaccauaagcuacugcca

SEQ ID NO: 3800945 - RNA, 23 nt, Human
ccacaccauaagcuacugccauc

SEQ ID NO: 3800946 - RNA, 21 nt, Human
ccacacccagcccacuucugc

SEQ ID NO: 3800947 - RNA, 22 nt, Human
ccacacccagcccacuucugcc

SEQ ID NO: 3800948 - RNA, 15 nt, Human
ccacacccagccuca

SEQ ID NO: 3800949 - RNA, 16 nt, Human
ccacacccagccucag

SEQ ID NO: 3800950 - RNA, 17 nt, Human
ccacacccagccucagu

SEQ ID NO: 3800951 - RNA, 20 nt, Human
ccacacccccaccccuugcu

SEQ ID NO: 3800952 - RNA, 15 nt, Human
ccacacccucuccca

SEQ ID NO: 3800953 - RNA, 14 nt, Human
ccacaccgcagaag

SEQ ID NO: 3800954 - RNA, 20 nt, Human
ccacaccguguaaaccaaag

SEQ ID NO: 3800955 - RNA, 13 nt, Human
ccacaccuccaca

SEQ ID NO: 3800956 - RNA, 15 nt, Human
ccacaccuccacagu

SEQ ID NO: 3800957 - RNA, 14 nt, Human
ccacaccucccuga

SEQ ID NO: 3800958 - RNA, 11 nt, Human
ccacaccuccu

SEQ ID NO: 3800959 - RNA, 13 nt, Human
ccacaccuccugg

SEQ ID NO: 3800960 - RNA, 15 nt, Human
ccacaccuccugggg

SEQ ID NO: 3800961 - RNA, 14 nt, Human
ccacaccugccucu

SEQ ID NO: 3800962 - RNA, 18 nt, Human
ccacaccuggcacugcug

SEQ ID NO: 3800963 - RNA, 19 nt, Human
ccacaccuggcacugcugu

SEQ ID NO: 3800964 - RNA, 22 nt, Human
ccacacguaaugaaacuuggau

SEQ ID NO: 3800965 - RNA, 15 nt, Human
cauuauguuaauauu

SEQ ID NO: 3800966 - RNA, 17 nt, Human
cauuauguuaauauuuc

SEQ ID NO: 3800967 - RNA, 13 nt, Human
cauuauuaaauug

SEQ ID NO: 3800968 - RNA, 12 nt, Human
cauuauuacuuu

SEQ ID NO: 3800969 - RNA, 18 nt, Human
cauuauuacuuuugcugu

SEQ ID NO: 3800970 - RNA, 13 nt, Human
cauuauuaucaac

SEQ ID NO: 3800971 - RNA, 17 nt, Human
ccaccaagagggacgcc

SEQ ID NO: 3800972 - RNA, 21 nt, Human
ccaccaagagggacgccuggg

SEQ ID NO: 3800973 - RNA, 17 nt, Human
ccaccaaggucuucagc

SEQ ID NO: 3800974 - RNA, 14 nt, Human
ccaccacacauccc

SEQ ID NO: 3800975 - RNA, 21 nt, Human
ccaccacacugauccagcccu

SEQ ID NO: 3800976 - RNA, 14 nt, Human
ccaccaccacuggc

SEQ ID NO: 3800977 - RNA, 15 nt, Human
ccaccaccagaaagc

SEQ ID NO: 3800978 - RNA, 18 nt, Human
ccaccaccgcccgucugu

SEQ ID NO: 3800979 - RNA, 22 nt, Human
ccaccaccuaggccacuccucc

SEQ ID NO: 3800980 - RNA, 17 nt, Human
cauucuuauaaauauga

SEQ ID NO: 3800981 - RNA, 21 nt, Human
cauucuucccaacuugccuuu

SEQ ID NO: 3800982 - RNA, 18 nt, Human
cauucuucucuagcuggu

SEQ ID NO: 3800983 - RNA, 21 nt, Human
cauucuucucuguugucguaa

SEQ ID NO: 3800984 - RNA, 18 nt, Human
cauucuucugagcacugu

SEQ ID NO: 3800985 - RNA, 13 nt, Human
cauucuucugauc

SEQ ID NO: 3800986 - RNA, 19 nt, Human
cauucuuggcuuaaucauu

SEQ ID NO: 3800987 - RNA, 20 nt, Human
cauucuuggcuuaaucauuu

SEQ ID NO: 3800988 - RNA, 21 nt, Human
cauucuuguaaggcuuugauu

SEQ ID NO: 3800989 - RNA, 18 nt, Human
cauucuugucacaauaaa

SEQ ID NO: 3800990 - RNA, 14 nt, Human
cauucuuucccaac

SEQ ID NO: 3800991 - RNA, 20 nt, Human
cauucuuugcuugaacacag

SEQ ID NO: 3800992 - RNA, 16 nt, Human
cauucuuuuaaaagac

SEQ ID NO: 3800993 - RNA, 18 nt, Human
cauucuuuuaacuucuuu

SEQ ID NO: 3800994 - RNA, 12 nt, Human
cauucuuuugua

SEQ ID NO: 3800995 - RNA, 16 nt, Human
cauucuuuuguaauuu

SEQ ID NO: 3800996 - RNA, 19 nt, Human
cauucuuuuguaauuuaaa

SEQ ID NO: 3800997 - RNA, 14 nt, Human
cauucuuuuugaaa

SEQ ID NO: 3800998 - RNA, 16 nt, Human
cauucuuuuugaaaug

SEQ ID NO: 3800999 - RNA, 17 nt, Human
cauucuuuuugcucuaa

SEQ ID NO: 3801000 - RNA, 19 nt, Human
cauucuuuuuuucuuggcc

SEQ ID NO: 3801001 - RNA, 18 nt, Human
cauugaaaauguaaguaa

SEQ ID NO: 3801002 - RNA, 19 nt, Human
cauugaaagagaaccaguu

SEQ ID NO: 3801003 - RNA, 10 nt, Human
cauugaaaug

SEQ ID NO: 3801004 - RNA, 16 nt, Human
cauugaaaugagcacc

SEQ ID NO: 3801005 - RNA, 19 nt, Human
cauugaaaugagcaccucc

SEQ ID NO: 3801006 - RNA, 13 nt, Human
cauugaaauguca

SEQ ID NO: 3801007 - RNA, 17 nt, Human
cauugaacacaaacugu

SEQ ID NO: 3801008 - RNA, 15 nt, Human
cauugaacagcaaag

SEQ ID NO: 3801009 - RNA, 21 nt, Human
cauugaagaauguuagaguaa

SEQ ID NO: 3801010 - RNA, 15 nt, Human
cauugaagagagagc

SEQ ID NO: 3801011 - RNA, 16 nt, Human
cauugaagagagagcu

SEQ ID NO: 3801012 - RNA, 16 nt, Human
cauugaagccgacucu

SEQ ID NO: 3801013 - RNA, 18 nt, Human
cauugaagccgacucugg

SEQ ID NO: 3801014 - RNA, 18 nt, Human
cauugaaguaaugaauuu

SEQ ID NO: 3801015 - RNA, 19 nt, Human
cauugaaucuguauggcua

SEQ ID NO: 3801016 - RNA, 22 nt, Human
cauugaauggcuauguuuuuaa

SEQ ID NO: 3801017 - RNA, 17 nt, Human
cauugaauuauaaaagc

SEQ ID NO: 3801018 - RNA, 21 nt, Human
cauugaauucuugguugagga

SEQ ID NO: 3801019 - RNA, 22 nt, Human
cauugaauucuugguugaggaa

SEQ ID NO: 3801020 - RNA, 16 nt, Human
cauugacaaaucugug

SEQ ID NO: 3801021 - RNA, 21 nt, Human
cauugacaaaucuguguauau

SEQ ID NO: 3801022 - RNA, 21 nt, Human
cauugacauuauagacauuga

SEQ ID NO: 3801023 - RNA, 15 nt, Human
cauugaccaagaacu

SEQ ID NO: 3801024 - RNA, 21 nt, Human
cauugaccaagaacugcaugg

SEQ ID NO: 3801025 - RNA, 17 nt, Human
cauugacccauagcaca

SEQ ID NO: 3801026 - RNA, 15 nt, Human
cauugaccuauuucc

SEQ ID NO: 3801027 - RNA, 17 nt, Human
cauugaccugaggcccu

SEQ ID NO: 3801028 - RNA, 18 nt, Human
cauugacgauuccuucuc

SEQ ID NO: 3801029 - RNA, 22 nt, Human
cauugacuaucaaacugaagcc

SEQ ID NO: 3801030 - RNA, 22 nt, Human
cauugacuuucaguaaacauaa

SEQ ID NO: 3801031 - RNA, 16 nt, Human
cauugacuuuuauaaa

SEQ ID NO: 3801032 - RNA, 17 nt, Human
cauugaggaagagucuu

SEQ ID NO: 3801033 - RNA, 21 nt, Human
cauugaguagacacauuuaag

SEQ ID NO: 3801034 - RNA, 14 nt, Human
cauugaguauuguu

SEQ ID NO: 3801035 - RNA, 16 nt, Human
cauugaguauuguuua

SEQ ID NO: 3801036 - RNA, 16 nt, Human
cauugaguugguuacu

SEQ ID NO: 3801037 - RNA, 19 nt, Human
cauugauauugugaacauu

SEQ ID NO: 3801038 - RNA, 22 nt, Human
cauugauauuugugcauuuucu

SEQ ID NO: 3801039 - RNA, 14 nt, Human
cauugauggggaag

SEQ ID NO: 3801040 - RNA, 16 nt, Human
cauugauggggaagga

SEQ ID NO: 3801041 - RNA, 19 nt, Human
cauugauggggaaggaggc

SEQ ID NO: 3801042 - RNA, 23 nt, Human
cauugauugcuguguccaacucc

SEQ ID NO: 3801043 - RNA, 18 nt, Human
cauugauuuccuguguca

SEQ ID NO: 3801044 - RNA, 16 nt, Human
cauugauuugauuuuu

SEQ ID NO: 3801045 - RNA, 14 nt, Human
cauugcaacaaaau

SEQ ID NO: 3801046 - RNA, 14 nt, Human
cauugcaauagaaa

SEQ ID NO: 3801047 - RNA, 17 nt, Human
cauugcacagggagacg

SEQ ID NO: 3801048 - RNA, 21 nt, Human
cauugcacauaagcuuccauu

SEQ ID NO: 3801049 - RNA, 20 nt, Human
cauugcacucuagccugggc

SEQ ID NO: 3801050 - RNA, 16 nt, Human
cauugcagucugcuuc

SEQ ID NO: 3801051 - RNA, 16 nt, Human
cauugcauucuauugc

SEQ ID NO: 3801052 - RNA, 11 nt, Human
cauugcauuua

SEQ ID NO: 3801053 - RNA, 13 nt, Human
cauugccaccagg

SEQ ID NO: 3801054 - RNA, 14 nt, Human
cauugccaccagga

SEQ ID NO: 3801055 - RNA, 15 nt, Human
cauugccaccaggag

SEQ ID NO: 3801056 - RNA, 17 nt, Human
cauugccaccaggagaa

SEQ ID NO: 3801057 - RNA, 15 nt, Human
cauugccauucccug

SEQ ID NO: 3801058 - RNA, 16 nt, Human
cauugccauucccugc

SEQ ID NO: 3801059 - RNA, 18 nt, Human
cauugccauucccugccu

SEQ ID NO: 3801060 - RNA, 12 nt, Human
cauugcccuggu

SEQ ID NO: 3801061 - RNA, 20 nt, Human
cauugccucggcuggcuccc

SEQ ID NO: 3801062 - RNA, 14 nt, Human
cauugccugcgguc

SEQ ID NO: 3801063 - RNA, 14 nt, Human
cauugccuuugaau

SEQ ID NO: 3801064 - RNA, 17 nt, Human
cauugccuuugaauguu

SEQ ID NO: 3801065 - RNA, 22 nt, Human
cauugccuuugaauguuaauuu

SEQ ID NO: 3801066 - RNA, 17 nt, Human
cauugcggacagccacg

SEQ ID NO: 3801067 - RNA, 15 nt, Human
cauugcuagauaaaa

SEQ ID NO: 3801068 - RNA, 19 nt, Human
cauugcucccuaagacugu

SEQ ID NO: 3801069 - RNA, 22 nt, Human
cauugcugaaaaugguauuuuc

SEQ ID NO: 3801070 - RNA, 21 nt, Human
cauugcugagccucugcuccc

SEQ ID NO: 3801071 - RNA, 22 nt, Human
cauugcugcuccuuagcugcca

SEQ ID NO: 3801072 - RNA, 13 nt, Human
cauugcuguagga

SEQ ID NO: 3801073 - RNA, 16 nt, Human
cauugcugucugcagc

SEQ ID NO: 3801074 - RNA, 23 nt, Human
cauugcuuguguaguagaaacua

SEQ ID NO: 3801075 - RNA, 14 nt, Human
cauugcuuuacugg

SEQ ID NO: 3801076 - RNA, 18 nt, Human
cauugcuuucguguaaau

SEQ ID NO: 3801077 - RNA, 12 nt, Human
cauugcuuucug

SEQ ID NO: 3801078 - RNA, 17 nt, Human
cauugcuuuuaaaacua

SEQ ID NO: 3801079 - RNA, 18 nt, Human
cauuggaaauuuagcauu

SEQ ID NO: 3801080 - RNA, 20 nt, Human
cauuggaaauuuagcauugu

SEQ ID NO: 3801081 - RNA, 19 nt, Human
cauuggaacuggaggcagg

SEQ ID NO: 3801082 - RNA, 15 nt, Human
cauuggaagacccca

SEQ ID NO: 3801083 - RNA, 17 nt, Human
cauuggaagaccccacc

SEQ ID NO: 3801084 - RNA, 20 nt, Human
cauuggaagaccccacccaa

SEQ ID NO: 3801085 - RNA, 23 nt, Human
cauuggaagcagguuaaauguuu

SEQ ID NO: 3801086 - RNA, 16 nt, Human
cauuggaauguucuca

SEQ ID NO: 3801087 - RNA, 18 nt, Human
cauuggaauguucucaga

SEQ ID NO: 3801088 - RNA, 19 nt, Human
cauuggaauguucucagau

SEQ ID NO: 3801089 - RNA, 16 nt, Human
cauuggagauguuuag

SEQ ID NO: 3801090 - RNA, 20 nt, Human
cauuggauucugagagcugu

SEQ ID NO: 3801091 - RNA, 20 nt, Human
cauuggcaccuaauccaggc

SEQ ID NO: 3801092 - RNA, 14 nt, Human
cauuggcagcaggu

SEQ ID NO: 3801093 - RNA, 17 nt, Human
cauuggcagcaggugcu

SEQ ID NO: 3801094 - RNA, 21 nt, Human
cauuggcagcaggugcugcua

SEQ ID NO: 3801095 - RNA, 18 nt, Human
cauuggcuauuuaaaacu

SEQ ID NO: 3801096 - RNA, 15 nt, Human
cauuggggcucccag

SEQ ID NO: 3801097 - RNA, 16 nt, Human
cauuggggcucccagc

SEQ ID NO: 3801098 - RNA, 23 nt, Human
cauugggguaguuguguuucaac

SEQ ID NO: 3801099 - RNA, 20 nt, Human
cauuggguccugggucuuuc

SEQ ID NO: 3801100 - RNA, 18 nt, Human
cauugggucuauuccagc

SEQ ID NO: 3801101 - RNA, 20 nt, Human
cauugggucuauuccagcuc

SEQ ID NO: 3801102 - RNA, 23 nt, Human
cauuggguuguagccaaagguuc

SEQ ID NO: 3801103 - RNA, 13 nt, Human
cauugguccaaga

SEQ ID NO: 3801104 - RNA, 14 nt, Human
cauugguggacuac

SEQ ID NO: 3801105 - RNA, 17 nt, Human
cauugguguuguacuca

SEQ ID NO: 3801106 - RNA, 13 nt, Human
cauugguguuguc

SEQ ID NO: 3801107 - RNA, 18 nt, Human
cauugguucccuuugcuc

SEQ ID NO: 3801108 - RNA, 15 nt, Human
cauuguaaaagcauu

SEQ ID NO: 3801109 - RNA, 22 nt, Human
cauuguaaaagcauuuuguaau

SEQ ID NO: 3801110 - RNA, 16 nt, Human
cauuguaaaauaauuc

SEQ ID NO: 3801111 - RNA, 18 nt, Human
cauuguaaacaaacucuu

SEQ ID NO: 3801112 - RNA, 13 nt, Human
cauuguaaaccac

SEQ ID NO: 3801113 - RNA, 21 nt, Human
cauuguaaaccacaaggcugu

SEQ ID NO: 3801114 - RNA, 19 nt, Human
cauuguaaauaguauuuga

SEQ ID NO: 3801115 - RNA, 17 nt, Human
ccaaauguucaucaaug

SEQ ID NO: 3801116 - RNA, 19 nt, Human
ccaaauguuuacagggagc

SEQ ID NO: 3801117 - RNA, 23 nt, Human
ccaaauguuuacagggagccucc

SEQ ID NO: 3801118 - RNA, 14 nt, Human
ccaaauguuuauuu

SEQ ID NO: 3801119 - RNA, 12 nt, Human
ccaaauuaaaaa

SEQ ID NO: 3801120 - RNA, 15 nt, Human
ccaaauuaaaaaaga

SEQ ID NO: 3801121 - RNA, 23 nt, Human
ccaaauuaagagagucuauuuac

SEQ ID NO: 3801122 - RNA, 18 nt, Human
ccaaauuaucaagcuaau

SEQ ID NO: 3801123 - RNA, 12 nt, Human
ccaaauuauuug

SEQ ID NO: 3801124 - RNA, 17 nt, Human
ccaaauuauuuguguaa

SEQ ID NO: 3801125 - RNA, 13 nt, Human
ccaaauucaguuu

SEQ ID NO: 3801126 - RNA, 19 nt, Human
ccaaauucaguuucauaaa

SEQ ID NO: 3801127 - RNA, 22 nt, Human
ccaaauucuuucaguggcuacc

SEQ ID NO: 3801128 - RNA, 22 nt, Human
ccaaauugcuccuaagcuucaa

SEQ ID NO: 3801129 - RNA, 17 nt, Human
ccaaauugugcuucucc

SEQ ID NO: 3801130 - RNA, 21 nt, Human
ccaaauugugcuucuccccag

SEQ ID NO: 3801131 - RNA, 23 nt, Human
ccaaauugugcuucuccccagaa

SEQ ID NO: 3801132 - RNA, 11 nt, Human
ccaaauuuaaa

SEQ ID NO: 3801133 - RNA, 17 nt, Human
ccaaauuuucuuuuuau

SEQ ID NO: 3801134 - RNA, 11 nt, Human
ccaacaaacca

SEQ ID NO: 3801135 - RNA, 12 nt, Human
ccaacaaagcug

SEQ ID NO: 3801136 - RNA, 17 nt, Human
ccaacaacauccauguc

SEQ ID NO: 3801137 - RNA, 13 nt, Human
ccaacaagaaugc

SEQ ID NO: 3801138 - RNA, 19 nt, Human
ccaacaagaaugcauugau

SEQ ID NO: 3801139 - RNA, 21 nt, Human
ccaacaagauugcuuaauaaa

SEQ ID NO: 3801140 - RNA, 14 nt, Human
ccaacaagggcagu

SEQ ID NO: 3801141 - RNA, 23 nt, Human
ccaacaagggcaguggaggugcu

SEQ ID NO: 3801142 - RNA, 20 nt, Human
ccaacacaaggugggcaggg

SEQ ID NO: 3801143 - RNA, 17 nt, Human
ccaacaccaagcacagc

SEQ ID NO: 3801144 - RNA, 23 nt, Human
ccaacaccaagcacagcagccug

SEQ ID NO: 3801145 - RNA, 15 nt, Human
ccaacaccacagaca

SEQ ID NO: 3801146 - RNA, 16 nt, Human
ccaacaccagccccug

SEQ ID NO: 3801147 - RNA, 18 nt, Human
ccaacaccagccccugcc

SEQ ID NO: 3801148 - RNA, 22 nt, Human
ccaacaccagccccugccccag

SEQ ID NO: 3801149 - RNA, 16 nt, Human
ccaacaccaucacagc

SEQ ID NO: 3801150 - RNA, 20 nt, Human
ccaacaccaucacagcuugu

SEQ ID NO: 3801151 - RNA, 22 nt, Human
ccaacaccaucacagcuuguuu

SEQ ID NO: 3801152 - RNA, 22 nt, Human
ccaacacccaaagcauggacua

SEQ ID NO: 3801153 - RNA, 18 nt, Human
ccaacacccaucuguuuu

SEQ ID NO: 3801154 - RNA, 14 nt, Human
ccaacacugccagc

SEQ ID NO: 3801155 - RNA, 17 nt, Human
ccaacacugugcccugg

SEQ ID NO: 3801156 - RNA, 18 nt, Human
ccaacacugugcccuggu

SEQ ID NO: 3801157 - RNA, 20 nt, Human
ccaacacuguggguguguga

SEQ ID NO: 3801158 - RNA, 12 nt, Human
ccaacagccaug

SEQ ID NO: 3801159 - RNA, 11 nt, Human
ccaacagcuac

SEQ ID NO: 3801160 - RNA, 15 nt, Human
ccaacaggagcuggg

SEQ ID NO: 3801161 - RNA, 19 nt, Human
ccaacaggaggacaauuca

SEQ ID NO: 3801162 - RNA, 15 nt, Human
ccaacagguggcagg

SEQ ID NO: 3801163 - RNA, 12 nt, Human
ccaacaguguga

SEQ ID NO: 3801164 - RNA, 22 nt, Human
ccaacagugugaaguuagaauu

SEQ ID NO: 3801165 - RNA, 21 nt, Human
ccaacaguguuaggccuggca

SEQ ID NO: 3801166 - RNA, 12 nt, Human
ccaacaguuccu

SEQ ID NO: 3801167 - RNA, 17 nt, Human
ccaacauacucccaucu

SEQ ID NO: 3801168 - RNA, 21 nt, Human
ccaacaucccauugcccuggu

SEQ ID NO: 3801169 - RNA, 13 nt, Human
ccaacaugcacug

SEQ ID NO: 3801170 - RNA, 17 nt, Human
ccaaccagaccuggaag

SEQ ID NO: 3801171 - RNA, 18 nt, Human
ccaaccagugccaaggac

SEQ ID NO: 3801172 - RNA, 18 nt, Human
ccaacccaaaccuggaga

SEQ ID NO: 3801173 - RNA, 19 nt, Human
ccaacccagccgcugcccg

SEQ ID NO: 3801174 - RNA, 16 nt, Human
ccaacccccaccccac

SEQ ID NO: 3801175 - RNA, 13 nt, Human
ccaacccccagca

SEQ ID NO: 3801176 - RNA, 14 nt, Human
ccaacccccagcac

SEQ ID NO: 3801177 - RNA, 19 nt, Human
ccaacccccauucucaucu

SEQ ID NO: 3801178 - RNA, 14 nt, Human
ccaaccccccagca

SEQ ID NO: 3801179 - RNA, 21 nt, Human
ccaaccccccagcacugagga

SEQ ID NO: 3801180 - RNA, 19 nt, Human
ccaacccccgacuucaucc

SEQ ID NO: 3801181 - RNA, 14 nt, Human
ccaacccguggagg

SEQ ID NO: 3801182 - RNA, 21 nt, Human
ccaacccguggaggcugcucg

SEQ ID NO: 3801183 - RNA, 14 nt, Human
ccaacccucagagc

SEQ ID NO: 3801184 - RNA, 14 nt, Human
ccaacccugccccu

SEQ ID NO: 3801185 - RNA, 17 nt, Human
ccaacccugccccugcc

SEQ ID NO: 3801186 - RNA, 24 nt, Human
ccagaaacuguucccaccugcugg

SEQ ID NO: 3801187 - RNA, 22 nt, Human
ccagaaagccccacccaggcca

SEQ ID NO: 3801188 - RNA, 23 nt, Human
ccagaaagccccacccaggccag

SEQ ID NO: 3801189 - RNA, 16 nt, Human
ccagaaaggagacuag

SEQ ID NO: 3801190 - RNA, 16 nt, Human
ccagaaaucauuuuac

SEQ ID NO: 3801191 - RNA, 22 nt, Human
ccagaaaugucccuuucuucuc

SEQ ID NO: 3801192 - RNA, 15 nt, Human
ccagaacaguaugaa

SEQ ID NO: 3801193 - RNA, 18 nt, Human
ccagaacguggcucugcu

SEQ ID NO: 3801194 - RNA, 20 nt, Human
ccagaacguggcucugcugg

SEQ ID NO: 3801195 - RNA, 15 nt, Human
ccagaacucuguguc

SEQ ID NO: 3801196 - RNA, 21 nt, Human
ccagaagaagagaagcugcug

SEQ ID NO: 3801197 - RNA, 18 nt, Human
ccagaagaauauucagga

SEQ ID NO: 3801198 - RNA, 19 nt, Human
ccagaagaauauucaggac

SEQ ID NO: 3801199 - RNA, 20 nt, Human
ccagaagaauauucaggacu

SEQ ID NO: 3801200 - RNA, 21 nt, Human
ccagaagagaauuaagcccua

SEQ ID NO: 3801201 - RNA, 19 nt, Human
ccagaagaugaacagacug

SEQ ID NO: 3801202 - RNA, 16 nt, Human
ccagaagccucuggcu

SEQ ID NO: 3801203 - RNA, 20 nt, Human
ccagaagcucccccagcaaa

SEQ ID NO: 3801204 - RNA, 17 nt, Human
ccagaaggagacaggca

SEQ ID NO: 3801205 - RNA, 12 nt, Human
ccagaaggcagg

SEQ ID NO: 3801206 - RNA, 15 nt, Human
ccagaagggggccau

SEQ ID NO: 3801207 - RNA, 16 nt, Human
ccagaaguagcuuugc

SEQ ID NO: 3801208 - RNA, 17 nt, Human
ccagaaguagcuuugca

SEQ ID NO: 3801209 - RNA, 13 nt, Human
ccagaagucaaca

SEQ ID NO: 3801210 - RNA, 13 nt, Human
ccagaaguugugg

SEQ ID NO: 3801211 - RNA, 11 nt, Human
ccagaaugaag

SEQ ID NO: 3801212 - RNA, 15 nt, Human
ccagaaugaggcugc

SEQ ID NO: 3801213 - RNA, 21 nt, Human
ccagaaugcuguacaucuauu

SEQ ID NO: 3801214 - RNA, 21 nt, Human
ccagaaugucagauuccuuuc

SEQ ID NO: 3801215 - RNA, 16 nt, Human
ccagaauuuggaaauc

SEQ ID NO: 3801216 - RNA, 15 nt, Human
ccagacaagcuguug

SEQ ID NO: 3801217 - RNA, 18 nt, Human
ccagacacaaacugccaa

SEQ ID NO: 3801218 - RNA, 19 nt, Human
ccagacacaggcccucccu

SEQ ID NO: 3801219 - RNA, 10 nt, Human
ccagacaccc

SEQ ID NO: 3801220 - RNA, 13 nt, Human
ccagacacccagg

SEQ ID NO: 3801221 - RNA, 15 nt, Human
ccagacacucugcuc

SEQ ID NO: 3801222 - RNA, 23 nt, Human
ccagacacugaccauccacucua

SEQ ID NO: 3801223 - RNA, 12 nt, Human
ccagacacuggu

SEQ ID NO: 3801224 - RNA, 17 nt, Human
ccagacagacaacacug

SEQ ID NO: 3801225 - RNA, 11 nt, Human
ccagacagacc

SEQ ID NO: 3801226 - RNA, 17 nt, Human
ccagacagagggucaca

SEQ ID NO: 3801227 - RNA, 13 nt, Human
ccagacagcuccc

SEQ ID NO: 3801228 - RNA, 18 nt, Human
ccagacauaaaggaaaag

SEQ ID NO: 3801229 - RNA, 18 nt, Human
ccagacauacgaaacaca

SEQ ID NO: 3801230 - RNA, 20 nt, Human
ccagacauacgaaacacaaa

SEQ ID NO: 3801231 - RNA, 14 nt, Human
ccagacaugccaca

SEQ ID NO: 3801232 - RNA, 14 nt, Human
ccagaccagagcuc

SEQ ID NO: 3801233 - RNA, 17 nt, Human
ccagaccccaggcugga

SEQ ID NO: 3801234 - RNA, 19 nt, Human
ccagacccccaccccuucc

SEQ ID NO: 3801235 - RNA, 21 nt, Human
ccagacccccaccccuucccc

SEQ ID NO: 3801236 - RNA, 19 nt, Human
ccagacccccagcaacccu

SEQ ID NO: 3801237 - RNA, 22 nt, Human
ccagacccccagcaacccuccu

SEQ ID NO: 3801238 - RNA, 17 nt, Human
ccagaccccucuggcca

SEQ ID NO: 3801239 - RNA, 19 nt, Human
ccagaccugauccuggagg

SEQ ID NO: 3801240 - RNA, 14 nt, Human
ccagaccugcagac

SEQ ID NO: 3801241 - RNA, 16 nt, Human
ccagaccugcagacgc

SEQ ID NO: 3801242 - RNA, 20 nt, Human
ccagaccugcagacgcccag

SEQ ID NO: 3801243 - RNA, 21 nt, Human
ccagaccugccucuucccccu

SEQ ID NO: 3801244 - RNA, 22 nt, Human
ccagaccuggaagaacaggccu

SEQ ID NO: 3801245 - RNA, 23 nt, Human
ccagaccuguuagcagacaggcc

SEQ ID NO: 3801246 - RNA, 14 nt, Human
ccagacgccuggcu

SEQ ID NO: 3801247 - RNA, 17 nt, Human
ccagacgccuggcugcu

SEQ ID NO: 3801248 - RNA, 19 nt, Human
ccagacgcucauucagcau

SEQ ID NO: 3801249 - RNA, 20 nt, Human
ccagacgcucauucagcauc

SEQ ID NO: 3801250 - RNA, 16 nt, Human
ccagacgguucaccag

SEQ ID NO: 3801251 - RNA, 18 nt, Human
ccagacgguucaccagcc

SEQ ID NO: 3801252 - RNA, 20 nt, Human
ccagacgguucaccagccuc

SEQ ID NO: 3801253 - RNA, 15 nt, Human
ccagacucuugccug

SEQ ID NO: 3801254 - RNA, 18 nt, Human
ccagacucuugccuguuu

SEQ ID NO: 3801255 - RNA, 16 nt, Human
ccagacuguggagaaa

SEQ ID NO: 3801256 - RNA, 15 nt, Human
ccagacuguuagaaa

SEQ ID NO: 3801257 - RNA, 21 nt, Human
ccagacuuuacaugacacagc

SEQ ID NO: 3801258 - RNA, 16 nt, Human
ccagagaaagcgcaga

SEQ ID NO: 3801259 - RNA, 12 nt, Human
ccagagaacaag

SEQ ID NO: 3801260 - RNA, 22 nt, Human
ccagauuuaugcauauuauuuu

SEQ ID NO: 3801261 - RNA, 14 nt, Human
ccagauuucacucu

SEQ ID NO: 3801262 - RNA, 19 nt, Human
ccagauuucacucuccuug

SEQ ID NO: 3801263 - RNA, 22 nt, Human
ccagauuuuucggaggccccac

SEQ ID NO: 3801264 - RNA, 22 nt, Human
ccagauuuuuuaaaauuuauau

SEQ ID NO: 3801265 - RNA, 15 nt, Human
ccagcaaacaaaaug

SEQ ID NO: 3801266 - RNA, 14 nt, Human
ccagcaaagcccca

SEQ ID NO: 3801267 - RNA, 17 nt, Human
ccagcaaagcccccaga

SEQ ID NO: 3801268 - RNA, 15 nt, Human
ccagcaacacaagcu

SEQ ID NO: 3801269 - RNA, 15 nt, Human
ccagcaacacagccu

SEQ ID NO: 3801270 - RNA, 18 nt, Human
ccagcaacccuccuauca

SEQ ID NO: 3801271 - RNA, 15 nt, Human
ccagcaacuccaacu

SEQ ID NO: 3801272 - RNA, 13 nt, Human
ccagcaacugaau

SEQ ID NO: 3801273 - RNA, 17 nt, Human
ccagcaacugaauaaau

SEQ ID NO: 3801274 - RNA, 21 nt, Human
ccagcaacuugucuuuuucug

SEQ ID NO: 3801275 - RNA, 18 nt, Human
ccagcaagguggagugga

SEQ ID NO: 3801276 - RNA, 19 nt, Human
ccagcaagugagagcuggg

SEQ ID NO: 3801277 - RNA, 17 nt, Human
ccagcaauauguaaaua

SEQ ID NO: 3801278 - RNA, 17 nt, Human
ccagcacaaacacaagg

SEQ ID NO: 3801279 - RNA, 12 nt, Human
ccagcacacucc

SEQ ID NO: 3801280 - RNA, 13 nt, Human
ccagcacacuccc

SEQ ID NO: 3801281 - RNA, 14 nt, Human
ccagcacacucccg

SEQ ID NO: 3801282 - RNA, 15 nt, Human
ccagcacacucccga

SEQ ID NO: 3801283 - RNA, 20 nt, Human
ccagcacacugggaggccga

SEQ ID NO: 3801284 - RNA, 19 nt, Human
ccagcacagcuuagauuuc

SEQ ID NO: 3801285 - RNA, 13 nt, Human
ccagcacaugaaa

SEQ ID NO: 3801286 - RNA, 17 nt, Human
ccagcaccaccaggucu

SEQ ID NO: 3801287 - RNA, 18 nt, Human
ccagcaccaccaggucuc

SEQ ID NO: 3801288 - RNA, 14 nt, Human
ccagcacccagcaa

SEQ ID NO: 3801289 - RNA, 17 nt, Human
ccagcacccgggcucag

SEQ ID NO: 3801290 - RNA, 20 nt, Human
ccagcacccgggcucaggga

SEQ ID NO: 3801291 - RNA, 20 nt, Human
ccagcaccggaccagccugg

SEQ ID NO: 3801292 - RNA, 17 nt, Human
ccagcaccucagccugc

SEQ ID NO: 3801293 - RNA, 18 nt, Human
ccagcaccucagccugca

SEQ ID NO: 3801294 - RNA, 14 nt, Human
ccagcaccuugugc

SEQ ID NO: 3801295 - RNA, 17 nt, Human
ccagcacuaaagcagug

SEQ ID NO: 3801296 - RNA, 18 nt, Human
ccagcacuaaagcagugg

SEQ ID NO: 3801297 - RNA, 20 nt, Human
ccagcacuaugcuuuccuuc

SEQ ID NO: 3801298 - RNA, 21 nt, Human
ccagcacuaugcuuuccuucu

SEQ ID NO: 3801299 - RNA, 13 nt, Human
ccagcacugccca

SEQ ID NO: 3801300 - RNA, 19 nt, Human
ccagcacugcuugaggaaa

SEQ ID NO: 3801301 - RNA, 17 nt, Human
ccagcacuucaggaggc

SEQ ID NO: 3801302 - RNA, 15 nt, Human
ccagcacuuguauau

SEQ ID NO: 3801303 - RNA, 19 nt, Human
ccagcacuuguccagcuga

SEQ ID NO: 3801304 - RNA, 20 nt, Human
ccagcacuuguccagcugag

SEQ ID NO: 3801305 - RNA, 15 nt, Human
ccagcacuuugggag

SEQ ID NO: 3801306 - RNA, 19 nt, Human
ccagcacuuugggagacca

SEQ ID NO: 3801307 - RNA, 16 nt, Human
ccagcacuuugggagg

SEQ ID NO: 3801308 - RNA, 17 nt, Human
ccagcacuuugggaggc

SEQ ID NO: 3801309 - RNA, 17 nt, Human
ccagcagaaaugccuua

SEQ ID NO: 3801310 - RNA, 19 nt, Human
ccagcagagcaccuuagac

SEQ ID NO: 3801311 - RNA, 15 nt, Human
ccagcagaucccagc

SEQ ID NO: 3801312 - RNA, 18 nt, Human
ccagcagaucccagcuca

SEQ ID NO: 3801313 - RNA, 19 nt, Human
ccagcagaucccagcucac

SEQ ID NO: 3801314 - RNA, 21 nt, Human
ccagcagaucccagcucacgu

SEQ ID NO: 3801315 - RNA, 21 nt, Human
ccagcagauuauucacugauu

SEQ ID NO: 3801316 - RNA, 14 nt, Human
ccagcagcaccugc

SEQ ID NO: 3801317 - RNA, 18 nt, Human
ccagcagcagcaggugau

SEQ ID NO: 3801318 - RNA, 15 nt, Human
ccagcagcagcccaa

SEQ ID NO: 3801319 - RNA, 14 nt, Human
ccagcagccagcca

SEQ ID NO: 3801320 - RNA, 18 nt, Human
ccagcagccagcucucag

SEQ ID NO: 3801321 - RNA, 19 nt, Human
ccagcagccagcucucagc

SEQ ID NO: 3801322 - RNA, 21 nt, Human
ccagcagcccuaaggaucucu

SEQ ID NO: 3801323 - RNA, 13 nt, Human
ccagcagccugga

SEQ ID NO: 3801324 - RNA, 20 nt, Human
ccagcagccuggacccugug

SEQ ID NO: 3801325 - RNA, 12 nt, Human
ccagcaggccca

SEQ ID NO: 3801326 - RNA, 17 nt, Human
ccagcaggcccauggga

SEQ ID NO: 3801327 - RNA, 18 nt, Human
ccagcaggcucucaggcc

SEQ ID NO: 3801328 - RNA, 23 nt, Human
ccagcaggcucucaggccagcug

SEQ ID NO: 3801329 - RNA, 20 nt, Human
ccagcagggucuuuucaucu

SEQ ID NO: 3801330 - RNA, 22 nt, Human
ccagcagggucuuuucaucugg

SEQ ID NO: 3801331 - RNA, 23 nt, Human
ccagcagggucuuuucaucuggg

SEQ ID NO: 3801332 - RNA, 15 nt, Human
ccagcaguacaauaa

SEQ ID NO: 3801333 - RNA, 17 nt, Human
ccagcaguacaauaaaa

SEQ ID NO: 3801334 - RNA, 16 nt, Human
ccagcagucucugccu

SEQ ID NO: 3801335 - RNA, 21 nt, Human
ccagcagucucugccuugccu

SEQ ID NO: 3801336 - RNA, 17 nt, Human
ccagcagucugccugga

SEQ ID NO: 3801337 - RNA, 22 nt, Human
ccagcaguucagagcugcccuc

SEQ ID NO: 3801338 - RNA, 15 nt, Human
ccagcaguuuucaag

SEQ ID NO: 3801339 - RNA, 20 nt, Human
ccagcauaaauaucuucuga

SEQ ID NO: 3801340 - RNA, 16 nt, Human
ccagcaucaccugccu

SEQ ID NO: 3801341 - RNA, 16 nt, Human
ccagcaucacucccca

SEQ ID NO: 3801342 - RNA, 21 nt, Human
ccagcaucacuccccaaggaa

SEQ ID NO: 3801343 - RNA, 18 nt, Human
ccagcaucccuugaccag

SEQ ID NO: 3801344 - RNA, 11 nt, Human
ccagcaucugg

SEQ ID NO: 3801345 - RNA, 18 nt, Human
ccagcaugacauaacagu

SEQ ID NO: 3801346 - RNA, 14 nt, Human
ccagcauuccagcc

SEQ ID NO: 3801347 - RNA, 15 nt, Human
ccagcauuccagccc

SEQ ID NO: 3801348 - RNA, 17 nt, Human
ccagcauuccagccccu

SEQ ID NO: 3801349 - RNA, 17 nt, Human
ccagcauuuagcuggcc

SEQ ID NO: 3801350 - RNA, 17 nt, Human
ccagccaaacccugucu

SEQ ID NO: 3801351 - RNA, 22 nt, Human
aaacucucuuugggaauguuug

SEQ ID NO: 3801352 - RNA, 13 nt, Human
aaacucugagugc

SEQ ID NO: 3801353 - RNA, 22 nt, Human
aaacucuguuacacuuuuugga

SEQ ID NO: 3801354 - RNA, 23 nt, Human
aaacucuuaaaacccaagugccu

SEQ ID NO: 3801355 - RNA, 17 nt, Human
aaacucuugaccucagg

SEQ ID NO: 3801356 - RNA, 12 nt, Human
aaacucuuuaac

SEQ ID NO: 3801357 - RNA, 14 nt, Human
aaacucuuuaacuu

SEQ ID NO: 3801358 - RNA, 21 nt, Human
aaacucuuuggucguuuuuuu

SEQ ID NO: 3801359 - RNA, 12 nt, Human
aaacugaaaauc

SEQ ID NO: 3801360 - RNA, 17 nt, Human
aaacugaaaaucuaaua

SEQ ID NO: 3801361 - RNA, 18 nt, Human
aaacugaaaaucuaauau

SEQ ID NO: 3801362 - RNA, 14 nt, Human
aaacugaagccaga

SEQ ID NO: 3801363 - RNA, 16 nt, Human
aaacugaaugaaaccc

SEQ ID NO: 3801364 - RNA, 14 nt, Human
aaacugaauggaag

SEQ ID NO: 3801365 - RNA, 19 nt, Human
aaacugaggaauuuucuuu

SEQ ID NO: 3801366 - RNA, 13 nt, Human
aaacugagugacu

SEQ ID NO: 3801367 - RNA, 12 nt, Human
aaacugauguga

SEQ ID NO: 3801368 - RNA, 16 nt, Human
aaacugcaauagagac

SEQ ID NO: 3801369 - RNA, 18 nt, Human
aaacugcaauagagacug

SEQ ID NO: 3801370 - RNA, 17 nt, Human
aaacugcacaugauuuc

SEQ ID NO: 3801371 - RNA, 21 nt, Human
aaacugcacaugauuucacaa

SEQ ID NO: 3801372 - RNA, 14 nt, Human
aaacugccagcaac

SEQ ID NO: 3801373 - RNA, 15 nt, Human
aaacugccagcaacg

SEQ ID NO: 3801374 - RNA, 19 nt, Human
aaacugccagcaacgcagg

SEQ ID NO: 3801375 - RNA, 20 nt, Human
aaacugccaguuuuguuucc

SEQ ID NO: 3801376 - RNA, 11 nt, Human
aaacugccccc

SEQ ID NO: 3801377 - RNA, 12 nt, Human
aaacugcccccu

SEQ ID NO: 3801378 - RNA, 19 nt, Human
aaacugcccccucugcccu

SEQ ID NO: 3801379 - RNA, 22 nt, Human
aaacugcuuuuuuuuuuccagc

SEQ ID NO: 3801380 - RNA, 19 nt, Human
aaacuggaacggugaaggu

SEQ ID NO: 3801381 - RNA, 20 nt, Human
aaacuggaacggugaaggug

SEQ ID NO: 3801382 - RNA, 13 nt, Human
aaacuggaaugag

SEQ ID NO: 3801383 - RNA, 12 nt, Human
aaacuggagacu

SEQ ID NO: 3801384 - RNA, 20 nt, Human
aaacuggcaucugacacaaa

SEQ ID NO: 3801385 - RNA, 14 nt, Human
aaacuggcuuuggc

SEQ ID NO: 3801386 - RNA, 23 nt, Human
aaacugggaugaaacuaaagcaa

SEQ ID NO: 3801387 - RNA, 18 nt, Human
aaacuggggccuccagaa

SEQ ID NO: 3801388 - RNA, 15 nt, Human
aaacuggguuccugc

SEQ ID NO: 3801389 - RNA, 16 nt, Human
aaacuggguuccugca

SEQ ID NO: 3801390 - RNA, 16 nt, Human
aaacugguauuuuauc

SEQ ID NO: 3801391 - RNA, 22 nt, Human
aaacugguuuguugcagccaaa

SEQ ID NO: 3801392 - RNA, 14 nt, Human
aaacuguaaaaaau

SEQ ID NO: 3801393 - RNA, 17 nt, Human
aaacuguaauacaauga

SEQ ID NO: 3801394 - RNA, 17 nt, Human
aaacuguacauuuaaaa

SEQ ID NO: 3801395 - RNA, 22 nt, Human
aaacuguacauuuaaaauugcu

SEQ ID NO: 3801396 - RNA, 18 nt, Human
aaacuguacuuugauuca

SEQ ID NO: 3801397 - RNA, 21 nt, Human
aaacuguacuuugauucacau

SEQ ID NO: 3801398 - RNA, 15 nt, Human
aaacugucacuguug

SEQ ID NO: 3801399 - RNA, 18 nt, Human
aaacuguccucuuucaga

SEQ ID NO: 3801400 - RNA, 21 nt, Human
aaacugucgugucauacucga

SEQ ID NO: 3801401 - RNA, 14 nt, Human
aaacuguguaacug

SEQ ID NO: 3801402 - RNA, 17 nt, Human
aaacuguguaacugccc

SEQ ID NO: 3801403 - RNA, 20 nt, Human
aaacuguguacauaacugaa

SEQ ID NO: 3801404 - RNA, 16 nt, Human
aaacuguguauuccaa

SEQ ID NO: 3801405 - RNA, 16 nt, Human
ccaccugaggugggcc

SEQ ID NO: 3801406 - RNA, 14 nt, Human
ccaccugaguuccu

SEQ ID NO: 3801407 - RNA, 12 nt, Human
ccaccugcagcu

SEQ ID NO: 3801408 - RNA, 9 nt, Human
ccaccugcc

SEQ ID NO: 3801409 - RNA, 14 nt, Human
ccaccugccacuag

SEQ ID NO: 3801410 - RNA, 23 nt, Human
ccaccugccacuaggcugggugc

SEQ ID NO: 3801411 - RNA, 14 nt, Human
ccaccugcccauca

SEQ ID NO: 3801412 - RNA, 18 nt, Human
ccaccugcccccuucucc

SEQ ID NO: 3801413 - RNA, 20 nt, Human
ccaccugcccccuucuccca

SEQ ID NO: 3801414 - RNA, 23 nt, Human
ccaccugcccccuucucccacac

SEQ ID NO: 3801415 - RNA, 18 nt, Human
ccaccugcccuuuuuucu

SEQ ID NO: 3801416 - RNA, 13 nt, Human
ccaccugccugcg

SEQ ID NO: 3801417 - RNA, 16 nt, Human
ccaccugccugcgucu

SEQ ID NO: 3801418 - RNA, 23 nt, Human
ccaccugccugcgucuuccgccc

SEQ ID NO: 3801419 - RNA, 13 nt, Human
ccaccugccuggc

SEQ ID NO: 3801420 - RNA, 14 nt, Human
ccaccugccuggcc

SEQ ID NO: 3801421 - RNA, 17 nt, Human
ccaccugccuggccggc

SEQ ID NO: 3801422 - RNA, 22 nt, Human
ccaccugccuggccggccagcc

SEQ ID NO: 3801423 - RNA, 23 nt, Human
ccaccugccuggccggccagcca

SEQ ID NO: 3801424 - RNA, 17 nt, Human
ccaccugccuguugggc

SEQ ID NO: 3801425 - RNA, 15 nt, Human
ccaccugcucugcug

SEQ ID NO: 3801426 - RNA, 22 nt, Human
ccaccugcugagagacccaagg

SEQ ID NO: 3801427 - RNA, 20 nt, Human
ccaccuggaagcccucucug

SEQ ID NO: 3801428 - RNA, 20 nt, Human
ccaccuggaccccugcauug

SEQ ID NO: 3801429 - RNA, 14 nt, Human
ccaccuggccaccu

SEQ ID NO: 3801430 - RNA, 18 nt, Human
ccaccuggccaccugagg

SEQ ID NO: 3801431 - RNA, 17 nt, Human
ccaccuggcccucucug

SEQ ID NO: 3801432 - RNA, 14 nt, Human
ccaccuggccucug

SEQ ID NO: 3801433 - RNA, 15 nt, Human
ccaccuggcucucac

SEQ ID NO: 3801434 - RNA, 19 nt, Human
ccaccuggcucucaccucu

SEQ ID NO: 3801435 - RNA, 13 nt, Human
ccaccuggcucug

SEQ ID NO: 3801436 - RNA, 14 nt, Human
ccaccuggcucugu

SEQ ID NO: 3801437 - RNA, 16 nt, Human
ccaccuggcucugugg

SEQ ID NO: 3801438 - RNA, 15 nt, Human
ccaccugguggccuc

SEQ ID NO: 3801439 - RNA, 17 nt, Human
ccaccugguggccucug

SEQ ID NO: 3801440 - RNA, 20 nt, Human
ccaccugucaaacaaagcca

SEQ ID NO: 3801441 - RNA, 12 nt, Human
ccaccuguccca

SEQ ID NO: 3801442 - RNA, 17 nt, Human
ccaccugucccaccuca

SEQ ID NO: 3801443 - RNA, 11 nt, Human
ccaccugucug

SEQ ID NO: 3801444 - RNA, 12 nt, Human
ccaccugucugu

SEQ ID NO: 3801445 - RNA, 16 nt, Human
ccaccugucugucugu

SEQ ID NO: 3801446 - RNA, 15 nt, Human
ccaccuuaaauuaaa

SEQ ID NO: 3801447 - RNA, 22 nt, Human
ccaccuuaaauuaaacaauuua

SEQ ID NO: 3801448 - RNA, 13 nt, Human
ccaccuucccagc

SEQ ID NO: 3801449 - RNA, 16 nt, Human
ccaccuucccagcucu

SEQ ID NO: 3801450 - RNA, 14 nt, Human
ccaccuucccaugc

SEQ ID NO: 3801451 - RNA, 21 nt, Human
ccaccuucucacauggaauga

SEQ ID NO: 3801452 - RNA, 14 nt, Human
ccaccuuggcucaa

SEQ ID NO: 3801453 - RNA, 16 nt, Human
ccaccuuggcugcagg

SEQ ID NO: 3801454 - RNA, 21 nt, Human
ccaccuuguuggagccugcag

SEQ ID NO: 3801455 - RNA, 17 nt, Human
ccaccuuucagcccacg

SEQ ID NO: 3801456 - RNA, 21 nt, Human
ccaccuuugaagaaguaagga

SEQ ID NO: 3801457 - RNA, 24 nt, Human
ccaccuuuggaaagcucugaccac

SEQ ID NO: 3801458 - RNA, 16 nt, Human
ccaccuuuguuucucc

SEQ ID NO: 3801459 - RNA, 14 nt, Human
ccaccuuuucagcg

SEQ ID NO: 3801460 - RNA, 17 nt, Human
ccacgaaacugcccugg

SEQ ID NO: 3801461 - RNA, 23 nt, Human
ccacgaauuucugugcccuccug

SEQ ID NO: 3801462 - RNA, 17 nt, Human
ccacgacacugcagccc

SEQ ID NO: 3801463 - RNA, 15 nt, Human
ccacgacuggccagg

SEQ ID NO: 3801464 - RNA, 14 nt, Human
ccacgacugucucc

SEQ ID NO: 3801465 - RNA, 15 nt, Human
ccacgacugucucca

SEQ ID NO: 3801466 - RNA, 14 nt, Human
ccacgagggcuggc

SEQ ID NO: 3801467 - RNA, 16 nt, Human
ccacgauccugccacc

SEQ ID NO: 3801468 - RNA, 16 nt, Human
ccacgauuuucuccag

SEQ ID NO: 3801469 - RNA, 12 nt, Human
ccacgccacagc

SEQ ID NO: 3801470 - RNA, 17 nt, Human
ccacgcccguccugccu

SEQ ID NO: 3801471 - RNA, 20 nt, Human
ccacgcccguccugccugug

SEQ ID NO: 3801472 - RNA, 21 nt, Human
ccacgcccucauuacggcucc

SEQ ID NO: 3801473 - RNA, 18 nt, Human
ccacgccucuugaccagg

SEQ ID NO: 3801474 - RNA, 19 nt, Human
ccacgccucuugaccaggc

SEQ ID NO: 3801475 - RNA, 21 nt, Human
ccacgccucuugaccaggcug

SEQ ID NO: 3801476 - RNA, 15 nt, Human
ccacgcgugccgugg

SEQ ID NO: 3801477 - RNA, 18 nt, Human
ccacgcuagggcuggcuc

SEQ ID NO: 3801478 - RNA, 15 nt, Human
ccacgcucacccccu

SEQ ID NO: 3801479 - RNA, 16 nt, Human
ccacgcuccagcugcc

SEQ ID NO: 3801480 - RNA, 13 nt, Human
ccacgcugacuac

SEQ ID NO: 3801481 - RNA, 18 nt, Human
ccacgcuggagugcagug

SEQ ID NO: 3801482 - RNA, 15 nt, Human
ccacgcugucuccag

SEQ ID NO: 3801483 - RNA, 19 nt, Human
ccacgcugucuccagaccc

SEQ ID NO: 3801484 - RNA, 21 nt, Human
ccacgcugucuccagaccccc

SEQ ID NO: 3801485 - RNA, 15 nt, Human
ccacggcaccugggc

SEQ ID NO: 3801486 - RNA, 16 nt, Human
ccacggccuccuuucc

SEQ ID NO: 3801487 - RNA, 18 nt, Human
ccacggcuaagaggcugc

SEQ ID NO: 3801488 - RNA, 18 nt, Human
ccacguccugucagugcc

SEQ ID NO: 3801489 - RNA, 17 nt, Human
ccacgucugucuucaca

SEQ ID NO: 3801490 - RNA, 14 nt, Human
ccacgugccaggcc

SEQ ID NO: 3801491 - RNA, 15 nt, Human
ccacgugccaggccc

SEQ ID NO: 3801492 - RNA, 16 nt, Human
ccacgugccaggcccg

SEQ ID NO: 3801493 - RNA, 23 nt, Human
ccacguggcugcgugccccugcu

SEQ ID NO: 3801494 - RNA, 16 nt, Human
ccacgugucuuccacu

SEQ ID NO: 3801495 - RNA, 16 nt, Human
ccacguuccacaguug

SEQ ID NO: 3801496 - RNA, 20 nt, Human
ccacguuccacaguugccac

SEQ ID NO: 3801497 - RNA, 21 nt, Human
ccacguuccuuacugcagaau

SEQ ID NO: 3801498 - RNA, 23 nt, Human
ccacguucucucugccugugagc

SEQ ID NO: 3801499 - RNA, 13 nt, Human
ccacguuuugaaa

SEQ ID NO: 3801500 - RNA, 13 nt, Human
ccacuaaaaauau

SEQ ID NO: 3801501 - RNA, 14 nt, Human
ccacuaaaaauauu

SEQ ID NO: 3801502 - RNA, 22 nt, Human
ccacuaaaagaucgcaguuugc

SEQ ID NO: 3801503 - RNA, 21 nt, Human
ccacuaaccuugccugguaca

SEQ ID NO: 3801504 - RNA, 20 nt, Human
ccacuaacuagagcagcccu

SEQ ID NO: 3801505 - RNA, 16 nt, Human
ccacuaagcagaggag

SEQ ID NO: 3801506 - RNA, 13 nt, Human
ccacuacaccugg

SEQ ID NO: 3801507 - RNA, 17 nt, Human
ccacuacaccuggcuga

SEQ ID NO: 3801508 - RNA, 21 nt, Human
ccacuacacuccagccugagc

SEQ ID NO: 3801509 - RNA, 22 nt, Human
ccacuacacuccagccugagca

SEQ ID NO: 3801510 - RNA, 15 nt, Human
ccacuacauucuguu

SEQ ID NO: 3801511 - RNA, 16 nt, Human
ccacuaccccuugauu

SEQ ID NO: 3801512 - RNA, 14 nt, Human
ccacuagccucagg

SEQ ID NO: 3801513 - RNA, 15 nt, Human
ccacuagccucaggg

SEQ ID NO: 3801514 - RNA, 16 nt, Human
ccacuaggacucugag

SEQ ID NO: 3801515 - RNA, 19 nt, Human
ccacuaggacucugaggcu

SEQ ID NO: 3801516 - RNA, 20 nt, Human
ccacuaggacucugaggcuc

SEQ ID NO: 3801517 - RNA, 16 nt, Human
ccacuaggcugggugc

SEQ ID NO: 3801518 - RNA, 23 nt, Human
ccacuaggcugggugcccacagc

SEQ ID NO: 3801519 - RNA, 22 nt, Human
ccacuaguaaguaauuaugcac

SEQ ID NO: 3801520 - RNA, 17 nt, Human
ccacuagugcaaaucau

SEQ ID NO: 3801521 - RNA, 14 nt, Human
ccacuaucugggug

SEQ ID NO: 3801522 - RNA, 13 nt, Human
ccacucaagacca

SEQ ID NO: 3801523 - RNA, 17 nt, Human
ccacucaagaccaaaug

SEQ ID NO: 3801524 - RNA, 20 nt, Human
ccacucaagaccaaauggaa

SEQ ID NO: 3801525 - RNA, 18 nt, Human
ccacucaagccaagcagc

SEQ ID NO: 3801526 - RNA, 20 nt, Human
ccacucacaacagcugccug

SEQ ID NO: 3801527 - RNA, 17 nt, Human
ccacucacacagccagg

SEQ ID NO: 3801528 - RNA, 13 nt, Human
ccacucaccccgg

SEQ ID NO: 3801529 - RNA, 12 nt, Human
ccacucagagac

SEQ ID NO: 3801530 - RNA, 15 nt, Human
ccacucagagacaug

SEQ ID NO: 3801531 - RNA, 17 nt, Human
ccacucagagacaugca

SEQ ID NO: 3801532 - RNA, 12 nt, Human
ccacucagcccc

SEQ ID NO: 3801533 - RNA, 20 nt, Human
ccacucaggccaacaagcca

SEQ ID NO: 3801534 - RNA, 22 nt, Human
ccacucaugugacucuuuccaa

SEQ ID NO: 3801535 - RNA, 15 nt, Human
ccacucauuucaucu

SEQ ID NO: 3801536 - RNA, 14 nt, Human
ccacuccaagccag

SEQ ID NO: 3801537 - RNA, 16 nt, Human
ccacuccaagccagca

SEQ ID NO: 3801538 - RNA, 18 nt, Human
ccacuccaagcccagccc

SEQ ID NO: 3801539 - RNA, 20 nt, Human
ccacuccagaccccuggcuu

SEQ ID NO: 3801540 - RNA, 18 nt, Human
ccacuccaucugguagaa

SEQ ID NO: 3801541 - RNA, 22 nt, Human
ccacucccacuucccugacacu

SEQ ID NO: 3801542 - RNA, 13 nt, Human
ccacucccaggca

SEQ ID NO: 3801543 - RNA, 16 nt, Human
ccacuccccaccuuca

SEQ ID NO: 3801544 - RNA, 20 nt, Human
ccacucccuugcuggcccca

SEQ ID NO: 3801545 - RNA, 19 nt, Human
ccacuccgagaggugggcc

SEQ ID NO: 3801546 - RNA, 22 nt, Human
ccacuccggcccuccagagccc

SEQ ID NO: 3801547 - RNA, 13 nt, Human
ccacuccucccuc

SEQ ID NO: 3801548 - RNA, 12 nt, Human
ccacuccucuga

SEQ ID NO: 3801549 - RNA, 14 nt, Human
ccacuccucugcug

SEQ ID NO: 3801550 - RNA, 15 nt, Human
ccacuccucuuauuu

SEQ ID NO: 3801551 - RNA, 12 nt, Human
aaagaugaaguu

SEQ ID NO: 3801552 - RNA, 20 nt, Human
aaagaugcaaggaccaggac

SEQ ID NO: 3801553 - RNA, 16 nt, Human
aaagaugcagccgccu

SEQ ID NO: 3801554 - RNA, 21 nt, Human
aaagaugccaauuauuguuac

SEQ ID NO: 3801555 - RNA, 22 nt, Human
aaagaugcucagguacagagaa

SEQ ID NO: 3801556 - RNA, 17 nt, Human
aaagaugcucuucugug

SEQ ID NO: 3801557 - RNA, 17 nt, Human
aaagaugcuucucacug

SEQ ID NO: 3801558 - RNA, 19 nt, Human
aaagaugcuuuuaacagag

SEQ ID NO: 3801559 - RNA, 18 nt, Human
aaagauggaguuucuaag

SEQ ID NO: 3801560 - RNA, 19 nt, Human
aaagauggaguuucuaagg

SEQ ID NO: 3801561 - RNA, 21 nt, Human
aaagauggaguuucuaagguc

SEQ ID NO: 3801562 - RNA, 12 nt, Human
aaagauggccuu

SEQ ID NO: 3801563 - RNA, 21 nt, Human
aaagauggcugugccucugcc

SEQ ID NO: 3801564 - RNA, 22 nt, Human
aaagauggggucuguaaaaucu

SEQ ID NO: 3801565 - RNA, 13 nt, Human
ccagggccagaag

SEQ ID NO: 3801566 - RNA, 14 nt, Human
ccagggccagggcc

SEQ ID NO: 3801567 - RNA, 13 nt, Human
ccagggcccagag

SEQ ID NO: 3801568 - RNA, 15 nt, Human
ccagggcccagagcc

SEQ ID NO: 3801569 - RNA, 18 nt, Human
ccagggcccagagcccag

SEQ ID NO: 3801570 - RNA, 11 nt, Human
ccagggccccu

SEQ ID NO: 3801571 - RNA, 22 nt, Human
ccagggccccucuccccaggga

SEQ ID NO: 3801572 - RNA, 14 nt, Human
ccagggcccgcacc

SEQ ID NO: 3801573 - RNA, 16 nt, Human
ccagggcccgggaagc

SEQ ID NO: 3801574 - RNA, 15 nt, Human
ccagggcccugcaga

SEQ ID NO: 3801575 - RNA, 14 nt, Human
ccagggccugagcc

SEQ ID NO: 3801576 - RNA, 18 nt, Human
ccagggccugagccaagc

SEQ ID NO: 3801577 - RNA, 16 nt, Human
ccagggccugagccug

SEQ ID NO: 3801578 - RNA, 16 nt, Human
ccagggccuggaagac

SEQ ID NO: 3801579 - RNA, 21 nt, Human
ccagggccuggaagacagaga

SEQ ID NO: 3801580 - RNA, 17 nt, Human
ccagggcuauagcucag

SEQ ID NO: 3801581 - RNA, 12 nt, Human
ccagggcuccag

SEQ ID NO: 3801582 - RNA, 16 nt, Human
ccagggcucugcccca

SEQ ID NO: 3801583 - RNA, 18 nt, Human
ccagggcucugccccagu

SEQ ID NO: 3801584 - RNA, 14 nt, Human
ccagggcugccccu

SEQ ID NO: 3801585 - RNA, 15 nt, Human
ccagggcugcccuga

SEQ ID NO: 3801586 - RNA, 16 nt, Human
ccagggcuggacugag

SEQ ID NO: 3801587 - RNA, 18 nt, Human
ccagggcuggacugaggc

SEQ ID NO: 3801588 - RNA, 19 nt, Human
ccagggcuggacugaggcc

SEQ ID NO: 3801589 - RNA, 18 nt, Human
ccagggcugggaggaagg

SEQ ID NO: 3801590 - RNA, 18 nt, Human
ccagggcuggggcagccu

SEQ ID NO: 3801591 - RNA, 22 nt, Human
ccagggcuuacggcccuggccu

SEQ ID NO: 3801592 - RNA, 19 nt, Human
ccaggggaaaaucagccug

SEQ ID NO: 3801593 - RNA, 19 nt, Human
ccaggggaaagaugagcuu

SEQ ID NO: 3801594 - RNA, 12 nt, Human
ccaggggaaccu

SEQ ID NO: 3801595 - RNA, 19 nt, Human
ccaggggagcagaggggca

SEQ ID NO: 3801596 - RNA, 13 nt, Human
ccaggggagcccu

SEQ ID NO: 3801597 - RNA, 14 nt, Human
ccaggggagcccuc

SEQ ID NO: 3801598 - RNA, 19 nt, Human
ccaggggcaggcacagcac

SEQ ID NO: 3801599 - RNA, 18 nt, Human
ccaggggcccacagggaa

SEQ ID NO: 3801600 - RNA, 12 nt, Human
ccaggggccccu

SEQ ID NO: 3801601 - RNA, 22 nt, Human
ccaggggccccuccagcuugug

SEQ ID NO: 3801602 - RNA, 23 nt, Human
ccaggggcugcuuccuccuggaa

SEQ ID NO: 3801603 - RNA, 14 nt, Human
ccaggggcuggcuu

SEQ ID NO: 3801604 - RNA, 21 nt, Human
ccaggggcuggcuucaggagg

SEQ ID NO: 3801605 - RNA, 18 nt, Human
ccagggggaaggccaagg

SEQ ID NO: 3801606 - RNA, 19 nt, Human
ccagggggaaggccaaggg

SEQ ID NO: 3801607 - RNA, 23 nt, Human
ccagggggagcugggccuggucu

SEQ ID NO: 3801608 - RNA, 15 nt, Human
ccagggggcaagagg

SEQ ID NO: 3801609 - RNA, 22 nt, Human
ccagggggcuuccugaggggag

SEQ ID NO: 3801610 - RNA, 14 nt, Human
ccaggggucucccu

SEQ ID NO: 3801611 - RNA, 18 nt, Human
ccaggggucucccuggag

SEQ ID NO: 3801612 - RNA, 18 nt, Human
ccaggggucucccuggcu

SEQ ID NO: 3801613 - RNA, 22 nt, Human
ccaggggucuugcaaaauuccu

SEQ ID NO: 3801614 - RNA, 17 nt, Human
ccaggggugggacaccc

SEQ ID NO: 3801615 - RNA, 22 nt, Human
ccaggggugggacacccuguga

SEQ ID NO: 3801616 - RNA, 16 nt, Human
ccaggguagcccgccu

SEQ ID NO: 3801617 - RNA, 20 nt, Human
ccaggguagcccgccugcca

SEQ ID NO: 3801618 - RNA, 13 nt, Human
ccagggucccugg

SEQ ID NO: 3801619 - RNA, 12 nt, Human
ccagggucucca

SEQ ID NO: 3801620 - RNA, 16 nt, Human
ccagggucugugugaa

SEQ ID NO: 3801621 - RNA, 16 nt, Human
ccagggugagagcugc

SEQ ID NO: 3801622 - RNA, 14 nt, Human
ccaggguggcagca

SEQ ID NO: 3801623 - RNA, 14 nt, Human
ccagggugugugcu

SEQ ID NO: 3801624 - RNA, 15 nt, Human
ccaggguucccccag

SEQ ID NO: 3801625 - RNA, 22 nt, Human
ccaggguucccccagcccugug

SEQ ID NO: 3801626 - RNA, 21 nt, Human
ccaggguugaccccagaggau

SEQ ID NO: 3801627 - RNA, 16 nt, Human
ccaggguuuuaacuuu

SEQ ID NO: 3801628 - RNA, 23 nt, Human
ccagguaauggcaugagauagcu

SEQ ID NO: 3801629 - RNA, 18 nt, Human
ccagguaccagcugcgcu

SEQ ID NO: 3801630 - RNA, 18 nt, Human
ccagguaccuugaccuuu

SEQ ID NO: 3801631 - RNA, 17 nt, Human
ccagguacgcacagaca

SEQ ID NO: 3801632 - RNA, 13 nt, Human
ccagguagaaacu

SEQ ID NO: 3801633 - RNA, 17 nt, Human
ccagguagaacgccagg

SEQ ID NO: 3801634 - RNA, 16 nt, Human
ccagguagcugggauu

SEQ ID NO: 3801635 - RNA, 15 nt, Human
ccagguaggccaagg

SEQ ID NO: 3801636 - RNA, 20 nt, Human
ccagguaggggccccucuca

SEQ ID NO: 3801637 - RNA, 18 nt, Human
ccagguaucuccaggauu

SEQ ID NO: 3801638 - RNA, 21 nt, Human
ccagguauucguuaucuaaua

SEQ ID NO: 3801639 - RNA, 18 nt, Human
ccaggucccccugcagcu

SEQ ID NO: 3801640 - RNA, 12 nt, Human
ccagguccccuc

SEQ ID NO: 3801641 - RNA, 22 nt, Human
ccaggucccuuucauuugcuau

SEQ ID NO: 3801642 - RNA, 21 nt, Human
ccagguccugguggggcagcu

SEQ ID NO: 3801643 - RNA, 18 nt, Human
ccaggucgggcucagcuc

SEQ ID NO: 3801644 - RNA, 23 nt, Human
ccaggucgggcucagcucuggcu

SEQ ID NO: 3801645 - RNA, 16 nt, Human
ccaggucuccuccacc

SEQ ID NO: 3801646 - RNA, 19 nt, Human
ccaggugaggucagcacau

SEQ ID NO: 3801647 - RNA, 20 nt, Human
ccaggugaggucagcacauc

SEQ ID NO: 3801648 - RNA, 16 nt, Human
ccaggugcacagacgu

SEQ ID NO: 3801649 - RNA, 14 nt, Human
ccaggugcagaggu

SEQ ID NO: 3801650 - RNA, 18 nt, Human
ccaggugccuuucaaauu

SEQ ID NO: 3801651 - RNA, 15 nt, Human
ccagguggaaggcag

SEQ ID NO: 3801652 - RNA, 20 nt, Human
ccagguggaaggcagacagc

SEQ ID NO: 3801653 - RNA, 16 nt, Human
ccagguggccacucca

SEQ ID NO: 3801654 - RNA, 17 nt, Human
ccagguggcugacccag

SEQ ID NO: 3801655 - RNA, 21 nt, Human
ccagguggcugacccaguccc

SEQ ID NO: 3801656 - RNA, 22 nt, Human
ccagguggcugacccagucccu

SEQ ID NO: 3801657 - RNA, 22 nt, Human
ccaggugggcgggcagcacagc

SEQ ID NO: 3801658 - RNA, 23 nt, Human
ccagguggggugaggcagugggu

SEQ ID NO: 3801659 - RNA, 22 nt, Human
ccagguggugggcauucucucu

SEQ ID NO: 3801660 - RNA, 23 nt, Human
ccaggugugcacguggcaugugg

SEQ ID NO: 3801661 - RNA, 22 nt, Human
ccaggugugguugcucacagcu

SEQ ID NO: 3801662 - RNA, 23 nt, Human
ccagguguuaacauuccaagacu

SEQ ID NO: 3801663 - RNA, 20 nt, Human
ccagguucaagcgauucucc

SEQ ID NO: 3801664 - RNA, 16 nt, Human
ccagguucuauuugga

SEQ ID NO: 3801665 - RNA, 22 nt, Human
ccagguucuauuuggaauuuau

SEQ ID NO: 3801666 - RNA, 23 nt, Human
ccagguucuccguuagcuccugu

SEQ ID NO: 3801667 - RNA, 23 nt, Human
ccagguucugguuagcucagccc

SEQ ID NO: 3801668 - RNA, 13 nt, Human
ccagguugaaaga

SEQ ID NO: 3801669 - RNA, 17 nt, Human
ccagguugucacugaga

SEQ ID NO: 3801670 - RNA, 13 nt, Human
ccagguuuaagcu

SEQ ID NO: 3801671 - RNA, 12 nt, Human
ccagguuuuuca

SEQ ID NO: 3801672 - RNA, 14 nt, Human
ccagguuuuucaau

SEQ ID NO: 3801673 - RNA, 18 nt, Human
ccagguuuuucaauuaaa

SEQ ID NO: 3801674 - RNA, 19 nt, Human
ccagguuuuucaauuaaac

SEQ ID NO: 3801675 - RNA, 21 nt, Human
ccagguuuuucaauuaaacgg

SEQ ID NO: 3801676 - RNA, 22 nt, Human
ccagguuuuucaauuaaacgga

SEQ ID NO: 3801677 - RNA, 15 nt, Human
ccaguaaaauugcca

SEQ ID NO: 3801678 - RNA, 24 nt, Human
ccaguaaaguguaacauaugcaaa

SEQ ID NO: 3801679 - RNA, 23 nt, Human
ccaguaaaugggggugcauuuga

SEQ ID NO: 3801680 - RNA, 20 nt, Human
ccaguaacgcgucuuccuga

SEQ ID NO: 3801681 - RNA, 12 nt, Human
ccaguaagauca

SEQ ID NO: 3801682 - RNA, 16 nt, Human
ccaguaagaucacugu

SEQ ID NO: 3801683 - RNA, 17 nt, Human
ccaguacaagaucucag

SEQ ID NO: 3801684 - RNA, 18 nt, Human
ccaguacaccccaccucu

SEQ ID NO: 3801685 - RNA, 19 nt, Human
ccaguacauucucaguuuu

SEQ ID NO: 3801686 - RNA, 13 nt, Human
ccaguacuuguca

SEQ ID NO: 3801687 - RNA, 15 nt, Human
ccaguacuugucaua

SEQ ID NO: 3801688 - RNA, 17 nt, Human
ccaguauacaagauaag

SEQ ID NO: 3801689 - RNA, 14 nt, Human
ccaguaucuauaua

SEQ ID NO: 3801690 - RNA, 18 nt, Human
ccaguaucuauauaugug

SEQ ID NO: 3801691 - RNA, 14 nt, Human
ccaguauuagacug

SEQ ID NO: 3801692 - RNA, 14 nt, Human
ccaguauuguacaa

SEQ ID NO: 3801693 - RNA, 18 nt, Human
ccaguauuuagaagccaa

SEQ ID NO: 3801694 - RNA, 20 nt, Human
ccaguauuuuugcugcuucu

SEQ ID NO: 3801695 - RNA, 17 nt, Human
ccagccccacccaggag

SEQ ID NO: 3801696 - RNA, 18 nt, Human
ccagccccacccaggagg

SEQ ID NO: 3801697 - RNA, 19 nt, Human
ccagccccacccuguuuug

SEQ ID NO: 3801698 - RNA, 18 nt, Human
ccagccccacuccucugc

SEQ ID NO: 3801699 - RNA, 13 nt, Human
ccagccccacugc

SEQ ID NO: 3801700 - RNA, 17 nt, Human
ccagccccacugccagc

SEQ ID NO: 3801701 - RNA, 13 nt, Human
ccagccccagcca

SEQ ID NO: 3801702 - RNA, 16 nt, Human
ccagccccagugccca

SEQ ID NO: 3801703 - RNA, 23 nt, Human
ccagccccauccucuguacagag

SEQ ID NO: 3801704 - RNA, 16 nt, Human
ccagcccccacagugc

SEQ ID NO: 3801705 - RNA, 21 nt, Human
ccagcccccacagugcugucu

SEQ ID NO: 3801706 - RNA, 23 nt, Human
ccagcccccugaccacucagaga

SEQ ID NO: 3801707 - RNA, 17 nt, Human
ccagccccggcccuggg

SEQ ID NO: 3801708 - RNA, 14 nt, Human
ccagccccuacugc

SEQ ID NO: 3801709 - RNA, 21 nt, Human
ccagccccuagaaacccaagc

SEQ ID NO: 3801710 - RNA, 14 nt, Human
ccagccccuagccc

SEQ ID NO: 3801711 - RNA, 18 nt, Human
ccagccccuagcccagga

SEQ ID NO: 3801712 - RNA, 23 nt, Human
ccagccccuagcccaggagagag

SEQ ID NO: 3801713 - RNA, 15 nt, Human
ccagccccucccacc

SEQ ID NO: 3801714 - RNA, 16 nt, Human
ccagccccucccacca

SEQ ID NO: 3801715 - RNA, 18 nt, Human
ccagccccucccccaucu

SEQ ID NO: 3801716 - RNA, 21 nt, Human
ccagccccucccccaucuccc

SEQ ID NO: 3801717 - RNA, 17 nt, Human
ccagccccucuggucgc

SEQ ID NO: 3801718 - RNA, 23 nt, Human
ccagccccucuggucgcuccugc

SEQ ID NO: 3801719 - RNA, 15 nt, Human
ccagccccucuuccc

SEQ ID NO: 3801720 - RNA, 13 nt, Human
ccagccccucuug

SEQ ID NO: 3801721 - RNA, 20 nt, Human
ccagccccucuuggagaagu

SEQ ID NO: 3801722 - RNA, 15 nt, Human
ccagccccugcccca

SEQ ID NO: 3801723 - RNA, 16 nt, Human
ccagccccugccccuc

SEQ ID NO: 3801724 - RNA, 15 nt, Human
ccagccccuggaugc

SEQ ID NO: 3801725 - RNA, 11 nt, Human
ccagccccugu

SEQ ID NO: 3801726 - RNA, 19 nt, Human
ccagccccuguagaacuca

SEQ ID NO: 3801727 - RNA, 10 nt, Human
ccagccccuu

SEQ ID NO: 3801728 - RNA, 19 nt, Human
ccagccccuuagacagagg

SEQ ID NO: 3801729 - RNA, 15 nt, Human
ccagccccuucugac

SEQ ID NO: 3801730 - RNA, 16 nt, Human
ccagccccuucugacc

SEQ ID NO: 3801731 - RNA, 17 nt, Human
ccagccccuucugaccc

SEQ ID NO: 3801732 - RNA, 15 nt, Human
ccagccccuuuccaa

SEQ ID NO: 3801733 - RNA, 19 nt, Human
ccagcccggccugcuccca

SEQ ID NO: 3801734 - RNA, 20 nt, Human
ccagcccggccugcucccag

SEQ ID NO: 3801735 - RNA, 15 nt, Human
ccagcccgggagccu

SEQ ID NO: 3801736 - RNA, 16 nt, Human
ccagcccuauggaugu

SEQ ID NO: 3801737 - RNA, 16 nt, Human
ccagcccucccugucc

SEQ ID NO: 3801738 - RNA, 20 nt, Human
ccagcccucucacugugucc

SEQ ID NO: 3801739 - RNA, 18 nt, Human
ccagcccugccuggagga

SEQ ID NO: 3801740 - RNA, 22 nt, Human
ccagcccugccuggaggaccug

SEQ ID NO: 3801741 - RNA, 14 nt, Human
ccagcccugcuggc

SEQ ID NO: 3801742 - RNA, 16 nt, Human
ccagcccugcuggccg

SEQ ID NO: 3801743 - RNA, 21 nt, Human
ccagcccugcuggccgccuca

SEQ ID NO: 3801744 - RNA, 24 nt, Human
ccagcccugcuggccgccucaccc

SEQ ID NO: 3801745 - RNA, 17 nt, Human
ccagcccuuccucugcu

SEQ ID NO: 3801746 - RNA, 20 nt, Human
ccagcccuugagcuccccaa

SEQ ID NO: 3801747 - RNA, 21 nt, Human
ccagcccuuuuguugagccag

SEQ ID NO: 3801748 - RNA, 22 nt, Human
ccagccgacccccucucccugc

SEQ ID NO: 3801749 - RNA, 18 nt, Human
ccagccgagcaggaggcc

SEQ ID NO: 3801750 - RNA, 14 nt, Human
ccagccgccaugcu

SEQ ID NO: 3801751 - RNA, 20 nt, Human
ccagccgccauugccaccag

SEQ ID NO: 3801752 - RNA, 17 nt, Human
ccagccgcucuccugcc

SEQ ID NO: 3801753 - RNA, 21 nt, Human
ccagccgcucuccugccacau

SEQ ID NO: 3801754 - RNA, 23 nt, Human
ccagccgcugcccggcgcccucu

SEQ ID NO: 3801755 - RNA, 13 nt, Human
ccagccggcaugg

SEQ ID NO: 3801756 - RNA, 22 nt, Human
ccagccggccaauggaaaccuc

SEQ ID NO: 3801757 - RNA, 23 nt, Human
ccagccggccucucuggccuccc

SEQ ID NO: 3801758 - RNA, 20 nt, Human
ccagccggggcgaguggcac

SEQ ID NO: 3801759 - RNA, 22 nt, Human
ccagccgguaccugggaagggg

SEQ ID NO: 3801760 - RNA, 18 nt, Human
ccagccgugaugcucagg

SEQ ID NO: 3801761 - RNA, 20 nt, Human
ccagccgugaugcucaggcu

SEQ ID NO: 3801762 - RNA, 21 nt, Human
ccagccgugaugcucaggcuu

SEQ ID NO: 3801763 - RNA, 17 nt, Human
ccagccuaagaugaaga

SEQ ID NO: 3801764 - RNA, 20 nt, Human
ccagccuaugagcauccuga

SEQ ID NO: 3801765 - RNA, 20 nt, Human
ccagccucaaauccaggacc

SEQ ID NO: 3801766 - RNA, 10 nt, Human
ccagccucag

SEQ ID NO: 3801767 - RNA, 12 nt, Human
ccagccucagcg

SEQ ID NO: 3801768 - RNA, 14 nt, Human
ccagccucagcucu

SEQ ID NO: 3801769 - RNA, 11 nt, Human
ccagccucagu

SEQ ID NO: 3801770 - RNA, 15 nt, Human
ccagccucaguccuc

SEQ ID NO: 3801771 - RNA, 20 nt, Human
cagaagggguuuggucuggg

SEQ ID NO: 3801772 - RNA, 15 nt, Human
cagaagguauuccuu

SEQ ID NO: 3801773 - RNA, 23 nt, Human
cagaaguaggggaagaauaauuu

SEQ ID NO: 3801774 - RNA, 14 nt, Human
cagaagucaaggcu

SEQ ID NO: 3801775 - RNA, 17 nt, Human
cagaagucaucuugcua

SEQ ID NO: 3801776 - RNA, 22 nt, Human
cagaagucaucuugcuaccagu

SEQ ID NO: 3801777 - RNA, 13 nt, Human
cagaagucuuuca

SEQ ID NO: 3801778 - RNA, 17 nt, Human
cagaagugagcuuugcu

SEQ ID NO: 3801779 - RNA, 14 nt, Human
cagaagugcaucug

SEQ ID NO: 3801780 - RNA, 13 nt, Human
cagaaguggagcu

SEQ ID NO: 3801781 - RNA, 17 nt, Human
cagaagugugacuggcu

SEQ ID NO: 3801782 - RNA, 13 nt, Human
cagaagugugauu

SEQ ID NO: 3801783 - RNA, 22 nt, Human
cagaagugugauugggaauaaa

SEQ ID NO: 3801784 - RNA, 22 nt, Human
cagaaguuuaaauauuaagcau

SEQ ID NO: 3801785 - RNA, 16 nt, Human
cagaaguuucugccgc

SEQ ID NO: 3801786 - RNA, 11 nt, Human
cagaauaaagc

SEQ ID NO: 3801787 - RNA, 12 nt, Human
cagaauaaagca

SEQ ID NO: 3801788 - RNA, 14 nt, Human
cagaauaaagcaau

SEQ ID NO: 3801789 - RNA, 17 nt, Human
cagaauaaagcaauuuu

SEQ ID NO: 3801790 - RNA, 18 nt, Human
cagaauaaagcaauuuuc

SEQ ID NO: 3801791 - RNA, 19 nt, Human
cagaauaaagcaauuuucc

SEQ ID NO: 3801792 - RNA, 20 nt, Human
cagaauaaagcaauuuuccu

SEQ ID NO: 3801793 - RNA, 22 nt, Human
cagaauaaaguucugaguguuu

SEQ ID NO: 3801794 - RNA, 20 nt, Human
cagaauaaguuauugcaguu

SEQ ID NO: 3801795 - RNA, 21 nt, Human
cagaauaaguuauugcaguuu

SEQ ID NO: 3801796 - RNA, 17 nt, Human
cagaauaaucuuugggu

SEQ ID NO: 3801797 - RNA, 16 nt, Human
cagaauacuuuucucu

SEQ ID NO: 3801798 - RNA, 21 nt, Human
cagaauagcaaggugcucaca

SEQ ID NO: 3801799 - RNA, 14 nt, Human
cagaauauguuuca

SEQ ID NO: 3801800 - RNA, 15 nt, Human
cagaauauguuucaa

SEQ ID NO: 3801801 - RNA, 17 nt, Human
cagaauauguuucaaac

SEQ ID NO: 3801802 - RNA, 13 nt, Human
cagaauauuucua

SEQ ID NO: 3801803 - RNA, 12 nt, Human
cagaauauuuua

SEQ ID NO: 3801804 - RNA, 22 nt, Human
cagaauauuuuuauauuuccuu

SEQ ID NO: 3801805 - RNA, 23 nt, Human
cagaauauuuuuauauuuccuuu

SEQ ID NO: 3801806 - RNA, 15 nt, Human
cagaaucaaagcaau

SEQ ID NO: 3801807 - RNA, 21 nt, Human
cagaaucaaagcaaugcauuu

SEQ ID NO: 3801808 - RNA, 16 nt, Human
cagaaucauaugauuc

SEQ ID NO: 3801809 - RNA, 14 nt, Human
cagaaucauugcuu

SEQ ID NO: 3801810 - RNA, 15 nt, Human
cagaaucauugcuua

SEQ ID NO: 3801811 - RNA, 13 nt, Human
cagaaucccuuaa

SEQ ID NO: 3801812 - RNA, 16 nt, Human
cagaauccuggcccuc

SEQ ID NO: 3801813 - RNA, 16 nt, Human
cagaaucuaaagccag

SEQ ID NO: 3801814 - RNA, 18 nt, Human
cagaaucuacccaaagga

SEQ ID NO: 3801815 - RNA, 16 nt, Human
cagaaucucugaauuu

SEQ ID NO: 3801816 - RNA, 16 nt, Human
cagaaucugaauguaa

SEQ ID NO: 3801817 - RNA, 13 nt, Human
cagaaucuuguuu

SEQ ID NO: 3801818 - RNA, 19 nt, Human
cagaaucuuguuuugaaaa

SEQ ID NO: 3801819 - RNA, 20 nt, Human
cagaaucuuguuuugaaaau

SEQ ID NO: 3801820 - RNA, 16 nt, Human
cagaaucuuuguuaag

SEQ ID NO: 3801821 - RNA, 15 nt, Human
cagaaugaaaaauga

SEQ ID NO: 3801822 - RNA, 14 nt, Human
cagaaugaggcugc

SEQ ID NO: 3801823 - RNA, 20 nt, Human
cagaaugcaaccaagucaca

SEQ ID NO: 3801824 - RNA, 18 nt, Human
cagaaugcugcaggacuu

SEQ ID NO: 3801825 - RNA, 11 nt, Human
cagaaugcugu

SEQ ID NO: 3801826 - RNA, 17 nt, Human
cagaaugcuguacaucu

SEQ ID NO: 3801827 - RNA, 18 nt, Human
cagaaugcuguacaucua

SEQ ID NO: 3801828 - RNA, 20 nt, Human
cagaauguaagugggcccac

SEQ ID NO: 3801829 - RNA, 12 nt, Human
cagaauguaucu

SEQ ID NO: 3801830 - RNA, 13 nt, Human
cagaauguaucug

SEQ ID NO: 3801831 - RNA, 22 nt, Human
cagaauguugauuacagugcag

SEQ ID NO: 3801832 - RNA, 19 nt, Human
cagaauuaaacuuuuaauu

SEQ ID NO: 3801833 - RNA, 15 nt, Human
cagaauuaacuccau

SEQ ID NO: 3801834 - RNA, 21 nt, Human
cagaauuauuuuuaaaaagaa

SEQ ID NO: 3801835 - RNA, 15 nt, Human
cagaauucccagcug

SEQ ID NO: 3801836 - RNA, 21 nt, Human
cagaauucugcuaccucacug

SEQ ID NO: 3801837 - RNA, 21 nt, Human
cagaauugaaacacuuuuuug

SEQ ID NO: 3801838 - RNA, 13 nt, Human
cagaauugaucau

SEQ ID NO: 3801839 - RNA, 19 nt, Human
cagaauuucccaaagcagu

SEQ ID NO: 3801840 - RNA, 18 nt, Human
cccaagcuuggcagccga

SEQ ID NO: 3801841 - RNA, 20 nt, Human
cccaagcuuggcagccgagc

SEQ ID NO: 3801842 - RNA, 19 nt, Human
cccaaggaaagccccagca

SEQ ID NO: 3801843 - RNA, 15 nt, Human
cccaaggagcacagg

SEQ ID NO: 3801844 - RNA, 18 nt, Human
cccaaggagcacaggucc

SEQ ID NO: 3801845 - RNA, 20 nt, Human
cccaaggagcacagguccca

SEQ ID NO: 3801846 - RNA, 22 nt, Human
cccaaggagcacaggucccacc

SEQ ID NO: 3801847 - RNA, 15 nt, Human
cccaaggaggaaaaa

SEQ ID NO: 3801848 - RNA, 22 nt, Human
cccaaggaggaaaaacagacaa

SEQ ID NO: 3801849 - RNA, 21 nt, Human
cccaaggcaaggggugccugg

SEQ ID NO: 3801850 - RNA, 22 nt, Human
cccaaggcaaggggugccuggg

SEQ ID NO: 3801851 - RNA, 23 nt, Human
cccaaggcaaggggugccuggga

SEQ ID NO: 3801852 - RNA, 23 nt, Human
cccaaggccuuccccuggcacug

SEQ ID NO: 3801853 - RNA, 22 nt, Human
cccaaggcugcgucuggagggg

SEQ ID NO: 3801854 - RNA, 23 nt, Human
cccaagggaucugguccuaccca

SEQ ID NO: 3801855 - RNA, 19 nt, Human
cccaagggcaaaauuccca

SEQ ID NO: 3801856 - RNA, 21 nt, Human
cccaagggcaaaauucccagg

SEQ ID NO: 3801857 - RNA, 18 nt, Human
cccaagggccuggccuga

SEQ ID NO: 3801858 - RNA, 15 nt, Human
cccaaggggcagucu

SEQ ID NO: 3801859 - RNA, 21 nt, Human
cccaagguucugggugcagga

SEQ ID NO: 3801860 - RNA, 22 nt, Human
cccaaguagggggucuaaaauu

SEQ ID NO: 3801861 - RNA, 12 nt, Human
cccaaguccaaa

SEQ ID NO: 3801862 - RNA, 17 nt, Human
cccaaguccugaagagg

SEQ ID NO: 3801863 - RNA, 24 nt, Human
cccaagugguuuccacaugcucug

SEQ ID NO: 3801864 - RNA, 22 nt, Human
cccaaguugggggucagugcug

SEQ ID NO: 3801865 - RNA, 23 nt, Human
cccaaguuuccauagcaacagga

SEQ ID NO: 3801866 - RNA, 12 nt, Human
cccaauagcugc

SEQ ID NO: 3801867 - RNA, 11 nt, Human
cccaauauuau

SEQ ID NO: 3801868 - RNA, 12 nt, Human
cccaauauuaua

SEQ ID NO: 3801869 - RNA, 16 nt, Human
cccaaucagcacugaa

SEQ ID NO: 3801870 - RNA, 21 nt, Human
cccaaucccuuuauuaccccc

SEQ ID NO: 3801871 - RNA, 17 nt, Human
cccaauccucccagaaa

SEQ ID NO: 3801872 - RNA, 22 nt, Human
cccaaugagacucuagggucca

SEQ ID NO: 3801873 - RNA, 19 nt, Human
cccaauuaggaaguguaac

SEQ ID NO: 3801874 - RNA, 18 nt, Human
cccaauuuugcagggagc

SEQ ID NO: 3801875 - RNA, 13 nt, Human
cccacaaagccuu

SEQ ID NO: 3801876 - RNA, 22 nt, Human
cccacaaagccuuaucaagugu

SEQ ID NO: 3801877 - RNA, 21 nt, Human
cccacaaaggagagcuagcag

SEQ ID NO: 3801878 - RNA, 13 nt, Human
cccacaagaaaug

SEQ ID NO: 3801879 - RNA, 15 nt, Human
cccacaagccugagg

SEQ ID NO: 3801880 - RNA, 16 nt, Human
cccacaagugguggua

SEQ ID NO: 3801881 - RNA, 23 nt, Human
cccacaaucuuaaggggcagcuu

SEQ ID NO: 3801882 - RNA, 13 nt, Human
cccacacacacac

SEQ ID NO: 3801883 - RNA, 20 nt, Human
cccacacacacacacaugca

SEQ ID NO: 3801884 - RNA, 14 nt, Human
cccacacaccccaa

SEQ ID NO: 3801885 - RNA, 15 nt, Human
cccacacacucgccc

SEQ ID NO: 3801886 - RNA, 21 nt, Human
cccacaccauaagcuacugcc

SEQ ID NO: 3801887 - RNA, 12 nt, Human
cccacacccugg

SEQ ID NO: 3801888 - RNA, 15 nt, Human
cccacaccguguaaa

SEQ ID NO: 3801889 - RNA, 15 nt, Human
cccacaccuccacag

SEQ ID NO: 3801890 - RNA, 14 nt, Human
cccacaccuccucu

SEQ ID NO: 3801891 - RNA, 15 nt, Human
cccacaccucugcca

SEQ ID NO: 3801892 - RNA, 12 nt, Human
cccacaccuggc

SEQ ID NO: 3801893 - RNA, 19 nt, Human
cccacaccuggcccugggg

SEQ ID NO: 3801894 - RNA, 22 nt, Human
cccacacggaggcaucugcacc

SEQ ID NO: 3801895 - RNA, 23 nt, Human
cccacacggaggcaucugcaccc

SEQ ID NO: 3801896 - RNA, 13 nt, Human
cccacacucacuc

SEQ ID NO: 3801897 - RNA, 21 nt, Human
cccacacucagauccuccuca

SEQ ID NO: 3801898 - RNA, 11 nt, Human
cccacacuccu

SEQ ID NO: 3801899 - RNA, 14 nt, Human
cccacacuccuaca

SEQ ID NO: 3801900 - RNA, 19 nt, Human
cccacacuggggugccgcc

SEQ ID NO: 3801901 - RNA, 22 nt, Human
cccacacuggggugccgccugc

SEQ ID NO: 3801902 - RNA, 14 nt, Human
cccacacuucccug

SEQ ID NO: 3801903 - RNA, 15 nt, Human
cccacacuucccugg

SEQ ID NO: 3801904 - RNA, 12 nt, Human
cccacagaaaga

SEQ ID NO: 3801905 - RNA, 23 nt, Human
cccacagaaagacugagcucaag

SEQ ID NO: 3801906 - RNA, 13 nt, Human
cccacagaaagag

SEQ ID NO: 3801907 - RNA, 12 nt, Human
cccacagagaca

SEQ ID NO: 3801908 - RNA, 12 nt, Human
cccacagcaggc

SEQ ID NO: 3801909 - RNA, 18 nt, Human
cccacagcccacguccug

SEQ ID NO: 3801910 - RNA, 19 nt, Human
cccacagcccacguccugu

SEQ ID NO: 3801911 - RNA, 22 nt, Human
cccacagcccacguccugucag

SEQ ID NO: 3801912 - RNA, 16 nt, Human
cccacagccccaucug

SEQ ID NO: 3801913 - RNA, 22 nt, Human
cccacagcgcuggccgggaccc

SEQ ID NO: 3801914 - RNA, 17 nt, Human
cccacagcgucccuggc

SEQ ID NO: 3801915 - RNA, 20 nt, Human
cccacagcucccaccccacc

SEQ ID NO: 3801916 - RNA, 16 nt, Human
cccacaggcccuuccu

SEQ ID NO: 3801917 - RNA, 18 nt, Human
cccacaggcccuuccucu

SEQ ID NO: 3801918 - RNA, 15 nt, Human
cccacaguugcucua

SEQ ID NO: 3801919 - RNA, 17 nt, Human
cccacaucccaucgucu

SEQ ID NO: 3801920 - RNA, 14 nt, Human
cccacaucccuggg

SEQ ID NO: 3801921 - RNA, 19 nt, Human
cccacaucccugggccugc

SEQ ID NO: 3801922 - RNA, 20 nt, Human
cccacaucccugggccugcu

SEQ ID NO: 3801923 - RNA, 24 nt, Human
cccacaucccugggccugcugcug

SEQ ID NO: 3801924 - RNA, 15 nt, Human
cccacauguccagca

SEQ ID NO: 3801925 - RNA, 16 nt, Human
cccacaugugacacau

SEQ ID NO: 3801926 - RNA, 22 nt, Human
cccacauuggaagagcagcacc

SEQ ID NO: 3801927 - RNA, 15 nt, Human
cccaccaccccagcu

SEQ ID NO: 3801928 - RNA, 13 nt, Human
cccaccaccuagg

SEQ ID NO: 3801929 - RNA, 16 nt, Human
cccaccaccuaggcca

SEQ ID NO: 3801930 - RNA, 19 nt, Human
cccaccaccuaggccacuc

SEQ ID NO: 3801931 - RNA, 19 nt, Human
cccaccacgauguggcccu

SEQ ID NO: 3801932 - RNA, 14 nt, Human
cccaccacggccac

SEQ ID NO: 3801933 - RNA, 20 nt, Human
cccaccacggccacuggcca

SEQ ID NO: 3801934 - RNA, 13 nt, Human
cccaccaggcugc

SEQ ID NO: 3801935 - RNA, 16 nt, Human
cccaccaggcugcuca

SEQ ID NO: 3801936 - RNA, 14 nt, Human
cccaccaucugcug

SEQ ID NO: 3801937 - RNA, 16 nt, Human
cccaccaucugcuguc

SEQ ID NO: 3801938 - RNA, 19 nt, Human
cccaccaucugcugucuuu

SEQ ID NO: 3801939 - RNA, 20 nt, Human
cccaccauuuggcaucccug

SEQ ID NO: 3801940 - RNA, 22 nt, Human
ccagcugaugacucaagauucc

SEQ ID NO: 3801941 - RNA, 16 nt, Human
ccagcugcaaaguguu

SEQ ID NO: 3801942 - RNA, 17 nt, Human
ccagcugcaaaguguuu

SEQ ID NO: 3801943 - RNA, 13 nt, Human
ccagcugcaccag

SEQ ID NO: 3801944 - RNA, 14 nt, Human
ccagcugcaccccu

SEQ ID NO: 3801945 - RNA, 20 nt, Human
ccagcugcaccccuuccugg

SEQ ID NO: 3801946 - RNA, 17 nt, Human
ccagcugcaccugccag

SEQ ID NO: 3801947 - RNA, 18 nt, Human
ccagcugcaccugccagc

SEQ ID NO: 3801948 - RNA, 19 nt, Human
ccagcugcaccugccagcc

SEQ ID NO: 3801949 - RNA, 18 nt, Human
ccagcugcacugaugcug

SEQ ID NO: 3801950 - RNA, 19 nt, Human
ccagcugcacugaugcugc

SEQ ID NO: 3801951 - RNA, 17 nt, Human
ccagcugcccccagagc

SEQ ID NO: 3801952 - RNA, 19 nt, Human
ccagcugcccccagagcca

SEQ ID NO: 3801953 - RNA, 17 nt, Human
ccagcugccccucccug

SEQ ID NO: 3801954 - RNA, 16 nt, Human
ccagcugcccuauggg

SEQ ID NO: 3801955 - RNA, 17 nt, Human
ccagcugcccuuccgca

SEQ ID NO: 3801956 - RNA, 21 nt, Human
ccagcugcccuuccgcagugu

SEQ ID NO: 3801957 - RNA, 18 nt, Human
ccagcugccgaccagagc

SEQ ID NO: 3801958 - RNA, 15 nt, Human
ccagcugccuauuga

SEQ ID NO: 3801959 - RNA, 12 nt, Human
ccagcugccucc

SEQ ID NO: 3801960 - RNA, 18 nt, Human
ccagcugcgcuugcuuuu

SEQ ID NO: 3801961 - RNA, 20 nt, Human
ccagcugcgcuugcuuuucu

SEQ ID NO: 3801962 - RNA, 21 nt, Human
ccagcugcgcuugcuuuucug

SEQ ID NO: 3801963 - RNA, 14 nt, Human
ccagcugcucccca

SEQ ID NO: 3801964 - RNA, 21 nt, Human
ccagcugcuccccucccuccu

SEQ ID NO: 3801965 - RNA, 12 nt, Human
ccagcugcucug

SEQ ID NO: 3801966 - RNA, 22 nt, Human
ccagcugcucugcccagagcug

SEQ ID NO: 3801967 - RNA, 19 nt, Human
ccagcugcugagccgcaga

SEQ ID NO: 3801968 - RNA, 11 nt, Human
ccagcugcugu

SEQ ID NO: 3801969 - RNA, 18 nt, Human
ccagcugcuugggcuuca

SEQ ID NO: 3801970 - RNA, 17 nt, Human
ccagcuggaggcagggg

SEQ ID NO: 3801971 - RNA, 22 nt, Human
ccagcuggaggcaggggcuucc

SEQ ID NO: 3801972 - RNA, 23 nt, Human
ccagcuggaggcaggggcuuccu

SEQ ID NO: 3801973 - RNA, 14 nt, Human
ccagcuggccggga

SEQ ID NO: 3801974 - RNA, 15 nt, Human
ccagcuggccuggac

SEQ ID NO: 3801975 - RNA, 13 nt, Human
ccagcuggccuuu

SEQ ID NO: 3801976 - RNA, 12 nt, Human
ccagcugggagg

SEQ ID NO: 3801977 - RNA, 14 nt, Human
ccagcugggaggca

SEQ ID NO: 3801978 - RNA, 18 nt, Human
ccagcugggaucugacug

SEQ ID NO: 3801979 - RNA, 14 nt, Human
ccagcugggcucug

SEQ ID NO: 3801980 - RNA, 16 nt, Human
ccagcugggcucugca

SEQ ID NO: 3801981 - RNA, 22 nt, Human
ccagcugggcucugccacccua

SEQ ID NO: 3801982 - RNA, 19 nt, Human
ccagcuggggccaggcugg

SEQ ID NO: 3801983 - RNA, 21 nt, Human
ccagcuggggccaggcugggu

SEQ ID NO: 3801984 - RNA, 15 nt, Human
cgcugagccaccugc

SEQ ID NO: 3801985 - RNA, 21 nt, Human
cgcugagccaccugcccuuuu

SEQ ID NO: 3801986 - RNA, 20 nt, Human
cgcugaguauggagcagccu

SEQ ID NO: 3801987 - RNA, 13 nt, Human
cgcugaguggcag

SEQ ID NO: 3801988 - RNA, 16 nt, Human
cgcugaguggcagggg

SEQ ID NO: 3801989 - RNA, 20 nt, Human
cgcugaguggcaggggacag

SEQ ID NO: 3801990 - RNA, 13 nt, Human
cgcugaugcuggg

SEQ ID NO: 3801991 - RNA, 14 nt, Human
cgcugaugcugggc

SEQ ID NO: 3801992 - RNA, 16 nt, Human
cgcugaugcugggcug

SEQ ID NO: 3801993 - RNA, 13 nt, Human
cgcugauguucac

SEQ ID NO: 3801994 - RNA, 19 nt, Human
cgcugcaaccuguugauag

SEQ ID NO: 3801995 - RNA, 17 nt, Human
cgcugccacccaccucc

SEQ ID NO: 3801996 - RNA, 20 nt, Human
cgcugccacccaccucccug

SEQ ID NO: 3801997 - RNA, 21 nt, Human
cgcugccagccuugagcccug

SEQ ID NO: 3801998 - RNA, 23 nt, Human
cgcugccccaucuccccucagcu

SEQ ID NO: 3801999 - RNA, 13 nt, Human
cgcugccccuggc

SEQ ID NO: 3802000 - RNA, 17 nt, Human
cgcugccccuggcagcc

SEQ ID NO: 3802001 - RNA, 21 nt, Human
cgcugcccggcgcccucuguc

SEQ ID NO: 3802002 - RNA, 18 nt, Human
cgcugccgcaccccagag

SEQ ID NO: 3802003 - RNA, 15 nt, Human
cgcugcucugcccca

SEQ ID NO: 3802004 - RNA, 13 nt, Human
cgcugcugucaca

SEQ ID NO: 3802005 - RNA, 18 nt, Human
cgcugcuucgugggauac

SEQ ID NO: 3802006 - RNA, 13 nt, Human
cuugcucugcacc

SEQ ID NO: 3802007 - RNA, 14 nt, Human
cuugcucugcugac

SEQ ID NO: 3802008 - RNA, 23 nt, Human
cuugcucugcuugacaacaucug

SEQ ID NO: 3802009 - RNA, 14 nt, Human
cuugcucuggaccu

SEQ ID NO: 3802010 - RNA, 17 nt, Human
cuugcucuggaccugcc

SEQ ID NO: 3802011 - RNA, 18 nt, Human
cuugcucuguuugugggg

SEQ ID NO: 3802012 - RNA, 19 nt, Human
cuugcucuuucuacucuga

SEQ ID NO: 3802013 - RNA, 20 nt, Human
cuugcucuuucuacucugaa

SEQ ID NO: 3802014 - RNA, 21 nt, Human
cuugcugaaacgcaucuaguu

SEQ ID NO: 3802015 - RNA, 20 nt, Human
cuugcugaaucggaaucucu

SEQ ID NO: 3802016 - RNA, 17 nt, Human
cuugcugagaggggcug

SEQ ID NO: 3802017 - RNA, 19 nt, Human
cuugcugagaggggcuguc

SEQ ID NO: 3802018 - RNA, 18 nt, Human
cuugcugagcuguuuaua

SEQ ID NO: 3802019 - RNA, 21 nt, Human
cuugcugcacucuugcacaug

SEQ ID NO: 3802020 - RNA, 13 nt, Human
cuugcugcccugc

SEQ ID NO: 3802021 - RNA, 10 nt, Human
cuugcugccu

SEQ ID NO: 3802022 - RNA, 19 nt, Human
cuugcugccuucuggauuc

SEQ ID NO: 3802023 - RNA, 16 nt, Human
cuugcugcuagaacuu

SEQ ID NO: 3802024 - RNA, 19 nt, Human
cuugcugcuauuuuacugu

SEQ ID NO: 3802025 - RNA, 19 nt, Human
cuugcugcugauuuaaaca

SEQ ID NO: 3802026 - RNA, 17 nt, Human
cuugcuggacggggacu

SEQ ID NO: 3802027 - RNA, 21 nt, Human
cuugcuggacggggacugggg

SEQ ID NO: 3802028 - RNA, 13 nt, Human
cuugcuggcccca

SEQ ID NO: 3802029 - RNA, 15 nt, Human
cuugcuggccccagc

SEQ ID NO: 3802030 - RNA, 16 nt, Human
cuugcuggccccagcc

SEQ ID NO: 3802031 - RNA, 22 nt, Human
cuugcuggccccagcccugcug

SEQ ID NO: 3802032 - RNA, 22 nt, Human
cuugcuggcuacgccucuucug

SEQ ID NO: 3802033 - RNA, 23 nt, Human
cuugcuggggacggggggcccca

SEQ ID NO: 3802034 - RNA, 16 nt, Human
cuugcuguauaugcag

SEQ ID NO: 3802035 - RNA, 19 nt, Human
cuugcuguaugcugaucau

SEQ ID NO: 3802036 - RNA, 13 nt, Human
cuugcuguccuga

SEQ ID NO: 3802037 - RNA, 17 nt, Human
cuugcuguccugaucug

SEQ ID NO: 3802038 - RNA, 13 nt, Human
cuugcugucucug

SEQ ID NO: 3802039 - RNA, 16 nt, Human
cuugcuguuggucaug

SEQ ID NO: 3802040 - RNA, 19 nt, Human
cuugcuguuuguccugaga

SEQ ID NO: 3802041 - RNA, 13 nt, Human
cuugcuuaaaugu

SEQ ID NO: 3802042 - RNA, 17 nt, Human
cuugcuuaaauuucuua

SEQ ID NO: 3802043 - RNA, 22 nt, Human
cuugcuuaccuugacuguugau

SEQ ID NO: 3802044 - RNA, 13 nt, Human
cuugcuucccuaa

SEQ ID NO: 3802045 - RNA, 14 nt, Human
cuugcuucuuacug

SEQ ID NO: 3802046 - RNA, 19 nt, Human
cuugcuucuuacugauaau

SEQ ID NO: 3802047 - RNA, 20 nt, Human
cuugcuucuuacugauaauu

SEQ ID NO: 3802048 - RNA, 14 nt, Human
cuugcuucuuucua

SEQ ID NO: 3802049 - RNA, 20 nt, Human
cuugcuugauuguauggugg

SEQ ID NO: 3802050 - RNA, 14 nt, Human
cuugcuuggcugcu

SEQ ID NO: 3802051 - RNA, 18 nt, Human
cuugcuuguaccucuggc

SEQ ID NO: 3802052 - RNA, 13 nt, Human
cuugcuuguuaca

SEQ ID NO: 3802053 - RNA, 22 nt, Human
cuugcuuguugggauuccugac

SEQ ID NO: 3802054 - RNA, 20 nt, Human
cuugcuuuaccuuuucaggg

SEQ ID NO: 3802055 - RNA, 21 nt, Human
cuugcuuucuaugcuguuugu

SEQ ID NO: 3802056 - RNA, 13 nt, Human
cuugcuuugauuu

SEQ ID NO: 3802057 - RNA, 18 nt, Human
cuugcuuuguguucuuug

SEQ ID NO: 3802058 - RNA, 14 nt, Human
cuugcuuuucaugc

SEQ ID NO: 3802059 - RNA, 16 nt, Human
cuugcuuuucccucuu

SEQ ID NO: 3802060 - RNA, 17 nt, Human
cuugcuuuucccucuuu

SEQ ID NO: 3802061 - RNA, 20 nt, Human
cuugcuuuucccucuuuucu

SEQ ID NO: 3802062 - RNA, 14 nt, Human
cuuggaaaaaguga

SEQ ID NO: 3802063 - RNA, 22 nt, Human
cuuggaaaaauccagaaagaaa

SEQ ID NO: 3802064 - RNA, 17 nt, Human
cuuggaaaccugcccug

SEQ ID NO: 3802065 - RNA, 20 nt, Human
cuuggaaaccugcccugccu

SEQ ID NO: 3802066 - RNA, 22 nt, Human
cuuggaaaccugcccugccuga

SEQ ID NO: 3802067 - RNA, 23 nt, Human
cuuggaaaccugcccugccugag

SEQ ID NO: 3802068 - RNA, 21 nt, Human
cuuggaaacuggaugagguca

SEQ ID NO: 3802069 - RNA, 14 nt, Human
cuuggaaauauuaa

SEQ ID NO: 3802070 - RNA, 15 nt, Human
cuuggaaauauuaaa

SEQ ID NO: 3802071 - RNA, 21 nt, Human
cuuggaaaucaaauguaaagu

SEQ ID NO: 3802072 - RNA, 16 nt, Human
cuuggaacauuggaau

SEQ ID NO: 3802073 - RNA, 22 nt, Human
cuuggaaccguaggacccaagc

SEQ ID NO: 3802074 - RNA, 15 nt, Human
cuuggaacugaaggg

SEQ ID NO: 3802075 - RNA, 23 nt, Human
cuuggaacuugccugccuuucca

SEQ ID NO: 3802076 - RNA, 19 nt, Human
cuuggaagagccugcaggu

SEQ ID NO: 3802077 - RNA, 20 nt, Human
cuuggaagcuccgcuuucua

SEQ ID NO: 3802078 - RNA, 16 nt, Human
cuuggaagcuguuugg

SEQ ID NO: 3802079 - RNA, 19 nt, Human
cuuggaagcuguuuggaaa

SEQ ID NO: 3802080 - RNA, 16 nt, Human
cuuggaaguacaugaa

SEQ ID NO: 3802081 - RNA, 18 nt, Human
cuuggaaguugcauggca

SEQ ID NO: 3802082 - RNA, 21 nt, Human
cuuggaaguuucauauauugu

SEQ ID NO: 3802083 - RNA, 22 nt, Human
cuuggacaagacaaaccaaguc

SEQ ID NO: 3802084 - RNA, 15 nt, Human
cuuggacacgcucag

SEQ ID NO: 3802085 - RNA, 17 nt, Human
cuuggacauccuccucc

SEQ ID NO: 3802086 - RNA, 21 nt, Human
cuuggacauccuccucccacc

SEQ ID NO: 3802087 - RNA, 13 nt, Human
cuuggaccucugc

SEQ ID NO: 3802088 - RNA, 14 nt, Human
cuuggaccucugcu

SEQ ID NO: 3802089 - RNA, 17 nt, Human
cuuggaccucugcucug

SEQ ID NO: 3802090 - RNA, 13 nt, Human
cuuggagaaauga

SEQ ID NO: 3802091 - RNA, 19 nt, Human
cuuggagaagucucagcua

SEQ ID NO: 3802092 - RNA, 14 nt, Human
cuuggagaccuuac

SEQ ID NO: 3802093 - RNA, 16 nt, Human
cuuggagaccuuaccc

SEQ ID NO: 3802094 - RNA, 15 nt, Human
cuuggagagacacag

SEQ ID NO: 3802095 - RNA, 13 nt, Human
cuuggagccccag

SEQ ID NO: 3802096 - RNA, 15 nt, Human
cuuggagccugcaga

SEQ ID NO: 3802097 - RNA, 20 nt, Human
cuuggagccugcagagcugc

SEQ ID NO: 3802098 - RNA, 18 nt, Human
cuuggagcguggacuggu

SEQ ID NO: 3802099 - RNA, 19 nt, Human
cuuggagcuauuuuccagg

SEQ ID NO: 3802100 - RNA, 18 nt, Human
cuuggagcugagccucuc

SEQ ID NO: 3802101 - RNA, 13 nt, Human
cuuggaggaagga

SEQ ID NO: 3802102 - RNA, 17 nt, Human
cuuggagggucccaagc

SEQ ID NO: 3802103 - RNA, 22 nt, Human
cuuggagggucccaagcugggc

SEQ ID NO: 3802104 - RNA, 15 nt, Human
cuuggaggugucugu

SEQ ID NO: 3802105 - RNA, 22 nt, Human
cuuggauauauaggcuauuuuc

SEQ ID NO: 3802106 - RNA, 21 nt, Human
cuuggaugaguuuugggaagu

SEQ ID NO: 3802107 - RNA, 15 nt, Human
cuuggauguauaugu

SEQ ID NO: 3802108 - RNA, 13 nt, Human
cuuggauuaaaua

SEQ ID NO: 3802109 - RNA, 16 nt, Human
cuuggauucuuuccau

SEQ ID NO: 3802110 - RNA, 16 nt, Human
cuuggauuuaguuuca

SEQ ID NO: 3802111 - RNA, 20 nt, Human
cuuggcaauaaauuuugaaa

SEQ ID NO: 3802112 - RNA, 16 nt, Human
cuuggcaccaaagaug

SEQ ID NO: 3802113 - RNA, 20 nt, Human
cuuggcaccagacacccagg

SEQ ID NO: 3802114 - RNA, 21 nt, Human
cuuggcacccaagaccucagg

SEQ ID NO: 3802115 - RNA, 14 nt, Human
cuuggcagccuugu

SEQ ID NO: 3802116 - RNA, 23 nt, Human
cuuggcagguaggaauauuauau

SEQ ID NO: 3802117 - RNA, 19 nt, Human
cuuggcaucacagggcaga

SEQ ID NO: 3802118 - RNA, 16 nt, Human
cuuggcaucagcuggc

SEQ ID NO: 3802119 - RNA, 22 nt, Human
cuuggccagaagggggccauga

SEQ ID NO: 3802120 - RNA, 15 nt, Human
cuuggccaugcagaa

SEQ ID NO: 3802121 - RNA, 19 nt, Human
cuuggccaugggaggccuu

SEQ ID NO: 3802122 - RNA, 20 nt, Human
cuuggccaugggaggccuuu

SEQ ID NO: 3802123 - RNA, 23 nt, Human
cuuggccaugggaggccuuuccc

SEQ ID NO: 3802124 - RNA, 13 nt, Human
cuuggcccaggag

SEQ ID NO: 3802125 - RNA, 14 nt, Human
cuuggcccaggagu

SEQ ID NO: 3802126 - RNA, 15 nt, Human
cuuggcccaggaguu

SEQ ID NO: 3802127 - RNA, 20 nt, Human
cuuggcccaggaguuuggcc

SEQ ID NO: 3802128 - RNA, 21 nt, Human
cuugaucaguaguuugcauuu

SEQ ID NO: 3802129 - RNA, 16 nt, Human
cuugaucauuuuggga

SEQ ID NO: 3802130 - RNA, 16 nt, Human
cuugauccauuucuaa

SEQ ID NO: 3802131 - RNA, 18 nt, Human
cuugauccauuucuaauu

SEQ ID NO: 3802132 - RNA, 18 nt, Human
cuugaucugcucagcccu

SEQ ID NO: 3802133 - RNA, 19 nt, Human
cuugaucugcucagcccug

SEQ ID NO: 3802134 - RNA, 20 nt, Human
cuugaucuguauauacaaua

SEQ ID NO: 3802135 - RNA, 22 nt, Human
cuugaucuguauauacaauaac

SEQ ID NO: 3802136 - RNA, 12 nt, Human
cuugaugaagaa

SEQ ID NO: 3802137 - RNA, 13 nt, Human
cuugaugaagaag

SEQ ID NO: 3802138 - RNA, 21 nt, Human
cuugaugagcugugcacaaag

SEQ ID NO: 3802139 - RNA, 20 nt, Human
cuugaugaguguaacaagaa

SEQ ID NO: 3802140 - RNA, 22 nt, Human
cuugaugaguguaacaagaaag

SEQ ID NO: 3802141 - RNA, 18 nt, Human
cuugaugcacagagaagc

SEQ ID NO: 3802142 - RNA, 19 nt, Human
cuugaugggauucuggaca

SEQ ID NO: 3802143 - RNA, 19 nt, Human
cuugauguaaggaugggca

SEQ ID NO: 3802144 - RNA, 12 nt, Human
cuugaugugccu

SEQ ID NO: 3802145 - RNA, 18 nt, Human
cuugauguguuaucucuu

SEQ ID NO: 3802146 - RNA, 14 nt, Human
cuugauguugcuua

SEQ ID NO: 3802147 - RNA, 15 nt, Human
cuugauuaaaucaac

SEQ ID NO: 3802148 - RNA, 16 nt, Human
cuugauucagucacau

SEQ ID NO: 3802149 - RNA, 12 nt, Human
cuugauucauaa

SEQ ID NO: 3802150 - RNA, 13 nt, Human
cuugauucugcag

SEQ ID NO: 3802151 - RNA, 22 nt, Human
cuugauucugcaguaaaucuuu

SEQ ID NO: 3802152 - RNA, 12 nt, Human
cuugauuggaag

SEQ ID NO: 3802153 - RNA, 13 nt, Human
cuugauuggaagg

SEQ ID NO: 3802154 - RNA, 19 nt, Human
cuugauuuaaacacacaga

SEQ ID NO: 3802155 - RNA, 21 nt, Human
cuugauuuaucacacaaagca

SEQ ID NO: 3802156 - RNA, 23 nt, Human
cuugauuucaaaguuuuguugua

SEQ ID NO: 3802157 - RNA, 21 nt, Human
cuugauuuuagccuucucugu

SEQ ID NO: 3802158 - RNA, 13 nt, Human
cuugauuuuccau

SEQ ID NO: 3802159 - RNA, 15 nt, Human
cuugcaaaaaggguc

SEQ ID NO: 3802160 - RNA, 13 nt, Human
cuuggcugcagga

SEQ ID NO: 3802161 - RNA, 14 nt, Human
cuuggcuggaccca

SEQ ID NO: 3802162 - RNA, 13 nt, Human
cuuggcuggugug

SEQ ID NO: 3802163 - RNA, 14 nt, Human
cuuggcuggugugg

SEQ ID NO: 3802164 - RNA, 22 nt, Human
cuuggcuggugugguacagaga

SEQ ID NO: 3802165 - RNA, 17 nt, Human
cuuggcuguagaaggag

SEQ ID NO: 3802166 - RNA, 13 nt, Human
cuuggcugugagg

SEQ ID NO: 3802167 - RNA, 16 nt, Human
cuuggcuuaccugacc

SEQ ID NO: 3802168 - RNA, 23 nt, Human
cuuggcuuaccugaccucuugcu

SEQ ID NO: 3802169 - RNA, 18 nt, Human
cuuggcuuggcccuggca

SEQ ID NO: 3802170 - RNA, 20 nt, Human
cuuggcuuuuacugaagccu

SEQ ID NO: 3802171 - RNA, 12 nt, Human
cuugggaaauau

SEQ ID NO: 3802172 - RNA, 20 nt, Human
cuugggaagacuccuagcug

SEQ ID NO: 3802173 - RNA, 18 nt, Human
cuugggaauggauccugg

SEQ ID NO: 3802174 - RNA, 16 nt, Human
cuugggagagccccug

SEQ ID NO: 3802175 - RNA, 18 nt, Human
cuugggaggaagcagaau

SEQ ID NO: 3802176 - RNA, 21 nt, Human
cuugggaggaagcagaauaaa

SEQ ID NO: 3802177 - RNA, 23 nt, Human
cuugggaggaagcagaauaaagc

SEQ ID NO: 3802178 - RNA, 19 nt, Human
cuugggaggccccacuggg

SEQ ID NO: 3802179 - RNA, 21 nt, Human
cuugggaggccccacugggga

SEQ ID NO: 3802180 - RNA, 20 nt, Human
cuugggagugugguuucuuu

SEQ ID NO: 3802181 - RNA, 15 nt, Human
cuugggcaauauucu

SEQ ID NO: 3802182 - RNA, 19 nt, Human
cuugggcaauauucucugu

SEQ ID NO: 3802183 - RNA, 13 nt, Human
cuugggcaccccc

SEQ ID NO: 3802184 - RNA, 17 nt, Human
cuugggcacccccagcc

SEQ ID NO: 3802185 - RNA, 18 nt, Human
cuugggcacccccagccu

SEQ ID NO: 3802186 - RNA, 21 nt, Human
cuugggcacccccagccuggg

SEQ ID NO: 3802187 - RNA, 13 nt, Human
cuugggcagagcu

SEQ ID NO: 3802188 - RNA, 14 nt, Human
cuugggcagcaucc

SEQ ID NO: 3802189 - RNA, 20 nt, Human
cuugggccaaauccgcucuc

SEQ ID NO: 3802190 - RNA, 23 nt, Human
cuugggccagaaguaccagacua

SEQ ID NO: 3802191 - RNA, 15 nt, Human
cuugggcccacaccu

SEQ ID NO: 3802192 - RNA, 15 nt, Human
cuugggcccagcugg

SEQ ID NO: 3802193 - RNA, 18 nt, Human
cuugggcccagcugggcu

SEQ ID NO: 3802194 - RNA, 12 nt, Human
cuugggcccucc

SEQ ID NO: 3802195 - RNA, 15 nt, Human
cuugggcccucuggu

SEQ ID NO: 3802196 - RNA, 15 nt, Human
cuugggcccuucccu

SEQ ID NO: 3802197 - RNA, 14 nt, Human
cuugggcccuuuga

SEQ ID NO: 3802198 - RNA, 16 nt, Human
cuugggcccuuugagu

SEQ ID NO: 3802199 - RNA, 17 nt, Human
cuugggccuaggcugca

SEQ ID NO: 3802200 - RNA, 23 nt, Human
cuugggcgccgugcugggcagcc

SEQ ID NO: 3802201 - RNA, 12 nt, Human
cuugggcggcug

SEQ ID NO: 3802202 - RNA, 18 nt, Human
cuugggcggcugagagcc

SEQ ID NO: 3802203 - RNA, 18 nt, Human
cuugggcucugaugaaaa

SEQ ID NO: 3802204 - RNA, 13 nt, Human
cuugggcuucauc

SEQ ID NO: 3802205 - RNA, 22 nt, Human
cuugggcuucauccuccucaga

SEQ ID NO: 3802206 - RNA, 19 nt, Human
cuugggcuuccauuugugu

SEQ ID NO: 3802207 - RNA, 16 nt, Human
cuuggggaauuuccuc

SEQ ID NO: 3802208 - RNA, 16 nt, Human
cuuggggaccagagcu

SEQ ID NO: 3802209 - RNA, 22 nt, Human
cuuggggaccagagcugccacc

SEQ ID NO: 3802210 - RNA, 22 nt, Human
cuuggggagaccucuacugccu

SEQ ID NO: 3802211 - RNA, 19 nt, Human
cuuggggaggacaaaacuu

SEQ ID NO: 3802212 - RNA, 22 nt, Human
cuuggggaguuaagaccuggca

SEQ ID NO: 3802213 - RNA, 23 nt, Human
cuuggggaguuaagaccuggcag

SEQ ID NO: 3802214 - RNA, 21 nt, Human
cuuggggccaccaaagcugcc

SEQ ID NO: 3802215 - RNA, 12 nt, Human
cuuggggcccag

SEQ ID NO: 3802216 - RNA, 15 nt, Human
cuuggggcccagugc

SEQ ID NO: 3802217 - RNA, 18 nt, Human
cuuggggcucacacaccu

SEQ ID NO: 3802218 - RNA, 15 nt, Human
cuugggggaaaauac

SEQ ID NO: 3802219 - RNA, 21 nt, Human
cuugggggaacgaugugucug

SEQ ID NO: 3802220 - RNA, 22 nt, Human
cuugggggaacgaugugucugu

SEQ ID NO: 3802221 - RNA, 22 nt, Human
cuugggggacagggcuggccca

SEQ ID NO: 3802222 - RNA, 17 nt, Human
cuugggggcucagcaag

SEQ ID NO: 3802223 - RNA, 15 nt, Human
cuuggggggcugagg

SEQ ID NO: 3802224 - RNA, 22 nt, Human
cuuggggggcugaggugggagg

SEQ ID NO: 3802225 - RNA, 20 nt, Human
cuuggggggugaugagggca

SEQ ID NO: 3802226 - RNA, 22 nt, Human
cuuggggggugaugagggcagc

SEQ ID NO: 3802227 - RNA, 22 nt, Human
cuugggggguuuuuacuccagu

SEQ ID NO: 3802228 - RNA, 21 nt, Human
cuuggggguccuccuccaggg

SEQ ID NO: 3802229 - RNA, 22 nt, Human
cuuggggguccuccuccaggga

SEQ ID NO: 3802230 - RNA, 17 nt, Human
cuugggucccagggaag

SEQ ID NO: 3802231 - RNA, 15 nt, Human
cuuggguggagaagc

SEQ ID NO: 3802232 - RNA, 17 nt, Human
cuuggguggagaagcca

SEQ ID NO: 3802233 - RNA, 20 nt, Human
cuuggguggagaagccauug

SEQ ID NO: 3802234 - RNA, 21 nt, Human
cuuggguguaacaggucuccu

SEQ ID NO: 3802235 - RNA, 16 nt, Human
cuuggguuagaccuac

SEQ ID NO: 3802236 - RNA, 14 nt, Human
cuuggguucugaua

SEQ ID NO: 3802237 - RNA, 17 nt, Human
cuuggguuuuuguuacc

SEQ ID NO: 3802238 - RNA, 15 nt, Human
cuugguaagaagccg

SEQ ID NO: 3802239 - RNA, 23 nt, Human
cuugguacuacuagaugucuuua

SEQ ID NO: 3802240 - RNA, 20 nt, Human
cuugguacuugcugcuauuu

SEQ ID NO: 3802241 - RNA, 21 nt, Human
cuugguauuuggauaucuguu

SEQ ID NO: 3802242 - RNA, 16 nt, Human
cuuggucacagccagg

SEQ ID NO: 3802243 - RNA, 17 nt, Human
cuuggucacagccaggc

SEQ ID NO: 3802244 - RNA, 14 nt, Human
cuuggucacauaca

SEQ ID NO: 3802245 - RNA, 16 nt, Human
cuugguccugcugcag

SEQ ID NO: 3802246 - RNA, 22 nt, Human
cuuggucuaacuuuugugugaa

SEQ ID NO: 3802247 - RNA, 19 nt, Human
cuuggugccuaauguucca

SEQ ID NO: 3802248 - RNA, 13 nt, Human
cuuggugcuggga

SEQ ID NO: 3802249 - RNA, 12 nt, Human
cuugguguaauu

SEQ ID NO: 3802250 - RNA, 17 nt, Human
cuugguguaguugaacu

SEQ ID NO: 3802251 - RNA, 17 nt, Human
cuugguguccaccuggc

SEQ ID NO: 3802252 - RNA, 14 nt, Human
cuugguguccuuuc

SEQ ID NO: 3802253 - RNA, 20 nt, Human
cuugguguccuuucccucca

SEQ ID NO: 3802254 - RNA, 21 nt, Human
cuugguguccuuucccuccac

SEQ ID NO: 3802255 - RNA, 19 nt, Human
cuuggugugacccucugaa

SEQ ID NO: 3802256 - RNA, 17 nt, Human
cuugguguuaaaacacu

SEQ ID NO: 3802257 - RNA, 21 nt, Human
cuugguuauuuguuuaccacu

SEQ ID NO: 3802258 - RNA, 22 nt, Human
cuugguucaauaaagcacugag

SEQ ID NO: 3802259 - RNA, 23 nt, Human
cuugguucaauaaagcacugagc

SEQ ID NO: 3802260 - RNA, 14 nt, Human
cuugguucauaaau

SEQ ID NO: 3802261 - RNA, 17 nt, Human
cuugguucauaaaugaa

SEQ ID NO: 3802262 - RNA, 13 nt, Human
cuugguuccccca

SEQ ID NO: 3802263 - RNA, 16 nt, Human
cuugguuccuggggca

SEQ ID NO: 3802264 - RNA, 14 nt, Human
cuugguugaggaaa

SEQ ID NO: 3802265 - RNA, 14 nt, Human
cuugguuggcuggc

SEQ ID NO: 3802266 - RNA, 15 nt, Human
cuugguuggcuggcc

SEQ ID NO: 3802267 - RNA, 19 nt, Human
cuugguugguaggguggga

SEQ ID NO: 3802268 - RNA, 17 nt, Human
cuugguuuccaaaggca

SEQ ID NO: 3802269 - RNA, 15 nt, Human
cuugguuuguaaauu

SEQ ID NO: 3802270 - RNA, 20 nt, Human
cuugguuuguaaauuaacuu

SEQ ID NO: 3802271 - RNA, 18 nt, Human
cuuguaaaaauuaaaagu

SEQ ID NO: 3802272 - RNA, 18 nt, Human
cggaggaaagacaacaca

SEQ ID NO: 3802273 - RNA, 13 nt, Human
cggaggaccaggg

SEQ ID NO: 3802274 - RNA, 19 nt, Human
cggaggagaagaaggaaau

SEQ ID NO: 3802275 - RNA, 21 nt, Human
cggaggcaaaaggcagugggg

SEQ ID NO: 3802276 - RNA, 16 nt, Human
cggaggcaaagcuggc

SEQ ID NO: 3802277 - RNA, 19 nt, Human
cggaggcaaagcuggcuca

SEQ ID NO: 3802278 - RNA, 16 nt, Human
cggaggccacaugagu

SEQ ID NO: 3802279 - RNA, 14 nt, Human
cggaggccccaaag

SEQ ID NO: 3802280 - RNA, 18 nt, Human
cggaggccccaaaggaaa

SEQ ID NO: 3802281 - RNA, 18 nt, Human
cggaggccccacugaugc

SEQ ID NO: 3802282 - RNA, 15 nt, Human
cggaggccgaggcca

SEQ ID NO: 3802283 - RNA, 12 nt, Human
cggaggcugugu

SEQ ID NO: 3802284 - RNA, 23 nt, Human
cggaggcuugucagagcugggag

SEQ ID NO: 3802285 - RNA, 19 nt, Human
cggagggaauugaggucug

SEQ ID NO: 3802286 - RNA, 17 nt, Human
cggagggauuccccuaa

SEQ ID NO: 3802287 - RNA, 20 nt, Human
cggagggugacgggggugaa

SEQ ID NO: 3802288 - RNA, 19 nt, Human
cggagucagugccaggucc

SEQ ID NO: 3802289 - RNA, 23 nt, Human
cggagucauuuuguguugaagag

SEQ ID NO: 3802290 - RNA, 16 nt, Human
cggagucccaccuugg

SEQ ID NO: 3802291 - RNA, 18 nt, Human
cggagucccaccuuggcu

SEQ ID NO: 3802292 - RNA, 22 nt, Human
cggagucguggggugugcuggg

SEQ ID NO: 3802293 - RNA, 19 nt, Human
cggagugagaagcuuugcc

SEQ ID NO: 3802294 - RNA, 13 nt, Human
cggaguugggggu

SEQ ID NO: 3802295 - RNA, 18 nt, Human
cggaucagagcaggaccu

SEQ ID NO: 3802296 - RNA, 16 nt, Human
cggaucaggcucccag

SEQ ID NO: 3802297 - RNA, 19 nt, Human
cggaucaucaacaagauuu

SEQ ID NO: 3802298 - RNA, 14 nt, Human
cggauccuaagcau

SEQ ID NO: 3802299 - RNA, 22 nt, Human
cggauccugcacugacucugga

SEQ ID NO: 3802300 - RNA, 16 nt, Human
cggaucugagaaucuu

SEQ ID NO: 3802301 - RNA, 16 nt, Human
cggaucuuuggacaga

SEQ ID NO: 3802302 - RNA, 19 nt, Human
cggaucuuuggacagaagc

SEQ ID NO: 3802303 - RNA, 14 nt, Human
cggaugauuucuau

SEQ ID NO: 3802304 - RNA, 14 nt, Human
cggaugcugcuucc

SEQ ID NO: 3802305 - RNA, 14 nt, Human
cggauuauuuuuuc

SEQ ID NO: 3802306 - RNA, 17 nt, Human
cggcaaccccaguucug

SEQ ID NO: 3802307 - RNA, 19 nt, Human
cggcaaccccaguucugcu

SEQ ID NO: 3802308 - RNA, 16 nt, Human
cggcaauaaaagccca

SEQ ID NO: 3802309 - RNA, 22 nt, Human
cggcaauaaaagcccaggagcc

SEQ ID NO: 3802310 - RNA, 13 nt, Human
cggcacagccugg

SEQ ID NO: 3802311 - RNA, 19 nt, Human
cggcacccccugcagcuug

SEQ ID NO: 3802312 - RNA, 19 nt, Human
cggcaccugggcccugggg

SEQ ID NO: 3802313 - RNA, 20 nt, Human
cggcaccugggcccuggggc

SEQ ID NO: 3802314 - RNA, 17 nt, Human
cggcacggucuucccuc

SEQ ID NO: 3802315 - RNA, 22 nt, Human
cuugcaaaaucaguuuuccucu

SEQ ID NO: 3802316 - RNA, 15 nt, Human
cuugcaacacacaga

SEQ ID NO: 3802317 - RNA, 17 nt, Human
cuugcaacacacagaca

SEQ ID NO: 3802318 - RNA, 18 nt, Human
cuugcaagaaucagugca

SEQ ID NO: 3802319 - RNA, 15 nt, Human
cuugcaauggcagcc

SEQ ID NO: 3802320 - RNA, 13 nt, Human
cuugcacacauca

SEQ ID NO: 3802321 - RNA, 14 nt, Human
cuugcacacaucau

SEQ ID NO: 3802322 - RNA, 23 nt, Human
cuugcacacaucaucuguaagcu

SEQ ID NO: 3802323 - RNA, 19 nt, Human
cuugcacacuccccugcac

SEQ ID NO: 3802324 - RNA, 15 nt, Human
cuugcacagucacug

SEQ ID NO: 3802325 - RNA, 19 nt, Human
cuugcacagucacugcucu

SEQ ID NO: 3802326 - RNA, 22 nt, Human
cuugcaccccaaagcuuuccug

SEQ ID NO: 3802327 - RNA, 16 nt, Human
cuugcacccgccucuc

SEQ ID NO: 3802328 - RNA, 17 nt, Human
cuugcacccgccucucc

SEQ ID NO: 3802329 - RNA, 18 nt, Human
cuugcacccgccucuccc

SEQ ID NO: 3802330 - RNA, 19 nt, Human
cuugcacguauuuuaauag

SEQ ID NO: 3802331 - RNA, 21 nt, Human
cuugcacuaaaguauguaaag

SEQ ID NO: 3802332 - RNA, 19 nt, Human
cuugcacuggccuucugau

SEQ ID NO: 3802333 - RNA, 14 nt, Human
cuugcagaacugua

SEQ ID NO: 3802334 - RNA, 20 nt, Human
cuugcagagaagccuuggua

SEQ ID NO: 3802335 - RNA, 18 nt, Human
cuugcagcacucacacag

SEQ ID NO: 3802336 - RNA, 22 nt, Human
cuugcagcacucacacaggacc

SEQ ID NO: 3802337 - RNA, 18 nt, Human
cuugcagcuaaggagggg

SEQ ID NO: 3802338 - RNA, 23 nt, Human
cuugcaggaaggacuaugaaaag

SEQ ID NO: 3802339 - RNA, 20 nt, Human
cuugcaggucucaacccuuu

SEQ ID NO: 3802340 - RNA, 17 nt, Human
cuugcaguagauuuucu

SEQ ID NO: 3802341 - RNA, 21 nt, Human
cuugcaguagauuuucuuuaa

SEQ ID NO: 3802342 - RNA, 15 nt, Human
cuugcagucaucaga

SEQ ID NO: 3802343 - RNA, 16 nt, Human
cuugcagucaucagaa

SEQ ID NO: 3802344 - RNA, 17 nt, Human
cuugcagucaucagaag

SEQ ID NO: 3802345 - RNA, 22 nt, Human
cuugcaguucagcaccacccua

SEQ ID NO: 3802346 - RNA, 21 nt, Human
cuugcauaauaagcuaaagag

SEQ ID NO: 3802347 - RNA, 22 nt, Human
cuugcauaauaagcuaaagagg

SEQ ID NO: 3802348 - RNA, 20 nt, Human
cuugcauacaaacaagcaua

SEQ ID NO: 3802349 - RNA, 21 nt, Human
cuugcauacaaacaagcauau

SEQ ID NO: 3802350 - RNA, 15 nt, Human
cuugcauccaacucc

SEQ ID NO: 3802351 - RNA, 15 nt, Human
cuugcauccuuccua

SEQ ID NO: 3802352 - RNA, 16 nt, Human
cuugcauccuuccuau

SEQ ID NO: 3802353 - RNA, 17 nt, Human
cuugcauccuuccuaua

SEQ ID NO: 3802354 - RNA, 14 nt, Human
cuugcaugaagaga

SEQ ID NO: 3802355 - RNA, 14 nt, Human
cuugcaugaggcua

SEQ ID NO: 3802356 - RNA, 13 nt, Human
cuugcaugcuugc

SEQ ID NO: 3802357 - RNA, 21 nt, Human
cuugcaugguuuagaaagcuu

SEQ ID NO: 3802358 - RNA, 12 nt, Human
cuugcauuccca

SEQ ID NO: 3802359 - RNA, 18 nt, Human
cuugcauuuaaaagacag

SEQ ID NO: 3802360 - RNA, 16 nt, Human
cuugcauuuuagcuaa

SEQ ID NO: 3802361 - RNA, 12 nt, Human
cuugcauuuuug

SEQ ID NO: 3802362 - RNA, 14 nt, Human
cuugcauuuuugca

SEQ ID NO: 3802363 - RNA, 14 nt, Human
cuugccaaggcaga

SEQ ID NO: 3802364 - RNA, 13 nt, Human
cuugccacacccc

SEQ ID NO: 3802365 - RNA, 22 nt, Human
cuugccaccccacccucccugg

SEQ ID NO: 3802366 - RNA, 23 nt, Human
cuugccaccccacccucccugga

SEQ ID NO: 3802367 - RNA, 19 nt, Human
cuugccacuaagccaugaa

SEQ ID NO: 3802368 - RNA, 15 nt, Human
cuugccacuuugcac

SEQ ID NO: 3802369 - RNA, 23 nt, Human
cuugccagagauccaaaagaagc

SEQ ID NO: 3802370 - RNA, 14 nt, Human
cuugccagaugcug

SEQ ID NO: 3802371 - RNA, 19 nt, Human
cuugccagcugcugagccg

SEQ ID NO: 3802372 - RNA, 22 nt, Human
cuugccagcugcugagccgcag

SEQ ID NO: 3802373 - RNA, 12 nt, Human
cuugccagucuu

SEQ ID NO: 3802374 - RNA, 15 nt, Human
cuugccaucagugaa

SEQ ID NO: 3802375 - RNA, 16 nt, Human
cuugccaucccucccu

SEQ ID NO: 3802376 - RNA, 17 nt, Human
cuugccaucccucccuc

SEQ ID NO: 3802377 - RNA, 15 nt, Human
cuugccaugugacuc

SEQ ID NO: 3802378 - RNA, 23 nt, Human
cuugcccacuccugcucugcucg

SEQ ID NO: 3802379 - RNA, 19 nt, Human
cuugcccagagaugccucc

SEQ ID NO: 3802380 - RNA, 22 nt, Human
cuugcccagagaugccuccacc

SEQ ID NO: 3802381 - RNA, 15 nt, Human
cuugcccagccugga

SEQ ID NO: 3802382 - RNA, 17 nt, Human
cuugcccagccuggaug

SEQ ID NO: 3802383 - RNA, 18 nt, Human
cuugcccagccuggaugc

SEQ ID NO: 3802384 - RNA, 16 nt, Human
cuugcccagggcucag

SEQ ID NO: 3802385 - RNA, 18 nt, Human
cuugcccagggcucagcc

SEQ ID NO: 3802386 - RNA, 13 nt, Human
cuugcccauccug

SEQ ID NO: 3802387 - RNA, 17 nt, Human
cuugccccaacccccag

SEQ ID NO: 3802388 - RNA, 19 nt, Human
cuugccccaacccccagca

SEQ ID NO: 3802389 - RNA, 21 nt, Human
cuugccccaacccccagcacc

SEQ ID NO: 3802390 - RNA, 14 nt, Human
cuugccccaucacu

SEQ ID NO: 3802391 - RNA, 17 nt, Human
cuugccccaucacugcg

SEQ ID NO: 3802392 - RNA, 15 nt, Human
cuugccccccacccc

SEQ ID NO: 3802393 - RNA, 16 nt, Human
cuugccccccuggccu

SEQ ID NO: 3802394 - RNA, 23 nt, Human
cuugcccccugcccguguacaua

SEQ ID NO: 3802395 - RNA, 18 nt, Human
cuugccccggccccggcc

SEQ ID NO: 3802396 - RNA, 21 nt, Human
cuugccccggccccggcccca

SEQ ID NO: 3802397 - RNA, 13 nt, Human
cuugcccugaccu

SEQ ID NO: 3802398 - RNA, 19 nt, Human
cuugcccugaccucccagc

SEQ ID NO: 3802399 - RNA, 16 nt, Human
cuugcccugcucccuc

SEQ ID NO: 3802400 - RNA, 14 nt, Human
cuugcccuguuaaa

SEQ ID NO: 3802401 - RNA, 12 nt, Human
cuugcccuuccc

SEQ ID NO: 3802402 - RNA, 15 nt, Human
cuugcccuucccugu

SEQ ID NO: 3802403 - RNA, 18 nt, Human
cuugccgaaacuggaagu

SEQ ID NO: 3802404 - RNA, 17 nt, Human
cuugccgaggagccagg

SEQ ID NO: 3802405 - RNA, 18 nt, Human
cuugccgaggagccaggc

SEQ ID NO: 3802406 - RNA, 18 nt, Human
cuugccgcgucgcccucc

SEQ ID NO: 3802407 - RNA, 23 nt, Human
cuugccgcgucgcccucccaggc

SEQ ID NO: 3802408 - RNA, 23 nt, Human
cuugccgucuaccugaggggccu

SEQ ID NO: 3802409 - RNA, 20 nt, Human
cuugccuagggccuggucca

SEQ ID NO: 3802410 - RNA, 14 nt, Human
cuugccuccaggug

SEQ ID NO: 3802411 - RNA, 19 nt, Human
cuugccuccauggugccuc

SEQ ID NO: 3802412 - RNA, 20 nt, Human
cuugccuccauggugccucu

SEQ ID NO: 3802413 - RNA, 21 nt, Human
cuugccuccauggugccucug

SEQ ID NO: 3802414 - RNA, 14 nt, Human
cuugccuccccauu

SEQ ID NO: 3802415 - RNA, 15 nt, Human
cuugccuccguguca

SEQ ID NO: 3802416 - RNA, 19 nt, Human
cuuuccugauggcaggaug

SEQ ID NO: 3802417 - RNA, 14 nt, Human
cuuuccugccccag

SEQ ID NO: 3802418 - RNA, 19 nt, Human
cuuuccugccccaggccug

SEQ ID NO: 3802419 - RNA, 13 nt, Human
cuuuccuggaugu

SEQ ID NO: 3802420 - RNA, 14 nt, Human
cuuuccuuccucuc

SEQ ID NO: 3802421 - RNA, 16 nt, Human
cuuuccuuccucucau

SEQ ID NO: 3802422 - RNA, 16 nt, Human
cuuuccuuccuucccu

SEQ ID NO: 3802423 - RNA, 13 nt, Human
cuuuccuucuugc

SEQ ID NO: 3802424 - RNA, 15 nt, Human
cuuuccuugcucaac

SEQ ID NO: 3802425 - RNA, 19 nt, Human
cuuuccuuguggcagagga

SEQ ID NO: 3802426 - RNA, 16 nt, Human
cuuuccuuuccccagc

SEQ ID NO: 3802427 - RNA, 13 nt, Human
cuuuccuuuuucc

SEQ ID NO: 3802428 - RNA, 18 nt, Human
cuuuccuuuuuuaaaaau

SEQ ID NO: 3802429 - RNA, 13 nt, Human
cuuucgaggccug

SEQ ID NO: 3802430 - RNA, 20 nt, Human
cuuucgaggccugaagccag

SEQ ID NO: 3802431 - RNA, 17 nt, Human
cuuucggauccagggag

SEQ ID NO: 3802432 - RNA, 15 nt, Human
cuuucgucacccuug

SEQ ID NO: 3802433 - RNA, 21 nt, Human
cuuucguccacagcuuccugu

SEQ ID NO: 3802434 - RNA, 19 nt, Human
cuuucguuuguuuguuuca

SEQ ID NO: 3802435 - RNA, 13 nt, Human
cuuucuaagaaau

SEQ ID NO: 3802436 - RNA, 16 nt, Human
cuuucuaagaaaucaa

SEQ ID NO: 3802437 - RNA, 23 nt, Human
cuuucuacaaagcacuagagaau

SEQ ID NO: 3802438 - RNA, 14 nt, Human
cuuucuacaggcca

SEQ ID NO: 3802439 - RNA, 16 nt, Human
cuuucuacccagcgag

SEQ ID NO: 3802440 - RNA, 16 nt, Human
cuuucuacuuccaaga

SEQ ID NO: 3802441 - RNA, 14 nt, Human
cuuucuagaaagaa

SEQ ID NO: 3802442 - RNA, 17 nt, Human
cuuucuagcuaauggaa

SEQ ID NO: 3802443 - RNA, 14 nt, Human
cuuucuagcuguug

SEQ ID NO: 3802444 - RNA, 21 nt, Human
cuuucuaguccuauucuauug

SEQ ID NO: 3802445 - RNA, 18 nt, Human
cuuucuaguggucuuugu

SEQ ID NO: 3802446 - RNA, 16 nt, Human
cuuucuaguugaaaau

SEQ ID NO: 3802447 - RNA, 18 nt, Human
cuuucuaguugaaaauaa

SEQ ID NO: 3802448 - RNA, 14 nt, Human
cuuucuaucauuuu

SEQ ID NO: 3802449 - RNA, 16 nt, Human
cuuucuauccucugua

SEQ ID NO: 3802450 - RNA, 17 nt, Human
cuuucuauccucuguaa

SEQ ID NO: 3802451 - RNA, 17 nt, Human
cuuucuaugcugcuuuu

SEQ ID NO: 3802452 - RNA, 20 nt, Human
cuuucuaugcugcuuuuaua

SEQ ID NO: 3802453 - RNA, 17 nt, Human
cuuucuauuguacagaa

SEQ ID NO: 3802454 - RNA, 17 nt, Human
cuuucucacuaaaucuu

SEQ ID NO: 3802455 - RNA, 16 nt, Human
cuuucucaguuuucau

SEQ ID NO: 3802456 - RNA, 20 nt, Human
cuuucuccaaaguuauccag

SEQ ID NO: 3802457 - RNA, 13 nt, Human
cuuucuccaggac

SEQ ID NO: 3802458 - RNA, 21 nt, Human
cuuucuccuuagucuucucau

SEQ ID NO: 3802459 - RNA, 13 nt, Human
cuuucuccuuuuu

SEQ ID NO: 3802460 - RNA, 15 nt, Human
cuuucucuaauaaua

SEQ ID NO: 3802461 - RNA, 19 nt, Human
cuuucucuaauaauaaaua

SEQ ID NO: 3802462 - RNA, 22 nt, Human
cuuucucuaauaauaaauaguu

SEQ ID NO: 3802463 - RNA, 20 nt, Human
cuuucucucagccuuacauu

SEQ ID NO: 3802464 - RNA, 21 nt, Human
cuuucucucagccuuacauuu

SEQ ID NO: 3802465 - RNA, 22 nt, Human
cuuucucucagccuuacauuug

SEQ ID NO: 3802466 - RNA, 18 nt, Human
cuuucucuccagccugac

SEQ ID NO: 3802467 - RNA, 14 nt, Human
cuuucucuccccaa

SEQ ID NO: 3802468 - RNA, 13 nt, Human
cuuucucucuucc

SEQ ID NO: 3802469 - RNA, 14 nt, Human
cuuucucugaggac

SEQ ID NO: 3802470 - RNA, 15 nt, Human
cuuucucugaggaca

SEQ ID NO: 3802471 - RNA, 16 nt, Human
cuuucucugcuucagc

SEQ ID NO: 3802472 - RNA, 17 nt, Human
cuuucucugcuucagcu

SEQ ID NO: 3802473 - RNA, 21 nt, Human
cuuucucugcuucagcuugcu

SEQ ID NO: 3802474 - RNA, 17 nt, Human
cuuucucuucucuguuc

SEQ ID NO: 3802475 - RNA, 18 nt, Human
cuuucucuuucccugguc

SEQ ID NO: 3802476 - RNA, 17 nt, Human
cuuucucuuucucucuu

SEQ ID NO: 3802477 - RNA, 14 nt, Human
cuuucucuuucuuc

SEQ ID NO: 3802478 - RNA, 16 nt, Human
cuuucucuuucuuccu

SEQ ID NO: 3802479 - RNA, 12 nt, Human
cuuucucuuuuc

SEQ ID NO: 3802480 - RNA, 13 nt, Human
cuuucucuuuucc

SEQ ID NO: 3802481 - RNA, 23 nt, Human
cuuucucuuuuccccuuuccugu

SEQ ID NO: 3802482 - RNA, 20 nt, Human
cuuucugaacagcuggugua

SEQ ID NO: 3802483 - RNA, 23 nt, Human
cuuucugaacagcugguguagcu

SEQ ID NO: 3802484 - RNA, 20 nt, Human
cuuucugaagccucacuuau

SEQ ID NO: 3802485 - RNA, 14 nt, Human
cuuucugaauugca

SEQ ID NO: 3802486 - RNA, 18 nt, Human
cuuucugaccuucagcuc

SEQ ID NO: 3802487 - RNA, 17 nt, Human
cuuucugagugccuucu

SEQ ID NO: 3802488 - RNA, 18 nt, Human
cuuucugagugccuucug

SEQ ID NO: 3802489 - RNA, 19 nt, Human
cuuucugagugccuucugu

SEQ ID NO: 3802490 - RNA, 21 nt, Human
cuuucugagugccuucugugg

SEQ ID NO: 3802491 - RNA, 15 nt, Human
cuuucugaucaaggc

SEQ ID NO: 3802492 - RNA, 18 nt, Human
cuuucugaucaaggccuu

SEQ ID NO: 3802493 - RNA, 20 nt, Human
cuuucugaucaaggccuuau

SEQ ID NO: 3802494 - RNA, 19 nt, Human
cuuucugcacacaaauauu

SEQ ID NO: 3802495 - RNA, 14 nt, Human
cuuucugccucuca

SEQ ID NO: 3802496 - RNA, 12 nt, Human
cuuucugccugg

SEQ ID NO: 3802497 - RNA, 14 nt, Human
cuuucugccuggag

SEQ ID NO: 3802498 - RNA, 15 nt, Human
cuuucugccuggagu

SEQ ID NO: 3802499 - RNA, 17 nt, Human
cuuucugcucagcuucu

SEQ ID NO: 3802500 - RNA, 23 nt, Human
cuuucuggauuauucugggggcu

SEQ ID NO: 3802501 - RNA, 19 nt, Human
cuuucuggcuaugcauuug

SEQ ID NO: 3802502 - RNA, 20 nt, Human
cuuucuggcuaugcauuuga

SEQ ID NO: 3802503 - RNA, 13 nt, Human
cuuucuggcucuc

SEQ ID NO: 3802504 - RNA, 19 nt, Human
cuuucuggggccuaauaaa

SEQ ID NO: 3802505 - RNA, 18 nt, Human
cuuucuguauauacuuuu

SEQ ID NO: 3802506 - RNA, 20 nt, Human
cuuucuguauauacuuuuuu

SEQ ID NO: 3802507 - RNA, 13 nt, Human
cuuucugugcccu

SEQ ID NO: 3802508 - RNA, 21 nt, Human
cuuucugugugcaccuuacca

SEQ ID NO: 3802509 - RNA, 19 nt, Human
cuuucuguguuuauucaaa

SEQ ID NO: 3802510 - RNA, 16 nt, Human
cuuucuguuccaaauu

SEQ ID NO: 3802511 - RNA, 17 nt, Human
cuuuaaaugcugcuuuu

SEQ ID NO: 3802512 - RNA, 19 nt, Human
cuuuaacucaggacuccag

SEQ ID NO: 3802513 - RNA, 20 nt, Human
cuuuaacucaggacuccagc

SEQ ID NO: 3802514 - RNA, 21 nt, Human
cuuuaacucaggacuccagcc

SEQ ID NO: 3802515 - RNA, 17 nt, Human
cuuuaagcagcucuugc

SEQ ID NO: 3802516 - RNA, 19 nt, Human
cuuuaagcagcucuugcua

SEQ ID NO: 3802517 - RNA, 21 nt, Human
cuuuaagcagcucuugcuaau

SEQ ID NO: 3802518 - RNA, 23 nt, Human
cuuuaagggaguguacucccagg

SEQ ID NO: 3802519 - RNA, 19 nt, Human
cuuuaagggcaugccuugu

SEQ ID NO: 3802520 - RNA, 22 nt, Human
cuuuaagggcaugccuugugcu

SEQ ID NO: 3802521 - RNA, 17 nt, Human
cuuuaaguagauaagca

SEQ ID NO: 3802522 - RNA, 17 nt, Human
cuuuaaguuucaggaua

SEQ ID NO: 3802523 - RNA, 19 nt, Human
cuuuaauaucaucaguauu

SEQ ID NO: 3802524 - RNA, 17 nt, Human
cuuuaauaugaaauuuu

SEQ ID NO: 3802525 - RNA, 21 nt, Human
cuuuaauauguauuuuaugua

SEQ ID NO: 3802526 - RNA, 17 nt, Human
cuuuaaucuucaguuuu

SEQ ID NO: 3802527 - RNA, 16 nt, Human
cuuuaaugauaugcuu

SEQ ID NO: 3802528 - RNA, 12 nt, Human
cuuuaaugcauc

SEQ ID NO: 3802529 - RNA, 23 nt, Human
cuuuaaugcaucuagauuaugga

SEQ ID NO: 3802530 - RNA, 20 nt, Human
cuuuaaugucacaggcaggu

SEQ ID NO: 3802531 - RNA, 13 nt, Human
cuuuaauguuuuu

SEQ ID NO: 3802532 - RNA, 18 nt, Human
cuuuaauuaccaaccugu

SEQ ID NO: 3802533 - RNA, 19 nt, Human
cuuuaauuaccaaccuguu

SEQ ID NO: 3802534 - RNA, 15 nt, Human
cuuuaauuccaugaa

SEQ ID NO: 3802535 - RNA, 17 nt, Human
cuuuaauucucauguga

SEQ ID NO: 3802536 - RNA, 23 nt, Human
cuuuaauuguuaagauaugaugu

SEQ ID NO: 3802537 - RNA, 18 nt, Human
cuuuaauuuauuuuugca

SEQ ID NO: 3802538 - RNA, 21 nt, Human
cuuuaauuuauuuuugcaugg

SEQ ID NO: 3802539 - RNA, 22 nt, Human
cuuuaauuuauuuuugcauggc

SEQ ID NO: 3802540 - RNA, 18 nt, Human
cuuuaauuucugucagaa

SEQ ID NO: 3802541 - RNA, 13 nt, Human
cuuuaauuuugga

SEQ ID NO: 3802542 - RNA, 20 nt, Human
cuuuaauuuuuuuaaccaaa

SEQ ID NO: 3802543 - RNA, 21 nt, Human
cuuuaauuuuuuuaaccaaag

SEQ ID NO: 3802544 - RNA, 23 nt, Human
cuuuaauuuuuuuaaccaaaggu

SEQ ID NO: 3802545 - RNA, 13 nt, Human
cuuuacaaaaaga

SEQ ID NO: 3802546 - RNA, 18 nt, Human
cuuuacaaaacaaacuca

SEQ ID NO: 3802547 - RNA, 18 nt, Human
cuuuacaaacaaaagcau

SEQ ID NO: 3802548 - RNA, 20 nt, Human
cuuuacacaauagaauuaua

SEQ ID NO: 3802549 - RNA, 14 nt, Human
cuuuacacacacag

SEQ ID NO: 3802550 - RNA, 22 nt, Human
cuuuacacaucagucacaaguu

SEQ ID NO: 3802551 - RNA, 19 nt, Human
cuuuacacucggcuuugga

SEQ ID NO: 3802552 - RNA, 14 nt, Human
cuuuacaugcaauu

SEQ ID NO: 3802553 - RNA, 16 nt, Human
cuuuaccaaacagcaa

SEQ ID NO: 3802554 - RNA, 20 nt, Human
cuuuaccaauugaaguaaaa

SEQ ID NO: 3802555 - RNA, 15 nt, Human
cuuuacccucaucug

SEQ ID NO: 3802556 - RNA, 19 nt, Human
cuuuacccuugagcccucc

SEQ ID NO: 3802557 - RNA, 22 nt, Human
cuuuacccuugagcccucccca

SEQ ID NO: 3802558 - RNA, 19 nt, Human
cuuuaccuuuuuuauacau

SEQ ID NO: 3802559 - RNA, 22 nt, Human
cuuuaccuuuuuuauacauaaa

SEQ ID NO: 3802560 - RNA, 23 nt, Human
cuuugaauauguaguaucuauau

SEQ ID NO: 3802561 - RNA, 15 nt, Human
cuuugaaugacaaag

SEQ ID NO: 3802562 - RNA, 16 nt, Human
cuuugaaugcggccca

SEQ ID NO: 3802563 - RNA, 23 nt, Human
cuuugaaugcuuuuugaauguua

SEQ ID NO: 3802564 - RNA, 13 nt, Human
cuuugaauguuaa

SEQ ID NO: 3802565 - RNA, 13 nt, Human
cuuugaauuuuca

SEQ ID NO: 3802566 - RNA, 15 nt, Human
cuuugaauuuucauu

SEQ ID NO: 3802567 - RNA, 18 nt, Human
cuuugacaauugggagcu

SEQ ID NO: 3802568 - RNA, 21 nt, Human
cuuugacaauugggagcugcc

SEQ ID NO: 3802569 - RNA, 14 nt, Human
cuuugacacucugc

SEQ ID NO: 3802570 - RNA, 17 nt, Human
cuuugacauuuaauuua

SEQ ID NO: 3802571 - RNA, 21 nt, Human
cuuugaccuaaauuauuuacu

SEQ ID NO: 3802572 - RNA, 17 nt, Human
cuuugaccucugcagca

SEQ ID NO: 3802573 - RNA, 24 nt, Human
cuuugaccucugcagcaauaaagc

SEQ ID NO: 3802574 - RNA, 14 nt, Human
cuuugaccugccuc

SEQ ID NO: 3802575 - RNA, 14 nt, Human
cuuugaccuguugg

SEQ ID NO: 3802576 - RNA, 18 nt, Human
cuuugacgccaucccagc

SEQ ID NO: 3802577 - RNA, 22 nt, Human
cuuugacgccaucccagcccca

SEQ ID NO: 3802578 - RNA, 20 nt, Human
cuuugacucuauaagcaaau

SEQ ID NO: 3802579 - RNA, 16 nt, Human
cuuugacugagcagac

SEQ ID NO: 3802580 - RNA, 21 nt, Human
cuuugacugaugcugagauuc

SEQ ID NO: 3802581 - RNA, 18 nt, Human
cuuugacuggagggucca

SEQ ID NO: 3802582 - RNA, 15 nt, Human
cuuugacuuuuugca

SEQ ID NO: 3802583 - RNA, 15 nt, Human
cuuugagaagccuuc

SEQ ID NO: 3802584 - RNA, 18 nt, Human
cuuugagacaguuucuua

SEQ ID NO: 3802585 - RNA, 23 nt, Human
cuuugagaucuaaaaauaacugu

SEQ ID NO: 3802586 - RNA, 21 nt, Human
cuuugagcccacaaagccuua

SEQ ID NO: 3802587 - RNA, 14 nt, Human
cuuugagcucccac

SEQ ID NO: 3802588 - RNA, 21 nt, Human
cuuugagcuuaaucuuugaaa

SEQ ID NO: 3802589 - RNA, 13 nt, Human
cuuugaggaaacc

SEQ ID NO: 3802590 - RNA, 22 nt, Human
cuuugagggacugccucugcca

SEQ ID NO: 3802591 - RNA, 14 nt, Human
cuuugagguggaag

SEQ ID NO: 3802592 - RNA, 18 nt, Human
cuuugaguuuccucaggc

SEQ ID NO: 3802593 - RNA, 22 nt, Human
cuuugauauauaggacauugau

SEQ ID NO: 3802594 - RNA, 15 nt, Human
cuuugaucagguggg

SEQ ID NO: 3802595 - RNA, 14 nt, Human
cuuugaucaugaau

SEQ ID NO: 3802596 - RNA, 13 nt, Human
cuuugauguguug

SEQ ID NO: 3802597 - RNA, 15 nt, Human
cuuugauguguuguu

SEQ ID NO: 3802598 - RNA, 16 nt, Human
cuuugauguguuguuc

SEQ ID NO: 3802599 - RNA, 15 nt, Human
cuuugauguuaacac

SEQ ID NO: 3802600 - RNA, 17 nt, Human
cuuugauguuaacacau

SEQ ID NO: 3802601 - RNA, 19 nt, Human
cuuugauguuaacacauuu

SEQ ID NO: 3802602 - RNA, 20 nt, Human
cuuugauuauuugcauguua

SEQ ID NO: 3802603 - RNA, 21 nt, Human
cuuugauucacauguuuucaa

SEQ ID NO: 3802604 - RNA, 22 nt, Human
cuuugauucacauguuuucaaa

SEQ ID NO: 3802605 - RNA, 21 nt, Human
cuuugauucauaguaacuucu

SEQ ID NO: 3802606 - RNA, 18 nt, Human
cuuugauucuccuucagc

SEQ ID NO: 3802607 - RNA, 21 nt, Human
cuuugauugcacauuguuguu

SEQ ID NO: 3802608 - RNA, 13 nt, Human
cuuugauuuacag

SEQ ID NO: 3802609 - RNA, 14 nt, Human
cuuugauuuagauu

SEQ ID NO: 3802610 - RNA, 19 nt, Human
cuuugauuuagauugagua

SEQ ID NO: 3802611 - RNA, 12 nt, Human
cuuugauuucca

SEQ ID NO: 3802612 - RNA, 19 nt, Human
cuuugcacacuuuggccca

SEQ ID NO: 3802613 - RNA, 22 nt, Human
cuuugcacacuuuggcccaggg

SEQ ID NO: 3802614 - RNA, 18 nt, Human
cuuugcacagcucuccgg

SEQ ID NO: 3802615 - RNA, 22 nt, Human
cuuugcacgacgcccucucccc

SEQ ID NO: 3802616 - RNA, 22 nt, Human
cuuugcacgugcuguuugcugu

SEQ ID NO: 3802617 - RNA, 13 nt, Human
cuuugcacugagg

SEQ ID NO: 3802618 - RNA, 23 nt, Human
cuuugcacugagggccacacuau

SEQ ID NO: 3802619 - RNA, 16 nt, Human
cuuugcacugauauau

SEQ ID NO: 3802620 - RNA, 20 nt, Human
cuuugcagacaggcaagcac

SEQ ID NO: 3802621 - RNA, 15 nt, Human
cuuugcagggcagcc

SEQ ID NO: 3802622 - RNA, 17 nt, Human
cuuugcagggcagcccc

SEQ ID NO: 3802623 - RNA, 19 nt, Human
cuuugcagggcagccccac

SEQ ID NO: 3802624 - RNA, 21 nt, Human
cuuugcauaugagccgugaac

SEQ ID NO: 3802625 - RNA, 22 nt, Human
cuuugcaucguccccuccccca

SEQ ID NO: 3802626 - RNA, 16 nt, Human
cuuugcaucucaguau

SEQ ID NO: 3802627 - RNA, 15 nt, Human
cuuugcauggauuuc

SEQ ID NO: 3802628 - RNA, 20 nt, Human
cuuugcauugucugucugca

SEQ ID NO: 3802629 - RNA, 15 nt, Human
cuuugcauuuggaau

SEQ ID NO: 3802630 - RNA, 17 nt, Human
cuuugccacccucaugc

SEQ ID NO: 3802631 - RNA, 18 nt, Human
cuuugccacccucaugcu

SEQ ID NO: 3802632 - RNA, 21 nt, Human
cuuugccacccucaugcugug

SEQ ID NO: 3802633 - RNA, 13 nt, Human
cuuugccagcuuu

SEQ ID NO: 3802634 - RNA, 16 nt, Human
cuuugcccaacaccag

SEQ ID NO: 3802635 - RNA, 18 nt, Human
cuuugcccaacaccagcc

SEQ ID NO: 3802636 - RNA, 23 nt, Human
cuuugccccaccuuuauuaaaau

SEQ ID NO: 3802637 - RNA, 19 nt, Human
cuuugcccuucuuucuacc

SEQ ID NO: 3802638 - RNA, 11 nt, Human
cuuugccucaa

SEQ ID NO: 3802639 - RNA, 14 nt, Human
cuuugccuccugug

SEQ ID NO: 3802640 - RNA, 15 nt, Human
cuuugccuguucagu

SEQ ID NO: 3802641 - RNA, 16 nt, Human
cuuugccuguucaguu

SEQ ID NO: 3802642 - RNA, 13 nt, Human
cuuugccuugggc

SEQ ID NO: 3802643 - RNA, 20 nt, Human
cuuugcgcuccuggcccagc

SEQ ID NO: 3802644 - RNA, 21 nt, Human
cuuugcgcuccuggcccagcc

SEQ ID NO: 3802645 - RNA, 18 nt, Human
cuuugcuaaagacaugaa

SEQ ID NO: 3802646 - RNA, 21 nt, Human
cuuugcuauggggacauucca

SEQ ID NO: 3802647 - RNA, 17 nt, Human
cuuugcucauauuuccc

SEQ ID NO: 3802648 - RNA, 19 nt, Human
cuuugcuccaccccacuca

SEQ ID NO: 3802649 - RNA, 17 nt, Human
cuuugcucuucaagaaa

SEQ ID NO: 3802650 - RNA, 14 nt, Human
cuuugcugagagcu

SEQ ID NO: 3802651 - RNA, 13 nt, Human
cuuugcugcuaca

SEQ ID NO: 3802652 - RNA, 11 nt, Human
cuuugcugcug

SEQ ID NO: 3802653 - RNA, 13 nt, Human
cuuugcuguaaga

SEQ ID NO: 3802654 - RNA, 17 nt, Human
cuuugcuguaagauguc

SEQ ID NO: 3802655 - RNA, 22 nt, Human
cuuugcuguaagaugucuguuu

SEQ ID NO: 3802656 - RNA, 20 nt, Human
cuuugcuuaugaauauuuau

SEQ ID NO: 3802657 - RNA, 14 nt, Human
cuuugcuugaaaga

SEQ ID NO: 3802658 - RNA, 15 nt, Human
cuuugcuugaacaca

SEQ ID NO: 3802659 - RNA, 21 nt, Human
cuuugcuugaacacaguauuu

SEQ ID NO: 3802660 - RNA, 22 nt, Human
cuuugcuugaacacaguauuuu

SEQ ID NO: 3802661 - RNA, 23 nt, Human
cuuugcuugaacacaguauuuuc

SEQ ID NO: 3802662 - RNA, 14 nt, Human
cuuugcuugcagua

SEQ ID NO: 3802663 - RNA, 20 nt, Human
cuuugcuugccucucuguuu

SEQ ID NO: 3802664 - RNA, 20 nt, Human
cgguuauaaaaaaugguuca

SEQ ID NO: 3802665 - RNA, 20 nt, Human
cgguucaaggucacuguuuc

SEQ ID NO: 3802666 - RNA, 16 nt, Human
cgguucaccagccucu

SEQ ID NO: 3802667 - RNA, 16 nt, Human
cgguuccuacacagga

SEQ ID NO: 3802668 - RNA, 17 nt, Human
cgguuccuacacaggac

SEQ ID NO: 3802669 - RNA, 12 nt, Human
cgguucuuccag

SEQ ID NO: 3802670 - RNA, 15 nt, Human
cgguuuauauaagcu

SEQ ID NO: 3802671 - RNA, 22 nt, Human
cgguuuaucgcccuggcaggca

SEQ ID NO: 3802672 - RNA, 13 nt, Human
cgguuucuuuuua

SEQ ID NO: 3802673 - RNA, 15 nt, Human
cgguuugaagccugg

SEQ ID NO: 3802674 - RNA, 16 nt, Human
cgguuuuacugcagcu

SEQ ID NO: 3802675 - RNA, 15 nt, Human
cguaaccacggaaaa

SEQ ID NO: 3802676 - RNA, 14 nt, Human
cguaacccaacucu

SEQ ID NO: 3802677 - RNA, 13 nt, Human
cguaaguacagag

SEQ ID NO: 3802678 - RNA, 17 nt, Human
cguaaguacagagaagc

SEQ ID NO: 3802679 - RNA, 21 nt, Human
cguaaguacagagaagccauc

SEQ ID NO: 3802680 - RNA, 16 nt, Human
cguaaguuuaaaggau

SEQ ID NO: 3802681 - RNA, 14 nt, Human
cguaauaauuauua

SEQ ID NO: 3802682 - RNA, 23 nt, Human
cguaauucuuauuccauauuaga

SEQ ID NO: 3802683 - RNA, 12 nt, Human
cguaauuuaacu

SEQ ID NO: 3802684 - RNA, 21 nt, Human
cguacaaguaguucuguauuu

SEQ ID NO: 3802685 - RNA, 13 nt, Human
cguacaguucuuc

SEQ ID NO: 3802686 - RNA, 13 nt, Human
cguaccccacccu

SEQ ID NO: 3802687 - RNA, 17 nt, Human
cguacguaauaagguuu

SEQ ID NO: 3802688 - RNA, 14 nt, Human
cguacuaaggauac

SEQ ID NO: 3802689 - RNA, 14 nt, Human
cguacugcagccuc

SEQ ID NO: 3802690 - RNA, 15 nt, Human
cguacugcagccucc

SEQ ID NO: 3802691 - RNA, 14 nt, Human
cguacuuauaaaga

SEQ ID NO: 3802692 - RNA, 19 nt, Human
cguagaaguuuuuguacug

SEQ ID NO: 3802693 - RNA, 15 nt, Human
cguaggcuacagaga

SEQ ID NO: 3802694 - RNA, 20 nt, Human
cguaggcuacagagaagccu

SEQ ID NO: 3802695 - RNA, 21 nt, Human
cguaggcuacagagaagccuu

SEQ ID NO: 3802696 - RNA, 17 nt, Human
cguaguagggucaggcc

SEQ ID NO: 3802697 - RNA, 21 nt, Human
cguagucggcacagccugguc

SEQ ID NO: 3802698 - RNA, 14 nt, Human
cguaguucccugaa

SEQ ID NO: 3802699 - RNA, 22 nt, Human
cguaguucccugaaaacccaga

SEQ ID NO: 3802700 - RNA, 17 nt, Human
cguauaaaagccuguuu

SEQ ID NO: 3802701 - RNA, 22 nt, Human
cguauaaaagccuguuuaagag

SEQ ID NO: 3802702 - RNA, 16 nt, Human
cguauagcuguauuga

SEQ ID NO: 3802703 - RNA, 18 nt, Human
cguauauauaagaaagac

SEQ ID NO: 3802704 - RNA, 23 nt, Human
cguauauauaagaaagacaucuu

SEQ ID NO: 3802705 - RNA, 17 nt, Human
cuuucagauacuggauu

SEQ ID NO: 3802706 - RNA, 16 nt, Human
cuuucagaugucuucu

SEQ ID NO: 3802707 - RNA, 19 nt, Human
cuuucagaugucuucugcc

SEQ ID NO: 3802708 - RNA, 19 nt, Human
cuuucagcaagauaaacau

SEQ ID NO: 3802709 - RNA, 15 nt, Human
cuuucagcaggcagc

SEQ ID NO: 3802710 - RNA, 12 nt, Human
cuuucagcuguc

SEQ ID NO: 3802711 - RNA, 14 nt, Human
cuuucagcugugaa

SEQ ID NO: 3802712 - RNA, 12 nt, Human
cuuucagguacu

SEQ ID NO: 3802713 - RNA, 20 nt, Human
cuuucaucaaucauuguaca

SEQ ID NO: 3802714 - RNA, 22 nt, Human
cuuucaucaaucauuguacagu

SEQ ID NO: 3802715 - RNA, 16 nt, Human
cuuucaucacacuggg

SEQ ID NO: 3802716 - RNA, 21 nt, Human
cuuucauggggugaugcuggg

SEQ ID NO: 3802717 - RNA, 23 nt, Human
cuuucauuaaaggcuucucucuc

SEQ ID NO: 3802718 - RNA, 18 nt, Human
cuuucauuuacuguggcu

SEQ ID NO: 3802719 - RNA, 15 nt, Human
cuuucauuuugcuuu

SEQ ID NO: 3802720 - RNA, 16 nt, Human
cuuucauuuuuuucca

SEQ ID NO: 3802721 - RNA, 20 nt, Human
cuuucauuuuuuuccaggcu

SEQ ID NO: 3802722 - RNA, 22 nt, Human
cuuucauuuuuuuccaggcugg

SEQ ID NO: 3802723 - RNA, 18 nt, Human
cuuuccaaaauuuuucaa

SEQ ID NO: 3802724 - RNA, 22 nt, Human
cuuuccaaaguacacuguuuca

SEQ ID NO: 3802725 - RNA, 19 nt, Human
cuuuccaaaugcccagcuu

SEQ ID NO: 3802726 - RNA, 16 nt, Human
cuuuccaauucuccuu

SEQ ID NO: 3802727 - RNA, 13 nt, Human
cuuuccacagaag

SEQ ID NO: 3802728 - RNA, 14 nt, Human
cuuuccacccccuc

SEQ ID NO: 3802729 - RNA, 16 nt, Human
cuuuccacccccuccc

SEQ ID NO: 3802730 - RNA, 22 nt, Human
cuuuccacggagccacuccucu

SEQ ID NO: 3802731 - RNA, 18 nt, Human
cuuuccacuccuccuagc

SEQ ID NO: 3802732 - RNA, 12 nt, Human
cuuuccagcuca

SEQ ID NO: 3802733 - RNA, 14 nt, Human
cuuuccaggaaggc

SEQ ID NO: 3802734 - RNA, 22 nt, Human
cuuuccauccauggccagcagc

SEQ ID NO: 3802735 - RNA, 18 nt, Human
cuuuccauuggaucucau

SEQ ID NO: 3802736 - RNA, 15 nt, Human
cuuuccauuucucuc

SEQ ID NO: 3802737 - RNA, 13 nt, Human
cuuucccaacacc

SEQ ID NO: 3802738 - RNA, 19 nt, Human
cuuucccaacacuucagac

SEQ ID NO: 3802739 - RNA, 16 nt, Human
cuuucccaacucuagc

SEQ ID NO: 3802740 - RNA, 15 nt, Human
cuuucccaagccuuc

SEQ ID NO: 3802741 - RNA, 17 nt, Human
cuuucccacccagccug

SEQ ID NO: 3802742 - RNA, 15 nt, Human
cuuucccaccccaac

SEQ ID NO: 3802743 - RNA, 23 nt, Human
cuuucccaccccaaccugcucuc

SEQ ID NO: 3802744 - RNA, 22 nt, Human
cuuucccacccuguucccaguc

SEQ ID NO: 3802745 - RNA, 15 nt, Human
cuuucccagucuguc

SEQ ID NO: 3802746 - RNA, 17 nt, Human
cuuucccagucugucga

SEQ ID NO: 3802747 - RNA, 18 nt, Human
cuuuccccaccagaugcu

SEQ ID NO: 3802748 - RNA, 22 nt, Human
cuuuccccagcaucacucccca

SEQ ID NO: 3802749 - RNA, 20 nt, Human
cuuuccccaugucucgacuc

SEQ ID NO: 3802750 - RNA, 13 nt, Human
cuuuccccugugg

SEQ ID NO: 3802751 - RNA, 17 nt, Human
cuuuccccuuccuuuua

SEQ ID NO: 3802752 - RNA, 18 nt, Human
cuuucccggacugcaagc

SEQ ID NO: 3802753 - RNA, 15 nt, Human
cuuucccuacccucu

SEQ ID NO: 3802754 - RNA, 13 nt, Human
cuuucccucccuu

SEQ ID NO: 3802755 - RNA, 16 nt, Human
cuuucccucccuuccu

SEQ ID NO: 3802756 - RNA, 13 nt, Human
cuuucccugaacu

SEQ ID NO: 3802757 - RNA, 19 nt, Human
cuuucccugcuuaaugaaa

SEQ ID NO: 3802758 - RNA, 15 nt, Human
cuuucccuuaucaaa

SEQ ID NO: 3802759 - RNA, 17 nt, Human
cuuucccuucaguaccc

SEQ ID NO: 3802760 - RNA, 12 nt, Human
cuuucccuucca

SEQ ID NO: 3802761 - RNA, 14 nt, Human
cuuucccuuccucu

SEQ ID NO: 3802762 - RNA, 19 nt, Human
cuuucccuugcuuuucccu

SEQ ID NO: 3802763 - RNA, 21 nt, Human
cuuucccuugcuuuucccucu

SEQ ID NO: 3802764 - RNA, 23 nt, Human
cuuucccuuguagcuccuccccu

SEQ ID NO: 3802765 - RNA, 21 nt, Human
cuuuccgucaacguuguacug

SEQ ID NO: 3802766 - RNA, 19 nt, Human
cuuuccguggcacugcaua

SEQ ID NO: 3802767 - RNA, 16 nt, Human
cuuuccuaagaccugg

SEQ ID NO: 3802768 - RNA, 16 nt, Human
cuuuccuaaggcugca

SEQ ID NO: 3802769 - RNA, 20 nt, Human
cuuuccuaaggcugcaaggu

SEQ ID NO: 3802770 - RNA, 22 nt, Human
cuuuccuacuugcacucuucua

SEQ ID NO: 3802771 - RNA, 18 nt, Human
cuuuccuaucauggagug

SEQ ID NO: 3802772 - RNA, 19 nt, Human
cuuuccucaaaacuucaga

SEQ ID NO: 3802773 - RNA, 13 nt, Human
cuuuccuccucug

SEQ ID NO: 3802774 - RNA, 14 nt, Human
cuuuccuccucuga

SEQ ID NO: 3802775 - RNA, 15 nt, Human
cuuuccuccucugac

SEQ ID NO: 3802776 - RNA, 16 nt, Human
cuuuccuccuggcaga

SEQ ID NO: 3802777 - RNA, 18 nt, Human
cuuuccuccuucacuguu

SEQ ID NO: 3802778 - RNA, 19 nt, Human
cuuuccuccuucacuguuu

SEQ ID NO: 3802779 - RNA, 14 nt, Human
cuuuccuccuucca

SEQ ID NO: 3802780 - RNA, 14 nt, Human
cuuuccucuucccc

SEQ ID NO: 3802781 - RNA, 22 nt, Human
cuuuccugaauccaaacuaauc

SEQ ID NO: 3802782 - RNA, 15 nt, Human
cuuuccugaggcugg

SEQ ID NO: 3802783 - RNA, 18 nt, Human
cuuuccugagucccaucc

SEQ ID NO: 3802784 - RNA, 10 nt, Human
cuuuccugcc

SEQ ID NO: 3802785 - RNA, 13 nt, Human
cuuuccugcccca

SEQ ID NO: 3802786 - RNA, 11 nt, Human
cuuuccugccu

SEQ ID NO: 3802787 - RNA, 23 nt, Human
cuuuccuggacacucagaccuga

SEQ ID NO: 3802788 - RNA, 15 nt, Human
cuuuccugugccagg

SEQ ID NO: 3802789 - RNA, 16 nt, Human
cuuuccuguucagcau

SEQ ID NO: 3802790 - RNA, 13 nt, Human
cuuuccuuccuaa

SEQ ID NO: 3802791 - RNA, 14 nt, Human
cuuuccuuccuaau

SEQ ID NO: 3802792 - RNA, 15 nt, Human
cuuuccuuccuuccc

SEQ ID NO: 3802793 - RNA, 22 nt, Human
cuuuccuuggcucccauucacu

SEQ ID NO: 3802794 - RNA, 17 nt, Human
cuuuccuuggcuuuaug

SEQ ID NO: 3802795 - RNA, 19 nt, Human
cuuuccuuguuccccauca

SEQ ID NO: 3802796 - RNA, 17 nt, Human
cuuuccuuuccccagcc

SEQ ID NO: 3802797 - RNA, 15 nt, Human
cuuuccuuuucuuua

SEQ ID NO: 3802798 - RNA, 21 nt, Human
cuuuccuuuuucccaauaaau

SEQ ID NO: 3802799 - RNA, 14 nt, Human
cuuucgaggccuga

SEQ ID NO: 3802800 - RNA, 20 nt, Human
cuuucgggccauguugcccc

SEQ ID NO: 3802801 - RNA, 15 nt, Human
cuuucguacauuggc

SEQ ID NO: 3802802 - RNA, 14 nt, Human
cuuucgucacccuu

SEQ ID NO: 3802803 - RNA, 18 nt, Human
cuuucuaaacaagauuuu

SEQ ID NO: 3802804 - RNA, 15 nt, Human
cuuucuacaauguga

SEQ ID NO: 3802805 - RNA, 20 nt, Human
cuuucuacagggcugacauu

SEQ ID NO: 3802806 - RNA, 15 nt, Human
cuuucuacccagcga

SEQ ID NO: 3802807 - RNA, 17 nt, Human
cuuucuacccagcgagc

SEQ ID NO: 3802808 - RNA, 17 nt, Human
cuuucuagaccaauaaa

SEQ ID NO: 3802809 - RNA, 15 nt, Human
cuuucuagccagagg

SEQ ID NO: 3802810 - RNA, 19 nt, Human
cuuucuaguggucuuugua

SEQ ID NO: 3802811 - RNA, 23 nt, Human
cuuucuaguggucuuuguaagag

SEQ ID NO: 3802812 - RNA, 17 nt, Human
cuuucuaguucagcugc

SEQ ID NO: 3802813 - RNA, 18 nt, Human
cuuucuaguucagcugcc

SEQ ID NO: 3802814 - RNA, 14 nt, Human
cuuucuaugcugcu

SEQ ID NO: 3802815 - RNA, 15 nt, Human
cuuucuaugcugcuu

SEQ ID NO: 3802816 - RNA, 21 nt, Human
cuuucuaugcugcuuuuauau

SEQ ID NO: 3802817 - RNA, 15 nt, Human
cuuucuauuccaaag

SEQ ID NO: 3802818 - RNA, 15 nt, Human
cuuucuauuguacag

SEQ ID NO: 3802819 - RNA, 13 nt, Human
cuuugcuuucugc

SEQ ID NO: 3802820 - RNA, 16 nt, Human
cuuugcuuucugcuca

SEQ ID NO: 3802821 - RNA, 17 nt, Human
cuuugcuuucugcucag

SEQ ID NO: 3802822 - RNA, 21 nt, Human
cuuuggaaaaugcauuguauc

SEQ ID NO: 3802823 - RNA, 14 nt, Human
cuuuggaaccagac

SEQ ID NO: 3802824 - RNA, 11 nt, Human
cuuuggaagga

SEQ ID NO: 3802825 - RNA, 21 nt, Human
cuuuggacagaagcagcucuu

SEQ ID NO: 3802826 - RNA, 16 nt, Human
cuuuggacccugaggc

SEQ ID NO: 3802827 - RNA, 17 nt, Human
cuuuggacgcacacagc

SEQ ID NO: 3802828 - RNA, 22 nt, Human
cuuuggagaagaguguggaguc

SEQ ID NO: 3802829 - RNA, 15 nt, Human
cuuuggagacuuucu

SEQ ID NO: 3802830 - RNA, 16 nt, Human
cuuuggagaucaagga

SEQ ID NO: 3802831 - RNA, 23 nt, Human
cuuuggagcuuuuuucuuuaaga

SEQ ID NO: 3802832 - RNA, 14 nt, Human
cuuuggaggugcug

SEQ ID NO: 3802833 - RNA, 14 nt, Human
cuuuggaguccccu

SEQ ID NO: 3802834 - RNA, 17 nt, Human
cuuuggaguuaaaaugc

SEQ ID NO: 3802835 - RNA, 14 nt, Human
cuuuggauucuaaa

SEQ ID NO: 3802836 - RNA, 20 nt, Human
cuuuggauucuaaauacaug

SEQ ID NO: 3802837 - RNA, 12 nt, Human
cuuuggcacugg

SEQ ID NO: 3802838 - RNA, 17 nt, Human
cuuuggcacuggggcac

SEQ ID NO: 3802839 - RNA, 24 nt, Human
cuuuggcaggugcagcccccacug

SEQ ID NO: 3802840 - RNA, 13 nt, Human
cuuuggcccaggg

SEQ ID NO: 3802841 - RNA, 13 nt, Human
cuuuggccugagu

SEQ ID NO: 3802842 - RNA, 22 nt, Human
cuuuggccugaugaccaauuuu

SEQ ID NO: 3802843 - RNA, 19 nt, Human
cuuuggcuauuagagauca

SEQ ID NO: 3802844 - RNA, 21 nt, Human
cuuuggcuuaauuccaaucau

SEQ ID NO: 3802845 - RNA, 13 nt, Human
cuuugggaauguu

SEQ ID NO: 3802846 - RNA, 13 nt, Human
cuuugggaggcca

SEQ ID NO: 3802847 - RNA, 20 nt, Human
cuuugggaggccgaggcggg

SEQ ID NO: 3802848 - RNA, 17 nt, Human
cuuugggaggcugaggc

SEQ ID NO: 3802849 - RNA, 17 nt, Human
cuuugggaggcugaggu

SEQ ID NO: 3802850 - RNA, 19 nt, Human
cuuugggauuuaauuucca

SEQ ID NO: 3802851 - RNA, 21 nt, Human
cgugccagucgcgcugccugu

SEQ ID NO: 3802852 - RNA, 16 nt, Human
cgugcccggggcagca

SEQ ID NO: 3802853 - RNA, 13 nt, Human
cgugccuccacca

SEQ ID NO: 3802854 - RNA, 21 nt, Human
cgugccuccaccaccacuggc

SEQ ID NO: 3802855 - RNA, 23 nt, Human
cgugccuccaccaccacuggcca

SEQ ID NO: 3802856 - RNA, 12 nt, Human
cgugccuguguc

SEQ ID NO: 3802857 - RNA, 14 nt, Human
cgugccugugucca

SEQ ID NO: 3802858 - RNA, 15 nt, Human
cgugccuguguccau

SEQ ID NO: 3802859 - RNA, 16 nt, Human
cgugccuucagcucua

SEQ ID NO: 3802860 - RNA, 19 nt, Human
cgugcgcugggcacuuccc

SEQ ID NO: 3802861 - RNA, 17 nt, Human
cgugcuacugcacucca

SEQ ID NO: 3802862 - RNA, 16 nt, Human
cgugcuccagccuggc

SEQ ID NO: 3802863 - RNA, 18 nt, Human
cgugcuccagccuggcuc

SEQ ID NO: 3802864 - RNA, 14 nt, Human
cgugcucuuuguuu

SEQ ID NO: 3802865 - RNA, 16 nt, Human
cgugcucuuuguuuug

SEQ ID NO: 3802866 - RNA, 17 nt, Human
cgugcucuuuguuuugu

SEQ ID NO: 3802867 - RNA, 15 nt, Human
cgugcugggcagccc

SEQ ID NO: 3802868 - RNA, 16 nt, Human
cgugcugggcagcccg

SEQ ID NO: 3802869 - RNA, 21 nt, Human
cguggaaagggugcugcuucc

SEQ ID NO: 3802870 - RNA, 20 nt, Human
cguggaacguuuuuccuguu

SEQ ID NO: 3802871 - RNA, 12 nt, Human
cguggacaccug

SEQ ID NO: 3802872 - RNA, 13 nt, Human
cguggacaccugc

SEQ ID NO: 3802873 - RNA, 15 nt, Human
cguggacaccugccc

SEQ ID NO: 3802874 - RNA, 16 nt, Human
cguggacaggugugcc

SEQ ID NO: 3802875 - RNA, 14 nt, Human
cguggaccuuccug

SEQ ID NO: 3802876 - RNA, 17 nt, Human
cguggaccuuccugcca

SEQ ID NO: 3802877 - RNA, 19 nt, Human
cguggacugagugggaagc

SEQ ID NO: 3802878 - RNA, 13 nt, Human
cguggagagggau

SEQ ID NO: 3802879 - RNA, 17 nt, Human
cguggagcagaaucagu

SEQ ID NO: 3802880 - RNA, 16 nt, Human
cguggagccagggagc

SEQ ID NO: 3802881 - RNA, 21 nt, Human
cguggagcgggguaugaagag

SEQ ID NO: 3802882 - RNA, 14 nt, Human
cguggagcugccug

SEQ ID NO: 3802883 - RNA, 18 nt, Human
cguggaggaaugcucccc

SEQ ID NO: 3802884 - RNA, 22 nt, Human
cguggaggagcagugcaggcac

SEQ ID NO: 3802885 - RNA, 13 nt, Human
cguggaggagguu

SEQ ID NO: 3802886 - RNA, 19 nt, Human
cguggaggagguugggagg

SEQ ID NO: 3802887 - RNA, 14 nt, Human
cguggaggcugcuc

SEQ ID NO: 3802888 - RNA, 15 nt, Human
cguggaggcugcucg

SEQ ID NO: 3802889 - RNA, 16 nt, Human
cguggagggaggcccc

SEQ ID NO: 3802890 - RNA, 19 nt, Human
cguggagggaggccccagg

SEQ ID NO: 3802891 - RNA, 20 nt, Human
cguggagggguaggggcugg

SEQ ID NO: 3802892 - RNA, 21 nt, Human
cguggagggguaggggcuggg

SEQ ID NO: 3802893 - RNA, 20 nt, Human
cguggauuaaacuuaugaau

SEQ ID NO: 3802894 - RNA, 15 nt, Human
cguggcaaauauaaa

SEQ ID NO: 3802895 - RNA, 15 nt, Human
cguggcaccuccucg

SEQ ID NO: 3802896 - RNA, 21 nt, Human
cguggcagauaaucagccucu

SEQ ID NO: 3802897 - RNA, 23 nt, Human
cguggcauagcccagacacagaa

SEQ ID NO: 3802898 - RNA, 13 nt, Human
cguggccagcccg

SEQ ID NO: 3802899 - RNA, 19 nt, Human
cguggcccaaggcuggcag

SEQ ID NO: 3802900 - RNA, 14 nt, Human
cguggccccagccu

SEQ ID NO: 3802901 - RNA, 19 nt, Human
cguggccccagccuggccc

SEQ ID NO: 3802902 - RNA, 22 nt, Human
cguggccccagccuggcccagc

SEQ ID NO: 3802903 - RNA, 18 nt, Human
cguggcccugcccucucc

SEQ ID NO: 3802904 - RNA, 14 nt, Human
cguggcccuuccug

SEQ ID NO: 3802905 - RNA, 17 nt, Human
cguggcccuuccuggac

SEQ ID NO: 3802906 - RNA, 20 nt, Human
cguggcucgacuauagaaaa

SEQ ID NO: 3802907 - RNA, 13 nt, Human
cguggcucugcug

SEQ ID NO: 3802908 - RNA, 21 nt, Human
cguggcugcccacacacccca

SEQ ID NO: 3802909 - RNA, 23 nt, Human
cguggcugugcucucaccagcug

SEQ ID NO: 3802910 - RNA, 14 nt, Human
cguggcuucugaug

SEQ ID NO: 3802911 - RNA, 14 nt, Human
cgugggagccagcc

SEQ ID NO: 3802912 - RNA, 17 nt, Human
cgugggagcgugggagg

SEQ ID NO: 3802913 - RNA, 20 nt, Human
cgugggaggcgggaguggag

SEQ ID NO: 3802914 - RNA, 16 nt, Human
cgugggauucagagaa

SEQ ID NO: 3802915 - RNA, 22 nt, Human
cgugggcugggcccacaaaggc

SEQ ID NO: 3802916 - RNA, 23 nt, Human
cguggggagggccguaccccacc

SEQ ID NO: 3802917 - RNA, 18 nt, Human
cguggggcagcacagaga

SEQ ID NO: 3802918 - RNA, 15 nt, Human
cguggggugugcugg

SEQ ID NO: 3802919 - RNA, 19 nt, Human
cgugggucuguuuuccuuu

SEQ ID NO: 3802920 - RNA, 16 nt, Human
cgugguaugucugcca

SEQ ID NO: 3802921 - RNA, 17 nt, Human
cgugguaugucugccau

SEQ ID NO: 3802922 - RNA, 17 nt, Human
cguggucacugcuguca

SEQ ID NO: 3802923 - RNA, 21 nt, Human
cgugguccccaacagcgacau

SEQ ID NO: 3802924 - RNA, 14 nt, Human
cguggucuuuuccu

SEQ ID NO: 3802925 - RNA, 13 nt, Human
cgugguggucccu

SEQ ID NO: 3802926 - RNA, 20 nt, Human
cguguacauagugcauuguu

SEQ ID NO: 3802927 - RNA, 22 nt, Human
cguguagcuauggaaguugcau

SEQ ID NO: 3802928 - RNA, 18 nt, Human
cguguaggaaccugcaca

SEQ ID NO: 3802929 - RNA, 17 nt, Human
cguguauugagauuucu

SEQ ID NO: 3802930 - RNA, 22 nt, Human
cguguauugagauuucuuaaau

SEQ ID NO: 3802931 - RNA, 15 nt, Human
cgugucaaugugugc

SEQ ID NO: 3802932 - RNA, 14 nt, Human
cguguccaccccca

SEQ ID NO: 3802933 - RNA, 16 nt, Human
cguguccccugacagg

SEQ ID NO: 3802934 - RNA, 21 nt, Human
cgugucuggcacagccuggcu

SEQ ID NO: 3802935 - RNA, 14 nt, Human
cgugucuuccacuu

SEQ ID NO: 3802936 - RNA, 15 nt, Human
cgugugagugugaca

SEQ ID NO: 3802937 - RNA, 17 nt, Human
cgugugagugugacagg

SEQ ID NO: 3802938 - RNA, 21 nt, Human
cgugugagugugacagggcca

SEQ ID NO: 3802939 - RNA, 13 nt, Human
cgugugcaggagc

SEQ ID NO: 3802940 - RNA, 22 nt, Human
cguguggcaauagugggcccuc

SEQ ID NO: 3802941 - RNA, 19 nt, Human
cguguguacacgggacuga

SEQ ID NO: 3802942 - RNA, 12 nt, Human
cguguguagagu

SEQ ID NO: 3802943 - RNA, 17 nt, Human
cguguguccaugugugu

SEQ ID NO: 3802944 - RNA, 22 nt, Human
cgugugugcaagugucugugug

SEQ ID NO: 3802945 - RNA, 12 nt, Human
cgugugugugcg

SEQ ID NO: 3802946 - RNA, 22 nt, Human
cgugugugugugugugugugca

SEQ ID NO: 3802947 - RNA, 17 nt, Human
cguguguuuuucuauua

SEQ ID NO: 3802948 - RNA, 18 nt, Human
cguguguuuuucuauuaa

SEQ ID NO: 3802949 - RNA, 15 nt, Human
cguguucaauauuuu

SEQ ID NO: 3802950 - RNA, 13 nt, Human
cguguuccccucu

SEQ ID NO: 3802951 - RNA, 18 nt, Human
cguguuccccucuugucu

SEQ ID NO: 3802952 - RNA, 15 nt, Human
cguguugccuugaac

SEQ ID NO: 3802953 - RNA, 15 nt, Human
cguguuucugacucu

SEQ ID NO: 3802954 - RNA, 20 nt, Human
cguguuucugacucugagcu

SEQ ID NO: 3802955 - RNA, 21 nt, Human
cguguuuggguuuuuuuccuu

SEQ ID NO: 3802956 - RNA, 12 nt, Human
cguguuuguguu

SEQ ID NO: 3802957 - RNA, 21 nt, Human
cguuaaaaacagauuuggaaa

SEQ ID NO: 3802958 - RNA, 22 nt, Human
cguuaacauugaccaagaacug

SEQ ID NO: 3802959 - RNA, 14 nt, Human
cguuacagcucccc

SEQ ID NO: 3802960 - RNA, 21 nt, Human
cguuacuagcagucacuugau

SEQ ID NO: 3802961 - RNA, 21 nt, Human
cguuacucagggcuccuccca

SEQ ID NO: 3802962 - RNA, 14 nt, Human
cguuagcuccugug

SEQ ID NO: 3802963 - RNA, 14 nt, Human
cguuagggaagaga

SEQ ID NO: 3802964 - RNA, 22 nt, Human
cguuauguguguauauguaugu

SEQ ID NO: 3802965 - RNA, 15 nt, Human
cguucaccccuccac

SEQ ID NO: 3802966 - RNA, 22 nt, Human
cguucauggaacgcguugaaau

SEQ ID NO: 3802967 - RNA, 12 nt, Human
cguuccacaguu

SEQ ID NO: 3802968 - RNA, 17 nt, Human
cguuccacaguugccac

SEQ ID NO: 3802969 - RNA, 10 nt, Human
cguuccagcc

SEQ ID NO: 3802970 - RNA, 20 nt, Human
cguuccaugaugcugggauu

SEQ ID NO: 3802971 - RNA, 19 nt, Human
cguuccugacaucacagca

SEQ ID NO: 3802972 - RNA, 18 nt, Human
cguucucacacccaccgu

SEQ ID NO: 3802973 - RNA, 13 nt, Human
cguucucucuuug

SEQ ID NO: 3802974 - RNA, 17 nt, Human
cuuucuauuugacuugu

SEQ ID NO: 3802975 - RNA, 20 nt, Human
cuuucucaaagaaauauuaa

SEQ ID NO: 3802976 - RNA, 21 nt, Human
cuuucucagccgcuucugacu

SEQ ID NO: 3802977 - RNA, 15 nt, Human
cuuucucaguuuuca

SEQ ID NO: 3802978 - RNA, 13 nt, Human
cuuucuccagcca

SEQ ID NO: 3802979 - RNA, 16 nt, Human
cuuucuccagccagca

SEQ ID NO: 3802980 - RNA, 14 nt, Human
cuuucuccaggacc

SEQ ID NO: 3802981 - RNA, 15 nt, Human
cuuucuccaggacca

SEQ ID NO: 3802982 - RNA, 20 nt, Human
cuuucucccaggccaggcuc

SEQ ID NO: 3802983 - RNA, 23 nt, Human
cuuucuccccugcccccaggacu

SEQ ID NO: 3802984 - RNA, 15 nt, Human
cuuucuccuuagucu

SEQ ID NO: 3802985 - RNA, 18 nt, Human
cuuucuccuuuaauugua

SEQ ID NO: 3802986 - RNA, 19 nt, Human
cuuucucgauuuuaucuuu

SEQ ID NO: 3802987 - RNA, 14 nt, Human
cuuucucuaauaau

SEQ ID NO: 3802988 - RNA, 18 nt, Human
cuuucucuaauaauaaau

SEQ ID NO: 3802989 - RNA, 16 nt, Human
cuuucucuacuuugag

SEQ ID NO: 3802990 - RNA, 13 nt, Human
cuuucucucccca

SEQ ID NO: 3802991 - RNA, 17 nt, Human
cuuucucuccccaaccc

SEQ ID NO: 3802992 - RNA, 15 nt, Human
cuuucucuccuuucu

SEQ ID NO: 3802993 - RNA, 13 nt, Human
cuuucucugccag

SEQ ID NO: 3802994 - RNA, 14 nt, Human
cuuucucugccagu

SEQ ID NO: 3802995 - RNA, 21 nt, Human
cuuucucuuucccuggucccu

SEQ ID NO: 3802996 - RNA, 21 nt, Human
gaaacacacugaggcagggaa

SEQ ID NO: 3802997 - RNA, 12 nt, Human
gaaacacagcug

SEQ ID NO: 3802998 - RNA, 13 nt, Human
gaaacacagcugu

SEQ ID NO: 3802999 - RNA, 14 nt, Human
gaaacacagcuguu

SEQ ID NO: 3803000 - RNA, 16 nt, Human
gaaacaccaaaaaaau

SEQ ID NO: 3803001 - RNA, 23 nt, Human
gaaacaccaaaaaaauccagaaa

SEQ ID NO: 3803002 - RNA, 15 nt, Human
gaaacacuaaauguu

SEQ ID NO: 3803003 - RNA, 16 nt, Human
gaaacacuaaauguua

SEQ ID NO: 3803004 - RNA, 19 nt, Human
gaaacacuaaauguuaaag

SEQ ID NO: 3803005 - RNA, 14 nt, Human
gaaacacuccuugc

SEQ ID NO: 3803006 - RNA, 17 nt, Human
gaaacacugacuccugu

SEQ ID NO: 3803007 - RNA, 22 nt, Human
gaaacacugggcuucuagaacc

SEQ ID NO: 3803008 - RNA, 14 nt, Human
gaaacacuuucucu

SEQ ID NO: 3803009 - RNA, 16 nt, Human
gaaacacuuugcauaa

SEQ ID NO: 3803010 - RNA, 19 nt, Human
gaaacacuuugccuccugu

SEQ ID NO: 3803011 - RNA, 22 nt, Human
gaaacagaaaaauauguaccaa

SEQ ID NO: 3803012 - RNA, 22 nt, Human
gaaacagaaacaaaaacacuaa

SEQ ID NO: 3803013 - RNA, 21 nt, Human
gaaacagaggaccagcacacu

SEQ ID NO: 3803014 - RNA, 14 nt, Human
gaaacagauaccau

SEQ ID NO: 3803015 - RNA, 21 nt, Human
gaaacagauaccauacucauu

SEQ ID NO: 3803016 - RNA, 18 nt, Human
gaaacagaugaaaagccu

SEQ ID NO: 3803017 - RNA, 12 nt, Human
gaaacagccagc

SEQ ID NO: 3803018 - RNA, 18 nt, Human
gaaacagcuaaugggaca

SEQ ID NO: 3803019 - RNA, 15 nt, Human
gaaacagcucgacuu

SEQ ID NO: 3803020 - RNA, 20 nt, Human
gaaacagcucgacuuuaaaa

SEQ ID NO: 3803021 - RNA, 14 nt, Human
gaaacagcugccuu

SEQ ID NO: 3803022 - RNA, 19 nt, Human
gaaacagcugccuuagcuu

SEQ ID NO: 3803023 - RNA, 15 nt, Human
gaaacagcuuucaag

SEQ ID NO: 3803024 - RNA, 18 nt, Human
cuuuuauugacacagaaa

SEQ ID NO: 3803025 - RNA, 16 nt, Human
cuuuuauuguauaaac

SEQ ID NO: 3803026 - RNA, 21 nt, Human
cuuuuauuguauaaacuauca

SEQ ID NO: 3803027 - RNA, 21 nt, Human
cuuuuauuuuacacagaaaca

SEQ ID NO: 3803028 - RNA, 22 nt, Human
cuuuuauuuuacacagaaacac

SEQ ID NO: 3803029 - RNA, 13 nt, Human
cuuuuauuuugaa

SEQ ID NO: 3803030 - RNA, 14 nt, Human
cuuuuauuuugaaa

SEQ ID NO: 3803031 - RNA, 15 nt, Human
cuuuucaaaacauuu

SEQ ID NO: 3803032 - RNA, 22 nt, Human
cuuuucaaauagggucuaacuc

SEQ ID NO: 3803033 - RNA, 23 nt, Human
cuuuucaacuuggcuuccuuucu

SEQ ID NO: 3803034 - RNA, 13 nt, Human
cuuuucaaggcuu

SEQ ID NO: 3803035 - RNA, 17 nt, Human
cuuuucaaguauuuaag

SEQ ID NO: 3803036 - RNA, 13 nt, Human
cuuuucacauucu

SEQ ID NO: 3803037 - RNA, 14 nt, Human
cuuuucacauucuu

SEQ ID NO: 3803038 - RNA, 19 nt, Human
cuuuucacauucuuauaaa

SEQ ID NO: 3803039 - RNA, 15 nt, Human
cuuuucaccauucgu

SEQ ID NO: 3803040 - RNA, 16 nt, Human
cuuuucacccuucuac

SEQ ID NO: 3803041 - RNA, 17 nt, Human
cuuuucacccuucuacu

SEQ ID NO: 3803042 - RNA, 16 nt, Human
cuuuucacugcuggcu

SEQ ID NO: 3803043 - RNA, 17 nt, Human
cuuuucacugcuggcug

SEQ ID NO: 3803044 - RNA, 20 nt, Human
cuuuucacugcuguuauauu

SEQ ID NO: 3803045 - RNA, 16 nt, Human
cuuuucagauugugga

SEQ ID NO: 3803046 - RNA, 14 nt, Human
cuuuucagcuucug

SEQ ID NO: 3803047 - RNA, 23 nt, Human
cuuuucagcuucugcugggcugg

SEQ ID NO: 3803048 - RNA, 13 nt, Human
cuuuucagggcug

SEQ ID NO: 3803049 - RNA, 20 nt, Human
cuuuucagggcuggcuccug

SEQ ID NO: 3803050 - RNA, 23 nt, Human
cuuuucagggcuggcuccugauc

SEQ ID NO: 3803051 - RNA, 21 nt, Human
cuuuucagguuugucaucaga

SEQ ID NO: 3803052 - RNA, 20 nt, Human
cuuuucauaaccuagccuua

SEQ ID NO: 3803053 - RNA, 16 nt, Human
cuuuucauaucauuuc

SEQ ID NO: 3803054 - RNA, 17 nt, Human
cuuuucauauuugcacu

SEQ ID NO: 3803055 - RNA, 13 nt, Human
cuuuucaugcaaa

SEQ ID NO: 3803056 - RNA, 14 nt, Human
cuuuucauugcugu

SEQ ID NO: 3803057 - RNA, 13 nt, Human
cuuuucauuugug

SEQ ID NO: 3803058 - RNA, 19 nt, Human
cuuuuccacuccauugucg

SEQ ID NO: 3803059 - RNA, 16 nt, Human
cuuuuccauuaugcug

SEQ ID NO: 3803060 - RNA, 22 nt, Human
cuuuucccaaagcaucccucuu

SEQ ID NO: 3803061 - RNA, 17 nt, Human
cuuuucccacuccaagc

SEQ ID NO: 3803062 - RNA, 18 nt, Human
cuuuucccacuguuuaag

SEQ ID NO: 3803063 - RNA, 21 nt, Human
cuuuucccauuuaucuaaaua

SEQ ID NO: 3803064 - RNA, 17 nt, Human
cuuuucccauuuguaau

SEQ ID NO: 3803065 - RNA, 19 nt, Human
cuuuucccauuuguaauuu

SEQ ID NO: 3803066 - RNA, 17 nt, Human
cuuuucccccaaagugg

SEQ ID NO: 3803067 - RNA, 15 nt, Human
cuuuuccccuuuccu

SEQ ID NO: 3803068 - RNA, 16 nt, Human
cuuuuccccuuuccug

SEQ ID NO: 3803069 - RNA, 20 nt, Human
cuuuucccucuuuggcuccc

SEQ ID NO: 3803070 - RNA, 15 nt, Human
cuuuucccucuuuuc

SEQ ID NO: 3803071 - RNA, 13 nt, Human
cuuuucccugcuu

SEQ ID NO: 3803072 - RNA, 20 nt, Human
cuuuucccugcuuccaggaa

SEQ ID NO: 3803073 - RNA, 18 nt, Human
cuuuucccuguacuuuuc

SEQ ID NO: 3803074 - RNA, 21 nt, Human
cuuuuccuacuuuuccuuccc

SEQ ID NO: 3803075 - RNA, 22 nt, Human
cuuuuccuacuuuuccuucccu

SEQ ID NO: 3803076 - RNA, 23 nt, Human
cuuuuccucccuuggguucugau

SEQ ID NO: 3803077 - RNA, 16 nt, Human
cuuuuccuguuguauu

SEQ ID NO: 3803078 - RNA, 18 nt, Human
cuuuuccuguuuuuguua

SEQ ID NO: 3803079 - RNA, 20 nt, Human
cuuuuccuucccucaaagcu

SEQ ID NO: 3803080 - RNA, 16 nt, Human
cuuuuccuucccuuuu

SEQ ID NO: 3803081 - RNA, 20 nt, Human
cuuuuccuugcauacaaaca

SEQ ID NO: 3803082 - RNA, 13 nt, Human
cuuuuccuuggca

SEQ ID NO: 3803083 - RNA, 13 nt, Human
cuuuuccuugggg

SEQ ID NO: 3803084 - RNA, 17 nt, Human
cuuuuccuuggggcagg

SEQ ID NO: 3803085 - RNA, 16 nt, Human
cuuuuccuuugugguu

SEQ ID NO: 3803086 - RNA, 11 nt, Human
cuuuucguuaa

SEQ ID NO: 3803087 - RNA, 20 nt, Human
cuuuucguuaacauugacca

SEQ ID NO: 3803088 - RNA, 21 nt, Human
cuuuucuaaccaagaggcugg

SEQ ID NO: 3803089 - RNA, 18 nt, Human
cuuuucuacccuagccau

SEQ ID NO: 3803090 - RNA, 21 nt, Human
cuuuucuauuccuucuggccu

SEQ ID NO: 3803091 - RNA, 13 nt, Human
cuuuucucagcug

SEQ ID NO: 3803092 - RNA, 15 nt, Human
cuuuucuccaugagu

SEQ ID NO: 3803093 - RNA, 17 nt, Human
cuuuucucugguaauau

SEQ ID NO: 3803094 - RNA, 14 nt, Human
cuuuucucuuucuc

SEQ ID NO: 3803095 - RNA, 16 nt, Human
cuuuucugaccaaaga

SEQ ID NO: 3803096 - RNA, 11 nt, Human
cuuuucugauc

SEQ ID NO: 3803097 - RNA, 14 nt, Human
cuuuucugauccag

SEQ ID NO: 3803098 - RNA, 18 nt, Human
cuuuucugauccaguuuu

SEQ ID NO: 3803099 - RNA, 13 nt, Human
cuuuucugcauuu

SEQ ID NO: 3803100 - RNA, 20 nt, Human
cuuuucugcauuuugcuauu

SEQ ID NO: 3803101 - RNA, 19 nt, Human
cuuuucuggccaaaagcag

SEQ ID NO: 3803102 - RNA, 21 nt, Human
cuuuucuggggaaagacacug

SEQ ID NO: 3803103 - RNA, 23 nt, Human
cuuuucuguccgagcuuugaaaa

SEQ ID NO: 3803104 - RNA, 18 nt, Human
cuuuucugucucucucuu

SEQ ID NO: 3803105 - RNA, 13 nt, Human
cuuuucuguguuu

SEQ ID NO: 3803106 - RNA, 18 nt, Human
cuuuucuguguuuacaga

SEQ ID NO: 3803107 - RNA, 22 nt, Human
cuuuucuguguuuacagagaug

SEQ ID NO: 3803108 - RNA, 16 nt, Human
cuuuucuguucuaguu

SEQ ID NO: 3803109 - RNA, 15 nt, Human
cuuuucuguuugcua

SEQ ID NO: 3803110 - RNA, 18 nt, Human
cuuuucuuaacaaccugg

SEQ ID NO: 3803111 - RNA, 19 nt, Human
cuuuucuuaacaaccuggc

SEQ ID NO: 3803112 - RNA, 14 nt, Human
cuuuucuuacuccu

SEQ ID NO: 3803113 - RNA, 15 nt, Human
cuuuucuuacuccuc

SEQ ID NO: 3803114 - RNA, 11 nt, Human
cuuuucuuauu

SEQ ID NO: 3803115 - RNA, 15 nt, Human
cuuuucuuccuggcu

SEQ ID NO: 3803116 - RNA, 23 nt, Human
cuuuucuugcaugaggcuagugu

SEQ ID NO: 3803117 - RNA, 13 nt, Human
cuuuucuuggaca

SEQ ID NO: 3803118 - RNA, 20 nt, Human
cuuuucuuggacacuuaauu

SEQ ID NO: 3803119 - RNA, 12 nt, Human
cuuuucuuggca

SEQ ID NO: 3803120 - RNA, 19 nt, Human
cuuuucuuguuuaucagca

SEQ ID NO: 3803121 - RNA, 17 nt, Human
cuuuucuuuagagaacu

SEQ ID NO: 3803122 - RNA, 22 nt, Human
cuuuucuuuagagaacugaaaa

SEQ ID NO: 3803123 - RNA, 16 nt, Human
cuuuucuuucagccaa

SEQ ID NO: 3803124 - RNA, 17 nt, Human
cuuuucuuugccaucuc

SEQ ID NO: 3803125 - RNA, 22 nt, Human
cuuuucuuugccaucucugcuc

SEQ ID NO: 3803126 - RNA, 14 nt, Human
cuuuucuuuuguua

SEQ ID NO: 3803127 - RNA, 16 nt, Human
cuuuucuuuuguuacu

SEQ ID NO: 3803128 - RNA, 18 nt, Human
cuuuucuuuuguuacugu

SEQ ID NO: 3803129 - RNA, 19 nt, Human
cuuuucuuuuguuacuguu

SEQ ID NO: 3803130 - RNA, 20 nt, Human
cuuuucuuuuguuacuguuc

SEQ ID NO: 3803131 - RNA, 16 nt, Human
cuuuucuuuuuacaua

SEQ ID NO: 3803132 - RNA, 23 nt, Human
cuuuucuuuuuacauaacugccu

SEQ ID NO: 3803133 - RNA, 14 nt, Human
cuuuucuuuuucuc

SEQ ID NO: 3803134 - RNA, 13 nt, Human
cuuuugaaacaau

SEQ ID NO: 3803135 - RNA, 14 nt, Human
cuuuugaacccagg

SEQ ID NO: 3803136 - RNA, 20 nt, Human
cuuuugaacccaggaguuca

SEQ ID NO: 3803137 - RNA, 21 nt, Human
cuuuugaagcauagauaauau

SEQ ID NO: 3803138 - RNA, 13 nt, Human
cuuuugaauauuc

SEQ ID NO: 3803139 - RNA, 23 nt, Human
cuuuugaauccaugcuugggugu

SEQ ID NO: 3803140 - RNA, 14 nt, Human
cuuuugaauuguua

SEQ ID NO: 3803141 - RNA, 18 nt, Human
gaaagacaccauuuaucu

SEQ ID NO: 3803142 - RNA, 15 nt, Human
gaaagacacugccug

SEQ ID NO: 3803143 - RNA, 18 nt, Human
gaaagacacugccugggc

SEQ ID NO: 3803144 - RNA, 20 nt, Human
gaaagacacugccugggcug

SEQ ID NO: 3803145 - RNA, 14 nt, Human
gaaagacagagcug

SEQ ID NO: 3803146 - RNA, 22 nt, Human
gaaagacauccauaaagaagca

SEQ ID NO: 3803147 - RNA, 17 nt, Human
gaaagacaucuuucucu

SEQ ID NO: 3803148 - RNA, 16 nt, Human
gaaagaccauuuuucc

SEQ ID NO: 3803149 - RNA, 18 nt, Human
gaaagacuaucuaaaugu

SEQ ID NO: 3803150 - RNA, 19 nt, Human
gaaagacuauucaaacagu

SEQ ID NO: 3803151 - RNA, 17 nt, Human
gaaagacugaagaaagu

SEQ ID NO: 3803152 - RNA, 19 nt, Human
gaaagacugaagaaagugu

SEQ ID NO: 3803153 - RNA, 14 nt, Human
gaaagacugagcuc

SEQ ID NO: 3803154 - RNA, 14 nt, Human
gaaagacuuccaaa

SEQ ID NO: 3803155 - RNA, 19 nt, Human
gaaagacuuuuccaacccu

SEQ ID NO: 3803156 - RNA, 14 nt, Human
gaaagagaaggugg

SEQ ID NO: 3803157 - RNA, 11 nt, Human
gaaagagagaa

SEQ ID NO: 3803158 - RNA, 15 nt, Human
gaaagagagaaaaua

SEQ ID NO: 3803159 - RNA, 17 nt, Human
gaaagagagaaaauaaa

SEQ ID NO: 3803160 - RNA, 18 nt, Human
gaaagagagaaaauaaaa

SEQ ID NO: 3803161 - RNA, 17 nt, Human
gaaagagagagaaacaa

SEQ ID NO: 3803162 - RNA, 18 nt, Human
gaaagagcacuuaagaga

SEQ ID NO: 3803163 - RNA, 16 nt, Human
gaaagaggaaaagaaa

SEQ ID NO: 3803164 - RNA, 20 nt, Human
gaaagaggcagcuugaaacu

SEQ ID NO: 3803165 - RNA, 22 nt, Human
gaaagaggguaauaaccagaca

SEQ ID NO: 3803166 - RNA, 20 nt, Human
gaaagaggugaccccagggc

SEQ ID NO: 3803167 - RNA, 15 nt, Human
gaaagaguaggaaga

SEQ ID NO: 3803168 - RNA, 17 nt, Human
gaaagaguccauuguuu

SEQ ID NO: 3803169 - RNA, 14 nt, Human
gaaagauaacuagg

SEQ ID NO: 3803170 - RNA, 12 nt, Human
gaaagauuugua

SEQ ID NO: 3803171 - RNA, 14 nt, Human
gaaagcaaaaaugc

SEQ ID NO: 3803172 - RNA, 17 nt, Human
gaaagcaaaaaugcuaa

SEQ ID NO: 3803173 - RNA, 18 nt, Human
gaaagcaaaaaugcuaau

SEQ ID NO: 3803174 - RNA, 15 nt, Human
gaaagcaaagcacag

SEQ ID NO: 3803175 - RNA, 20 nt, Human
gaaagcacagaggccuccug

SEQ ID NO: 3803176 - RNA, 15 nt, Human
gaaagcacagguggg

SEQ ID NO: 3803177 - RNA, 17 nt, Human
gaaagcagaacagugau

SEQ ID NO: 3803178 - RNA, 22 nt, Human
gaaagcagaacagugauuacca

SEQ ID NO: 3803179 - RNA, 18 nt, Human
cuaaugaagggaaaggau

SEQ ID NO: 3803180 - RNA, 13 nt, Human
cuaaugagacuga

SEQ ID NO: 3803181 - RNA, 17 nt, Human
cuaaugaggagagaaaa

SEQ ID NO: 3803182 - RNA, 20 nt, Human
cuaaugaggagagaaaauau

SEQ ID NO: 3803183 - RNA, 23 nt, Human
cuaaugaggagagaaaauauaug

SEQ ID NO: 3803184 - RNA, 23 nt, Human
cuaaugauggcccauucuacuug

SEQ ID NO: 3803185 - RNA, 12 nt, Human
cuaaugauguuu

SEQ ID NO: 3803186 - RNA, 16 nt, Human
cuaaugccucuucauu

SEQ ID NO: 3803187 - RNA, 15 nt, Human
cuaaugcgcaggcug

SEQ ID NO: 3803188 - RNA, 16 nt, Human
cuaaugcgcaggcugg

SEQ ID NO: 3803189 - RNA, 19 nt, Human
cuaaugcgcaggcuggccc

SEQ ID NO: 3803190 - RNA, 20 nt, Human
cuaaugcgcaggcuggcccu

SEQ ID NO: 3803191 - RNA, 14 nt, Human
cuaauggcaugaga

SEQ ID NO: 3803192 - RNA, 12 nt, Human
cuaaugggacac

SEQ ID NO: 3803193 - RNA, 19 nt, Human
cuaauggguauuuaaacaa

SEQ ID NO: 3803194 - RNA, 17 nt, Human
cuaauguauuuuauugu

SEQ ID NO: 3803195 - RNA, 18 nt, Human
cuaauguauuuuauugua

SEQ ID NO: 3803196 - RNA, 20 nt, Human
cuaauguauuuuauuguaac

SEQ ID NO: 3803197 - RNA, 13 nt, Human
cuaaugucuucau

SEQ ID NO: 3803198 - RNA, 16 nt, Human
cuaaugucuucauaaa

SEQ ID NO: 3803199 - RNA, 19 nt, Human
cuaaugugccuaguucuuu

SEQ ID NO: 3803200 - RNA, 23 nt, Human
cuaauguggaccuuagaauacag

SEQ ID NO: 3803201 - RNA, 19 nt, Human
cuaaugugguuauuucucu

SEQ ID NO: 3803202 - RNA, 15 nt, Human
cuaauguuugcauau

SEQ ID NO: 3803203 - RNA, 14 nt, Human
cuaauuaacauaua

SEQ ID NO: 3803204 - RNA, 17 nt, Human
cuaauuaacauauaaua

SEQ ID NO: 3803205 - RNA, 23 nt, Human
cuaauuaauauauuaaaauucca

SEQ ID NO: 3803206 - RNA, 13 nt, Human
cuaauuaauuuca

SEQ ID NO: 3803207 - RNA, 16 nt, Human
cuaauuauacuacuuu

SEQ ID NO: 3803208 - RNA, 18 nt, Human
cuaauuauacuacuuugu

SEQ ID NO: 3803209 - RNA, 13 nt, Human
cuaauuauuuuaa

SEQ ID NO: 3803210 - RNA, 16 nt, Human
cuaauucaaggaauuu

SEQ ID NO: 3803211 - RNA, 20 nt, Human
cuaauucaaggaauuucuua

SEQ ID NO: 3803212 - RNA, 15 nt, Human
cuaauucaauucaaa

SEQ ID NO: 3803213 - RNA, 19 nt, Human
cuaauucagccauguacag

SEQ ID NO: 3803214 - RNA, 20 nt, Human
cuaauucccauuuugcaaaa

SEQ ID NO: 3803215 - RNA, 14 nt, Human
cuaauuccccagau

SEQ ID NO: 3803216 - RNA, 15 nt, Human
cuaauuccuuucuau

SEQ ID NO: 3803217 - RNA, 15 nt, Human
cuaauucuuuaauga

SEQ ID NO: 3803218 - RNA, 21 nt, Human
cuaauucuuugaccuguuggg

SEQ ID NO: 3803219 - RNA, 22 nt, Human
cuaauucuuugaccuguuggga

SEQ ID NO: 3803220 - RNA, 12 nt, Human
cuaauucuuugc

SEQ ID NO: 3803221 - RNA, 14 nt, Human
cuaauucuuugcaa

SEQ ID NO: 3803222 - RNA, 16 nt, Human
cuaauucuuugcaaaa

SEQ ID NO: 3803223 - RNA, 19 nt, Human
cuaauugcuguugaaagca

SEQ ID NO: 3803224 - RNA, 11 nt, Human
cuaauugcuua

SEQ ID NO: 3803225 - RNA, 13 nt, Human
cuaauugcuuauu

SEQ ID NO: 3803226 - RNA, 14 nt, Human
cuaauugcuuauuu

SEQ ID NO: 3803227 - RNA, 19 nt, Human
cuaauuggccucuuuaaga

SEQ ID NO: 3803228 - RNA, 15 nt, Human
cuaauugguacuuuu

SEQ ID NO: 3803229 - RNA, 15 nt, Human
cuaauuguauaacag

SEQ ID NO: 3803230 - RNA, 20 nt, Human
cuaauuguauaacagguuau

SEQ ID NO: 3803231 - RNA, 22 nt, Human
cuaauuguauaacagguuauuu

SEQ ID NO: 3803232 - RNA, 14 nt, Human
cuaauuuauaaaaa

SEQ ID NO: 3803233 - RNA, 21 nt, Human
cuaauuucaaaaauauaacuu

SEQ ID NO: 3803234 - RNA, 17 nt, Human
cuaauuucaaaaugcuu

SEQ ID NO: 3803235 - RNA, 18 nt, Human
cuaauuucuccucccuuc

SEQ ID NO: 3803236 - RNA, 21 nt, Human
cuaauuugcauuaaauucaca

SEQ ID NO: 3803237 - RNA, 22 nt, Human
cuaauuuuuaagaauugaguaa

SEQ ID NO: 3803238 - RNA, 11 nt, Human
cuaauuuuugu

SEQ ID NO: 3803239 - RNA, 20 nt, Human
cuaauuuuuguauuuuucgu

SEQ ID NO: 3803240 - RNA, 21 nt, Human
cuaauuuuuuuguauuuuagc

SEQ ID NO: 3803241 - RNA, 15 nt, Human
cuacaaaaacacagc

SEQ ID NO: 3803242 - RNA, 18 nt, Human
cuacaaaaacacagcaag

SEQ ID NO: 3803243 - RNA, 22 nt, Human
cuacaaaaccuacccucaguga

SEQ ID NO: 3803244 - RNA, 18 nt, Human
cuacaaaacgcgcagaug

SEQ ID NO: 3803245 - RNA, 21 nt, Human
cuacaaacaaaauuucuauua

SEQ ID NO: 3803246 - RNA, 15 nt, Human
cuacaaagaagacau

SEQ ID NO: 3803247 - RNA, 18 nt, Human
cuacaaagguuuaaauga

SEQ ID NO: 3803248 - RNA, 19 nt, Human
cuacaaagguuuaaaugaa

SEQ ID NO: 3803249 - RNA, 20 nt, Human
cuacaaagguuuaaaugaac

SEQ ID NO: 3803250 - RNA, 15 nt, Human
cuacaaaucaguaau

SEQ ID NO: 3803251 - RNA, 16 nt, Human
cuacaacaagaguuua

SEQ ID NO: 3803252 - RNA, 12 nt, Human
cuacaacagccu

SEQ ID NO: 3803253 - RNA, 16 nt, Human
cuacaaccuccgccuc

SEQ ID NO: 3803254 - RNA, 14 nt, Human
cuacaacugagucc

SEQ ID NO: 3803255 - RNA, 19 nt, Human
cuacaagagcagccugugg

SEQ ID NO: 3803256 - RNA, 15 nt, Human
cuacaagauuuagaa

SEQ ID NO: 3803257 - RNA, 14 nt, Human
cuacaauauguaca

SEQ ID NO: 3803258 - RNA, 21 nt, Human
cuacaauauguacauuucuaa

SEQ ID NO: 3803259 - RNA, 21 nt, Human
cuacaaucucuuuuuguuugc

SEQ ID NO: 3803260 - RNA, 17 nt, Human
cuacaaugugaacuuua

SEQ ID NO: 3803261 - RNA, 19 nt, Human
cuacaaugugaacuuuauu

SEQ ID NO: 3803262 - RNA, 21 nt, Human
cuacaauuaauaguuugucua

SEQ ID NO: 3803263 - RNA, 16 nt, Human
cuacaauuuucuccca

SEQ ID NO: 3803264 - RNA, 12 nt, Human
cuacacacccug

SEQ ID NO: 3803265 - RNA, 22 nt, Human
cuacacacugucaugcuucauc

SEQ ID NO: 3803266 - RNA, 22 nt, Human
cuacacaggacagggguuccuu

SEQ ID NO: 3803267 - RNA, 23 nt, Human
cuacacagucugcaagauucuga

SEQ ID NO: 3803268 - RNA, 17 nt, Human
cuacacauuuuuaaauu

SEQ ID NO: 3803269 - RNA, 12 nt, Human
cuacaccacaca

SEQ ID NO: 3803270 - RNA, 16 nt, Human
cuacaccacucuggca

SEQ ID NO: 3803271 - RNA, 13 nt, Human
cuacacccagcaa

SEQ ID NO: 3803272 - RNA, 22 nt, Human
cuacaccccuccccugcccuag

SEQ ID NO: 3803273 - RNA, 17 nt, Human
cuacaccuauuauccca

SEQ ID NO: 3803274 - RNA, 13 nt, Human
cuacaccuugagg

SEQ ID NO: 3803275 - RNA, 20 nt, Human
cuacaccuuucuccuuugua

SEQ ID NO: 3803276 - RNA, 14 nt, Human
cuacacuaagagag

SEQ ID NO: 3803277 - RNA, 15 nt, Human
cuacacucaccugca

SEQ ID NO: 3803278 - RNA, 14 nt, Human
cuacacuccagccu

SEQ ID NO: 3803279 - RNA, 15 nt, Human
cuacacucuccuggg

SEQ ID NO: 3803280 - RNA, 16 nt, Human
cuacacucuccugggc

SEQ ID NO: 3803281 - RNA, 14 nt, Human
cuacacugggugcu

SEQ ID NO: 3803282 - RNA, 22 nt, Human
cuacacuguauuacauaaauaa

SEQ ID NO: 3803283 - RNA, 14 nt, Human
cuacacugugcuga

SEQ ID NO: 3803284 - RNA, 17 nt, Human
cuacacugugcugaguc

SEQ ID NO: 3803285 - RNA, 18 nt, Human
cuacacugugcugagucu

SEQ ID NO: 3803286 - RNA, 16 nt, Human
cuuuuuuauacauaaa

SEQ ID NO: 3803287 - RNA, 21 nt, Human
cuuuuuuauggcgauucccau

SEQ ID NO: 3803288 - RNA, 13 nt, Human
cuuuuuuauuaau

SEQ ID NO: 3803289 - RNA, 15 nt, Human
cuuuuuuauuaauca

SEQ ID NO: 3803290 - RNA, 13 nt, Human
cuuuuuuccuccu

SEQ ID NO: 3803291 - RNA, 19 nt, Human
cuuuuuuccuuuccaccuu

SEQ ID NO: 3803292 - RNA, 22 nt, Human
cuuuuuucucugauacagaaaa

SEQ ID NO: 3803293 - RNA, 13 nt, Human
cuuuuuucugccu

SEQ ID NO: 3803294 - RNA, 20 nt, Human
cuuuuuugaaauaauaaauc

SEQ ID NO: 3803295 - RNA, 16 nt, Human
cuuuuuuggccaucug

SEQ ID NO: 3803296 - RNA, 14 nt, Human
cuuuuuuggcugcu

SEQ ID NO: 3803297 - RNA, 20 nt, Human
cuuuuuuggggauaugcuua

SEQ ID NO: 3803298 - RNA, 19 nt, Human
cuuuuuugucccccaacuu

SEQ ID NO: 3803299 - RNA, 22 nt, Human
cuuuuuugucccccaacuugag

SEQ ID NO: 3803300 - RNA, 13 nt, Human
cuuuuuuguuuug

SEQ ID NO: 3803301 - RNA, 15 nt, Human
cuuuuuuucuacugu

SEQ ID NO: 3803302 - RNA, 18 nt, Human
cuuuuuuucuauauuauu

SEQ ID NO: 3803303 - RNA, 17 nt, Human
cuuuuuuucucuagagu

SEQ ID NO: 3803304 - RNA, 19 nt, Human
cuuuuuuucuguaccaguu

SEQ ID NO: 3803305 - RNA, 20 nt, Human
cuuuuuuucuguaccaguua

SEQ ID NO: 3803306 - RNA, 21 nt, Human
cuuuuuuuggugauucaaaug

SEQ ID NO: 3803307 - RNA, 12 nt, Human
cuuuuuuuguau

SEQ ID NO: 3803308 - RNA, 18 nt, Human
cuuuuuuuuaaugugcug

SEQ ID NO: 3803309 - RNA, 21 nt, Human
cuuuuuuuuccccccuagaaa

SEQ ID NO: 3803310 - RNA, 15 nt, Human
cuuuuuuuuguaugu

SEQ ID NO: 3803311 - RNA, 18 nt, Human
cuuuuuuuuuaaguucuu

SEQ ID NO: 3803312 - RNA, 15 nt, Human
cuuuuuuuuuccaaa

SEQ ID NO: 3803313 - RNA, 17 nt, Human
cuuuuuuuuucucuuuc

SEQ ID NO: 3803314 - RNA, 22 nt, Human
cuuuuuuuuucucuuucucucc

SEQ ID NO: 3803315 - RNA, 14 nt, Human
cuuuuuuuuuucuu

SEQ ID NO: 3803316 - RNA, 16 nt, Human
cuuuuuuuuuucuugg

SEQ ID NO: 3803317 - RNA, 23 nt, Human
cuuuuuuuuuucuuuauaagaaa

SEQ ID NO: 3803318 - RNA, 23 nt, Human
cuuuuuuuuuuuguuugaugcag

SEQ ID NO: 3803319 - RNA, 15 nt, Human
cuuuuuuuuuuuucc

SEQ ID NO: 3803320 - RNA, 21 nt, Human
cuuuuuuuuuuuuuaauaaau

SEQ ID NO: 3803321 - RNA, 18 nt, Human
cuuuuuuuuuuuuuuggu

SEQ ID NO: 3803322 - RNA, 21 nt, Human
cuuuuuuuuuuuuuuugacaa

SEQ ID NO: 3803323 - RNA, 19 nt, Human
gaaaaaaaaaaagaaagaa

SEQ ID NO: 3803324 - RNA, 18 nt, Human
gaaaaaaaaaagaagaag

SEQ ID NO: 3803325 - RNA, 13 nt, Human
gaaaaaaaaagaa

SEQ ID NO: 3803326 - RNA, 17 nt, Human
gaaaaaaaaagaaaaaa

SEQ ID NO: 3803327 - RNA, 21 nt, Human
gaaaaaaaaagucagacugcu

SEQ ID NO: 3803328 - RNA, 22 nt, Human
gaaaaaaaaaugccauaauaca

SEQ ID NO: 3803329 - RNA, 16 nt, Human
gaaaaaaaacagugga

SEQ ID NO: 3803330 - RNA, 18 nt, Human
gaaaaaaaaccugagauu

SEQ ID NO: 3803331 - RNA, 15 nt, Human
gaaaaaaaagaaagc

SEQ ID NO: 3803332 - RNA, 22 nt, Human
gaaaaaaaaguuucagagaagu

SEQ ID NO: 3803333 - RNA, 18 nt, Human
gaaaaaaaccacacaaag

SEQ ID NO: 3803334 - RNA, 23 nt, Human
gaaaaaaacuuuuauaaauuaaa

SEQ ID NO: 3803335 - RNA, 20 nt, Human
gaaagcagauaccucacccu

SEQ ID NO: 3803336 - RNA, 19 nt, Human
gaaagcaggggcuacaaga

SEQ ID NO: 3803337 - RNA, 23 nt, Human
gaaagcaggggcuacaagaggga

SEQ ID NO: 3803338 - RNA, 18 nt, Human
gaaagcauaaagcucaaa

SEQ ID NO: 3803339 - RNA, 18 nt, Human
gaaagcauauugacuuuu

SEQ ID NO: 3803340 - RNA, 18 nt, Human
gaaagcaucaccucaggc

SEQ ID NO: 3803341 - RNA, 19 nt, Human
gaaagcaucaccucaggcc

SEQ ID NO: 3803342 - RNA, 15 nt, Human
gaaagcauccaugug

SEQ ID NO: 3803343 - RNA, 21 nt, Human
gaaagcauguggcauguucau

SEQ ID NO: 3803344 - RNA, 15 nt, Human
gaaagcauuugaaug

SEQ ID NO: 3803345 - RNA, 16 nt, Human
gaaagcauuugaaugc

SEQ ID NO: 3803346 - RNA, 20 nt, Human
gaaagcauuugaaugcauuu

SEQ ID NO: 3803347 - RNA, 23 nt, Human
gaaagccaaggagucacugagac

SEQ ID NO: 3803348 - RNA, 15 nt, Human
gaaagccaccucucc

SEQ ID NO: 3803349 - RNA, 18 nt, Human
gaaagccaccucucccuc

SEQ ID NO: 3803350 - RNA, 14 nt, Human
gaaagccaggcagg

SEQ ID NO: 3803351 - RNA, 19 nt, Human
gaaagccagucuuaacauu

SEQ ID NO: 3803352 - RNA, 20 nt, Human
gaaagccagugacuccagga

SEQ ID NO: 3803353 - RNA, 13 nt, Human
gaaagccccaccc

SEQ ID NO: 3803354 - RNA, 18 nt, Human
gaaagccccacccaggcc

SEQ ID NO: 3803355 - RNA, 21 nt, Human
gaaagccccacccaggccagg

SEQ ID NO: 3803356 - RNA, 18 nt, Human
gaaagccuguuccccuca

SEQ ID NO: 3803357 - RNA, 18 nt, Human
gaaagccuuaagcugcag

SEQ ID NO: 3803358 - RNA, 22 nt, Human
gaaagcgccuccaacccuagca

SEQ ID NO: 3803359 - RNA, 20 nt, Human
gaaagcgcggacgugcuggg

SEQ ID NO: 3803360 - RNA, 16 nt, Human
gaaagcuagagauaug

SEQ ID NO: 3803361 - RNA, 17 nt, Human
gaaagcucacuguagcu

SEQ ID NO: 3803362 - RNA, 22 nt, Human
gaaagcuccucgagggcaggga

SEQ ID NO: 3803363 - RNA, 13 nt, Human
gaaagcucuagaa

SEQ ID NO: 3803364 - RNA, 20 nt, Human
gaaagcugacuuggcuggug

SEQ ID NO: 3803365 - RNA, 21 nt, Human
gaaagcugagaacuccugacu

SEQ ID NO: 3803366 - RNA, 23 nt, Human
gaaagcugauuacugucaauaaa

SEQ ID NO: 3803367 - RNA, 21 nt, Human
gaaagcugcugugaucccagu

SEQ ID NO: 3803368 - RNA, 19 nt, Human
gaaagcugguggcagaguc

SEQ ID NO: 3803369 - RNA, 20 nt, Human
gaaagcuguguuuauaugga

SEQ ID NO: 3803370 - RNA, 21 nt, Human
gaaagcuugcccuggugccuc

SEQ ID NO: 3803371 - RNA, 23 nt, Human
gaaagcuuugaauacuaaauuau

SEQ ID NO: 3803372 - RNA, 15 nt, Human
gaaagcuuuggcagu

SEQ ID NO: 3803373 - RNA, 21 nt, Human
gaaagcuuuguugaaagaaag

SEQ ID NO: 3803374 - RNA, 11 nt, Human
gaaaggaaaga

SEQ ID NO: 3803375 - RNA, 19 nt, Human
gaaaggacacuagaagauu

SEQ ID NO: 3803376 - RNA, 13 nt, Human
gaaaggagacuag

SEQ ID NO: 3803377 - RNA, 17 nt, Human
gaaaggaggcaugccuc

SEQ ID NO: 3803378 - RNA, 15 nt, Human
gaaaggagguggggg

SEQ ID NO: 3803379 - RNA, 15 nt, Human
gaaaggaguagaaaa

SEQ ID NO: 3803380 - RNA, 16 nt, Human
gaaaggaguagaaaaa

SEQ ID NO: 3803381 - RNA, 14 nt, Human
gaaaggauauuuaa

SEQ ID NO: 3803382 - RNA, 17 nt, Human
gaaaggauuucucuuua

SEQ ID NO: 3803383 - RNA, 17 nt, Human
gaaaggcauucucugaa

SEQ ID NO: 3803384 - RNA, 15 nt, Human
gaaaggccagcacuc

SEQ ID NO: 3803385 - RNA, 16 nt, Human
gaaaggccagcuggca

SEQ ID NO: 3803386 - RNA, 19 nt, Human
gaaaggccagcuggcagca

SEQ ID NO: 3803387 - RNA, 14 nt, Human
gaaaggcucagucu

SEQ ID NO: 3803388 - RNA, 12 nt, Human
gaaaggcuccag

SEQ ID NO: 3803389 - RNA, 13 nt, Human
gaaaggcuccagg

SEQ ID NO: 3803390 - RNA, 15 nt, Human
gaaaggcuccaggag

SEQ ID NO: 3803391 - RNA, 16 nt, Human
gaaaggcuccaggagc

SEQ ID NO: 3803392 - RNA, 17 nt, Human
gaaaggcuccaggagca

SEQ ID NO: 3803393 - RNA, 19 nt, Human
gaaaggcuccaggagcagc

SEQ ID NO: 3803394 - RNA, 19 nt, Human
gaaaggcucugaaagccag

SEQ ID NO: 3803395 - RNA, 23 nt, Human
gaaaggcugcuguacugaaguaa

SEQ ID NO: 3803396 - RNA, 22 nt, Human
gaaaggcuguuaaauacaggaa

SEQ ID NO: 3803397 - RNA, 19 nt, Human
gaaagggacuuggaagcuc

SEQ ID NO: 3803398 - RNA, 17 nt, Human
gaaagggagcagagaag

SEQ ID NO: 3803399 - RNA, 14 nt, Human
gaaagggagggcuc

SEQ ID NO: 3803400 - RNA, 15 nt, Human
gaaagggagggcucu

SEQ ID NO: 3803401 - RNA, 17 nt, Human
gaaagggagggcucuga

SEQ ID NO: 3803402 - RNA, 19 nt, Human
gaaagggagggcucugagg

SEQ ID NO: 3803403 - RNA, 13 nt, Human
gaaagggccagga

SEQ ID NO: 3803404 - RNA, 18 nt, Human
gaaagggccaggagaugg

SEQ ID NO: 3803405 - RNA, 16 nt, Human
gaaagggcccagagag

SEQ ID NO: 3803406 - RNA, 20 nt, Human
gaaaggggagagccugcugg

SEQ ID NO: 3803407 - RNA, 16 nt, Human
gaaagggggucccagu

SEQ ID NO: 3803408 - RNA, 22 nt, Human
gaaagggggucccagugggagg

SEQ ID NO: 3803409 - RNA, 14 nt, Human
gaaaggggugcuuu

SEQ ID NO: 3803410 - RNA, 15 nt, Human
gaaaggggugcuuuu

SEQ ID NO: 3803411 - RNA, 19 nt, Human
gaaagggugcugcuucccu

SEQ ID NO: 3803412 - RNA, 18 nt, Human
gaaagguacuauauuugc

SEQ ID NO: 3803413 - RNA, 14 nt, Human
gaaaggucaccuca

SEQ ID NO: 3803414 - RNA, 20 nt, Human
gaaaggucaccucacucagc

SEQ ID NO: 3803415 - RNA, 14 nt, Human
gaaaggugguguuu

SEQ ID NO: 3803416 - RNA, 13 nt, Human
gaaagguucugcc

SEQ ID NO: 3803417 - RNA, 14 nt, Human
gaaagguuuacauu

SEQ ID NO: 3803418 - RNA, 13 nt, Human
gaaagguuuugga

SEQ ID NO: 3803419 - RNA, 13 nt, Human
gaaagguuuuuuu

SEQ ID NO: 3803420 - RNA, 16 nt, Human
gaaaguaauuucuucu

SEQ ID NO: 3803421 - RNA, 17 nt, Human
gaaaguacacucugcug

SEQ ID NO: 3803422 - RNA, 19 nt, Human
gaaaguacacucugcuguu

SEQ ID NO: 3803423 - RNA, 20 nt, Human
gaaaguacauuuuuugaaau

SEQ ID NO: 3803424 - RNA, 21 nt, Human
gaaaguacuucuccacccugc

SEQ ID NO: 3803425 - RNA, 16 nt, Human
gaaaguagaacuuacu

SEQ ID NO: 3803426 - RNA, 21 nt, Human
gaaagucagaaucagaagaua

SEQ ID NO: 3803427 - RNA, 20 nt, Human
gaaagucagaugcccagagg

SEQ ID NO: 3803428 - RNA, 20 nt, Human
gaaagucagccauaucucca

SEQ ID NO: 3803429 - RNA, 21 nt, Human
gaaagucauuggcuuuauccu

SEQ ID NO: 3803430 - RNA, 23 nt, Human
gaaaggugccauggaagaggcua

SEQ ID NO: 3803431 - RNA, 16 nt, Human
gaaaggugguguuucu

SEQ ID NO: 3803432 - RNA, 18 nt, Human
gaaagguuacccuguaac

SEQ ID NO: 3803433 - RNA, 20 nt, Human
gaaagguuagagaauaaauu

SEQ ID NO: 3803434 - RNA, 14 nt, Human
gaaagguucugccc

SEQ ID NO: 3803435 - RNA, 19 nt, Human
gaaaguaaauaaaaggacu

SEQ ID NO: 3803436 - RNA, 15 nt, Human
gaaaguaauuucuuc

SEQ ID NO: 3803437 - RNA, 19 nt, Human
gaaaguaauuucuucucaa

SEQ ID NO: 3803438 - RNA, 13 nt, Human
gaaaguacauuuu

SEQ ID NO: 3803439 - RNA, 10 nt, Human
gaaagucaga

SEQ ID NO: 3803440 - RNA, 19 nt, Human
gaaagucagauucuugcau

SEQ ID NO: 3803441 - RNA, 14 nt, Human
gaaagucauuggcu

SEQ ID NO: 3803442 - RNA, 17 nt, Human
gaaagucauuggcuuua

SEQ ID NO: 3803443 - RNA, 21 nt, Human
gaaagucuaucuaaugacaug

SEQ ID NO: 3803444 - RNA, 18 nt, Human
gaaagugaauaaacuuca

SEQ ID NO: 3803445 - RNA, 20 nt, Human
gaaagugaauaaacuucagc

SEQ ID NO: 3803446 - RNA, 13 nt, Human
gaaagugaauuug

SEQ ID NO: 3803447 - RNA, 19 nt, Human
gaaagugaauuugaaugaa

SEQ ID NO: 3803448 - RNA, 23 nt, Human
gaaagugaauuugaaugaaaaau

SEQ ID NO: 3803449 - RNA, 16 nt, Human
gaaagugagcaguguu

SEQ ID NO: 3803450 - RNA, 20 nt, Human
gaaagugaggaaauaaaguu

SEQ ID NO: 3803451 - RNA, 21 nt, Human
gaaagugauaucccccagccu

SEQ ID NO: 3803452 - RNA, 15 nt, Human
gaaagugaugacaua

SEQ ID NO: 3803453 - RNA, 13 nt, Human
gaaagugcauuuu

SEQ ID NO: 3803454 - RNA, 20 nt, Human
gaaagugcauuuuuguaaau

SEQ ID NO: 3803455 - RNA, 16 nt, Human
gaaagugccagaaagu

SEQ ID NO: 3803456 - RNA, 21 nt, Human
gaaagugccuuucaggaucua

SEQ ID NO: 3803457 - RNA, 18 nt, Human
gaaaguggugcucaguug

SEQ ID NO: 3803458 - RNA, 20 nt, Human
gaaaguggugcucaguugua

SEQ ID NO: 3803459 - RNA, 16 nt, Human
gaaaguguaaagcauu

SEQ ID NO: 3803460 - RNA, 15 nt, Human
gaaaguguucuguua

SEQ ID NO: 3803461 - RNA, 21 nt, Human
gaaaguguucuguuacaaaau

SEQ ID NO: 3803462 - RNA, 17 nt, Human
gaaaguuaacauuaaug

SEQ ID NO: 3803463 - RNA, 23 nt, Human
gaaaguuauugauaaguucauac

SEQ ID NO: 3803464 - RNA, 13 nt, Human
gaaaguucaugcu

SEQ ID NO: 3803465 - RNA, 17 nt, Human
gaaaguugcaaggcaaa

SEQ ID NO: 3803466 - RNA, 21 nt, Human
gaaaguugcaaggcaaauguu

SEQ ID NO: 3803467 - RNA, 19 nt, Human
gaaaguugcacggcugcug

SEQ ID NO: 3803468 - RNA, 22 nt, Human
gaaaguuuggggacaugugauu

SEQ ID NO: 3803469 - RNA, 22 nt, Human
gaaaguuuucagaaccucuucc

SEQ ID NO: 3803470 - RNA, 13 nt, Human
gaaaguuuuguaa

SEQ ID NO: 3803471 - RNA, 16 nt, Human
gaaauaaaaaagucuc

SEQ ID NO: 3803472 - RNA, 14 nt, Human
gaaauaaaaagagu

SEQ ID NO: 3803473 - RNA, 18 nt, Human
gaaauaaaaccuuucaaa

SEQ ID NO: 3803474 - RNA, 19 nt, Human
gaaauaaaagugaaugaaa

SEQ ID NO: 3803475 - RNA, 22 nt, Human
gaaauaaaccuuaauauuucuu

SEQ ID NO: 3803476 - RNA, 14 nt, Human
gaaauaaacgucuu

SEQ ID NO: 3803477 - RNA, 20 nt, Human
gaaauaaaggaugugauugu

SEQ ID NO: 3803478 - RNA, 19 nt, Human
gaaauaaaguuaaguuugu

SEQ ID NO: 3803479 - RNA, 15 nt, Human
gaaauaaauagcuau

SEQ ID NO: 3803480 - RNA, 21 nt, Human
gaaauaaauguaucauagaaa

SEQ ID NO: 3803481 - RNA, 17 nt, Human
gaaauaacaaaauggac

SEQ ID NO: 3803482 - RNA, 18 nt, Human
gaaauaacaauguuaagg

SEQ ID NO: 3803483 - RNA, 17 nt, Human
gaaauaacacagcaguu

SEQ ID NO: 3803484 - RNA, 22 nt, Human
gaaauaacagaagaaaauagaa

SEQ ID NO: 3803485 - RNA, 22 nt, Human
gaaauaacuccuucuuguagua

SEQ ID NO: 3803486 - RNA, 16 nt, Human
gaaauaagaaaaauca

SEQ ID NO: 3803487 - RNA, 18 nt, Human
gaaauaagaaaaaucaug

SEQ ID NO: 3803488 - RNA, 19 nt, Human
gaaauaagcuauuugaugu

SEQ ID NO: 3803489 - RNA, 23 nt, Human
gaaauaagcuauuugauguaaua

SEQ ID NO: 3803490 - RNA, 20 nt, Human
gaaauaagugcccucuccca

SEQ ID NO: 3803491 - RNA, 11 nt, Human
gaaauaauaaa

SEQ ID NO: 3803492 - RNA, 20 nt, Human
gaaauaauaaaaaauuucag

SEQ ID NO: 3803493 - RNA, 14 nt, Human
gaaauaauaaaucu

SEQ ID NO: 3803494 - RNA, 19 nt, Human
gaaauaaugcuacaauuuu

SEQ ID NO: 3803495 - RNA, 23 nt, Human
gaaauaaugcuacaauuuuaaga

SEQ ID NO: 3803496 - RNA, 12 nt, Human
gaaauaaugugu

SEQ ID NO: 3803497 - RNA, 13 nt, Human
gaaauaaugugua

SEQ ID NO: 3803498 - RNA, 20 nt, Human
gaaauaauuguuguucuguu

SEQ ID NO: 3803499 - RNA, 18 nt, Human
gaaauacaaaaauacuca

SEQ ID NO: 3803500 - RNA, 19 nt, Human
gaaauacacaaguaaacau

SEQ ID NO: 3803501 - RNA, 17 nt, Human
gaaauacagacuggaug

SEQ ID NO: 3803502 - RNA, 19 nt, Human
gaaauacagauaaaugauu

SEQ ID NO: 3803503 - RNA, 22 nt, Human
gaaauacagauaaaugauucaa

SEQ ID NO: 3803504 - RNA, 22 nt, Human
gaaauacagauuuugauagcaa

SEQ ID NO: 3803505 - RNA, 16 nt, Human
gaaauacagucuucca

SEQ ID NO: 3803506 - RNA, 17 nt, Human
gaaauacaguucugcuc

SEQ ID NO: 3803507 - RNA, 21 nt, Human
gaaauacccuucuuuuaugag

SEQ ID NO: 3803508 - RNA, 11 nt, Human
gaaauaccuca

SEQ ID NO: 3803509 - RNA, 17 nt, Human
gaaauaccucauguuua

SEQ ID NO: 3803510 - RNA, 21 nt, Human
gaaauacuacuuaccauaugu

SEQ ID NO: 3803511 - RNA, 15 nt, Human
gaaauacuguuugag

SEQ ID NO: 3803512 - RNA, 19 nt, Human
gaaauacuguuugagguuu

SEQ ID NO: 3803513 - RNA, 19 nt, Human
gaaauagaaaaacccugcc

SEQ ID NO: 3803514 - RNA, 23 nt, Human
gaaauagaaaaacccugccccca

SEQ ID NO: 3803515 - RNA, 20 nt, Human
gaaauagaaauuuccagaga

SEQ ID NO: 3803516 - RNA, 20 nt, Human
gaaauagcuccguggagcag

SEQ ID NO: 3803517 - RNA, 18 nt, Human
gaaauagcuuaugaaaag

SEQ ID NO: 3803518 - RNA, 14 nt, Human
gaaauaggaaacaa

SEQ ID NO: 3803519 - RNA, 15 nt, Human
gaaauaggaaacaag

SEQ ID NO: 3803520 - RNA, 18 nt, Human
gaaauaggaaacaaguga

SEQ ID NO: 3803521 - RNA, 20 nt, Human
gaaauaggagggaaaccuuu

SEQ ID NO: 3803522 - RNA, 19 nt, Human
gaaauagucauuugugaau

SEQ ID NO: 3803523 - RNA, 20 nt, Human
gaaauagucauuugugaauu

SEQ ID NO: 3803524 - RNA, 22 nt, Human
gaaauaguguggaaauuaagaa

SEQ ID NO: 3803525 - RNA, 18 nt, Human
gaaauaguucaaagccaa

SEQ ID NO: 3803526 - RNA, 22 nt, Human
gaacucauuccugccugucucc

SEQ ID NO: 3803527 - RNA, 15 nt, Human
gaacucccuuucaac

SEQ ID NO: 3803528 - RNA, 23 nt, Human
gaacuccuaaaccuuugccccug

SEQ ID NO: 3803529 - RNA, 13 nt, Human
gaacuccuggccu

SEQ ID NO: 3803530 - RNA, 14 nt, Human
gaacuccugggcuc

SEQ ID NO: 3803531 - RNA, 14 nt, Human
gaacuccuuggccu

SEQ ID NO: 3803532 - RNA, 15 nt, Human
gaacuccuuggccua

SEQ ID NO: 3803533 - RNA, 17 nt, Human
gaacucgguguccccac

SEQ ID NO: 3803534 - RNA, 20 nt, Human
gaacucgguguccccaccau

SEQ ID NO: 3803535 - RNA, 20 nt, Human
gaacucuaucugggccuggg

SEQ ID NO: 3803536 - RNA, 11 nt, Human
gaacucugaca

SEQ ID NO: 3803537 - RNA, 14 nt, Human
gaacucugacaagg

SEQ ID NO: 3803538 - RNA, 19 nt, Human
gaacucugacaagggcuga

SEQ ID NO: 3803539 - RNA, 16 nt, Human
gaacucugccugcccu

SEQ ID NO: 3803540 - RNA, 16 nt, Human
gaacucuggcuuccag

SEQ ID NO: 3803541 - RNA, 17 nt, Human
gaacucuggcuuccagg

SEQ ID NO: 3803542 - RNA, 13 nt, Human
gaacucugggcuc

SEQ ID NO: 3803543 - RNA, 14 nt, Human
gaacucugggcuca

SEQ ID NO: 3803544 - RNA, 19 nt, Human
gaacucugguggcacagga

SEQ ID NO: 3803545 - RNA, 12 nt, Human
gaacucuuccuc

SEQ ID NO: 3803546 - RNA, 19 nt, Human
gaacucuucucauuacuug

SEQ ID NO: 3803547 - RNA, 15 nt, Human
gaacucuugacagcu

SEQ ID NO: 3803548 - RNA, 22 nt, Human
gaacucuuucuggccugccuuc

SEQ ID NO: 3803549 - RNA, 18 nt, Human
gaacugaaaacauaaaaa

SEQ ID NO: 3803550 - RNA, 14 nt, Human
gaacugaaaagaga

SEQ ID NO: 3803551 - RNA, 22 nt, Human
gaacugaaaggcuuuucaacca

SEQ ID NO: 3803552 - RNA, 12 nt, Human
gaacugaacacc

SEQ ID NO: 3803553 - RNA, 22 nt, Human
gaacugaacaccauugaaggcu

SEQ ID NO: 3803554 - RNA, 23 nt, Human
gaacugaacaccauugaaggcuu

SEQ ID NO: 3803555 - RNA, 20 nt, Human
gaacugaaccggcuuuacca

SEQ ID NO: 3803556 - RNA, 19 nt, Human
gaacugagcuccucugggc

SEQ ID NO: 3803557 - RNA, 20 nt, Human
gaacugaucauguuuaugag

SEQ ID NO: 3803558 - RNA, 22 nt, Human
gaacugaucauguuuaugagaa

SEQ ID NO: 3803559 - RNA, 18 nt, Human
gaacugcacaugaagaaa

SEQ ID NO: 3803560 - RNA, 16 nt, Human
gaacugcagaccuguc

SEQ ID NO: 3803561 - RNA, 19 nt, Human
gaacugcagaccuguccuc

SEQ ID NO: 3803562 - RNA, 17 nt, Human
gaacugcaggcccuggc

SEQ ID NO: 3803563 - RNA, 18 nt, Human
gaacugcaggcccuggcc

SEQ ID NO: 3803564 - RNA, 19 nt, Human
gaacugcaggcccuggccu

SEQ ID NO: 3803565 - RNA, 19 nt, Human
gaacugccauuauuuucug

SEQ ID NO: 3803566 - RNA, 19 nt, Human
gaacugcguuaugaagagc

SEQ ID NO: 3803567 - RNA, 17 nt, Human
gaacugcugccacugag

SEQ ID NO: 3803568 - RNA, 20 nt, Human
gaacugcugggcuuggcagc

SEQ ID NO: 3803569 - RNA, 16 nt, Human
gaacugcuuucuuucg

SEQ ID NO: 3803570 - RNA, 14 nt, Human
gaacuggacucagg

SEQ ID NO: 3803571 - RNA, 18 nt, Human
gaacuggagccaugggca

SEQ ID NO: 3803572 - RNA, 18 nt, Human
gaacuggcaauugucuau

SEQ ID NO: 3803573 - RNA, 21 nt, Human
gaaaucccuguuuaauauuua

SEQ ID NO: 3803574 - RNA, 15 nt, Human
gaaaucuaguauuuc

SEQ ID NO: 3803575 - RNA, 12 nt, Human
gaaaucucaccc

SEQ ID NO: 3803576 - RNA, 15 nt, Human
gaaaucucuuugccc

SEQ ID NO: 3803577 - RNA, 15 nt, Human
gaaaucuuuaaaaaa

SEQ ID NO: 3803578 - RNA, 11 nt, Human
gaaaugaaaaa

SEQ ID NO: 3803579 - RNA, 16 nt, Human
gaaaugaaaacaugua

SEQ ID NO: 3803580 - RNA, 19 nt, Human
gaaaugaaaacauguaaua

SEQ ID NO: 3803581 - RNA, 17 nt, Human
gaaaugaaagcagggac

SEQ ID NO: 3803582 - RNA, 13 nt, Human
gaaaugaaauuua

SEQ ID NO: 3803583 - RNA, 12 nt, Human
gaaaugaacauu

SEQ ID NO: 3803584 - RNA, 16 nt, Human
gaaaugaacauuccaa

SEQ ID NO: 3803585 - RNA, 19 nt, Human
gaaaugacuaaaaaacaaa

SEQ ID NO: 3803586 - RNA, 17 nt, Human
gaaaugaggcaugaguu

SEQ ID NO: 3803587 - RNA, 22 nt, Human
gaaaugaggucuguuuaaagug

SEQ ID NO: 3803588 - RNA, 16 nt, Human
gaaaugauagauuuga

SEQ ID NO: 3803589 - RNA, 20 nt, Human
gaaaugcauuauuuugaaug

SEQ ID NO: 3803590 - RNA, 16 nt, Human
gaaaugccuuacuuug

SEQ ID NO: 3803591 - RNA, 22 nt, Human
gaaaugccuuacuuuguaugau

SEQ ID NO: 3803592 - RNA, 14 nt, Human
gaaaugcugaccca

SEQ ID NO: 3803593 - RNA, 13 nt, Human
gaaaugcugccug

SEQ ID NO: 3803594 - RNA, 16 nt, Human
gaaaugcugccugccu

SEQ ID NO: 3803595 - RNA, 15 nt, Human
gaaaugcugcuggcc

SEQ ID NO: 3803596 - RNA, 17 nt, Human
gaaaugcugcuggccaa

SEQ ID NO: 3803597 - RNA, 15 nt, Human
gaaaugcugggcuga

SEQ ID NO: 3803598 - RNA, 15 nt, Human
gaaauggaaagcaga

SEQ ID NO: 3803599 - RNA, 17 nt, Human
gaaauggcuugaagcca

SEQ ID NO: 3803600 - RNA, 19 nt, Human
gaaaugggcagagcagaga

SEQ ID NO: 3803601 - RNA, 20 nt, Human
gaaaugggcagagcagagac

SEQ ID NO: 3803602 - RNA, 14 nt, Human
gaaaugguuguauu

SEQ ID NO: 3803603 - RNA, 15 nt, Human
gaaaugguuguauua

SEQ ID NO: 3803604 - RNA, 14 nt, Human
gaaauguaaacugc

SEQ ID NO: 3803605 - RNA, 22 nt, Human
gaaauguaggcaucaugcaugu

SEQ ID NO: 3803606 - RNA, 14 nt, Human
gaaauguaguugau

SEQ ID NO: 3803607 - RNA, 18 nt, Human
gaaauguaguugauguau

SEQ ID NO: 3803608 - RNA, 15 nt, Human
gaaaugucuggagaa

SEQ ID NO: 3803609 - RNA, 17 nt, Human
gaaaugucuggagaaua

SEQ ID NO: 3803610 - RNA, 18 nt, Human
gaaaugucuggagaauaa

SEQ ID NO: 3803611 - RNA, 21 nt, Human
gaaaugugaauuuuuauuguu

SEQ ID NO: 3803612 - RNA, 16 nt, Human
gaaaugugguuuuccu

SEQ ID NO: 3803613 - RNA, 20 nt, Human
gaaaugugugugaugugaca

SEQ ID NO: 3803614 - RNA, 23 nt, Human
gaaaugugugugaugugacauuu

SEQ ID NO: 3803615 - RNA, 21 nt, Human
gaaauguuaaagguucacagg

SEQ ID NO: 3803616 - RNA, 15 nt, Human
gaaauguuuuaaggc

SEQ ID NO: 3803617 - RNA, 18 nt, Human
gaaauguuuuguaaacau

SEQ ID NO: 3803618 - RNA, 22 nt, Human
gaaauguuuuguaaacauuuau

SEQ ID NO: 3803619 - RNA, 21 nt, Human
gaaauguuuuuaauaaaagaa

SEQ ID NO: 3803620 - RNA, 23 nt, Human
gaaauuaacuuacccuguauauc

SEQ ID NO: 3803621 - RNA, 15 nt, Human
gaaauuaagaagaaa

SEQ ID NO: 3803622 - RNA, 16 nt, Human
gaaauuaagaagaaac

SEQ ID NO: 3803623 - RNA, 16 nt, Human
gaaauuaccuguggau

SEQ ID NO: 3803624 - RNA, 18 nt, Human
gaaauuaccuguggauau

SEQ ID NO: 3803625 - RNA, 13 nt, Human
gaaauuagggccc

SEQ ID NO: 3803626 - RNA, 23 nt, Human
gaaauuaguacuccccuccuuga

SEQ ID NO: 3803627 - RNA, 13 nt, Human
gaaauuauaucug

SEQ ID NO: 3803628 - RNA, 19 nt, Human
gaaauucaacguuaauaau

SEQ ID NO: 3803629 - RNA, 12 nt, Human
gaaauuccaaag

SEQ ID NO: 3803630 - RNA, 15 nt, Human
gaaauuccuguagca

SEQ ID NO: 3803631 - RNA, 19 nt, Human
gaaauucguguguuuuuuu

SEQ ID NO: 3803632 - RNA, 16 nt, Human
gaaauucuaaagagca

SEQ ID NO: 3803633 - RNA, 14 nt, Human
gaaauucugaauuu

SEQ ID NO: 3803634 - RNA, 21 nt, Human
gaaauucugaauuugcaaagu

SEQ ID NO: 3803635 - RNA, 13 nt, Human
gaaauucuguuuu

SEQ ID NO: 3803636 - RNA, 14 nt, Human
gaaauucuguuuuu

SEQ ID NO: 3803637 - RNA, 18 nt, Human
gaaauucuguuuuuaaaa

SEQ ID NO: 3803638 - RNA, 18 nt, Human
gaaauucuuguuauggua

SEQ ID NO: 3803639 - RNA, 15 nt, Human
gaaauugaaaaguua

SEQ ID NO: 3803640 - RNA, 21 nt, Human
gaaauugaauacuuugaaugu

SEQ ID NO: 3803641 - RNA, 17 nt, Human
gaaauugccugacgaac

SEQ ID NO: 3803642 - RNA, 18 nt, Human
gaaauugcuuuguauugu

SEQ ID NO: 3803643 - RNA, 22 nt, Human
gaaauuggaacagaauguuuua

SEQ ID NO: 3803644 - RNA, 14 nt, Human
gaaauuggcuggau

SEQ ID NO: 3803645 - RNA, 13 nt, Human
gaaauuguauauu

SEQ ID NO: 3803646 - RNA, 19 nt, Human
gaaauuguauauuguaauu

SEQ ID NO: 3803647 - RNA, 21 nt, Human
gaaauugucuagcagagcagg

SEQ ID NO: 3803648 - RNA, 14 nt, Human
gaaauuuaaacuau

SEQ ID NO: 3803649 - RNA, 20 nt, Human
gaaauuuaauucauguuucu

SEQ ID NO: 3803650 - RNA, 16 nt, Human
gaaauuuauaaacuuu

SEQ ID NO: 3803651 - RNA, 17 nt, Human
gaaauuuauaaacuuuu

SEQ ID NO: 3803652 - RNA, 19 nt, Human
gaaauuuauuaguuaauau

SEQ ID NO: 3803653 - RNA, 22 nt, Human
gaaauuuauugaggaaaaauau

SEQ ID NO: 3803654 - RNA, 20 nt, Human
gaaauuuccacucaggucug

SEQ ID NO: 3803655 - RNA, 13 nt, Human
gaaauuuccagag

SEQ ID NO: 3803656 - RNA, 13 nt, Human
gaaauuucuguga

SEQ ID NO: 3803657 - RNA, 14 nt, Human
gaaauuugauuucu

SEQ ID NO: 3803658 - RNA, 22 nt, Human
gaaauuuuaaccuaugauauuu

SEQ ID NO: 3803659 - RNA, 21 nt, Human
gaaauuuuaccaaguuauaua

SEQ ID NO: 3803660 - RNA, 14 nt, Human
gaaauuuuagaaau

SEQ ID NO: 3803661 - RNA, 22 nt, Human
gaaauuuuauaugcuuacugau

SEQ ID NO: 3803662 - RNA, 21 nt, Human
gaaauuuucaagagucuaaua

SEQ ID NO: 3803663 - RNA, 20 nt, Human
gaaauuuucuagacuuucug

SEQ ID NO: 3803664 - RNA, 16 nt, Human
gaaauuuucuugauuu

SEQ ID NO: 3803665 - RNA, 20 nt, Human
gaaauuuucuugauuugagu

SEQ ID NO: 3803666 - RNA, 17 nt, Human
gaaauuuugcaaauaua

SEQ ID NO: 3803667 - RNA, 21 nt, Human
gaaauuuugcaaauauaaaca

SEQ ID NO: 3803668 - RNA, 17 nt, Human
gaaauuuuguaagaagg

SEQ ID NO: 3803669 - RNA, 17 nt, Human
gaaauuuuuauuuuucu

SEQ ID NO: 3803670 - RNA, 12 nt, Human
gaaauuuuucau

SEQ ID NO: 3803671 - RNA, 17 nt, Human
gaaauuuuucauauuuu

SEQ ID NO: 3803672 - RNA, 19 nt, Human
gaaauuuuucauauuuuaa

SEQ ID NO: 3803673 - RNA, 15 nt, Human
gaaauuuuucuucuu

SEQ ID NO: 3803674 - RNA, 16 nt, Human
gaacaaaauaaauugg

SEQ ID NO: 3803675 - RNA, 14 nt, Human
gaacaaagcuguua

SEQ ID NO: 3803676 - RNA, 19 nt, Human
gaacaaagcuguuaaacug

SEQ ID NO: 3803677 - RNA, 19 nt, Human
gaacaaauauucagaauau

SEQ ID NO: 3803678 - RNA, 13 nt, Human
gaacaaaugaaga

SEQ ID NO: 3803679 - RNA, 14 nt, Human
gaacaaauuuacag

SEQ ID NO: 3803680 - RNA, 15 nt, Human
gaacaacauauacaa

SEQ ID NO: 3803681 - RNA, 20 nt, Human
gaacaaccucggcuccugga

SEQ ID NO: 3803682 - RNA, 17 nt, Human
cuagagaagauaauugu

SEQ ID NO: 3803683 - RNA, 21 nt, Human
cuagagaagauaauuguugaa

SEQ ID NO: 3803684 - RNA, 23 nt, Human
cuagagaaguggacuggaggagc

SEQ ID NO: 3803685 - RNA, 15 nt, Human
cuagagaaugcacag

SEQ ID NO: 3803686 - RNA, 23 nt, Human
cuagagacagaagcaggcuggag

SEQ ID NO: 3803687 - RNA, 22 nt, Human
cuagagagggaggcaagcccug

SEQ ID NO: 3803688 - RNA, 20 nt, Human
cuagagagugugauguucac

SEQ ID NO: 3803689 - RNA, 17 nt, Human
cuagagauauggcagcg

SEQ ID NO: 3803690 - RNA, 17 nt, Human
cuagagaucugguuuug

SEQ ID NO: 3803691 - RNA, 14 nt, Human
cuagagcagggauu

SEQ ID NO: 3803692 - RNA, 11 nt, Human
cuagagccugc

SEQ ID NO: 3803693 - RNA, 12 nt, Human
cuagagccugcc

SEQ ID NO: 3803694 - RNA, 18 nt, Human
cuagagccugcuggaucu

SEQ ID NO: 3803695 - RNA, 16 nt, Human
cuagagccuucagccu

SEQ ID NO: 3803696 - RNA, 11 nt, Human
cuagagcuccu

SEQ ID NO: 3803697 - RNA, 17 nt, Human
cuagaggaaaagaaaga

SEQ ID NO: 3803698 - RNA, 15 nt, Human
cuagaggcagggagg

SEQ ID NO: 3803699 - RNA, 19 nt, Human
cuagaggccagccccaccc

SEQ ID NO: 3803700 - RNA, 18 nt, Human
cuagaggccugaggauga

SEQ ID NO: 3803701 - RNA, 20 nt, Human
cuagaggccugaggaugagc

SEQ ID NO: 3803702 - RNA, 21 nt, Human
cuagaggcuuccuucauuucc

SEQ ID NO: 3803703 - RNA, 18 nt, Human
cuagagggaccucuccca

SEQ ID NO: 3803704 - RNA, 19 nt, Human
cuagagggaccucucccag

SEQ ID NO: 3803705 - RNA, 21 nt, Human
cuagagggaccucucccaggg

SEQ ID NO: 3803706 - RNA, 22 nt, Human
cuagagggauacacugaaguua

SEQ ID NO: 3803707 - RNA, 15 nt, Human
cuagaggguuccugu

SEQ ID NO: 3803708 - RNA, 19 nt, Human
cuagaggguuccuguagac

SEQ ID NO: 3803709 - RNA, 15 nt, Human
cuagaggugagaaau

SEQ ID NO: 3803710 - RNA, 17 nt, Human
cuagaggugagaaauuu

SEQ ID NO: 3803711 - RNA, 15 nt, Human
cuagagguucaaaga

SEQ ID NO: 3803712 - RNA, 20 nt, Human
cuagagguuuuaugauauuu

SEQ ID NO: 3803713 - RNA, 23 nt, Human
cuagaguccaagguuuaaagagu

SEQ ID NO: 3803714 - RNA, 21 nt, Human
cuagagucccagguuggcucu

SEQ ID NO: 3803715 - RNA, 19 nt, Human
cuagagucugaacagcugu

SEQ ID NO: 3803716 - RNA, 20 nt, Human
cuagagucugaacagcugua

SEQ ID NO: 3803717 - RNA, 17 nt, Human
cuagagugaacuugggc

SEQ ID NO: 3803718 - RNA, 16 nt, Human
gaagagagcaugagag

SEQ ID NO: 3803719 - RNA, 21 nt, Human
gaagagaggagaggagagagg

SEQ ID NO: 3803720 - RNA, 13 nt, Human
gaagagaggaguu

SEQ ID NO: 3803721 - RNA, 16 nt, Human
gaagagaggaguucaa

SEQ ID NO: 3803722 - RNA, 20 nt, Human
gaagagaggaguucaaugau

SEQ ID NO: 3803723 - RNA, 17 nt, Human
gaagagaucaggaagag

SEQ ID NO: 3803724 - RNA, 16 nt, Human
gaagagauccaaagac

SEQ ID NO: 3803725 - RNA, 17 nt, Human
gaagagauccaaagacu

SEQ ID NO: 3803726 - RNA, 14 nt, Human
gaagagcagcaccu

SEQ ID NO: 3803727 - RNA, 18 nt, Human
gaagagcagcaccuccuc

SEQ ID NO: 3803728 - RNA, 15 nt, Human
gaagagcaggcacau

SEQ ID NO: 3803729 - RNA, 13 nt, Human
gaagagccacagu

SEQ ID NO: 3803730 - RNA, 14 nt, Human
gaagagcccagucu

SEQ ID NO: 3803731 - RNA, 17 nt, Human
gaagagcccagucuguu

SEQ ID NO: 3803732 - RNA, 12 nt, Human
gaagagccccac

SEQ ID NO: 3803733 - RNA, 16 nt, Human
gaagagccccacucuc

SEQ ID NO: 3803734 - RNA, 19 nt, Human
gaagagccuuccacccagg

SEQ ID NO: 3803735 - RNA, 21 nt, Human
gaagagcgcaguguuuugcaa

SEQ ID NO: 3803736 - RNA, 17 nt, Human
gaagagcuauuauauaa

SEQ ID NO: 3803737 - RNA, 20 nt, Human
gaagagcuguucacagccag

SEQ ID NO: 3803738 - RNA, 14 nt, Human
gaagagcuuagaaa

SEQ ID NO: 3803739 - RNA, 16 nt, Human
gaagagcuugcuuuga

SEQ ID NO: 3803740 - RNA, 17 nt, Human
gaagaggaacugggccu

SEQ ID NO: 3803741 - RNA, 15 nt, Human
gaagaggagcccuca

SEQ ID NO: 3803742 - RNA, 18 nt, Human
gaagaggaggggaagagg

SEQ ID NO: 3803743 - RNA, 15 nt, Human
gaagaggcgggccag

SEQ ID NO: 3803744 - RNA, 13 nt, Human
gaagagggccugu

SEQ ID NO: 3803745 - RNA, 18 nt, Human
gaagaggguguguuugaa

SEQ ID NO: 3803746 - RNA, 17 nt, Human
gaagaggguuuuaggua

SEQ ID NO: 3803747 - RNA, 14 nt, Human
gaagaguauggauu

SEQ ID NO: 3803748 - RNA, 14 nt, Human
gaagaguccucuga

SEQ ID NO: 3803749 - RNA, 16 nt, Human
gaagagugaaauacca

SEQ ID NO: 3803750 - RNA, 14 nt, Human
gaagagugagaggg

SEQ ID NO: 3803751 - RNA, 16 nt, Human
gaagaguggaggugga

SEQ ID NO: 3803752 - RNA, 17 nt, Human
gaagaguguacuggggg

SEQ ID NO: 3803753 - RNA, 15 nt, Human
gaagauaaacgugga

SEQ ID NO: 3803754 - RNA, 21 nt, Human
gaagauaaacguggauguuac

SEQ ID NO: 3803755 - RNA, 20 nt, Human
gaagauaauguaaagguuuu

SEQ ID NO: 3803756 - RNA, 13 nt, Human
gaagauaauuguu

SEQ ID NO: 3803757 - RNA, 17 nt, Human
gaagauaauuguugaaa

SEQ ID NO: 3803758 - RNA, 16 nt, Human
gaagauaccaucagca

SEQ ID NO: 3803759 - RNA, 15 nt, Human
gaagauaggcucugc

SEQ ID NO: 3803760 - RNA, 18 nt, Human
gaagauaggcucugcaca

SEQ ID NO: 3803761 - RNA, 20 nt, Human
gaagauaggcucugcacaga

SEQ ID NO: 3803762 - RNA, 14 nt, Human
gaagauaguaacug

SEQ ID NO: 3803763 - RNA, 18 nt, Human
gaagaucacgcuccccgc

SEQ ID NO: 3803764 - RNA, 17 nt, Human
gaagauccuaaaacaaa

SEQ ID NO: 3803765 - RNA, 15 nt, Human
gaagauccugugagg

SEQ ID NO: 3803766 - RNA, 22 nt, Human
gaagaucucugcagggccgcca

SEQ ID NO: 3803767 - RNA, 14 nt, Human
gaagaugaaucaau

SEQ ID NO: 3803768 - RNA, 16 nt, Human
gaagaugaucagaccu

SEQ ID NO: 3803769 - RNA, 13 nt, Human
gaagaugcagcuc

SEQ ID NO: 3803770 - RNA, 24 nt, Human
gaagaugcgagcgcuaucuucaca

SEQ ID NO: 3803771 - RNA, 22 nt, Human
gaagaugcuccagcaacacagc

SEQ ID NO: 3803772 - RNA, 18 nt, Human
gaagauggauaugaccag

SEQ ID NO: 3803773 - RNA, 13 nt, Human
gaagauggcuguu

SEQ ID NO: 3803774 - RNA, 16 nt, Human
gaagauggcuguuagc

SEQ ID NO: 3803775 - RNA, 19 nt, Human
gaagaugucaucccauugu

SEQ ID NO: 3803776 - RNA, 17 nt, Human
gaagauugagauguguu

SEQ ID NO: 3803777 - RNA, 23 nt, Human
gaagauuguuuaucuagauguaa

SEQ ID NO: 3803778 - RNA, 21 nt, Human
gaagauuugcccauuuacacu

SEQ ID NO: 3803779 - RNA, 16 nt, Human
gaagauuuucagucua

SEQ ID NO: 3803780 - RNA, 17 nt, Human
gaagauuuucagucuag

SEQ ID NO: 3803781 - RNA, 20 nt, Human
gaagcaaaaacgaaagcugg

SEQ ID NO: 3803782 - RNA, 13 nt, Human
gaagcaaacacau

SEQ ID NO: 3803783 - RNA, 14 nt, Human
gaagcaaauaaaua

SEQ ID NO: 3803784 - RNA, 23 nt, Human
gaagcaacccaaauguucaucaa

SEQ ID NO: 3803785 - RNA, 20 nt, Human
gaagcaaccucaguaauuua

SEQ ID NO: 3803786 - RNA, 22 nt, Human
gaagcaaccucaguaauuuaga

SEQ ID NO: 3803787 - RNA, 23 nt, Human
gaagcaaggaagauauacaugaa

SEQ ID NO: 3803788 - RNA, 20 nt, Human
gaagcaaguaaaaaggcuaa

SEQ ID NO: 3803789 - RNA, 20 nt, Human
gaagcaaugcuucaucccuu

SEQ ID NO: 3803790 - RNA, 23 nt, Human
gaagcacaccaaucuuacuuugu

SEQ ID NO: 3803791 - RNA, 15 nt, Human
gaagcacagaauauu

SEQ ID NO: 3803792 - RNA, 17 nt, Human
gaagcacagaauauuuu

SEQ ID NO: 3803793 - RNA, 13 nt, Human
gaagcagaauaaa

SEQ ID NO: 3803794 - RNA, 12 nt, Human
gaagcagagaga

SEQ ID NO: 3803795 - RNA, 11 nt, Human
gaagcagagug

SEQ ID NO: 3803796 - RNA, 19 nt, Human
gaagcagcaacuuguccua

SEQ ID NO: 3803797 - RNA, 22 nt, Human
gaagcagccucuccccaggucc

SEQ ID NO: 3803798 - RNA, 12 nt, Human
gaagcagcucuu

SEQ ID NO: 3803799 - RNA, 14 nt, Human
gaagcaggcuacac

SEQ ID NO: 3803800 - RNA, 19 nt, Human
gaagcaggcuacacugaca

SEQ ID NO: 3803801 - RNA, 13 nt, Human
gaagcaggcugga

SEQ ID NO: 3803802 - RNA, 15 nt, Human
gaagcaggcuggagg

SEQ ID NO: 3803803 - RNA, 19 nt, Human
gaagcagguuaaauguuuu

SEQ ID NO: 3803804 - RNA, 19 nt, Human
gaagcagguucccaagcuc

SEQ ID NO: 3803805 - RNA, 19 nt, Human
gaagcagguugaggggcuc

SEQ ID NO: 3803806 - RNA, 22 nt, Human
gaagcagguugaggggcuccug

SEQ ID NO: 3803807 - RNA, 16 nt, Human
gaagcagugcccaggu

SEQ ID NO: 3803808 - RNA, 18 nt, Human
gaagcagugcccaggugg

SEQ ID NO: 3803809 - RNA, 14 nt, Human
gaagcaguuguguc

SEQ ID NO: 3803810 - RNA, 16 nt, Human
gaagcaguugugucag

SEQ ID NO: 3803811 - RNA, 11 nt, Human
gaagcauccag

SEQ ID NO: 3803812 - RNA, 13 nt, Human
gaagcaugaaaaa

SEQ ID NO: 3803813 - RNA, 18 nt, Human
gaagcaugaacagugcac

SEQ ID NO: 3803814 - RNA, 16 nt, Human
gaagcauguaggagaa

SEQ ID NO: 3803815 - RNA, 18 nt, Human
gaagcauucucauuggaa

SEQ ID NO: 3803816 - RNA, 19 nt, Human
gaagcauucuccccagugu

SEQ ID NO: 3803817 - RNA, 17 nt, Human
gaagcauuguaaaauaa

SEQ ID NO: 3803818 - RNA, 17 nt, Human
gaagcauuuacuuugug

SEQ ID NO: 3803819 - RNA, 12 nt, Human
gaagcauuugua

SEQ ID NO: 3803820 - RNA, 18 nt, Human
gaagcauuuguauuuugu

SEQ ID NO: 3803821 - RNA, 22 nt, Human
gaagcauuuguauuuuguguga

SEQ ID NO: 3803822 - RNA, 13 nt, Human
gaagcauuuuaua

SEQ ID NO: 3803823 - RNA, 10 nt, Human
gaagccaaag

SEQ ID NO: 3803824 - RNA, 12 nt, Human
gaagccaaagaa

SEQ ID NO: 3803825 - RNA, 13 nt, Human
gaagccaaagagu

SEQ ID NO: 3803826 - RNA, 18 nt, Human
gaagccacaggccugaga

SEQ ID NO: 3803827 - RNA, 22 nt, Human
gaagccacccucccagcucuga

SEQ ID NO: 3803828 - RNA, 22 nt, Human
gaagccacgguguucugugaua

SEQ ID NO: 3803829 - RNA, 16 nt, Human
gaagccagcaggcucu

SEQ ID NO: 3803830 - RNA, 19 nt, Human
gaagccagcaggcucucag

SEQ ID NO: 3803831 - RNA, 23 nt, Human
gaagccagcaggcucucaggcca

SEQ ID NO: 3803832 - RNA, 12 nt, Human
gaagccagccuu

SEQ ID NO: 3803833 - RNA, 20 nt, Human
gaagccagccuucuuccauc

SEQ ID NO: 3803834 - RNA, 15 nt, Human
gaagccagcugcccu

SEQ ID NO: 3803835 - RNA, 13 nt, Human
gaagccagcuugu

SEQ ID NO: 3803836 - RNA, 22 nt, Human
gaagccagcuuucccugccucu

SEQ ID NO: 3803837 - RNA, 19 nt, Human
gaagccaggaauuucccag

SEQ ID NO: 3803838 - RNA, 13 nt, Human
gaacaacugauac

SEQ ID NO: 3803839 - RNA, 16 nt, Human
gaacaagagaagcauu

SEQ ID NO: 3803840 - RNA, 21 nt, Human
gaacaagcaaacccagacggc

SEQ ID NO: 3803841 - RNA, 13 nt, Human
gaacaagcuucag

SEQ ID NO: 3803842 - RNA, 15 nt, Human
gaacaaggcaaggcu

SEQ ID NO: 3803843 - RNA, 19 nt, Human
gaacaauauugacuuuguc

SEQ ID NO: 3803844 - RNA, 14 nt, Human
gaacaaucaaagca

SEQ ID NO: 3803845 - RNA, 14 nt, Human
gaacacacacauau

SEQ ID NO: 3803846 - RNA, 22 nt, Human
gaacacacuguguccuggugcu

SEQ ID NO: 3803847 - RNA, 15 nt, Human
gaacacagaaagccu

SEQ ID NO: 3803848 - RNA, 14 nt, Human
gaacacaggcagcu

SEQ ID NO: 3803849 - RNA, 15 nt, Human
gaacacauuucucug

SEQ ID NO: 3803850 - RNA, 22 nt, Human
gaacacauuucuuuuuaaaaaa

SEQ ID NO: 3803851 - RNA, 23 nt, Human
gaacacauuucuuuuuaaaaaaa

SEQ ID NO: 3803852 - RNA, 19 nt, Human
gaacaccauugaaggcuua

SEQ ID NO: 3803853 - RNA, 16 nt, Human
gaacacccuauauuuu

SEQ ID NO: 3803854 - RNA, 17 nt, Human
gaacacgcguauuuaca

SEQ ID NO: 3803855 - RNA, 20 nt, Human
gaacacuagacaagccagaa

SEQ ID NO: 3803856 - RNA, 18 nt, Human
gaacacuauuuucagaau

SEQ ID NO: 3803857 - RNA, 19 nt, Human
gaacacuauuuucagaauc

SEQ ID NO: 3803858 - RNA, 15 nt, Human
gaacacuccuucaca

SEQ ID NO: 3803859 - RNA, 17 nt, Human
gaacacuccuucacaga

SEQ ID NO: 3803860 - RNA, 14 nt, Human
gaacacucugagac

SEQ ID NO: 3803861 - RNA, 19 nt, Human
gaacacuggcagacugugu

SEQ ID NO: 3803862 - RNA, 22 nt, Human
gaacacuggggacuuggccucu

SEQ ID NO: 3803863 - RNA, 22 nt, Human
gaacacuuauaagugaagugau

SEQ ID NO: 3803864 - RNA, 20 nt, Human
cuaggaacacuccuucacag

SEQ ID NO: 3803865 - RNA, 15 nt, Human
cuaggaagaauuuua

SEQ ID NO: 3803866 - RNA, 20 nt, Human
cuaggaagaauuuuaaaaau

SEQ ID NO: 3803867 - RNA, 21 nt, Human
cuaggaagaauuuuaaaaaug

SEQ ID NO: 3803868 - RNA, 22 nt, Human
cuaggaagaauuuuaaaaauga

SEQ ID NO: 3803869 - RNA, 19 nt, Human
cuaggaagagcaggacucc

SEQ ID NO: 3803870 - RNA, 14 nt, Human
cuaggaauauagau

SEQ ID NO: 3803871 - RNA, 15 nt, Human
cuaggacacaguucc

SEQ ID NO: 3803872 - RNA, 16 nt, Human
cuaggaccacucagcc

SEQ ID NO: 3803873 - RNA, 21 nt, Human
cuaggaccacucagccccuag

SEQ ID NO: 3803874 - RNA, 22 nt, Human
cuaggaccacucagccccuagg

SEQ ID NO: 3803875 - RNA, 22 nt, Human
cuaggacugaauuaugaaacuu

SEQ ID NO: 3803876 - RNA, 13 nt, Human
cuaggagaagagu

SEQ ID NO: 3803877 - RNA, 20 nt, Human
cuaggagaagaguugaggaa

SEQ ID NO: 3803878 - RNA, 18 nt, Human
cuaggagauaucugaggg

SEQ ID NO: 3803879 - RNA, 21 nt, Human
cuaggagauaucugagggagg

SEQ ID NO: 3803880 - RNA, 13 nt, Human
cuaggagcaaagc

SEQ ID NO: 3803881 - RNA, 16 nt, Human
cuaggagcaaagccug

SEQ ID NO: 3803882 - RNA, 17 nt, Human
cuaggagcaaagccugu

SEQ ID NO: 3803883 - RNA, 20 nt, Human
cuaggagcaaagccuguuca

SEQ ID NO: 3803884 - RNA, 13 nt, Human
cuaggagggagac

SEQ ID NO: 3803885 - RNA, 23 nt, Human
cuaggagggagacacuggccccu

SEQ ID NO: 3803886 - RNA, 15 nt, Human
cuaggaggguccucu

SEQ ID NO: 3803887 - RNA, 21 nt, Human
cuaggauaaaaagccagggcu

SEQ ID NO: 3803888 - RNA, 16 nt, Human
cuaggcaggaccugug

SEQ ID NO: 3803889 - RNA, 16 nt, Human
cuaggcaguaggccgg

SEQ ID NO: 3803890 - RNA, 18 nt, Human
cuaggcaguuagagaugc

SEQ ID NO: 3803891 - RNA, 20 nt, Human
cuaggcaguuagagaugccu

SEQ ID NO: 3803892 - RNA, 20 nt, Human
cuaggcaguucaaagcagga

SEQ ID NO: 3803893 - RNA, 22 nt, Human
cuaggcauucuggaccucuggg

SEQ ID NO: 3803894 - RNA, 19 nt, Human
cuaggccacaccaucuccu

SEQ ID NO: 3803895 - RNA, 15 nt, Human
cuaggccacuccucc

SEQ ID NO: 3803896 - RNA, 16 nt, Human
cuaggccagagcccac

SEQ ID NO: 3803897 - RNA, 17 nt, Human
cuaggcccccacuugcc

SEQ ID NO: 3803898 - RNA, 22 nt, Human
cuaggcccccacuugccucuuc

SEQ ID NO: 3803899 - RNA, 12 nt, Human
cuaggccgggcg

SEQ ID NO: 3803900 - RNA, 15 nt, Human
cuaggccuaguccug

SEQ ID NO: 3803901 - RNA, 15 nt, Human
cuaggccucagccag

SEQ ID NO: 3803902 - RNA, 18 nt, Human
cuaggccucagccagaga

SEQ ID NO: 3803903 - RNA, 17 nt, Human
cuaggccuccuggccca

SEQ ID NO: 3803904 - RNA, 18 nt, Human
cuaggccuccuggcccag

SEQ ID NO: 3803905 - RNA, 23 nt, Human
cuaggccucucaccucugugccu

SEQ ID NO: 3803906 - RNA, 13 nt, Human
cuaggccuggcca

SEQ ID NO: 3803907 - RNA, 14 nt, Human
cuaggccuggccag

SEQ ID NO: 3803908 - RNA, 19 nt, Human
cuaggccuggccagaugca

SEQ ID NO: 3803909 - RNA, 16 nt, Human
cuaggcgagugccagg

SEQ ID NO: 3803910 - RNA, 15 nt, Human
cuaggcgugagaagc

SEQ ID NO: 3803911 - RNA, 22 nt, Human
cuaggcucagagaugugcaccc

SEQ ID NO: 3803912 - RNA, 15 nt, Human
cuaggcucagcggcg

SEQ ID NO: 3803913 - RNA, 17 nt, Human
cuaggcucgccuucccu

SEQ ID NO: 3803914 - RNA, 22 nt, Human
cuaggcucugucuggaagaugg

SEQ ID NO: 3803915 - RNA, 23 nt, Human
cuaggcugcauugaaaagagcug

SEQ ID NO: 3803916 - RNA, 14 nt, Human
cuaggcuggaagga

SEQ ID NO: 3803917 - RNA, 17 nt, Human
cuaggcuggaaggagga

SEQ ID NO: 3803918 - RNA, 19 nt, Human
cuaggcuggaaggaggaag

SEQ ID NO: 3803919 - RNA, 19 nt, Human
cuaggcugggugcccacag

SEQ ID NO: 3803920 - RNA, 22 nt, Human
cuaggcugggugcccacagccc

SEQ ID NO: 3803921 - RNA, 21 nt, Human
cuaggcuuaauaccuggguga

SEQ ID NO: 3803922 - RNA, 16 nt, Human
cuagggaaacuucccg

SEQ ID NO: 3803923 - RNA, 11 nt, Human
cuagggaagaa

SEQ ID NO: 3803924 - RNA, 20 nt, Human
cuagggaagaaagcagaaca

SEQ ID NO: 3803925 - RNA, 14 nt, Human
cuagggaagauaau

SEQ ID NO: 3803926 - RNA, 15 nt, Human
cuagggaccccuccu

SEQ ID NO: 3803927 - RNA, 17 nt, Human
cuagggaccccuccucc

SEQ ID NO: 3803928 - RNA, 13 nt, Human
cuagggaccuggg

SEQ ID NO: 3803929 - RNA, 14 nt, Human
cuagggaccugggg

SEQ ID NO: 3803930 - RNA, 18 nt, Human
cuagggagccauuugaga

SEQ ID NO: 3803931 - RNA, 15 nt, Human
cuagggccuggguuu

SEQ ID NO: 3803932 - RNA, 16 nt, Human
cuagggccuuggaaau

SEQ ID NO: 3803933 - RNA, 14 nt, Human
cuaggggaaugagg

SEQ ID NO: 3803934 - RNA, 22 nt, Human
cuaggggaaugagggggcucag

SEQ ID NO: 3803935 - RNA, 16 nt, Human
cuaggggucaggcucc

SEQ ID NO: 3803936 - RNA, 21 nt, Human
cuaggggucagggaccaagga

SEQ ID NO: 3803937 - RNA, 23 nt, Human
cuaggggucuuguuaagugcagu

SEQ ID NO: 3803938 - RNA, 13 nt, Human
cuaggguccuggg

SEQ ID NO: 3803939 - RNA, 15 nt, Human
cuaggguugcuggag

SEQ ID NO: 3803940 - RNA, 18 nt, Human
cuaggguugcuggagccu

SEQ ID NO: 3803941 - RNA, 19 nt, Human
cuagguacgaugacagugu

SEQ ID NO: 3803942 - RNA, 17 nt, Human
cuagguagagucugagg

SEQ ID NO: 3803943 - RNA, 17 nt, Human
cuagguaggaaaugugg

SEQ ID NO: 3803944 - RNA, 15 nt, Human
cuagguaggguuuaa

SEQ ID NO: 3803945 - RNA, 15 nt, Human
cuaggucaaggccug

SEQ ID NO: 3803946 - RNA, 17 nt, Human
cuaggucaguacccacc

SEQ ID NO: 3803947 - RNA, 21 nt, Human
cuaggucaguacccaccugag

SEQ ID NO: 3803948 - RNA, 22 nt, Human
cuaggucaguacccaccugagc

SEQ ID NO: 3803949 - RNA, 21 nt, Human
cuagguccccauacuccuaug

SEQ ID NO: 3803950 - RNA, 12 nt, Human
cuaggucuccag

SEQ ID NO: 3803951 - RNA, 12 nt, Human
cuagguggaaaa

SEQ ID NO: 3803952 - RNA, 17 nt, Human
cuagguggcaaggcugu

SEQ ID NO: 3803953 - RNA, 13 nt, Human
cuaggugggccag

SEQ ID NO: 3803954 - RNA, 23 nt, Human
cuagguggguugaaagccaagga

SEQ ID NO: 3803955 - RNA, 15 nt, Human
cuagguucaauuccc

SEQ ID NO: 3803956 - RNA, 19 nt, Human
cuagguucccggucccgag

SEQ ID NO: 3803957 - RNA, 13 nt, Human
cuagguucccugu

SEQ ID NO: 3803958 - RNA, 12 nt, Human
cuagguuuaacu

SEQ ID NO: 3803959 - RNA, 12 nt, Human
cuagguuuauga

SEQ ID NO: 3803960 - RNA, 16 nt, Human
cuagguuuaugacagu

SEQ ID NO: 3803961 - RNA, 22 nt, Human
cuaguaaguaauuaugcacuaa

SEQ ID NO: 3803962 - RNA, 16 nt, Human
cuaguaagugccuucc

SEQ ID NO: 3803963 - RNA, 12 nt, Human
cuaguacugugu

SEQ ID NO: 3803964 - RNA, 15 nt, Human
cuaguacuguguacu

SEQ ID NO: 3803965 - RNA, 17 nt, Human
cuaguacuguguacugu

SEQ ID NO: 3803966 - RNA, 17 nt, Human
cuaguaguuccugcuac

SEQ ID NO: 3803967 - RNA, 17 nt, Human
cuaguaucaaaagaaag

SEQ ID NO: 3803968 - RNA, 23 nt, Human
cuaguaucaaaagaaagaaaauc

SEQ ID NO: 3803969 - RNA, 14 nt, Human
cuaguauugacaaa

SEQ ID NO: 3803970 - RNA, 20 nt, Human
cuaguauugacaaaauguua

SEQ ID NO: 3803971 - RNA, 19 nt, Human
cuaguauuucuaugaaaua

SEQ ID NO: 3803972 - RNA, 22 nt, Human
cuaguauuucuaugaaauauua

SEQ ID NO: 3803973 - RNA, 13 nt, Human
cuaguauuugaau

SEQ ID NO: 3803974 - RNA, 14 nt, Human
cuaguauuugaauu

SEQ ID NO: 3803975 - RNA, 15 nt, Human
cuaguauuugaauua

SEQ ID NO: 3803976 - RNA, 24 nt, Human
cuaguauuugaauuaaaacuucuu

SEQ ID NO: 3803977 - RNA, 16 nt, Human
cuagucaagcuccucc

SEQ ID NO: 3803978 - RNA, 21 nt, Human
cuagucaaucaagucuguuua

SEQ ID NO: 3803979 - RNA, 18 nt, Human
cuagucagagagaguguu

SEQ ID NO: 3803980 - RNA, 16 nt, Human
cuagucagccacaugg

SEQ ID NO: 3803981 - RNA, 15 nt, Human
cuagucccuuccaca

SEQ ID NO: 3803982 - RNA, 15 nt, Human
cuaguccggacccac

SEQ ID NO: 3803983 - RNA, 15 nt, Human
cuaguccuuuacuaa

SEQ ID NO: 3803984 - RNA, 21 nt, Human
cuagucguggagaugucuucg

SEQ ID NO: 3803985 - RNA, 23 nt, Human
cuagucuccuuugcacugagggc

SEQ ID NO: 3803986 - RNA, 13 nt, Human
cuagucucucugg

SEQ ID NO: 3803987 - RNA, 18 nt, Human
cuagucugugugcugugg

SEQ ID NO: 3803988 - RNA, 23 nt, Human
cuagucugugugggacuguacac

SEQ ID NO: 3803989 - RNA, 21 nt, Human
cuagugaauguaggcuggcuu

SEQ ID NO: 3803990 - RNA, 17 nt, Human
cuagugacccacaugcc

SEQ ID NO: 3803991 - RNA, 20 nt, Human
cuagugaccccuucccuguc

SEQ ID NO: 3803992 - RNA, 18 nt, Human
cuagugacuuguguccca

SEQ ID NO: 3803993 - RNA, 14 nt, Human
gaaccucagccugg

SEQ ID NO: 3803994 - RNA, 15 nt, Human
gaaccucagccuggc

SEQ ID NO: 3803995 - RNA, 14 nt, Human
gaaccucaggcuuc

SEQ ID NO: 3803996 - RNA, 14 nt, Human
gaaccucccagagg

SEQ ID NO: 3803997 - RNA, 13 nt, Human
gaaccuccuuucu

SEQ ID NO: 3803998 - RNA, 22 nt, Human
gaaccucgaguacugugggcaa

SEQ ID NO: 3803999 - RNA, 12 nt, Human
gaaccucugucu

SEQ ID NO: 3804000 - RNA, 17 nt, Human
gaaccugacguagcugc

SEQ ID NO: 3804001 - RNA, 15 nt, Human
gaaccugaugaaaau

SEQ ID NO: 3804002 - RNA, 20 nt, Human
gaaccugaugaaaauaaaga

SEQ ID NO: 3804003 - RNA, 17 nt, Human
gaaccugcacacgagca

SEQ ID NO: 3804004 - RNA, 12 nt, Human
gaaccuggaacu

SEQ ID NO: 3804005 - RNA, 16 nt, Human
gaaccuggaacuuggg

SEQ ID NO: 3804006 - RNA, 18 nt, Human
gaaccuggaccaaagcug

SEQ ID NO: 3804007 - RNA, 12 nt, Human
gaaccuggccuu

SEQ ID NO: 3804008 - RNA, 14 nt, Human
gaaccuggccuuca

SEQ ID NO: 3804009 - RNA, 16 nt, Human
cuggagucuccugagg

SEQ ID NO: 3804010 - RNA, 14 nt, Human
cuggagugcagugg

SEQ ID NO: 3804011 - RNA, 23 nt, Human
cuggaguggccacuaagcagagg

SEQ ID NO: 3804012 - RNA, 18 nt, Human
cuggaguggcucgccagg

SEQ ID NO: 3804013 - RNA, 19 nt, Human
cuggaguguggcugaggag

SEQ ID NO: 3804014 - RNA, 16 nt, Human
cuggaguuacauuaau

SEQ ID NO: 3804015 - RNA, 16 nt, Human
cuggaguuagggacug

SEQ ID NO: 3804016 - RNA, 23 nt, Human
cuggaguuauugaagcagagugg

SEQ ID NO: 3804017 - RNA, 24 nt, Human
cuggaguuauugaagcagaguggc

SEQ ID NO: 3804018 - RNA, 15 nt, Human
cuggaguugaucugg

SEQ ID NO: 3804019 - RNA, 16 nt, Human
cuggaguugaucugga

SEQ ID NO: 3804020 - RNA, 20 nt, Human
cuggaguugaucuggaaccc

SEQ ID NO: 3804021 - RNA, 14 nt, Human
cuggaguugcauug

SEQ ID NO: 3804022 - RNA, 15 nt, Human
cuggaguugcauuga

SEQ ID NO: 3804023 - RNA, 14 nt, Human
cuggaguuugggau

SEQ ID NO: 3804024 - RNA, 17 nt, Human
cuggauaaagccacuga

SEQ ID NO: 3804025 - RNA, 17 nt, Human
cuggauaacuuccacag

SEQ ID NO: 3804026 - RNA, 13 nt, Human
cuggauaauuuug

SEQ ID NO: 3804027 - RNA, 15 nt, Human
cuggauaauuuugca

SEQ ID NO: 3804028 - RNA, 20 nt, Human
cuggauacaguauaaaaaua

SEQ ID NO: 3804029 - RNA, 14 nt, Human
cuggauagacgagu

SEQ ID NO: 3804030 - RNA, 13 nt, Human
cuggauaggagcc

SEQ ID NO: 3804031 - RNA, 18 nt, Human
cuggauaggagccugcug

SEQ ID NO: 3804032 - RNA, 21 nt, Human
cuggauauuuucaaauuguau

SEQ ID NO: 3804033 - RNA, 22 nt, Human
cuggauauuuucaaauuguauc

SEQ ID NO: 3804034 - RNA, 23 nt, Human
cuggaucaaaguaggcaggacca

SEQ ID NO: 3804035 - RNA, 14 nt, Human
cuggaucacagcug

SEQ ID NO: 3804036 - RNA, 14 nt, Human
cuggaucagcgugg

SEQ ID NO: 3804037 - RNA, 18 nt, Human
cuggaucagcguggccuu

SEQ ID NO: 3804038 - RNA, 12 nt, Human
cuggaucaguaa

SEQ ID NO: 3804039 - RNA, 23 nt, Human
cuggauccccucugucuacaaau

SEQ ID NO: 3804040 - RNA, 16 nt, Human
cuggaucuaccuggag

SEQ ID NO: 3804041 - RNA, 13 nt, Human
cuggaucucccag

SEQ ID NO: 3804042 - RNA, 15 nt, Human
cuggaucuccccacu

SEQ ID NO: 3804043 - RNA, 14 nt, Human
cuggaucugugagg

SEQ ID NO: 3804044 - RNA, 22 nt, Human
cuggaugaaauaacuccuucuu

SEQ ID NO: 3804045 - RNA, 20 nt, Human
cuggaugaaguuaucuggcu

SEQ ID NO: 3804046 - RNA, 15 nt, Human
cuggaugacauuaaa

SEQ ID NO: 3804047 - RNA, 20 nt, Human
cuggaugagcucccacaagc

SEQ ID NO: 3804048 - RNA, 22 nt, Human
cuggaugaguagcgcuauaguu

SEQ ID NO: 3804049 - RNA, 15 nt, Human
cuggaugauacuaau

SEQ ID NO: 3804050 - RNA, 16 nt, Human
cuggaugauacuaaua

SEQ ID NO: 3804051 - RNA, 18 nt, Human
cuggaugauacuaauaaa

SEQ ID NO: 3804052 - RNA, 20 nt, Human
cuggaugauggucuucagcc

SEQ ID NO: 3804053 - RNA, 15 nt, Human
cuggaugcagccuca

SEQ ID NO: 3804054 - RNA, 16 nt, Human
cuggaugcagccucac

SEQ ID NO: 3804055 - RNA, 12 nt, Human
cuggaugccauc

SEQ ID NO: 3804056 - RNA, 15 nt, Human
cuggaugcccaggaa

SEQ ID NO: 3804057 - RNA, 16 nt, Human
cuggaugcccaggaau

SEQ ID NO: 3804058 - RNA, 15 nt, Human
cuggauggagcccag

SEQ ID NO: 3804059 - RNA, 16 nt, Human
cuggauggggcugcac

SEQ ID NO: 3804060 - RNA, 18 nt, Human
cuggauggugugccuucc

SEQ ID NO: 3804061 - RNA, 21 nt, Human
cuggauggugugccuuccaga

SEQ ID NO: 3804062 - RNA, 19 nt, Human
cuggaugguucccagaggg

SEQ ID NO: 3804063 - RNA, 16 nt, Human
cuggaugucugaacuu

SEQ ID NO: 3804064 - RNA, 17 nt, Human
cuggaugucugaacuuu

SEQ ID NO: 3804065 - RNA, 21 nt, Human
cuggaugucugaacuuuggga

SEQ ID NO: 3804066 - RNA, 13 nt, Human
cuggauuaaacuu

SEQ ID NO: 3804067 - RNA, 23 nt, Human
cuggauuaaacuuaaucuaaaug

SEQ ID NO: 3804068 - RNA, 23 nt, Human
cuggauuauucaaaaugauguau

SEQ ID NO: 3804069 - RNA, 16 nt, Human
cuggauuauucugggg

SEQ ID NO: 3804070 - RNA, 14 nt, Human
cuggauucagccuu

SEQ ID NO: 3804071 - RNA, 15 nt, Human
cugcucuugggcaau

SEQ ID NO: 3804072 - RNA, 19 nt, Human
cugcucuugggcaauauuc

SEQ ID NO: 3804073 - RNA, 15 nt, Human
cugcucuuucucugc

SEQ ID NO: 3804074 - RNA, 16 nt, Human
cugcucuuucucugcc

SEQ ID NO: 3804075 - RNA, 19 nt, Human
cugcucuuucucugccagu

SEQ ID NO: 3804076 - RNA, 20 nt, Human
cugcucuuucucugccagug

SEQ ID NO: 3804077 - RNA, 21 nt, Human
cugcucuuucucugccaguga

SEQ ID NO: 3804078 - RNA, 22 nt, Human
cugcucuuucucugccagugac

SEQ ID NO: 3804079 - RNA, 20 nt, Human
cugcugaaaaccaucuggcc

SEQ ID NO: 3804080 - RNA, 13 nt, Human
cugcugaaacaac

SEQ ID NO: 3804081 - RNA, 20 nt, Human
cugcugaagcugccugcuuu

SEQ ID NO: 3804082 - RNA, 16 nt, Human
cugcugaaggcucauu

SEQ ID NO: 3804083 - RNA, 15 nt, Human
cugcugaaggcucga

SEQ ID NO: 3804084 - RNA, 23 nt, Human
cugcugaaggcucgagcaugccu

SEQ ID NO: 3804085 - RNA, 24 nt, Human
cugcugaaggcucgagcaugccug

SEQ ID NO: 3804086 - RNA, 18 nt, Human
cugcugacagacacaggc

SEQ ID NO: 3804087 - RNA, 19 nt, Human
cugcugacagacacaggcc

SEQ ID NO: 3804088 - RNA, 20 nt, Human
cugcugacagacacaggccc

SEQ ID NO: 3804089 - RNA, 11 nt, Human
cugcugaccaa

SEQ ID NO: 3804090 - RNA, 20 nt, Human
cugcugaccaauugugcugc

SEQ ID NO: 3804091 - RNA, 22 nt, Human
cugcugaccaauugugcugcca

SEQ ID NO: 3804092 - RNA, 22 nt, Human
cugcugacccagccuguuuuaa

SEQ ID NO: 3804093 - RNA, 16 nt, Human
cugcugaccuccacag

SEQ ID NO: 3804094 - RNA, 19 nt, Human
cugcugaccuccacagcuu

SEQ ID NO: 3804095 - RNA, 13 nt, Human
cugcugaccugcu

SEQ ID NO: 3804096 - RNA, 18 nt, Human
cugcugacuguuuucucu

SEQ ID NO: 3804097 - RNA, 14 nt, Human
cugcugagaaccug

SEQ ID NO: 3804098 - RNA, 17 nt, Human
cugcugagaaccuggcc

SEQ ID NO: 3804099 - RNA, 18 nt, Human
cugcugagaaccuggccu

SEQ ID NO: 3804100 - RNA, 16 nt, Human
cugcugagagacccaa

SEQ ID NO: 3804101 - RNA, 16 nt, Human
cugcugagauccugga

SEQ ID NO: 3804102 - RNA, 23 nt, Human
cugcugagauccuggacugaggg

SEQ ID NO: 3804103 - RNA, 15 nt, Human
cugcugagcucugag

SEQ ID NO: 3804104 - RNA, 16 nt, Human
cugcugagcucugaga

SEQ ID NO: 3804105 - RNA, 23 nt, Human
cugcugagcucugagaggcccug

SEQ ID NO: 3804106 - RNA, 17 nt, Human
cugcugagggaccagcc

SEQ ID NO: 3804107 - RNA, 19 nt, Human
cugcugaguccgaccuggc

SEQ ID NO: 3804108 - RNA, 15 nt, Human
cugcugcaaggccuu

SEQ ID NO: 3804109 - RNA, 23 nt, Human
cugcugcaccaacccagccgcug

SEQ ID NO: 3804110 - RNA, 22 nt, Human
cugcugcagaggggcaggcccu

SEQ ID NO: 3804111 - RNA, 20 nt, Human
cugcugcaggggcucuggag

SEQ ID NO: 3804112 - RNA, 14 nt, Human
cugcugcaugcccu

SEQ ID NO: 3804113 - RNA, 15 nt, Human
cugcugcaugcccuc

SEQ ID NO: 3804114 - RNA, 21 nt, Human
cugcugcaugcccucucaggc

SEQ ID NO: 3804115 - RNA, 13 nt, Human
cugcugccacuga

SEQ ID NO: 3804116 - RNA, 18 nt, Human
cugcugccaguaccagcc

SEQ ID NO: 3804117 - RNA, 14 nt, Human
cugcugcccaaucu

SEQ ID NO: 3804118 - RNA, 12 nt, Human
cugcugcccagc

SEQ ID NO: 3804119 - RNA, 13 nt, Human
cugcugcccaggc

SEQ ID NO: 3804120 - RNA, 19 nt, Human
cugcugcccaggcugugca

SEQ ID NO: 3804121 - RNA, 14 nt, Human
cugcugcccccacc

SEQ ID NO: 3804122 - RNA, 12 nt, Human
cugcugcccucc

SEQ ID NO: 3804123 - RNA, 13 nt, Human
cugcugcccucca

SEQ ID NO: 3804124 - RNA, 19 nt, Human
cugcugccgccccacccag

SEQ ID NO: 3804125 - RNA, 17 nt, Human
cugcugccucuuucccu

SEQ ID NO: 3804126 - RNA, 21 nt, Human
cugcugccucuuucccuagga

SEQ ID NO: 3804127 - RNA, 22 nt, Human
cugcugccucuuucccuaggaa

SEQ ID NO: 3804128 - RNA, 11 nt, Human
cugcugccugc

SEQ ID NO: 3804129 - RNA, 21 nt, Human
cugcugccugcccgcacagca

SEQ ID NO: 3804130 - RNA, 14 nt, Human
cugcugccugcuuu

SEQ ID NO: 3804131 - RNA, 12 nt, Human
cugcugccuggc

SEQ ID NO: 3804132 - RNA, 23 nt, Human
cugcugccuggccacugcucccu

SEQ ID NO: 3804133 - RNA, 23 nt, Human
cugcugccuucugacggcccugc

SEQ ID NO: 3804134 - RNA, 16 nt, Human
cugcugcuacaauguc

SEQ ID NO: 3804135 - RNA, 13 nt, Human
cugcugcucccuc

SEQ ID NO: 3804136 - RNA, 17 nt, Human
cugcugcucccucagac

SEQ ID NO: 3804137 - RNA, 21 nt, Human
cugcugcucccucagacuggg

SEQ ID NO: 3804138 - RNA, 22 nt, Human
cugcugcucuuggcuggaccca

SEQ ID NO: 3804139 - RNA, 13 nt, Human
cugcugcugagaa

SEQ ID NO: 3804140 - RNA, 19 nt, Human
cugcugcugagaaccuggc

SEQ ID NO: 3804141 - RNA, 20 nt, Human
cugcugcugagaaccuggcc

SEQ ID NO: 3804142 - RNA, 22 nt, Human
cugcugcugagaaccuggccuu

SEQ ID NO: 3804143 - RNA, 12 nt, Human
cugcugcugccu

SEQ ID NO: 3804144 - RNA, 17 nt, Human
cugcugcugccuggcca

SEQ ID NO: 3804145 - RNA, 16 nt, Human
cugcugcugcgcccuu

SEQ ID NO: 3804146 - RNA, 15 nt, Human
cugcugcugcugcug

SEQ ID NO: 3804147 - RNA, 14 nt, Human
cugcugcugcugug

SEQ ID NO: 3804148 - RNA, 13 nt, Human
cugcugcuggcug

SEQ ID NO: 3804149 - RNA, 14 nt, Human
cugcugcuggcugg

SEQ ID NO: 3804150 - RNA, 13 nt, Human
cugcugcugggcu

SEQ ID NO: 3804151 - RNA, 14 nt, Human
cugcugcugucccu

SEQ ID NO: 3804152 - RNA, 16 nt, Human
cugcugcugucugggu

SEQ ID NO: 3804153 - RNA, 18 nt, Human
cugcugcugucugggugc

SEQ ID NO: 3804154 - RNA, 20 nt, Human
cugcuuugcgugcccggggc

SEQ ID NO: 3804155 - RNA, 21 nt, Human
cugcuuugcgugcccggggca

SEQ ID NO: 3804156 - RNA, 23 nt, Human
cugcuuugcgugcccggggcagc

SEQ ID NO: 3804157 - RNA, 21 nt, Human
cugcuuugcucuucaagaaau

SEQ ID NO: 3804158 - RNA, 22 nt, Human
cugcuuugggauuuaauuucca

SEQ ID NO: 3804159 - RNA, 21 nt, Human
cugcuuugggcugcccuggug

SEQ ID NO: 3804160 - RNA, 19 nt, Human
cugcuuuguuaccuuaaaa

SEQ ID NO: 3804161 - RNA, 20 nt, Human
cugcuuuguugugugccucu

SEQ ID NO: 3804162 - RNA, 15 nt, Human
cugcuuuucccuaag

SEQ ID NO: 3804163 - RNA, 18 nt, Human
cugcuuuucccuaagcca

SEQ ID NO: 3804164 - RNA, 23 nt, Human
cugcuuuuccuuggggcaggcag

SEQ ID NO: 3804165 - RNA, 14 nt, Human
cugcuuuucugccc

SEQ ID NO: 3804166 - RNA, 19 nt, Human
cugcuuuucugcccuggcu

SEQ ID NO: 3804167 - RNA, 21 nt, Human
cugcuuuucugcccuggcugc

SEQ ID NO: 3804168 - RNA, 22 nt, Human
cugcuuuucugcccuggcugcu

SEQ ID NO: 3804169 - RNA, 24 nt, Human
cugcuuuucugcccuggcugcugc

SEQ ID NO: 3804170 - RNA, 21 nt, Human
cugcuuuugucuaugggacuc

SEQ ID NO: 3804171 - RNA, 13 nt, Human
cugcuuuuugaaa

SEQ ID NO: 3804172 - RNA, 18 nt, Human
cugcuuuuugaaaugaaa

SEQ ID NO: 3804173 - RNA, 16 nt, Human
cuggaaaccacagucc

SEQ ID NO: 3804174 - RNA, 17 nt, Human
cuggaaaccuuccaccc

SEQ ID NO: 3804175 - RNA, 11 nt, Human
cuggaaagaag

SEQ ID NO: 3804176 - RNA, 21 nt, Human
cuggaaaggcucagucucagg

SEQ ID NO: 3804177 - RNA, 22 nt, Human
cuggaaaggcucagucucagga

SEQ ID NO: 3804178 - RNA, 15 nt, Human
cuggaaaggggagag

SEQ ID NO: 3804179 - RNA, 17 nt, Human
cuggaaaggggagagcc

SEQ ID NO: 3804180 - RNA, 23 nt, Human
cuggaaaggggagagccugcugg

SEQ ID NO: 3804181 - RNA, 19 nt, Human
cuggaaaggggggagcugg

SEQ ID NO: 3804182 - RNA, 20 nt, Human
cuggaaaggggggagcuggg

SEQ ID NO: 3804183 - RNA, 21 nt, Human
cuggaaaucaggguuaguauu

SEQ ID NO: 3804184 - RNA, 16 nt, Human
cuggaacaaauuauuu

SEQ ID NO: 3804185 - RNA, 17 nt, Human
cuggaacaaauuauuuu

SEQ ID NO: 3804186 - RNA, 21 nt, Human
cuggaacacuagacaagccag

SEQ ID NO: 3804187 - RNA, 17 nt, Human
cuggaacauccuuugca

SEQ ID NO: 3804188 - RNA, 15 nt, Human
cuggaaccaucagaa

SEQ ID NO: 3804189 - RNA, 16 nt, Human
cuggaacccagacuca

SEQ ID NO: 3804190 - RNA, 12 nt, Human
cuggaaccucag

SEQ ID NO: 3804191 - RNA, 23 nt, Human
cuggaaccucagccuggccagac

SEQ ID NO: 3804192 - RNA, 19 nt, Human
cuggaaccuugcuguccug

SEQ ID NO: 3804193 - RNA, 17 nt, Human
cuggaacucagugugac

SEQ ID NO: 3804194 - RNA, 23 nt, Human
cuggaacucuaucugggccuggg

SEQ ID NO: 3804195 - RNA, 16 nt, Human
cuggaacugucucuca

SEQ ID NO: 3804196 - RNA, 16 nt, Human
cuggaacuugaacuga

SEQ ID NO: 3804197 - RNA, 19 nt, Human
cuggaagaacaggccucuc

SEQ ID NO: 3804198 - RNA, 13 nt, Human
cuggaagacagag

SEQ ID NO: 3804199 - RNA, 13 nt, Human
cuggaagagagga

SEQ ID NO: 3804200 - RNA, 12 nt, Human
cuggaagcacag

SEQ ID NO: 3804201 - RNA, 19 nt, Human
cuggaagcacagaaaacua

SEQ ID NO: 3804202 - RNA, 22 nt, Human
cuggaagcacagaaaacuagaa

SEQ ID NO: 3804203 - RNA, 15 nt, Human
cuggaagcacauguu

SEQ ID NO: 3804204 - RNA, 14 nt, Human
cuggaagcagugcc

SEQ ID NO: 3804205 - RNA, 17 nt, Human
cuggaagcagugcccag

SEQ ID NO: 3804206 - RNA, 22 nt, Human
cuggaagcauuuguuucuacuu

SEQ ID NO: 3804207 - RNA, 17 nt, Human
cuggaagccagcuuucc

SEQ ID NO: 3804208 - RNA, 22 nt, Human
cuggaagcuaauuugcauuaaa

SEQ ID NO: 3804209 - RNA, 21 nt, Human
cuggaagcuuuguccccugcu

SEQ ID NO: 3804210 - RNA, 17 nt, Human
cuggaaggggcccgugg

SEQ ID NO: 3804211 - RNA, 19 nt, Human
cuggaaggggcccguggga

SEQ ID NO: 3804212 - RNA, 16 nt, Human
cuggaaguccaaugug

SEQ ID NO: 3804213 - RNA, 20 nt, Human
cuggaagugcuaauuuugaa

SEQ ID NO: 3804214 - RNA, 13 nt, Human
cuggaauaagaag

SEQ ID NO: 3804215 - RNA, 21 nt, Human
cuggaauaagaagcaaauaaa

SEQ ID NO: 3804216 - RNA, 19 nt, Human
cuggaaucuggagaccagg

SEQ ID NO: 3804217 - RNA, 20 nt, Human
cuggaauggaaggguucugg

SEQ ID NO: 3804218 - RNA, 23 nt, Human
cuggaauuccuaacuuuucaaug

SEQ ID NO: 3804219 - RNA, 21 nt, Human
cuggaauuugcaagucauggc

SEQ ID NO: 3804220 - RNA, 13 nt, Human
cuggaauuuuuau

SEQ ID NO: 3804221 - RNA, 15 nt, Human
cuggaauuuuuuauu

SEQ ID NO: 3804222 - RNA, 17 nt, Human
cuggaauuuuuuauucu

SEQ ID NO: 3804223 - RNA, 18 nt, Human
cuggaauuuuuuauucuu

SEQ ID NO: 3804224 - RNA, 15 nt, Human
cuggacaagcagagg

SEQ ID NO: 3804225 - RNA, 14 nt, Human
cuggacacaggccu

SEQ ID NO: 3804226 - RNA, 13 nt, Human
cuggacagagggg

SEQ ID NO: 3804227 - RNA, 14 nt, Human
cuggacagagggga

SEQ ID NO: 3804228 - RNA, 22 nt, Human
cuggacagaggggacucugggc

SEQ ID NO: 3804229 - RNA, 14 nt, Human
cuggacagccccac

SEQ ID NO: 3804230 - RNA, 16 nt, Human
cuggacagcugugccu

SEQ ID NO: 3804231 - RNA, 17 nt, Human
cuggacagcugugccuc

SEQ ID NO: 3804232 - RNA, 18 nt, Human
cuggacagcugugccucg

SEQ ID NO: 3804233 - RNA, 20 nt, Human
cuggacagcugugccucgcu

SEQ ID NO: 3804234 - RNA, 12 nt, Human
cuggacagcuug

SEQ ID NO: 3804235 - RNA, 14 nt, Human
ccucccuucucccu

SEQ ID NO: 3804236 - RNA, 15 nt, Human
ccucccuucucccug

SEQ ID NO: 3804237 - RNA, 17 nt, Human
ccucccuucucccugga

SEQ ID NO: 3804238 - RNA, 17 nt, Human
ccucccuucugcuacug

SEQ ID NO: 3804239 - RNA, 12 nt, Human
ccucccuuucuc

SEQ ID NO: 3804240 - RNA, 17 nt, Human
ccucccuuuuuccuugu

SEQ ID NO: 3804241 - RNA, 18 nt, Human
ccucccuuuuuccuuguc

SEQ ID NO: 3804242 - RNA, 19 nt, Human
ccucccuuuuuccuugucc

SEQ ID NO: 3804243 - RNA, 20 nt, Human
ccuccgacagcccccucugc

SEQ ID NO: 3804244 - RNA, 20 nt, Human
ccuccgaccacuuccagggg

SEQ ID NO: 3804245 - RNA, 15 nt, Human
ccuccgauccuuccu

SEQ ID NO: 3804246 - RNA, 18 nt, Human
ccuccgccaaugcacggc

SEQ ID NO: 3804247 - RNA, 20 nt, Human
ccuccgccaaugcacggccu

SEQ ID NO: 3804248 - RNA, 14 nt, Human
ccuccgccaggcga

SEQ ID NO: 3804249 - RNA, 14 nt, Human
ccuccgccauccac

SEQ ID NO: 3804250 - RNA, 13 nt, Human
ccuccgcccugcc

SEQ ID NO: 3804251 - RNA, 15 nt, Human
ccuccgcccugccac

SEQ ID NO: 3804252 - RNA, 18 nt, Human
ccuccgcccugccacuca

SEQ ID NO: 3804253 - RNA, 19 nt, Human
ccuccgccuucacuccggu

SEQ ID NO: 3804254 - RNA, 15 nt, Human
ccuccgcggcgggcc

SEQ ID NO: 3804255 - RNA, 13 nt, Human
ccuccggacuggu

SEQ ID NO: 3804256 - RNA, 21 nt, Human
ccuccggccaggugccuccug

SEQ ID NO: 3804257 - RNA, 12 nt, Human
ccuccggccucc

SEQ ID NO: 3804258 - RNA, 15 nt, Human
ccuccggccuccccu

SEQ ID NO: 3804259 - RNA, 17 nt, Human
ccuccggcgucagccuc

SEQ ID NO: 3804260 - RNA, 23 nt, Human
ccuccggcgucagccuccagccu

SEQ ID NO: 3804261 - RNA, 15 nt, Human
ccuccgggaccccca

SEQ ID NO: 3804262 - RNA, 16 nt, Human
ccuccguauuucagac

SEQ ID NO: 3804263 - RNA, 19 nt, Human
ccuccgucacuaccuggcu

SEQ ID NO: 3804264 - RNA, 15 nt, Human
ccuccguccauauca

SEQ ID NO: 3804265 - RNA, 15 nt, Human
ccuccuaaaaggccc

SEQ ID NO: 3804266 - RNA, 21 nt, Human
ccuccuaccccucccagcuga

SEQ ID NO: 3804267 - RNA, 19 nt, Human
ccuccuaccgaaaccuugc

SEQ ID NO: 3804268 - RNA, 15 nt, Human
ccuccuagccaccca

SEQ ID NO: 3804269 - RNA, 20 nt, Human
ccuccuagggaaaaguucau

SEQ ID NO: 3804270 - RNA, 20 nt, Human
ccuccuagggcauuguaucu

SEQ ID NO: 3804271 - RNA, 19 nt, Human
ccuccuauucuauaaaacu

SEQ ID NO: 3804272 - RNA, 13 nt, Human
ccuccucaccccc

SEQ ID NO: 3804273 - RNA, 16 nt, Human
ccuccucacccccagc

SEQ ID NO: 3804274 - RNA, 13 nt, Human
ccuccucaccuca

SEQ ID NO: 3804275 - RNA, 16 nt, Human
ccuccucaccucaugc

SEQ ID NO: 3804276 - RNA, 13 nt, Human
ccuccucaccucu

SEQ ID NO: 3804277 - RNA, 14 nt, Human
ccuccucagaucuu

SEQ ID NO: 3804278 - RNA, 23 nt, Human
ccuccucaucccguguucuccuu

SEQ ID NO: 3804279 - RNA, 19 nt, Human
ccuccuccaaaggcccccu

SEQ ID NO: 3804280 - RNA, 14 nt, Human
ccuccuccaccacc

SEQ ID NO: 3804281 - RNA, 18 nt, Human
ccuccuccaccaccgccc

SEQ ID NO: 3804282 - RNA, 17 nt, Human
ccuccuccaccucaccu

SEQ ID NO: 3804283 - RNA, 18 nt, Human
ccuccuccagccccuguc

SEQ ID NO: 3804284 - RNA, 18 nt, Human
ccuccuccagggacagca

SEQ ID NO: 3804285 - RNA, 23 nt, Human
ccuccucccacccggcugcagag

SEQ ID NO: 3804286 - RNA, 12 nt, Human
ccuccucccaug

SEQ ID NO: 3804287 - RNA, 13 nt, Human
ccuccucccaugu

SEQ ID NO: 3804288 - RNA, 18 nt, Human
ccuccucccaugucacug

SEQ ID NO: 3804289 - RNA, 13 nt, Human
ccuccuccccacu

SEQ ID NO: 3804290 - RNA, 14 nt, Human
ccuccuccccacuu

SEQ ID NO: 3804291 - RNA, 14 nt, Human
ccuccucccucccu

SEQ ID NO: 3804292 - RNA, 17 nt, Human
ccuccucccugcaucug

SEQ ID NO: 3804293 - RNA, 14 nt, Human
ccuccucccuuagc

SEQ ID NO: 3804294 - RNA, 12 nt, Human
ccuccuccugac

SEQ ID NO: 3804295 - RNA, 13 nt, Human
ccuccuccuuccc

SEQ ID NO: 3804296 - RNA, 15 nt, Human
ccuccuccuuccuag

SEQ ID NO: 3804297 - RNA, 17 nt, Human
ccuccucggcuggcugu

SEQ ID NO: 3804298 - RNA, 21 nt, Human
ccuccucuaacaggggcuggu

SEQ ID NO: 3804299 - RNA, 19 nt, Human
cuggccuggcccugcccug

SEQ ID NO: 3804300 - RNA, 21 nt, Human
cuggccuggcccugcccugag

SEQ ID NO: 3804301 - RNA, 23 nt, Human
cuggccuggcccugcccugagga

SEQ ID NO: 3804302 - RNA, 13 nt, Human
cuggccuggccug

SEQ ID NO: 3804303 - RNA, 17 nt, Human
cuggccuggccuggccc

SEQ ID NO: 3804304 - RNA, 16 nt, Human
cuggccuggggucagg

SEQ ID NO: 3804305 - RNA, 18 nt, Human
cuggccugucugugaaga

SEQ ID NO: 3804306 - RNA, 17 nt, Human
cuggccuuccacuuggc

SEQ ID NO: 3804307 - RNA, 17 nt, Human
cuggccuucggccucca

SEQ ID NO: 3804308 - RNA, 19 nt, Human
cuggccuugggauccaggc

SEQ ID NO: 3804309 - RNA, 22 nt, Human
cuggccuugggauccaggcccc

SEQ ID NO: 3804310 - RNA, 15 nt, Human
cuggccuuguccuca

SEQ ID NO: 3804311 - RNA, 19 nt, Human
cuggccuuuguaagugcag

SEQ ID NO: 3804312 - RNA, 21 nt, Human
cuggccuuuuucauuuaucua

SEQ ID NO: 3804313 - RNA, 13 nt, Human
cuggcgcagccaa

SEQ ID NO: 3804314 - RNA, 13 nt, Human
cuggcgcaggugg

SEQ ID NO: 3804315 - RNA, 21 nt, Human
cuggcgccaacaacuucucca

SEQ ID NO: 3804316 - RNA, 22 nt, Human
cuggcgccaacaacuucuccau

SEQ ID NO: 3804317 - RNA, 19 nt, Human
cuggcgccaucgccgggac

SEQ ID NO: 3804318 - RNA, 15 nt, Human
cuggcgccuccgagg

SEQ ID NO: 3804319 - RNA, 18 nt, Human
cuggcggcugggguccca

SEQ ID NO: 3804320 - RNA, 13 nt, Human
cuggcgggauggg

SEQ ID NO: 3804321 - RNA, 19 nt, Human
cuggcgggaugggccaccg

SEQ ID NO: 3804322 - RNA, 15 nt, Human
cuggcggggggccca

SEQ ID NO: 3804323 - RNA, 16 nt, Human
cuggcggggggcccau

SEQ ID NO: 3804324 - RNA, 22 nt, Human
cuggcguagaaguuuuuguacu

SEQ ID NO: 3804325 - RNA, 13 nt, Human
cuggcgucugucu

SEQ ID NO: 3804326 - RNA, 14 nt, Human
cuggcgucugucuu

SEQ ID NO: 3804327 - RNA, 15 nt, Human
cuggcgugcaguggu

SEQ ID NO: 3804328 - RNA, 20 nt, Human
cuggcuaaagauaauugcua

SEQ ID NO: 3804329 - RNA, 20 nt, Human
cuggcuagaggccagcccca

SEQ ID NO: 3804330 - RNA, 17 nt, Human
cuggcuagaguccucac

SEQ ID NO: 3804331 - RNA, 19 nt, Human
cuggcuagaguccucacuc

SEQ ID NO: 3804332 - RNA, 18 nt, Human
cuggcuauagaugucuuu

SEQ ID NO: 3804333 - RNA, 23 nt, Human
cuggcuaucaaagaauaagaaaa

SEQ ID NO: 3804334 - RNA, 14 nt, Human
cuggcuaugcauuu

SEQ ID NO: 3804335 - RNA, 23 nt, Human
cuggcucacacuuggcucugagg

SEQ ID NO: 3804336 - RNA, 12 nt, Human
cuggcucacaga

SEQ ID NO: 3804337 - RNA, 16 nt, Human
cuggcucacagacugg

SEQ ID NO: 3804338 - RNA, 19 nt, Human
cuggcucacagacuggaga

SEQ ID NO: 3804339 - RNA, 16 nt, Human
cuggcucacaguacag

SEQ ID NO: 3804340 - RNA, 19 nt, Human
cuggcucacaguacagcau

SEQ ID NO: 3804341 - RNA, 14 nt, Human
cuggcucacccagu

SEQ ID NO: 3804342 - RNA, 21 nt, Human
cuggcucagguggggucacuc

SEQ ID NO: 3804343 - RNA, 20 nt, Human
cuggcucauauuccugcagc

SEQ ID NO: 3804344 - RNA, 22 nt, Human
cuggcucauauuccugcagccu

SEQ ID NO: 3804345 - RNA, 23 nt, Human
cuggcucauauuccugcagccug

SEQ ID NO: 3804346 - RNA, 24 nt, Human
cuggcucauauuccugcagccugg

SEQ ID NO: 3804347 - RNA, 19 nt, Human
cuggcuccaaacccucgag

SEQ ID NO: 3804348 - RNA, 21 nt, Human
cuggcuccagaugcagggcag

SEQ ID NO: 3804349 - RNA, 13 nt, Human
cuggcuccagccu

SEQ ID NO: 3804350 - RNA, 14 nt, Human
cuggcuccagcugg

SEQ ID NO: 3804351 - RNA, 17 nt, Human
cuggcuccagugaaacu

SEQ ID NO: 3804352 - RNA, 15 nt, Human
cuggcucccacaggc

SEQ ID NO: 3804353 - RNA, 18 nt, Human
cuggcucccacaggcagc

SEQ ID NO: 3804354 - RNA, 19 nt, Human
cuggcucccacaggcccuu

SEQ ID NO: 3804355 - RNA, 14 nt, Human
cuggcucccagggc

SEQ ID NO: 3804356 - RNA, 13 nt, Human
cuggcuccccugc

SEQ ID NO: 3804357 - RNA, 19 nt, Human
cuggcuccccugcagcccu

SEQ ID NO: 3804358 - RNA, 15 nt, Human
cuggcuccccugggg

SEQ ID NO: 3804359 - RNA, 18 nt, Human
cuggcucccucacucuca

SEQ ID NO: 3804360 - RNA, 20 nt, Human
cuggcucccucacucucagg

SEQ ID NO: 3804361 - RNA, 21 nt, Human
cuggcucccuccuccaggccu

SEQ ID NO: 3804362 - RNA, 23 nt, Human
cuggcucccuccuccaggccugc

SEQ ID NO: 3804363 - RNA, 14 nt, Human
cuggcucccucuug

SEQ ID NO: 3804364 - RNA, 17 nt, Human
cuggcuccucuguggug

SEQ ID NO: 3804365 - RNA, 18 nt, Human
cuggcuccucuguggugu

SEQ ID NO: 3804366 - RNA, 22 nt, Human
cuggcuccucuguggugucugc

SEQ ID NO: 3804367 - RNA, 17 nt, Human
cuggcuccugaggggca

SEQ ID NO: 3804368 - RNA, 22 nt, Human
cuggcuccuuuacaaaagaaau

SEQ ID NO: 3804369 - RNA, 15 nt, Human
cuggcucuaauucac

SEQ ID NO: 3804370 - RNA, 13 nt, Human
cuggcucuacaca

SEQ ID NO: 3804371 - RNA, 16 nt, Human
cuggcucuacacauau

SEQ ID NO: 3804372 - RNA, 14 nt, Human
cuggcucucaccuc

SEQ ID NO: 3804373 - RNA, 19 nt, Human
cuggcucucaccucuaggu

SEQ ID NO: 3804374 - RNA, 13 nt, Human
cuggcucuccaag

SEQ ID NO: 3804375 - RNA, 14 nt, Human
cuggcucuccaagu

SEQ ID NO: 3804376 - RNA, 15 nt, Human
cuggcucuccaagug

SEQ ID NO: 3804377 - RNA, 16 nt, Human
cuggcucuccaagugc

SEQ ID NO: 3804378 - RNA, 17 nt, Human
cuggcucuccuggcccu

SEQ ID NO: 3804379 - RNA, 15 nt, Human
cuggcucucuccagg

SEQ ID NO: 3804380 - RNA, 20 nt, Human
cuggcucugagcgccuccau

SEQ ID NO: 3804381 - RNA, 14 nt, Human
cuggcucuguggcg

SEQ ID NO: 3804382 - RNA, 14 nt, Human
cuggcucuuccagg

SEQ ID NO: 3804383 - RNA, 15 nt, Human
cuggcucuucugccc

SEQ ID NO: 3804384 - RNA, 16 nt, Human
cuggcucuucugccca

SEQ ID NO: 3804385 - RNA, 20 nt, Human
cuggcucuugauaccccccu

SEQ ID NO: 3804386 - RNA, 21 nt, Human
cuggcucuugauaccccccuc

SEQ ID NO: 3804387 - RNA, 22 nt, Human
cuggcucuugauaccccccucu

SEQ ID NO: 3804388 - RNA, 20 nt, Human
cuggcucuugugcuggaugg

SEQ ID NO: 3804389 - RNA, 20 nt, Human
cuggcucuuucgucacccuu

SEQ ID NO: 3804390 - RNA, 17 nt, Human
cuggcugaacccugugc

SEQ ID NO: 3804391 - RNA, 21 nt, Human
cuggcugaacccugugcuggu

SEQ ID NO: 3804392 - RNA, 12 nt, Human
cuggcugaagga

SEQ ID NO: 3804393 - RNA, 15 nt, Human
cuggcugaaggacug

SEQ ID NO: 3804394 - RNA, 16 nt, Human
cuggcugaaggacugu

SEQ ID NO: 3804395 - RNA, 16 nt, Human
cuggcugagccuggcu

SEQ ID NO: 3804396 - RNA, 13 nt, Human
cuggcugagcuga

SEQ ID NO: 3804397 - RNA, 13 nt, Human
cuggcugagggca

SEQ ID NO: 3804398 - RNA, 15 nt, Human
cuggcugagggcagu

SEQ ID NO: 3804399 - RNA, 22 nt, Human
cuggcugagguuccucugccug

SEQ ID NO: 3804400 - RNA, 23 nt, Human
cuggcugagguuccucugccugc

SEQ ID NO: 3804401 - RNA, 16 nt, Human
cuggcugccagcuauu

SEQ ID NO: 3804402 - RNA, 18 nt, Human
cuggcugcccagaccccu

SEQ ID NO: 3804403 - RNA, 16 nt, Human
cuggcugccccaaccu

SEQ ID NO: 3804404 - RNA, 19 nt, Human
cuggcugcccuggcccuga

SEQ ID NO: 3804405 - RNA, 15 nt, Human
cuggcugccuccacu

SEQ ID NO: 3804406 - RNA, 20 nt, Human
cuggcugccuccacucccac

SEQ ID NO: 3804407 - RNA, 20 nt, Human
cuggcugcugaucgccuucc

SEQ ID NO: 3804408 - RNA, 16 nt, Human
cuggcugcugccccca

SEQ ID NO: 3804409 - RNA, 19 nt, Human
cuggcugcugcccccaccc

SEQ ID NO: 3804410 - RNA, 13 nt, Human
cuggcugcuugcc

SEQ ID NO: 3804411 - RNA, 19 nt, Human
cuggcuggagaauguggag

SEQ ID NO: 3804412 - RNA, 18 nt, Human
cuggcuggagccuagaac

SEQ ID NO: 3804413 - RNA, 13 nt, Human
cuggcuggccuca

SEQ ID NO: 3804414 - RNA, 17 nt, Human
cuggcuggccucaccca

SEQ ID NO: 3804415 - RNA, 21 nt, Human
cuggcuggccuugugguccaa

SEQ ID NO: 3804416 - RNA, 11 nt, Human
cuggcuggcug

SEQ ID NO: 3804417 - RNA, 15 nt, Human
cuggcuggcugcagu

SEQ ID NO: 3804418 - RNA, 17 nt, Human
cuggcuggcugcaguga

SEQ ID NO: 3804419 - RNA, 15 nt, Human
cuggcugggcaugga

SEQ ID NO: 3804420 - RNA, 22 nt, Human
cuggcugggggccucacuccag

SEQ ID NO: 3804421 - RNA, 20 nt, Human
cuggcugggguggccugugu

SEQ ID NO: 3804422 - RNA, 21 nt, Human
cuggcugggguggccugugug

SEQ ID NO: 3804423 - RNA, 21 nt, Human
cuggcugguguuaacagaagg

SEQ ID NO: 3804424 - RNA, 20 nt, Human
cuggcugguuagagguuccc

SEQ ID NO: 3804425 - RNA, 16 nt, Human
cuggcuguaaggcucu

SEQ ID NO: 3804426 - RNA, 19 nt, Human
cuggcuguaaggcucuaga

SEQ ID NO: 3804427 - RNA, 14 nt, Human
cuggcuguccaccc

SEQ ID NO: 3804428 - RNA, 12 nt, Human
cuggcugugggc

SEQ ID NO: 3804429 - RNA, 17 nt, Human
cuggcugugggcucccu

SEQ ID NO: 3804430 - RNA, 18 nt, Human
ccucugggaaccucccag

SEQ ID NO: 3804431 - RNA, 19 nt, Human
ccucugggaaccucccaga

SEQ ID NO: 3804432 - RNA, 20 nt, Human
ccucugggaaccucccagag

SEQ ID NO: 3804433 - RNA, 22 nt, Human
ccucugggaaccucccagaggu

SEQ ID NO: 3804434 - RNA, 12 nt, Human
ccucugggacug

SEQ ID NO: 3804435 - RNA, 16 nt, Human
ccucugggcaggaccu

SEQ ID NO: 3804436 - RNA, 15 nt, Human
ccucugggggguggc

SEQ ID NO: 3804437 - RNA, 19 nt, Human
ccucugguaaccucuuacu

SEQ ID NO: 3804438 - RNA, 16 nt, Human
ccucuggucgcuccug

SEQ ID NO: 3804439 - RNA, 21 nt, Human
ccucuggucgcuccugcccac

SEQ ID NO: 3804440 - RNA, 17 nt, Human
ccucuguacagagccca

SEQ ID NO: 3804441 - RNA, 23 nt, Human
ccucuguacagagcccacgcccc

SEQ ID NO: 3804442 - RNA, 17 nt, Human
ccucuguaccccaugac

SEQ ID NO: 3804443 - RNA, 20 nt, Human
cuggggagcccgucucagug

SEQ ID NO: 3804444 - RNA, 23 nt, Human
cuggggauccccgccuggccagg

SEQ ID NO: 3804445 - RNA, 17 nt, Human
cuggggaugucucucau

SEQ ID NO: 3804446 - RNA, 17 nt, Human
cuggggaugugggaggg

SEQ ID NO: 3804447 - RNA, 18 nt, Human
cuggggauugggccccug

SEQ ID NO: 3804448 - RNA, 14 nt, Human
cuggggcaaguccc

SEQ ID NO: 3804449 - RNA, 23 nt, Human
cuggggcaggaggggagugaggc

SEQ ID NO: 3804450 - RNA, 12 nt, Human
cuggggcaggcu

SEQ ID NO: 3804451 - RNA, 17 nt, Human
cuggggcaggcugggcc

SEQ ID NO: 3804452 - RNA, 19 nt, Human
cuggggcauccaugggguc

SEQ ID NO: 3804453 - RNA, 18 nt, Human
cuggggccacacagaaac

SEQ ID NO: 3804454 - RNA, 12 nt, Human
cuggggccaggc

SEQ ID NO: 3804455 - RNA, 15 nt, Human
cuggggccccaccgu

SEQ ID NO: 3804456 - RNA, 19 nt, Human
cuggggccuagacucugua

SEQ ID NO: 3804457 - RNA, 22 nt, Human
cuggggccuagcgaucucuccu

SEQ ID NO: 3804458 - RNA, 17 nt, Human
cuggggccuaucagugu

SEQ ID NO: 3804459 - RNA, 19 nt, Human
cuggggccucggagccuca

SEQ ID NO: 3804460 - RNA, 12 nt, Human
cuggggccugac

SEQ ID NO: 3804461 - RNA, 20 nt, Human
cuggggccugacugcucaga

SEQ ID NO: 3804462 - RNA, 14 nt, Human
cuggggccugagag

SEQ ID NO: 3804463 - RNA, 19 nt, Human
cuggggccuggcagggagg

SEQ ID NO: 3804464 - RNA, 14 nt, Human
cuggggccuguacu

SEQ ID NO: 3804465 - RNA, 20 nt, Human
cuggggccuguacugccugc

SEQ ID NO: 3804466 - RNA, 23 nt, Human
cuggggccuguacugccugcuug

SEQ ID NO: 3804467 - RNA, 17 nt, Human
cuggggcgcgugaggcc

SEQ ID NO: 3804468 - RNA, 18 nt, Human
cuggggcgggccccucau

SEQ ID NO: 3804469 - RNA, 15 nt, Human
cuggggcguggggag

SEQ ID NO: 3804470 - RNA, 13 nt, Human
cuggggcucagag

SEQ ID NO: 3804471 - RNA, 14 nt, Human
cuggggcucagagc

SEQ ID NO: 3804472 - RNA, 17 nt, Human
cuggggcucagagccgg

SEQ ID NO: 3804473 - RNA, 14 nt, Human
cuggggcucugugc

SEQ ID NO: 3804474 - RNA, 20 nt, Human
cuggggcugaggcugaggca

SEQ ID NO: 3804475 - RNA, 14 nt, Human
cuggggcuggccuc

SEQ ID NO: 3804476 - RNA, 12 nt, Human
cuggggcugggc

SEQ ID NO: 3804477 - RNA, 13 nt, Human
cugggggaagaag

SEQ ID NO: 3804478 - RNA, 15 nt, Human
cugggggaagaagcu

SEQ ID NO: 3804479 - RNA, 20 nt, Human
cugggggacccaauguagga

SEQ ID NO: 3804480 - RNA, 14 nt, Human
cugggggaguggaa

SEQ ID NO: 3804481 - RNA, 13 nt, Human
cugggggaugggc

SEQ ID NO: 3804482 - RNA, 17 nt, Human
cugggggcaacuggcca

SEQ ID NO: 3804483 - RNA, 18 nt, Human
cugggggcacaagacuga

SEQ ID NO: 3804484 - RNA, 22 nt, Human
cugggggcacaagacugacgcc

SEQ ID NO: 3804485 - RNA, 13 nt, Human
cugggggcacagg

SEQ ID NO: 3804486 - RNA, 20 nt, Human
cugggggcagccugcguggc

SEQ ID NO: 3804487 - RNA, 14 nt, Human
cugggggcaggagg

SEQ ID NO: 3804488 - RNA, 22 nt, Human
cugggggccaugagcuccagac

SEQ ID NO: 3804489 - RNA, 13 nt, Human
cugggggccucac

SEQ ID NO: 3804490 - RNA, 16 nt, Human
cugggggccucacucc

SEQ ID NO: 3804491 - RNA, 17 nt, Human
cugggggccucagugcc

SEQ ID NO: 3804492 - RNA, 18 nt, Human
cugggggccucagugcca

SEQ ID NO: 3804493 - RNA, 12 nt, Human
cugggggccuga

SEQ ID NO: 3804494 - RNA, 14 nt, Human
cugggggccuggcu

SEQ ID NO: 3804495 - RNA, 17 nt, Human
cugggggccuggcuggc

SEQ ID NO: 3804496 - RNA, 23 nt, Human
cugggggccuggcuggcugaggg

SEQ ID NO: 3804497 - RNA, 18 nt, Human
cugggggcugaggagcag

SEQ ID NO: 3804498 - RNA, 19 nt, Human
cugggggcugggcagagga

SEQ ID NO: 3804499 - RNA, 16 nt, Human
cuggggggacccagug

SEQ ID NO: 3804500 - RNA, 17 nt, Human
cuggggggacccagugc

SEQ ID NO: 3804501 - RNA, 18 nt, Human
cuggggggacccagugca

SEQ ID NO: 3804502 - RNA, 19 nt, Human
cuggggggacccagugcag

SEQ ID NO: 3804503 - RNA, 22 nt, Human
cugggggggauuguaaaauggu

SEQ ID NO: 3804504 - RNA, 13 nt, Human
cugggggguggcc

SEQ ID NO: 3804505 - RNA, 17 nt, Human
cugggggguggccaggc

SEQ ID NO: 3804506 - RNA, 19 nt, Human
cugggggguggccaggccg

SEQ ID NO: 3804507 - RNA, 14 nt, Human
cugggggugccagg

SEQ ID NO: 3804508 - RNA, 19 nt, Human
cugggggugccaggaccag

SEQ ID NO: 3804509 - RNA, 15 nt, Human
cugggggugggccag

SEQ ID NO: 3804510 - RNA, 17 nt, Human
cugggggugggccaggc

SEQ ID NO: 3804511 - RNA, 20 nt, Human
cuggggguucuuucuuccuc

SEQ ID NO: 3804512 - RNA, 23 nt, Human
cuggggguucuuucuuccucugc

SEQ ID NO: 3804513 - RNA, 12 nt, Human
cuggggucccca

SEQ ID NO: 3804514 - RNA, 17 nt, Human
cugggguccccagggcu

SEQ ID NO: 3804515 - RNA, 18 nt, Human
cugggguccuggggccuc

SEQ ID NO: 3804516 - RNA, 19 nt, Human
cugggguccuggggccucg

SEQ ID NO: 3804517 - RNA, 21 nt, Human
cuggggugacccggcaccccc

SEQ ID NO: 3804518 - RNA, 15 nt, Human
cuggggugccgccug

SEQ ID NO: 3804519 - RNA, 16 nt, Human
cuggggugccgccugc

SEQ ID NO: 3804520 - RNA, 16 nt, Human
cugggguggccaccag

SEQ ID NO: 3804521 - RNA, 12 nt, Human
cugggguggccu

SEQ ID NO: 3804522 - RNA, 16 nt, Human
cuggggugggcaguuu

SEQ ID NO: 3804523 - RNA, 13 nt, Human
cuggggugggguc

SEQ ID NO: 3804524 - RNA, 20 nt, Human
cugggguguuaguggcaccg

SEQ ID NO: 3804525 - RNA, 19 nt, Human
cugggguucagccccuccu

SEQ ID NO: 3804526 - RNA, 21 nt, Human
cugggguucagccccuccucu

SEQ ID NO: 3804527 - RNA, 16 nt, Human
cuggguaaaugcaaag

SEQ ID NO: 3804528 - RNA, 20 nt, Human
cuggguaacuagggaagaua

SEQ ID NO: 3804529 - RNA, 16 nt, Human
cuggguacgagggaug

SEQ ID NO: 3804530 - RNA, 18 nt, Human
cuggguacugaaagccuu

SEQ ID NO: 3804531 - RNA, 15 nt, Human
cuggguacuucuuga

SEQ ID NO: 3804532 - RNA, 20 nt, Human
cuggguacuucuugaaggug

SEQ ID NO: 3804533 - RNA, 14 nt, Human
cuggguacuugugg

SEQ ID NO: 3804534 - RNA, 19 nt, Human
cuggguacuuguggacaca

SEQ ID NO: 3804535 - RNA, 20 nt, Human
cuggguacuuguggacacag

SEQ ID NO: 3804536 - RNA, 14 nt, Human
cuggguaggaaaga

SEQ ID NO: 3804537 - RNA, 17 nt, Human
cuggguaggaaagagga

SEQ ID NO: 3804538 - RNA, 19 nt, Human
cuggguauuggaaauggau

SEQ ID NO: 3804539 - RNA, 14 nt, Human
cugggucacacacg

SEQ ID NO: 3804540 - RNA, 21 nt, Human
cuggguccaggggaugggagg

SEQ ID NO: 3804541 - RNA, 18 nt, Human
cuggguccuugcaccccu

SEQ ID NO: 3804542 - RNA, 23 nt, Human
cuggguccuugcaccccucacuc

SEQ ID NO: 3804543 - RNA, 19 nt, Human
cuggguccuuuucagaagu

SEQ ID NO: 3804544 - RNA, 15 nt, Human
cugggucgcccugga

SEQ ID NO: 3804545 - RNA, 17 nt, Human
cugggucgcccuggacu

SEQ ID NO: 3804546 - RNA, 18 nt, Human
cugggucgcccuggacug

SEQ ID NO: 3804547 - RNA, 22 nt, Human
cugggugacagagcaagacucu

SEQ ID NO: 3804548 - RNA, 14 nt, Human
cugggugacauuug

SEQ ID NO: 3804549 - RNA, 21 nt, Human
cugggugacauuugggagaca

SEQ ID NO: 3804550 - RNA, 15 nt, Human
cugggugcagcugag

SEQ ID NO: 3804551 - RNA, 14 nt, Human
cugggugcaggagc

SEQ ID NO: 3804552 - RNA, 21 nt, Human
cugggugccccguccacggcu

SEQ ID NO: 3804553 - RNA, 19 nt, Human
cugggugcgaccccaucug

SEQ ID NO: 3804554 - RNA, 23 nt, Human
cuggguggcaccagcagccugga

SEQ ID NO: 3804555 - RNA, 14 nt, Human
cuggguggcacugc

SEQ ID NO: 3804556 - RNA, 15 nt, Human
cuggguggcacugcc

SEQ ID NO: 3804557 - RNA, 12 nt, Human
cuggguggccca

SEQ ID NO: 3804558 - RNA, 13 nt, Human
cuggguggcccau

SEQ ID NO: 3804559 - RNA, 21 nt, Human
cuggguggcccauccccccuc

SEQ ID NO: 3804560 - RNA, 19 nt, Human
cuggguggccucgggacac

SEQ ID NO: 3804561 - RNA, 17 nt, Human
cuggguggcuacucugu

SEQ ID NO: 3804562 - RNA, 20 nt, Human
cuggguggcuacucugugcc

SEQ ID NO: 3804563 - RNA, 15 nt, Human
cuggguggcucacuc

SEQ ID NO: 3804564 - RNA, 13 nt, Human
cugggugggcucu

SEQ ID NO: 3804565 - RNA, 15 nt, Human
cugggugggcucugu

SEQ ID NO: 3804566 - RNA, 15 nt, Human
cuggguggggcagug

SEQ ID NO: 3804567 - RNA, 15 nt, Human
cuggguggguggugg

SEQ ID NO: 3804568 - RNA, 22 nt, Human
cugggugggugguggggagggg

SEQ ID NO: 3804569 - RNA, 13 nt, Human
cuggguggucugc

SEQ ID NO: 3804570 - RNA, 20 nt, Human
cuggguguaaaaccuggaga

SEQ ID NO: 3804571 - RNA, 20 nt, Human
cuggguguccccgcugcugu

SEQ ID NO: 3804572 - RNA, 21 nt, Human
cuggguguccccgcugcugug

SEQ ID NO: 3804573 - RNA, 16 nt, Human
cuggguguggcgcagc

SEQ ID NO: 3804574 - RNA, 21 nt, Human
cuggguucccuuuccuuccau

SEQ ID NO: 3804575 - RNA, 13 nt, Human
cuggguuccugca

SEQ ID NO: 3804576 - RNA, 17 nt, Human
cuggguucuacccaggu

SEQ ID NO: 3804577 - RNA, 15 nt, Human
cuggguugcagacag

SEQ ID NO: 3804578 - RNA, 17 nt, Human
cuggguugccuuuauuu

SEQ ID NO: 3804579 - RNA, 16 nt, Human
cuggguugcgggacag

SEQ ID NO: 3804580 - RNA, 20 nt, Human
cuggguugcgggacagagua

SEQ ID NO: 3804581 - RNA, 15 nt, Human
cuggguuggagggug

SEQ ID NO: 3804582 - RNA, 18 nt, Human
cuggguuggcgcacccuc

SEQ ID NO: 3804583 - RNA, 22 nt, Human
cuggguuggcgcacccuccccu

SEQ ID NO: 3804584 - RNA, 13 nt, Human
cuggguuggugca

SEQ ID NO: 3804585 - RNA, 19 nt, Human
cuggguuggugcacaguga

SEQ ID NO: 3804586 - RNA, 20 nt, Human
cuggcuguuggcugggggcc

SEQ ID NO: 3804587 - RNA, 12 nt, Human
cuggcuguuuga

SEQ ID NO: 3804588 - RNA, 16 nt, Human
ccugagcuuuggacac

SEQ ID NO: 3804589 - RNA, 17 nt, Human
ccugagcuuuggacaca

SEQ ID NO: 3804590 - RNA, 22 nt, Human
ccugagcuuuggacgcacacag

SEQ ID NO: 3804591 - RNA, 23 nt, Human
ccugagcuuuggacgcacacagc

SEQ ID NO: 3804592 - RNA, 23 nt, Human
ccugaggaagcgugaaggccgag

SEQ ID NO: 3804593 - RNA, 18 nt, Human
ccugaggacauggcuucu

SEQ ID NO: 3804594 - RNA, 22 nt, Human
ccugaggagucugagguccuga

SEQ ID NO: 3804595 - RNA, 14 nt, Human
ccugaggaucagaa

SEQ ID NO: 3804596 - RNA, 22 nt, Human
cuggguuggugcacagugauuu

SEQ ID NO: 3804597 - RNA, 22 nt, Human
cuggguuuaaggggagaggaaa

SEQ ID NO: 3804598 - RNA, 22 nt, Human
cuggguuuauuacauggcagug

SEQ ID NO: 3804599 - RNA, 13 nt, Human
cuggguuucuagc

SEQ ID NO: 3804600 - RNA, 15 nt, Human
cuggguuuggacccc

SEQ ID NO: 3804601 - RNA, 18 nt, Human
cuggguuuggaccccagc

SEQ ID NO: 3804602 - RNA, 20 nt, Human
cuggguuuggaccccagcug

SEQ ID NO: 3804603 - RNA, 23 nt, Human
cuggguuuggaccccagcuggga

SEQ ID NO: 3804604 - RNA, 16 nt, Human
cugguaaaaugaagaa

SEQ ID NO: 3804605 - RNA, 17 nt, Human
cugguaaaaugaagaau

SEQ ID NO: 3804606 - RNA, 16 nt, Human
cugguaaacuauuugu

SEQ ID NO: 3804607 - RNA, 17 nt, Human
cugguaagaaaaagcaa

SEQ ID NO: 3804608 - RNA, 18 nt, Human
cugguaagaaaaagcaaa

SEQ ID NO: 3804609 - RNA, 20 nt, Human
cugguaagauuguuauuaaa

SEQ ID NO: 3804610 - RNA, 22 nt, Human
cugguaagauuguuauuaaaug

SEQ ID NO: 3804611 - RNA, 15 nt, Human
cugguaauauugacu

SEQ ID NO: 3804612 - RNA, 18 nt, Human
cugguaauuuguaucuga

SEQ ID NO: 3804613 - RNA, 22 nt, Human
cugguaauuuguaucugaagga

SEQ ID NO: 3804614 - RNA, 23 nt, Human
cugguacccagccaucugcccag

SEQ ID NO: 3804615 - RNA, 18 nt, Human
cugguacucccucucagg

SEQ ID NO: 3804616 - RNA, 13 nt, Human
cugguacucuccu

SEQ ID NO: 3804617 - RNA, 17 nt, Human
cugguagaagggaaagc

SEQ ID NO: 3804618 - RNA, 21 nt, Human
cugguagacacaggauagaua

SEQ ID NO: 3804619 - RNA, 17 nt, Human
cugguagccugcagaag

SEQ ID NO: 3804620 - RNA, 15 nt, Human
cugguagcucaggug

SEQ ID NO: 3804621 - RNA, 20 nt, Human
cugguaggaauagcauguca

SEQ ID NO: 3804622 - RNA, 17 nt, Human
cugguaggaccaagcau

SEQ ID NO: 3804623 - RNA, 18 nt, Human
cugguauauccaaaagcu

SEQ ID NO: 3804624 - RNA, 19 nt, Human
cugguauauccaaaagcuu

SEQ ID NO: 3804625 - RNA, 14 nt, Human
cugguaucucagaa

SEQ ID NO: 3804626 - RNA, 19 nt, Human
cugguaucucagaaagugc

SEQ ID NO: 3804627 - RNA, 13 nt, Human
cugguauggcugc

SEQ ID NO: 3804628 - RNA, 16 nt, Human
cugguauggcugcagu

SEQ ID NO: 3804629 - RNA, 18 nt, Human
cugguauggcugcagucc

SEQ ID NO: 3804630 - RNA, 22 nt, Human
cugguauguaaaagaaaaucca

SEQ ID NO: 3804631 - RNA, 12 nt, Human
cugguauuaaau

SEQ ID NO: 3804632 - RNA, 16 nt, Human
cugguauuaaaugcca

SEQ ID NO: 3804633 - RNA, 19 nt, Human
cugguauuaaaugccaagg

SEQ ID NO: 3804634 - RNA, 18 nt, Human
cugguauucuguucugga

SEQ ID NO: 3804635 - RNA, 20 nt, Human
cugguauugguggcuuuccu

SEQ ID NO: 3804636 - RNA, 17 nt, Human
cuggucaaacaaacucu

SEQ ID NO: 3804637 - RNA, 19 nt, Human
cuggucacacacagguguu

SEQ ID NO: 3804638 - RNA, 18 nt, Human
cuggucacaggacucugc

SEQ ID NO: 3804639 - RNA, 21 nt, Human
cuggucacaggacucugccuc

SEQ ID NO: 3804640 - RNA, 14 nt, Human
cuggucaccuagga

SEQ ID NO: 3804641 - RNA, 18 nt, Human
cuggucacggauuugugu

SEQ ID NO: 3804642 - RNA, 15 nt, Human
cuggucacuucuucu

SEQ ID NO: 3804643 - RNA, 16 nt, Human
cuggucaggcccuggu

SEQ ID NO: 3804644 - RNA, 17 nt, Human
cuggucagguauuucag

SEQ ID NO: 3804645 - RNA, 13 nt, Human
cugguccagggcu

SEQ ID NO: 3804646 - RNA, 17 nt, Human
cugguccauagagagca

SEQ ID NO: 3804647 - RNA, 16 nt, Human
cugguccaugauggag

SEQ ID NO: 3804648 - RNA, 19 nt, Human
cugguccaugauggaguca

SEQ ID NO: 3804649 - RNA, 16 nt, Human
cugguccaugcagggg

SEQ ID NO: 3804650 - RNA, 17 nt, Human
cuggucccacgagggug

SEQ ID NO: 3804651 - RNA, 19 nt, Human
cuggucccacgagggugcc

SEQ ID NO: 3804652 - RNA, 22 nt, Human
cuggucccacucaguccauagc

SEQ ID NO: 3804653 - RNA, 21 nt, Human
cuggucccagccagcaguuca

SEQ ID NO: 3804654 - RNA, 14 nt, Human
cugguccccuccuu

SEQ ID NO: 3804655 - RNA, 19 nt, Human
cuggucccggggccagcac

SEQ ID NO: 3804656 - RNA, 9 nt, Human
cuggucccu

SEQ ID NO: 3804657 - RNA, 17 nt, Human
cuggucccuugcagcua

SEQ ID NO: 3804658 - RNA, 19 nt, Human
cuggucccuuguauccccu

SEQ ID NO: 3804659 - RNA, 19 nt, Human
cugguccgugggacggugc

SEQ ID NO: 3804660 - RNA, 19 nt, Human
cugguccuaggcuggaagg

SEQ ID NO: 3804661 - RNA, 16 nt, Human
cugguccuuccaggcc

SEQ ID NO: 3804662 - RNA, 22 nt, Human
cugguccuuuuuggucgaggag

SEQ ID NO: 3804663 - RNA, 14 nt, Human
cuggucgccuucca

SEQ ID NO: 3804664 - RNA, 13 nt, Human
cuggucgcuccug

SEQ ID NO: 3804665 - RNA, 20 nt, Human
cuggucguaaacaucucaga

SEQ ID NO: 3804666 - RNA, 23 nt, Human
cuggucucaaacuccugaccuca

SEQ ID NO: 3804667 - RNA, 16 nt, Human
cuggucucacccugga

SEQ ID NO: 3804668 - RNA, 23 nt, Human
cuggucucacccuggaggcaccu

SEQ ID NO: 3804669 - RNA, 20 nt, Human
cuggucuccugcccccacac

SEQ ID NO: 3804670 - RNA, 16 nt, Human
cuggucucgaacuccu

SEQ ID NO: 3804671 - RNA, 20 nt, Human
cuggucucuaggcuggggaa

SEQ ID NO: 3804672 - RNA, 14 nt, Human
cuggucucuccuug

SEQ ID NO: 3804673 - RNA, 12 nt, Human
cuggucucucua

SEQ ID NO: 3804674 - RNA, 22 nt, Human
cuggucuguagaagagggauaa

SEQ ID NO: 3804675 - RNA, 18 nt, Human
cuggucuuauuuguaaag

SEQ ID NO: 3804676 - RNA, 16 nt, Human
cuggucuuccuuuuug

SEQ ID NO: 3804677 - RNA, 15 nt, Human
cuggucuugagaugu

SEQ ID NO: 3804678 - RNA, 20 nt, Human
cuggucuuguuagaaaacaa

SEQ ID NO: 3804679 - RNA, 16 nt, Human
cuggugacaccagccu

SEQ ID NO: 3804680 - RNA, 18 nt, Human
cuggugacugauucuuca

SEQ ID NO: 3804681 - RNA, 23 nt, Human
cuggugagagggccgggcagagg

SEQ ID NO: 3804682 - RNA, 16 nt, Human
cuggugagcagacugg

SEQ ID NO: 3804683 - RNA, 18 nt, Human
cuggugaggaagcuccag

SEQ ID NO: 3804684 - RNA, 17 nt, Human
cuggugaggccuugcuc

SEQ ID NO: 3804685 - RNA, 20 nt, Human
cuggugagucuuggcggcag

SEQ ID NO: 3804686 - RNA, 20 nt, Human
cuggugcagggccuccauuc

SEQ ID NO: 3804687 - RNA, 12 nt, Human
cuggugcagugg

SEQ ID NO: 3804688 - RNA, 19 nt, Human
cuggugcauuacagagagg

SEQ ID NO: 3804689 - RNA, 12 nt, Human
cuggugccaccu

SEQ ID NO: 3804690 - RNA, 14 nt, Human
cuggugccagccuu

SEQ ID NO: 3804691 - RNA, 17 nt, Human
cuggugccagccuuccu

SEQ ID NO: 3804692 - RNA, 20 nt, Human
cuggugccccccaccccugg

SEQ ID NO: 3804693 - RNA, 19 nt, Human
cuggugcccugcuuucaga

SEQ ID NO: 3804694 - RNA, 20 nt, Human
cuggugcccuggaugcccag

SEQ ID NO: 3804695 - RNA, 16 nt, Human
cuggugccuccagagg

SEQ ID NO: 3804696 - RNA, 16 nt, Human
cuggugccuggcucuu

SEQ ID NO: 3804697 - RNA, 19 nt, Human
cuggugcggcuggccaugg

SEQ ID NO: 3804698 - RNA, 20 nt, Human
cuggugcggcuggccaugga

SEQ ID NO: 3804699 - RNA, 18 nt, Human
cuggugcucucugccacu

SEQ ID NO: 3804700 - RNA, 17 nt, Human
cuggugcugcagcaccg

SEQ ID NO: 3804701 - RNA, 17 nt, Human
cuggugcugcaguaugu

SEQ ID NO: 3804702 - RNA, 13 nt, Human
cuggugcugccac

SEQ ID NO: 3804703 - RNA, 22 nt, Human
cuggugcugccacacuucaggc

SEQ ID NO: 3804704 - RNA, 14 nt, Human
cuggugcuggaggu

SEQ ID NO: 3804705 - RNA, 23 nt, Human
cuggugcuguggccagggugaga

SEQ ID NO: 3804706 - RNA, 17 nt, Human
cuggugcuuaugcucuu

SEQ ID NO: 3804707 - RNA, 12 nt, Human
cugguggacagu

SEQ ID NO: 3804708 - RNA, 16 nt, Human
cugguggacaguccug

SEQ ID NO: 3804709 - RNA, 19 nt, Human
cugguggacaguccuggga

SEQ ID NO: 3804710 - RNA, 21 nt, Human
cugguggacaguccugggaga

SEQ ID NO: 3804711 - RNA, 15 nt, Human
cugguggacccaggg

SEQ ID NO: 3804712 - RNA, 15 nt, Human
cugguggagaaagca

SEQ ID NO: 3804713 - RNA, 21 nt, Human
cugguggagaaagcacugacc

SEQ ID NO: 3804714 - RNA, 21 nt, Human
cugguggagaacucuggcuuu

SEQ ID NO: 3804715 - RNA, 16 nt, Human
cugguggcagaguccu

SEQ ID NO: 3804716 - RNA, 16 nt, Human
cugguggcagcucacc

SEQ ID NO: 3804717 - RNA, 13 nt, Human
cugguggcagcug

SEQ ID NO: 3804718 - RNA, 14 nt, Human
cugguggcaguggg

SEQ ID NO: 3804719 - RNA, 19 nt, Human
cugguggcagugggagcug

SEQ ID NO: 3804720 - RNA, 23 nt, Human
cugguggcagugggagcugccug

SEQ ID NO: 3804721 - RNA, 11 nt, Human
cugguggccca

SEQ ID NO: 3804722 - RNA, 12 nt, Human
cugguggcccag

SEQ ID NO: 3804723 - RNA, 14 nt, Human
cugguggcccagga

SEQ ID NO: 3804724 - RNA, 20 nt, Human
cugguggccccguuucuggu

SEQ ID NO: 3804725 - RNA, 21 nt, Human
cugguggccccguuucuggug

SEQ ID NO: 3804726 - RNA, 21 nt, Human
cugguggcccgacagccuggc

SEQ ID NO: 3804727 - RNA, 18 nt, Human
cugguggcccucuccccu

SEQ ID NO: 3804728 - RNA, 20 nt, Human
cugguggcccucuccccugc

SEQ ID NO: 3804729 - RNA, 23 nt, Human
cugguggcucccggagggcccug

SEQ ID NO: 3804730 - RNA, 22 nt, Human
cuggugggaggggcgcccaccu

SEQ ID NO: 3804731 - RNA, 23 nt, Human
cuggugggaucugugcccagaga

SEQ ID NO: 3804732 - RNA, 18 nt, Human
cuggggcaggcugcuuca

SEQ ID NO: 3804733 - RNA, 16 nt, Human
cuggggcaggcugggc

SEQ ID NO: 3804734 - RNA, 18 nt, Human
cuggggcauccugugcca

SEQ ID NO: 3804735 - RNA, 15 nt, Human
cuggggccacacaga

SEQ ID NO: 3804736 - RNA, 17 nt, Human
cuggggccacacagaaa

SEQ ID NO: 3804737 - RNA, 13 nt, Human
cuggggccaggcc

SEQ ID NO: 3804738 - RNA, 19 nt, Human
cuggggccaggcugggucg

SEQ ID NO: 3804739 - RNA, 18 nt, Human
cuggggccuaauaaaacu

SEQ ID NO: 3804740 - RNA, 24 nt, Human
cuggggccuagcgaucucuccugg

SEQ ID NO: 3804741 - RNA, 21 nt, Human
cuggggccuaucagugugccc

SEQ ID NO: 3804742 - RNA, 15 nt, Human
cuggggccuccagaa

SEQ ID NO: 3804743 - RNA, 20 nt, Human
cuggggccucggagccucau

SEQ ID NO: 3804744 - RNA, 16 nt, Human
cuggggccugacugcu

SEQ ID NO: 3804745 - RNA, 18 nt, Human
cuggggccugacugcuca

SEQ ID NO: 3804746 - RNA, 19 nt, Human
cuggggccugacugcucag

SEQ ID NO: 3804747 - RNA, 12 nt, Human
cuggggccugag

SEQ ID NO: 3804748 - RNA, 14 nt, Human
cuggggccuggacc

SEQ ID NO: 3804749 - RNA, 16 nt, Human
cuggggccugggacaa

SEQ ID NO: 3804750 - RNA, 19 nt, Human
ccugaggaugggucagagc

SEQ ID NO: 3804751 - RNA, 20 nt, Human
ccugaggaugggucagagcu

SEQ ID NO: 3804752 - RNA, 15 nt, Human
ccugaggcagguccc

SEQ ID NO: 3804753 - RNA, 18 nt, Human
ccugaggcagguccccag

SEQ ID NO: 3804754 - RNA, 19 nt, Human
ccugaggcagguccccaga

SEQ ID NO: 3804755 - RNA, 15 nt, Human
ccugaggcccagagg

SEQ ID NO: 3804756 - RNA, 17 nt, Human
ccugaggcccagagggc

SEQ ID NO: 3804757 - RNA, 21 nt, Human
ccugaggcccagagggccugc

SEQ ID NO: 3804758 - RNA, 23 nt, Human
ccugaggcccuucucuccagccc

SEQ ID NO: 3804759 - RNA, 13 nt, Human
ccugaggccuaga

SEQ ID NO: 3804760 - RNA, 15 nt, Human
ccugaggcucaggga

SEQ ID NO: 3804761 - RNA, 14 nt, Human
ccugaggcuccacu

SEQ ID NO: 3804762 - RNA, 20 nt, Human
ccugaggcuccacuuggucu

SEQ ID NO: 3804763 - RNA, 12 nt, Human
ccugaggcuccu

SEQ ID NO: 3804764 - RNA, 18 nt, Human
ccugaggcuccugugcua

SEQ ID NO: 3804765 - RNA, 14 nt, Human
ccugaggcugagac

SEQ ID NO: 3804766 - RNA, 15 nt, Human
ccugaggcuggacuc

SEQ ID NO: 3804767 - RNA, 13 nt, Human
ccugaggcugggc

SEQ ID NO: 3804768 - RNA, 15 nt, Human
ccugaggcugugguc

SEQ ID NO: 3804769 - RNA, 20 nt, Human
ccugaggcuuuggauuugac

SEQ ID NO: 3804770 - RNA, 22 nt, Human
ccugaggcuuuggauuugacau

SEQ ID NO: 3804771 - RNA, 13 nt, Human
ccugagggaaagg

SEQ ID NO: 3804772 - RNA, 19 nt, Human
ccugagggaaaggccagca

SEQ ID NO: 3804773 - RNA, 13 nt, Human
ccugagggagcuc

SEQ ID NO: 3804774 - RNA, 21 nt, Human
ccugagggaggaccuggggca

SEQ ID NO: 3804775 - RNA, 23 nt, Human
ccugagggaggaccuggggcaca

SEQ ID NO: 3804776 - RNA, 23 nt, Human
ccugagggcagaaagguucugcc

SEQ ID NO: 3804777 - RNA, 19 nt, Human
ccugagggccccucugccc

SEQ ID NO: 3804778 - RNA, 23 nt, Human
ccugagggccccucugcccagcu

SEQ ID NO: 3804779 - RNA, 19 nt, Human
ccugaggggagacagagca

SEQ ID NO: 3804780 - RNA, 20 nt, Human
ccugaggggagacagagcaa

SEQ ID NO: 3804781 - RNA, 22 nt, Human
ccugaggggagacagagcaacc

SEQ ID NO: 3804782 - RNA, 19 nt, Human
ccugaggggcaucugcccc

SEQ ID NO: 3804783 - RNA, 13 nt, Human
ccugagggucccc

SEQ ID NO: 3804784 - RNA, 13 nt, Human
ccugagggucugu

SEQ ID NO: 3804785 - RNA, 19 nt, Human
ccugagggucuguagguug

SEQ ID NO: 3804786 - RNA, 15 nt, Human
ccugaggguggagac

SEQ ID NO: 3804787 - RNA, 22 nt, Human
ccugaggucaggaguucaagac

SEQ ID NO: 3804788 - RNA, 20 nt, Human
ccugaggucagggagugcug

SEQ ID NO: 3804789 - RNA, 19 nt, Human
ccugaggucaucggcgugg

SEQ ID NO: 3804790 - RNA, 23 nt, Human
ccugaggucgggaguuggagacc

SEQ ID NO: 3804791 - RNA, 21 nt, Human
ccugaggucuggcugcuugcc

SEQ ID NO: 3804792 - RNA, 23 nt, Human
ccugaggugggcccaggaccagc

SEQ ID NO: 3804793 - RNA, 14 nt, Human
ccugagguguacca

SEQ ID NO: 3804794 - RNA, 22 nt, Human
ccugaggugugggggcugcagc

SEQ ID NO: 3804795 - RNA, 22 nt, Human
ccugaguaaaaaagcugugugc

SEQ ID NO: 3804796 - RNA, 17 nt, Human
ccugaguacuccacacu

SEQ ID NO: 3804797 - RNA, 23 nt, Human
ccugaguacuccacacugcacaa

SEQ ID NO: 3804798 - RNA, 13 nt, Human
ccugaguagcugg

SEQ ID NO: 3804799 - RNA, 15 nt, Human
ccugaguagcuggau

SEQ ID NO: 3804800 - RNA, 15 nt, Human
ccugagucacccaug

SEQ ID NO: 3804801 - RNA, 18 nt, Human
ccugagucacccaugaag

SEQ ID NO: 3804802 - RNA, 16 nt, Human
ccugagucccaucccu

SEQ ID NO: 3804803 - RNA, 19 nt, Human
ccugagucguacagaaagc

SEQ ID NO: 3804804 - RNA, 21 nt, Human
ccugagucguacagaaagcug

SEQ ID NO: 3804805 - RNA, 21 nt, Human
ccugagucgugaccugcuagg

SEQ ID NO: 3804806 - RNA, 18 nt, Human
ccugagucuccugugccc

SEQ ID NO: 3804807 - RNA, 23 nt, Human
ccugagucugcuauauuuucaug

SEQ ID NO: 3804808 - RNA, 15 nt, Human
ccugagugagagggg

SEQ ID NO: 3804809 - RNA, 18 nt, Human
ccugagugagaggggagg

SEQ ID NO: 3804810 - RNA, 15 nt, Human
ccugagugccuggcc

SEQ ID NO: 3804811 - RNA, 19 nt, Human
ccugagugcuugcuuuuca

SEQ ID NO: 3804812 - RNA, 14 nt, Human
ccugaguggaucuc

SEQ ID NO: 3804813 - RNA, 23 nt, Human
ccugaguggaucuccaaggacca

SEQ ID NO: 3804814 - RNA, 16 nt, Human
ccugaguggugccaaa

SEQ ID NO: 3804815 - RNA, 13 nt, Human
ccugaguuccuga

SEQ ID NO: 3804816 - RNA, 20 nt, Human
ccugaguugcuuuucagcug

SEQ ID NO: 3804817 - RNA, 20 nt, Human
ccugauaaaacaacagcucg

SEQ ID NO: 3804818 - RNA, 17 nt, Human
ccugauaacaaccugga

SEQ ID NO: 3804819 - RNA, 18 nt, Human
ccugauaacaaccuggag

SEQ ID NO: 3804820 - RNA, 15 nt, Human
ccugauauaaaugca

SEQ ID NO: 3804821 - RNA, 14 nt, Human
ccugaucaaugaca

SEQ ID NO: 3804822 - RNA, 17 nt, Human
ccugaucaaugacagag

SEQ ID NO: 3804823 - RNA, 14 nt, Human
ccugaucagaccac

SEQ ID NO: 3804824 - RNA, 15 nt, Human
ccugauccagccucu

SEQ ID NO: 3804825 - RNA, 17 nt, Human
ccugaucccagagagcc

SEQ ID NO: 3804826 - RNA, 21 nt, Human
ccugaucccauuuuccucuga

SEQ ID NO: 3804827 - RNA, 13 nt, Human
ccugauccuggag

SEQ ID NO: 3804828 - RNA, 19 nt, Human
ccugauccuggaggcccag

SEQ ID NO: 3804829 - RNA, 14 nt, Human
ccugaucucuuccu

SEQ ID NO: 3804830 - RNA, 19 nt, Human
ccugaucugacauccccac

SEQ ID NO: 3804831 - RNA, 13 nt, Human
ccugaugaaaaua

SEQ ID NO: 3804832 - RNA, 13 nt, Human
ccugaugacagag

SEQ ID NO: 3804833 - RNA, 16 nt, Human
ccugaugagauuuuua

SEQ ID NO: 3804834 - RNA, 16 nt, Human
ccugaugcucauauca

SEQ ID NO: 3804835 - RNA, 14 nt, Human
ccugaugcucccuc

SEQ ID NO: 3804836 - RNA, 20 nt, Human
ccugaugcucccuccccugc

SEQ ID NO: 3804837 - RNA, 23 nt, Human
ccugaugcugacauucaccugcc

SEQ ID NO: 3804838 - RNA, 14 nt, Human
ccugaugcuucuuc

SEQ ID NO: 3804839 - RNA, 17 nt, Human
ccugaugcuucuucaga

SEQ ID NO: 3804840 - RNA, 19 nt, Human
ccugaugcuucuucagaga

SEQ ID NO: 3804841 - RNA, 19 nt, Human
ccugaugcuuuugucuaau

SEQ ID NO: 3804842 - RNA, 20 nt, Human
ccugauggcaggauggccug

SEQ ID NO: 3804843 - RNA, 21 nt, Human
ccugaugggguggaaggcaug

SEQ ID NO: 3804844 - RNA, 19 nt, Human
ccugauguguccucaggga

SEQ ID NO: 3804845 - RNA, 21 nt, Human
ccugauguguccucagggagc

SEQ ID NO: 3804846 - RNA, 19 nt, Human
ccugauucggcugucucag

SEQ ID NO: 3804847 - RNA, 15 nt, Human
ccugauugugucucu

SEQ ID NO: 3804848 - RNA, 19 nt, Human
ccugauugugucucuuggu

SEQ ID NO: 3804849 - RNA, 14 nt, Human
ccugauuuacaguu

SEQ ID NO: 3804850 - RNA, 17 nt, Human
ccugauuuacaguuuca

SEQ ID NO: 3804851 - RNA, 18 nt, Human
ccugauuuagauaugcaa

SEQ ID NO: 3804852 - RNA, 20 nt, Human
ccugauuuaggagaagccag

SEQ ID NO: 3804853 - RNA, 22 nt, Human
ccugauuuaggagaagccagga

SEQ ID NO: 3804854 - RNA, 17 nt, Human
ccugcaaacagaacagg

SEQ ID NO: 3804855 - RNA, 18 nt, Human
ccugcaaacgcugccugc

SEQ ID NO: 3804856 - RNA, 21 nt, Human
ccugcaaacgcugccugcccg

SEQ ID NO: 3804857 - RNA, 15 nt, Human
ccugcaaagcccagc

SEQ ID NO: 3804858 - RNA, 18 nt, Human
ccugcaaagcccagcuug

SEQ ID NO: 3804859 - RNA, 23 nt, Human
ccugcaaaguacagguacuuugu

SEQ ID NO: 3804860 - RNA, 18 nt, Human
ccugcaacaccuuguuuc

SEQ ID NO: 3804861 - RNA, 21 nt, Human
ccugcaaccugauugugucuc

SEQ ID NO: 3804862 - RNA, 17 nt, Human
ccugcaacucaaggacu

SEQ ID NO: 3804863 - RNA, 13 nt, Human
ccugcaaggacua

SEQ ID NO: 3804864 - RNA, 14 nt, Human
ccugcaaggcccac

SEQ ID NO: 3804865 - RNA, 20 nt, Human
ccugcaagggcuccccacug

SEQ ID NO: 3804866 - RNA, 16 nt, Human
ccugcaauaaaauggg

SEQ ID NO: 3804867 - RNA, 14 nt, Human
ccugcaaugaaagg

SEQ ID NO: 3804868 - RNA, 20 nt, Human
ccugcaaugaagucucugaa

SEQ ID NO: 3804869 - RNA, 22 nt, Human
ccugcacaaagcccuuccaugu

SEQ ID NO: 3804870 - RNA, 17 nt, Human
ccugcacaagccagggu

SEQ ID NO: 3804871 - RNA, 23 nt, Human
ccugcacacaagcccacagcaca

SEQ ID NO: 3804872 - RNA, 23 nt, Human
ccugcacagcaggcugccagugc

SEQ ID NO: 3804873 - RNA, 15 nt, Human
ccugcacagugacuu

SEQ ID NO: 3804874 - RNA, 20 nt, Human
ccugcacagugacuucugag

SEQ ID NO: 3804875 - RNA, 21 nt, Human
ccuggaaccuugcuguccuga

SEQ ID NO: 3804876 - RNA, 20 nt, Human
ccuggaacucuaucugggcc

SEQ ID NO: 3804877 - RNA, 22 nt, Human
ccuggaacucuaucugggccug

SEQ ID NO: 3804878 - RNA, 17 nt, Human
ccuggaagaacaggccu

SEQ ID NO: 3804879 - RNA, 23 nt, Human
ccuggaagaacaggccucuccau

SEQ ID NO: 3804880 - RNA, 16 nt, Human
ccuggaagagcagccc

SEQ ID NO: 3804881 - RNA, 14 nt, Human
ccuggaagagccca

SEQ ID NO: 3804882 - RNA, 15 nt, Human
ccuggaagagcccag

SEQ ID NO: 3804883 - RNA, 18 nt, Human
ccuggaagagcccagucu

SEQ ID NO: 3804884 - RNA, 17 nt, Human
ccuggaagccagcuuuc

SEQ ID NO: 3804885 - RNA, 21 nt, Human
ccuggaagcuguguccuugca

SEQ ID NO: 3804886 - RNA, 23 nt, Human
ccuggaagcuuuguccccugcuu

SEQ ID NO: 3804887 - RNA, 20 nt, Human
ccuggaaggacauccauguu

SEQ ID NO: 3804888 - RNA, 22 nt, Human
ccuggaaggacauccauguucc

SEQ ID NO: 3804889 - RNA, 17 nt, Human
ccuggaaggcccagcac

SEQ ID NO: 3804890 - RNA, 18 nt, Human
ccuggaaggcccagcacc

SEQ ID NO: 3804891 - RNA, 16 nt, Human
ccuggacacaggccug

SEQ ID NO: 3804892 - RNA, 16 nt, Human
ccuggacacucagacc

SEQ ID NO: 3804893 - RNA, 13 nt, Human
ccuggacagcugu

SEQ ID NO: 3804894 - RNA, 14 nt, Human
ccuggacagcugug

SEQ ID NO: 3804895 - RNA, 16 nt, Human
ccuggacagcugugcc

SEQ ID NO: 3804896 - RNA, 19 nt, Human
ccuggacaguaucccacau

SEQ ID NO: 3804897 - RNA, 23 nt, Human
ccuggacaguaucccacauccaa

SEQ ID NO: 3804898 - RNA, 20 nt, Human
ccuggacauccucuucugcu

SEQ ID NO: 3804899 - RNA, 23 nt, Human
ccuggacaugaagauucuuuccc

SEQ ID NO: 3804900 - RNA, 19 nt, Human
ccuggacauuuuuucaguc

SEQ ID NO: 3804901 - RNA, 16 nt, Human
ccuggaccagccucuc

SEQ ID NO: 3804902 - RNA, 12 nt, Human
ccuggaccccca

SEQ ID NO: 3804903 - RNA, 15 nt, Human
ccuggacccccagcu

SEQ ID NO: 3804904 - RNA, 17 nt, Human
ccuggacccccagcuuu

SEQ ID NO: 3804905 - RNA, 23 nt, Human
ccuggaccccccuuucacaggca

SEQ ID NO: 3804906 - RNA, 14 nt, Human
ccuggaccccugca

SEQ ID NO: 3804907 - RNA, 15 nt, Human
ccuggaccccugcau

SEQ ID NO: 3804908 - RNA, 15 nt, Human
ccuggaccucugaca

SEQ ID NO: 3804909 - RNA, 21 nt, Human
ccuggaccugcccugggccac

SEQ ID NO: 3804910 - RNA, 23 nt, Human
ccuggaccugcccugggccacac

SEQ ID NO: 3804911 - RNA, 14 nt, Human
ccuggacuccugca

SEQ ID NO: 3804912 - RNA, 14 nt, Human
ccuggacugagggg

SEQ ID NO: 3804913 - RNA, 14 nt, Human
ccuggacugcuacc

SEQ ID NO: 3804914 - RNA, 17 nt, Human
ccuggacugguggcccc

SEQ ID NO: 3804915 - RNA, 13 nt, Human
ccuggacuugccu

SEQ ID NO: 3804916 - RNA, 14 nt, Human
ccuggacuuuccug

SEQ ID NO: 3804917 - RNA, 13 nt, Human
ccuggagaacuag

SEQ ID NO: 3804918 - RNA, 23 nt, Human
ccuggagaacuagaaccuggagg

SEQ ID NO: 3804919 - RNA, 21 nt, Human
ccuggagacccaccccaccug

SEQ ID NO: 3804920 - RNA, 22 nt, Human
ccuggagacguggaaccucugu

SEQ ID NO: 3804921 - RNA, 13 nt, Human
ccuggagagcuag

SEQ ID NO: 3804922 - RNA, 21 nt, Human
ccuggagauccuccugcagac

SEQ ID NO: 3804923 - RNA, 15 nt, Human
ccuggagauggggag

SEQ ID NO: 3804924 - RNA, 21 nt, Human
ccuggagcagaagcagcaacu

SEQ ID NO: 3804925 - RNA, 15 nt, Human
ccuggagccaacugc

SEQ ID NO: 3804926 - RNA, 12 nt, Human
ccuggagccaga

SEQ ID NO: 3804927 - RNA, 14 nt, Human
ccuggagcccagag

SEQ ID NO: 3804928 - RNA, 17 nt, Human
ccuggagccccugggug

SEQ ID NO: 3804929 - RNA, 22 nt, Human
ccuggagccccugggugggugg

SEQ ID NO: 3804930 - RNA, 20 nt, Human
ccuggagcccgaggcaccag

SEQ ID NO: 3804931 - RNA, 21 nt, Human
ccuggagcccuggagacccca

SEQ ID NO: 3804932 - RNA, 15 nt, Human
ccuggagcuccuggg

SEQ ID NO: 3804933 - RNA, 18 nt, Human
ccuggagcuccugggaag

SEQ ID NO: 3804934 - RNA, 17 nt, Human
ccuggaggaccugagcc

SEQ ID NO: 3804935 - RNA, 18 nt, Human
ccuggaggaccugagccu

SEQ ID NO: 3804936 - RNA, 19 nt, Human
ccuggaggaccugagccug

SEQ ID NO: 3804937 - RNA, 12 nt, Human
ccuggaggccca

SEQ ID NO: 3804938 - RNA, 23 nt, Human
ccuggaggccccaacccuguccu

SEQ ID NO: 3804939 - RNA, 21 nt, Human
ccuggaggcggugcggcaggg

SEQ ID NO: 3804940 - RNA, 16 nt, Human
ccuggaggcugccucc

SEQ ID NO: 3804941 - RNA, 18 nt, Human
ccuggagggcuagaacug

SEQ ID NO: 3804942 - RNA, 20 nt, Human
ccuggaggggcuagaaccua

SEQ ID NO: 3804943 - RNA, 18 nt, Human
ccuggaggugccagcaaa

SEQ ID NO: 3804944 - RNA, 22 nt, Human
ccuggaggugccagcaaagccc

SEQ ID NO: 3804945 - RNA, 14 nt, Human
ccuggagguggcug

SEQ ID NO: 3804946 - RNA, 23 nt, Human
cugguucggauuugggguggauu

SEQ ID NO: 3804947 - RNA, 20 nt, Human
cugguucucaauuccaacag

SEQ ID NO: 3804948 - RNA, 20 nt, Human
cugguucucaucuuucuuga

SEQ ID NO: 3804949 - RNA, 23 nt, Human
cugguucugaugaugugccuggg

SEQ ID NO: 3804950 - RNA, 20 nt, Human
cugguucuuguguuggcugu

SEQ ID NO: 3804951 - RNA, 13 nt, Human
cugguugucauuu

SEQ ID NO: 3804952 - RNA, 21 nt, Human
cugguuguuucuguuccaaau

SEQ ID NO: 3804953 - RNA, 15 nt, Human
cugguuuacacuuua

SEQ ID NO: 3804954 - RNA, 13 nt, Human
cugguuucacugg

SEQ ID NO: 3804955 - RNA, 23 nt, Human
cugguuucauuucuacugugacu

SEQ ID NO: 3804956 - RNA, 16 nt, Human
cugguuuccugcccug

SEQ ID NO: 3804957 - RNA, 21 nt, Human
cugguuuccugcccugggagg

SEQ ID NO: 3804958 - RNA, 18 nt, Human
cugguuucucauucuugu

SEQ ID NO: 3804959 - RNA, 19 nt, Human
cugguuugccgguggugca

SEQ ID NO: 3804960 - RNA, 16 nt, Human
cugguuuggggcgagg

SEQ ID NO: 3804961 - RNA, 17 nt, Human
cugguuuggggcgaggc

SEQ ID NO: 3804962 - RNA, 16 nt, Human
cugguuuguucccugu

SEQ ID NO: 3804963 - RNA, 14 nt, Human
cugguuuugcuauu

SEQ ID NO: 3804964 - RNA, 21 nt, Human
cugguuuuggcaucucugucc

SEQ ID NO: 3804965 - RNA, 20 nt, Human
cugguuuuuggauuaaauua

SEQ ID NO: 3804966 - RNA, 13 nt, Human
cuguaaaacgcug

SEQ ID NO: 3804967 - RNA, 13 nt, Human
cuguaaaacuaag

SEQ ID NO: 3804968 - RNA, 14 nt, Human
cuguaaaacuuuau

SEQ ID NO: 3804969 - RNA, 18 nt, Human
cuguaaaagauuaaacug

SEQ ID NO: 3804970 - RNA, 19 nt, Human
cuguaaaagcaaguccugc

SEQ ID NO: 3804971 - RNA, 11 nt, Human
cuguaaaaucu

SEQ ID NO: 3804972 - RNA, 15 nt, Human
cuguaaaaugaaauu

SEQ ID NO: 3804973 - RNA, 20 nt, Human
cuguaaaaugcaaaaaaucu

SEQ ID NO: 3804974 - RNA, 15 nt, Human
cuguaaacacagaca

SEQ ID NO: 3804975 - RNA, 17 nt, Human
cuguaaacacucagcug

SEQ ID NO: 3804976 - RNA, 18 nt, Human
cuguaaacacucagcugu

SEQ ID NO: 3804977 - RNA, 20 nt, Human
cuguaaaccucucgagggca

SEQ ID NO: 3804978 - RNA, 19 nt, Human
cuguaaacucaaaacuuaa

SEQ ID NO: 3804979 - RNA, 17 nt, Human
cuguaaagaaagagaga

SEQ ID NO: 3804980 - RNA, 21 nt, Human
cuguaaagaaagagagaaaau

SEQ ID NO: 3804981 - RNA, 12 nt, Human
cuguaaagaauu

SEQ ID NO: 3804982 - RNA, 23 nt, Human
cuguaaagagaccuaccucaggu

SEQ ID NO: 3804983 - RNA, 14 nt, Human
cuguaaagaguugc

SEQ ID NO: 3804984 - RNA, 21 nt, Human
cuguaaagauguuuauuucag

SEQ ID NO: 3804985 - RNA, 22 nt, Human
cuguaaagauguuuauuucagg

SEQ ID NO: 3804986 - RNA, 16 nt, Human
cuguaaagcaaaagau

SEQ ID NO: 3804987 - RNA, 15 nt, Human
cuguaaagugccuua

SEQ ID NO: 3804988 - RNA, 16 nt, Human
cuguaaauaccauuga

SEQ ID NO: 3804989 - RNA, 14 nt, Human
cuguaaauauguuu

SEQ ID NO: 3804990 - RNA, 20 nt, Human
cuguaaaucuaacauuauua

SEQ ID NO: 3804991 - RNA, 17 nt, Human
cuguaaaugguguacau

SEQ ID NO: 3804992 - RNA, 18 nt, Human
cuguaaaugguguacaua

SEQ ID NO: 3804993 - RNA, 21 nt, Human
cuguaaaugguguacauaaug

SEQ ID NO: 3804994 - RNA, 23 nt, Human
cuguaaaugguguacauaaugua

SEQ ID NO: 3804995 - RNA, 16 nt, Human
cuguaaauuauuuuaa

SEQ ID NO: 3804996 - RNA, 18 nt, Human
cuguaaauuauuuuaaau

SEQ ID NO: 3804997 - RNA, 22 nt, Human
cuguaaauuauuuuaaauuaua

SEQ ID NO: 3804998 - RNA, 17 nt, Human
cuguaacacaagccaca

SEQ ID NO: 3804999 - RNA, 20 nt, Human
cuguaacacaagccacagaa

SEQ ID NO: 3805000 - RNA, 21 nt, Human
cuguaacacaagccacagaag

SEQ ID NO: 3805001 - RNA, 22 nt, Human
cuguaacacaagccacagaagc

SEQ ID NO: 3805002 - RNA, 16 nt, Human
cuguaacacuccucug

SEQ ID NO: 3805003 - RNA, 17 nt, Human
cuguaacacuccucugc

SEQ ID NO: 3805004 - RNA, 16 nt, Human
cuguaacacuuuacaa

SEQ ID NO: 3805005 - RNA, 23 nt, Human
cuguaacagguauuuuguuucuu

SEQ ID NO: 3805006 - RNA, 15 nt, Human
cuguaaccucuucag

SEQ ID NO: 3805007 - RNA, 19 nt, Human
cuguaaccucuucagaggc

SEQ ID NO: 3805008 - RNA, 23 nt, Human
cuguaaccucuucagaggcccuc

SEQ ID NO: 3805009 - RNA, 17 nt, Human
cuguaacuacuuuauaa

SEQ ID NO: 3805010 - RNA, 15 nt, Human
cuguaacucuaaaag

SEQ ID NO: 3805011 - RNA, 19 nt, Human
cuguaacucuaaaagaucc

SEQ ID NO: 3805012 - RNA, 13 nt, Human
cuguaacugucac

SEQ ID NO: 3805013 - RNA, 16 nt, Human
cuguaacuuaaaauag

SEQ ID NO: 3805014 - RNA, 16 nt, Human
cuguaacuuccaaaua

SEQ ID NO: 3805015 - RNA, 22 nt, Human
cuguaacuugauccauuucuaa

SEQ ID NO: 3805016 - RNA, 20 nt, Human
cuguaagaaaauaucacuug

SEQ ID NO: 3805017 - RNA, 21 nt, Human
cuguaagaaaccuacugccca

SEQ ID NO: 3805018 - RNA, 23 nt, Human
cuguauaaguuauuuuuguacau

SEQ ID NO: 3805019 - RNA, 21 nt, Human
cuguauacagugcagagccuu

SEQ ID NO: 3805020 - RNA, 13 nt, Human
cuguauacuuuag

SEQ ID NO: 3805021 - RNA, 16 nt, Human
cuguauagacaguuug

SEQ ID NO: 3805022 - RNA, 17 nt, Human
cuguauagacaguuugu

SEQ ID NO: 3805023 - RNA, 18 nt, Human
cuguauagacaguuugua

SEQ ID NO: 3805024 - RNA, 16 nt, Human
cuguauagauuagaau

SEQ ID NO: 3805025 - RNA, 16 nt, Human
cuguauagauuagaga

SEQ ID NO: 3805026 - RNA, 16 nt, Human
cuguauaguuaggaua

SEQ ID NO: 3805027 - RNA, 18 nt, Human
cuguauauaaaauauuuu

SEQ ID NO: 3805028 - RNA, 14 nt, Human
cuguauauaaaugg

SEQ ID NO: 3805029 - RNA, 19 nt, Human
cuguauauacaauaacaua

SEQ ID NO: 3805030 - RNA, 13 nt, Human
cuguauauacuuu

SEQ ID NO: 3805031 - RNA, 22 nt, Human
cuguauauauuuauggccgggc

SEQ ID NO: 3805032 - RNA, 16 nt, Human
cuguauauuuguauga

SEQ ID NO: 3805033 - RNA, 19 nt, Human
cuguaucaacccagaaaca

SEQ ID NO: 3805034 - RNA, 16 nt, Human
cuguaucacucugugu

SEQ ID NO: 3805035 - RNA, 15 nt, Human
cuguaucaguggauu

SEQ ID NO: 3805036 - RNA, 14 nt, Human
cuguaucccaugag

SEQ ID NO: 3805037 - RNA, 22 nt, Human
cuguaucccaugagccucagca

SEQ ID NO: 3805038 - RNA, 17 nt, Human
cuguaucggagacagug

SEQ ID NO: 3805039 - RNA, 18 nt, Human
cuguaucggagacaguga

SEQ ID NO: 3805040 - RNA, 14 nt, Human
cuguaucuguguag

SEQ ID NO: 3805041 - RNA, 19 nt, Human
cuguaugaaagauuguggg

SEQ ID NO: 3805042 - RNA, 14 nt, Human
cuguaugaucaaau

SEQ ID NO: 3805043 - RNA, 16 nt, Human
cuguaugaucaaaugu

SEQ ID NO: 3805044 - RNA, 21 nt, Human
cuguaugaucaaauguuuaau

SEQ ID NO: 3805045 - RNA, 16 nt, Human
cuguaugcugaucauc

SEQ ID NO: 3805046 - RNA, 20 nt, Human
cuguauguauuagugauauu

SEQ ID NO: 3805047 - RNA, 20 nt, Human
cuguaugucaacuuuaugca

SEQ ID NO: 3805048 - RNA, 19 nt, Human
cuguaugugcuguaauuua

SEQ ID NO: 3805049 - RNA, 16 nt, Human
cuguauguucaacuag

SEQ ID NO: 3805050 - RNA, 21 nt, Human
cuguauucucaaacacaguua

SEQ ID NO: 3805051 - RNA, 13 nt, Human
cuguauugaauca

SEQ ID NO: 3805052 - RNA, 14 nt, Human
cuguauugaaucau

SEQ ID NO: 3805053 - RNA, 20 nt, Human
cuguauugaaucauguagua

SEQ ID NO: 3805054 - RNA, 14 nt, Human
cuguauuguaacua

SEQ ID NO: 3805055 - RNA, 14 nt, Human
cuguauugucugaa

SEQ ID NO: 3805056 - RNA, 17 nt, Human
cuguauuuaagcaaaua

SEQ ID NO: 3805057 - RNA, 14 nt, Human
cuguauuuaauuuu

SEQ ID NO: 3805058 - RNA, 15 nt, Human
cuguauuuaauuuug

SEQ ID NO: 3805059 - RNA, 18 nt, Human
cuguauuuaugugugagg

SEQ ID NO: 3805060 - RNA, 13 nt, Human
cuguauuugaaag

SEQ ID NO: 3805061 - RNA, 17 nt, Human
cuguauuugaaagugcc

SEQ ID NO: 3805062 - RNA, 18 nt, Human
cuguauuugaaucagccu

SEQ ID NO: 3805063 - RNA, 22 nt, Human
cuguauuugccggugccuagga

SEQ ID NO: 3805064 - RNA, 15 nt, Human
cuguauuugugacua

SEQ ID NO: 3805065 - RNA, 21 nt, Human
cuguauuugugacuaauugua

SEQ ID NO: 3805066 - RNA, 13 nt, Human
cuguauuuuaaaa

SEQ ID NO: 3805067 - RNA, 21 nt, Human
cuguauuuuauuuagacaaga

SEQ ID NO: 3805068 - RNA, 22 nt, Human
cuguauuuuauuuagacaagag

SEQ ID NO: 3805069 - RNA, 20 nt, Human
cuguauuuuguauuguuuca

SEQ ID NO: 3805070 - RNA, 20 nt, Human
cuguauuuuguuuuugucuu

SEQ ID NO: 3805071 - RNA, 18 nt, Human
cuguauuuuuuuuucuaa

SEQ ID NO: 3805072 - RNA, 16 nt, Human
cugucaaaacacugug

SEQ ID NO: 3805073 - RNA, 17 nt, Human
cugucaaaacacugugg

SEQ ID NO: 3805074 - RNA, 20 nt, Human
cugucaaaacacuguggaac

SEQ ID NO: 3805075 - RNA, 17 nt, Human
cugucaaacaaagccag

SEQ ID NO: 3805076 - RNA, 20 nt, Human
cugucaaacauuaguacuuu

SEQ ID NO: 3805077 - RNA, 22 nt, Human
cugucaaacauuaguacuuuau

SEQ ID NO: 3805078 - RNA, 18 nt, Human
cugucaaaugaugugcaa

SEQ ID NO: 3805079 - RNA, 18 nt, Human
cugucaagaggcaaagga

SEQ ID NO: 3805080 - RNA, 19 nt, Human
cugucaagccauuuuuaca

SEQ ID NO: 3805081 - RNA, 14 nt, Human
cugucaaggcucag

SEQ ID NO: 3805082 - RNA, 20 nt, Human
cugucaaggcugcuuagaau

SEQ ID NO: 3805083 - RNA, 21 nt, Human
cugucaagugggaucugucac

SEQ ID NO: 3805084 - RNA, 19 nt, Human
cugucaaugggaccugugg

SEQ ID NO: 3805085 - RNA, 20 nt, Human
cugucaauuacaggaaguac

SEQ ID NO: 3805086 - RNA, 19 nt, Human
cugucaauuucccugacuc

SEQ ID NO: 3805087 - RNA, 13 nt, Human
cugucacauugca

SEQ ID NO: 3805088 - RNA, 19 nt, Human
cugucacauugcauucuau

SEQ ID NO: 3805089 - RNA, 23 nt, Human
cugucaccaagcucacaguuccu

SEQ ID NO: 3805090 - RNA, 16 nt, Human
cugucaccacccugcu

SEQ ID NO: 3805091 - RNA, 13 nt, Human
cugucaccucuuc

SEQ ID NO: 3805092 - RNA, 19 nt, Human
cugucacgcagccaccagg

SEQ ID NO: 3805093 - RNA, 16 nt, Human
cugucacucaggcugg

SEQ ID NO: 3805094 - RNA, 18 nt, Human
cugucacucaggcuggag

SEQ ID NO: 3805095 - RNA, 19 nt, Human
cugucacucaggcuggagu

SEQ ID NO: 3805096 - RNA, 13 nt, Human
cugucacugcagg

SEQ ID NO: 3805097 - RNA, 13 nt, Human
cugucacuguggg

SEQ ID NO: 3805098 - RNA, 19 nt, Human
cugucagauccaggagcuc

SEQ ID NO: 3805099 - RNA, 22 nt, Human
cugucagauccaggagcuccag

SEQ ID NO: 3805100 - RNA, 24 nt, Human
cugucagauccaggagcuccagug

SEQ ID NO: 3805101 - RNA, 21 nt, Human
cugucagaugagaacaaagcu

SEQ ID NO: 3805102 - RNA, 22 nt, Human
cugucagaugggaagacaugaa

SEQ ID NO: 3805103 - RNA, 17 nt, Human
cugucagccgggcccug

SEQ ID NO: 3805104 - RNA, 23 nt, Human
cugucagccgggcccugaguaau

SEQ ID NO: 3805105 - RNA, 22 nt, Human
cugucagcuaaagaaguuugaa

SEQ ID NO: 3805106 - RNA, 18 nt, Human
cugucaggaagaaaucac

SEQ ID NO: 3805107 - RNA, 12 nt, Human
cugucaggaggc

SEQ ID NO: 3805108 - RNA, 14 nt, Human
cugucaggauugcg

SEQ ID NO: 3805109 - RNA, 15 nt, Human
cugucaggauugcga

SEQ ID NO: 3805110 - RNA, 19 nt, Human
ccuggcuccgcugugugga

SEQ ID NO: 3805111 - RNA, 21 nt, Human
ccuggcuccguccaggagccu

SEQ ID NO: 3805112 - RNA, 15 nt, Human
ccuggcuccugaggg

SEQ ID NO: 3805113 - RNA, 22 nt, Human
ccuggcuccuugugccagagaa

SEQ ID NO: 3805114 - RNA, 16 nt, Human
ccuggcucucaccucu

SEQ ID NO: 3805115 - RNA, 19 nt, Human
ccuggcucucaccucuagg

SEQ ID NO: 3805116 - RNA, 11 nt, Human
ccuggcucuga

SEQ ID NO: 3805117 - RNA, 20 nt, Human
ccuggcucugaccgaaacag

SEQ ID NO: 3805118 - RNA, 17 nt, Human
ccuggcucuguggcuug

SEQ ID NO: 3805119 - RNA, 13 nt, Human
ccuggcucuugug

SEQ ID NO: 3805120 - RNA, 16 nt, Human
ccuggcugaaggacug

SEQ ID NO: 3805121 - RNA, 22 nt, Human
ccuggcugaccccaaagagccu

SEQ ID NO: 3805122 - RNA, 23 nt, Human
ccuggcugaccccaaagagccug

SEQ ID NO: 3805123 - RNA, 19 nt, Human
ccuggcugagccuggcugg

SEQ ID NO: 3805124 - RNA, 17 nt, Human
ccuggcugagggcagcu

SEQ ID NO: 3805125 - RNA, 20 nt, Human
ccuggcugagguuccucugc

SEQ ID NO: 3805126 - RNA, 13 nt, Human
ccuggcugccggc

SEQ ID NO: 3805127 - RNA, 21 nt, Human
ccuggcugcugaucgccuucc

SEQ ID NO: 3805128 - RNA, 23 nt, Human
ccuggcugcugaucgccuucccc

SEQ ID NO: 3805129 - RNA, 20 nt, Human
ccuggcugcugcccccaccc

SEQ ID NO: 3805130 - RNA, 21 nt, Human
ccuggcugggacugggaacag

SEQ ID NO: 3805131 - RNA, 16 nt, Human
ccuggcugucugaggc

SEQ ID NO: 3805132 - RNA, 13 nt, Human
ccuggcuuccuua

SEQ ID NO: 3805133 - RNA, 23 nt, Human
ccuggcuucuggagcccuugggu

SEQ ID NO: 3805134 - RNA, 14 nt, Human
ccuggcuucugugg

SEQ ID NO: 3805135 - RNA, 22 nt, Human
ccuggcuucuguggggccccuc

SEQ ID NO: 3805136 - RNA, 16 nt, Human
ccuggcuuuucacugc

SEQ ID NO: 3805137 - RNA, 17 nt, Human
ccuggcuuuucacugcu

SEQ ID NO: 3805138 - RNA, 20 nt, Human
ccuggcuuuucacugcuggc

SEQ ID NO: 3805139 - RNA, 19 nt, Human
ccugggaaagagauuuaaa

SEQ ID NO: 3805140 - RNA, 20 nt, Human
ccugggaaccuuccugucuu

SEQ ID NO: 3805141 - RNA, 19 nt, Human
ccugggacagggagcagcc

SEQ ID NO: 3805142 - RNA, 20 nt, Human
ccugggaccuccccugaggc

SEQ ID NO: 3805143 - RNA, 18 nt, Human
ccugggacggcggcagua

SEQ ID NO: 3805144 - RNA, 14 nt, Human
ccugggacuuccau

SEQ ID NO: 3805145 - RNA, 18 nt, Human
ccugggacuuccaugccu

SEQ ID NO: 3805146 - RNA, 20 nt, Human
ccugggacuuccaugccuua

SEQ ID NO: 3805147 - RNA, 22 nt, Human
ccugggagaaaucuggcuucug

SEQ ID NO: 3805148 - RNA, 17 nt, Human
ccugggagaaccucagg

SEQ ID NO: 3805149 - RNA, 15 nt, Human
ccugggagacagacc

SEQ ID NO: 3805150 - RNA, 13 nt, Human
ccugggaggcagu

SEQ ID NO: 3805151 - RNA, 12 nt, Human
ccugggaggccc

SEQ ID NO: 3805152 - RNA, 23 nt, Human
ccugggaggcggagaguacagug

SEQ ID NO: 3805153 - RNA, 23 nt, Human
ccugggaggcgggcgcacugccu

SEQ ID NO: 3805154 - RNA, 13 nt, Human
ccugggaggcucu

SEQ ID NO: 3805155 - RNA, 20 nt, Human
ccugggaggucaaggcugca

SEQ ID NO: 3805156 - RNA, 23 nt, Human
ccugggagguggagguugcagug

SEQ ID NO: 3805157 - RNA, 18 nt, Human
ccugggagugagcugguu

SEQ ID NO: 3805158 - RNA, 23 nt, Human
ccugggaguuuuguauucaucuu

SEQ ID NO: 3805159 - RNA, 17 nt, Human
ccugggauaggggcaga

SEQ ID NO: 3805160 - RNA, 16 nt, Human
ccugggaucccucauc

SEQ ID NO: 3805161 - RNA, 15 nt, Human
ccuguucaaggcccc

SEQ ID NO: 3805162 - RNA, 21 nt, Human
ccuguucacucuacuuagcau

SEQ ID NO: 3805163 - RNA, 12 nt, Human
ccuguucagcau

SEQ ID NO: 3805164 - RNA, 15 nt, Human
ccuguucagcuccag

SEQ ID NO: 3805165 - RNA, 18 nt, Human
ccuguucauggcagaugu

SEQ ID NO: 3805166 - RNA, 15 nt, Human
cuuaaaaccugcuuu

SEQ ID NO: 3805167 - RNA, 22 nt, Human
cuuaaaacuaggcauuuguaaa

SEQ ID NO: 3805168 - RNA, 18 nt, Human
cuuaaaagaggaaaauga

SEQ ID NO: 3805169 - RNA, 24 nt, Human
cuuaaaagcuaucuucauguaaau

SEQ ID NO: 3805170 - RNA, 14 nt, Human
cuuaaaauaagcag

SEQ ID NO: 3805171 - RNA, 14 nt, Human
cuuaaaauacaaga

SEQ ID NO: 3805172 - RNA, 22 nt, Human
cuuaaaauagcaacacucuaua

SEQ ID NO: 3805173 - RNA, 14 nt, Human
cuuaaaauauuuua

SEQ ID NO: 3805174 - RNA, 14 nt, Human
cuuaaaaugcaaua

SEQ ID NO: 3805175 - RNA, 14 nt, Human
cuuaaaauuugaaa

SEQ ID NO: 3805176 - RNA, 15 nt, Human
cuuaaaauuugaaac

SEQ ID NO: 3805177 - RNA, 20 nt, Human
cuuaaaauuugaaacauugc

SEQ ID NO: 3805178 - RNA, 19 nt, Human
cuuaaacaaaaauuaaaau

SEQ ID NO: 3805179 - RNA, 14 nt, Human
cuuaaacaaaugua

SEQ ID NO: 3805180 - RNA, 15 nt, Human
cuuaaacaccccuca

SEQ ID NO: 3805181 - RNA, 18 nt, Human
cuuaaacaguugcacagc

SEQ ID NO: 3805182 - RNA, 19 nt, Human
cuuaaacaguugcacagca

SEQ ID NO: 3805183 - RNA, 22 nt, Human
cuuaaacaguugcacagcaucu

SEQ ID NO: 3805184 - RNA, 15 nt, Human
cuuaaaccuucaguu

SEQ ID NO: 3805185 - RNA, 12 nt, Human
cuuaaagaaagu

SEQ ID NO: 3805186 - RNA, 22 nt, Human
cuuaaagaaagucgaauuaaua

SEQ ID NO: 3805187 - RNA, 20 nt, Human
cuuaaagaaguauuuuuaga

SEQ ID NO: 3805188 - RNA, 18 nt, Human
cuuaaagaauucaaauuu

SEQ ID NO: 3805189 - RNA, 18 nt, Human
cuuaaagcugccuguagu

SEQ ID NO: 3805190 - RNA, 20 nt, Human
cuuaaaggcaccaucuaaua

SEQ ID NO: 3805191 - RNA, 18 nt, Human
cuuaaaggugucuuccuc

SEQ ID NO: 3805192 - RNA, 14 nt, Human
cuuaaagucaggag

SEQ ID NO: 3805193 - RNA, 11 nt, Human
cuuaaaguuga

SEQ ID NO: 3805194 - RNA, 15 nt, Human
cuuaaaguugucacu

SEQ ID NO: 3805195 - RNA, 23 nt, Human
cuuaaauaaaagaaaugcacaau

SEQ ID NO: 3805196 - RNA, 17 nt, Human
cuuaaauaagaaacuuu

SEQ ID NO: 3805197 - RNA, 20 nt, Human
cuuaaauaaugcuucagaua

SEQ ID NO: 3805198 - RNA, 18 nt, Human
cuuaaauaucaaucauuu

SEQ ID NO: 3805199 - RNA, 11 nt, Human
cuuaaaucuua

SEQ ID NO: 3805200 - RNA, 12 nt, Human
cuuaaaucuuaa

SEQ ID NO: 3805201 - RNA, 21 nt, Human
cuuaaaugaaagcauguggca

SEQ ID NO: 3805202 - RNA, 16 nt, Human
cuuaaaugagaaggaa

SEQ ID NO: 3805203 - RNA, 12 nt, Human
cuuaaaugugaa

SEQ ID NO: 3805204 - RNA, 13 nt, Human
cuuaaaugugaau

SEQ ID NO: 3805205 - RNA, 22 nt, Human
cuuaaaugugaauuacuaacuu

SEQ ID NO: 3805206 - RNA, 18 nt, Human
cuuaaauguuauguauau

SEQ ID NO: 3805207 - RNA, 14 nt, Human
cuuaaauuaaacaa

SEQ ID NO: 3805208 - RNA, 15 nt, Human
cuuaaauuaaacaau

SEQ ID NO: 3805209 - RNA, 14 nt, Human
cuuaaauuccucaa

SEQ ID NO: 3805210 - RNA, 18 nt, Human
cuuaaauuucuuauguga

SEQ ID NO: 3805211 - RNA, 17 nt, Human
cuuaaauuuuaauuuau

SEQ ID NO: 3805212 - RNA, 17 nt, Human
cuuaacauauuuacuaa

SEQ ID NO: 3805213 - RNA, 17 nt, Human
cuuaacaugcuguguaa

SEQ ID NO: 3805214 - RNA, 17 nt, Human
cuuaacauucuguaaaa

SEQ ID NO: 3805215 - RNA, 20 nt, Human
cuuaacauuucuaacucuga

SEQ ID NO: 3805216 - RNA, 24 nt, Human
cuuaacauuucuaacucugaugua

SEQ ID NO: 3805217 - RNA, 14 nt, Human
cuuaaccaguugug

SEQ ID NO: 3805218 - RNA, 12 nt, Human
cuuaaccaucuu

SEQ ID NO: 3805219 - RNA, 13 nt, Human
cuuaacccaagga

SEQ ID NO: 3805220 - RNA, 22 nt, Human
cuuaacccugacaaauuuuaau

SEQ ID NO: 3805221 - RNA, 14 nt, Human
cuuaacggcuccag

SEQ ID NO: 3805222 - RNA, 15 nt, Human
cuuaacggcuccagg

SEQ ID NO: 3805223 - RNA, 13 nt, Human
cuuaacucuuugc

SEQ ID NO: 3805224 - RNA, 12 nt, Human
cuuaacuucaca

SEQ ID NO: 3805225 - RNA, 14 nt, Human
cuuaacuucuugcu

SEQ ID NO: 3805226 - RNA, 19 nt, Human
cuuaagaauuccaaaaaaa

SEQ ID NO: 3805227 - RNA, 19 nt, Human
cuuaagacagaguauccug

SEQ ID NO: 3805228 - RNA, 18 nt, Human
cuuaagacagcauguguu

SEQ ID NO: 3805229 - RNA, 19 nt, Human
cuuaagaccaccucaaauu

SEQ ID NO: 3805230 - RNA, 20 nt, Human
cuuaagaccaccucaaauuu

SEQ ID NO: 3805231 - RNA, 18 nt, Human
cuuaagagaauauuuuaa

SEQ ID NO: 3805232 - RNA, 18 nt, Human
cuuaagcaaaagaaaaag

SEQ ID NO: 3805233 - RNA, 19 nt, Human
cuuaagcaaaggggacagc

SEQ ID NO: 3805234 - RNA, 17 nt, Human
cuuaagcaucuggcucu

SEQ ID NO: 3805235 - RNA, 21 nt, Human
cuuaagccacugccucucccu

SEQ ID NO: 3805236 - RNA, 22 nt, Human
cuuaagccacugccucucccuc

SEQ ID NO: 3805237 - RNA, 17 nt, Human
cuuaagccaucuuggua

SEQ ID NO: 3805238 - RNA, 11 nt, Human
cuuaagcugau

SEQ ID NO: 3805239 - RNA, 13 nt, Human
cuuaagcuuugga

SEQ ID NO: 3805240 - RNA, 18 nt, Human
cuuaaggacaaagugcca

SEQ ID NO: 3805241 - RNA, 14 nt, Human
cuuaaggggcagcu

SEQ ID NO: 3805242 - RNA, 15 nt, Human
cuuaaggggcagcuu

SEQ ID NO: 3805243 - RNA, 18 nt, Human
cuuaaggggcagcuucua

SEQ ID NO: 3805244 - RNA, 19 nt, Human
cuuaaggugaggccugucu

SEQ ID NO: 3805245 - RNA, 21 nt, Human
cuuaaggugaggccugucugu

SEQ ID NO: 3805246 - RNA, 20 nt, Human
cuuaaguacuguagaaaaga

SEQ ID NO: 3805247 - RNA, 19 nt, Human
cuuaaguauaucauguaaa

SEQ ID NO: 3805248 - RNA, 18 nt, Human
cuuaagugaggaaaucaa

SEQ ID NO: 3805249 - RNA, 21 nt, Human
cuuaagugaggaaaucaaagu

SEQ ID NO: 3805250 - RNA, 21 nt, Human
cuuaaguuaguuccacugaga

SEQ ID NO: 3805251 - RNA, 17 nt, Human
cuuaaguuucucagcuc

SEQ ID NO: 3805252 - RNA, 21 nt, Human
cuuaauaaaaaugacagacug

SEQ ID NO: 3805253 - RNA, 19 nt, Human
cuuaauaaacuguggugcu

SEQ ID NO: 3805254 - RNA, 18 nt, Human
cuuaauaaauucagauau

SEQ ID NO: 3805255 - RNA, 21 nt, Human
cuuaauaaucaagagccuuaa

SEQ ID NO: 3805256 - RNA, 19 nt, Human
cuuaauacuguuauucuuu

SEQ ID NO: 3805257 - RNA, 17 nt, Human
cuuaauaguauuuauga

SEQ ID NO: 3805258 - RNA, 20 nt, Human
cuuaauauauagcauuuaug

SEQ ID NO: 3805259 - RNA, 19 nt, Human
cuuaauauucuggagucau

SEQ ID NO: 3805260 - RNA, 12 nt, Human
cuuaauauuucu

SEQ ID NO: 3805261 - RNA, 19 nt, Human
cuuaauauuucuucaaaua

SEQ ID NO: 3805262 - RNA, 20 nt, Human
cuuaaucauuuucauuccua

SEQ ID NO: 3805263 - RNA, 16 nt, Human
cuuaaucuaaauggaa

SEQ ID NO: 3805264 - RNA, 17 nt, Human
cuuaaucuuuucacaaa

SEQ ID NO: 3805265 - RNA, 23 nt, Human
cuuaaugaaguuugaauguuaaa

SEQ ID NO: 3805266 - RNA, 21 nt, Human
cuuaaugaaugagucuguugu

SEQ ID NO: 3805267 - RNA, 14 nt, Human
cuuaaugagauagu

SEQ ID NO: 3805268 - RNA, 15 nt, Human
cuuaaugcuucuuuc

SEQ ID NO: 3805269 - RNA, 22 nt, Human
cuuaauggcugauaauuuuaaa

SEQ ID NO: 3805270 - RNA, 16 nt, Human
cuuaauguaucaaacu

SEQ ID NO: 3805271 - RNA, 14 nt, Human
cuuaauguucuuau

SEQ ID NO: 3805272 - RNA, 15 nt, Human
cuuaauguuuauucc

SEQ ID NO: 3805273 - RNA, 19 nt, Human
cuuaauuaaguaaacuaau

SEQ ID NO: 3805274 - RNA, 17 nt, Human
cuuaauuaauuugauua

SEQ ID NO: 3805275 - RNA, 12 nt, Human
cuuaauuacuua

SEQ ID NO: 3805276 - RNA, 14 nt, Human
cuuaauuauuauaa

SEQ ID NO: 3805277 - RNA, 19 nt, Human
cuuaauuauuauaaaaaua

SEQ ID NO: 3805278 - RNA, 16 nt, Human
cuuaauuauugauguu

SEQ ID NO: 3805279 - RNA, 13 nt, Human
cuuaauucaaaua

SEQ ID NO: 3805280 - RNA, 13 nt, Human
cuuaauucuguuc

SEQ ID NO: 3805281 - RNA, 22 nt, Human
cuuaauucuguucugauauuaa

SEQ ID NO: 3805282 - RNA, 23 nt, Human
cuuaauucuguucugauauuaau

SEQ ID NO: 3805283 - RNA, 16 nt, Human
cuuaauuguucauuuu

SEQ ID NO: 3805284 - RNA, 12 nt, Human
cuuaauuuccuu

SEQ ID NO: 3805285 - RNA, 21 nt, Human
cuuaauuuccuuuuugacacu

SEQ ID NO: 3805286 - RNA, 21 nt, Human
cuuaauuuggaaacuaauaaa

SEQ ID NO: 3805287 - RNA, 18 nt, Human
cuuaauuuucaguauaau

SEQ ID NO: 3805288 - RNA, 23 nt, Human
cuuaauuuugguuguauucuuug

SEQ ID NO: 3805289 - RNA, 20 nt, Human
cuuacaaaguguauuuuaua

SEQ ID NO: 3805290 - RNA, 14 nt, Human
cuuacaaaugaaaa

SEQ ID NO: 3805291 - RNA, 21 nt, Human
cuuacaauauugauugggaaa

SEQ ID NO: 3805292 - RNA, 22 nt, Human
cuuacaauuuuuuuaauuuugu

SEQ ID NO: 3805293 - RNA, 13 nt, Human
cuuacacaaaggg

SEQ ID NO: 3805294 - RNA, 20 nt, Human
cuuacacaagacuuucccca

SEQ ID NO: 3805295 - RNA, 13 nt, Human
cuuacacaauggu

SEQ ID NO: 3805296 - RNA, 20 nt, Human
cuuacaccucguuagggaag

SEQ ID NO: 3805297 - RNA, 20 nt, Human
cuuacacugccuguauacuu

SEQ ID NO: 3805298 - RNA, 21 nt, Human
cuuacacugccuguauacuuu

SEQ ID NO: 3805299 - RNA, 17 nt, Human
cuuacacuuacuguugu

SEQ ID NO: 3805300 - RNA, 16 nt, Human
cuuacagcaaauccuu

SEQ ID NO: 3805301 - RNA, 18 nt, Human
cuuacagcaaauccuuug

SEQ ID NO: 3805302 - RNA, 15 nt, Human
cuuacagccucugac

SEQ ID NO: 3805303 - RNA, 14 nt, Human
cuuacagcugggug

SEQ ID NO: 3805304 - RNA, 16 nt, Human
cuuacaguaggagccc

SEQ ID NO: 3805305 - RNA, 23 nt, Human
cuuacaguaggagcccagcucug

SEQ ID NO: 3805306 - RNA, 15 nt, Human
ccuuauucaggaaaa

SEQ ID NO: 3805307 - RNA, 18 nt, Human
ccuuauugcuguccugga

SEQ ID NO: 3805308 - RNA, 16 nt, Human
ccuuauuuuuucccaa

SEQ ID NO: 3805309 - RNA, 12 nt, Human
ccuucaaagcug

SEQ ID NO: 3805310 - RNA, 22 nt, Human
ccuucaacaauucuaaaaugau

SEQ ID NO: 3805311 - RNA, 13 nt, Human
ccuucaacugaaa

SEQ ID NO: 3805312 - RNA, 14 nt, Human
ccuucaagcucuga

SEQ ID NO: 3805313 - RNA, 19 nt, Human
ccuucaaguuagcucagga

SEQ ID NO: 3805314 - RNA, 16 nt, Human
ccuucaauaaaguauc

SEQ ID NO: 3805315 - RNA, 22 nt, Human
ccuucaauaaaugguauagcaa

SEQ ID NO: 3805316 - RNA, 12 nt, Human
ccuucacaaagc

SEQ ID NO: 3805317 - RNA, 17 nt, Human
ccuucacauacccuccc

SEQ ID NO: 3805318 - RNA, 20 nt, Human
ccuucacauccuguguuucu

SEQ ID NO: 3805319 - RNA, 20 nt, Human
ccuucaccuuuguccccacc

SEQ ID NO: 3805320 - RNA, 19 nt, Human
ccuucacugucaccacccu

SEQ ID NO: 3805321 - RNA, 22 nt, Human
ccuucacuucugaccacacuuc

SEQ ID NO: 3805322 - RNA, 11 nt, Human
ccuucagacac

SEQ ID NO: 3805323 - RNA, 17 nt, Human
ccuucagacacccucaa

SEQ ID NO: 3805324 - RNA, 18 nt, Human
ccuucagacuuugcuucc

SEQ ID NO: 3805325 - RNA, 20 nt, Human
ccuucagagagcagugcuuu

SEQ ID NO: 3805326 - RNA, 23 nt, Human
ccuucagagagcagugcuuuugg

SEQ ID NO: 3805327 - RNA, 18 nt, Human
ccuucagagguggcucug

SEQ ID NO: 3805328 - RNA, 20 nt, Human
ccuucagauccuaccccuga

SEQ ID NO: 3805329 - RNA, 15 nt, Human
ccuucagcccucacc

SEQ ID NO: 3805330 - RNA, 20 nt, Human
ccuucagggugaugccaggu

SEQ ID NO: 3805331 - RNA, 22 nt, Human
ccuucaguaacccccacuggac

SEQ ID NO: 3805332 - RNA, 19 nt, Human
cuguuggacccgcucugga

SEQ ID NO: 3805333 - RNA, 17 nt, Human
cuguuggauuccaugcu

SEQ ID NO: 3805334 - RNA, 19 nt, Human
cuguuggauuuguuuaaaa

SEQ ID NO: 3805335 - RNA, 14 nt, Human
cuguuggcagugag

SEQ ID NO: 3805336 - RNA, 15 nt, Human
cuguuggccagugug

SEQ ID NO: 3805337 - RNA, 18 nt, Human
cuguugggguggguauaa

SEQ ID NO: 3805338 - RNA, 21 nt, Human
cuguuguaagaauucugauug

SEQ ID NO: 3805339 - RNA, 18 nt, Human
cuguuguacauuuaugau

SEQ ID NO: 3805340 - RNA, 15 nt, Human
cuguuguagaagaca

SEQ ID NO: 3805341 - RNA, 17 nt, Human
cuguugucaccuucacc

SEQ ID NO: 3805342 - RNA, 12 nt, Human
cuguugucauug

SEQ ID NO: 3805343 - RNA, 14 nt, Human
cuguuguccucccc

SEQ ID NO: 3805344 - RNA, 15 nt, Human
cuguuguccuccccu

SEQ ID NO: 3805345 - RNA, 18 nt, Human
cuguugucucuucuccuu

SEQ ID NO: 3805346 - RNA, 16 nt, Human
cuguugugccacagag

SEQ ID NO: 3805347 - RNA, 23 nt, Human
cuguugugccacagaguguagcc

SEQ ID NO: 3805348 - RNA, 17 nt, Human
cuguuguguucguucuu

SEQ ID NO: 3805349 - RNA, 17 nt, Human
cuguuguguuguuguua

SEQ ID NO: 3805350 - RNA, 22 nt, Human
cuguuguuaucuguuugagaaa

SEQ ID NO: 3805351 - RNA, 19 nt, Human
cuguuguuaugaugugcuu

SEQ ID NO: 3805352 - RNA, 23 nt, Human
cuguuguuguuaaugaaaauguc

SEQ ID NO: 3805353 - RNA, 20 nt, Human
cuguuuaaaaaaccacaugg

SEQ ID NO: 3805354 - RNA, 19 nt, Human
cuguuuaaauauuucaaga

SEQ ID NO: 3805355 - RNA, 23 nt, Human
cuguuuaaauguuuuucuaugua

SEQ ID NO: 3805356 - RNA, 12 nt, Human
cuguuuaagaaa

SEQ ID NO: 3805357 - RNA, 22 nt, Human
cuguuuaagaaaaguauuuuga

SEQ ID NO: 3805358 - RNA, 18 nt, Human
cuguuuaagacacuuccg

SEQ ID NO: 3805359 - RNA, 16 nt, Human
cuguuuacaagaaaaa

SEQ ID NO: 3805360 - RNA, 17 nt, Human
cuguuuacaagaaaaaa

SEQ ID NO: 3805361 - RNA, 20 nt, Human
cuguuuacaagaaaaaauga

SEQ ID NO: 3805362 - RNA, 13 nt, Human
cuguuuacagugu

SEQ ID NO: 3805363 - RNA, 17 nt, Human
cuguuuacugcaagguu

SEQ ID NO: 3805364 - RNA, 17 nt, Human
cuguuuagauaauacac

SEQ ID NO: 3805365 - RNA, 20 nt, Human
cuguuuagcagcagccuuua

SEQ ID NO: 3805366 - RNA, 18 nt, Human
cuguuuagguuccccugu

SEQ ID NO: 3805367 - RNA, 19 nt, Human
cuguuuagguuccccuguc

SEQ ID NO: 3805368 - RNA, 21 nt, Human
cuguuuagguuccccugucaa

SEQ ID NO: 3805369 - RNA, 20 nt, Human
cuguuuaguagcagugauug

SEQ ID NO: 3805370 - RNA, 15 nt, Human
cuguuuauagaauaa

SEQ ID NO: 3805371 - RNA, 16 nt, Human
cuguuuauauguguug

SEQ ID NO: 3805372 - RNA, 15 nt, Human
cuguuuauggccuca

SEQ ID NO: 3805373 - RNA, 21 nt, Human
cuguuuauggccucagcugcc

SEQ ID NO: 3805374 - RNA, 22 nt, Human
cuguuuauggccucagcugccu

SEQ ID NO: 3805375 - RNA, 13 nt, Human
cuguuuauuacuu

SEQ ID NO: 3805376 - RNA, 14 nt, Human
cuguuuauuacuuc

SEQ ID NO: 3805377 - RNA, 15 nt, Human
cuguuucaaacuuua

SEQ ID NO: 3805378 - RNA, 18 nt, Human
cuguuucaaagccaagac

SEQ ID NO: 3805379 - RNA, 21 nt, Human
cuguuucaaagccaagaccuc

SEQ ID NO: 3805380 - RNA, 17 nt, Human
cuguuucaacacagacc

SEQ ID NO: 3805381 - RNA, 15 nt, Human
cuguuucaaucacug

SEQ ID NO: 3805382 - RNA, 11 nt, Human
cuguuucacaa

SEQ ID NO: 3805383 - RNA, 21 nt, Human
cuguuucccagcaguggacuc

SEQ ID NO: 3805384 - RNA, 16 nt, Human
cuguuucccuucccuu

SEQ ID NO: 3805385 - RNA, 16 nt, Human
cuguuuccuagcugug

SEQ ID NO: 3805386 - RNA, 19 nt, Human
cuguuuccugacauugucu

SEQ ID NO: 3805387 - RNA, 16 nt, Human
cuguuuccugggcacg

SEQ ID NO: 3805388 - RNA, 17 nt, Human
cuguuucucuugagcug

SEQ ID NO: 3805389 - RNA, 12 nt, Human
cuguuucugaaa

SEQ ID NO: 3805390 - RNA, 16 nt, Human
cuguuucugaaaagaa

SEQ ID NO: 3805391 - RNA, 23 nt, Human
cuguuucuggacccuuauaaaau

SEQ ID NO: 3805392 - RNA, 19 nt, Human
cuguuucuuccuguuaaug

SEQ ID NO: 3805393 - RNA, 12 nt, Human
cuguuucuugcu

SEQ ID NO: 3805394 - RNA, 19 nt, Human
cuguuucuugcuuguaccu

SEQ ID NO: 3805395 - RNA, 12 nt, Human
cuguuugacaaa

SEQ ID NO: 3805396 - RNA, 15 nt, Human
cuguuugacaaaccu

SEQ ID NO: 3805397 - RNA, 15 nt, Human
cuguuugacaccucu

SEQ ID NO: 3805398 - RNA, 19 nt, Human
cuguuugacaccucuuuuu

SEQ ID NO: 3805399 - RNA, 23 nt, Human
cuguuugacaccucuuuuuucgu

SEQ ID NO: 3805400 - RNA, 13 nt, Human
cuguuugauucuu

SEQ ID NO: 3805401 - RNA, 14 nt, Human
cuguuugauucuuu

SEQ ID NO: 3805402 - RNA, 19 nt, Human
cuguuugcugauggucugg

SEQ ID NO: 3805403 - RNA, 13 nt, Human
cuguuugcugugc

SEQ ID NO: 3805404 - RNA, 17 nt, Human
cuguuugcuucaccgug

SEQ ID NO: 3805405 - RNA, 21 nt, Human
cuguuugcuucaccguggauu

SEQ ID NO: 3805406 - RNA, 23 nt, Human
cuguuuggaaauaaaucuuccua

SEQ ID NO: 3805407 - RNA, 19 nt, Human
cuguuuggauuuuuaauua

SEQ ID NO: 3805408 - RNA, 21 nt, Human
cuguuuggauuuuuaauuaaa

SEQ ID NO: 3805409 - RNA, 21 nt, Human
cuguuugggaagagcuuagaa

SEQ ID NO: 3805410 - RNA, 16 nt, Human
cuguuugggccccucu

SEQ ID NO: 3805411 - RNA, 20 nt, Human
cuguuugggccccucuccca

SEQ ID NO: 3805412 - RNA, 17 nt, Human
cuguuuguagugaaaua

SEQ ID NO: 3805413 - RNA, 11 nt, Human
cuguuugucau

SEQ ID NO: 3805414 - RNA, 20 nt, Human
cuguuuguuuacaaaaucag

SEQ ID NO: 3805415 - RNA, 14 nt, Human
cuguuuguuucaag

SEQ ID NO: 3805416 - RNA, 15 nt, Human
cuguuuuauaauuuu

SEQ ID NO: 3805417 - RNA, 13 nt, Human
cuguuuuaugacu

SEQ ID NO: 3805418 - RNA, 21 nt, Human
cuguuuuauuuuaauucaguu

SEQ ID NO: 3805419 - RNA, 16 nt, Human
cuguuuucccacgagg

SEQ ID NO: 3805420 - RNA, 20 nt, Human
cuguuuuccucccuucugcu

SEQ ID NO: 3805421 - RNA, 21 nt, Human
cuguuuuccucccuucugcua

SEQ ID NO: 3805422 - RNA, 23 nt, Human
cuguuuuccucccuucugcuacu

SEQ ID NO: 3805423 - RNA, 14 nt, Human
cuguuuuccuuucu

SEQ ID NO: 3805424 - RNA, 18 nt, Human
cuguuuuccuuucucacc

SEQ ID NO: 3805425 - RNA, 18 nt, Human
cuguuuucuaguguauca

SEQ ID NO: 3805426 - RNA, 22 nt, Human
cuguuuucuaguguaucaaaau

SEQ ID NO: 3805427 - RNA, 14 nt, Human
cuguuuucucuuga

SEQ ID NO: 3805428 - RNA, 20 nt, Human
cuguuuucugagcccgggcu

SEQ ID NO: 3805429 - RNA, 18 nt, Human
cuguuuucuucuauucca

SEQ ID NO: 3805430 - RNA, 17 nt, Human
cuguuuugaguuccuau

SEQ ID NO: 3805431 - RNA, 14 nt, Human
cuguuuugccagcc

SEQ ID NO: 3805432 - RNA, 20 nt, Human
cuguuuuguacauagauuua

SEQ ID NO: 3805433 - RNA, 20 nt, Human
cuguuuuguggucagcugua

SEQ ID NO: 3805434 - RNA, 13 nt, Human
cuguuuuguugac

SEQ ID NO: 3805435 - RNA, 20 nt, Human
cuguuuuguugacauucuga

SEQ ID NO: 3805436 - RNA, 21 nt, Human
cuguuuuguugacauucugaa

SEQ ID NO: 3805437 - RNA, 14 nt, Human
cuguuuuuaaaaau

SEQ ID NO: 3805438 - RNA, 16 nt, Human
cuguuuuuaaaaauua

SEQ ID NO: 3805439 - RNA, 16 nt, Human
cuguuuuuaagcuguu

SEQ ID NO: 3805440 - RNA, 13 nt, Human
cuguuuuuaccca

SEQ ID NO: 3805441 - RNA, 13 nt, Human
cuguuuuucacau

SEQ ID NO: 3805442 - RNA, 17 nt, Human
cuguuuuucagggaggu

SEQ ID NO: 3805443 - RNA, 14 nt, Human
cuguuuuuccauag

SEQ ID NO: 3805444 - RNA, 15 nt, Human
cuguuuuucggacag

SEQ ID NO: 3805445 - RNA, 17 nt, Human
cuguuuuucggacaguu

SEQ ID NO: 3805446 - RNA, 17 nt, Human
cuguuuuucuaacuggg

SEQ ID NO: 3805447 - RNA, 15 nt, Human
cuguuuuucugggug

SEQ ID NO: 3805448 - RNA, 15 nt, Human
cuguuuuuguuucuu

SEQ ID NO: 3805449 - RNA, 17 nt, Human
cuguuuuuuccugagcu

SEQ ID NO: 3805450 - RNA, 18 nt, Human
cuguuuuuuccugagcuu

SEQ ID NO: 3805451 - RNA, 21 nt, Human
cuucacaaucugucaguucua

SEQ ID NO: 3805452 - RNA, 21 nt, Human
cuucacaauggugcucauuuc

SEQ ID NO: 3805453 - RNA, 13 nt, Human
cuucacacacaga

SEQ ID NO: 3805454 - RNA, 22 nt, Human
cuucacacacaggcaacugagg

SEQ ID NO: 3805455 - RNA, 18 nt, Human
cuucacacugcaagagcc

SEQ ID NO: 3805456 - RNA, 20 nt, Human
cuucacacugcaagagccuu

SEQ ID NO: 3805457 - RNA, 13 nt, Human
cuucacagagugu

SEQ ID NO: 3805458 - RNA, 18 nt, Human
cuucacaguagagccagc

SEQ ID NO: 3805459 - RNA, 20 nt, Human
cuucacaguagagccagcuu

SEQ ID NO: 3805460 - RNA, 21 nt, Human
cuucacaguagagccagcuug

SEQ ID NO: 3805461 - RNA, 22 nt, Human
cuucacaguagagccagcuugg

SEQ ID NO: 3805462 - RNA, 12 nt, Human
cuucacaguguu

SEQ ID NO: 3805463 - RNA, 13 nt, Human
cuucacaguguuu

SEQ ID NO: 3805464 - RNA, 15 nt, Human
cuucacauuaaaaaa

SEQ ID NO: 3805465 - RNA, 17 nt, Human
cuucacauuaaaaaaug

SEQ ID NO: 3805466 - RNA, 22 nt, Human
cuucacauuccccuggggaccc

SEQ ID NO: 3805467 - RNA, 19 nt, Human
cuucaccagagcauuucca

SEQ ID NO: 3805468 - RNA, 22 nt, Human
cuucaccagaggaaucacucuu

SEQ ID NO: 3805469 - RNA, 23 nt, Human
cuucaccccaguggccacucagc

SEQ ID NO: 3805470 - RNA, 15 nt, Human
cuucaccccccacuc

SEQ ID NO: 3805471 - RNA, 18 nt, Human
cuucaccccggcaggccc

SEQ ID NO: 3805472 - RNA, 21 nt, Human
cuucacccugaaugguuccau

SEQ ID NO: 3805473 - RNA, 15 nt, Human
cuucacccugaguuu

SEQ ID NO: 3805474 - RNA, 15 nt, Human
cuucacccuggagcc

SEQ ID NO: 3805475 - RNA, 18 nt, Human
cuucaccuaagucucugu

SEQ ID NO: 3805476 - RNA, 20 nt, Human
cuucaccugauucaacuaaa

SEQ ID NO: 3805477 - RNA, 21 nt, Human
cuucaccugauucaacuaaaa

SEQ ID NO: 3805478 - RNA, 20 nt, Human
cuucaccuuuguccccaccg

SEQ ID NO: 3805479 - RNA, 18 nt, Human
cuucacgaaguguugcau

SEQ ID NO: 3805480 - RNA, 16 nt, Human
cuucacggcaggacaa

SEQ ID NO: 3805481 - RNA, 18 nt, Human
cuucacuacuuuaauaaa

SEQ ID NO: 3805482 - RNA, 22 nt, Human
cuucacuccggugugccugcag

SEQ ID NO: 3805483 - RNA, 15 nt, Human
cuucacuccugcugu

SEQ ID NO: 3805484 - RNA, 13 nt, Human
cuucacugccuuu

SEQ ID NO: 3805485 - RNA, 17 nt, Human
cuucacugccuuugcuc

SEQ ID NO: 3805486 - RNA, 13 nt, Human
cuucacuguauaa

SEQ ID NO: 3805487 - RNA, 12 nt, Human
cuucacugucac

SEQ ID NO: 3805488 - RNA, 21 nt, Human
cuucacuguccuccaagccag

SEQ ID NO: 3805489 - RNA, 16 nt, Human
cuucacuguugaaaau

SEQ ID NO: 3805490 - RNA, 13 nt, Human
cuucacuucugac

SEQ ID NO: 3805491 - RNA, 15 nt, Human
cuucacuucugacca

SEQ ID NO: 3805492 - RNA, 21 nt, Human
cuucacuucugacucuucccc

SEQ ID NO: 3805493 - RNA, 21 nt, Human
cuucacuuuaauucucaugug

SEQ ID NO: 3805494 - RNA, 14 nt, Human
cuucacuuuugcaa

SEQ ID NO: 3805495 - RNA, 11 nt, Human
cuucagaaaga

SEQ ID NO: 3805496 - RNA, 19 nt, Human
cuucagacagagaggacug

SEQ ID NO: 3805497 - RNA, 11 nt, Human
cuucagacaua

SEQ ID NO: 3805498 - RNA, 15 nt, Human
cuucagacuuugcuu

SEQ ID NO: 3805499 - RNA, 16 nt, Human
cuucagagacuccugc

SEQ ID NO: 3805500 - RNA, 18 nt, Human
cuucagagacuccugcag

SEQ ID NO: 3805501 - RNA, 22 nt, Human
cuucagagacuccugcaggcag

SEQ ID NO: 3805502 - RNA, 24 nt, Human
cuucagagacuccugcaggcagcc

SEQ ID NO: 3805503 - RNA, 19 nt, Human
cuucagagagcagugcuuu

SEQ ID NO: 3805504 - RNA, 22 nt, Human
cuucagagagcagugcuuuugg

SEQ ID NO: 3805505 - RNA, 16 nt, Human
cuucagagagcuggua

SEQ ID NO: 3805506 - RNA, 18 nt, Human
cuucagagauaggccugu

SEQ ID NO: 3805507 - RNA, 18 nt, Human
cuucagagcugacacagg

SEQ ID NO: 3805508 - RNA, 13 nt, Human
cuucagaggcuga

SEQ ID NO: 3805509 - RNA, 20 nt, Human
cuucagaucagugcuugagu

SEQ ID NO: 3805510 - RNA, 21 nt, Human
cuucagaugggaggaaagaga

SEQ ID NO: 3805511 - RNA, 17 nt, Human
cuucagauguggagcca

SEQ ID NO: 3805512 - RNA, 17 nt, Human
cuucagcaagagagaac

SEQ ID NO: 3805513 - RNA, 20 nt, Human
cuucagcaaguuagaacuag

SEQ ID NO: 3805514 - RNA, 14 nt, Human
cuucagcacuuuag

SEQ ID NO: 3805515 - RNA, 16 nt, Human
cuucagcauucccucc

SEQ ID NO: 3805516 - RNA, 17 nt, Human
cuucagcauucccuccc

SEQ ID NO: 3805517 - RNA, 18 nt, Human
cuucagcauucccuccca

SEQ ID NO: 3805518 - RNA, 15 nt, Human
cuucagccaccucuc

SEQ ID NO: 3805519 - RNA, 17 nt, Human
cuucagccaccucucuu

SEQ ID NO: 3805520 - RNA, 18 nt, Human
cuucagccaggagcuggg

SEQ ID NO: 3805521 - RNA, 15 nt, Human
cuucagcccccagcc

SEQ ID NO: 3805522 - RNA, 16 nt, Human
cuucagcccccagccc

SEQ ID NO: 3805523 - RNA, 17 nt, Human
cuucagcccccagcccc

SEQ ID NO: 3805524 - RNA, 20 nt, Human
cuucagcccccagccccucc

SEQ ID NO: 3805525 - RNA, 19 nt, Human
cuucagcccucaccccugg

SEQ ID NO: 3805526 - RNA, 17 nt, Human
cuucagccuaguggcuu

SEQ ID NO: 3805527 - RNA, 13 nt, Human
cuucagccuccca

SEQ ID NO: 3805528 - RNA, 14 nt, Human
cuucagccucccac

SEQ ID NO: 3805529 - RNA, 15 nt, Human
cuucagccucccaca

SEQ ID NO: 3805530 - RNA, 17 nt, Human
cuucagccucccacagu

SEQ ID NO: 3805531 - RNA, 20 nt, Human
cuucagccucuuucuguccc

SEQ ID NO: 3805532 - RNA, 14 nt, Human
cuucagccugaggc

SEQ ID NO: 3805533 - RNA, 22 nt, Human
cuucagccugaggcugagacug

SEQ ID NO: 3805534 - RNA, 16 nt, Human
cuucagcgguuuauau

SEQ ID NO: 3805535 - RNA, 18 nt, Human
cuucagcgguuuauauaa

SEQ ID NO: 3805536 - RNA, 18 nt, Human
cuuccuccagcugcacca

SEQ ID NO: 3805537 - RNA, 20 nt, Human
cuuccuccagcugcaccaga

SEQ ID NO: 3805538 - RNA, 22 nt, Human
cuuccuccagcugcaccagagc

SEQ ID NO: 3805539 - RNA, 15 nt, Human
cuuccucccucauuc

SEQ ID NO: 3805540 - RNA, 12 nt, Human
cuuccucccucc

SEQ ID NO: 3805541 - RNA, 14 nt, Human
cuuccucccucccu

SEQ ID NO: 3805542 - RNA, 18 nt, Human
cuuccucccucccucuuu

SEQ ID NO: 3805543 - RNA, 20 nt, Human
cuuccuccgaggccaguacc

SEQ ID NO: 3805544 - RNA, 16 nt, Human
cuuccuccuccccacu

SEQ ID NO: 3805545 - RNA, 18 nt, Human
cuuccuccucccuccugc

SEQ ID NO: 3805546 - RNA, 18 nt, Human
cuuccuccugacacccca

SEQ ID NO: 3805547 - RNA, 12 nt, Human
cuuccuccuggg

SEQ ID NO: 3805548 - RNA, 15 nt, Human
cuuccuccugggccc

SEQ ID NO: 3805549 - RNA, 21 nt, Human
cuuccucucauccuuuucucc

SEQ ID NO: 3805550 - RNA, 14 nt, Human
cuuccucuccaccc

SEQ ID NO: 3805551 - RNA, 15 nt, Human
cuuccucuccugucu

SEQ ID NO: 3805552 - RNA, 15 nt, Human
cuuccucuccuuccu

SEQ ID NO: 3805553 - RNA, 17 nt, Human
cuuccucuccuuccuug

SEQ ID NO: 3805554 - RNA, 20 nt, Human
cuuccucucgcggcccucag

SEQ ID NO: 3805555 - RNA, 21 nt, Human
cuuccucucgcggcccucagu

SEQ ID NO: 3805556 - RNA, 22 nt, Human
cuuccucugaggcugaaauuca

SEQ ID NO: 3805557 - RNA, 20 nt, Human
cuuccucugcagcugaccuc

SEQ ID NO: 3805558 - RNA, 16 nt, Human
cuuccucugcuaaauu

SEQ ID NO: 3805559 - RNA, 14 nt, Human
cuuccucugcuccc

SEQ ID NO: 3805560 - RNA, 15 nt, Human
cuuccucuugacccu

SEQ ID NO: 3805561 - RNA, 19 nt, Human
cuuccucuugacccugcac

SEQ ID NO: 3805562 - RNA, 14 nt, Human
cuuccucuugucug

SEQ ID NO: 3805563 - RNA, 19 nt, Human
cuuccucuuuuccuuccca

SEQ ID NO: 3805564 - RNA, 19 nt, Human
cuuccugaaacuauauuuu

SEQ ID NO: 3805565 - RNA, 15 nt, Human
cuuccugacacuuua

SEQ ID NO: 3805566 - RNA, 17 nt, Human
cuuccugacacuuuaau

SEQ ID NO: 3805567 - RNA, 14 nt, Human
cuuccugagcuuua

SEQ ID NO: 3805568 - RNA, 23 nt, Human
cuuccugaggggagacagagcaa

SEQ ID NO: 3805569 - RNA, 14 nt, Human
cuuccugaguucag

SEQ ID NO: 3805570 - RNA, 19 nt, Human
cuuccugauugguuucucu

SEQ ID NO: 3805571 - RNA, 23 nt, Human
cuuccugauugguuucucuucuc

SEQ ID NO: 3805572 - RNA, 21 nt, Human
cuuccugcaggcaggaacaaa

SEQ ID NO: 3805573 - RNA, 21 nt, Human
cuuccugcauucacccagaca

SEQ ID NO: 3805574 - RNA, 19 nt, Human
cuuccugccccucuuucuc

SEQ ID NO: 3805575 - RNA, 20 nt, Human
cuuccugccccucuuucucu

SEQ ID NO: 3805576 - RNA, 18 nt, Human
cuuccugccuggucuccu

SEQ ID NO: 3805577 - RNA, 19 nt, Human
cuuccugcuuccucagagg

SEQ ID NO: 3805578 - RNA, 14 nt, Human
cuuccugcuugcca

SEQ ID NO: 3805579 - RNA, 17 nt, Human
cuuccuggacagcugug

SEQ ID NO: 3805580 - RNA, 20 nt, Human
cuuccuggacagcugugccu

SEQ ID NO: 3805581 - RNA, 22 nt, Human
cuuccuggacagcugugccucg

SEQ ID NO: 3805582 - RNA, 14 nt, Human
cuuccuggagacug

SEQ ID NO: 3805583 - RNA, 13 nt, Human
cuuccuggagcag

SEQ ID NO: 3805584 - RNA, 19 nt, Human
cuuccuggccgccuggguc

SEQ ID NO: 3805585 - RNA, 23 nt, Human
cuuccuggccggugugggggccc

SEQ ID NO: 3805586 - RNA, 15 nt, Human
cuuccuggccugaga

SEQ ID NO: 3805587 - RNA, 19 nt, Human
cuuccuggccugagaguca

SEQ ID NO: 3805588 - RNA, 18 nt, Human
cuuccugggcacacgcug

SEQ ID NO: 3805589 - RNA, 20 nt, Human
cuuccuggggcaucuggcga

SEQ ID NO: 3805590 - RNA, 22 nt, Human
cuuccugggucuucagcauucc

SEQ ID NO: 3805591 - RNA, 17 nt, Human
cuuccuggucgaaaguu

SEQ ID NO: 3805592 - RNA, 22 nt, Human
cuuccuguaacacaagccacag

SEQ ID NO: 3805593 - RNA, 17 nt, Human
cuuccugucccaccucu

SEQ ID NO: 3805594 - RNA, 21 nt, Human
cuuccugucccaccucuucuc

SEQ ID NO: 3805595 - RNA, 15 nt, Human
cuucaguugcuuguc

SEQ ID NO: 3805596 - RNA, 19 nt, Human
cuucaguugguguguuuuu

SEQ ID NO: 3805597 - RNA, 14 nt, Human
cuucaguuguuuuc

SEQ ID NO: 3805598 - RNA, 20 nt, Human
cuucaguuucacagaaaaua

SEQ ID NO: 3805599 - RNA, 14 nt, Human
cuucauaaaugaag

SEQ ID NO: 3805600 - RNA, 23 nt, Human
cuucauacuugaacguuuucuaa

SEQ ID NO: 3805601 - RNA, 15 nt, Human
cuucauauauuucuc

SEQ ID NO: 3805602 - RNA, 17 nt, Human
cuucauaucauccacac

SEQ ID NO: 3805603 - RNA, 20 nt, Human
cuucauaucauccacacaug

SEQ ID NO: 3805604 - RNA, 23 nt, Human
cuucauaugaaaggugccaugga

SEQ ID NO: 3805605 - RNA, 20 nt, Human
cuucauauucuaaaaccauu

SEQ ID NO: 3805606 - RNA, 15 nt, Human
cuucauauugcugag

SEQ ID NO: 3805607 - RNA, 19 nt, Human
cuucaucauucccucucau

SEQ ID NO: 3805608 - RNA, 15 nt, Human
cuucaucccauucca

SEQ ID NO: 3805609 - RNA, 23 nt, Human
cuucaucccauuccaggcagccu

SEQ ID NO: 3805610 - RNA, 15 nt, Human
cuucaucccuuucca

SEQ ID NO: 3805611 - RNA, 19 nt, Human
cuucauccuuagcaacagc

SEQ ID NO: 3805612 - RNA, 16 nt, Human
cuucaucuaauaugau

SEQ ID NO: 3805613 - RNA, 13 nt, Human
cuucaucuccagg

SEQ ID NO: 3805614 - RNA, 19 nt, Human
cuucaucucccaccuagca

SEQ ID NO: 3805615 - RNA, 15 nt, Human
cuucaucugcccaac

SEQ ID NO: 3805616 - RNA, 14 nt, Human
cuucaucuggcaac

SEQ ID NO: 3805617 - RNA, 14 nt, Human
cuucaucuggcugc

SEQ ID NO: 3805618 - RNA, 12 nt, Human
cuucaucuuccc

SEQ ID NO: 3805619 - RNA, 14 nt, Human
cuucaucuuccugu

SEQ ID NO: 3805620 - RNA, 22 nt, Human
cuucaucuuccuguguccugaa

SEQ ID NO: 3805621 - RNA, 12 nt, Human
cuucaucuucuc

SEQ ID NO: 3805622 - RNA, 16 nt, Human
cuucaucuucucagcu

SEQ ID NO: 3805623 - RNA, 17 nt, Human
cuucaucuucucagcuc

SEQ ID NO: 3805624 - RNA, 16 nt, Human
cuucaugacagccucc

SEQ ID NO: 3805625 - RNA, 17 nt, Human
cuucaugcaaugacauc

SEQ ID NO: 3805626 - RNA, 18 nt, Human
cuucaugcacuuaaagaa

SEQ ID NO: 3805627 - RNA, 20 nt, Human
cuucaugcauagguuuagca

SEQ ID NO: 3805628 - RNA, 13 nt, Human
cuucaugcaugga

SEQ ID NO: 3805629 - RNA, 14 nt, Human
cuucaugccagcua

SEQ ID NO: 3805630 - RNA, 16 nt, Human
cuucaugccagcuacu

SEQ ID NO: 3805631 - RNA, 17 nt, Human
cuucaugccuuuguaag

SEQ ID NO: 3805632 - RNA, 19 nt, Human
cuucaugccuuuguaaguu

SEQ ID NO: 3805633 - RNA, 19 nt, Human
cuucaugcucagcccugac

SEQ ID NO: 3805634 - RNA, 21 nt, Human
cuucauggaacucagcugucu

SEQ ID NO: 3805635 - RNA, 22 nt, Human
cuucauguucaauuauuucccc

SEQ ID NO: 3805636 - RNA, 15 nt, Human
cuucauuagagcagg

SEQ ID NO: 3805637 - RNA, 15 nt, Human
cuucauuauucucug

SEQ ID NO: 3805638 - RNA, 14 nt, Human
cuucauuauuuuaa

SEQ ID NO: 3805639 - RNA, 20 nt, Human
cuucauucaauauugacauu

SEQ ID NO: 3805640 - RNA, 17 nt, Human
cuucauuccuuccacua

SEQ ID NO: 3805641 - RNA, 18 nt, Human
cuucauucuaucaagccc

SEQ ID NO: 3805642 - RNA, 13 nt, Human
cuucauucuccuu

SEQ ID NO: 3805643 - RNA, 12 nt, Human
cuucauucucgu

SEQ ID NO: 3805644 - RNA, 22 nt, Human
cuucauucucgugagucauuua

SEQ ID NO: 3805645 - RNA, 21 nt, Human
cuucauugagaguuuugucuu

SEQ ID NO: 3805646 - RNA, 17 nt, Human
cuucauugauuuccugu

SEQ ID NO: 3805647 - RNA, 20 nt, Human
cuucauugauuuccuguguc

SEQ ID NO: 3805648 - RNA, 22 nt, Human
cuucauuguacuaccuguguau

SEQ ID NO: 3805649 - RNA, 23 nt, Human
cuucauuguacuaccuguguaua

SEQ ID NO: 3805650 - RNA, 15 nt, Human
cuucauugucccucu

SEQ ID NO: 3805651 - RNA, 16 nt, Human
cuucauugucccucuu

SEQ ID NO: 3805652 - RNA, 13 nt, Human
cuucauuuaaaaa

SEQ ID NO: 3805653 - RNA, 14 nt, Human
cuucauuuaaaaaa

SEQ ID NO: 3805654 - RNA, 16 nt, Human
cuucauuucauuguau

SEQ ID NO: 3805655 - RNA, 19 nt, Human
cuucauuucauuguaugau

SEQ ID NO: 3805656 - RNA, 11 nt, Human
cuucauuugua

SEQ ID NO: 3805657 - RNA, 18 nt, Human
cuucauuugugucaaugg

SEQ ID NO: 3805658 - RNA, 22 nt, Human
cuucauuuuauuaauauuuuuc

SEQ ID NO: 3805659 - RNA, 19 nt, Human
cuuccaaaaauuauuauaa

SEQ ID NO: 3805660 - RNA, 14 nt, Human
cuuccaaagaaugu

SEQ ID NO: 3805661 - RNA, 12 nt, Human
cuuccaaagcag

SEQ ID NO: 3805662 - RNA, 15 nt, Human
cuuccaaauaaauaa

SEQ ID NO: 3805663 - RNA, 15 nt, Human
cuuccaaauaauaaa

SEQ ID NO: 3805664 - RNA, 20 nt, Human
cuuccaaauaauaaagucua

SEQ ID NO: 3805665 - RNA, 16 nt, Human
cuuccaaauccccuaa

SEQ ID NO: 3805666 - RNA, 19 nt, Human
cuuccaaauccccuaagca

SEQ ID NO: 3805667 - RNA, 21 nt, Human
cuuccaaccauuuaucuugaa

SEQ ID NO: 3805668 - RNA, 17 nt, Human
cuuccaacugcugcccc

SEQ ID NO: 3805669 - RNA, 16 nt, Human
cuuccaagaccugacu

SEQ ID NO: 3805670 - RNA, 17 nt, Human
cuuccaagaccugacuc

SEQ ID NO: 3805671 - RNA, 14 nt, Human
cuuccaagagccug

SEQ ID NO: 3805672 - RNA, 16 nt, Human
cuuccaagcaaaggug

SEQ ID NO: 3805673 - RNA, 15 nt, Human
cuuccaagguggucu

SEQ ID NO: 3805674 - RNA, 16 nt, Human
cuuccaagguggucug

SEQ ID NO: 3805675 - RNA, 18 nt, Human
cuuccaagguggucugcu

SEQ ID NO: 3805676 - RNA, 20 nt, Human
cuuccaagguggucugcucg

SEQ ID NO: 3805677 - RNA, 16 nt, Human
cuuccaauuaaugcuu

SEQ ID NO: 3805678 - RNA, 17 nt, Human
cuuccaauuaaugcuuu

SEQ ID NO: 3805679 - RNA, 14 nt, Human
cuuccacaagagcc

SEQ ID NO: 3805680 - RNA, 21 nt, Human
cuuccacaagagcccaggccu

SEQ ID NO: 3805681 - RNA, 16 nt, Human
cuuccacauguuacug

SEQ ID NO: 3805682 - RNA, 13 nt, Human
cuuccaccacaga

SEQ ID NO: 3805683 - RNA, 13 nt, Human
cuuccaccagccu

SEQ ID NO: 3805684 - RNA, 15 nt, Human
cuuccaccagccugc

SEQ ID NO: 3805685 - RNA, 21 nt, Human
cuuccaccagccugcacuacu

SEQ ID NO: 3805686 - RNA, 17 nt, Human
cuuccaccauuguccua

SEQ ID NO: 3805687 - RNA, 13 nt, Human
cuuccacccaggg

SEQ ID NO: 3805688 - RNA, 12 nt, Human
cuuccacccagu

SEQ ID NO: 3805689 - RNA, 14 nt, Human
cuuccaccucccuc

SEQ ID NO: 3805690 - RNA, 15 nt, Human
cuuccaccucccucc

SEQ ID NO: 3805691 - RNA, 15 nt, Human
cuuccaccugcucug

SEQ ID NO: 3805692 - RNA, 20 nt, Human
cuuccacgcugucuccagac

SEQ ID NO: 3805693 - RNA, 18 nt, Human
cuuccacugagggcaguc

SEQ ID NO: 3805694 - RNA, 13 nt, Human
cuuccacugccuc

SEQ ID NO: 3805695 - RNA, 14 nt, Human
cuuccacugccucu

SEQ ID NO: 3805696 - RNA, 19 nt, Human
cuuccacugccucugccuu

SEQ ID NO: 3805697 - RNA, 15 nt, Human
cuucuacugcuucua

SEQ ID NO: 3805698 - RNA, 17 nt, Human
cuucuagaaccaggcaa

SEQ ID NO: 3805699 - RNA, 23 nt, Human
cuucuagaauuauaagucacaaa

SEQ ID NO: 3805700 - RNA, 9 nt, Human
cuucuagag

SEQ ID NO: 3805701 - RNA, 13 nt, Human
cuucuagaguuca

SEQ ID NO: 3805702 - RNA, 14 nt, Human
cuucuagaguucag

SEQ ID NO: 3805703 - RNA, 22 nt, Human
cuucuaggauagcuaacuguaa

SEQ ID NO: 3805704 - RNA, 15 nt, Human
cuucuaguuucccac

SEQ ID NO: 3805705 - RNA, 16 nt, Human
cuucuaguuucccaca

SEQ ID NO: 3805706 - RNA, 18 nt, Human
cuucuauacccacccaga

SEQ ID NO: 3805707 - RNA, 16 nt, Human
cuucuauagcaucacu

SEQ ID NO: 3805708 - RNA, 14 nt, Human
cuucuauauaauuc

SEQ ID NO: 3805709 - RNA, 13 nt, Human
cuucuaugaccca

SEQ ID NO: 3805710 - RNA, 18 nt, Human
cuucuauguaggaaaaaa

SEQ ID NO: 3805711 - RNA, 13 nt, Human
cuucuauucuagc

SEQ ID NO: 3805712 - RNA, 13 nt, Human
cuucuauugccuc

SEQ ID NO: 3805713 - RNA, 16 nt, Human
cuucuauuuauuuauu

SEQ ID NO: 3805714 - RNA, 23 nt, Human
cuucuauuuggggcuugaugacu

SEQ ID NO: 3805715 - RNA, 14 nt, Human
cuucuauuuuguaa

SEQ ID NO: 3805716 - RNA, 16 nt, Human
cuucucaaaagaacuu

SEQ ID NO: 3805717 - RNA, 23 nt, Human
cuucucaaguucuaagauucuaa

SEQ ID NO: 3805718 - RNA, 23 nt, Human
cuucucacagcacaugcuggcca

SEQ ID NO: 3805719 - RNA, 13 nt, Human
cuucucaccagcu

SEQ ID NO: 3805720 - RNA, 14 nt, Human
cuucucaccagcug

SEQ ID NO: 3805721 - RNA, 15 nt, Human
cuucucaccagcugc

SEQ ID NO: 3805722 - RNA, 21 nt, Human
cuucucacugccaugccagcu

SEQ ID NO: 3805723 - RNA, 13 nt, Human
cuucucacuuuuu

SEQ ID NO: 3805724 - RNA, 16 nt, Human
cuucucagaaggcaaa

SEQ ID NO: 3805725 - RNA, 14 nt, Human
cuucucagauuucu

SEQ ID NO: 3805726 - RNA, 14 nt, Human
cuucucagcuccca

SEQ ID NO: 3805727 - RNA, 20 nt, Human
cuucucaggacacaggccug

SEQ ID NO: 3805728 - RNA, 22 nt, Human
cuucucaggcaugaacauguac

SEQ ID NO: 3805729 - RNA, 15 nt, Human
cuucucaggcucugc

SEQ ID NO: 3805730 - RNA, 15 nt, Human
cuucucauagcauua

SEQ ID NO: 3805731 - RNA, 22 nt, Human
cuucucauagcauuaacuaauc

SEQ ID NO: 3805732 - RNA, 14 nt, Human
cuucucaucacaca

SEQ ID NO: 3805733 - RNA, 13 nt, Human
cuucucaucacuc

SEQ ID NO: 3805734 - RNA, 16 nt, Human
cuucucauccugcagg

SEQ ID NO: 3805735 - RNA, 17 nt, Human
cuucucauccugcaggc

SEQ ID NO: 3805736 - RNA, 17 nt, Human
cuucucaucuugacaga

SEQ ID NO: 3805737 - RNA, 16 nt, Human
cuucucaucuugugaa

SEQ ID NO: 3805738 - RNA, 14 nt, Human
cuucucaugaucca

SEQ ID NO: 3805739 - RNA, 21 nt, Human
cuucucauuucaccccucccu

SEQ ID NO: 3805740 - RNA, 17 nt, Human
cuucuccacccugcucu

SEQ ID NO: 3805741 - RNA, 18 nt, Human
cuucuccacccugcucuc

SEQ ID NO: 3805742 - RNA, 20 nt, Human
ccagggcaucuugcuggcua

SEQ ID NO: 3805743 - RNA, 21 nt, Human
ccagggcaucuugcuggcuac

SEQ ID NO: 3805744 - RNA, 14 nt, Human
ccagggccacgcuc

SEQ ID NO: 3805745 - RNA, 13 nt, Human
ccagggccacgug

SEQ ID NO: 3805746 - RNA, 21 nt, Human
ccagggccacucugccucugc

SEQ ID NO: 3805747 - RNA, 12 nt, Human
ccagggccaggg

SEQ ID NO: 3805748 - RNA, 15 nt, Human
ccagggccagggguc

SEQ ID NO: 3805749 - RNA, 14 nt, Human
ccagggcccagagc

SEQ ID NO: 3805750 - RNA, 17 nt, Human
ccagggcccagagccca

SEQ ID NO: 3805751 - RNA, 19 nt, Human
ccagggcccagagcccagc

SEQ ID NO: 3805752 - RNA, 21 nt, Human
ccagggcccagagcccagcuc

SEQ ID NO: 3805753 - RNA, 17 nt, Human
ccagggcccccaucuca

SEQ ID NO: 3805754 - RNA, 22 nt, Human
ccagggccccucacccugccuu

SEQ ID NO: 3805755 - RNA, 15 nt, Human
ccagggccccucucc

SEQ ID NO: 3805756 - RNA, 24 nt, Human
ccagggccccucuccccagggaag

SEQ ID NO: 3805757 - RNA, 17 nt, Human
ccagggccuggaagaca

SEQ ID NO: 3805758 - RNA, 19 nt, Human
ccagggccuggaagacaga

SEQ ID NO: 3805759 - RNA, 12 nt, Human
ccagggccuuuu

SEQ ID NO: 3805760 - RNA, 12 nt, Human
ccagggcucagc

SEQ ID NO: 3805761 - RNA, 14 nt, Human
ccagggcucagccu

SEQ ID NO: 3805762 - RNA, 15 nt, Human
ccagggcucagccug

SEQ ID NO: 3805763 - RNA, 20 nt, Human
ccagggcucagccugguggg

SEQ ID NO: 3805764 - RNA, 19 nt, Human
ccagggcuccagccccucu

SEQ ID NO: 3805765 - RNA, 12 nt, Human
ccagggcuccug

SEQ ID NO: 3805766 - RNA, 14 nt, Human
ccagggcuccugca

SEQ ID NO: 3805767 - RNA, 23 nt, Human
ccagggcugcccugagaagcugc

SEQ ID NO: 3805768 - RNA, 20 nt, Human
ccagggcugcuagacggagg

SEQ ID NO: 3805769 - RNA, 17 nt, Human
ccagggcuggacugagg

SEQ ID NO: 3805770 - RNA, 13 nt, Human
ccagggcuggaga

SEQ ID NO: 3805771 - RNA, 21 nt, Human
ccagggcugggaggaaggacu

SEQ ID NO: 3805772 - RNA, 22 nt, Human
ccagggcuguaacugccaggcu

SEQ ID NO: 3805773 - RNA, 22 nt, Human
ccagggcuuaccuguacacuga

SEQ ID NO: 3805774 - RNA, 21 nt, Human
ccaggggaaaaucagccugcu

SEQ ID NO: 3805775 - RNA, 13 nt, Human
ccaggggaaccug

SEQ ID NO: 3805776 - RNA, 17 nt, Human
ccaggggaccuccuggg

SEQ ID NO: 3805777 - RNA, 21 nt, Human
ccaggggagagggucuggaga

SEQ ID NO: 3805778 - RNA, 20 nt, Human
ccaggggagcagaggggcag

SEQ ID NO: 3805779 - RNA, 21 nt, Human
ccaggggaggccugaggcuuc

SEQ ID NO: 3805780 - RNA, 18 nt, Human
ccaggggaguugugucug

SEQ ID NO: 3805781 - RNA, 19 nt, Human
ccaggggcagccccaggcc

SEQ ID NO: 3805782 - RNA, 15 nt, Human
ccaggggcaggcaca

SEQ ID NO: 3805783 - RNA, 19 nt, Human
ccaggggcccaaggcggcc

SEQ ID NO: 3805784 - RNA, 19 nt, Human
ccaggggccccuccagcuu

SEQ ID NO: 3805785 - RNA, 16 nt, Human
ccaggggccuuugggu

SEQ ID NO: 3805786 - RNA, 16 nt, Human
ccaggggcucccuccg

SEQ ID NO: 3805787 - RNA, 21 nt, Human
ccaggggcugcuuccuccugg

SEQ ID NO: 3805788 - RNA, 19 nt, Human
ccaggggcuggcuucagga

SEQ ID NO: 3805789 - RNA, 18 nt, Human
ccagggggacuagccccu

SEQ ID NO: 3805790 - RNA, 20 nt, Human
ccagggggacuagccccugu

SEQ ID NO: 3805791 - RNA, 23 nt, Human
ccagggggacuagccccugugga

SEQ ID NO: 3805792 - RNA, 22 nt, Human
ccagggggccagucccugaggc

SEQ ID NO: 3805793 - RNA, 13 nt, Human
ccagggggcuucc

SEQ ID NO: 3805794 - RNA, 20 nt, Human
ccaggggggugaggagcugg

SEQ ID NO: 3805795 - RNA, 18 nt, Human
ccagggggucucacccau

SEQ ID NO: 3805796 - RNA, 18 nt, Human
ccaggggucccagccacc

SEQ ID NO: 3805797 - RNA, 19 nt, Human
ccaggggucucccuggagu

SEQ ID NO: 3805798 - RNA, 13 nt, Human
ccaggggugcccc

SEQ ID NO: 3805799 - RNA, 15 nt, Human
ccaggggugcccccu

SEQ ID NO: 3805800 - RNA, 18 nt, Human
ccaggggugcccccuccu

SEQ ID NO: 3805801 - RNA, 20 nt, Human
ccaggggugcccccuccucu

SEQ ID NO: 3805802 - RNA, 13 nt, Human
ccaggggugggac

SEQ ID NO: 3805803 - RNA, 19 nt, Human
ccaggggugggacacccug

SEQ ID NO: 3805804 - RNA, 20 nt, Human
ccaggggugggacacccugu

SEQ ID NO: 3805805 - RNA, 14 nt, Human
ccaggguagcccgc

SEQ ID NO: 3805806 - RNA, 17 nt, Human
ccaggguaugaagagug

SEQ ID NO: 3805807 - RNA, 19 nt, Human
ccagggucagaaacaggac

SEQ ID NO: 3805808 - RNA, 16 nt, Human
ccagggucccucugug

SEQ ID NO: 3805809 - RNA, 16 nt, Human
ccaggguccugggagg

SEQ ID NO: 3805810 - RNA, 23 nt, Human
ccaggguccugggaggagagaca

SEQ ID NO: 3805811 - RNA, 13 nt, Human
ccagggucuccag

SEQ ID NO: 3805812 - RNA, 17 nt, Human
ccagggucuccagaaag

SEQ ID NO: 3805813 - RNA, 16 nt, Human
ccagggucucucccuc

SEQ ID NO: 3805814 - RNA, 18 nt, Human
ccagggucucucccucag

SEQ ID NO: 3805815 - RNA, 22 nt, Human
ccagggucugugugaauguggg

SEQ ID NO: 3805816 - RNA, 23 nt, Human
ccagggucuucccuaccucaggc

SEQ ID NO: 3805817 - RNA, 14 nt, Human
ccagggugagagcu

SEQ ID NO: 3805818 - RNA, 17 nt, Human
ccagggugagagcugcu

SEQ ID NO: 3805819 - RNA, 22 nt, Human
ccagggugcccagaacuucccu

SEQ ID NO: 3805820 - RNA, 22 nt, Human
ccaggguggacuuagaaagcag

SEQ ID NO: 3805821 - RNA, 18 nt, Human
ccaggguggccacaccuc

SEQ ID NO: 3805822 - RNA, 19 nt, Human
ccaggguguggcccugcca

SEQ ID NO: 3805823 - RNA, 19 nt, Human
cuauacugcauacuuuuua

SEQ ID NO: 3805824 - RNA, 13 nt, Human
cuauacugccucu

SEQ ID NO: 3805825 - RNA, 23 nt, Human
cuauacugcuuggagcugagcaa

SEQ ID NO: 3805826 - RNA, 14 nt, Human
cuauacuugaacaa

SEQ ID NO: 3805827 - RNA, 16 nt, Human
cuauacuugaacaaaa

SEQ ID NO: 3805828 - RNA, 20 nt, Human
cuauacuugaacaaaagggu

SEQ ID NO: 3805829 - RNA, 19 nt, Human
cuauacuugcuuuguguuc

SEQ ID NO: 3805830 - RNA, 14 nt, Human
cuauagaaaguguu

SEQ ID NO: 3805831 - RNA, 16 nt, Human
cuauagaaaguguucu

SEQ ID NO: 3805832 - RNA, 17 nt, Human
cuauagaaaguguucug

SEQ ID NO: 3805833 - RNA, 12 nt, Human
cuauagacucua

SEQ ID NO: 3805834 - RNA, 21 nt, Human
cuauagacuggaaaaaaugag

SEQ ID NO: 3805835 - RNA, 14 nt, Human
cuauagaugucuuu

SEQ ID NO: 3805836 - RNA, 17 nt, Human
cuauagcaaaguaguac

SEQ ID NO: 3805837 - RNA, 15 nt, Human
cuauagcaucacuua

SEQ ID NO: 3805838 - RNA, 15 nt, Human
cuauagcccaggucc

SEQ ID NO: 3805839 - RNA, 18 nt, Human
cuauagccuaggugacag

SEQ ID NO: 3805840 - RNA, 19 nt, Human
cuauagccuaggugacaga

SEQ ID NO: 3805841 - RNA, 20 nt, Human
cuauagccuaggugacagag

SEQ ID NO: 3805842 - RNA, 18 nt, Human
cuauagccuggggugggg

SEQ ID NO: 3805843 - RNA, 22 nt, Human
cuauaguauuugauucaaaaua

SEQ ID NO: 3805844 - RNA, 23 nt, Human
cuauaguauuugauucaaaauau

SEQ ID NO: 3805845 - RNA, 13 nt, Human
cuauagucccagc

SEQ ID NO: 3805846 - RNA, 15 nt, Human
cuauagucccagcua

SEQ ID NO: 3805847 - RNA, 16 nt, Human
cuauauaauuuauuuc

SEQ ID NO: 3805848 - RNA, 20 nt, Human
cuauauaauuuauuuccacu

SEQ ID NO: 3805849 - RNA, 11 nt, Human
cuauauacaug

SEQ ID NO: 3805850 - RNA, 13 nt, Human
cuauauacaugug

SEQ ID NO: 3805851 - RNA, 22 nt, Human
cuauauacauguguguauauau

SEQ ID NO: 3805852 - RNA, 17 nt, Human
cuauauagaaugcugca

SEQ ID NO: 3805853 - RNA, 23 nt, Human
cuauauaggcaucacauuuuugu

SEQ ID NO: 3805854 - RNA, 22 nt, Human
cuauauauaaaacggugcugug

SEQ ID NO: 3805855 - RNA, 16 nt, Human
cuauauauaauucugu

SEQ ID NO: 3805856 - RNA, 17 nt, Human
cuauauauaauucugua

SEQ ID NO: 3805857 - RNA, 18 nt, Human
cuauauauaauucuguac

SEQ ID NO: 3805858 - RNA, 13 nt, Human
cuauauauauaaa

SEQ ID NO: 3805859 - RNA, 14 nt, Human
cuauauauauaaau

SEQ ID NO: 3805860 - RNA, 17 nt, Human
cuauauauauaaaugua

SEQ ID NO: 3805861 - RNA, 18 nt, Human
cuauauaugugaugaucu

SEQ ID NO: 3805862 - RNA, 17 nt, Human
cuauauauguguaugua

SEQ ID NO: 3805863 - RNA, 14 nt, Human
cuauauccauguac

SEQ ID NO: 3805864 - RNA, 15 nt, Human
cuauauccugugacu

SEQ ID NO: 3805865 - RNA, 14 nt, Human
cuauaucuauauau

SEQ ID NO: 3805866 - RNA, 18 nt, Human
cuauaucuguuuuacugc

SEQ ID NO: 3805867 - RNA, 16 nt, Human
cuauaugaauuuaaau

SEQ ID NO: 3805868 - RNA, 18 nt, Human
cuauaugagaagaauagc

SEQ ID NO: 3805869 - RNA, 16 nt, Human
cuauaugauuuauagu

SEQ ID NO: 3805870 - RNA, 16 nt, Human
cuauauggaauugcuu

SEQ ID NO: 3805871 - RNA, 14 nt, Human
cuauauguacuugu

SEQ ID NO: 3805872 - RNA, 18 nt, Human
cuauaugugaauccucuu

SEQ ID NO: 3805873 - RNA, 17 nt, Human
cuauauuagaucaaaua

SEQ ID NO: 3805874 - RNA, 20 nt, Human
cuauauucuggccagacucg

SEQ ID NO: 3805875 - RNA, 14 nt, Human
cuauauuguacaca

SEQ ID NO: 3805876 - RNA, 19 nt, Human
cuauauuguuugcuaagca

SEQ ID NO: 3805877 - RNA, 22 nt, Human
cuauauuguuuucaguguacau

SEQ ID NO: 3805878 - RNA, 16 nt, Human
cuauauuuaacaagau

SEQ ID NO: 3805879 - RNA, 21 nt, Human
cuauauuuaaguauucaagaa

SEQ ID NO: 3805880 - RNA, 12 nt, Human
cuauauuuacag

SEQ ID NO: 3805881 - RNA, 20 nt, Human
cuaucaaacugaagccagaa

SEQ ID NO: 3805882 - RNA, 17 nt, Human
cuaucaaccccagacac

SEQ ID NO: 3805883 - RNA, 20 nt, Human
cuaucaagaggcugagacag

SEQ ID NO: 3805884 - RNA, 23 nt, Human
cuaucaagaggcugagacaggag

SEQ ID NO: 3805885 - RNA, 20 nt, Human
cuaucaaguauuauaccuuu

SEQ ID NO: 3805886 - RNA, 19 nt, Human
cuaucaccuccccuccuug

SEQ ID NO: 3805887 - RNA, 15 nt, Human
cuaucagccugucuc

SEQ ID NO: 3805888 - RNA, 12 nt, Human
cuaucagugugc

SEQ ID NO: 3805889 - RNA, 16 nt, Human
cuaucagugugccccc

SEQ ID NO: 3805890 - RNA, 22 nt, Human
cuaucauacuacugaaacagau

SEQ ID NO: 3805891 - RNA, 14 nt, Human
cuaucauggugaaa

SEQ ID NO: 3805892 - RNA, 22 nt, Human
cuaucauggugaaaagcuccau

SEQ ID NO: 3805893 - RNA, 14 nt, Human
cuaucauuaaaguu

SEQ ID NO: 3805894 - RNA, 15 nt, Human
cuaucauuaaaguuc

SEQ ID NO: 3805895 - RNA, 15 nt, Human
cuaucauuuaauaau

SEQ ID NO: 3805896 - RNA, 21 nt, Human
cuaucauuuaauaauauacuu

SEQ ID NO: 3805897 - RNA, 12 nt, Human
cuaucauuuauu

SEQ ID NO: 3805898 - RNA, 23 nt, Human
cuaucauuuauuggauggguggg

SEQ ID NO: 3805899 - RNA, 18 nt, Human
cuaucauuuuuguacagu

SEQ ID NO: 3805900 - RNA, 18 nt, Human
cuauccaaacauguauuu

SEQ ID NO: 3805901 - RNA, 17 nt, Human
cuauccacagagagucc

SEQ ID NO: 3805902 - RNA, 17 nt, Human
cuauccacccagcccau

SEQ ID NO: 3805903 - RNA, 18 nt, Human
cuauccaugcaccaaacu

SEQ ID NO: 3805904 - RNA, 14 nt, Human
cuaucccaucccau

SEQ ID NO: 3805905 - RNA, 20 nt, Human
cuauccccaucucccugccu

SEQ ID NO: 3805906 - RNA, 18 nt, Human
cuaucccuaggcacuuaa

SEQ ID NO: 3805907 - RNA, 14 nt, Human
cuauccgcugccag

SEQ ID NO: 3805908 - RNA, 15 nt, Human
cuauccguguugcag

SEQ ID NO: 3805909 - RNA, 11 nt, Human
cuauccucauc

SEQ ID NO: 3805910 - RNA, 12 nt, Human
cuauccucugua

SEQ ID NO: 3805911 - RNA, 19 nt, Human
cuauccugaaaauucugua

SEQ ID NO: 3805912 - RNA, 11 nt, Human
cuauccuggcc

SEQ ID NO: 3805913 - RNA, 19 nt, Human
cuauccuggcuuugcccaa

SEQ ID NO: 3805914 - RNA, 17 nt, Human
cuauccugggcuuuugu

SEQ ID NO: 3805915 - RNA, 13 nt, Human
cuauccuucguga

SEQ ID NO: 3805916 - RNA, 17 nt, Human
cuauccuuggcaccaaa

SEQ ID NO: 3805917 - RNA, 17 nt, Human
cuaucguaaaauuaaga

SEQ ID NO: 3805918 - RNA, 14 nt, Human
cuaucuaaauguug

SEQ ID NO: 3805919 - RNA, 13 nt, Human
cuaucuaaugaca

SEQ ID NO: 3805920 - RNA, 14 nt, Human
cuaucuauuugagg

SEQ ID NO: 3805921 - RNA, 18 nt, Human
cuaucucacagcacacuc

SEQ ID NO: 3805922 - RNA, 12 nt, Human
cuaucucaucua

SEQ ID NO: 3805923 - RNA, 18 nt, Human
cuaucucauuuccaagca

SEQ ID NO: 3805924 - RNA, 15 nt, Human
cuaucucccccagcc

SEQ ID NO: 3805925 - RNA, 18 nt, Human
cuaucucccccagcccca

SEQ ID NO: 3805926 - RNA, 17 nt, Human
cuaucucccugccuccu

SEQ ID NO: 3805927 - RNA, 18 nt, Human
cuaucucccugccuccug

SEQ ID NO: 3805928 - RNA, 17 nt, Human
cuaucucgugggagagc

SEQ ID NO: 3805929 - RNA, 19 nt, Human
cuaucuggaggccuuccag

SEQ ID NO: 3805930 - RNA, 19 nt, Human
cuaucugggcuuccuggag

SEQ ID NO: 3805931 - RNA, 23 nt, Human
cuaucugggcuuccuggagcaga

SEQ ID NO: 3805932 - RNA, 21 nt, Human
cuaucugguauuaaaugccaa

SEQ ID NO: 3805933 - RNA, 22 nt, Human
cuaucuggucaaccuccuggac

SEQ ID NO: 3805934 - RNA, 17 nt, Human
cuaucuguauucccaaa

SEQ ID NO: 3805935 - RNA, 16 nt, Human
cuaucugucugguggc

SEQ ID NO: 3805936 - RNA, 21 nt, Human
cuaucugucugguggccccgu

SEQ ID NO: 3805937 - RNA, 16 nt, Human
cuaucuguuuacagug

SEQ ID NO: 3805938 - RNA, 17 nt, Human
cuaucuguuuacagugu

SEQ ID NO: 3805939 - RNA, 23 nt, Human
cuaucuuaauuuugguuguauuc

SEQ ID NO: 3805940 - RNA, 18 nt, Human
cuaucuuacuauuucaca

SEQ ID NO: 3805941 - RNA, 20 nt, Human
cuaucuuaucucagauauuu

SEQ ID NO: 3805942 - RNA, 20 nt, Human
cuaucuucauguaaauugac

SEQ ID NO: 3805943 - RNA, 14 nt, Human
cuaucuuccaaaug

SEQ ID NO: 3805944 - RNA, 18 nt, Human
cuaucuugcucuguaauc

SEQ ID NO: 3805945 - RNA, 21 nt, Human
cuaucuuggagagcuggggac

SEQ ID NO: 3805946 - RNA, 17 nt, Human
cuaucuuguuccaaggc

SEQ ID NO: 3805947 - RNA, 18 nt, Human
cuaugaaaccuuuuuccu

SEQ ID NO: 3805948 - RNA, 13 nt, Human
cuaugaaauauua

SEQ ID NO: 3805949 - RNA, 18 nt, Human
cuaugaaauauuauguua

SEQ ID NO: 3805950 - RNA, 17 nt, Human
cuaugaacuucucucag

SEQ ID NO: 3805951 - RNA, 19 nt, Human
cuaugaaguaaagaacugc

SEQ ID NO: 3805952 - RNA, 18 nt, Human
cuaugaaguauauaaugg

SEQ ID NO: 3805953 - RNA, 23 nt, Human
cuaugaaugggcaaaacugaauu

SEQ ID NO: 3805954 - RNA, 17 nt, Human
cuaugaauucuaaguga

SEQ ID NO: 3805955 - RNA, 21 nt, Human
cuaugacauaaaaacaacuuu

SEQ ID NO: 3805956 - RNA, 21 nt, Human
cuaugaccucgcccuccacaa

SEQ ID NO: 3805957 - RNA, 16 nt, Human
cuaugacuuaacauag

SEQ ID NO: 3805958 - RNA, 23 nt, Human
cuaugacuugggcacccccagcc

SEQ ID NO: 3805959 - RNA, 11 nt, Human
cuaugagaaaa

SEQ ID NO: 3805960 - RNA, 16 nt, Human
cuaugagaaaagaggc

SEQ ID NO: 3805961 - RNA, 21 nt, Human
cuaugagaauugggauuacau

SEQ ID NO: 3805962 - RNA, 17 nt, Human
cuaugagggccuugagu

SEQ ID NO: 3805963 - RNA, 20 nt, Human
cuaugauaugguaaaaguua

SEQ ID NO: 3805964 - RNA, 23 nt, Human
cuaugauauuuucugugccugaa

SEQ ID NO: 3805965 - RNA, 13 nt, Human
cuaugauguauac

SEQ ID NO: 3805966 - RNA, 14 nt, Human
cuaugauguauacu

SEQ ID NO: 3805967 - RNA, 16 nt, Human
cuaugauguauacugc

SEQ ID NO: 3805968 - RNA, 20 nt, Human
cuaugauuuaauuugaaaua

SEQ ID NO: 3805969 - RNA, 14 nt, Human
cuaugcaaaaagcu

SEQ ID NO: 3805970 - RNA, 20 nt, Human
cuaugcaauauaucuaaauu

SEQ ID NO: 3805971 - RNA, 12 nt, Human
cuaugcacauau

SEQ ID NO: 3805972 - RNA, 20 nt, Human
cuaugcagagguccacaaca

SEQ ID NO: 3805973 - RNA, 13 nt, Human
cucagaacccagg

SEQ ID NO: 3805974 - RNA, 17 nt, Human
cucagaacuugcugcug

SEQ ID NO: 3805975 - RNA, 23 nt, Human
cucagaacuugcugcugucuugu

SEQ ID NO: 3805976 - RNA, 13 nt, Human
cucagaagaaaga

SEQ ID NO: 3805977 - RNA, 13 nt, Human
cucagaagacacu

SEQ ID NO: 3805978 - RNA, 17 nt, Human
cucagaagacacugaug

SEQ ID NO: 3805979 - RNA, 20 nt, Human
cucagaagacacugaugggc

SEQ ID NO: 3805980 - RNA, 15 nt, Human
cucagaagccugagg

SEQ ID NO: 3805981 - RNA, 18 nt, Human
cucagaagccugaggcug

SEQ ID NO: 3805982 - RNA, 13 nt, Human
cucagaagccugg

SEQ ID NO: 3805983 - RNA, 15 nt, Human
cucagaagccugggg

SEQ ID NO: 3805984 - RNA, 20 nt, Human
cucagaaggcaaaugacuuu

SEQ ID NO: 3805985 - RNA, 21 nt, Human
cucagaagggagcuagccaga

SEQ ID NO: 3805986 - RNA, 14 nt, Human
cucagaagggaggc

SEQ ID NO: 3805987 - RNA, 22 nt, Human
cucagaagugcaucuggagaga

SEQ ID NO: 3805988 - RNA, 17 nt, Human
cucagaauaaggcaggc

SEQ ID NO: 3805989 - RNA, 19 nt, Human
cucagaauaaggcaggcau

SEQ ID NO: 3805990 - RNA, 22 nt, Human
cucagacaggaaagggaaggcc

SEQ ID NO: 3805991 - RNA, 16 nt, Human
cucagaccagcucuuc

SEQ ID NO: 3805992 - RNA, 14 nt, Human
cucagacccccacu

SEQ ID NO: 3805993 - RNA, 16 nt, Human
cucagacccccacucu

SEQ ID NO: 3805994 - RNA, 15 nt, Human
cucagacccuuucuu

SEQ ID NO: 3805995 - RNA, 16 nt, Human
cucagaccgucuuccu

SEQ ID NO: 3805996 - RNA, 14 nt, Human
cucagacuccauuu

SEQ ID NO: 3805997 - RNA, 18 nt, Human
cucagacucuaagaaaga

SEQ ID NO: 3805998 - RNA, 15 nt, Human
cucagacugcaccca

SEQ ID NO: 3805999 - RNA, 17 nt, Human
cucagacugcacccagg

SEQ ID NO: 3806000 - RNA, 13 nt, Human
cucagacugcuca

SEQ ID NO: 3806001 - RNA, 13 nt, Human
cucagacuguaua

SEQ ID NO: 3806002 - RNA, 16 nt, Human
cucagacuuuuguaca

SEQ ID NO: 3806003 - RNA, 23 nt, Human
cucagagaaaaaugcuccccaca

SEQ ID NO: 3806004 - RNA, 13 nt, Human
cucagagacaugc

SEQ ID NO: 3806005 - RNA, 13 nt, Human
cucagagaccagg

SEQ ID NO: 3806006 - RNA, 15 nt, Human
cucagagccaccccu

SEQ ID NO: 3806007 - RNA, 15 nt, Human
cucagagccagucuu

SEQ ID NO: 3806008 - RNA, 18 nt, Human
cucagagcuacuugggcc

SEQ ID NO: 3806009 - RNA, 19 nt, Human
cucagagcuacuugggcca

SEQ ID NO: 3806010 - RNA, 21 nt, Human
cucagaggccccaauacccca

SEQ ID NO: 3806011 - RNA, 19 nt, Human
cucagaggcgcacugugac

SEQ ID NO: 3806012 - RNA, 17 nt, Human
cucagagggggacugcu

SEQ ID NO: 3806013 - RNA, 18 nt, Human
cucagagggggacugcug

SEQ ID NO: 3806014 - RNA, 18 nt, Human
cucagaggguuguucucc

SEQ ID NO: 3806015 - RNA, 21 nt, Human
cucagaggguuguucuccuag

SEQ ID NO: 3806016 - RNA, 19 nt, Human
cucagagguagggcugcca

SEQ ID NO: 3806017 - RNA, 16 nt, Human
cucagaguauggagcu

SEQ ID NO: 3806018 - RNA, 18 nt, Human
cucagaguccaggcccca

SEQ ID NO: 3806019 - RNA, 21 nt, Human
cucagauaagguaaaaugcca

SEQ ID NO: 3806020 - RNA, 22 nt, Human
cucagauaagguaaaaugccau

SEQ ID NO: 3806021 - RNA, 16 nt, Human
cucagauagaaugaca

SEQ ID NO: 3806022 - RNA, 17 nt, Human
cucagaucacuacugca

SEQ ID NO: 3806023 - RNA, 14 nt, Human
cucagauccaggga

SEQ ID NO: 3806024 - RNA, 15 nt, Human
cucagaucugucuga

SEQ ID NO: 3806025 - RNA, 15 nt, Human
cucagaucuucugug

SEQ ID NO: 3806026 - RNA, 19 nt, Human
cucagaugcucaaaguugu

SEQ ID NO: 3806027 - RNA, 21 nt, Human
cucagaugcucaaaguuguuu

SEQ ID NO: 3806028 - RNA, 21 nt, Human
cucagauggaaccgcaggaag

SEQ ID NO: 3806029 - RNA, 22 nt, Human
cucagauggaaccgcaggaagc

SEQ ID NO: 3806030 - RNA, 23 nt, Human
cucagauggaaccgcaggaagcu

SEQ ID NO: 3806031 - RNA, 13 nt, Human
ccaggugccuugg

SEQ ID NO: 3806032 - RNA, 14 nt, Human
ccaggugccuugga

SEQ ID NO: 3806033 - RNA, 20 nt, Human
ccaggugccuuucaaauuua

SEQ ID NO: 3806034 - RNA, 21 nt, Human
ccaggugccuuucaaauuuag

SEQ ID NO: 3806035 - RNA, 19 nt, Human
ccaggugcuaggaacacuc

SEQ ID NO: 3806036 - RNA, 21 nt, Human
ccagguggccacuccagaccc

SEQ ID NO: 3806037 - RNA, 19 nt, Human
ccagguggcugacccaguc

SEQ ID NO: 3806038 - RNA, 20 nt, Human
ccagguggcugacccagucc

SEQ ID NO: 3806039 - RNA, 23 nt, Human
ccagguggcugacccagucccug

SEQ ID NO: 3806040 - RNA, 13 nt, Human
ccaggugggagcg

SEQ ID NO: 3806041 - RNA, 19 nt, Human
ccaggugggcgggcagcac

SEQ ID NO: 3806042 - RNA, 20 nt, Human
ccagguggggugaggcagug

SEQ ID NO: 3806043 - RNA, 22 nt, Human
ccaggugggucccggcucugug

SEQ ID NO: 3806044 - RNA, 16 nt, Human
ccaggugugcacgugg

SEQ ID NO: 3806045 - RNA, 22 nt, Human
ccagguguguccaccugggcau

SEQ ID NO: 3806046 - RNA, 17 nt, Human
ccagguguuacuguaau

SEQ ID NO: 3806047 - RNA, 13 nt, Human
ccagguguuuaua

SEQ ID NO: 3806048 - RNA, 15 nt, Human
ccagguucaacccac

SEQ ID NO: 3806049 - RNA, 22 nt, Human
ccagguucaagcgauucuccug

SEQ ID NO: 3806050 - RNA, 15 nt, Human
ccagguucagcuugu

SEQ ID NO: 3806051 - RNA, 14 nt, Human
ccagguuccgaaga

SEQ ID NO: 3806052 - RNA, 24 nt, Human
ccagguucuccguuagcuccugug

SEQ ID NO: 3806053 - RNA, 21 nt, Human
ccagguucugguuagcucagc

SEQ ID NO: 3806054 - RNA, 22 nt, Human
ccagguucugguuagcucagcc

SEQ ID NO: 3806055 - RNA, 16 nt, Human
ccagguuggcucugcc

SEQ ID NO: 3806056 - RNA, 24 nt, Human
ccagguuggcucugccaguccugu

SEQ ID NO: 3806057 - RNA, 19 nt, Human
ccagguuuaaguagauuuc

SEQ ID NO: 3806058 - RNA, 22 nt, Human
ccagguuuaaguagauuucaug

SEQ ID NO: 3806059 - RNA, 16 nt, Human
ccagguuuagacagua

SEQ ID NO: 3806060 - RNA, 16 nt, Human
ccagguuucuaugugu

SEQ ID NO: 3806061 - RNA, 20 nt, Human
ccagguuuucugggugucca

SEQ ID NO: 3806062 - RNA, 18 nt, Human
ccagguuuugcacucuug

SEQ ID NO: 3806063 - RNA, 23 nt, Human
ccagguuuugcacucuuguuucu

SEQ ID NO: 3806064 - RNA, 15 nt, Human
ccagguuuuucaauu

SEQ ID NO: 3806065 - RNA, 16 nt, Human
ccagguuuuucaauua

SEQ ID NO: 3806066 - RNA, 17 nt, Human
ccagguuuuucaauuaa

SEQ ID NO: 3806067 - RNA, 20 nt, Human
ccagguuuuucaauuaaacg

SEQ ID NO: 3806068 - RNA, 20 nt, Human
ccaguaaaaaaaaaaaaugg

SEQ ID NO: 3806069 - RNA, 13 nt, Human
ccaguaaaauugc

SEQ ID NO: 3806070 - RNA, 17 nt, Human
ccaguaaaauugccaua

SEQ ID NO: 3806071 - RNA, 17 nt, Human
ccaguaaacagaggagu

SEQ ID NO: 3806072 - RNA, 20 nt, Human
ccaguaaaugggggugcauu

SEQ ID NO: 3806073 - RNA, 16 nt, Human
ccaguaacaggcucaa

SEQ ID NO: 3806074 - RNA, 14 nt, Human
ccaguaagaucacu

SEQ ID NO: 3806075 - RNA, 15 nt, Human
ccaguaagaucacug

SEQ ID NO: 3806076 - RNA, 21 nt, Human
ccaguaagaucacuguuuaga

SEQ ID NO: 3806077 - RNA, 18 nt, Human
ccaguaccuccugucucu

SEQ ID NO: 3806078 - RNA, 20 nt, Human
ccaguaccuccugucucugg

SEQ ID NO: 3806079 - RNA, 22 nt, Human
ccaguaccuccugucucuggcc

SEQ ID NO: 3806080 - RNA, 14 nt, Human
ccaguaccuugcuu

SEQ ID NO: 3806081 - RNA, 16 nt, Human
ccaguacgugcuaaca

SEQ ID NO: 3806082 - RNA, 18 nt, Human
ccaguauaaaauuacagu

SEQ ID NO: 3806083 - RNA, 21 nt, Human
ccaguauaaaauuacagugga

SEQ ID NO: 3806084 - RNA, 15 nt, Human
ccaguaucucuucag

SEQ ID NO: 3806085 - RNA, 13 nt, Human
ccaguaucuugaa

SEQ ID NO: 3806086 - RNA, 19 nt, Human
ccaguaucuugaagacuuu

SEQ ID NO: 3806087 - RNA, 22 nt, Human
ccaguaucuugaagacuuuucu

SEQ ID NO: 3806088 - RNA, 15 nt, Human
ccaguaugagcccua

SEQ ID NO: 3806089 - RNA, 12 nt, Human
ccaguauucuug

SEQ ID NO: 3806090 - RNA, 22 nt, Human
ccaguauuguacaaaguauuaa

SEQ ID NO: 3806091 - RNA, 17 nt, Human
ccaguauuuaacuucug

SEQ ID NO: 3806092 - RNA, 22 nt, Human
ccaguauuuaacuucugaggaa

SEQ ID NO: 3806093 - RNA, 14 nt, Human
ccaguauuuuuaaa

SEQ ID NO: 3806094 - RNA, 19 nt, Human
ccaguauuuuugcugcuuc

SEQ ID NO: 3806095 - RNA, 13 nt, Human
ccagucacaugac

SEQ ID NO: 3806096 - RNA, 21 nt, Human
ccagucacaugaccugaucac

SEQ ID NO: 3806097 - RNA, 17 nt, Human
ccagucaccccggccac

SEQ ID NO: 3806098 - RNA, 20 nt, Human
ccagucaccccggccaccug

SEQ ID NO: 3806099 - RNA, 12 nt, Human
ccagucagccuc

SEQ ID NO: 3806100 - RNA, 17 nt, Human
ccagucagccucucucc

SEQ ID NO: 3806101 - RNA, 19 nt, Human
ccagucagccucucuccca

SEQ ID NO: 3806102 - RNA, 20 nt, Human
ccagucagccucucucccag

SEQ ID NO: 3806103 - RNA, 14 nt, Human
ccagucaggcccag

SEQ ID NO: 3806104 - RNA, 14 nt, Human
ccagucaggcucuc

SEQ ID NO: 3806105 - RNA, 21 nt, Human
ccagucaucagcuauucaguu

SEQ ID NO: 3806106 - RNA, 18 nt, Human
ccaguccaaauguccucc

SEQ ID NO: 3806107 - RNA, 18 nt, Human
ccaguccacccugccugc

SEQ ID NO: 3806108 - RNA, 19 nt, Human
ccaguccaggcugccgugg

SEQ ID NO: 3806109 - RNA, 15 nt, Human
ccagucccagagcag

SEQ ID NO: 3806110 - RNA, 15 nt, Human
ccagucccagcagcc

SEQ ID NO: 3806111 - RNA, 18 nt, Human
ccagucccagcagccagc

SEQ ID NO: 3806112 - RNA, 14 nt, Human
ccagucccaggggc

SEQ ID NO: 3806113 - RNA, 21 nt, Human
ccaguccccaccccugccccc

SEQ ID NO: 3806114 - RNA, 22 nt, Human
ccaguccccaccccugccccca

SEQ ID NO: 3806115 - RNA, 17 nt, Human
ccaguccccccacccuc

SEQ ID NO: 3806116 - RNA, 18 nt, Human
ccagucccccuauccuug

SEQ ID NO: 3806117 - RNA, 14 nt, Human
ccagucccccugcc

SEQ ID NO: 3806118 - RNA, 17 nt, Human
ccaguccccgugccccg

SEQ ID NO: 3806119 - RNA, 15 nt, Human
ccagucccuggggga

SEQ ID NO: 3806120 - RNA, 19 nt, Human
ccagucccugggggaagcc

SEQ ID NO: 3806121 - RNA, 18 nt, Human
ccaguccuagcugcacag

SEQ ID NO: 3806122 - RNA, 21 nt, Human
ccaguccuaucugggcuuccu

SEQ ID NO: 3806123 - RNA, 17 nt, Human
ccaguccugccuggcca

SEQ ID NO: 3806124 - RNA, 18 nt, Human
ccaguccugccuggccag

SEQ ID NO: 3806125 - RNA, 19 nt, Human
ccaguccugccuggccagg

SEQ ID NO: 3806126 - RNA, 22 nt, Human
ccaguccugccuggccaggcag

SEQ ID NO: 3806127 - RNA, 11 nt, Human
ccaguccugcu

SEQ ID NO: 3806128 - RNA, 15 nt, Human
ccaguccugcuaccu

SEQ ID NO: 3806129 - RNA, 21 nt, Human
ccaguccugcuaccucccuug

SEQ ID NO: 3806130 - RNA, 18 nt, Human
ccagucgcgcugccugug

SEQ ID NO: 3806131 - RNA, 14 nt, Human
ccagucuaaaaaua

SEQ ID NO: 3806132 - RNA, 17 nt, Human
cucagcucggcucagcu

SEQ ID NO: 3806133 - RNA, 15 nt, Human
cucagcucggggagc

SEQ ID NO: 3806134 - RNA, 23 nt, Human
cucagcucugacauucugauucg

SEQ ID NO: 3806135 - RNA, 18 nt, Human
cucagcucuggcucacag

SEQ ID NO: 3806136 - RNA, 14 nt, Human
cucagcucugggcc

SEQ ID NO: 3806137 - RNA, 23 nt, Human
cucagcucugggccauucuccac

SEQ ID NO: 3806138 - RNA, 16 nt, Human
cucagcucuucugacu

SEQ ID NO: 3806139 - RNA, 17 nt, Human
cucagcucuuggcucca

SEQ ID NO: 3806140 - RNA, 18 nt, Human
cucagcucuuggcuccac

SEQ ID NO: 3806141 - RNA, 20 nt, Human
cucagcucuuggcuccacug

SEQ ID NO: 3806142 - RNA, 23 nt, Human
cucagcugaaugccuccuguggg

SEQ ID NO: 3806143 - RNA, 12 nt, Human
cucagcugcuuc

SEQ ID NO: 3806144 - RNA, 13 nt, Human
cucagcugcuucu

SEQ ID NO: 3806145 - RNA, 17 nt, Human
cucagcugcuucuccca

SEQ ID NO: 3806146 - RNA, 18 nt, Human
cucagcugucuguggcuu

SEQ ID NO: 3806147 - RNA, 14 nt, Human
cucagcuuaucucu

SEQ ID NO: 3806148 - RNA, 12 nt, Human
cucagcuuugag

SEQ ID NO: 3806149 - RNA, 16 nt, Human
cucagcuuugagaagc

SEQ ID NO: 3806150 - RNA, 23 nt, Human
cucaggaaacgagacuuuccauu

SEQ ID NO: 3806151 - RNA, 11 nt, Human
cucaggaaaga

SEQ ID NO: 3806152 - RNA, 22 nt, Human
cucaggaaaucaaauaugcaaa

SEQ ID NO: 3806153 - RNA, 21 nt, Human
cucaggaaaugcugacccaug

SEQ ID NO: 3806154 - RNA, 16 nt, Human
cucaggaaugggcugu

SEQ ID NO: 3806155 - RNA, 15 nt, Human
cucaggacacaggcc

SEQ ID NO: 3806156 - RNA, 19 nt, Human
cucaggacacaggccugug

SEQ ID NO: 3806157 - RNA, 16 nt, Human
cucaggacagaugcca

SEQ ID NO: 3806158 - RNA, 19 nt, Human
cucaggacagaugccacac

SEQ ID NO: 3806159 - RNA, 20 nt, Human
cucaggaccaaagcuuucau

SEQ ID NO: 3806160 - RNA, 22 nt, Human
cucaggaccaaagcuuucaugu

SEQ ID NO: 3806161 - RNA, 14 nt, Human
cucaggaccaggca

SEQ ID NO: 3806162 - RNA, 20 nt, Human
cucaggacccucgcuggccc

SEQ ID NO: 3806163 - RNA, 21 nt, Human
cucaggacccucgcuggcccc

SEQ ID NO: 3806164 - RNA, 22 nt, Human
cucaggacccucgcuggccccc

SEQ ID NO: 3806165 - RNA, 21 nt, Human
cucaggacucagaagccucug

SEQ ID NO: 3806166 - RNA, 17 nt, Human
cucaggacugcaacagg

SEQ ID NO: 3806167 - RNA, 14 nt, Human
cucaggacugcgac

SEQ ID NO: 3806168 - RNA, 15 nt, Human
cucaggagcacaggc

SEQ ID NO: 3806169 - RNA, 22 nt, Human
cucaggagcacaggcagcugga

SEQ ID NO: 3806170 - RNA, 12 nt, Human
cucaggagcccu

SEQ ID NO: 3806171 - RNA, 14 nt, Human
cucaggagcccugg

SEQ ID NO: 3806172 - RNA, 15 nt, Human
cucaggagcccuggg

SEQ ID NO: 3806173 - RNA, 17 nt, Human
cucaggagcccugggag

SEQ ID NO: 3806174 - RNA, 21 nt, Human
cucaggagcccugggaggcuc

SEQ ID NO: 3806175 - RNA, 17 nt, Human
aaauauauauguugauu

SEQ ID NO: 3806176 - RNA, 17 nt, Human
aaauauaucuuauaaag

SEQ ID NO: 3806177 - RNA, 18 nt, Human
aaauauaugcuaagucuu

SEQ ID NO: 3806178 - RNA, 15 nt, Human
aaauauauguaugua

SEQ ID NO: 3806179 - RNA, 14 nt, Human
aaauauauguauuu

SEQ ID NO: 3806180 - RNA, 19 nt, Human
aaauauauuacuuaacugu

SEQ ID NO: 3806181 - RNA, 22 nt, Human
aaauauauuguuaaucucuguu

SEQ ID NO: 3806182 - RNA, 12 nt, Human
aaauauauuuaa

SEQ ID NO: 3806183 - RNA, 15 nt, Human
aaauauauuuaauga

SEQ ID NO: 3806184 - RNA, 22 nt, Human
aaauauauuuuaagacgaaaca

SEQ ID NO: 3806185 - RNA, 23 nt, Human
aaauauauuuuaccauacauuua

SEQ ID NO: 3806186 - RNA, 13 nt, Human
aaauaucaaauua

SEQ ID NO: 3806187 - RNA, 16 nt, Human
aaauaucaaauuaauu

SEQ ID NO: 3806188 - RNA, 23 nt, Human
cucagagaauuucuaccauuuca

SEQ ID NO: 3806189 - RNA, 22 nt, Human
cucagagacacuguugauaaaa

SEQ ID NO: 3806190 - RNA, 16 nt, Human
cucagagacaugcaga

SEQ ID NO: 3806191 - RNA, 19 nt, Human
cucagagacaugcagagau

SEQ ID NO: 3806192 - RNA, 15 nt, Human
cucagagagcaccau

SEQ ID NO: 3806193 - RNA, 15 nt, Human
cucagagagggcagg

SEQ ID NO: 3806194 - RNA, 23 nt, Human
cucagagagggcaggcaugaagu

SEQ ID NO: 3806195 - RNA, 14 nt, Human
cucagagagggugg

SEQ ID NO: 3806196 - RNA, 23 nt, Human
cucagagagggugggagugggcc

SEQ ID NO: 3806197 - RNA, 19 nt, Human
cucagagauauugugagga

SEQ ID NO: 3806198 - RNA, 12 nt, Human
cucagagccagu

SEQ ID NO: 3806199 - RNA, 16 nt, Human
cucagaggcuguucuu

SEQ ID NO: 3806200 - RNA, 13 nt, Human
cucagagggggac

SEQ ID NO: 3806201 - RNA, 23 nt, Human
cucagagguuuaccuagagaaca

SEQ ID NO: 3806202 - RNA, 14 nt, Human
cucagaguccaggc

SEQ ID NO: 3806203 - RNA, 18 nt, Human
cucagagucggaacggag

SEQ ID NO: 3806204 - RNA, 13 nt, Human
cucagagugcaag

SEQ ID NO: 3806205 - RNA, 21 nt, Human
cucagaguggugggggaaggc

SEQ ID NO: 3806206 - RNA, 18 nt, Human
cucagaguucuauacugu

SEQ ID NO: 3806207 - RNA, 17 nt, Human
cucagauauuuauauuu

SEQ ID NO: 3806208 - RNA, 17 nt, Human
cucagaucaguguacca

SEQ ID NO: 3806209 - RNA, 17 nt, Human
cucagauccagggacag

SEQ ID NO: 3806210 - RNA, 20 nt, Human
cucagauccagggacagagg

SEQ ID NO: 3806211 - RNA, 19 nt, Human
cucagauccuuguuucaaa

SEQ ID NO: 3806212 - RNA, 16 nt, Human
cucagaucuucugugg

SEQ ID NO: 3806213 - RNA, 16 nt, Human
cucagauggaaccgca

SEQ ID NO: 3806214 - RNA, 20 nt, Human
cucagauggaaccgcaggaa

SEQ ID NO: 3806215 - RNA, 14 nt, Human
cucagauggcagcu

SEQ ID NO: 3806216 - RNA, 20 nt, Human
cucagauggcagcuuuuaaa

SEQ ID NO: 3806217 - RNA, 16 nt, Human
cucagauguuaaaaua

SEQ ID NO: 3806218 - RNA, 19 nt, Human
cucagauguuaaaauaaau

SEQ ID NO: 3806219 - RNA, 23 nt, Human
cucagauguuaaaauaaaugguu

SEQ ID NO: 3806220 - RNA, 22 nt, Human
cucagauuuuauuauguaaauc

SEQ ID NO: 3806221 - RNA, 16 nt, Human
cucagcaaggccaccu

SEQ ID NO: 3806222 - RNA, 17 nt, Human
cucagcaaggccaccuc

SEQ ID NO: 3806223 - RNA, 16 nt, Human
cucagcaaggggcucu

SEQ ID NO: 3806224 - RNA, 13 nt, Human
cucagcaccacuc

SEQ ID NO: 3806225 - RNA, 12 nt, Human
cucagcaccccu

SEQ ID NO: 3806226 - RNA, 16 nt, Human
cucagcaccccuucca

SEQ ID NO: 3806227 - RNA, 16 nt, Human
cucagcacugccugcu

SEQ ID NO: 3806228 - RNA, 17 nt, Human
cucagcacugccugcuc

SEQ ID NO: 3806229 - RNA, 14 nt, Human
cucagcagcccucc

SEQ ID NO: 3806230 - RNA, 18 nt, Human
cucagcagcccuccucac

SEQ ID NO: 3806231 - RNA, 22 nt, Human
cucagcagccgccuuaagcuga

SEQ ID NO: 3806232 - RNA, 16 nt, Human
cucagcaggggagggu

SEQ ID NO: 3806233 - RNA, 17 nt, Human
cucagcagugagagcag

SEQ ID NO: 3806234 - RNA, 16 nt, Human
cucagcauaccugcug

SEQ ID NO: 3806235 - RNA, 19 nt, Human
cucagcauauuuguauagu

SEQ ID NO: 3806236 - RNA, 23 nt, Human
cucagcauauuuguauaguugcu

SEQ ID NO: 3806237 - RNA, 15 nt, Human
cucagcauccuggca

SEQ ID NO: 3806238 - RNA, 16 nt, Human
cucagcauccuggcac

SEQ ID NO: 3806239 - RNA, 13 nt, Human
cucagcaugcauc

SEQ ID NO: 3806240 - RNA, 15 nt, Human
cucagcauuaccucu

SEQ ID NO: 3806241 - RNA, 19 nt, Human
cucagcauuaccucuuugg

SEQ ID NO: 3806242 - RNA, 22 nt, Human
cucagcauuaccucuuuggaaa

SEQ ID NO: 3806243 - RNA, 20 nt, Human
cucagccaaccuuacuuaca

SEQ ID NO: 3806244 - RNA, 13 nt, Human
cucagccaagcac

SEQ ID NO: 3806245 - RNA, 15 nt, Human
cucagccaagcacag

SEQ ID NO: 3806246 - RNA, 18 nt, Human
cucagccaagcacagugg

SEQ ID NO: 3806247 - RNA, 12 nt, Human
cucagccaagcu

SEQ ID NO: 3806248 - RNA, 15 nt, Human
cucagccacccugag

SEQ ID NO: 3806249 - RNA, 16 nt, Human
cucagccacccugagu

SEQ ID NO: 3806250 - RNA, 21 nt, Human
cucagccacccugaguugcuu

SEQ ID NO: 3806251 - RNA, 11 nt, Human
cucagccagca

SEQ ID NO: 3806252 - RNA, 13 nt, Human
cucagccagcacu

SEQ ID NO: 3806253 - RNA, 14 nt, Human
cucagccagccucg

SEQ ID NO: 3806254 - RNA, 21 nt, Human
cucagccaugaggaguugcug

SEQ ID NO: 3806255 - RNA, 16 nt, Human
cucagcccaccccccu

SEQ ID NO: 3806256 - RNA, 17 nt, Human
cucagccccaccccagg

SEQ ID NO: 3806257 - RNA, 15 nt, Human
cucagccccagccca

SEQ ID NO: 3806258 - RNA, 18 nt, Human
cucagcccccugcuucag

SEQ ID NO: 3806259 - RNA, 14 nt, Human
cucagccccuagga

SEQ ID NO: 3806260 - RNA, 15 nt, Human
cucagccccuaggag

SEQ ID NO: 3806261 - RNA, 23 nt, Human
cucagccccuaggaguauauuuc

SEQ ID NO: 3806262 - RNA, 18 nt, Human
cucagccccucuugcccc

SEQ ID NO: 3806263 - RNA, 22 nt, Human
cucagccccugauccugugaag

SEQ ID NO: 3806264 - RNA, 19 nt, Human
cucagcccucccugccccu

SEQ ID NO: 3806265 - RNA, 20 nt, Human
cucagcccucccugccccuc

SEQ ID NO: 3806266 - RNA, 14 nt, Human
cucagcccugaccc

SEQ ID NO: 3806267 - RNA, 13 nt, Human
cucagcccugacu

SEQ ID NO: 3806268 - RNA, 17 nt, Human
cucagcccugaggacag

SEQ ID NO: 3806269 - RNA, 16 nt, Human
cucagcccugcaccau

SEQ ID NO: 3806270 - RNA, 13 nt, Human
cucagcccuggag

SEQ ID NO: 3806271 - RNA, 15 nt, Human
cucagcccuggaggu

SEQ ID NO: 3806272 - RNA, 12 nt, Human
cucagcccuggg

SEQ ID NO: 3806273 - RNA, 14 nt, Human
cucagcccugggcc

SEQ ID NO: 3806274 - RNA, 23 nt, Human
cucagccggcguggcaaauauaa

SEQ ID NO: 3806275 - RNA, 14 nt, Human
cucagccucccaaa

SEQ ID NO: 3806276 - RNA, 16 nt, Human
cucagccucccaaagu

SEQ ID NO: 3806277 - RNA, 13 nt, Human
cucagccucccag

SEQ ID NO: 3806278 - RNA, 20 nt, Human
cucagccucccagagugcug

SEQ ID NO: 3806279 - RNA, 23 nt, Human
cucagccucccgaauagcuggga

SEQ ID NO: 3806280 - RNA, 20 nt, Human
cucagccuccggaguagcug

SEQ ID NO: 3806281 - RNA, 18 nt, Human
cucagccuccucaucugg

SEQ ID NO: 3806282 - RNA, 23 nt, Human
cucagccuccuguguagcuggga

SEQ ID NO: 3806283 - RNA, 17 nt, Human
cucagccucugaauaug

SEQ ID NO: 3806284 - RNA, 16 nt, Human
cucagccugaacccca

SEQ ID NO: 3806285 - RNA, 15 nt, Human
cucagccuggccaga

SEQ ID NO: 3806286 - RNA, 19 nt, Human
cucagccuggccagacaca

SEQ ID NO: 3806287 - RNA, 20 nt, Human
cucagccuggccagacacag

SEQ ID NO: 3806288 - RNA, 16 nt, Human
cucagccugggcgcug

SEQ ID NO: 3806289 - RNA, 18 nt, Human
cucagccuggugggccuc

SEQ ID NO: 3806290 - RNA, 20 nt, Human
cucagccuggugggccuccu

SEQ ID NO: 3806291 - RNA, 13 nt, Human
cucagccugugcu

SEQ ID NO: 3806292 - RNA, 14 nt, Human
cucagccugugcug

SEQ ID NO: 3806293 - RNA, 16 nt, Human
cucagccugugcugcc

SEQ ID NO: 3806294 - RNA, 15 nt, Human
cucagccuucagaca

SEQ ID NO: 3806295 - RNA, 11 nt, Human
cucagccuugg

SEQ ID NO: 3806296 - RNA, 14 nt, Human
cucagcgaaugaau

SEQ ID NO: 3806297 - RNA, 14 nt, Human
cucagcggggacag

SEQ ID NO: 3806298 - RNA, 19 nt, Human
cucagcuacccacuauccu

SEQ ID NO: 3806299 - RNA, 20 nt, Human
cucagcucacuacaaccucc

SEQ ID NO: 3806300 - RNA, 14 nt, Human
cucagcucacugca

SEQ ID NO: 3806301 - RNA, 15 nt, Human
cucagcucacugcaa

SEQ ID NO: 3806302 - RNA, 21 nt, Human
cucagcucaucuucacugcac

SEQ ID NO: 3806303 - RNA, 18 nt, Human
cucagcucccacaagccu

SEQ ID NO: 3806304 - RNA, 21 nt, Human
cucagcucccauuucuacucu

SEQ ID NO: 3806305 - RNA, 19 nt, Human
cucagcuccccagaguccu

SEQ ID NO: 3806306 - RNA, 15 nt, Human
cucagcucccccugu

SEQ ID NO: 3806307 - RNA, 18 nt, Human
cucagcucccccuguccc

SEQ ID NO: 3806308 - RNA, 19 nt, Human
cucagcucccccugucccc

SEQ ID NO: 3806309 - RNA, 18 nt, Human
cucagcucggggagccuu

SEQ ID NO: 3806310 - RNA, 19 nt, Human
cucagcucggggagccuua

SEQ ID NO: 3806311 - RNA, 14 nt, Human
cucagcucuggcuc

SEQ ID NO: 3806312 - RNA, 17 nt, Human
cucagcucuggcucaca

SEQ ID NO: 3806313 - RNA, 19 nt, Human
cucagcucuggcucacaga

SEQ ID NO: 3806314 - RNA, 13 nt, Human
cucagcucuggga

SEQ ID NO: 3806315 - RNA, 14 nt, Human
cucagcucugggag

SEQ ID NO: 3806316 - RNA, 16 nt, Human
cucagcucugggagag

SEQ ID NO: 3806317 - RNA, 22 nt, Human
cucagcucugggagaggauuuu

SEQ ID NO: 3806318 - RNA, 14 nt, Human
cucagcugccucac

SEQ ID NO: 3806319 - RNA, 21 nt, Human
cucagcugcuucucccacuug

SEQ ID NO: 3806320 - RNA, 17 nt, Human
ccauucugccugcccag

SEQ ID NO: 3806321 - RNA, 19 nt, Human
ccauucugccugcccaggc

SEQ ID NO: 3806322 - RNA, 20 nt, Human
ccauucugccugcccaggcc

SEQ ID NO: 3806323 - RNA, 12 nt, Human
ccauucuggaag

SEQ ID NO: 3806324 - RNA, 15 nt, Human
ccauucuggaaguga

SEQ ID NO: 3806325 - RNA, 19 nt, Human
ccauucuggaagugacuuu

SEQ ID NO: 3806326 - RNA, 22 nt, Human
ccauucuggauuuugucaagca

SEQ ID NO: 3806327 - RNA, 16 nt, Human
ccauucuuggcccagg

SEQ ID NO: 3806328 - RNA, 20 nt, Human
ccauucuuuauucuuuuacu

SEQ ID NO: 3806329 - RNA, 20 nt, Human
ccauucuuucccaacaccuc

SEQ ID NO: 3806330 - RNA, 22 nt, Human
ccauucuuugcuugaacacagu

SEQ ID NO: 3806331 - RNA, 17 nt, Human
ccauugaaggcuuaaac

SEQ ID NO: 3806332 - RNA, 15 nt, Human
ccauugacauguaca

SEQ ID NO: 3806333 - RNA, 18 nt, Human
ccauugaucauaaacuga

SEQ ID NO: 3806334 - RNA, 13 nt, Human
ccauugcacccag

SEQ ID NO: 3806335 - RNA, 16 nt, Human
ccauugccaccaggag

SEQ ID NO: 3806336 - RNA, 17 nt, Human
ccauugccaccaggaga

SEQ ID NO: 3806337 - RNA, 14 nt, Human
ccauugcugcuccu

SEQ ID NO: 3806338 - RNA, 15 nt, Human
ccauuggaucucauu

SEQ ID NO: 3806339 - RNA, 13 nt, Human
ccauugguguugu

SEQ ID NO: 3806340 - RNA, 17 nt, Human
ccauugucccucugccc

SEQ ID NO: 3806341 - RNA, 15 nt, Human
ccauugucucagagc

SEQ ID NO: 3806342 - RNA, 15 nt, Human
ccauugucuuguucu

SEQ ID NO: 3806343 - RNA, 12 nt, Human
ccauugucuuua

SEQ ID NO: 3806344 - RNA, 20 nt, Human
ccauugucuuuauaugaaca

SEQ ID NO: 3806345 - RNA, 22 nt, Human
ccauugucuuuauaugaacaua

SEQ ID NO: 3806346 - RNA, 12 nt, Human
ccauugugcauu

SEQ ID NO: 3806347 - RNA, 20 nt, Human
ccauuguggcuccuaucugu

SEQ ID NO: 3806348 - RNA, 18 nt, Human
cuccccacagcgucccug

SEQ ID NO: 3806349 - RNA, 20 nt, Human
cuccccacagcgucccuggc

SEQ ID NO: 3806350 - RNA, 17 nt, Human
cuccccacccuccuggc

SEQ ID NO: 3806351 - RNA, 23 nt, Human
cuccccacccuccuggccucaga

SEQ ID NO: 3806352 - RNA, 16 nt, Human
cuccccaccuccaggc

SEQ ID NO: 3806353 - RNA, 23 nt, Human
cuccccaccuucccucucccggc

SEQ ID NO: 3806354 - RNA, 20 nt, Human
cuccccacgucagcugggac

SEQ ID NO: 3806355 - RNA, 12 nt, Human
cuccccacucua

SEQ ID NO: 3806356 - RNA, 13 nt, Human
cuccccacucuag

SEQ ID NO: 3806357 - RNA, 17 nt, Human
cuccccacucugcucug

SEQ ID NO: 3806358 - RNA, 20 nt, Human
cuccccacucugcucugaug

SEQ ID NO: 3806359 - RNA, 11 nt, Human
cuccccagaau

SEQ ID NO: 3806360 - RNA, 20 nt, Human
cuccccagaguuccccaugc

SEQ ID NO: 3806361 - RNA, 12 nt, Human
cuccccagcaag

SEQ ID NO: 3806362 - RNA, 21 nt, Human
cuccccagcaagugagagcug

SEQ ID NO: 3806363 - RNA, 22 nt, Human
cuccccagcaagugagagcugg

SEQ ID NO: 3806364 - RNA, 15 nt, Human
cuccccagcaggugg

SEQ ID NO: 3806365 - RNA, 19 nt, Human
cuccccagcauuccagccc

SEQ ID NO: 3806366 - RNA, 15 nt, Human
cuccccagccagccu

SEQ ID NO: 3806367 - RNA, 20 nt, Human
cuccccagccagccuggcug

SEQ ID NO: 3806368 - RNA, 15 nt, Human
cuccccagcccagag

SEQ ID NO: 3806369 - RNA, 17 nt, Human
cuccccagcccagagac

SEQ ID NO: 3806370 - RNA, 15 nt, Human
cuccccagcccaggg

SEQ ID NO: 3806371 - RNA, 13 nt, Human
cuccccagccccu

SEQ ID NO: 3806372 - RNA, 15 nt, Human
cuccccagccccuag

SEQ ID NO: 3806373 - RNA, 16 nt, Human
cuccccagcccuggcu

SEQ ID NO: 3806374 - RNA, 21 nt, Human
cuccccagccugcgccugcug

SEQ ID NO: 3806375 - RNA, 14 nt, Human
cuccccagccuggg

SEQ ID NO: 3806376 - RNA, 16 nt, Human
cuccccagccugggcc

SEQ ID NO: 3806377 - RNA, 15 nt, Human
cuccccagcucccag

SEQ ID NO: 3806378 - RNA, 12 nt, Human
cuccccaggcca

SEQ ID NO: 3806379 - RNA, 21 nt, Human
cuccccaggccaggccaccag

SEQ ID NO: 3806380 - RNA, 21 nt, Human
cuccccaggccguggcugccc

SEQ ID NO: 3806381 - RNA, 21 nt, Human
cuccccaggggagagggucug

SEQ ID NO: 3806382 - RNA, 18 nt, Human
cuccccagguccagcucu

SEQ ID NO: 3806383 - RNA, 20 nt, Human
cuccccagguccagcucugg

SEQ ID NO: 3806384 - RNA, 22 nt, Human
cuccccaguacaccccaccucu

SEQ ID NO: 3806385 - RNA, 11 nt, Human
cuccccagugu

SEQ ID NO: 3806386 - RNA, 15 nt, Human
cuccccaucccaugu

SEQ ID NO: 3806387 - RNA, 21 nt, Human
cuccccaucgccagcugauga

SEQ ID NO: 3806388 - RNA, 23 nt, Human
cuccccaucgccagcugaugacu

SEQ ID NO: 3806389 - RNA, 15 nt, Human
cuccccaugccacgu

SEQ ID NO: 3806390 - RNA, 23 nt, Human
cuccccaugugccugcaccagga

SEQ ID NO: 3806391 - RNA, 18 nt, Human
cuccccauguguccuggu

SEQ ID NO: 3806392 - RNA, 18 nt, Human
cuccccauuucccaucug

SEQ ID NO: 3806393 - RNA, 20 nt, Human
cuccccauuucccaucugca

SEQ ID NO: 3806394 - RNA, 22 nt, Human
cuccccauuucccaucugcacc

SEQ ID NO: 3806395 - RNA, 16 nt, Human
cucccccaccccugcu

SEQ ID NO: 3806396 - RNA, 19 nt, Human
cucccccaccguugucuca

SEQ ID NO: 3806397 - RNA, 22 nt, Human
cucccccaccguugucucaugc

SEQ ID NO: 3806398 - RNA, 19 nt, Human
cucccccacuuucuuucuu

SEQ ID NO: 3806399 - RNA, 12 nt, Human
cucccccagcaa

SEQ ID NO: 3806400 - RNA, 22 nt, Human
cucccccagcaaagcccccaga

SEQ ID NO: 3806401 - RNA, 22 nt, Human
cucccccagccaugccagcugg

SEQ ID NO: 3806402 - RNA, 22 nt, Human
cucccccagccccauccucugu

SEQ ID NO: 3806403 - RNA, 20 nt, Human
cucccccaggggcugucccg

SEQ ID NO: 3806404 - RNA, 19 nt, Human
cucccccaucucccacccu

SEQ ID NO: 3806405 - RNA, 14 nt, Human
cuccccccacugca

SEQ ID NO: 3806406 - RNA, 18 nt, Human
cucccccccaugcacugu

SEQ ID NO: 3806407 - RNA, 20 nt, Human
cucccccccaugcacuguga

SEQ ID NO: 3806408 - RNA, 21 nt, Human
cucccccccaugcacugugaa

SEQ ID NO: 3806409 - RNA, 15 nt, Human
cucccccggcucuac

SEQ ID NO: 3806410 - RNA, 17 nt, Human
cucccccguccuggagg

SEQ ID NO: 3806411 - RNA, 16 nt, Human
cucccccuagccauuu

SEQ ID NO: 3806412 - RNA, 22 nt, Human
cucccccuaguuugugagaaac

SEQ ID NO: 3806413 - RNA, 14 nt, Human
cucccccuccuucc

SEQ ID NO: 3806414 - RNA, 12 nt, Human
cucccccugucc

SEQ ID NO: 3806415 - RNA, 13 nt, Human
cucccccuucucc

SEQ ID NO: 3806416 - RNA, 14 nt, Human
cucccccuucuccc

SEQ ID NO: 3806417 - RNA, 14 nt, Human
cuccccgccuguuc

SEQ ID NO: 3806418 - RNA, 16 nt, Human
cuccccgcuaaggaag

SEQ ID NO: 3806419 - RNA, 19 nt, Human
cuccccggcacccucuggc

SEQ ID NO: 3806420 - RNA, 20 nt, Human
cuccccggcacccucuggcc

SEQ ID NO: 3806421 - RNA, 14 nt, Human
cuccccggcccuac

SEQ ID NO: 3806422 - RNA, 23 nt, Human
cuccccuaaagccucaaaacaaa

SEQ ID NO: 3806423 - RNA, 15 nt, Human
cuccccuaccacugu

SEQ ID NO: 3806424 - RNA, 23 nt, Human
cuccccuauccacccagcccauu

SEQ ID NO: 3806425 - RNA, 10 nt, Human
cuccccucaa

SEQ ID NO: 3806426 - RNA, 16 nt, Human
cuccccucacagccuc

SEQ ID NO: 3806427 - RNA, 17 nt, Human
cuccccucacagccucu

SEQ ID NO: 3806428 - RNA, 12 nt, Human
cuccccucagcc

SEQ ID NO: 3806429 - RNA, 15 nt, Human
cuccccuccaaccug

SEQ ID NO: 3806430 - RNA, 14 nt, Human
cuccccuccauccc

SEQ ID NO: 3806431 - RNA, 16 nt, Human
cuccccuccaucccug

SEQ ID NO: 3806432 - RNA, 15 nt, Human
cuccccuccccaacu

SEQ ID NO: 3806433 - RNA, 15 nt, Human
cuccccuccccugcu

SEQ ID NO: 3806434 - RNA, 11 nt, Human
cuccccuccuc

SEQ ID NO: 3806435 - RNA, 12 nt, Human
cuccccuccucc

SEQ ID NO: 3806436 - RNA, 16 nt, Human
cuccccuccucucccc

SEQ ID NO: 3806437 - RNA, 17 nt, Human
cuccccuccucuccccu

SEQ ID NO: 3806438 - RNA, 19 nt, Human
cuccccuccuugccuccug

SEQ ID NO: 3806439 - RNA, 17 nt, Human
cuccccucucuugcacc

SEQ ID NO: 3806440 - RNA, 22 nt, Human
cuccccucugaaaguuguacau

SEQ ID NO: 3806441 - RNA, 23 nt, Human
cuccccucugaaaguuguacaug

SEQ ID NO: 3806442 - RNA, 13 nt, Human
cuccccucugcug

SEQ ID NO: 3806443 - RNA, 15 nt, Human
cuccccucugcuggc

SEQ ID NO: 3806444 - RNA, 18 nt, Human
cuccccucuuauguaccu

SEQ ID NO: 3806445 - RNA, 14 nt, Human
cuccccucuuccuc

SEQ ID NO: 3806446 - RNA, 17 nt, Human
cuccccucuuccucuug

SEQ ID NO: 3806447 - RNA, 16 nt, Human
cuccccugaccuguga

SEQ ID NO: 3806448 - RNA, 12 nt, Human
cuccccugcacu

SEQ ID NO: 3806449 - RNA, 15 nt, Human
cuccccugcacugua

SEQ ID NO: 3806450 - RNA, 19 nt, Human
cuccccugcacuguaaaau

SEQ ID NO: 3806451 - RNA, 15 nt, Human
cuccccugcagcccu

SEQ ID NO: 3806452 - RNA, 13 nt, Human
cuccccugccacc

SEQ ID NO: 3806453 - RNA, 23 nt, Human
cuccccugccaccaggccaccuc

SEQ ID NO: 3806454 - RNA, 16 nt, Human
cuccccugccagggca

SEQ ID NO: 3806455 - RNA, 22 nt, Human
cuccccugcccccaggacuggg

SEQ ID NO: 3806456 - RNA, 15 nt, Human
cuccccugcccccug

SEQ ID NO: 3806457 - RNA, 19 nt, Human
cuccccugcccccugcagg

SEQ ID NO: 3806458 - RNA, 20 nt, Human
cuccccugcccccugcagga

SEQ ID NO: 3806459 - RNA, 15 nt, Human
cuccccugcccugcu

SEQ ID NO: 3806460 - RNA, 15 nt, Human
cuccccugccuugcu

SEQ ID NO: 3806461 - RNA, 13 nt, Human
cuccccugcugca

SEQ ID NO: 3806462 - RNA, 12 nt, Human
cuccccugcugg

SEQ ID NO: 3806463 - RNA, 21 nt, Human
cuccccugcuggguguggcgc

SEQ ID NO: 3806464 - RNA, 19 nt, Human
cuccccugugcaguccugg

SEQ ID NO: 3806465 - RNA, 13 nt, Human
cccaacuccugga

SEQ ID NO: 3806466 - RNA, 15 nt, Human
cccaacuccuggaag

SEQ ID NO: 3806467 - RNA, 17 nt, Human
cccaacuccuggaagcu

SEQ ID NO: 3806468 - RNA, 16 nt, Human
cccaacuccuuccagc

SEQ ID NO: 3806469 - RNA, 20 nt, Human
cccaacucgggcucccgggu

SEQ ID NO: 3806470 - RNA, 11 nt, Human
cccaacugucu

SEQ ID NO: 3806471 - RNA, 15 nt, Human
cccaacugucuuuuu

SEQ ID NO: 3806472 - RNA, 17 nt, Human
cccaacugugagcaagg

SEQ ID NO: 3806473 - RNA, 16 nt, Human
cccaacuguguagcau

SEQ ID NO: 3806474 - RNA, 17 nt, Human
cccaacuucaucuggaa

SEQ ID NO: 3806475 - RNA, 22 nt, Human
cccaagaacagcaggcccaccu

SEQ ID NO: 3806476 - RNA, 23 nt, Human
cccaagaacagcaggcccaccua

SEQ ID NO: 3806477 - RNA, 16 nt, Human
cccaagaaggcugggg

SEQ ID NO: 3806478 - RNA, 19 nt, Human
cccaagacagaugccccag

SEQ ID NO: 3806479 - RNA, 21 nt, Human
cccaagacagaugccccagag

SEQ ID NO: 3806480 - RNA, 18 nt, Human
cccaagaccucagggcac

SEQ ID NO: 3806481 - RNA, 16 nt, Human
cccaagacucccauga

SEQ ID NO: 3806482 - RNA, 24 nt, Human
cccaagagaacucgcgcucaguaa

SEQ ID NO: 3806483 - RNA, 23 nt, Human
cccaagagcuacguauuuaauag

SEQ ID NO: 3806484 - RNA, 18 nt, Human
cccaagcccgacuugcug

SEQ ID NO: 3806485 - RNA, 22 nt, Human
cccaagccuucgggcgucugug

SEQ ID NO: 3806486 - RNA, 18 nt, Human
cccaagcgcccuggcccc

SEQ ID NO: 3806487 - RNA, 20 nt, Human
cccaagcgcccuggccccca

SEQ ID NO: 3806488 - RNA, 16 nt, Human
cccaagcggugucucu

SEQ ID NO: 3806489 - RNA, 13 nt, Human
cccaagcuccucc

SEQ ID NO: 3806490 - RNA, 14 nt, Human
cccaagcucugcuc

SEQ ID NO: 3806491 - RNA, 17 nt, Human
cccaagcucugcuccuc

SEQ ID NO: 3806492 - RNA, 11 nt, Human
cccaagcugga

SEQ ID NO: 3806493 - RNA, 16 nt, Human
cccaagcuggcugggg

SEQ ID NO: 3806494 - RNA, 21 nt, Human
cccaagcugggccccagccca

SEQ ID NO: 3806495 - RNA, 14 nt, Human
cccaagcuuggcag

SEQ ID NO: 3806496 - RNA, 17 nt, Human
cccaaggaaaacugcau

SEQ ID NO: 3806497 - RNA, 21 nt, Human
cccaaggacugagggacucug

SEQ ID NO: 3806498 - RNA, 14 nt, Human
cccaaggagcacag

SEQ ID NO: 3806499 - RNA, 14 nt, Human
cccaaggaggaaaa

SEQ ID NO: 3806500 - RNA, 17 nt, Human
cccaaggcucugagcaa

SEQ ID NO: 3806501 - RNA, 20 nt, Human
cccaaggcugcgucuggagg

SEQ ID NO: 3806502 - RNA, 21 nt, Human
cccaaggcugcgucuggaggg

SEQ ID NO: 3806503 - RNA, 17 nt, Human
cccaagggaaagaaaag

SEQ ID NO: 3806504 - RNA, 12 nt, Human
cccaagggccug

SEQ ID NO: 3806505 - RNA, 17 nt, Human
cccaagggccuggccug

SEQ ID NO: 3806506 - RNA, 21 nt, Human
cccaaggggcagucuggaggg

SEQ ID NO: 3806507 - RNA, 17 nt, Human
cccaagguaccauccua

SEQ ID NO: 3806508 - RNA, 12 nt, Human
cucccuaccuca

SEQ ID NO: 3806509 - RNA, 16 nt, Human
cucccuaccucaaccu

SEQ ID NO: 3806510 - RNA, 16 nt, Human
cucccuacuuucuuag

SEQ ID NO: 3806511 - RNA, 21 nt, Human
cucccuagugacccggaggcc

SEQ ID NO: 3806512 - RNA, 22 nt, Human
cucccuagugacccggaggcca

SEQ ID NO: 3806513 - RNA, 17 nt, Human
cucccuaguuccuucau

SEQ ID NO: 3806514 - RNA, 20 nt, Human
cucccuauaaugcuggagcg

SEQ ID NO: 3806515 - RNA, 18 nt, Human
cucccuaucccucacaca

SEQ ID NO: 3806516 - RNA, 19 nt, Human
cucccuauuuuuuuucugu

SEQ ID NO: 3806517 - RNA, 21 nt, Human
cucccuauuuuuuuucuguua

SEQ ID NO: 3806518 - RNA, 13 nt, Human
cucccucaaccuc

SEQ ID NO: 3806519 - RNA, 17 nt, Human
cucccucaaccucaucc

SEQ ID NO: 3806520 - RNA, 14 nt, Human
cucccucagccccu

SEQ ID NO: 3806521 - RNA, 13 nt, Human
cucccuccacccc

SEQ ID NO: 3806522 - RNA, 16 nt, Human
cucccuccaccccagg

SEQ ID NO: 3806523 - RNA, 17 nt, Human
cucccuccaccccagga

SEQ ID NO: 3806524 - RNA, 15 nt, Human
cucccuccaccuccc

SEQ ID NO: 3806525 - RNA, 21 nt, Human
cucccuccaccucccugcaau

SEQ ID NO: 3806526 - RNA, 20 nt, Human
cucccucccagagcaccugc

SEQ ID NO: 3806527 - RNA, 14 nt, Human
cucccucccagcuc

SEQ ID NO: 3806528 - RNA, 16 nt, Human
cucccucccagcucca

SEQ ID NO: 3806529 - RNA, 13 nt, Human
cucccucccagga

SEQ ID NO: 3806530 - RNA, 17 nt, Human
cucccucccaggacucu

SEQ ID NO: 3806531 - RNA, 20 nt, Human
cucccuccccgucucauucc

SEQ ID NO: 3806532 - RNA, 14 nt, Human
cucccuccccugcc

SEQ ID NO: 3806533 - RNA, 18 nt, Human
cucccuccccugccauuu

SEQ ID NO: 3806534 - RNA, 15 nt, Human
cucccuccccugccc

SEQ ID NO: 3806535 - RNA, 16 nt, Human
cucccuccccugcccu

SEQ ID NO: 3806536 - RNA, 21 nt, Human
cucccuccccugcccuggucc

SEQ ID NO: 3806537 - RNA, 16 nt, Human
cucccucccucuuucc

SEQ ID NO: 3806538 - RNA, 21 nt, Human
cucccuccgauccuuccuccc

SEQ ID NO: 3806539 - RNA, 18 nt, Human
cucccuccgcccccaggu

SEQ ID NO: 3806540 - RNA, 20 nt, Human
cucccuccgcccccagguag

SEQ ID NO: 3806541 - RNA, 14 nt, Human
cucccuccucaccu

SEQ ID NO: 3806542 - RNA, 18 nt, Human
cucccuccucaccucugg

SEQ ID NO: 3806543 - RNA, 21 nt, Human
cucccuccucaccucuggacu

SEQ ID NO: 3806544 - RNA, 14 nt, Human
cucccuccucugcc

SEQ ID NO: 3806545 - RNA, 17 nt, Human
cucccuccugccgacuc

SEQ ID NO: 3806546 - RNA, 19 nt, Human
cucccuccugccgacuccu

SEQ ID NO: 3806547 - RNA, 17 nt, Human
cucccucgucgagcugg

SEQ ID NO: 3806548 - RNA, 13 nt, Human
cucccucuacugg

SEQ ID NO: 3806549 - RNA, 19 nt, Human
cucccucuacugggagccu

SEQ ID NO: 3806550 - RNA, 19 nt, Human
cucccucuaggcucugccu

SEQ ID NO: 3806551 - RNA, 21 nt, Human
cucccucuaggcucugccuuc

SEQ ID NO: 3806552 - RNA, 14 nt, Human
cucccucucacugu

SEQ ID NO: 3806553 - RNA, 15 nt, Human
cucccucucacuguc

SEQ ID NO: 3806554 - RNA, 21 nt, Human
cucccucucacugucugagag

SEQ ID NO: 3806555 - RNA, 17 nt, Human
cucccucucaggaucca

SEQ ID NO: 3806556 - RNA, 16 nt, Human
cucccucuccagcagg

SEQ ID NO: 3806557 - RNA, 21 nt, Human
cucccucuccagcaggcccau

SEQ ID NO: 3806558 - RNA, 13 nt, Human
cucccucucccug

SEQ ID NO: 3806559 - RNA, 14 nt, Human
cucccucuccugcc

SEQ ID NO: 3806560 - RNA, 15 nt, Human
cucccucucucuucu

SEQ ID NO: 3806561 - RNA, 17 nt, Human
cucccucucucuucugc

SEQ ID NO: 3806562 - RNA, 21 nt, Human
cucccucucucuucugcucca

SEQ ID NO: 3806563 - RNA, 22 nt, Human
cucccucucucuucugcuccac

SEQ ID NO: 3806564 - RNA, 21 nt, Human
cucccucugaccugcaggcca

SEQ ID NO: 3806565 - RNA, 16 nt, Human
cucccucugaggcugu

SEQ ID NO: 3806566 - RNA, 18 nt, Human
cucccucugauuuuucau

SEQ ID NO: 3806567 - RNA, 11 nt, Human
cucccucugga

SEQ ID NO: 3806568 - RNA, 13 nt, Human
cucccucuggauc

SEQ ID NO: 3806569 - RNA, 15 nt, Human
cucccucugguccca

SEQ ID NO: 3806570 - RNA, 18 nt, Human
cucccucuguccaccagc

SEQ ID NO: 3806571 - RNA, 14 nt, Human
cucccucuucucaa

SEQ ID NO: 3806572 - RNA, 15 nt, Human
cucccucuucucaag

SEQ ID NO: 3806573 - RNA, 15 nt, Human
cucccucuuucccuc

SEQ ID NO: 3806574 - RNA, 23 nt, Human
cucccugaaaauguuuuucugcc

SEQ ID NO: 3806575 - RNA, 14 nt, Human
cucccugaagccag

SEQ ID NO: 3806576 - RNA, 15 nt, Human
cucccugaagccagc

SEQ ID NO: 3806577 - RNA, 16 nt, Human
cucccugaagccagcc

SEQ ID NO: 3806578 - RNA, 16 nt, Human
cucccugacccgucua

SEQ ID NO: 3806579 - RNA, 16 nt, Human
cucccugacccuguau

SEQ ID NO: 3806580 - RNA, 17 nt, Human
cucccugacccuguaua

SEQ ID NO: 3806581 - RNA, 24 nt, Human
cucccugacugggggcagacaugg

SEQ ID NO: 3806582 - RNA, 14 nt, Human
cucccugacuuuuc

SEQ ID NO: 3806583 - RNA, 12 nt, Human
cucccugaugua

SEQ ID NO: 3806584 - RNA, 20 nt, Human
cucccugcagaggggcugag

SEQ ID NO: 3806585 - RNA, 14 nt, Human
cucccugccagagg

SEQ ID NO: 3806586 - RNA, 16 nt, Human
cucccugccagcaccc

SEQ ID NO: 3806587 - RNA, 18 nt, Human
cucccugccccucccuuc

SEQ ID NO: 3806588 - RNA, 10 nt, Human
cucccugccg

SEQ ID NO: 3806589 - RNA, 15 nt, Human
cucccugccgccuca

SEQ ID NO: 3806590 - RNA, 14 nt, Human
cucccugccuccag

SEQ ID NO: 3806591 - RNA, 16 nt, Human
cucccugccuccagga

SEQ ID NO: 3806592 - RNA, 16 nt, Human
cucccugccuggcccc

SEQ ID NO: 3806593 - RNA, 14 nt, Human
cucccugcugcucc

SEQ ID NO: 3806594 - RNA, 16 nt, Human
cucccugcuguccccu

SEQ ID NO: 3806595 - RNA, 12 nt, Human
cucccuggagcc

SEQ ID NO: 3806596 - RNA, 19 nt, Human
cucccuggagccagacucu

SEQ ID NO: 3806597 - RNA, 22 nt, Human
cucccuggagugcaguuuccaa

SEQ ID NO: 3806598 - RNA, 22 nt, Human
cucccuggaguguggcugagga

SEQ ID NO: 3806599 - RNA, 23 nt, Human
cucccuggaucagaacaggagcu

SEQ ID NO: 3806600 - RNA, 20 nt, Human
cucccuggaucuaccuggag

SEQ ID NO: 3806601 - RNA, 21 nt, Human
cucccuggaucuaccuggagg

SEQ ID NO: 3806602 - RNA, 12 nt, Human
cucccuggauga

SEQ ID NO: 3806603 - RNA, 19 nt, Human
cucccuggauuuuuaccag

SEQ ID NO: 3806604 - RNA, 24 nt, Human
cucccuggauuuuuaccagucuca

SEQ ID NO: 3806605 - RNA, 13 nt, Human
cucccuggccugu

SEQ ID NO: 3806606 - RNA, 21 nt, Human
cucccuggccuguucuguuuu

SEQ ID NO: 3806607 - RNA, 16 nt, Human
cucccuggcucccucc

SEQ ID NO: 3806608 - RNA, 20 nt, Human
cucccuggcucucagaaggu

SEQ ID NO: 3806609 - RNA, 17 nt, Human
cucccuggcugcccugg

SEQ ID NO: 3806610 - RNA, 15 nt, Human
cucgggaggcugaga

SEQ ID NO: 3806611 - RNA, 20 nt, Human
cucgggauuaguacacacuu

SEQ ID NO: 3806612 - RNA, 14 nt, Human
cucgggcccaccug

SEQ ID NO: 3806613 - RNA, 18 nt, Human
cucgggcccaccuggcca

SEQ ID NO: 3806614 - RNA, 19 nt, Human
cucgggcccaccuggccac

SEQ ID NO: 3806615 - RNA, 21 nt, Human
cucgggcccaccuggccaccu

SEQ ID NO: 3806616 - RNA, 16 nt, Human
cucgggcccaggccau

SEQ ID NO: 3806617 - RNA, 23 nt, Human
cucgggcccaggccaucuuccag

SEQ ID NO: 3806618 - RNA, 24 nt, Human
cucgggcccaggccaucuuccagg

SEQ ID NO: 3806619 - RNA, 15 nt, Human
cucgggcuccugugc

SEQ ID NO: 3806620 - RNA, 17 nt, Human
cucgggcuccugugccc

SEQ ID NO: 3806621 - RNA, 14 nt, Human
cucggggagccuua

SEQ ID NO: 3806622 - RNA, 17 nt, Human
cucggguuucucugugg

SEQ ID NO: 3806623 - RNA, 13 nt, Human
cucggugucccca

SEQ ID NO: 3806624 - RNA, 15 nt, Human
cucgguguccccacc

SEQ ID NO: 3806625 - RNA, 20 nt, Human
cucgguguccccaccaucug

SEQ ID NO: 3806626 - RNA, 23 nt, Human
cucgguguggagaagcggcuggc

SEQ ID NO: 3806627 - RNA, 21 nt, Human
cucgguucaaggucacuguuu

SEQ ID NO: 3806628 - RNA, 15 nt, Human
cucgguugaaaccug

SEQ ID NO: 3806629 - RNA, 14 nt, Human
cucguagccaucuc

SEQ ID NO: 3806630 - RNA, 16 nt, Human
cucguauagaagucuu

SEQ ID NO: 3806631 - RNA, 16 nt, Human
cucguccucccccugc

SEQ ID NO: 3806632 - RNA, 20 nt, Human
cucguccucccccugccagu

SEQ ID NO: 3806633 - RNA, 20 nt, Human
cucgucggggggacagcucc

SEQ ID NO: 3806634 - RNA, 20 nt, Human
cucgugagucauuuaaaugu

SEQ ID NO: 3806635 - RNA, 12 nt, Human
cucguggacacc

SEQ ID NO: 3806636 - RNA, 15 nt, Human
cucguggacaccugc

SEQ ID NO: 3806637 - RNA, 16 nt, Human
cucguggacaccugcc

SEQ ID NO: 3806638 - RNA, 17 nt, Human
cucguggacaccugccc

SEQ ID NO: 3806639 - RNA, 19 nt, Human
cucguggacaccugcccug

SEQ ID NO: 3806640 - RNA, 16 nt, Human
cucguggccagcccgg

SEQ ID NO: 3806641 - RNA, 21 nt, Human
cucgugguaggacuguagaaa

SEQ ID NO: 3806642 - RNA, 15 nt, Human
cucguguauccuggg

SEQ ID NO: 3806643 - RNA, 16 nt, Human
cucguguauccugggg

SEQ ID NO: 3806644 - RNA, 18 nt, Human
cucguguauccuggggcu

SEQ ID NO: 3806645 - RNA, 20 nt, Human
cucguguauccuggggcucc

SEQ ID NO: 3806646 - RNA, 14 nt, Human
cucguguguuucua

SEQ ID NO: 3806647 - RNA, 14 nt, Human
cucguuaauuugua

SEQ ID NO: 3806648 - RNA, 22 nt, Human
cucguuagggaagagaaacagg

SEQ ID NO: 3806649 - RNA, 14 nt, Human
cucguucucccugg

SEQ ID NO: 3806650 - RNA, 20 nt, Human
cucguugacuggcugugugu

SEQ ID NO: 3806651 - RNA, 19 nt, Human
cucguuucaaaaacacagu

SEQ ID NO: 3806652 - RNA, 13 nt, Human
cucguuuguguuc

SEQ ID NO: 3806653 - RNA, 23 nt, Human
cucuaaaagcguuggauguagca

SEQ ID NO: 3806654 - RNA, 18 nt, Human
cucuaaaagguucaggga

SEQ ID NO: 3806655 - RNA, 19 nt, Human
cucuaaaauauuuaugaag

SEQ ID NO: 3806656 - RNA, 15 nt, Human
cucuaaagaccaaac

SEQ ID NO: 3806657 - RNA, 19 nt, Human
cucuaaagaccaaacuuca

SEQ ID NO: 3806658 - RNA, 14 nt, Human
cucuaaagagcauc

SEQ ID NO: 3806659 - RNA, 19 nt, Human
cucuaaauucuuuauuucu

SEQ ID NO: 3806660 - RNA, 13 nt, Human
cucuaacagcacc

SEQ ID NO: 3806661 - RNA, 14 nt, Human
cucuaacagcccuc

SEQ ID NO: 3806662 - RNA, 15 nt, Human
cucuaacaguggaca

SEQ ID NO: 3806663 - RNA, 16 nt, Human
cucuaaccccaggccc

SEQ ID NO: 3806664 - RNA, 17 nt, Human
cucuaaccccaggcccc

SEQ ID NO: 3806665 - RNA, 15 nt, Human
cucuaacccuaggca

SEQ ID NO: 3806666 - RNA, 14 nt, Human
cucuaaccuccuuu

SEQ ID NO: 3806667 - RNA, 15 nt, Human
cucuaacgccugagc

SEQ ID NO: 3806668 - RNA, 16 nt, Human
cucuaacgccugagcc

SEQ ID NO: 3806669 - RNA, 20 nt, Human
cucuaacgccugagcccagg

SEQ ID NO: 3806670 - RNA, 21 nt, Human
cucuaacuuauuuuauuucca

SEQ ID NO: 3806671 - RNA, 14 nt, Human
cucuaagaaagaac

SEQ ID NO: 3806672 - RNA, 12 nt, Human
cucuaagauguu

SEQ ID NO: 3806673 - RNA, 17 nt, Human
cucuaagauguuauauu

SEQ ID NO: 3806674 - RNA, 18 nt, Human
cucuaagauguuauauuu

SEQ ID NO: 3806675 - RNA, 23 nt, Human
cucuaagauguuauauuuuucuu

SEQ ID NO: 3806676 - RNA, 13 nt, Human
cucuaagccacuc

SEQ ID NO: 3806677 - RNA, 19 nt, Human
cucuaagccacucuuccaa

SEQ ID NO: 3806678 - RNA, 16 nt, Human
cucuaagucauguaug

SEQ ID NO: 3806679 - RNA, 17 nt, Human
cucuaagucauguaugu

SEQ ID NO: 3806680 - RNA, 20 nt, Human
cucuaaguuccacugagcuc

SEQ ID NO: 3806681 - RNA, 13 nt, Human
cucuaauaauaaa

SEQ ID NO: 3806682 - RNA, 14 nt, Human
cucuaauaauaaau

SEQ ID NO: 3806683 - RNA, 16 nt, Human
cucuaauaauaaauag

SEQ ID NO: 3806684 - RNA, 18 nt, Human
cucuaauaauaaauaguu

SEQ ID NO: 3806685 - RNA, 17 nt, Human
cucuaaucgaaagaaaa

SEQ ID NO: 3806686 - RNA, 18 nt, Human
cucuaauguuugcauaua

SEQ ID NO: 3806687 - RNA, 16 nt, Human
cucuaauucacagugc

SEQ ID NO: 3806688 - RNA, 22 nt, Human
cucuaauuggaagaaauuccug

SEQ ID NO: 3806689 - RNA, 16 nt, Human
cucuaauuuauuuugu

SEQ ID NO: 3806690 - RNA, 16 nt, Human
cucuacaaacucccac

SEQ ID NO: 3806691 - RNA, 16 nt, Human
cucuacaacugagucc

SEQ ID NO: 3806692 - RNA, 23 nt, Human
cucuacaacugaguccuuaaaca

SEQ ID NO: 3806693 - RNA, 17 nt, Human
cucuacagagcuucccu

SEQ ID NO: 3806694 - RNA, 22 nt, Human
cucuacagagcuucccugacuc

SEQ ID NO: 3806695 - RNA, 23 nt, Human
cucuacagagcuucccugacuca

SEQ ID NO: 3806696 - RNA, 12 nt, Human
cucuacauauuu

SEQ ID NO: 3806697 - RNA, 17 nt, Human
cucuacaucuucugccu

SEQ ID NO: 3806698 - RNA, 20 nt, Human
cucuaccaagcuauccuggc

SEQ ID NO: 3806699 - RNA, 18 nt, Human
cucuaccagacuguguau

SEQ ID NO: 3806700 - RNA, 20 nt, Human
cucuaccagauaacugagga

SEQ ID NO: 3806701 - RNA, 22 nt, Human
cucuaccagugcaggcuggcca

SEQ ID NO: 3806702 - RNA, 22 nt, Human
cucuaccauuugcagaguccug

SEQ ID NO: 3806703 - RNA, 14 nt, Human
cucuacccaaaccc

SEQ ID NO: 3806704 - RNA, 12 nt, Human
cucuacccagcc

SEQ ID NO: 3806705 - RNA, 19 nt, Human
cucuacccauauuacagau

SEQ ID NO: 3806706 - RNA, 14 nt, Human
cucuaccccaauuu

SEQ ID NO: 3806707 - RNA, 14 nt, Human
cucuacccucccac

SEQ ID NO: 3806708 - RNA, 16 nt, Human
cucuacccucccaccc

SEQ ID NO: 3806709 - RNA, 18 nt, Human
cucuacccucccaccccc

SEQ ID NO: 3806710 - RNA, 14 nt, Human
cucuaccuucuccc

SEQ ID NO: 3806711 - RNA, 15 nt, Human
cucuaccuucucccc

SEQ ID NO: 3806712 - RNA, 15 nt, Human
cucuacuaaaaagaa

SEQ ID NO: 3806713 - RNA, 19 nt, Human
cucuacuaaaaauacagaa

SEQ ID NO: 3806714 - RNA, 20 nt, Human
cucuacuaaugccucuucau

SEQ ID NO: 3806715 - RNA, 15 nt, Human
cccagcugcuugugu

SEQ ID NO: 3806716 - RNA, 20 nt, Human
cccagcuggcccgugacaga

SEQ ID NO: 3806717 - RNA, 14 nt, Human
cccagcugggaggc

SEQ ID NO: 3806718 - RNA, 17 nt, Human
cccagcugggaggcaag

SEQ ID NO: 3806719 - RNA, 22 nt, Human
cccagcugggaggcaagagggg

SEQ ID NO: 3806720 - RNA, 13 nt, Human
cccagcugggcuc

SEQ ID NO: 3806721 - RNA, 19 nt, Human
cccagcugggcucugccac

SEQ ID NO: 3806722 - RNA, 16 nt, Human
cccagcugucuguguc

SEQ ID NO: 3806723 - RNA, 17 nt, Human
cccagcugugagccuug

SEQ ID NO: 3806724 - RNA, 21 nt, Human
cccagcugugcucuggacagg

SEQ ID NO: 3806725 - RNA, 23 nt, Human
cccagcugugcucuggacaggca

SEQ ID NO: 3806726 - RNA, 13 nt, Human
cccagcuuccagc

SEQ ID NO: 3806727 - RNA, 16 nt, Human
cccagcuuccagcagg

SEQ ID NO: 3806728 - RNA, 16 nt, Human
cccagcuucucagcuc

SEQ ID NO: 3806729 - RNA, 20 nt, Human
cccagcuugggcccagcugg

SEQ ID NO: 3806730 - RNA, 22 nt, Human
cccagcuugggcccagcugggc

SEQ ID NO: 3806731 - RNA, 18 nt, Human
cccagcuuugcccaacac

SEQ ID NO: 3806732 - RNA, 22 nt, Human
cccagcuuugcccaacaccagc

SEQ ID NO: 3806733 - RNA, 19 nt, Human
cccaggaaaggcuccagga

SEQ ID NO: 3806734 - RNA, 23 nt, Human
cccaggaaaggcuccaggagcag

SEQ ID NO: 3806735 - RNA, 21 nt, Human
cccaggaagcccaggagggca

SEQ ID NO: 3806736 - RNA, 22 nt, Human
cccaggaagucucaucugggga

SEQ ID NO: 3806737 - RNA, 22 nt, Human
cccaggaauuugaagcugcagu

SEQ ID NO: 3806738 - RNA, 20 nt, Human
cccaggacaccacacccagc

SEQ ID NO: 3806739 - RNA, 17 nt, Human
cccaggaccacaggcuc

SEQ ID NO: 3806740 - RNA, 22 nt, Human
cccaggaccacaggcucaggca

SEQ ID NO: 3806741 - RNA, 23 nt, Human
cccaggaccagaagcucccccag

SEQ ID NO: 3806742 - RNA, 13 nt, Human
cccaggaccagcu

SEQ ID NO: 3806743 - RNA, 15 nt, Human
cccaggaccagcuca

SEQ ID NO: 3806744 - RNA, 16 nt, Human
cccaggaccagcuggg

SEQ ID NO: 3806745 - RNA, 17 nt, Human
cccaggaccagcugggg

SEQ ID NO: 3806746 - RNA, 21 nt, Human
cccaggaccagcuggggcgug

SEQ ID NO: 3806747 - RNA, 11 nt, Human
cccaggacccu

SEQ ID NO: 3806748 - RNA, 23 nt, Human
cccaggacccuggacccagccag

SEQ ID NO: 3806749 - RNA, 13 nt, Human
cccaggacgccac

SEQ ID NO: 3806750 - RNA, 13 nt, Human
cccaggacugggc

SEQ ID NO: 3806751 - RNA, 14 nt, Human
cccaggacugggcc

SEQ ID NO: 3806752 - RNA, 16 nt, Human
cccaggagagagaaag

SEQ ID NO: 3806753 - RNA, 14 nt, Human
cccaggagagccag

SEQ ID NO: 3806754 - RNA, 15 nt, Human
cccaggagagccagc

SEQ ID NO: 3806755 - RNA, 18 nt, Human
cucuaguaguuaaaaaaa

SEQ ID NO: 3806756 - RNA, 20 nt, Human
cucuagugaauguaggcugg

SEQ ID NO: 3806757 - RNA, 18 nt, Human
cucuagugcccuccacag

SEQ ID NO: 3806758 - RNA, 16 nt, Human
cucuagugccuucuaa

SEQ ID NO: 3806759 - RNA, 13 nt, Human
cucuagugcugug

SEQ ID NO: 3806760 - RNA, 13 nt, Human
cucuagugggaca

SEQ ID NO: 3806761 - RNA, 20 nt, Human
cucuagugggacagcccaga

SEQ ID NO: 3806762 - RNA, 22 nt, Human
cucuagugggacagcccagagc

SEQ ID NO: 3806763 - RNA, 21 nt, Human
cucuaguuuuuucuuccuuuu

SEQ ID NO: 3806764 - RNA, 15 nt, Human
cucuauaaaaaauau

SEQ ID NO: 3806765 - RNA, 21 nt, Human
cucuaucauuuaauaauauac

SEQ ID NO: 3806766 - RNA, 16 nt, Human
cucuauccugggcuuu

SEQ ID NO: 3806767 - RNA, 15 nt, Human
cucuaucugggccug

SEQ ID NO: 3806768 - RNA, 17 nt, Human
cucuaucugggccuggg

SEQ ID NO: 3806769 - RNA, 20 nt, Human
cucuaucugggccugggcua

SEQ ID NO: 3806770 - RNA, 15 nt, Human
cucuaucuugcucug

SEQ ID NO: 3806771 - RNA, 16 nt, Human
cucuaugagucuagau

SEQ ID NO: 3806772 - RNA, 16 nt, Human
cucuaugcuuuccaaa

SEQ ID NO: 3806773 - RNA, 21 nt, Human
cucuauggguaucaaacagcu

SEQ ID NO: 3806774 - RNA, 18 nt, Human
cucuauuaagauuuccaa

SEQ ID NO: 3806775 - RNA, 20 nt, Human
cucuauuccccacccucccc

SEQ ID NO: 3806776 - RNA, 23 nt, Human
cucuauucgccacacaguauuuu

SEQ ID NO: 3806777 - RNA, 21 nt, Human
cucuauuguagcauuucuuga

SEQ ID NO: 3806778 - RNA, 17 nt, Human
cucuauuuaaauucuuu

SEQ ID NO: 3806779 - RNA, 15 nt, Human
cucuauuuaauauuu

SEQ ID NO: 3806780 - RNA, 16 nt, Human
cucuauuuaauauuua

SEQ ID NO: 3806781 - RNA, 14 nt, Human
cucuauuuagcaug

SEQ ID NO: 3806782 - RNA, 16 nt, Human
cucuauuuauguuugc

SEQ ID NO: 3806783 - RNA, 13 nt, Human
cucuauuucugga

SEQ ID NO: 3806784 - RNA, 22 nt, Human
cucucaaaucuuuuagucauua

SEQ ID NO: 3806785 - RNA, 14 nt, Human
cucucaacaccaug

SEQ ID NO: 3806786 - RNA, 15 nt, Human
cucucaauaugcuua

SEQ ID NO: 3806787 - RNA, 16 nt, Human
cucucaauaugcuuac

SEQ ID NO: 3806788 - RNA, 19 nt, Human
cucucaauauucaauaaag

SEQ ID NO: 3806789 - RNA, 21 nt, Human
cucucaauauucaauaaagcu

SEQ ID NO: 3806790 - RNA, 14 nt, Human
cucucaauuuuugg

SEQ ID NO: 3806791 - RNA, 12 nt, Human
cucucacacaca

SEQ ID NO: 3806792 - RNA, 20 nt, Human
cucucacagacaggaccccu

SEQ ID NO: 3806793 - RNA, 22 nt, Human
cucucacauguuuagaguugca

SEQ ID NO: 3806794 - RNA, 13 nt, Human
cucucacauuacu

SEQ ID NO: 3806795 - RNA, 14 nt, Human
cucucacauuacug

SEQ ID NO: 3806796 - RNA, 16 nt, Human
cucucaccauuuggau

SEQ ID NO: 3806797 - RNA, 23 nt, Human
cucucaccuugguuccuggggca

SEQ ID NO: 3806798 - RNA, 22 nt, Human
cucucacuccccagccugggcc

SEQ ID NO: 3806799 - RNA, 23 nt, Human
cucucacuccccagccugggccc

SEQ ID NO: 3806800 - RNA, 14 nt, Human
cucucacugugucc

SEQ ID NO: 3806801 - RNA, 16 nt, Human
cucucagaagguauuc

SEQ ID NO: 3806802 - RNA, 19 nt, Human
cucucagaccgucuuccuc

SEQ ID NO: 3806803 - RNA, 21 nt, Human
cucucagagcuacuugggcca

SEQ ID NO: 3806804 - RNA, 19 nt, Human
cucucagauuguaccauug

SEQ ID NO: 3806805 - RNA, 22 nt, Human
cucucagccccugauccuguga

SEQ ID NO: 3806806 - RNA, 21 nt, Human
cucucaggaaaugcugaccca

SEQ ID NO: 3806807 - RNA, 17 nt, Human
cucucaggaccaaagcu

SEQ ID NO: 3806808 - RNA, 15 nt, Human
cucucaggagcacag

SEQ ID NO: 3806809 - RNA, 16 nt, Human
cucucaggagcacagg

SEQ ID NO: 3806810 - RNA, 21 nt, Human
cucucaggagcacaggcagcu

SEQ ID NO: 3806811 - RNA, 14 nt, Human
cucucaggaucaag

SEQ ID NO: 3806812 - RNA, 13 nt, Human
cucucaggaucca

SEQ ID NO: 3806813 - RNA, 18 nt, Human
cucucaggcaugccugug

SEQ ID NO: 3806814 - RNA, 20 nt, Human
cucucaggcaugccugugug

SEQ ID NO: 3806815 - RNA, 19 nt, Human
cucucaggcauggaugaau

SEQ ID NO: 3806816 - RNA, 22 nt, Human
cucucaggccaaacucaccugc

SEQ ID NO: 3806817 - RNA, 19 nt, Human
cucucaggccagcugcuug

SEQ ID NO: 3806818 - RNA, 23 nt, Human
cucucaggccagcugcuugggcu

SEQ ID NO: 3806819 - RNA, 18 nt, Human
cucucaggugaaaggaaa

SEQ ID NO: 3806820 - RNA, 13 nt, Human
cucucagucucug

SEQ ID NO: 3806821 - RNA, 15 nt, Human
cucucagucucugag

SEQ ID NO: 3806822 - RNA, 16 nt, Human
cucucagucucugagc

SEQ ID NO: 3806823 - RNA, 17 nt, Human
cucucagucucugagca

SEQ ID NO: 3806824 - RNA, 12 nt, Human
cucucaguguuu

SEQ ID NO: 3806825 - RNA, 18 nt, Human
cucucaguuaaaauguga

SEQ ID NO: 3806826 - RNA, 15 nt, Human
cucucaguugcagcc

SEQ ID NO: 3806827 - RNA, 17 nt, Human
cucucaucaacugaaug

SEQ ID NO: 3806828 - RNA, 18 nt, Human
cucucaucaacugaauga

SEQ ID NO: 3806829 - RNA, 20 nt, Human
cucucaucacuuuucucuga

SEQ ID NO: 3806830 - RNA, 15 nt, Human
cucucaucugaggca

SEQ ID NO: 3806831 - RNA, 21 nt, Human
cucucaugcugccccugccuu

SEQ ID NO: 3806832 - RNA, 16 nt, Human
cucucauuccccaggu

SEQ ID NO: 3806833 - RNA, 15 nt, Human
cucuccaagggcuuc

SEQ ID NO: 3806834 - RNA, 17 nt, Human
cucuccaagggcuucug

SEQ ID NO: 3806835 - RNA, 22 nt, Human
cucuccaagugccagagguggg

SEQ ID NO: 3806836 - RNA, 12 nt, Human
cucuccaccuca

SEQ ID NO: 3806837 - RNA, 13 nt, Human
cucuccaccucag

SEQ ID NO: 3806838 - RNA, 17 nt, Human
cucuccaccucagccuu

SEQ ID NO: 3806839 - RNA, 21 nt, Human
cucuccacucaugugacucuu

SEQ ID NO: 3806840 - RNA, 14 nt, Human
cucuccacugccuu

SEQ ID NO: 3806841 - RNA, 16 nt, Human
cucuccacugccuucg

SEQ ID NO: 3806842 - RNA, 21 nt, Human
cucuccagaaagcucaucuca

SEQ ID NO: 3806843 - RNA, 20 nt, Human
cucuccagauguuuccagac

SEQ ID NO: 3806844 - RNA, 12 nt, Human
cucuccagcccc

SEQ ID NO: 3806845 - RNA, 14 nt, Human
cucuccagccccug

SEQ ID NO: 3806846 - RNA, 18 nt, Human
cucuccagccucagcucu

SEQ ID NO: 3806847 - RNA, 15 nt, Human
cucuccagcuccaag

SEQ ID NO: 3806848 - RNA, 15 nt, Human
cucuccagcugacua

SEQ ID NO: 3806849 - RNA, 10 nt, Human
cucuccaggg

SEQ ID NO: 3806850 - RNA, 18 nt, Human
cucuccagucuuccaccu

SEQ ID NO: 3806851 - RNA, 17 nt, Human
cucuccaguuugcaccu

SEQ ID NO: 3806852 - RNA, 20 nt, Human
cucuccaguuugcaccuguc

SEQ ID NO: 3806853 - RNA, 12 nt, Human
cucuccauucug

SEQ ID NO: 3806854 - RNA, 21 nt, Human
cucuccauucugcuccuuccc

SEQ ID NO: 3806855 - RNA, 16 nt, Human
cucucccacccucuuc

SEQ ID NO: 3806856 - RNA, 19 nt, Human
cucucccacccucuuccua

SEQ ID NO: 3806857 - RNA, 19 nt, Human
cucucccaggccccaugac

SEQ ID NO: 3806858 - RNA, 21 nt, Human
cucucccaggccccaugaccu

SEQ ID NO: 3806859 - RNA, 13 nt, Human
cucucccaggggc

SEQ ID NO: 3806860 - RNA, 21 nt, Human
cucucccagucuacccagaga

SEQ ID NO: 3806861 - RNA, 18 nt, Human
cucucccaucccccugcc

SEQ ID NO: 3806862 - RNA, 16 nt, Human
cucucccauggagccc

SEQ ID NO: 3806863 - RNA, 18 nt, Human
cucucccauugucccucu

SEQ ID NO: 3806864 - RNA, 19 nt, Human
cucucccauugucccucug

SEQ ID NO: 3806865 - RNA, 20 nt, Human
cucuccccaauauccucgcu

SEQ ID NO: 3806866 - RNA, 13 nt, Human
cucuccccacacu

SEQ ID NO: 3806867 - RNA, 19 nt, Human
cucuccccaccccuacccc

SEQ ID NO: 3806868 - RNA, 22 nt, Human
cucuccccaccccuaccccugg

SEQ ID NO: 3806869 - RNA, 18 nt, Human
cucuccccacgagggcug

SEQ ID NO: 3806870 - RNA, 13 nt, Human
cucuccccagcaa

SEQ ID NO: 3806871 - RNA, 14 nt, Human
cucuccccagcaag

SEQ ID NO: 3806872 - RNA, 18 nt, Human
cucuccccagcccagaga

SEQ ID NO: 3806873 - RNA, 19 nt, Human
cucuccccagcccagagac

SEQ ID NO: 3806874 - RNA, 20 nt, Human
cucuccccagggaagcagca

SEQ ID NO: 3806875 - RNA, 16 nt, Human
cucccggguccuuggc

SEQ ID NO: 3806876 - RNA, 21 nt, Human
cucccggugcccaagaauaga

SEQ ID NO: 3806877 - RNA, 16 nt, Human
cucccgguucuuccag

SEQ ID NO: 3806878 - RNA, 21 nt, Human
cucccgguucuuccagugguu

SEQ ID NO: 3806879 - RNA, 17 nt, Human
cucccuaagccagccug

SEQ ID NO: 3806880 - RNA, 21 nt, Human
cucccuaaggcaugugugaaa

SEQ ID NO: 3806881 - RNA, 20 nt, Human
cucccuaccucaaccuguaa

SEQ ID NO: 3806882 - RNA, 21 nt, Human
cucccuaccucaaccuguaaa

SEQ ID NO: 3806883 - RNA, 14 nt, Human
cucccuagcuccuc

SEQ ID NO: 3806884 - RNA, 16 nt, Human
cucccuauaaugcugg

SEQ ID NO: 3806885 - RNA, 21 nt, Human
cucccuauacugcuuggagcu

SEQ ID NO: 3806886 - RNA, 23 nt, Human
cucccuaucuaacccucccaugg

SEQ ID NO: 3806887 - RNA, 19 nt, Human
cucccuauuaaccuagaga

SEQ ID NO: 3806888 - RNA, 22 nt, Human
cucccuauuuuuuuucuguuau

SEQ ID NO: 3806889 - RNA, 22 nt, Human
cucccucaagccagacucugcc

SEQ ID NO: 3806890 - RNA, 13 nt, Human
cucccucacccug

SEQ ID NO: 3806891 - RNA, 16 nt, Human
cucccucacucucagg

SEQ ID NO: 3806892 - RNA, 17 nt, Human
cucccucacucucagga

SEQ ID NO: 3806893 - RNA, 18 nt, Human
cucccucacucucaggaa

SEQ ID NO: 3806894 - RNA, 15 nt, Human
cucccucagccccuc

SEQ ID NO: 3806895 - RNA, 18 nt, Human
cucccucagucuggcccu

SEQ ID NO: 3806896 - RNA, 23 nt, Human
cucccucagugcccucauuuuau

SEQ ID NO: 3806897 - RNA, 12 nt, Human
cucccuccaccc

SEQ ID NO: 3806898 - RNA, 14 nt, Human
cucccuccacccca

SEQ ID NO: 3806899 - RNA, 15 nt, Human
cucgcuccccacucu

SEQ ID NO: 3806900 - RNA, 18 nt, Human
cucgcugaugcugggcug

SEQ ID NO: 3806901 - RNA, 21 nt, Human
cucgcugaugcugggcugggu

SEQ ID NO: 3806902 - RNA, 23 nt, Human
cucgcugaugcugggcugggugc

SEQ ID NO: 3806903 - RNA, 16 nt, Human
cucgcugccagcucug

SEQ ID NO: 3806904 - RNA, 19 nt, Human
cucgcugccagcucuguau

SEQ ID NO: 3806905 - RNA, 15 nt, Human
cucgcuggacucuca

SEQ ID NO: 3806906 - RNA, 19 nt, Human
cucgcuggacucucagucu

SEQ ID NO: 3806907 - RNA, 21 nt, Human
cucgcuggcccccacuggcug

SEQ ID NO: 3806908 - RNA, 22 nt, Human
cucgcuggcccccacuggcugu

SEQ ID NO: 3806909 - RNA, 12 nt, Human
cucgcuguugcu

SEQ ID NO: 3806910 - RNA, 16 nt, Human
cucgcuguugcugaau

SEQ ID NO: 3806911 - RNA, 19 nt, Human
cucgcuucccccauagcca

SEQ ID NO: 3806912 - RNA, 13 nt, Human
cucgcuucucugu

SEQ ID NO: 3806913 - RNA, 14 nt, Human
cucgcuucucugug

SEQ ID NO: 3806914 - RNA, 11 nt, Human
cucgcuuguaa

SEQ ID NO: 3806915 - RNA, 12 nt, Human
cucgcuuguaaa

SEQ ID NO: 3806916 - RNA, 14 nt, Human
cucgcuugugcaga

SEQ ID NO: 3806917 - RNA, 20 nt, Human
cucggaaccgcucaccuaga

SEQ ID NO: 3806918 - RNA, 21 nt, Human
cucggaaccgcucaccuagag

SEQ ID NO: 3806919 - RNA, 23 nt, Human
cucggaaccugugagcugcacca

SEQ ID NO: 3806920 - RNA, 16 nt, Human
cucggaaggcuggcug

SEQ ID NO: 3806921 - RNA, 19 nt, Human
cucggaccccacuccggcc

SEQ ID NO: 3806922 - RNA, 19 nt, Human
cucggacuuagcugggaga

SEQ ID NO: 3806923 - RNA, 18 nt, Human
cucggagcaucccggagg

SEQ ID NO: 3806924 - RNA, 22 nt, Human
cucggagcaucccggaggaaau

SEQ ID NO: 3806925 - RNA, 13 nt, Human
cucugcuccacca

SEQ ID NO: 3806926 - RNA, 18 nt, Human
cucugcuccaccacaucc

SEQ ID NO: 3806927 - RNA, 19 nt, Human
cucugcuccaccacauccu

SEQ ID NO: 3806928 - RNA, 18 nt, Human
cucugcuccucuccccag

SEQ ID NO: 3806929 - RNA, 20 nt, Human
cucugcuccucuccccagca

SEQ ID NO: 3806930 - RNA, 13 nt, Human
cucugcucgccuu

SEQ ID NO: 3806931 - RNA, 16 nt, Human
cucugcucgccuuagc

SEQ ID NO: 3806932 - RNA, 15 nt, Human
cucugcucugaggcu

SEQ ID NO: 3806933 - RNA, 15 nt, Human
cucugcucugaugca

SEQ ID NO: 3806934 - RNA, 13 nt, Human
cucugcucugccc

SEQ ID NO: 3806935 - RNA, 14 nt, Human
cucugcucugcccu

SEQ ID NO: 3806936 - RNA, 18 nt, Human
cucugcugacagacacag

SEQ ID NO: 3806937 - RNA, 21 nt, Human
cucugcugacagacacaggcc

SEQ ID NO: 3806938 - RNA, 17 nt, Human
cucugcugaccugcuga

SEQ ID NO: 3806939 - RNA, 17 nt, Human
cucugcugaggguccag

SEQ ID NO: 3806940 - RNA, 21 nt, Human
cucugcugaugacccccccag

SEQ ID NO: 3806941 - RNA, 13 nt, Human
cucugcugccaug

SEQ ID NO: 3806942 - RNA, 13 nt, Human
cucugcugccgcc

SEQ ID NO: 3806943 - RNA, 16 nt, Human
cucugcugcuggcugg

SEQ ID NO: 3806944 - RNA, 21 nt, Human
cucugcugcugucccuccccc

SEQ ID NO: 3806945 - RNA, 18 nt, Human
cucugcuggacguccagg

SEQ ID NO: 3806946 - RNA, 21 nt, Human
cucugcuggccuggccggcaa

SEQ ID NO: 3806947 - RNA, 17 nt, Human
cucugcuggucuucaau

SEQ ID NO: 3806948 - RNA, 22 nt, Human
cucugcugugggcacaggucag

SEQ ID NO: 3806949 - RNA, 15 nt, Human
cucugcuucagcuug

SEQ ID NO: 3806950 - RNA, 12 nt, Human
cucugcuucucu

SEQ ID NO: 3806951 - RNA, 14 nt, Human
cucugcuucucuga

SEQ ID NO: 3806952 - RNA, 15 nt, Human
cucugcuucucugac

SEQ ID NO: 3806953 - RNA, 17 nt, Human
cucugcuugagucaggu

SEQ ID NO: 3806954 - RNA, 20 nt, Human
cucugcuugccaucccuccc

SEQ ID NO: 3806955 - RNA, 23 nt, Human
cucugcuugccgaaacuggaagu

SEQ ID NO: 3806956 - RNA, 18 nt, Human
cucugcuugccuggagac

SEQ ID NO: 3806957 - RNA, 15 nt, Human
cucugcuuuggaaau

SEQ ID NO: 3806958 - RNA, 21 nt, Human
cucuggaaaaugugacccaga

SEQ ID NO: 3806959 - RNA, 13 nt, Human
cucuggaaagcaa

SEQ ID NO: 3806960 - RNA, 21 nt, Human
cucuggaaaggggggagcugg

SEQ ID NO: 3806961 - RNA, 18 nt, Human
cucuggaagcccuggaga

SEQ ID NO: 3806962 - RNA, 15 nt, Human
cucuggacaggcaug

SEQ ID NO: 3806963 - RNA, 12 nt, Human
cucuggaccugc

SEQ ID NO: 3806964 - RNA, 13 nt, Human
cucuggaccugcc

SEQ ID NO: 3806965 - RNA, 15 nt, Human
cucuggacggcaggc

SEQ ID NO: 3806966 - RNA, 14 nt, Human
cucuggacuggcua

SEQ ID NO: 3806967 - RNA, 15 nt, Human
cucuggacuggcuag

SEQ ID NO: 3806968 - RNA, 13 nt, Human
cucuggacuuucu

SEQ ID NO: 3806969 - RNA, 21 nt, Human
cucuggacuuucucuaauaau

SEQ ID NO: 3806970 - RNA, 19 nt, Human
cucuggagacagccccaga

SEQ ID NO: 3806971 - RNA, 12 nt, Human
cucuggagccca

SEQ ID NO: 3806972 - RNA, 15 nt, Human
cucuggaguggccac

SEQ ID NO: 3806973 - RNA, 22 nt, Human
cucuggaucuguuccuuggcag

SEQ ID NO: 3806974 - RNA, 20 nt, Human
cucuggauuauauuaugaag

SEQ ID NO: 3806975 - RNA, 18 nt, Human
cucuggauugugggaauu

SEQ ID NO: 3806976 - RNA, 11 nt, Human
cucuggcagcc

SEQ ID NO: 3806977 - RNA, 14 nt, Human
cucuggcagccaca

SEQ ID NO: 3806978 - RNA, 22 nt, Human
cucuggcagccacacuucucag

SEQ ID NO: 3806979 - RNA, 16 nt, Human
cucuggcagcucagag

SEQ ID NO: 3806980 - RNA, 17 nt, Human
cucuggcagcucagaga

SEQ ID NO: 3806981 - RNA, 23 nt, Human
cucuggcagcucagagagggugg

SEQ ID NO: 3806982 - RNA, 18 nt, Human
cucuggcauuagaauuau

SEQ ID NO: 3806983 - RNA, 19 nt, Human
cucuggcauuagaauuauu

SEQ ID NO: 3806984 - RNA, 15 nt, Human
cucuggccccaaggg

SEQ ID NO: 3806985 - RNA, 16 nt, Human
cucuggcccuggcccu

SEQ ID NO: 3806986 - RNA, 16 nt, Human
cucuggccucccaccc

SEQ ID NO: 3806987 - RNA, 19 nt, Human
cucuggccuucggccucca

SEQ ID NO: 3806988 - RNA, 16 nt, Human
cucuggcgacaguuuu

SEQ ID NO: 3806989 - RNA, 19 nt, Human
cucuggcuagaggccagcc

SEQ ID NO: 3806990 - RNA, 20 nt, Human
cucuggcuagaggccagccc

SEQ ID NO: 3806991 - RNA, 18 nt, Human
cucuggcucacagacugg

SEQ ID NO: 3806992 - RNA, 16 nt, Human
cucuggcucucauggg

SEQ ID NO: 3806993 - RNA, 16 nt, Human
cucuggcugaacccug

SEQ ID NO: 3806994 - RNA, 19 nt, Human
cucuggcugaacccugugc

SEQ ID NO: 3806995 - RNA, 20 nt, Human
cucuggcugaacccugugcu

SEQ ID NO: 3806996 - RNA, 15 nt, Human
cucuggcuggggagc

SEQ ID NO: 3806997 - RNA, 14 nt, Human
cucuggcuuccagg

SEQ ID NO: 3806998 - RNA, 17 nt, Human
cucuggcuuccagguau

SEQ ID NO: 3806999 - RNA, 22 nt, Human
cucuggcuuggccacagccagg

SEQ ID NO: 3807000 - RNA, 14 nt, Human
cucuggcuuggccu

SEQ ID NO: 3807001 - RNA, 17 nt, Human
cucuggcuuggccuauc

SEQ ID NO: 3807002 - RNA, 19 nt, Human
cucugggaaauaagagaga

SEQ ID NO: 3807003 - RNA, 23 nt, Human
cucugggaaaugagaaggcagcc

SEQ ID NO: 3807004 - RNA, 19 nt, Human
cucugggaaccucccagag

SEQ ID NO: 3807005 - RNA, 18 nt, Human
cucugggagaaaaucauc

SEQ ID NO: 3807006 - RNA, 20 nt, Human
cucugggagaaaaucaucaa

SEQ ID NO: 3807007 - RNA, 21 nt, Human
cucugggagaaaaucaucaag

SEQ ID NO: 3807008 - RNA, 16 nt, Human
cucugggauccugggg

SEQ ID NO: 3807009 - RNA, 19 nt, Human
cucugggcacacucugcca

SEQ ID NO: 3807010 - RNA, 23 nt, Human
cucugggcaggaccucagagucc

SEQ ID NO: 3807011 - RNA, 18 nt, Human
cucugggcuauggacaca

SEQ ID NO: 3807012 - RNA, 17 nt, Human
cucugggcugccaugug

SEQ ID NO: 3807013 - RNA, 22 nt, Human
cucugggcuggaugagcuccca

SEQ ID NO: 3807014 - RNA, 11 nt, Human
cucugggcugu

SEQ ID NO: 3807015 - RNA, 10 nt, Human
cucugggcuu

SEQ ID NO: 3807016 - RNA, 22 nt, Human
cucugggcuuugauuccaucuc

SEQ ID NO: 3807017 - RNA, 23 nt, Human
cucugggcuuugauuccaucucc

SEQ ID NO: 3807018 - RNA, 15 nt, Human
cucuggggcuguguu

SEQ ID NO: 3807019 - RNA, 21 nt, Human
cucuggggcuguugaagucac

SEQ ID NO: 3807020 - RNA, 21 nt, Human
cucugggggcugaggagcagc

SEQ ID NO: 3807021 - RNA, 21 nt, Human
cucugggggguggccaggccg

SEQ ID NO: 3807022 - RNA, 18 nt, Human
cucuggggugcugccuga

SEQ ID NO: 3807023 - RNA, 15 nt, Human
cucugguaaccucuu

SEQ ID NO: 3807024 - RNA, 17 nt, Human
cucugguagacacagga

SEQ ID NO: 3807025 - RNA, 19 nt, Human
cucugguaucuaauucuuu

SEQ ID NO: 3807026 - RNA, 21 nt, Human
cucugguaucuaauucuuuaa

SEQ ID NO: 3807027 - RNA, 14 nt, Human
cucugguccauaga

SEQ ID NO: 3807028 - RNA, 18 nt, Human
cucugguccauagagagc

SEQ ID NO: 3807029 - RNA, 22 nt, Human
cucuggucuccucuuuguuuug

SEQ ID NO: 3807030 - RNA, 21 nt, Human
cucuggugagucuuggcggca

SEQ ID NO: 3807031 - RNA, 14 nt, Human
cucuggugccucca

SEQ ID NO: 3807032 - RNA, 16 nt, Human
cucuggugcugcagua

SEQ ID NO: 3807033 - RNA, 15 nt, Human
cucugguuaucuaau

SEQ ID NO: 3807034 - RNA, 14 nt, Human
cucugguuccuccc

SEQ ID NO: 3807035 - RNA, 21 nt, Human
cucuguaaaugaaaaaaccca

SEQ ID NO: 3807036 - RNA, 15 nt, Human
cucuguaacaucacu

SEQ ID NO: 3807037 - RNA, 19 nt, Human
cucuguaauugaauauuau

SEQ ID NO: 3807038 - RNA, 14 nt, Human
cucuguaauugcaa

SEQ ID NO: 3807039 - RNA, 13 nt, Human
cucuguacagagc

SEQ ID NO: 3807040 - RNA, 17 nt, Human
cucuguacagagcccac

SEQ ID NO: 3807041 - RNA, 19 nt, Human
cucuguaccccaugaccuu

SEQ ID NO: 3807042 - RNA, 18 nt, Human
cucuguagggaacucugg

SEQ ID NO: 3807043 - RNA, 13 nt, Human
cucuguauaaaca

SEQ ID NO: 3807044 - RNA, 14 nt, Human
cucuacagaggcca

SEQ ID NO: 3807045 - RNA, 19 nt, Human
cucuacagaggccaugggc

SEQ ID NO: 3807046 - RNA, 20 nt, Human
cucuacagugccaacuccuc

SEQ ID NO: 3807047 - RNA, 18 nt, Human
cucuacaucuucugccuu

SEQ ID NO: 3807048 - RNA, 21 nt, Human
cucuaccagauaacugaggag

SEQ ID NO: 3807049 - RNA, 23 nt, Human
cucuaccagauaacugaggaggg

SEQ ID NO: 3807050 - RNA, 17 nt, Human
cucuaccagugcaggcu

SEQ ID NO: 3807051 - RNA, 23 nt, Human
cucuaccagugcaggcuggccag

SEQ ID NO: 3807052 - RNA, 20 nt, Human
cucuaccauuugcagagucc

SEQ ID NO: 3807053 - RNA, 17 nt, Human
cucuacccagcccaucu

SEQ ID NO: 3807054 - RNA, 18 nt, Human
cucuacccagcccaucuu

SEQ ID NO: 3807055 - RNA, 19 nt, Human
cucuacccagcccaucuug

SEQ ID NO: 3807056 - RNA, 20 nt, Human
cucuacccagcccaucuugc

SEQ ID NO: 3807057 - RNA, 13 nt, Human
cucuacccagggc

SEQ ID NO: 3807058 - RNA, 22 nt, Human
cucuacccaucuuaaaaacaac

SEQ ID NO: 3807059 - RNA, 15 nt, Human
cucuacccucccacc

SEQ ID NO: 3807060 - RNA, 22 nt, Human
cucuacccugcauggcugagcu

SEQ ID NO: 3807061 - RNA, 20 nt, Human
cucuaccucauaucaguuug

SEQ ID NO: 3807062 - RNA, 18 nt, Human
cucuaccuucuccccagc

SEQ ID NO: 3807063 - RNA, 20 nt, Human
cucuacguggcaaauuaacu

SEQ ID NO: 3807064 - RNA, 18 nt, Human
cucuacuaaaaauacaaa

SEQ ID NO: 3807065 - RNA, 22 nt, Human
cucuacuaaaaauacaaaaauu

SEQ ID NO: 3807066 - RNA, 14 nt, Human
cucuacucugcuuu

SEQ ID NO: 3807067 - RNA, 16 nt, Human
cucuacucuuacuucc

SEQ ID NO: 3807068 - RNA, 12 nt, Human
cucuacugggaa

SEQ ID NO: 3807069 - RNA, 13 nt, Human
cucuacugggaag

SEQ ID NO: 3807070 - RNA, 16 nt, Human
cucuacugggaaggcu

SEQ ID NO: 3807071 - RNA, 14 nt, Human
cucuacuguguaau

SEQ ID NO: 3807072 - RNA, 17 nt, Human
cucuacuuaauccaaug

SEQ ID NO: 3807073 - RNA, 15 nt, Human
cucuagaagccaagg

SEQ ID NO: 3807074 - RNA, 22 nt, Human
cucuagaagccaagggaaaggg

SEQ ID NO: 3807075 - RNA, 12 nt, Human
cucuagaaucug

SEQ ID NO: 3807076 - RNA, 20 nt, Human
cucuagaauuuuaagugcuu

SEQ ID NO: 3807077 - RNA, 23 nt, Human
cucuagaauuuuaagugcuuugu

SEQ ID NO: 3807078 - RNA, 17 nt, Human
cucuagacaacccugca

SEQ ID NO: 3807079 - RNA, 21 nt, Human
cucuagacaagauauuguaca

SEQ ID NO: 3807080 - RNA, 15 nt, Human
cucuagagccuucag

SEQ ID NO: 3807081 - RNA, 22 nt, Human
cucuagagccuucagccuuaau

SEQ ID NO: 3807082 - RNA, 21 nt, Human
cucuagaguagagguauaauu

SEQ ID NO: 3807083 - RNA, 16 nt, Human
cucuagaguccaaggu

SEQ ID NO: 3807084 - RNA, 20 nt, Human
cucuagauuuuguuuugcuu

SEQ ID NO: 3807085 - RNA, 19 nt, Human
cucuagccaaaugguuuaa

SEQ ID NO: 3807086 - RNA, 17 nt, Human
cucuagcucucuaggcc

SEQ ID NO: 3807087 - RNA, 15 nt, Human
cucuagcugaauuga

SEQ ID NO: 3807088 - RNA, 13 nt, Human
cucuagcuggugg

SEQ ID NO: 3807089 - RNA, 16 nt, Human
cucuagcugugggggu

SEQ ID NO: 3807090 - RNA, 18 nt, Human
cccccuguacacaacuca

SEQ ID NO: 3807091 - RNA, 15 nt, Human
cccccuguccccuca

SEQ ID NO: 3807092 - RNA, 18 nt, Human
cccccuguccccucagcu

SEQ ID NO: 3807093 - RNA, 19 nt, Human
cccccuguccccucagcuc

SEQ ID NO: 3807094 - RNA, 12 nt, Human
cccccuguccuc

SEQ ID NO: 3807095 - RNA, 23 nt, Human
cccccugucucucagggccaggc

SEQ ID NO: 3807096 - RNA, 12 nt, Human
cccccugugcag

SEQ ID NO: 3807097 - RNA, 20 nt, Human
cccccuguggaugcugcugc

SEQ ID NO: 3807098 - RNA, 16 nt, Human
cccccuuaaauuuaau

SEQ ID NO: 3807099 - RNA, 15 nt, Human
cccccuucagugccc

SEQ ID NO: 3807100 - RNA, 23 nt, Human
cccccuucagugcccaccaacau

SEQ ID NO: 3807101 - RNA, 11 nt, Human
cccccuuccac

SEQ ID NO: 3807102 - RNA, 14 nt, Human
cccccuuccaugga

SEQ ID NO: 3807103 - RNA, 15 nt, Human
cccccuucucccaca

SEQ ID NO: 3807104 - RNA, 17 nt, Human
cccccuucucccacacu

SEQ ID NO: 3807105 - RNA, 21 nt, Human
cccccuucucugcccauuccc

SEQ ID NO: 3807106 - RNA, 23 nt, Human
cccccuucugggcaucuguucug

SEQ ID NO: 3807107 - RNA, 14 nt, Human
cccccuugaguggg

SEQ ID NO: 3807108 - RNA, 15 nt, Human
cccccuugccacccc

SEQ ID NO: 3807109 - RNA, 17 nt, Human
cccccuuucacaggcag

SEQ ID NO: 3807110 - RNA, 22 nt, Human
cccccuuucacaggcagccagu

SEQ ID NO: 3807111 - RNA, 17 nt, Human
cccccuuucagaugucu

SEQ ID NO: 3807112 - RNA, 17 nt, Human
cccccuuugugcugugg

SEQ ID NO: 3807113 - RNA, 18 nt, Human
cccccuuugugcuguggg

SEQ ID NO: 3807114 - RNA, 23 nt, Human
ccccgacccuugccgucuaccug

SEQ ID NO: 3807115 - RNA, 18 nt, Human
ccccgacgccacagccca

SEQ ID NO: 3807116 - RNA, 14 nt, Human
ccccgacuccagcc

SEQ ID NO: 3807117 - RNA, 14 nt, Human
ccccgagcccuacu

SEQ ID NO: 3807118 - RNA, 12 nt, Human
ccccgagcuggg

SEQ ID NO: 3807119 - RNA, 23 nt, Human
ccccgaggccuucucugaaggac

SEQ ID NO: 3807120 - RNA, 21 nt, Human
ccccgagggaugaugccacac

SEQ ID NO: 3807121 - RNA, 13 nt, Human
ccccgcagaccuc

SEQ ID NO: 3807122 - RNA, 12 nt, Human
ccccgcccaggc

SEQ ID NO: 3807123 - RNA, 13 nt, Human
ccccgccccacau

SEQ ID NO: 3807124 - RNA, 13 nt, Human
ccccgcccccugc

SEQ ID NO: 3807125 - RNA, 13 nt, Human
ccccgccccgccc

SEQ ID NO: 3807126 - RNA, 16 nt, Human
ccccgccccgccccac

SEQ ID NO: 3807127 - RNA, 17 nt, Human
ccccgcccucuuccuga

SEQ ID NO: 3807128 - RNA, 14 nt, Human
ccccgccuguuccc

SEQ ID NO: 3807129 - RNA, 13 nt, Human
ccccgcuggagga

SEQ ID NO: 3807130 - RNA, 14 nt, Human
ccccgcuucugccu

SEQ ID NO: 3807131 - RNA, 15 nt, Human
ccccggagggcugcg

SEQ ID NO: 3807132 - RNA, 15 nt, Human
ccccggaucagagca

SEQ ID NO: 3807133 - RNA, 14 nt, Human
ccccggcagacgcc

SEQ ID NO: 3807134 - RNA, 13 nt, Human
ccccggcagcagc

SEQ ID NO: 3807135 - RNA, 13 nt, Human
ccccggcaggccc

SEQ ID NO: 3807136 - RNA, 18 nt, Human
ccccggcaggcccugcag

SEQ ID NO: 3807137 - RNA, 21 nt, Human
ccccggcaggcccugcagugu

SEQ ID NO: 3807138 - RNA, 13 nt, Human
ccccggccaccuc

SEQ ID NO: 3807139 - RNA, 14 nt, Human
ccccggccaccugc

SEQ ID NO: 3807140 - RNA, 17 nt, Human
ccccggccccagccaga

SEQ ID NO: 3807141 - RNA, 18 nt, Human
ccccggccccagccagag

SEQ ID NO: 3807142 - RNA, 13 nt, Human
ccccggcccuacc

SEQ ID NO: 3807143 - RNA, 18 nt, Human
ccccggcccuaccagcgc

SEQ ID NO: 3807144 - RNA, 12 nt, Human
ccccggcccugg

SEQ ID NO: 3807145 - RNA, 15 nt, Human
ccccggcggcgccgg

SEQ ID NO: 3807146 - RNA, 16 nt, Human
ccccgggcucucugcu

SEQ ID NO: 3807147 - RNA, 17 nt, Human
ccccgggcucucugcug

SEQ ID NO: 3807148 - RNA, 21 nt, Human
ccccggggcguuucuuugccg

SEQ ID NO: 3807149 - RNA, 22 nt, Human
ccccggggugaguccauucucc

SEQ ID NO: 3807150 - RNA, 18 nt, Human
ccccggguuuggcgggcc

SEQ ID NO: 3807151 - RNA, 19 nt, Human
ccccggguuuggcgggcca

SEQ ID NO: 3807152 - RNA, 24 nt, Human
ccccggucccuugagaccucagcc

SEQ ID NO: 3807153 - RNA, 16 nt, Human
ccccgucacagccuca

SEQ ID NO: 3807154 - RNA, 23 nt, Human
ccccguccuggagguuccccagc

SEQ ID NO: 3807155 - RNA, 14 nt, Human
ccccgucucuacua

SEQ ID NO: 3807156 - RNA, 21 nt, Human
ccccgucugggguucagcccc

SEQ ID NO: 3807157 - RNA, 22 nt, Human
ccccgucugggguucagccccu

SEQ ID NO: 3807158 - RNA, 14 nt, Human
ccccgucuguggcu

SEQ ID NO: 3807159 - RNA, 20 nt, Human
ccccguggccaucccuguga

SEQ ID NO: 3807160 - RNA, 22 nt, Human
ccccguggccaucccugugagg

SEQ ID NO: 3807161 - RNA, 17 nt, Human
ccccgugggccauggca

SEQ ID NO: 3807162 - RNA, 14 nt, Human
ccccguuucuggug

SEQ ID NO: 3807163 - RNA, 18 nt, Human
ccccuaagagagcaccug

SEQ ID NO: 3807164 - RNA, 15 nt, Human
ccccuaccacugucu

SEQ ID NO: 3807165 - RNA, 22 nt, Human
ccccuacccccuccucucugcc

SEQ ID NO: 3807166 - RNA, 15 nt, Human
ccccuacgcgccuug

SEQ ID NO: 3807167 - RNA, 19 nt, Human
ccccuagaaacccaagcuc

SEQ ID NO: 3807168 - RNA, 19 nt, Human
ccccuagccauuuuuacug

SEQ ID NO: 3807169 - RNA, 18 nt, Human
ccccuagcccaggagaga

SEQ ID NO: 3807170 - RNA, 20 nt, Human
ccccuagcccaggagagaga

SEQ ID NO: 3807171 - RNA, 23 nt, Human
ccccuagcuuuauauauggacau

SEQ ID NO: 3807172 - RNA, 18 nt, Human
ccccuaguaagugccuuc

SEQ ID NO: 3807173 - RNA, 14 nt, Human
ccccuauccaccca

SEQ ID NO: 3807174 - RNA, 17 nt, Human
ccccuauccacccagcc

SEQ ID NO: 3807175 - RNA, 20 nt, Human
ccccuauccuuggcaccaaa

SEQ ID NO: 3807176 - RNA, 19 nt, Human
ccccuauggaauuuauaau

SEQ ID NO: 3807177 - RNA, 18 nt, Human
ccccucaaaucguccagc

SEQ ID NO: 3807178 - RNA, 11 nt, Human
ccccucaaccc

SEQ ID NO: 3807179 - RNA, 19 nt, Human
ccccucaaccuccugugga

SEQ ID NO: 3807180 - RNA, 13 nt, Human
ccccucacagccu

SEQ ID NO: 3807181 - RNA, 20 nt, Human
ccccucacaguauugcucac

SEQ ID NO: 3807182 - RNA, 13 nt, Human
ccccucaccccuc

SEQ ID NO: 3807183 - RNA, 13 nt, Human
ccccucaccuacu

SEQ ID NO: 3807184 - RNA, 12 nt, Human
ccccucaccucc

SEQ ID NO: 3807185 - RNA, 14 nt, Human
ccccucaccuccuc

SEQ ID NO: 3807186 - RNA, 14 nt, Human
ccccucaccuugca

SEQ ID NO: 3807187 - RNA, 14 nt, Human
ccccucacucuggc

SEQ ID NO: 3807188 - RNA, 23 nt, Human
ccccucagccucuccccugccug

SEQ ID NO: 3807189 - RNA, 17 nt, Human
ccuucucuuccaggcag

SEQ ID NO: 3807190 - RNA, 20 nt, Human
ccuucugaaaaaguauccug

SEQ ID NO: 3807191 - RNA, 20 nt, Human
ccuucugacccaugcugccc

SEQ ID NO: 3807192 - RNA, 15 nt, Human
ccuucugagcuccug

SEQ ID NO: 3807193 - RNA, 17 nt, Human
ccuucugagcuccuguc

SEQ ID NO: 3807194 - RNA, 15 nt, Human
ccuucugaugaaaug

SEQ ID NO: 3807195 - RNA, 21 nt, Human
ccuucugaugaaauguuaaca

SEQ ID NO: 3807196 - RNA, 23 nt, Human
ccuucugcacauaaacucuuuua

SEQ ID NO: 3807197 - RNA, 17 nt, Human
ccuucugccuuugaugu

SEQ ID NO: 3807198 - RNA, 19 nt, Human
ccuucuggaaacugugaag

SEQ ID NO: 3807199 - RNA, 12 nt, Human
ccuucugggcau

SEQ ID NO: 3807200 - RNA, 16 nt, Human
ccuucuguaguuuuau

SEQ ID NO: 3807201 - RNA, 20 nt, Human
ccuucuguccuacucugugu

SEQ ID NO: 3807202 - RNA, 15 nt, Human
ccuucuguccuggug

SEQ ID NO: 3807203 - RNA, 16 nt, Human
ccuucuguccuggugu

SEQ ID NO: 3807204 - RNA, 18 nt, Human
ccuucuguccugguguca

SEQ ID NO: 3807205 - RNA, 19 nt, Human
ccuucuguccuggugucac

SEQ ID NO: 3807206 - RNA, 16 nt, Human
ccuucugugcccagcu

SEQ ID NO: 3807207 - RNA, 21 nt, Human
ccuucuguggcucacagaacc

SEQ ID NO: 3807208 - RNA, 17 nt, Human
ccuucuuauucucacuc

SEQ ID NO: 3807209 - RNA, 20 nt, Human
ccuucuuauucucacuccac

SEQ ID NO: 3807210 - RNA, 22 nt, Human
ccuucuuauucucacuccacca

SEQ ID NO: 3807211 - RNA, 20 nt, Human
ccuucuucauguucaauuau

SEQ ID NO: 3807212 - RNA, 22 nt, Human
ccuucuucggggaacuccugga

SEQ ID NO: 3807213 - RNA, 21 nt, Human
ccuucuucuuuuugcuguugu

SEQ ID NO: 3807214 - RNA, 16 nt, Human
ccuucuugcugcccug

SEQ ID NO: 3807215 - RNA, 12 nt, Human
ccuucuuguagu

SEQ ID NO: 3807216 - RNA, 13 nt, Human
ccuucuuuccucu

SEQ ID NO: 3807217 - RNA, 17 nt, Human
ccuucuuuccucuuccc

SEQ ID NO: 3807218 - RNA, 16 nt, Human
ccuucuuugcccuuua

SEQ ID NO: 3807219 - RNA, 19 nt, Human
ccuucuuuucucauguguu

SEQ ID NO: 3807220 - RNA, 21 nt, Human
ccuucuuuuucuggacucugg

SEQ ID NO: 3807221 - RNA, 19 nt, Human
ccuugaaaacacuguucuc

SEQ ID NO: 3807222 - RNA, 21 nt, Human
ccuugaaaauaagaauagaaa

SEQ ID NO: 3807223 - RNA, 18 nt, Human
ccuugaaacuuugggaaa

SEQ ID NO: 3807224 - RNA, 21 nt, Human
ccuugaaagucaugaacacau

SEQ ID NO: 3807225 - RNA, 15 nt, Human
ccuugaaccacuucc

SEQ ID NO: 3807226 - RNA, 15 nt, Human
ccuugaaccugugag

SEQ ID NO: 3807227 - RNA, 18 nt, Human
ccuugaaccugugaguaa

SEQ ID NO: 3807228 - RNA, 18 nt, Human
ccuugaagaaccucucac

SEQ ID NO: 3807229 - RNA, 11 nt, Human
ccuugaagccg

SEQ ID NO: 3807230 - RNA, 18 nt, Human
ccuugaaggacuaauaga

SEQ ID NO: 3807231 - RNA, 17 nt, Human
ccuugaagucacccggc

SEQ ID NO: 3807232 - RNA, 14 nt, Human
ccuugaaugcugcc

SEQ ID NO: 3807233 - RNA, 16 nt, Human
ccuugaaugcugccag

SEQ ID NO: 3807234 - RNA, 20 nt, Human
ccuugaaugcugccagugug

SEQ ID NO: 3807235 - RNA, 15 nt, Human
ccuugacaacuggca

SEQ ID NO: 3807236 - RNA, 16 nt, Human
ccuugacaacuggcag

SEQ ID NO: 3807237 - RNA, 21 nt, Human
ccuugacaacuggcaggcagg

SEQ ID NO: 3807238 - RNA, 14 nt, Human
ccuugacacauuac

SEQ ID NO: 3807239 - RNA, 17 nt, Human
ccuugacagggcacacc

SEQ ID NO: 3807240 - RNA, 18 nt, Human
ccuugacagggcacaccg

SEQ ID NO: 3807241 - RNA, 12 nt, Human
ccuugaccagca

SEQ ID NO: 3807242 - RNA, 21 nt, Human
ccuugaccagcagaucccagc

SEQ ID NO: 3807243 - RNA, 23 nt, Human
ccuugaccauucuccaccugcca

SEQ ID NO: 3807244 - RNA, 14 nt, Human
ccuugaccuuugua

SEQ ID NO: 3807245 - RNA, 21 nt, Human
ccuugacuggaccugguggcu

SEQ ID NO: 3807246 - RNA, 14 nt, Human
ccuugagacagcuu

SEQ ID NO: 3807247 - RNA, 14 nt, Human
ccuugagaccucag

SEQ ID NO: 3807248 - RNA, 18 nt, Human
ccuugagagaccaggcaa

SEQ ID NO: 3807249 - RNA, 20 nt, Human
ccuugagagaccaggcaaag

SEQ ID NO: 3807250 - RNA, 21 nt, Human
ccuugagaguaucaggucucc

SEQ ID NO: 3807251 - RNA, 20 nt, Human
ccuugagcccuccccaggaa

SEQ ID NO: 3807252 - RNA, 13 nt, Human
cauucuuggccca

SEQ ID NO: 3807253 - RNA, 16 nt, Human
cauucuuggcccagga

SEQ ID NO: 3807254 - RNA, 16 nt, Human
cauucuugguuggcug

SEQ ID NO: 3807255 - RNA, 23 nt, Human
cauucuuguuuucuuucuuuaaa

SEQ ID NO: 3807256 - RNA, 18 nt, Human
cauucuuuaucuugacau

SEQ ID NO: 3807257 - RNA, 17 nt, Human
cauucuuucugauaacu

SEQ ID NO: 3807258 - RNA, 12 nt, Human
cauucuuugcuu

SEQ ID NO: 3807259 - RNA, 19 nt, Human
cauucuuugcuugaacaca

SEQ ID NO: 3807260 - RNA, 21 nt, Human
cauucuuugcuugaacacagu

SEQ ID NO: 3807261 - RNA, 18 nt, Human
cauucuuuuaaaagacaa

SEQ ID NO: 3807262 - RNA, 19 nt, Human
cauucuuuuaaaagacaag

SEQ ID NO: 3807263 - RNA, 17 nt, Human
cauucuuuuaacuucuu

SEQ ID NO: 3807264 - RNA, 14 nt, Human
cauucuuuuguaau

SEQ ID NO: 3807265 - RNA, 13 nt, Human
cauucuuuuugaa

SEQ ID NO: 3807266 - RNA, 16 nt, Human
cauugaaaagagcuga

SEQ ID NO: 3807267 - RNA, 16 nt, Human
cauugaaaauguaagu

SEQ ID NO: 3807268 - RNA, 16 nt, Human
cauugaaagagaacca

SEQ ID NO: 3807269 - RNA, 18 nt, Human
cauugaaauucugagaaa

SEQ ID NO: 3807270 - RNA, 18 nt, Human
cauugaacacaaacugua

SEQ ID NO: 3807271 - RNA, 22 nt, Human
cauugaagaauguuagaguaau

SEQ ID NO: 3807272 - RNA, 20 nt, Human
cauugaagccgacucuggcc

SEQ ID NO: 3807273 - RNA, 13 nt, Human
cauugaaggcuua

SEQ ID NO: 3807274 - RNA, 19 nt, Human
cauugaaguaaugaauuuu

SEQ ID NO: 3807275 - RNA, 16 nt, Human
cauugaagucagaugu

SEQ ID NO: 3807276 - RNA, 16 nt, Human
cauugacauguacaga

SEQ ID NO: 3807277 - RNA, 17 nt, Human
cauugacauguacagag

SEQ ID NO: 3807278 - RNA, 12 nt, Human
cauugacauuau

SEQ ID NO: 3807279 - RNA, 15 nt, Human
cauugacauuauaga

SEQ ID NO: 3807280 - RNA, 16 nt, Human
cauugaccaagaacug

SEQ ID NO: 3807281 - RNA, 22 nt, Human
cauugaccgcgacuaauuucaa

SEQ ID NO: 3807282 - RNA, 19 nt, Human
cauugacuaucaaacugaa

SEQ ID NO: 3807283 - RNA, 23 nt, Human
cauugacugguuuacaggcccug

SEQ ID NO: 3807284 - RNA, 18 nt, Human
cauugacuuuuauaaagc

SEQ ID NO: 3807285 - RNA, 23 nt, Human
cauugagaacugcauauguuucg

SEQ ID NO: 3807286 - RNA, 18 nt, Human
cauugagaccgugaagau

SEQ ID NO: 3807287 - RNA, 18 nt, Human
cauugagcugauauaaau

SEQ ID NO: 3807288 - RNA, 19 nt, Human
cauugagcugauauaaauu

SEQ ID NO: 3807289 - RNA, 20 nt, Human
cauugagcugauauaaauuc

SEQ ID NO: 3807290 - RNA, 15 nt, Human
cauugagcugugcaa

SEQ ID NO: 3807291 - RNA, 19 nt, Human
cauugagcuugcaugcuug

SEQ ID NO: 3807292 - RNA, 16 nt, Human
cauugaggaagagucu

SEQ ID NO: 3807293 - RNA, 20 nt, Human
cauugauacaaucauagcau

SEQ ID NO: 3807294 - RNA, 17 nt, Human
cauugauaugaaaaaua

SEQ ID NO: 3807295 - RNA, 22 nt, Human
cauugauaugaaaaauaugaua

SEQ ID NO: 3807296 - RNA, 16 nt, Human
cauugauauuugugca

SEQ ID NO: 3807297 - RNA, 17 nt, Human
cauugaucauaaacuga

SEQ ID NO: 3807298 - RNA, 17 nt, Human
cauugauugucagcuac

SEQ ID NO: 3807299 - RNA, 17 nt, Human
cauugauuuccuguguc

SEQ ID NO: 3807300 - RNA, 21 nt, Human
cauugcaacaaaauacauucu

SEQ ID NO: 3807301 - RNA, 12 nt, Human
cauugcacccag

SEQ ID NO: 3807302 - RNA, 14 nt, Human
cauugcacccagcc

SEQ ID NO: 3807303 - RNA, 17 nt, Human
cauugcacuccagccug

SEQ ID NO: 3807304 - RNA, 15 nt, Human
cauugcacucuagcc

SEQ ID NO: 3807305 - RNA, 18 nt, Human
cauugcacucuagccugg

SEQ ID NO: 3807306 - RNA, 20 nt, Human
cauugcaguuuaagagcaga

SEQ ID NO: 3807307 - RNA, 21 nt, Human
cauugcaugccgggugcagca

SEQ ID NO: 3807308 - RNA, 12 nt, Human
cauugcauucua

SEQ ID NO: 3807309 - RNA, 18 nt, Human
cauugcauucuauugccu

SEQ ID NO: 3807310 - RNA, 19 nt, Human
cauugcauucuauugccuu

SEQ ID NO: 3807311 - RNA, 20 nt, Human
cauugccaccaggagaacca

SEQ ID NO: 3807312 - RNA, 14 nt, Human
cauugccagugucu

SEQ ID NO: 3807313 - RNA, 15 nt, Human
cauugccagugucuu

SEQ ID NO: 3807314 - RNA, 16 nt, Human
cauugccagugucuuu

SEQ ID NO: 3807315 - RNA, 18 nt, Human
cauugccagugucuuucu

SEQ ID NO: 3807316 - RNA, 19 nt, Human
cauugccagugucuuucuu

SEQ ID NO: 3807317 - RNA, 17 nt, Human
cauugccauucccugcc

SEQ ID NO: 3807318 - RNA, 18 nt, Human
cauugcccagucuuucau

SEQ ID NO: 3807319 - RNA, 20 nt, Human
cauugcccagucuuucaugu

SEQ ID NO: 3807320 - RNA, 18 nt, Human
cauugcccccagggcacu

SEQ ID NO: 3807321 - RNA, 16 nt, Human
cauugccuagcucuuu

SEQ ID NO: 3807322 - RNA, 18 nt, Human
cauugccucggcuggcuc

SEQ ID NO: 3807323 - RNA, 21 nt, Human
cauugccugauuuguuccuuc

SEQ ID NO: 3807324 - RNA, 17 nt, Human
cauugccuuaacuggag

SEQ ID NO: 3807325 - RNA, 23 nt, Human
cauugcguuugaccuuuuaugua

SEQ ID NO: 3807326 - RNA, 14 nt, Human
cauugcugagccuc

SEQ ID NO: 3807327 - RNA, 18 nt, Human
cauugcugagccucugcu

SEQ ID NO: 3807328 - RNA, 23 nt, Human
cauugcugcuccuuagcugccaa

SEQ ID NO: 3807329 - RNA, 16 nt, Human
cauugcuggacucuga

SEQ ID NO: 3807330 - RNA, 19 nt, Human
cauugcuggucuuguaaga

SEQ ID NO: 3807331 - RNA, 15 nt, Human
cauugcugguucuau

SEQ ID NO: 3807332 - RNA, 21 nt, Human
cauugcugguucuauuuaaug

SEQ ID NO: 3807333 - RNA, 14 nt, Human
cgccccagccucug

SEQ ID NO: 3807334 - RNA, 20 nt, Human
cgccccccacacuucccugg

SEQ ID NO: 3807335 - RNA, 17 nt, Human
cgccccccccuccccau

SEQ ID NO: 3807336 - RNA, 14 nt, Human
cgccccccucccag

SEQ ID NO: 3807337 - RNA, 23 nt, Human
cgcccccggguuuggcgggccaa

SEQ ID NO: 3807338 - RNA, 17 nt, Human
cgcccccuccgcccugc

SEQ ID NO: 3807339 - RNA, 14 nt, Human
cgcccccugcccuc

SEQ ID NO: 3807340 - RNA, 14 nt, Human
cgcccgcccacugu

SEQ ID NO: 3807341 - RNA, 15 nt, Human
cgcccgccccugcag

SEQ ID NO: 3807342 - RNA, 16 nt, Human
cgcccgccccugcagc

SEQ ID NO: 3807343 - RNA, 18 nt, Human
cgcccgccccugcagcac

SEQ ID NO: 3807344 - RNA, 14 nt, Human
cgcccgcugggcug

SEQ ID NO: 3807345 - RNA, 18 nt, Human
cgcccgggcccagaggag

SEQ ID NO: 3807346 - RNA, 15 nt, Human
cgcccguccugccug

SEQ ID NO: 3807347 - RNA, 18 nt, Human
cgcccucauuacggcucc

SEQ ID NO: 3807348 - RNA, 20 nt, Human
cgcccuccccuccccugcug

SEQ ID NO: 3807349 - RNA, 14 nt, Human
cgcccucuuccuga

SEQ ID NO: 3807350 - RNA, 12 nt, Human
cgcccugcagac

SEQ ID NO: 3807351 - RNA, 15 nt, Human
cgcccugcuccuccc

SEQ ID NO: 3807352 - RNA, 14 nt, Human
cgcccuggcaggca

SEQ ID NO: 3807353 - RNA, 17 nt, Human
cgcccuggcccccacau

SEQ ID NO: 3807354 - RNA, 22 nt, Human
cgcccugggcucgucuuugcag

SEQ ID NO: 3807355 - RNA, 20 nt, Human
cgcccuuacuucuugcccug

SEQ ID NO: 3807356 - RNA, 21 nt, Human
cgcccuuagucccccaacucu

SEQ ID NO: 3807357 - RNA, 13 nt, Human
cgcccuuccucuc

SEQ ID NO: 3807358 - RNA, 17 nt, Human
cgcccuuccucuccacc

SEQ ID NO: 3807359 - RNA, 16 nt, Human
cgcccuuuccuccuca

SEQ ID NO: 3807360 - RNA, 18 nt, Human
cgccgagucugucucugu

SEQ ID NO: 3807361 - RNA, 20 nt, Human
cgccgcaaaccacacuggac

SEQ ID NO: 3807362 - RNA, 21 nt, Human
cgccgcaaaccacacuggacu

SEQ ID NO: 3807363 - RNA, 13 nt, Human
cgccgccaccgcg

SEQ ID NO: 3807364 - RNA, 17 nt, Human
cgccgcuuuucuccucu

SEQ ID NO: 3807365 - RNA, 18 nt, Human
cgccggcgggcgggccgg

SEQ ID NO: 3807366 - RNA, 16 nt, Human
cgccgucuccauggca

SEQ ID NO: 3807367 - RNA, 19 nt, Human
cgccgugaguucucagggc

SEQ ID NO: 3807368 - RNA, 16 nt, Human
cgccgugcugggcagc

SEQ ID NO: 3807369 - RNA, 20 nt, Human
cgccuaaggucacagcuagu

SEQ ID NO: 3807370 - RNA, 14 nt, Human
cgccuacaggagug

SEQ ID NO: 3807371 - RNA, 17 nt, Human
cgccucaggaaugggcu

SEQ ID NO: 3807372 - RNA, 19 nt, Human
cgccucaggaaugggcugu

SEQ ID NO: 3807373 - RNA, 14 nt, Human
cgccucccacuggg

SEQ ID NO: 3807374 - RNA, 16 nt, Human
cgccucccacuggggu

SEQ ID NO: 3807375 - RNA, 18 nt, Human
cgccuccccaccuccagg

SEQ ID NO: 3807376 - RNA, 20 nt, Human
cgccucccuccaccccagga

SEQ ID NO: 3807377 - RNA, 19 nt, Human
cgccuccgggacccccagg

SEQ ID NO: 3807378 - RNA, 14 nt, Human
cgccucgcccaccg

SEQ ID NO: 3807379 - RNA, 17 nt, Human
cgccucggaucagcuga

SEQ ID NO: 3807380 - RNA, 13 nt, Human
cgccucucccguc

SEQ ID NO: 3807381 - RNA, 15 nt, Human
cgccucucccgucag

SEQ ID NO: 3807382 - RNA, 21 nt, Human
cgccucucccgucagggccca

SEQ ID NO: 3807383 - RNA, 19 nt, Human
cgccucuucuucuucagaa

SEQ ID NO: 3807384 - RNA, 15 nt, Human
cgccugagcccaggg

SEQ ID NO: 3807385 - RNA, 17 nt, Human
cgccugagcccagggag

SEQ ID NO: 3807386 - RNA, 18 nt, Human
cgccugagcccagggagg

SEQ ID NO: 3807387 - RNA, 20 nt, Human
cgccugaggaacccuuacag

SEQ ID NO: 3807388 - RNA, 17 nt, Human
cgccugaggcaauuaga

SEQ ID NO: 3807389 - RNA, 17 nt, Human
cgccugcauguaaacac

SEQ ID NO: 3807390 - RNA, 14 nt, Human
cgccugccaguccu

SEQ ID NO: 3807391 - RNA, 13 nt, Human
cgccugcccaccu

SEQ ID NO: 3807392 - RNA, 18 nt, Human
cgccugcccaccugccug

SEQ ID NO: 3807393 - RNA, 16 nt, Human
cgccugccccucccag

SEQ ID NO: 3807394 - RNA, 20 nt, Human
cgccugcccucauggccccu

SEQ ID NO: 3807395 - RNA, 15 nt, Human
cgccugcugcaugcc

SEQ ID NO: 3807396 - RNA, 12 nt, Human
cgccuggagccc

SEQ ID NO: 3807397 - RNA, 23 nt, Human
cgccuggauuucugguucugaug

SEQ ID NO: 3807398 - RNA, 15 nt, Human
cgccuggccaggagc

SEQ ID NO: 3807399 - RNA, 16 nt, Human
cgccuggccaggagca

SEQ ID NO: 3807400 - RNA, 12 nt, Human
cgccuggccucc

SEQ ID NO: 3807401 - RNA, 14 nt, Human
cgccuggccuccag

SEQ ID NO: 3807402 - RNA, 12 nt, Human
cgccuggccuga

SEQ ID NO: 3807403 - RNA, 19 nt, Human
cgccuggcugcagccugcg

SEQ ID NO: 3807404 - RNA, 16 nt, Human
cgccuguaaucccagc

SEQ ID NO: 3807405 - RNA, 18 nt, Human
cgccuguaaucccagcag

SEQ ID NO: 3807406 - RNA, 17 nt, Human
cgccuguaguccuagcc

SEQ ID NO: 3807407 - RNA, 13 nt, Human
cgccuguccucac

SEQ ID NO: 3807408 - RNA, 12 nt, Human
cgccuguccugc

SEQ ID NO: 3807409 - RNA, 16 nt, Human
cgccugugaugcuggg

SEQ ID NO: 3807410 - RNA, 18 nt, Human
cgccuguggagcucagcc

SEQ ID NO: 3807411 - RNA, 13 nt, Human
cgccuguuccccc

SEQ ID NO: 3807412 - RNA, 19 nt, Human
cgccuguucccccgccgcu

SEQ ID NO: 3807413 - RNA, 22 nt, Human
cgccuuagcacuaccacuccug

SEQ ID NO: 3807414 - RNA, 21 nt, Human
cgccuuagcauguuugcugaa

SEQ ID NO: 3807415 - RNA, 23 nt, Human
cgccuuagguacuuauuccagau

SEQ ID NO: 3807416 - RNA, 14 nt, Human
cgccuucccuccug

SEQ ID NO: 3807417 - RNA, 19 nt, Human
cgccuucucccccccgggg

SEQ ID NO: 3807418 - RNA, 15 nt, Human
cgccuugcccagccu

SEQ ID NO: 3807419 - RNA, 19 nt, Human
cauuguguugacauuaaga

SEQ ID NO: 3807420 - RNA, 21 nt, Human
cauuguuauauaaucauuauu

SEQ ID NO: 3807421 - RNA, 15 nt, Human
cauuguuauuuauac

SEQ ID NO: 3807422 - RNA, 14 nt, Human
cauuguuauuuuca

SEQ ID NO: 3807423 - RNA, 15 nt, Human
cauuguuauuuucag

SEQ ID NO: 3807424 - RNA, 15 nt, Human
cauuguucaaaagga

SEQ ID NO: 3807425 - RNA, 17 nt, Human
cauuguucaccuuugua

SEQ ID NO: 3807426 - RNA, 18 nt, Human
cauuguucaccuuuguag

SEQ ID NO: 3807427 - RNA, 19 nt, Human
cauuguucuuauucuggca

SEQ ID NO: 3807428 - RNA, 21 nt, Human
cauuguugagguggucugaau

SEQ ID NO: 3807429 - RNA, 17 nt, Human
cauuguugcucccugug

SEQ ID NO: 3807430 - RNA, 18 nt, Human
cauuguuggccaaagcca

SEQ ID NO: 3807431 - RNA, 18 nt, Human
cauuguuuagaaagaaua

SEQ ID NO: 3807432 - RNA, 17 nt, Human
cauuguuuauuaacaaa

SEQ ID NO: 3807433 - RNA, 22 nt, Human
cauuguuugcuuauuguuccaa

SEQ ID NO: 3807434 - RNA, 15 nt, Human
cauuguuuggcauug

SEQ ID NO: 3807435 - RNA, 13 nt, Human
cauuguuuuaaaa

SEQ ID NO: 3807436 - RNA, 18 nt, Human
cauuguuuugaauauuac

SEQ ID NO: 3807437 - RNA, 16 nt, Human
cauuguuuugccaaca

SEQ ID NO: 3807438 - RNA, 17 nt, Human
cauuguuuuucugauau

SEQ ID NO: 3807439 - RNA, 12 nt, Human
cauuuaaaaaaa

SEQ ID NO: 3807440 - RNA, 21 nt, Human
cauuuaaaaaaaaaauuuguu

SEQ ID NO: 3807441 - RNA, 20 nt, Human
cauuuaaaacauuaaaauau

SEQ ID NO: 3807442 - RNA, 15 nt, Human
cauuuaaaagauaca

SEQ ID NO: 3807443 - RNA, 13 nt, Human
cauuuaaaauaua

SEQ ID NO: 3807444 - RNA, 14 nt, Human
cauuuaaaaugauu

SEQ ID NO: 3807445 - RNA, 16 nt, Human
cauuuaaaaugauuag

SEQ ID NO: 3807446 - RNA, 18 nt, Human
cauuuaaaaugauuagaa

SEQ ID NO: 3807447 - RNA, 16 nt, Human
cauuuaaaauugcuau

SEQ ID NO: 3807448 - RNA, 19 nt, Human
cauuuaaaauugcuauguu

SEQ ID NO: 3807449 - RNA, 20 nt, Human
cauuuaaaauugcuauguua

SEQ ID NO: 3807450 - RNA, 16 nt, Human
cauuuaaacagauguc

SEQ ID NO: 3807451 - RNA, 19 nt, Human
cauuuaaacagauguccau

SEQ ID NO: 3807452 - RNA, 12 nt, Human
cauuuaaagcau

SEQ ID NO: 3807453 - RNA, 15 nt, Human
cauuuaaaguauuuu

SEQ ID NO: 3807454 - RNA, 21 nt, Human
cauuuaaauguguacaaugua

SEQ ID NO: 3807455 - RNA, 23 nt, Human
cauuuaaauuuuacccuuuagac

SEQ ID NO: 3807456 - RNA, 23 nt, Human
cauuuaagagacagucaccccag

SEQ ID NO: 3807457 - RNA, 20 nt, Human
cauuuaagcuguggucaagg

SEQ ID NO: 3807458 - RNA, 22 nt, Human
cauuuaagggaaaaauauauau

SEQ ID NO: 3807459 - RNA, 22 nt, Human
cauuuaauaauauacuugugga

SEQ ID NO: 3807460 - RNA, 17 nt, Human
cauuuaauaauuauaug

SEQ ID NO: 3807461 - RNA, 23 nt, Human
cauuuaauaauuauaugcuauuu

SEQ ID NO: 3807462 - RNA, 13 nt, Human
cauuuaauagacu

SEQ ID NO: 3807463 - RNA, 14 nt, Human
cauuuaauugagaa

SEQ ID NO: 3807464 - RNA, 20 nt, Human
cauuuaccagcaacuugaac

SEQ ID NO: 3807465 - RNA, 15 nt, Human
cauuuacuaaacaua

SEQ ID NO: 3807466 - RNA, 20 nt, Human
cauuuacuaaacauaugauu

SEQ ID NO: 3807467 - RNA, 21 nt, Human
cauuuacuaaacauaugauuu

SEQ ID NO: 3807468 - RNA, 22 nt, Human
cauuuacugcauucuucugauc

SEQ ID NO: 3807469 - RNA, 12 nt, Human
cauuuacugugg

SEQ ID NO: 3807470 - RNA, 17 nt, Human
cauuuacuuaagacuua

SEQ ID NO: 3807471 - RNA, 17 nt, Human
cauuuacuuuguguuca

SEQ ID NO: 3807472 - RNA, 19 nt, Human
cauuuagaauggugauuuu

SEQ ID NO: 3807473 - RNA, 23 nt, Human
cauuuagagaacuguggccguua

SEQ ID NO: 3807474 - RNA, 18 nt, Human
cauuuagccaccaucuuu

SEQ ID NO: 3807475 - RNA, 18 nt, Human
cauuuagccuguccuguc

SEQ ID NO: 3807476 - RNA, 14 nt, Human
cauuuagcuggcca

SEQ ID NO: 3807477 - RNA, 21 nt, Human
cauuuagggaguauucuaaua

SEQ ID NO: 3807478 - RNA, 13 nt, Human
cgaggcccugcau

SEQ ID NO: 3807479 - RNA, 17 nt, Human
cgaggccuaccccgcag

SEQ ID NO: 3807480 - RNA, 18 nt, Human
cgaggccuucucugaagg

SEQ ID NO: 3807481 - RNA, 20 nt, Human
cgaggcugagaaucagacug

SEQ ID NO: 3807482 - RNA, 22 nt, Human
cgaggcugcccacuauggucau

SEQ ID NO: 3807483 - RNA, 15 nt, Human
cgaggcuggagcugg

SEQ ID NO: 3807484 - RNA, 13 nt, Human
cgagggaugaugc

SEQ ID NO: 3807485 - RNA, 17 nt, Human
cgagggauguggagcac

SEQ ID NO: 3807486 - RNA, 12 nt, Human
cgagggcaggga

SEQ ID NO: 3807487 - RNA, 21 nt, Human
cgagggcagggaccacacccu

SEQ ID NO: 3807488 - RNA, 14 nt, Human
cgagggcuggcugg

SEQ ID NO: 3807489 - RNA, 15 nt, Human
cgagggcuggcuggc

SEQ ID NO: 3807490 - RNA, 19 nt, Human
cgagggcuggcuggccuca

SEQ ID NO: 3807491 - RNA, 23 nt, Human
cgagggcuggcuggccucaccca

SEQ ID NO: 3807492 - RNA, 17 nt, Human
cgagggggcugcuccca

SEQ ID NO: 3807493 - RNA, 18 nt, Human
cgagggggcugcucccac

SEQ ID NO: 3807494 - RNA, 18 nt, Human
cgaggggugucuugggca

SEQ ID NO: 3807495 - RNA, 20 nt, Human
cgaggguugauuaaggcagu

SEQ ID NO: 3807496 - RNA, 22 nt, Human
cgagguggaucacagaggcuuc

SEQ ID NO: 3807497 - RNA, 23 nt, Human
cgagguggaucacagaggcuucu

SEQ ID NO: 3807498 - RNA, 20 nt, Human
cgagguggcugccuggagcc

SEQ ID NO: 3807499 - RNA, 21 nt, Human
cgagguuucucaaagaaauuu

SEQ ID NO: 3807500 - RNA, 12 nt, Human
cgaguacugugg

SEQ ID NO: 3807501 - RNA, 16 nt, Human
cgaguacugugggcaa

SEQ ID NO: 3807502 - RNA, 22 nt, Human
cgaguagaaaaugugacccucc

SEQ ID NO: 3807503 - RNA, 19 nt, Human
cgaguagcugagauuauag

SEQ ID NO: 3807504 - RNA, 13 nt, Human
cgaguagcuggga

SEQ ID NO: 3807505 - RNA, 14 nt, Human
cgaguagcugggac

SEQ ID NO: 3807506 - RNA, 20 nt, Human
cgagucaaaacucaaaugcu

SEQ ID NO: 3807507 - RNA, 14 nt, Human
cgagucaccuucca

SEQ ID NO: 3807508 - RNA, 15 nt, Human
cgagucacugccucu

SEQ ID NO: 3807509 - RNA, 18 nt, Human
cgagucauucguucugug

SEQ ID NO: 3807510 - RNA, 15 nt, Human
cgaguccaagcuggg

SEQ ID NO: 3807511 - RNA, 21 nt, Human
cgagucucuucuccacuggau

SEQ ID NO: 3807512 - RNA, 14 nt, Human
cgagugccaggacu

SEQ ID NO: 3807513 - RNA, 20 nt, Human
cgagugccgcaucucacagc

SEQ ID NO: 3807514 - RNA, 14 nt, Human
cgaguggagucugc

SEQ ID NO: 3807515 - RNA, 22 nt, Human
cgaguggauagaugcccugcua

SEQ ID NO: 3807516 - RNA, 23 nt, Human
cgaguggauagaugcccugcuag

SEQ ID NO: 3807517 - RNA, 19 nt, Human
cgagugugugcaugugugu

SEQ ID NO: 3807518 - RNA, 21 nt, Human
cgaguguguuucauccuuccc

SEQ ID NO: 3807519 - RNA, 17 nt, Human
cgaguuacagacaaagc

SEQ ID NO: 3807520 - RNA, 18 nt, Human
cgaguuacagacaaagcg

SEQ ID NO: 3807521 - RNA, 19 nt, Human
cgaguucggcucugggugg

SEQ ID NO: 3807522 - RNA, 14 nt, Human
cgaguuuccccaga

SEQ ID NO: 3807523 - RNA, 16 nt, Human
cgaguuuggucccugg

SEQ ID NO: 3807524 - RNA, 21 nt, Human
cgauacaccgggccuggagaa

SEQ ID NO: 3807525 - RNA, 23 nt, Human
cgauacugcgacuuucugccugg

SEQ ID NO: 3807526 - RNA, 12 nt, Human
cgauagagucuc

SEQ ID NO: 3807527 - RNA, 16 nt, Human
cgauaguuuacugaga

SEQ ID NO: 3807528 - RNA, 15 nt, Human
cgauauacucuagau

SEQ ID NO: 3807529 - RNA, 18 nt, Human
cgauaucagaauuugugu

SEQ ID NO: 3807530 - RNA, 16 nt, Human
cgauauuuuuaaagau

SEQ ID NO: 3807531 - RNA, 18 nt, Human
cgaucacaaaugacuuua

SEQ ID NO: 3807532 - RNA, 23 nt, Human
cgaucacaacgugcauugugcuu

SEQ ID NO: 3807533 - RNA, 17 nt, Human
cgaucaggcacagguca

SEQ ID NO: 3807534 - RNA, 20 nt, Human
cgaucauggcucacugcagc

SEQ ID NO: 3807535 - RNA, 14 nt, Human
cgaucccacacagg

SEQ ID NO: 3807536 - RNA, 14 nt, Human
cgauccuccccugg

SEQ ID NO: 3807537 - RNA, 18 nt, Human
cgauccugccacccugua

SEQ ID NO: 3807538 - RNA, 15 nt, Human
cgauccuucaaaguc

SEQ ID NO: 3807539 - RNA, 16 nt, Human
cgaucucauucaguau

SEQ ID NO: 3807540 - RNA, 14 nt, Human
cgaucucccaccuu

SEQ ID NO: 3807541 - RNA, 15 nt, Human
cgaucucggcucagu

SEQ ID NO: 3807542 - RNA, 15 nt, Human
cgaucucuccuggcc

SEQ ID NO: 3807543 - RNA, 16 nt, Human
cgaucucuccuggccu

SEQ ID NO: 3807544 - RNA, 18 nt, Human
cgaucuguaccugagagg

SEQ ID NO: 3807545 - RNA, 20 nt, Human
cgaucuugguucacugcaac

SEQ ID NO: 3807546 - RNA, 14 nt, Human
cgaugaaggcugcc

SEQ ID NO: 3807547 - RNA, 17 nt, Human
cgaugauucaggugcag

SEQ ID NO: 3807548 - RNA, 23 nt, Human
cgaugcagacagggggccagaac

SEQ ID NO: 3807549 - RNA, 13 nt, Human
cgaugcccagaga

SEQ ID NO: 3807550 - RNA, 18 nt, Human
cgaugcugcuuuccccug

SEQ ID NO: 3807551 - RNA, 14 nt, Human
cgaugcuuuaccaa

SEQ ID NO: 3807552 - RNA, 22 nt, Human
cgaugcuuuaccaaacagcaaa

SEQ ID NO: 3807553 - RNA, 18 nt, Human
cgauggauauauguuuuu

SEQ ID NO: 3807554 - RNA, 21 nt, Human
cgaugggcccaauucuuacaa

SEQ ID NO: 3807555 - RNA, 18 nt, Human
cgaugggggaugcuucau

SEQ ID NO: 3807556 - RNA, 19 nt, Human
cgaugggggaugcuucaug

SEQ ID NO: 3807557 - RNA, 13 nt, Human
cgauguaaauuau

SEQ ID NO: 3807558 - RNA, 15 nt, Human
cgauguggaacugcu

SEQ ID NO: 3807559 - RNA, 13 nt, Human
cgauguggcccug

SEQ ID NO: 3807560 - RNA, 21 nt, Human
cgauucacccuguccaaacug

SEQ ID NO: 3807561 - RNA, 22 nt, Human
cgauucaccugagcaggaccuc

SEQ ID NO: 3807562 - RNA, 23 nt, Human
cgauucaucucucagaagggagg

SEQ ID NO: 3807563 - RNA, 23 nt, Human
cgauucccucucccaggccccau

SEQ ID NO: 3807564 - RNA, 12 nt, Human
cgauuccuucuc

SEQ ID NO: 3807565 - RNA, 11 nt, Human
cgauucuggau

SEQ ID NO: 3807566 - RNA, 18 nt, Human
cgauuuaauucucuugaa

SEQ ID NO: 3807567 - RNA, 13 nt, Human
cgauuucuguaaa

SEQ ID NO: 3807568 - RNA, 14 nt, Human
cgauuuuauuacug

SEQ ID NO: 3807569 - RNA, 16 nt, Human
cgauuuuauuacuggc

SEQ ID NO: 3807570 - RNA, 19 nt, Human
cgauuuuauuacuggcgug

SEQ ID NO: 3807571 - RNA, 23 nt, Human
cgauuuuguaucugcaggcagac

SEQ ID NO: 3807572 - RNA, 18 nt, Human
cgcaaaccacacuggacu

SEQ ID NO: 3807573 - RNA, 16 nt, Human
cgcaaagagagauuuu

SEQ ID NO: 3807574 - RNA, 13 nt, Human
cgcaacccgugcc

SEQ ID NO: 3807575 - RNA, 22 nt, Human
cgcaagcaccauccccuccggc

SEQ ID NO: 3807576 - RNA, 14 nt, Human
cgcaagggccugau

SEQ ID NO: 3807577 - RNA, 14 nt, Human
cgcaaguucccagu

SEQ ID NO: 3807578 - RNA, 13 nt, Human
cgcacacacacaa

SEQ ID NO: 3807579 - RNA, 14 nt, Human
cgcacacacacaca

SEQ ID NO: 3807580 - RNA, 22 nt, Human
cgcacacacacacacacacauc

SEQ ID NO: 3807581 - RNA, 16 nt, Human
cgcacacacacacaua

SEQ ID NO: 3807582 - RNA, 18 nt, Human
cgcacacacacacauaca

SEQ ID NO: 3807583 - RNA, 13 nt, Human
cgcacagucucuc

SEQ ID NO: 3807584 - RNA, 15 nt, Human
cgcacagucucucuc

SEQ ID NO: 3807585 - RNA, 18 nt, Human
cgcacauauacacacaca

SEQ ID NO: 3807586 - RNA, 14 nt, Human
cgcaccauucugac

SEQ ID NO: 3807587 - RNA, 15 nt, Human
cgcaccauucugacu

SEQ ID NO: 3807588 - RNA, 19 nt, Human
cgcacccccacccuuuggg

SEQ ID NO: 3807589 - RNA, 21 nt, Human
cgcaccccccuguucuaaggg

SEQ ID NO: 3807590 - RNA, 16 nt, Human
cgcacccuccccuccc

SEQ ID NO: 3807591 - RNA, 21 nt, Human
cgcaccggagugucuggaauu

SEQ ID NO: 3807592 - RNA, 13 nt, Human
cgcaccuaaagca

SEQ ID NO: 3807593 - RNA, 20 nt, Human
cgcaccuaaagcagccagcc

SEQ ID NO: 3807594 - RNA, 12 nt, Human
cgcaccucccau

SEQ ID NO: 3807595 - RNA, 17 nt, Human
cgcaccugcccccuggu

SEQ ID NO: 3807596 - RNA, 15 nt, Human
cgcaccugccucagg

SEQ ID NO: 3807597 - RNA, 11 nt, Human
cgcacgcacac

SEQ ID NO: 3807598 - RNA, 16 nt, Human
cgcacgcacacacaca

SEQ ID NO: 3807599 - RNA, 16 nt, Human
cgcacggcagccacag

SEQ ID NO: 3807600 - RNA, 18 nt, Human
cgcacucacccaugugcc

SEQ ID NO: 3807601 - RNA, 17 nt, Human
cgcacuccaugagcacc

SEQ ID NO: 3807602 - RNA, 13 nt, Human
cgcacugggcuug

SEQ ID NO: 3807603 - RNA, 17 nt, Human
cgcacugggcuugggga

SEQ ID NO: 3807604 - RNA, 22 nt, Human
cgcacuucagaauuccauaucu

SEQ ID NO: 3807605 - RNA, 13 nt, Human
cgcagaagcccug

SEQ ID NO: 3807606 - RNA, 22 nt, Human
cgcagacacacccacagaagga

SEQ ID NO: 3807607 - RNA, 16 nt, Human
cgcagacaggaccagg

SEQ ID NO: 3807608 - RNA, 18 nt, Human
cgcagaccuccccagccc

SEQ ID NO: 3807609 - RNA, 21 nt, Human
cgcagagaagugacgguuccu

SEQ ID NO: 3807610 - RNA, 12 nt, Human
cgcagagaggcc

SEQ ID NO: 3807611 - RNA, 13 nt, Human
cgcagagcgcgcc

SEQ ID NO: 3807612 - RNA, 21 nt, Human
cgcagagcgcgccccuagccg

SEQ ID NO: 3807613 - RNA, 18 nt, Human
cgcagagcuuuucagauu

SEQ ID NO: 3807614 - RNA, 17 nt, Human
cgcagaugugcagcaga

SEQ ID NO: 3807615 - RNA, 18 nt, Human
cgcagaugugcagcagau

SEQ ID NO: 3807616 - RNA, 12 nt, Human
cgcagccaggac

SEQ ID NO: 3807617 - RNA, 20 nt, Human
cgcagcccuagagccugccu

SEQ ID NO: 3807618 - RNA, 14 nt, Human
cgcagcccugcaga

SEQ ID NO: 3807619 - RNA, 13 nt, Human
cgcagcccugcuu

SEQ ID NO: 3807620 - RNA, 20 nt, Human
cgggcucagggaccacagca

SEQ ID NO: 3807621 - RNA, 13 nt, Human
cgggcuccagcca

SEQ ID NO: 3807622 - RNA, 14 nt, Human
cgggcuccagccau

SEQ ID NO: 3807623 - RNA, 14 nt, Human
ccaagguucugggu

SEQ ID NO: 3807624 - RNA, 21 nt, Human
ccaagguuuaaacuucucuga

SEQ ID NO: 3807625 - RNA, 17 nt, Human
ccaaguaaauagcaaca

SEQ ID NO: 3807626 - RNA, 14 nt, Human
ccaaguacacugag

SEQ ID NO: 3807627 - RNA, 22 nt, Human
ccaaguagaaucucaguugauu

SEQ ID NO: 3807628 - RNA, 20 nt, Human
ccaagucagcuuugccuucc

SEQ ID NO: 3807629 - RNA, 18 nt, Human
ccaaguccagguccuggu

SEQ ID NO: 3807630 - RNA, 22 nt, Human
ccaaguccaggucgggcucagc

SEQ ID NO: 3807631 - RNA, 23 nt, Human
ccaagucccaccgguugcuucug

SEQ ID NO: 3807632 - RNA, 12 nt, Human
ccaagucccugu

SEQ ID NO: 3807633 - RNA, 13 nt, Human
ccaagucccuguu

SEQ ID NO: 3807634 - RNA, 19 nt, Human
ccaagugcaggcuggcacc

SEQ ID NO: 3807635 - RNA, 12 nt, Human
cguauuuuaaaa

SEQ ID NO: 3807636 - RNA, 17 nt, Human
cgucaacgugcauuuua

SEQ ID NO: 3807637 - RNA, 15 nt, Human
cgucaacguuguacu

SEQ ID NO: 3807638 - RNA, 17 nt, Human
cgucaacguuguacugu

SEQ ID NO: 3807639 - RNA, 16 nt, Human
cgucaacucauauuuu

SEQ ID NO: 3807640 - RNA, 21 nt, Human
cgucaccccuguuucuggcac

SEQ ID NO: 3807641 - RNA, 15 nt, Human
cgucagccuccagcc

SEQ ID NO: 3807642 - RNA, 17 nt, Human
cgucagucuuuuucugu

SEQ ID NO: 3807643 - RNA, 17 nt, Human
cgucauaacuagaacug

SEQ ID NO: 3807644 - RNA, 20 nt, Human
cgucaucauuuuuccuuccc

SEQ ID NO: 3807645 - RNA, 17 nt, Human
cgucaucuaguuuuaaa

SEQ ID NO: 3807646 - RNA, 21 nt, Human
cgucaugaggagauucugccu

SEQ ID NO: 3807647 - RNA, 20 nt, Human
cgucaugcacaguauuugua

SEQ ID NO: 3807648 - RNA, 15 nt, Human
cgucaugcuuguguu

SEQ ID NO: 3807649 - RNA, 19 nt, Human
cgucauggcuuaauguuua

SEQ ID NO: 3807650 - RNA, 20 nt, Human
cgucauggcuuaauguuuau

SEQ ID NO: 3807651 - RNA, 19 nt, Human
cgucauuacagggcacagg

SEQ ID NO: 3807652 - RNA, 15 nt, Human
cguccacagcuuccu

SEQ ID NO: 3807653 - RNA, 16 nt, Human
cguccacggcucuagg

SEQ ID NO: 3807654 - RNA, 13 nt, Human
cguccaucucccu

SEQ ID NO: 3807655 - RNA, 14 nt, Human
cgucccccucuggc

SEQ ID NO: 3807656 - RNA, 21 nt, Human
cgucccccucuggcuccagcu

SEQ ID NO: 3807657 - RNA, 10 nt, Human
cguccccucc

SEQ ID NO: 3807658 - RNA, 11 nt, Human
cguccccuguc

SEQ ID NO: 3807659 - RNA, 16 nt, Human
cgucccuagcagugaa

SEQ ID NO: 3807660 - RNA, 13 nt, Human
cgucccugcccau

SEQ ID NO: 3807661 - RNA, 19 nt, Human
cguccgcccugcuccuccc

SEQ ID NO: 3807662 - RNA, 21 nt, Human
cguccguggguugcuaacuga

SEQ ID NO: 3807663 - RNA, 23 nt, Human
cguccguggguugcuaacugaac

SEQ ID NO: 3807664 - RNA, 14 nt, Human
cguccucaccccug

SEQ ID NO: 3807665 - RNA, 15 nt, Human
cguccucccccugcc

SEQ ID NO: 3807666 - RNA, 20 nt, Human
cguccugccaccuggggcag

SEQ ID NO: 3807667 - RNA, 15 nt, Human
cguccuuacuccugu

SEQ ID NO: 3807668 - RNA, 16 nt, Human
cgucgaggggcucuca

SEQ ID NO: 3807669 - RNA, 18 nt, Human
cgucuaaccacagcuccu

SEQ ID NO: 3807670 - RNA, 14 nt, Human
cgucuacagcuccc

SEQ ID NO: 3807671 - RNA, 14 nt, Human
cgucuaccugaggg

SEQ ID NO: 3807672 - RNA, 22 nt, Human
cgucuagcuaugcuguaucugu

SEQ ID NO: 3807673 - RNA, 11 nt, Human
cgucucagugu

SEQ ID NO: 3807674 - RNA, 20 nt, Human
cgucuccaggggcugcuucc

SEQ ID NO: 3807675 - RNA, 19 nt, Human
cgucucccccaacagcugg

SEQ ID NO: 3807676 - RNA, 20 nt, Human
cgucucccccaacagcugga

SEQ ID NO: 3807677 - RNA, 21 nt, Human
cgucucccccguguuccccuc

SEQ ID NO: 3807678 - RNA, 16 nt, Human
cgucucggccuucaca

SEQ ID NO: 3807679 - RNA, 16 nt, Human
cgucucuacuaaaaau

SEQ ID NO: 3807680 - RNA, 22 nt, Human
cgucucucccucccuuugaaau

SEQ ID NO: 3807681 - RNA, 23 nt, Human
cgucucuggagcggaauuuaccu

SEQ ID NO: 3807682 - RNA, 22 nt, Human
cgucugacaggcaaugcuggcu

SEQ ID NO: 3807683 - RNA, 16 nt, Human
cgucugacccucucca

SEQ ID NO: 3807684 - RNA, 23 nt, Human
cgucuggaggggccccugcuucu

SEQ ID NO: 3807685 - RNA, 21 nt, Human
cgucugggagaaauugacaga

SEQ ID NO: 3807686 - RNA, 22 nt, Human
cgucugggagaaauugacagau

SEQ ID NO: 3807687 - RNA, 20 nt, Human
cgucuguccaucugcccgcc

SEQ ID NO: 3807688 - RNA, 18 nt, Human
cgucugucuucacagcuc

SEQ ID NO: 3807689 - RNA, 21 nt, Human
cgucuguggcuuucagccucu

SEQ ID NO: 3807690 - RNA, 23 nt, Human
cgucugugugugaccccuccugg

SEQ ID NO: 3807691 - RNA, 17 nt, Human
cgucuguuuauaaacau

SEQ ID NO: 3807692 - RNA, 23 nt, Human
cgucuuagaaguggaccaggaca

SEQ ID NO: 3807693 - RNA, 21 nt, Human
cgucuuagcagugauuuuuau

SEQ ID NO: 3807694 - RNA, 21 nt, Human
cgucuuccgccccugccugcc

SEQ ID NO: 3807695 - RNA, 19 nt, Human
cgucuugcuugggaagggg

SEQ ID NO: 3807696 - RNA, 16 nt, Human
cgucuugguguaauuu

SEQ ID NO: 3807697 - RNA, 18 nt, Human
cgucuuuuccuguuuccu

SEQ ID NO: 3807698 - RNA, 16 nt, Human
cgugaaaacggagcug

SEQ ID NO: 3807699 - RNA, 15 nt, Human
cgugaaacacaccag

SEQ ID NO: 3807700 - RNA, 16 nt, Human
cgugaaacacaccagg

SEQ ID NO: 3807701 - RNA, 13 nt, Human
cgugaaacccugu

SEQ ID NO: 3807702 - RNA, 16 nt, Human
cgugaaagcagaugag

SEQ ID NO: 3807703 - RNA, 17 nt, Human
cgugaaagugcauuuuu

SEQ ID NO: 3807704 - RNA, 19 nt, Human
cgugaaagugcauuuuugu

SEQ ID NO: 3807705 - RNA, 22 nt, Human
cgugaacaggugggugucugcg

SEQ ID NO: 3807706 - RNA, 19 nt, Human
cgugaacccaggaggcgga

SEQ ID NO: 3807707 - RNA, 12 nt, Human
cgugaacugugc

SEQ ID NO: 3807708 - RNA, 22 nt, Human
cgugaagauacuuuguauuguc

SEQ ID NO: 3807709 - RNA, 13 nt, Human
cgugaagggauuu

SEQ ID NO: 3807710 - RNA, 15 nt, Human
cgugacaacacuugu

SEQ ID NO: 3807711 - RNA, 17 nt, Human
cgugacaauaaaacauu

SEQ ID NO: 3807712 - RNA, 16 nt, Human
cgugacacucuccuug

SEQ ID NO: 3807713 - RNA, 18 nt, Human
cgugacacucuccuugca

SEQ ID NO: 3807714 - RNA, 22 nt, Human
cgugacacucuccuugcaguuc

SEQ ID NO: 3807715 - RNA, 17 nt, Human
cgugacagacuccugag

SEQ ID NO: 3807716 - RNA, 18 nt, Human
cgugacagacuccugagg

SEQ ID NO: 3807717 - RNA, 17 nt, Human
cgugacagugccuggga

SEQ ID NO: 3807718 - RNA, 18 nt, Human
cgugacauccccacccuu

SEQ ID NO: 3807719 - RNA, 23 nt, Human
cgugacccaaaaaagucaagaac

SEQ ID NO: 3807720 - RNA, 15 nt, Human
cgugacccgaccugg

SEQ ID NO: 3807721 - RNA, 18 nt, Human
cgugacccgaccuggccg

SEQ ID NO: 3807722 - RNA, 22 nt, Human
cgugaccugcuaggccagagcc

SEQ ID NO: 3807723 - RNA, 16 nt, Human
cgugaccuggucaggg

SEQ ID NO: 3807724 - RNA, 14 nt, Human
cgugacgcugaaua

SEQ ID NO: 3807725 - RNA, 19 nt, Human
cgugacgcugaauaaaugu

SEQ ID NO: 3807726 - RNA, 20 nt, Human
cgugacugccccaacuccug

SEQ ID NO: 3807727 - RNA, 21 nt, Human
cgugagacgccaccauuccug

SEQ ID NO: 3807728 - RNA, 23 nt, Human
cgugagagugucuucacggcagg

SEQ ID NO: 3807729 - RNA, 20 nt, Human
cgugagcauguuuggaaggg

SEQ ID NO: 3807730 - RNA, 23 nt, Human
cgugagccaccgugccuggccac

SEQ ID NO: 3807731 - RNA, 20 nt, Human
cgugagccacugcaccgggc

SEQ ID NO: 3807732 - RNA, 21 nt, Human
cgugagccagguaaugaggga

SEQ ID NO: 3807733 - RNA, 13 nt, Human
cgugagccccauc

SEQ ID NO: 3807734 - RNA, 14 nt, Human
cgugagccccaucu

SEQ ID NO: 3807735 - RNA, 19 nt, Human
cgugagcgacaaagaugau

SEQ ID NO: 3807736 - RNA, 16 nt, Human
cgugagcgccugugca

SEQ ID NO: 3807737 - RNA, 21 nt, Human
cgugagcgccugugcacacac

SEQ ID NO: 3807738 - RNA, 22 nt, Human
cgugagcuuaaaauacaagacu

SEQ ID NO: 3807739 - RNA, 16 nt, Human
cgugagucauuuaaau

SEQ ID NO: 3807740 - RNA, 17 nt, Human
cgugaguccuggcaugg

SEQ ID NO: 3807741 - RNA, 19 nt, Human
cgugaguccuggcauggga

SEQ ID NO: 3807742 - RNA, 14 nt, Human
cgugaguucucagg

SEQ ID NO: 3807743 - RNA, 18 nt, Human
cgugaucaaagccacacu

SEQ ID NO: 3807744 - RNA, 22 nt, Human
cgugaucaaagccacacucugg

SEQ ID NO: 3807745 - RNA, 18 nt, Human
cgugauccacccaccucg

SEQ ID NO: 3807746 - RNA, 24 nt, Human
cgugauccacccgccucagccucc

SEQ ID NO: 3807747 - RNA, 22 nt, Human
cgugaucucggcucacugcaac

SEQ ID NO: 3807748 - RNA, 17 nt, Human
cgugaugccucccuguu

SEQ ID NO: 3807749 - RNA, 13 nt, Human
cgugcaacugaca

SEQ ID NO: 3807750 - RNA, 14 nt, Human
cgugcacacaccag

SEQ ID NO: 3807751 - RNA, 16 nt, Human
cgugcacacaccagag

SEQ ID NO: 3807752 - RNA, 17 nt, Human
cgugcacguggagagcu

SEQ ID NO: 3807753 - RNA, 20 nt, Human
cgugcacguggagagcuggu

SEQ ID NO: 3807754 - RNA, 21 nt, Human
cgugcacguggagagcuggug

SEQ ID NO: 3807755 - RNA, 22 nt, Human
cgugcaguggugcgaucugggu

SEQ ID NO: 3807756 - RNA, 17 nt, Human
cgugcaucccugagaca

SEQ ID NO: 3807757 - RNA, 21 nt, Human
cgugcauuagcacagauuuua

SEQ ID NO: 3807758 - RNA, 20 nt, Human
cgugccaaagucucccuucu

SEQ ID NO: 3807759 - RNA, 15 nt, Human
cgugccaaguccagg

SEQ ID NO: 3807760 - RNA, 21 nt, Human
cgugccaaguccagguccugg

SEQ ID NO: 3807761 - RNA, 15 nt, Human
cgugccaccccgagg

SEQ ID NO: 3807762 - RNA, 20 nt, Human
cgugcccaguggcugcuccu

SEQ ID NO: 3807763 - RNA, 17 nt, Human
cgugccccgccuccccg

SEQ ID NO: 3807764 - RNA, 14 nt, Human
cgugcccggggcag

SEQ ID NO: 3807765 - RNA, 15 nt, Human
cgugccguggcacca

SEQ ID NO: 3807766 - RNA, 19 nt, Human
ccacggacguuuccaucag

SEQ ID NO: 3807767 - RNA, 21 nt, Human
ccacggagccacuccucugac

SEQ ID NO: 3807768 - RNA, 19 nt, Human
ccacggcaccugggcccug

SEQ ID NO: 3807769 - RNA, 12 nt, Human
ccacggccaggc

SEQ ID NO: 3807770 - RNA, 16 nt, Human
ccacggccaggccaga

SEQ ID NO: 3807771 - RNA, 15 nt, Human
ccacggccgcuccag

SEQ ID NO: 3807772 - RNA, 16 nt, Human
ccacggccgcuccagg

SEQ ID NO: 3807773 - RNA, 18 nt, Human
ccacggccgcuccagggg

SEQ ID NO: 3807774 - RNA, 17 nt, Human
ccacggcuaagaggcug

SEQ ID NO: 3807775 - RNA, 21 nt, Human
ccacggcuaagaggcugcuga

SEQ ID NO: 3807776 - RNA, 20 nt, Human
ccacgggacaucacagggug

SEQ ID NO: 3807777 - RNA, 17 nt, Human
ccacggggacucagccc

SEQ ID NO: 3807778 - RNA, 16 nt, Human
ccacguacugcagccu

SEQ ID NO: 3807779 - RNA, 17 nt, Human
ccacguacugcagccuc

SEQ ID NO: 3807780 - RNA, 15 nt, Human
ccacguauuccccuu

SEQ ID NO: 3807781 - RNA, 20 nt, Human
ccacguauuccccuucccac

SEQ ID NO: 3807782 - RNA, 21 nt, Human
ccacgucagcugggacacccc

SEQ ID NO: 3807783 - RNA, 22 nt, Human
ccacgucccccuggggcuucuc

SEQ ID NO: 3807784 - RNA, 18 nt, Human
ccacguggcugcgugccc

SEQ ID NO: 3807785 - RNA, 20 nt, Human
ccacguuccuuacugcagaa

SEQ ID NO: 3807786 - RNA, 16 nt, Human
ccacguucucacaccc

SEQ ID NO: 3807787 - RNA, 17 nt, Human
ccacguucucacaccca

SEQ ID NO: 3807788 - RNA, 19 nt, Human
ccacguucucacacccacc

SEQ ID NO: 3807789 - RNA, 21 nt, Human
ccacguuggagaagcccgugu

SEQ ID NO: 3807790 - RNA, 13 nt, Human
ccacguuucuaaa

SEQ ID NO: 3807791 - RNA, 20 nt, Human
ccacuaagaaccccucugcu

SEQ ID NO: 3807792 - RNA, 21 nt, Human
ccacuaagcagaggaggggcc

SEQ ID NO: 3807793 - RNA, 18 nt, Human
ccacuacacuccagccug

SEQ ID NO: 3807794 - RNA, 19 nt, Human
ccacuacacuccagccuga

SEQ ID NO: 3807795 - RNA, 14 nt, Human
ccacuacauucugu

SEQ ID NO: 3807796 - RNA, 16 nt, Human
ccacuacauucuguua

SEQ ID NO: 3807797 - RNA, 23 nt, Human
ccacuacggaauaguuggcuagg

SEQ ID NO: 3807798 - RNA, 21 nt, Human
ccacuagaacucuccaucuua

SEQ ID NO: 3807799 - RNA, 15 nt, Human
ccacuagacccacug

SEQ ID NO: 3807800 - RNA, 17 nt, Human
ccacuagacccacugga

SEQ ID NO: 3807801 - RNA, 14 nt, Human
ccacuagugcaaau

SEQ ID NO: 3807802 - RNA, 18 nt, Human
ccacuaugacagaggauu

SEQ ID NO: 3807803 - RNA, 16 nt, Human
ccacucaaaggccaga

SEQ ID NO: 3807804 - RNA, 14 nt, Human
ccacucacaacagc

SEQ ID NO: 3807805 - RNA, 13 nt, Human
ccacucacacagc

SEQ ID NO: 3807806 - RNA, 15 nt, Human
ccacucacacagcca

SEQ ID NO: 3807807 - RNA, 22 nt, Human
ccacucacacagccaggugccu

SEQ ID NO: 3807808 - RNA, 23 nt, Human
ccacucacacagccaggugccuu

SEQ ID NO: 3807809 - RNA, 15 nt, Human
ccacucagccccuag

SEQ ID NO: 3807810 - RNA, 15 nt, Human
ccacucagcuccgug

SEQ ID NO: 3807811 - RNA, 15 nt, Human
ccacucagcuguccu

SEQ ID NO: 3807812 - RNA, 13 nt, Human
ccacucagcuucc

SEQ ID NO: 3807813 - RNA, 13 nt, Human
ccacucaggccaa

SEQ ID NO: 3807814 - RNA, 11 nt, Human
ccacucagguc

SEQ ID NO: 3807815 - RNA, 16 nt, Human
ccacucaggucuguuu

SEQ ID NO: 3807816 - RNA, 13 nt, Human
ccacucauuucau

SEQ ID NO: 3807817 - RNA, 19 nt, Human
ccacuccagaccccuggcu

SEQ ID NO: 3807818 - RNA, 21 nt, Human
ccacuccagaccccuggcuuu

SEQ ID NO: 3807819 - RNA, 13 nt, Human
ccacuccaucugg

SEQ ID NO: 3807820 - RNA, 16 nt, Human
ccacuccaucugguag

SEQ ID NO: 3807821 - RNA, 13 nt, Human
ccacuccauuccc

SEQ ID NO: 3807822 - RNA, 14 nt, Human
ccacuccauuccca

SEQ ID NO: 3807823 - RNA, 11 nt, Human
ccacucccacu

SEQ ID NO: 3807824 - RNA, 17 nt, Human
ccacucccacuucccug

SEQ ID NO: 3807825 - RNA, 23 nt, Human
ccacucccacuucccugacacug

SEQ ID NO: 3807826 - RNA, 14 nt, Human
ccacucccagugcu

SEQ ID NO: 3807827 - RNA, 19 nt, Human
ccacuccccagccagccug

SEQ ID NO: 3807828 - RNA, 22 nt, Human
ccacuccccagccagccuggcu

SEQ ID NO: 3807829 - RNA, 15 nt, Human
ccacuccccggcaug

SEQ ID NO: 3807830 - RNA, 12 nt, Human
ccacucccucac

SEQ ID NO: 3807831 - RNA, 13 nt, Human
ccacucccucaca

SEQ ID NO: 3807832 - RNA, 15 nt, Human
ccacucccugcaacc

SEQ ID NO: 3807833 - RNA, 17 nt, Human
ccacucccugcaaccug

SEQ ID NO: 3807834 - RNA, 17 nt, Human
ccacuccgagagguggg

SEQ ID NO: 3807835 - RNA, 23 nt, Human
ccacuccgagaggugggccaguc

SEQ ID NO: 3807836 - RNA, 20 nt, Human
ccacuccggcccuccagagc

SEQ ID NO: 3807837 - RNA, 21 nt, Human
ccacuccggcccuccagagcc

SEQ ID NO: 3807838 - RNA, 16 nt, Human
ccacuccuccaaagga

SEQ ID NO: 3807839 - RNA, 14 nt, Human
ccacuccuccuagc

SEQ ID NO: 3807840 - RNA, 22 nt, Human
ccacuccucugcugaccugcug

SEQ ID NO: 3807841 - RNA, 12 nt, Human
ccacuccuuccu

SEQ ID NO: 3807842 - RNA, 13 nt, Human
ccacuccuuccug

SEQ ID NO: 3807843 - RNA, 16 nt, Human
ccacuccuuccugccc

SEQ ID NO: 3807844 - RNA, 16 nt, Human
ccacucgcuuccccca

SEQ ID NO: 3807845 - RNA, 22 nt, Human
cuaaucugugcuguuucaaagu

SEQ ID NO: 3807846 - RNA, 21 nt, Human
cuaaucuuauucauuuucucu

SEQ ID NO: 3807847 - RNA, 19 nt, Human
cuaaugaaugcauaaaaug

SEQ ID NO: 3807848 - RNA, 22 nt, Human
cuaaugaguuucuuuuauaaaa

SEQ ID NO: 3807849 - RNA, 22 nt, Human
cuaaugauggcccauucuacuu

SEQ ID NO: 3807850 - RNA, 13 nt, Human
cuaaugauguuuu

SEQ ID NO: 3807851 - RNA, 23 nt, Human
cuaaugcgcaggcuggcccugcc

SEQ ID NO: 3807852 - RNA, 18 nt, Human
cuaaugcuccuuguuccu

SEQ ID NO: 3807853 - RNA, 17 nt, Human
cuaauggaaaaugauuu

SEQ ID NO: 3807854 - RNA, 21 nt, Human
cuaauggaaaaugauuuuacu

SEQ ID NO: 3807855 - RNA, 16 nt, Human
cuaauggcaugagaaa

SEQ ID NO: 3807856 - RNA, 13 nt, Human
cuaaugggacacu

SEQ ID NO: 3807857 - RNA, 14 nt, Human
cuaauguacugcau

SEQ ID NO: 3807858 - RNA, 19 nt, Human
cuaauguauuuuauuguaa

SEQ ID NO: 3807859 - RNA, 22 nt, Human
cuaauguauuuuauuguaacag

SEQ ID NO: 3807860 - RNA, 15 nt, Human
cuaaugucuucauaa

SEQ ID NO: 3807861 - RNA, 17 nt, Human
cuaaugucuucauaaag

SEQ ID NO: 3807862 - RNA, 19 nt, Human
cuaaugucuucauuucauu

SEQ ID NO: 3807863 - RNA, 22 nt, Human
cuaaugucuucauuucauugua

SEQ ID NO: 3807864 - RNA, 18 nt, Human
cuaauguugcuggaucag

SEQ ID NO: 3807865 - RNA, 18 nt, Human
cuaauguuuaagcagaau

SEQ ID NO: 3807866 - RNA, 22 nt, Human
cuaauguuuaagcagaauugga

SEQ ID NO: 3807867 - RNA, 18 nt, Human
cuaauguuuaugagccag

SEQ ID NO: 3807868 - RNA, 17 nt, Human
cuaauguuugcauauaa

SEQ ID NO: 3807869 - RNA, 18 nt, Human
cuaauguuugcauauaag

SEQ ID NO: 3807870 - RNA, 15 nt, Human
cuaauuaaaaaguua

SEQ ID NO: 3807871 - RNA, 17 nt, Human
cuaauuaacugaaacau

SEQ ID NO: 3807872 - RNA, 15 nt, Human
cuaauuaauauauua

SEQ ID NO: 3807873 - RNA, 15 nt, Human
cuaauuaauuucagu

SEQ ID NO: 3807874 - RNA, 14 nt, Human
cuaauuagagcaga

SEQ ID NO: 3807875 - RNA, 19 nt, Human
cuaauuaggguacauuuau

SEQ ID NO: 3807876 - RNA, 22 nt, Human
cuaauuauacccccugcaaagc

SEQ ID NO: 3807877 - RNA, 15 nt, Human
cuaauuauguagcuc

SEQ ID NO: 3807878 - RNA, 18 nt, Human
cuaauuauguagcucuuu

SEQ ID NO: 3807879 - RNA, 18 nt, Human
cuaauuauuuaauugucc

SEQ ID NO: 3807880 - RNA, 13 nt, Human
cuaauucauuuau

SEQ ID NO: 3807881 - RNA, 15 nt, Human
cuaauuccacagcug

SEQ ID NO: 3807882 - RNA, 16 nt, Human
cuaauucccagagugu

SEQ ID NO: 3807883 - RNA, 16 nt, Human
cuaauucgaugaaggc

SEQ ID NO: 3807884 - RNA, 11 nt, Human
cuaauucuaac

SEQ ID NO: 3807885 - RNA, 18 nt, Human
cuaauucuaaccagagca

SEQ ID NO: 3807886 - RNA, 15 nt, Human
cuaauucuaugccug

SEQ ID NO: 3807887 - RNA, 18 nt, Human
cuaauucuuccuuuguaa

SEQ ID NO: 3807888 - RNA, 18 nt, Human
cuaauucuucuguccuga

SEQ ID NO: 3807889 - RNA, 15 nt, Human
cuaauucuuugcaaa

SEQ ID NO: 3807890 - RNA, 18 nt, Human
cuaauucuuugcaaaaau

SEQ ID NO: 3807891 - RNA, 20 nt, Human
cuaauugacuuuagaaagcu

SEQ ID NO: 3807892 - RNA, 19 nt, Human
cuaauugcaucucaaaauu

SEQ ID NO: 3807893 - RNA, 13 nt, Human
cuaauugccaugu

SEQ ID NO: 3807894 - RNA, 22 nt, Human
cuaauugcugugugucccaggc

SEQ ID NO: 3807895 - RNA, 12 nt, Human
cuaauugcuuau

SEQ ID NO: 3807896 - RNA, 18 nt, Human
cuaauugcuuauuuauug

SEQ ID NO: 3807897 - RNA, 19 nt, Human
cuaauuggaagaaauuccu

SEQ ID NO: 3807898 - RNA, 22 nt, Human
cuaauuggaagaaauuccugua

SEQ ID NO: 3807899 - RNA, 22 nt, Human
cuaauuggcaugaaggugucau

SEQ ID NO: 3807900 - RNA, 21 nt, Human
cuaauugguacuuuuaaaaac

SEQ ID NO: 3807901 - RNA, 18 nt, Human
cuaauuguauaacagguu

SEQ ID NO: 3807902 - RNA, 15 nt, Human
cuaauuuaaagagac

SEQ ID NO: 3807903 - RNA, 12 nt, Human
cuaauuuauaaa

SEQ ID NO: 3807904 - RNA, 13 nt, Human
cuaauuuauaaaa

SEQ ID NO: 3807905 - RNA, 15 nt, Human
cuaauuucccuucuu

SEQ ID NO: 3807906 - RNA, 14 nt, Human
cuaauuucuccucc

SEQ ID NO: 3807907 - RNA, 19 nt, Human
cuaauuucuccucccuucc

SEQ ID NO: 3807908 - RNA, 20 nt, Human
cuaauuucuccucccuuccu

SEQ ID NO: 3807909 - RNA, 16 nt, Human
cuaauuugaggcucag

SEQ ID NO: 3807910 - RNA, 12 nt, Human
cuaauuugcauu

SEQ ID NO: 3807911 - RNA, 13 nt, Human
ccacugccucugc

SEQ ID NO: 3807912 - RNA, 21 nt, Human
ccacugccucugccuuagagg

SEQ ID NO: 3807913 - RNA, 16 nt, Human
ccacugccucuuccuc

SEQ ID NO: 3807914 - RNA, 13 nt, Human
ccacugccugccc

SEQ ID NO: 3807915 - RNA, 14 nt, Human
ccacugccugccca

SEQ ID NO: 3807916 - RNA, 21 nt, Human
ccacugccuucgauacaccgg

SEQ ID NO: 3807917 - RNA, 15 nt, Human
ccacugccuucgcuu

SEQ ID NO: 3807918 - RNA, 16 nt, Human
ccacugccuucgcuuc

SEQ ID NO: 3807919 - RNA, 22 nt, Human
ccacugccuucgcuucuugccu

SEQ ID NO: 3807920 - RNA, 14 nt, Human
ccacugccuuugac

SEQ ID NO: 3807921 - RNA, 16 nt, Human
ccacugcuccguggag

SEQ ID NO: 3807922 - RNA, 22 nt, Human
ccacugcugauauuuucucuag

SEQ ID NO: 3807923 - RNA, 16 nt, Human
ccacugcugcuucucc

SEQ ID NO: 3807924 - RNA, 19 nt, Human
ccacugcugcuucuccaug

SEQ ID NO: 3807925 - RNA, 16 nt, Human
ccacuggacuugagcu

SEQ ID NO: 3807926 - RNA, 22 nt, Human
ccacuggacuugagcuuggcag

SEQ ID NO: 3807927 - RNA, 11 nt, Human
ccacuggccac

SEQ ID NO: 3807928 - RNA, 11 nt, Human
ccacuggccau

SEQ ID NO: 3807929 - RNA, 11 nt, Human
ccacuggcucc

SEQ ID NO: 3807930 - RNA, 14 nt, Human
ccacuggcuguggg

SEQ ID NO: 3807931 - RNA, 16 nt, Human
ccacuggcugugggcu

SEQ ID NO: 3807932 - RNA, 17 nt, Human
ccacuggcugugggcuc

SEQ ID NO: 3807933 - RNA, 22 nt, Human
ccacuggcugugggcucccuuc

SEQ ID NO: 3807934 - RNA, 18 nt, Human
ccacugggaccaacccug

SEQ ID NO: 3807935 - RNA, 11 nt, Human
ccacuggggaa

SEQ ID NO: 3807936 - RNA, 19 nt, Human
ccacugggguccagggagc

SEQ ID NO: 3807937 - RNA, 23 nt, Human
ccacuggugacaugucuuuucuu

SEQ ID NO: 3807938 - RNA, 16 nt, Human
ccacugguuccuucuu

SEQ ID NO: 3807939 - RNA, 18 nt, Human
ccacuguaaaaugaaauu

SEQ ID NO: 3807940 - RNA, 17 nt, Human
ccacuguacuugcucuu

SEQ ID NO: 3807941 - RNA, 21 nt, Human
ccacuguaugauuuauaaaca

SEQ ID NO: 3807942 - RNA, 17 nt, Human
ccacugucacccuccac

SEQ ID NO: 3807943 - RNA, 22 nt, Human
ccacugucacuguuucucugcu

SEQ ID NO: 3807944 - RNA, 23 nt, Human
ccacugucacuguuucucugcug

SEQ ID NO: 3807945 - RNA, 15 nt, Human
ccacuguccugggcg

SEQ ID NO: 3807946 - RNA, 22 nt, Human
ccacuguccugggcgcccugga

SEQ ID NO: 3807947 - RNA, 20 nt, Human
ccacugugcaggugcuauug

SEQ ID NO: 3807948 - RNA, 19 nt, Human
ccacugugccaugugccag

SEQ ID NO: 3807949 - RNA, 14 nt, Human
ccacugugccucag

SEQ ID NO: 3807950 - RNA, 19 nt, Human
ccacugugcguggggcucc

SEQ ID NO: 3807951 - RNA, 20 nt, Human
ccacugugcuccagccuggg

SEQ ID NO: 3807952 - RNA, 15 nt, Human
ccacugugcuuucag

SEQ ID NO: 3807953 - RNA, 16 nt, Human
ccacuguguuccuucc

SEQ ID NO: 3807954 - RNA, 14 nt, Human
ccacuguuuauuca

SEQ ID NO: 3807955 - RNA, 21 nt, Human
ccacuguuucucuugagcugg

SEQ ID NO: 3807956 - RNA, 17 nt, Human
ccacuguuucuugcuug

SEQ ID NO: 3807957 - RNA, 16 nt, Human
ccacuuaaaaaauguc

SEQ ID NO: 3807958 - RNA, 18 nt, Human
ccacuuacauauauuuuu

SEQ ID NO: 3807959 - RNA, 20 nt, Human
ccacuuacauauauuuuuaa

SEQ ID NO: 3807960 - RNA, 12 nt, Human
ccacuuaccuag

SEQ ID NO: 3807961 - RNA, 21 nt, Human
ccacuuaccuucaauaaagua

SEQ ID NO: 3807962 - RNA, 19 nt, Human
ccacuuagaaauugcauuu

SEQ ID NO: 3807963 - RNA, 21 nt, Human
ccacuuagaaauugcauuucc

SEQ ID NO: 3807964 - RNA, 16 nt, Human
ccacuuaggcuuugua

SEQ ID NO: 3807965 - RNA, 16 nt, Human
ccacuuauagccucug

SEQ ID NO: 3807966 - RNA, 17 nt, Human
ccacuuaucccucucca

SEQ ID NO: 3807967 - RNA, 13 nt, Human
ccacuucacugcg

SEQ ID NO: 3807968 - RNA, 14 nt, Human
ccacuucagcugac

SEQ ID NO: 3807969 - RNA, 18 nt, Human
ccacuuccaggggaaccu

SEQ ID NO: 3807970 - RNA, 14 nt, Human
ccacuucccaggua

SEQ ID NO: 3807971 - RNA, 13 nt, Human
ccacuuccccucc

SEQ ID NO: 3807972 - RNA, 14 nt, Human
ccacuuccccuccu

SEQ ID NO: 3807973 - RNA, 12 nt, Human
ccacuucccuca

SEQ ID NO: 3807974 - RNA, 20 nt, Human
ccacuucggccaggucacac

SEQ ID NO: 3807975 - RNA, 10 nt, Human
ccacuucugg

SEQ ID NO: 3807976 - RNA, 13 nt, Human
ccacuucugucca

SEQ ID NO: 3807977 - RNA, 13 nt, Human
ccacuucuuccuu

SEQ ID NO: 3807978 - RNA, 22 nt, Human
ccacuucuuccuuucucuuucu

SEQ ID NO: 3807979 - RNA, 23 nt, Human
ccacuucuuccuuucucuuucuc

SEQ ID NO: 3807980 - RNA, 13 nt, Human
ccacuugaggccu

SEQ ID NO: 3807981 - RNA, 14 nt, Human
ccacuugaggccug

SEQ ID NO: 3807982 - RNA, 18 nt, Human
ccacuugaggccugaucu

SEQ ID NO: 3807983 - RNA, 20 nt, Human
ccacuugaggccugaucugc

SEQ ID NO: 3807984 - RNA, 19 nt, Human
ccacuugccucuuccuuga

SEQ ID NO: 3807985 - RNA, 12 nt, Human
ccacuuggcauu

SEQ ID NO: 3807986 - RNA, 16 nt, Human
ccacuugggucuuccc

SEQ ID NO: 3807987 - RNA, 17 nt, Human
ccacuugggucuucccu

SEQ ID NO: 3807988 - RNA, 20 nt, Human
ccacuuggucugugagaugc

SEQ ID NO: 3807989 - RNA, 19 nt, Human
ccacuugucccacuaucug

SEQ ID NO: 3807990 - RNA, 20 nt, Human
ccacuuuaaaauaucuacau

SEQ ID NO: 3807991 - RNA, 12 nt, Human
ccacuuucagcu

SEQ ID NO: 3807992 - RNA, 20 nt, Human
ccacuuuccaagucacugca

SEQ ID NO: 3807993 - RNA, 23 nt, Human
ccacuuuccuuuucuauuccuuc

SEQ ID NO: 3807994 - RNA, 16 nt, Human
ccacuuucuuucuuuc

SEQ ID NO: 3807995 - RNA, 23 nt, Human
ccacuuugcacgacgcccucucc

SEQ ID NO: 3807996 - RNA, 17 nt, Human
ccacuuuggccuccguu

SEQ ID NO: 3807997 - RNA, 21 nt, Human
ccacuuugguacauggccagu

SEQ ID NO: 3807998 - RNA, 18 nt, Human
ccacuuuggucccgugca

SEQ ID NO: 3807999 - RNA, 22 nt, Human
ccacuuuguuucguggggaggu

SEQ ID NO: 3808000 - RNA, 17 nt, Human
ccacuuuuccaguauuu

SEQ ID NO: 3808001 - RNA, 15 nt, Human
ccacuuuuguucuug

SEQ ID NO: 3808002 - RNA, 12 nt, Human
ccacuuuuuaac

SEQ ID NO: 3808003 - RNA, 19 nt, Human
ccagaaaaaaaaaaacuua

SEQ ID NO: 3808004 - RNA, 13 nt, Human
ccagaaaacaaaa

SEQ ID NO: 3808005 - RNA, 15 nt, Human
ccagaaaaggacaga

SEQ ID NO: 3808006 - RNA, 12 nt, Human
ccagaaagaaaa

SEQ ID NO: 3808007 - RNA, 17 nt, Human
ccagaaaggauauuuaa

SEQ ID NO: 3808008 - RNA, 20 nt, Human
ccagaaaggauauuuaagaa

SEQ ID NO: 3808009 - RNA, 15 nt, Human
ccagaaaguaaaggu

SEQ ID NO: 3808010 - RNA, 17 nt, Human
ccagaacaacaacuauc

SEQ ID NO: 3808011 - RNA, 20 nt, Human
cgugacgucuggguggcccu

SEQ ID NO: 3808012 - RNA, 15 nt, Human
cgugacucacccaag

SEQ ID NO: 3808013 - RNA, 21 nt, Human
cgugacugccccaacuccugg

SEQ ID NO: 3808014 - RNA, 23 nt, Human
cgugacuguauuauacaugggua

SEQ ID NO: 3808015 - RNA, 12 nt, Human
cgugagaagcau

SEQ ID NO: 3808016 - RNA, 23 nt, Human
cgugagacgccaccauuccugga

SEQ ID NO: 3808017 - RNA, 20 nt, Human
cgugagcaggaaggccuggg

SEQ ID NO: 3808018 - RNA, 14 nt, Human
cgugagccaccgcg

SEQ ID NO: 3808019 - RNA, 15 nt, Human
cgugagccacugcac

SEQ ID NO: 3808020 - RNA, 22 nt, Human
cgugagccacugcaccgggcca

SEQ ID NO: 3808021 - RNA, 15 nt, Human
cgugagcucuuguga

SEQ ID NO: 3808022 - RNA, 14 nt, Human
cgugagcugagcag

SEQ ID NO: 3808023 - RNA, 17 nt, Human
cgugagcugagcaggcc

SEQ ID NO: 3808024 - RNA, 20 nt, Human
cgugagcugagcaggccaca

SEQ ID NO: 3808025 - RNA, 19 nt, Human
cgugaggaugucacucaga

SEQ ID NO: 3808026 - RNA, 16 nt, Human
cgugaggccagagaca

SEQ ID NO: 3808027 - RNA, 17 nt, Human
cgugaggccagagacac

SEQ ID NO: 3808028 - RNA, 15 nt, Human
cgugaggcccguggg

SEQ ID NO: 3808029 - RNA, 18 nt, Human
cgugaggcccguggggcc

SEQ ID NO: 3808030 - RNA, 15 nt, Human
cgugaggucccagga

SEQ ID NO: 3808031 - RNA, 15 nt, Human
cgugagugcagaccc

SEQ ID NO: 3808032 - RNA, 15 nt, Human
cgugaguucucaggg

SEQ ID NO: 3808033 - RNA, 18 nt, Human
cgugaguucucagggcuc

SEQ ID NO: 3808034 - RNA, 21 nt, Human
cgugaucaaagccacacucug

SEQ ID NO: 3808035 - RNA, 23 nt, Human
cgugaucaaguugaggggcuucc

SEQ ID NO: 3808036 - RNA, 13 nt, Human
cgugaucuuggcu

SEQ ID NO: 3808037 - RNA, 16 nt, Human
cgugcaacugacacuc

SEQ ID NO: 3808038 - RNA, 20 nt, Human
cgugcaauuuguuugugcuu

SEQ ID NO: 3808039 - RNA, 20 nt, Human
cgugcacacaccagagccca

SEQ ID NO: 3808040 - RNA, 15 nt, Human
cgugcaccuguacuc

SEQ ID NO: 3808041 - RNA, 18 nt, Human
cgugcacgcacacugucu

SEQ ID NO: 3808042 - RNA, 22 nt, Human
cgugcacguggagagcuggugc

SEQ ID NO: 3808043 - RNA, 17 nt, Human
cgugcagacuggagggg

SEQ ID NO: 3808044 - RNA, 14 nt, Human
cgugcagcauauga

SEQ ID NO: 3808045 - RNA, 17 nt, Human
cgugcagggacaaagag

SEQ ID NO: 3808046 - RNA, 22 nt, Human
cgugcauuggaagaccccaccc

SEQ ID NO: 3808047 - RNA, 20 nt, Human
cgugccaaguccagguccug

SEQ ID NO: 3808048 - RNA, 19 nt, Human
cgugccaccccgagggcug

SEQ ID NO: 3808049 - RNA, 21 nt, Human
cgugccagucaagaagaaaaa

SEQ ID NO: 3808050 - RNA, 17 nt, Human
cgugccagucgcgcugc

SEQ ID NO: 3808051 - RNA, 19 nt, Human
cgugcccaggggcccacag

SEQ ID NO: 3808052 - RNA, 16 nt, Human
cgugcccaguggcugc

SEQ ID NO: 3808053 - RNA, 18 nt, Human
cgugccccugcugcuguc

SEQ ID NO: 3808054 - RNA, 22 nt, Human
cgugccgugugagugugacagg

SEQ ID NO: 3808055 - RNA, 19 nt, Human
cgugccguuacucuccaac

SEQ ID NO: 3808056 - RNA, 15 nt, Human
cuauacaacuggaca

SEQ ID NO: 3808057 - RNA, 14 nt, Human
cuauacaucucucc

SEQ ID NO: 3808058 - RNA, 23 nt, Human
ccagcaggccggaucgguacugu

SEQ ID NO: 3808059 - RNA, 13 nt, Human
ccagcaggcucuc

SEQ ID NO: 3808060 - RNA, 15 nt, Human
ccagcaggcucucag

SEQ ID NO: 3808061 - RNA, 16 nt, Human
ccagcaggcucucagg

SEQ ID NO: 3808062 - RNA, 17 nt, Human
ccagcaggcucucaggc

SEQ ID NO: 3808063 - RNA, 20 nt, Human
ccagcaggcucucaggccag

SEQ ID NO: 3808064 - RNA, 14 nt, Human
ccagcagucacuuc

SEQ ID NO: 3808065 - RNA, 17 nt, Human
ccagcagucucugccuu

SEQ ID NO: 3808066 - RNA, 23 nt, Human
ccagcagucucugccuugccuuu

SEQ ID NO: 3808067 - RNA, 13 nt, Human
ccagcaguucaga

SEQ ID NO: 3808068 - RNA, 20 nt, Human
ccagcaguucagagcugccc

SEQ ID NO: 3808069 - RNA, 23 nt, Human
ccagcaguucagagcugcccucu

SEQ ID NO: 3808070 - RNA, 15 nt, Human
ccagcaguucuguua

SEQ ID NO: 3808071 - RNA, 22 nt, Human
ccagcaguuuucaagucaaauu

SEQ ID NO: 3808072 - RNA, 18 nt, Human
ccagcaucaccugccugu

SEQ ID NO: 3808073 - RNA, 15 nt, Human
ccagcaucccuugac

SEQ ID NO: 3808074 - RNA, 19 nt, Human
ccagcauccuuuucugcag

SEQ ID NO: 3808075 - RNA, 21 nt, Human
ccagcauccuuuucugcagag

SEQ ID NO: 3808076 - RNA, 12 nt, Human
ccagcaucuggg

SEQ ID NO: 3808077 - RNA, 15 nt, Human
ccagcaucugggccu

SEQ ID NO: 3808078 - RNA, 20 nt, Human
ccagcaugacauaacagugc

SEQ ID NO: 3808079 - RNA, 21 nt, Human
ccagcaugacauaacagugca

SEQ ID NO: 3808080 - RNA, 18 nt, Human
ccagcaugcaccacgggc

SEQ ID NO: 3808081 - RNA, 20 nt, Human
ccagcauuccagccccucug

SEQ ID NO: 3808082 - RNA, 15 nt, Human
ccagcauucccaggu

SEQ ID NO: 3808083 - RNA, 14 nt, Human
ccagcauuccuuuu

SEQ ID NO: 3808084 - RNA, 16 nt, Human
ccagcauucucaggca

SEQ ID NO: 3808085 - RNA, 13 nt, Human
ccagcauugcugg

SEQ ID NO: 3808086 - RNA, 17 nt, Human
ccagcauugcugguucu

SEQ ID NO: 3808087 - RNA, 16 nt, Human
ccagcauuuagcuggc

SEQ ID NO: 3808088 - RNA, 18 nt, Human
ccagcauuuuacugauuc

SEQ ID NO: 3808089 - RNA, 20 nt, Human
ccagccaaacacacagaagg

SEQ ID NO: 3808090 - RNA, 15 nt, Human
ccagccaaagccucc

SEQ ID NO: 3808091 - RNA, 18 nt, Human
ccagccaaagccuccucc

SEQ ID NO: 3808092 - RNA, 13 nt, Human
ccagccaaccccu

SEQ ID NO: 3808093 - RNA, 14 nt, Human
ccagccaagcucug

SEQ ID NO: 3808094 - RNA, 20 nt, Human
ccagccaagcucugcagucc

SEQ ID NO: 3808095 - RNA, 21 nt, Human
ccagccacucuaccagugcag

SEQ ID NO: 3808096 - RNA, 13 nt, Human
ccagccagauccu

SEQ ID NO: 3808097 - RNA, 21 nt, Human
ccagccagauggacuccagcc

SEQ ID NO: 3808098 - RNA, 22 nt, Human
ccagccagcaaugauguccaga

SEQ ID NO: 3808099 - RNA, 22 nt, Human
ccagccagcagcagcccaagcu

SEQ ID NO: 3808100 - RNA, 13 nt, Human
ccagccagccacu

SEQ ID NO: 3808101 - RNA, 15 nt, Human
ccagccagccacucu

SEQ ID NO: 3808102 - RNA, 16 nt, Human
ccagccagccacucua

SEQ ID NO: 3808103 - RNA, 16 nt, Human
ccagccagccuggcug

SEQ ID NO: 3808104 - RNA, 12 nt, Human
ccagccagcgcc

SEQ ID NO: 3808105 - RNA, 14 nt, Human
ccagccagcgccuc

SEQ ID NO: 3808106 - RNA, 15 nt, Human
ccagccagcgccucc

SEQ ID NO: 3808107 - RNA, 16 nt, Human
ccagccagcgccuccc

SEQ ID NO: 3808108 - RNA, 22 nt, Human
ccagccagcgucggucugugcc

SEQ ID NO: 3808109 - RNA, 20 nt, Human
ccagccaggcccagccgacc

SEQ ID NO: 3808110 - RNA, 21 nt, Human
ccagccaggcccagccgaccc

SEQ ID NO: 3808111 - RNA, 22 nt, Human
ccagccaggcccagccgacccc

SEQ ID NO: 3808112 - RNA, 17 nt, Human
ccagccaggcgggcuca

SEQ ID NO: 3808113 - RNA, 15 nt, Human
ccagccagggcucaa

SEQ ID NO: 3808114 - RNA, 13 nt, Human
ccagccagggcug

SEQ ID NO: 3808115 - RNA, 19 nt, Human
ccagccagugaccugagga

SEQ ID NO: 3808116 - RNA, 22 nt, Human
ccagccagugaccugaggaagc

SEQ ID NO: 3808117 - RNA, 16 nt, Human
ccagccaucaaaaugc

SEQ ID NO: 3808118 - RNA, 18 nt, Human
ccagccaucugcccaggg

SEQ ID NO: 3808119 - RNA, 21 nt, Human
ccagccaucugcccaggggug

SEQ ID NO: 3808120 - RNA, 16 nt, Human
ccagccaugccagcug

SEQ ID NO: 3808121 - RNA, 18 nt, Human
ccagccaugccagcuggc

SEQ ID NO: 3808122 - RNA, 19 nt, Human
ccagccauuaccauggaga

SEQ ID NO: 3808123 - RNA, 21 nt, Human
ccagcccaaaggggacaggcc

SEQ ID NO: 3808124 - RNA, 15 nt, Human
ccagcccaauccagg

SEQ ID NO: 3808125 - RNA, 15 nt, Human
ccagcccaccccaug

SEQ ID NO: 3808126 - RNA, 14 nt, Human
ccagcccacccucc

SEQ ID NO: 3808127 - RNA, 21 nt, Human
ccagcccacgcugacuacagg

SEQ ID NO: 3808128 - RNA, 17 nt, Human
ccagcccacuucugcca

SEQ ID NO: 3808129 - RNA, 16 nt, Human
ccagcccagaggccga

SEQ ID NO: 3808130 - RNA, 15 nt, Human
ccagcccagauguuu

SEQ ID NO: 3808131 - RNA, 15 nt, Human
ccagcccagcccagc

SEQ ID NO: 3808132 - RNA, 18 nt, Human
ccagcccagcugcucugc

SEQ ID NO: 3808133 - RNA, 22 nt, Human
ccagcccagcugcucugcccag

SEQ ID NO: 3808134 - RNA, 13 nt, Human
ccagcccagcugg

SEQ ID NO: 3808135 - RNA, 14 nt, Human
ccagcccagggcuc

SEQ ID NO: 3808136 - RNA, 15 nt, Human
ccagcccagggcucc

SEQ ID NO: 3808137 - RNA, 17 nt, Human
ccagcccagggcuccug

SEQ ID NO: 3808138 - RNA, 14 nt, Human
ccagcccagggugg

SEQ ID NO: 3808139 - RNA, 16 nt, Human
ccagcccaucucggag

SEQ ID NO: 3808140 - RNA, 17 nt, Human
ccagcccaucucggagc

SEQ ID NO: 3808141 - RNA, 19 nt, Human
ccagcccaucuugccucca

SEQ ID NO: 3808142 - RNA, 19 nt, Human
ccagcccauggcccugugc

SEQ ID NO: 3808143 - RNA, 19 nt, Human
ccagcccauucucucuccu

SEQ ID NO: 3808144 - RNA, 21 nt, Human
ccagcccauucucucuccugu

SEQ ID NO: 3808145 - RNA, 23 nt, Human
ccagccccaaaacucuccucugc

SEQ ID NO: 3808146 - RNA, 13 nt, Human
ccagccccacagc

SEQ ID NO: 3808147 - RNA, 22 nt, Human
ccagccccacagcccacguccu

SEQ ID NO: 3808148 - RNA, 15 nt, Human
ccagccccacccagg

SEQ ID NO: 3808149 - RNA, 16 nt, Human
ccagccccacccagga

SEQ ID NO: 3808150 - RNA, 19 nt, Human
ccagccccacuccucugcu

SEQ ID NO: 3808151 - RNA, 18 nt, Human
ccagccccacugccagca

SEQ ID NO: 3808152 - RNA, 23 nt, Human
ccagccccacugccagcagcagc

SEQ ID NO: 3808153 - RNA, 16 nt, Human
ccagccccaucaggac

SEQ ID NO: 3808154 - RNA, 13 nt, Human
ccagcccccacag

SEQ ID NO: 3808155 - RNA, 15 nt, Human
ccagcccccuccugg

SEQ ID NO: 3808156 - RNA, 22 nt, Human
ccagcccccugaccacucagag

SEQ ID NO: 3808157 - RNA, 15 nt, Human
ccagcccccuuuggg

SEQ ID NO: 3808158 - RNA, 19 nt, Human
ccagccccgacuccagcca

SEQ ID NO: 3808159 - RNA, 13 nt, Human
ccagccccuagcc

SEQ ID NO: 3808160 - RNA, 17 nt, Human
ccagccccuagcccagg

SEQ ID NO: 3808161 - RNA, 22 nt, Human
ccagccccuagcccaggagaga

SEQ ID NO: 3808162 - RNA, 13 nt, Human
ccagccccuccca

SEQ ID NO: 3808163 - RNA, 14 nt, Human
ccagccccucccac

SEQ ID NO: 3808164 - RNA, 17 nt, Human
ccagccccucuucccca

SEQ ID NO: 3808165 - RNA, 18 nt, Human
ccagccccucuuggagaa

SEQ ID NO: 3808166 - RNA, 21 nt, Human
ccagccccucuuggagaaguc

SEQ ID NO: 3808167 - RNA, 18 nt, Human
ccagccccuggaugcagc

SEQ ID NO: 3808168 - RNA, 23 nt, Human
ccagccccuggccccaggaccug

SEQ ID NO: 3808169 - RNA, 13 nt, Human
ccagccccugucc

SEQ ID NO: 3808170 - RNA, 18 nt, Human
ccagccccuuagacagag

SEQ ID NO: 3808171 - RNA, 16 nt, Human
ccagccccuucucaga

SEQ ID NO: 3808172 - RNA, 23 nt, Human
ccagccccuucugacccaugcug

SEQ ID NO: 3808173 - RNA, 24 nt, Human
ccagccccuucugacccaugcugc

SEQ ID NO: 3808174 - RNA, 14 nt, Human
ccagccccuuucca

SEQ ID NO: 3808175 - RNA, 17 nt, Human
ccagccccuuuccaaaa

SEQ ID NO: 3808176 - RNA, 13 nt, Human
ccagcccggccug

SEQ ID NO: 3808177 - RNA, 17 nt, Human
ccagcccggccugcucc

SEQ ID NO: 3808178 - RNA, 14 nt, Human
ccagcccgggagcc

SEQ ID NO: 3808179 - RNA, 20 nt, Human
ccagcccgggagccuaggac

SEQ ID NO: 3808180 - RNA, 22 nt, Human
ccagcccgggagccuaggacca

SEQ ID NO: 3808181 - RNA, 15 nt, Human
ccagcccuauggaug

SEQ ID NO: 3808182 - RNA, 20 nt, Human
ccagcccuccccauggagcc

SEQ ID NO: 3808183 - RNA, 21 nt, Human
ccagcccuccccauggagcca

SEQ ID NO: 3808184 - RNA, 13 nt, Human
ccagcccucccug

SEQ ID NO: 3808185 - RNA, 14 nt, Human
ccagcccucccugu

SEQ ID NO: 3808186 - RNA, 17 nt, Human
ccagcccucccuguccu

SEQ ID NO: 3808187 - RNA, 18 nt, Human
ccagcccucccuguccuc

SEQ ID NO: 3808188 - RNA, 21 nt, Human
ccagcccucccuguccuccuc

SEQ ID NO: 3808189 - RNA, 22 nt, Human
ccagcccucccuguccuccucg

SEQ ID NO: 3808190 - RNA, 21 nt, Human
ccagcccuccuuaucaaagga

SEQ ID NO: 3808191 - RNA, 22 nt, Human
ccagcccuccuuaucaaaggac

SEQ ID NO: 3808192 - RNA, 18 nt, Human
ccagcccugaguuccuag

SEQ ID NO: 3808193 - RNA, 15 nt, Human
ccagcccugccugga

SEQ ID NO: 3808194 - RNA, 16 nt, Human
ccagcccugccuggag

SEQ ID NO: 3808195 - RNA, 17 nt, Human
ccagcccugccuggagg

SEQ ID NO: 3808196 - RNA, 21 nt, Human
ccagcccugccuggaggaccu

SEQ ID NO: 3808197 - RNA, 12 nt, Human
ccagcccugcug

SEQ ID NO: 3808198 - RNA, 18 nt, Human
ccagcccugcuggccgcc

SEQ ID NO: 3808199 - RNA, 16 nt, Human
ccagcccugcugggga

SEQ ID NO: 3808200 - RNA, 19 nt, Human
ccagcuauuuuuacuagaa

SEQ ID NO: 3808201 - RNA, 12 nt, Human
ccagcucacccc

SEQ ID NO: 3808202 - RNA, 17 nt, Human
ccagcucaccccccaca

SEQ ID NO: 3808203 - RNA, 19 nt, Human
ccagcucaccccccacacu

SEQ ID NO: 3808204 - RNA, 23 nt, Human
ccagcucaccccccacacucacu

SEQ ID NO: 3808205 - RNA, 15 nt, Human
ccagcucacgucaca

SEQ ID NO: 3808206 - RNA, 21 nt, Human
ccagcucagaacccagggcuc

SEQ ID NO: 3808207 - RNA, 12 nt, Human
ccagcucagcac

SEQ ID NO: 3808208 - RNA, 15 nt, Human
ccagcucagcaguga

SEQ ID NO: 3808209 - RNA, 19 nt, Human
ccagcucaggacagaugcc

SEQ ID NO: 3808210 - RNA, 23 nt, Human
ccagcucaggacagaugccacac

SEQ ID NO: 3808211 - RNA, 11 nt, Human
ccagcucaggg

SEQ ID NO: 3808212 - RNA, 15 nt, Human
ccagcucagucccau

SEQ ID NO: 3808213 - RNA, 18 nt, Human
ccagcucagucuucccua

SEQ ID NO: 3808214 - RNA, 12 nt, Human
ccagcucauuca

SEQ ID NO: 3808215 - RNA, 12 nt, Human
ccagcuccaggg

SEQ ID NO: 3808216 - RNA, 17 nt, Human
ccagcucccccgggagg

SEQ ID NO: 3808217 - RNA, 21 nt, Human
ccagcucccccgggaggggcc

SEQ ID NO: 3808218 - RNA, 16 nt, Human
ccagcucccccucccu

SEQ ID NO: 3808219 - RNA, 19 nt, Human
ccagcucccugugccccca

SEQ ID NO: 3808220 - RNA, 19 nt, Human
ccagcuccgcgccaggaug

SEQ ID NO: 3808221 - RNA, 20 nt, Human
ccagcuccggccuguccucc

SEQ ID NO: 3808222 - RNA, 18 nt, Human
cuacacccuuuuccagcu

SEQ ID NO: 3808223 - RNA, 13 nt, Human
cuacaccuaacuc

SEQ ID NO: 3808224 - RNA, 15 nt, Human
cuacaccuugccuug

SEQ ID NO: 3808225 - RNA, 17 nt, Human
cuacacuccagccugag

SEQ ID NO: 3808226 - RNA, 18 nt, Human
cuacacuccagccugagc

SEQ ID NO: 3808227 - RNA, 17 nt, Human
cuacacuccagugagac

SEQ ID NO: 3808228 - RNA, 14 nt, Human
cuacacucuccugg

SEQ ID NO: 3808229 - RNA, 16 nt, Human
cuacacugacacuggu

SEQ ID NO: 3808230 - RNA, 13 nt, Human
cuacacugaggag

SEQ ID NO: 3808231 - RNA, 22 nt, Human
cuacagaaaaacaaugguaaca

SEQ ID NO: 3808232 - RNA, 17 nt, Human
cuacagaaaaaccuugg

SEQ ID NO: 3808233 - RNA, 17 nt, Human
cuacagaaaagaaacuc

SEQ ID NO: 3808234 - RNA, 18 nt, Human
cuacagaaaagaaacucu

SEQ ID NO: 3808235 - RNA, 19 nt, Human
cuacagaacuucagaaaga

SEQ ID NO: 3808236 - RNA, 16 nt, Human
cuacagacuucuccag

SEQ ID NO: 3808237 - RNA, 21 nt, Human
cuacagacuucuccagaccca

SEQ ID NO: 3808238 - RNA, 12 nt, Human
cuacagagaaac

SEQ ID NO: 3808239 - RNA, 15 nt, Human
cuacagagaaaccag

SEQ ID NO: 3808240 - RNA, 16 nt, Human
cuacagagaaaccagc

SEQ ID NO: 3808241 - RNA, 22 nt, Human
cuacagagaaaccagcuuccuu

SEQ ID NO: 3808242 - RNA, 11 nt, Human
cuacagagaag

SEQ ID NO: 3808243 - RNA, 14 nt, Human
cuacagagaagccu

SEQ ID NO: 3808244 - RNA, 16 nt, Human
cuacagagaagccuuc

SEQ ID NO: 3808245 - RNA, 22 nt, Human
cuacagagaagccuucaagcuc

SEQ ID NO: 3808246 - RNA, 23 nt, Human
cuacagagaagccuucaagcucu

SEQ ID NO: 3808247 - RNA, 23 nt, Human
cuacagagccgagcaauauuuau

SEQ ID NO: 3808248 - RNA, 17 nt, Human
cuacagagcuucccuga

SEQ ID NO: 3808249 - RNA, 18 nt, Human
cuacagaggccaugggcc

SEQ ID NO: 3808250 - RNA, 16 nt, Human
cuacagcaaauuuaua

SEQ ID NO: 3808251 - RNA, 22 nt, Human
cuacagcaaauuuauaauuuua

SEQ ID NO: 3808252 - RNA, 21 nt, Human
cuacagcacuacuggguguca

SEQ ID NO: 3808253 - RNA, 14 nt, Human
cuacagccucagaa

SEQ ID NO: 3808254 - RNA, 22 nt, Human
cuacagcuaaucagcauucuca

SEQ ID NO: 3808255 - RNA, 18 nt, Human
cuacagcuggggugcagg

SEQ ID NO: 3808256 - RNA, 22 nt, Human
cuacagcuugaccgugaggcca

SEQ ID NO: 3808257 - RNA, 23 nt, Human
cuacagcuugaccgugaggccag

SEQ ID NO: 3808258 - RNA, 11 nt, Human
cuacagcuuuc

SEQ ID NO: 3808259 - RNA, 22 nt, Human
cuacagcuuugugacuguauau

SEQ ID NO: 3808260 - RNA, 22 nt, Human
cuacaggcacacgccaccucgc

SEQ ID NO: 3808261 - RNA, 15 nt, Human
cuacaggcacccacc

SEQ ID NO: 3808262 - RNA, 18 nt, Human
cuacaggcagucucucuc

SEQ ID NO: 3808263 - RNA, 22 nt, Human
cuacagggcgagacucugucuc

SEQ ID NO: 3808264 - RNA, 22 nt, Human
cuacaggggaagguggccucug

SEQ ID NO: 3808265 - RNA, 15 nt, Human
cuacagggggucugg

SEQ ID NO: 3808266 - RNA, 17 nt, Human
cuacagggggucuggcu

SEQ ID NO: 3808267 - RNA, 19 nt, Human
cuacagggggucuggcugg

SEQ ID NO: 3808268 - RNA, 14 nt, Human
cuacaggugugagu

SEQ ID NO: 3808269 - RNA, 17 nt, Human
cuacagguuacaacaga

SEQ ID NO: 3808270 - RNA, 18 nt, Human
cuacagucaagauagaaa

SEQ ID NO: 3808271 - RNA, 14 nt, Human
cuacagucaggaaa

SEQ ID NO: 3808272 - RNA, 21 nt, Human
cuacagucaggaaaggaauca

SEQ ID NO: 3808273 - RNA, 15 nt, Human
cuacaguccucccau

SEQ ID NO: 3808274 - RNA, 18 nt, Human
cuacagugccaacuccuc

SEQ ID NO: 3808275 - RNA, 14 nt, Human
cuacagugguuuua

SEQ ID NO: 3808276 - RNA, 13 nt, Human
cuacaguugaaaa

SEQ ID NO: 3808277 - RNA, 19 nt, Human
cuacaguugaaaaacagcu

SEQ ID NO: 3808278 - RNA, 21 nt, Human
cuacaguuggaaauccaucca

SEQ ID NO: 3808279 - RNA, 18 nt, Human
cuacaguuuuaacugugg

SEQ ID NO: 3808280 - RNA, 19 nt, Human
cuacaguuuuaacugugga

SEQ ID NO: 3808281 - RNA, 12 nt, Human
cuacauaaauug

SEQ ID NO: 3808282 - RNA, 13 nt, Human
cuacauaaauugg

SEQ ID NO: 3808283 - RNA, 15 nt, Human
cuacauaauuuaguu

SEQ ID NO: 3808284 - RNA, 18 nt, Human
cuacauaucccuuccaga

SEQ ID NO: 3808285 - RNA, 18 nt, Human
cuacaugacgacaaagcu

SEQ ID NO: 3808286 - RNA, 17 nt, Human
cuacaugagaacaaaca

SEQ ID NO: 3808287 - RNA, 15 nt, Human
cuacaugagguacug

SEQ ID NO: 3808288 - RNA, 22 nt, Human
cuacaugcaaggcacuguacua

SEQ ID NO: 3808289 - RNA, 17 nt, Human
cuacaugcuuugugaac

SEQ ID NO: 3808290 - RNA, 18 nt, Human
cuacauggaguauauguc

SEQ ID NO: 3808291 - RNA, 22 nt, Human
cuacauggggucuggguggggg

SEQ ID NO: 3808292 - RNA, 21 nt, Human
cuacauguauugcacauugua

SEQ ID NO: 3808293 - RNA, 18 nt, Human
cuacauuagguugugaau

SEQ ID NO: 3808294 - RNA, 12 nt, Human
cuacauucauuu

SEQ ID NO: 3808295 - RNA, 14 nt, Human
cuacauucuguuaa

SEQ ID NO: 3808296 - RNA, 16 nt, Human
cuacauuuuuucauca

SEQ ID NO: 3808297 - RNA, 14 nt, Human
cuaccaacuggaag

SEQ ID NO: 3808298 - RNA, 15 nt, Human
cuaccaacuggaagc

SEQ ID NO: 3808299 - RNA, 14 nt, Human
cuaccaacuuucaa

SEQ ID NO: 3808300 - RNA, 19 nt, Human
cuaccaagcuauccuggcu

SEQ ID NO: 3808301 - RNA, 18 nt, Human
cuaccaauagauucccca

SEQ ID NO: 3808302 - RNA, 13 nt, Human
cuaccaaugcaug

SEQ ID NO: 3808303 - RNA, 14 nt, Human
cuaccacagugucu

SEQ ID NO: 3808304 - RNA, 14 nt, Human
cuaccaccccuucc

SEQ ID NO: 3808305 - RNA, 16 nt, Human
cuaccaccccuuccug

SEQ ID NO: 3808306 - RNA, 22 nt, Human
cuaccaccccuuccugucccac

SEQ ID NO: 3808307 - RNA, 14 nt, Human
cuaccacuccugcc

SEQ ID NO: 3808308 - RNA, 18 nt, Human
cuaccacugucuucuuca

SEQ ID NO: 3808309 - RNA, 16 nt, Human
cuaccagacuguguau

SEQ ID NO: 3808310 - RNA, 17 nt, Human
cuaccagcgcccgcugg

SEQ ID NO: 3808311 - RNA, 21 nt, Human
cuaccagcguauauauaagaa

SEQ ID NO: 3808312 - RNA, 19 nt, Human
cuaccaguauuuagaagcc

SEQ ID NO: 3808313 - RNA, 16 nt, Human
cuaccaucagggacag

SEQ ID NO: 3808314 - RNA, 11 nt, Human
cuaccaucucc

SEQ ID NO: 3808315 - RNA, 13 nt, Human
cuaccauucagug

SEQ ID NO: 3808316 - RNA, 20 nt, Human
cuaccauuugcagaguccug

SEQ ID NO: 3808317 - RNA, 13 nt, Human
cuacccacccucc

SEQ ID NO: 3808318 - RNA, 22 nt, Human
cuacccacccuccuuucaccac

SEQ ID NO: 3808319 - RNA, 15 nt, Human
cuacccacuauccuu

SEQ ID NO: 3808320 - RNA, 19 nt, Human
cuacccacuauccuucgug

SEQ ID NO: 3808321 - RNA, 14 nt, Human
cuacccacuucuaa

SEQ ID NO: 3808322 - RNA, 21 nt, Human
cuacccagagaagccccuucc

SEQ ID NO: 3808323 - RNA, 18 nt, Human
cuacccagcgagcccugg

SEQ ID NO: 3808324 - RNA, 19 nt, Human
cuacccaggaggcugaggu

SEQ ID NO: 3808325 - RNA, 19 nt, Human
cuacccagggccugcagga

SEQ ID NO: 3808326 - RNA, 13 nt, Human
cuacccauccccg

SEQ ID NO: 3808327 - RNA, 19 nt, Human
cuaccccauggugcuagga

SEQ ID NO: 3808328 - RNA, 18 nt, Human
cuacccccagcugugcuu

SEQ ID NO: 3808329 - RNA, 19 nt, Human
cuacccccaggguugaggg

SEQ ID NO: 3808330 - RNA, 15 nt, Human
cuacccccuccucuc

SEQ ID NO: 3808331 - RNA, 15 nt, Human
cuaccccucccagcu

SEQ ID NO: 3808332 - RNA, 18 nt, Human
cuaccccucccagcugac

SEQ ID NO: 3808333 - RNA, 16 nt, Human
cuaccccuugauuuuc

SEQ ID NO: 3808334 - RNA, 20 nt, Human
cuacccgacauaagucgagg

SEQ ID NO: 3808335 - RNA, 16 nt, Human
cuacccuaaccaaguu

SEQ ID NO: 3808336 - RNA, 14 nt, Human
cuacccucccaccc

SEQ ID NO: 3808337 - RNA, 13 nt, Human
cuacccucccugc

SEQ ID NO: 3808338 - RNA, 17 nt, Human
cuacccuccugcacugu

SEQ ID NO: 3808339 - RNA, 20 nt, Human
cuacccucgggcccaccugg

SEQ ID NO: 3808340 - RNA, 14 nt, Human
cuacccucuagaga

SEQ ID NO: 3808341 - RNA, 18 nt, Human
cuacccugagcugaggca

SEQ ID NO: 3808342 - RNA, 13 nt, Human
cuacccuuaauua

SEQ ID NO: 3808343 - RNA, 18 nt, Human
cuacccuuuuucuccagc

SEQ ID NO: 3808344 - RNA, 18 nt, Human
cuaccgaaugugucuuua

SEQ ID NO: 3808345 - RNA, 14 nt, Human
gaaggcuggcauga

SEQ ID NO: 3808346 - RNA, 13 nt, Human
gaaggcuggcugg

SEQ ID NO: 3808347 - RNA, 22 nt, Human
gaaggcuggguucugauccuag

SEQ ID NO: 3808348 - RNA, 17 nt, Human
gaaggcuuguugugcuu

SEQ ID NO: 3808349 - RNA, 23 nt, Human
gaaggcuuucagggccuccagcc

SEQ ID NO: 3808350 - RNA, 19 nt, Human
gaagggaaaauauccaucc

SEQ ID NO: 3808351 - RNA, 15 nt, Human
gaagggaagaaaagg

SEQ ID NO: 3808352 - RNA, 22 nt, Human
gaagggaauaagguacaagaag

SEQ ID NO: 3808353 - RNA, 13 nt, Human
gaagggacauauu

SEQ ID NO: 3808354 - RNA, 22 nt, Human
gaagggaccaaggcaaggcagg

SEQ ID NO: 3808355 - RNA, 18 nt, Human
gaagggaccuugaagggu

SEQ ID NO: 3808356 - RNA, 20 nt, Human
gaagggaccuugaaggguaa

SEQ ID NO: 3808357 - RNA, 21 nt, Human
gaagggacuaggagcacugua

SEQ ID NO: 3808358 - RNA, 21 nt, Human
gaagggagaaggaucuagaau

SEQ ID NO: 3808359 - RNA, 15 nt, Human
gaagggagcagcaca

SEQ ID NO: 3808360 - RNA, 15 nt, Human
gaagggagccaaggg

SEQ ID NO: 3808361 - RNA, 16 nt, Human
gaagggagccaaggga

SEQ ID NO: 3808362 - RNA, 20 nt, Human
gaagggagccaagggaugga

SEQ ID NO: 3808363 - RNA, 14 nt, Human
gaagggagggcaga

SEQ ID NO: 3808364 - RNA, 20 nt, Human
gaagggagggcagagcuggu

SEQ ID NO: 3808365 - RNA, 23 nt, Human
gaagggagggcagagcuggugcg

SEQ ID NO: 3808366 - RNA, 19 nt, Human
gaagggccaguccugccug

SEQ ID NO: 3808367 - RNA, 20 nt, Human
gaagggccaguccugccugg

SEQ ID NO: 3808368 - RNA, 22 nt, Human
gaagggccaguccugccuggcc

SEQ ID NO: 3808369 - RNA, 18 nt, Human
gaagggccagucugggcu

SEQ ID NO: 3808370 - RNA, 20 nt, Human
gaagggccagucugggcugc

SEQ ID NO: 3808371 - RNA, 13 nt, Human
gaagggcccagga

SEQ ID NO: 3808372 - RNA, 21 nt, Human
gaagggcccuucacugccuuu

SEQ ID NO: 3808373 - RNA, 22 nt, Human
gaagggcugcaugauguuugcc

SEQ ID NO: 3808374 - RNA, 13 nt, Human
gaauauggacaua

SEQ ID NO: 3808375 - RNA, 17 nt, Human
gaauaugggagaaauag

SEQ ID NO: 3808376 - RNA, 18 nt, Human
gaauaugggagaaauagu

SEQ ID NO: 3808377 - RNA, 15 nt, Human
gaauauguauguaua

SEQ ID NO: 3808378 - RNA, 12 nt, Human
gaauaugucugc

SEQ ID NO: 3808379 - RNA, 14 nt, Human
gaauauguuucaaa

SEQ ID NO: 3808380 - RNA, 13 nt, Human
gaauauuauauuu

SEQ ID NO: 3808381 - RNA, 24 nt, Human
gaauauuauauuuggaugcagagu

SEQ ID NO: 3808382 - RNA, 18 nt, Human
gaauauugcaaaauacau

SEQ ID NO: 3808383 - RNA, 21 nt, Human
gaauauugcaaaauacaugaa

SEQ ID NO: 3808384 - RNA, 22 nt, Human
gaauauugcugauggugcaaug

SEQ ID NO: 3808385 - RNA, 23 nt, Human
gaauauuguauuguuagauguuu

SEQ ID NO: 3808386 - RNA, 23 nt, Human
gaauauuguguuccuuuuuauga

SEQ ID NO: 3808387 - RNA, 18 nt, Human
gaauauuuauauuucacu

SEQ ID NO: 3808388 - RNA, 19 nt, Human
gaauauuuauauuucacua

SEQ ID NO: 3808389 - RNA, 11 nt, Human
gaauauuugaa

SEQ ID NO: 3808390 - RNA, 16 nt, Human
gaauauuugaaucuug

SEQ ID NO: 3808391 - RNA, 22 nt, Human
gaauauuugaaucuugucucaa

SEQ ID NO: 3808392 - RNA, 17 nt, Human
gaauauuugaauguaug

SEQ ID NO: 3808393 - RNA, 19 nt, Human
gaauauuugguuuuccugu

SEQ ID NO: 3808394 - RNA, 15 nt, Human
gaauauuuuauucaa

SEQ ID NO: 3808395 - RNA, 18 nt, Human
gaauauuuuauucaaggu

SEQ ID NO: 3808396 - RNA, 19 nt, Human
gaauauuuuuauauuuccu

SEQ ID NO: 3808397 - RNA, 22 nt, Human
gaauauuuuuauauuuccuuua

SEQ ID NO: 3808398 - RNA, 15 nt, Human
gaaucaaaaauugaa

SEQ ID NO: 3808399 - RNA, 19 nt, Human
gaaucaaagcaaugcauuu

SEQ ID NO: 3808400 - RNA, 17 nt, Human
gaaucaaauaaaaauuc

SEQ ID NO: 3808401 - RNA, 17 nt, Human
gaaucaacauuucucaa

SEQ ID NO: 3808402 - RNA, 18 nt, Human
gaaucaagagcugcccuc

SEQ ID NO: 3808403 - RNA, 19 nt, Human
gaaucaagagcugcccucc

SEQ ID NO: 3808404 - RNA, 22 nt, Human
gaaucaagcuagaaggccacau

SEQ ID NO: 3808405 - RNA, 19 nt, Human
gaaucaagggucaggccuu

SEQ ID NO: 3808406 - RNA, 11 nt, Human
gaaucaauaau

SEQ ID NO: 3808407 - RNA, 12 nt, Human
gaaucacaggcu

SEQ ID NO: 3808408 - RNA, 18 nt, Human
gaaucaccuaauuaauuu

SEQ ID NO: 3808409 - RNA, 21 nt, Human
gaaucacguuagaggaaaaau

SEQ ID NO: 3808410 - RNA, 20 nt, Human
gaaucacuguuuagaacaca

SEQ ID NO: 3808411 - RNA, 15 nt, Human
gaaucacuguuuuua

SEQ ID NO: 3808412 - RNA, 13 nt, Human
gaaucagaaacag

SEQ ID NO: 3808413 - RNA, 22 nt, Human
gaaucagaagauagucuuggaa

SEQ ID NO: 3808414 - RNA, 18 nt, Human
gaaucagccuacaggccu

SEQ ID NO: 3808415 - RNA, 21 nt, Human
gaaucaggaauauuuuccaaa

SEQ ID NO: 3808416 - RNA, 21 nt, Human
gaaucaguauaaacaaaguua

SEQ ID NO: 3808417 - RNA, 15 nt, Human
gaaucaugagccugc

SEQ ID NO: 3808418 - RNA, 18 nt, Human
gaaucaugagccugcugg

SEQ ID NO: 3808419 - RNA, 13 nt, Human
gaaucauguagua

SEQ ID NO: 3808420 - RNA, 17 nt, Human
gaaucaugucaggccug

SEQ ID NO: 3808421 - RNA, 20 nt, Human
gaaucaugucaggccugugu

SEQ ID NO: 3808422 - RNA, 15 nt, Human
gaaucauguuucuuu

SEQ ID NO: 3808423 - RNA, 16 nt, Human
gaaucauuauuuauua

SEQ ID NO: 3808424 - RNA, 18 nt, Human
gaaucauucagaaauguu

SEQ ID NO: 3808425 - RNA, 12 nt, Human
gaaucauugcuu

SEQ ID NO: 3808426 - RNA, 20 nt, Human
gaaucauuguaaacauuagu

SEQ ID NO: 3808427 - RNA, 16 nt, Human
gaauccaaaagaaaaa

SEQ ID NO: 3808428 - RNA, 13 nt, Human
gaauccaaacuug

SEQ ID NO: 3808429 - RNA, 15 nt, Human
gaauccaagauuggu

SEQ ID NO: 3808430 - RNA, 17 nt, Human
gaauccaagccuccaca

SEQ ID NO: 3808431 - RNA, 15 nt, Human
gaauccaagcucccu

SEQ ID NO: 3808432 - RNA, 17 nt, Human
gaauccacauuucuaaa

SEQ ID NO: 3808433 - RNA, 18 nt, Human
gaauccacauuucuaaaa

SEQ ID NO: 3808434 - RNA, 15 nt, Human
gaauccacccauccu

SEQ ID NO: 3808435 - RNA, 23 nt, Human
gaauccacguauuccccuuccca

SEQ ID NO: 3808436 - RNA, 17 nt, Human
gaaucccaaauuugauu

SEQ ID NO: 3808437 - RNA, 15 nt, Human
gaaucccaagaccca

SEQ ID NO: 3808438 - RNA, 19 nt, Human
gaaucccagcccccugacc

SEQ ID NO: 3808439 - RNA, 13 nt, Human
gaaucccagccgg

SEQ ID NO: 3808440 - RNA, 19 nt, Human
gaauccccaacaugcacug

SEQ ID NO: 3808441 - RNA, 17 nt, Human
gaaucccccuugccacc

SEQ ID NO: 3808442 - RNA, 17 nt, Human
gaauccccucccuguca

SEQ ID NO: 3808443 - RNA, 20 nt, Human
gaaucccuagacuuuaggcu

SEQ ID NO: 3808444 - RNA, 17 nt, Human
gaaucccuguguuaauu

SEQ ID NO: 3808445 - RNA, 16 nt, Human
gaaucccuuaacaguu

SEQ ID NO: 3808446 - RNA, 19 nt, Human
gaaucccuuaacaguugua

SEQ ID NO: 3808447 - RNA, 21 nt, Human
gaaucccuuaacaguuguauu

SEQ ID NO: 3808448 - RNA, 19 nt, Human
gaauccgggcuccccuuuc

SEQ ID NO: 3808449 - RNA, 23 nt, Human
gaauccuacacaccuaagggaca

SEQ ID NO: 3808450 - RNA, 15 nt, Human
gaauccuagggccug

SEQ ID NO: 3808451 - RNA, 12 nt, Human
gaauccuggcag

SEQ ID NO: 3808452 - RNA, 13 nt, Human
gaauccuggcagc

SEQ ID NO: 3808453 - RNA, 16 nt, Human
gaauccuggcagccca

SEQ ID NO: 3808454 - RNA, 22 nt, Human
gaauccugucgauuagacugga

SEQ ID NO: 3808455 - RNA, 16 nt, Human
gaauccuuccauucca

SEQ ID NO: 3808456 - RNA, 14 nt, Human
gaauccuuugccug

SEQ ID NO: 3808457 - RNA, 13 nt, Human
gaauccuuuugua

SEQ ID NO: 3808458 - RNA, 19 nt, Human
gaaucgaggaaccagagcc

SEQ ID NO: 3808459 - RNA, 14 nt, Human
gaaucgcuucucuu

SEQ ID NO: 3808460 - RNA, 12 nt, Human
gaaucuaccaac

SEQ ID NO: 3808461 - RNA, 16 nt, Human
gaaucuacccaaagga

SEQ ID NO: 3808462 - RNA, 17 nt, Human
gaaucuacccaaaggau

SEQ ID NO: 3808463 - RNA, 18 nt, Human
gaaucuacccccagaucc

SEQ ID NO: 3808464 - RNA, 14 nt, Human
gaaucuacuuaacc

SEQ ID NO: 3808465 - RNA, 16 nt, Human
gaaucuagaagaaaug

SEQ ID NO: 3808466 - RNA, 17 nt, Human
gaaucuagaagaaauga

SEQ ID NO: 3808467 - RNA, 18 nt, Human
gaaucuagggagggggaa

SEQ ID NO: 3808468 - RNA, 15 nt, Human
gaaucuaugccaaag

SEQ ID NO: 3808469 - RNA, 13 nt, Human
gaaucuauuuaag

SEQ ID NO: 3808470 - RNA, 17 nt, Human
gaaucuauuuucuaugu

SEQ ID NO: 3808471 - RNA, 21 nt, Human
gaaucuauuuucuauguacua

SEQ ID NO: 3808472 - RNA, 16 nt, Human
gaaucucaaauaacua

SEQ ID NO: 3808473 - RNA, 21 nt, Human
gaaucucaacaugucuccuac

SEQ ID NO: 3808474 - RNA, 18 nt, Human
gaaucucauaauuuauac

SEQ ID NO: 3808475 - RNA, 18 nt, Human
gaaucucuuuuugcuuuc

SEQ ID NO: 3808476 - RNA, 17 nt, Human
gaaucugauuuuuauga

SEQ ID NO: 3808477 - RNA, 15 nt, Human
gaaucugcaauucaa

SEQ ID NO: 3808478 - RNA, 13 nt, Human
gaaucugcucacu

SEQ ID NO: 3808479 - RNA, 12 nt, Human
gaaucuggagac

SEQ ID NO: 3808480 - RNA, 18 nt, Human
gaaucuggagaccaggga

SEQ ID NO: 3808481 - RNA, 22 nt, Human
gaaucuggagaccagggagccu

SEQ ID NO: 3808482 - RNA, 18 nt, Human
gaaucuguaugauucuau

SEQ ID NO: 3808483 - RNA, 23 nt, Human
gaaucugucucccaguuaugaau

SEQ ID NO: 3808484 - RNA, 20 nt, Human
gaaucuuguuuugaaaauaa

SEQ ID NO: 3808485 - RNA, 19 nt, Human
gaaucuuuaaaagaugcuu

SEQ ID NO: 3808486 - RNA, 19 nt, Human
gaaucuuuauugagaaaga

SEQ ID NO: 3808487 - RNA, 20 nt, Human
gaaucuuuccaauaaaccag

SEQ ID NO: 3808488 - RNA, 19 nt, Human
gaaucuuuguaccaaaauu

SEQ ID NO: 3808489 - RNA, 20 nt, Human
gaaugaaaaaugaaagauga

SEQ ID NO: 3808490 - RNA, 15 nt, Human
gaaugaaaaauuuaa

SEQ ID NO: 3808491 - RNA, 12 nt, Human
gaaugaaaauaa

SEQ ID NO: 3808492 - RNA, 16 nt, Human
gaaugaaaauuguaug

SEQ ID NO: 3808493 - RNA, 12 nt, Human
gaaugaaagagu

SEQ ID NO: 3808494 - RNA, 14 nt, Human
gaaugaaagaguaa

SEQ ID NO: 3808495 - RNA, 15 nt, Human
gaaugaaagcuguuc

SEQ ID NO: 3808496 - RNA, 14 nt, Human
gaaugaaagggccc

SEQ ID NO: 3808497 - RNA, 19 nt, Human
gaaugaaagggcccagaga

SEQ ID NO: 3808498 - RNA, 21 nt, Human
gaaugaaagggcccagagagg

SEQ ID NO: 3808499 - RNA, 21 nt, Human
gaaugaaagucuugugacuag

SEQ ID NO: 3808500 - RNA, 23 nt, Human
gaaugaaauccugcuucagugua

SEQ ID NO: 3808501 - RNA, 20 nt, Human
gaaugaacacucuuuugcuu

SEQ ID NO: 3808502 - RNA, 23 nt, Human
gaaugaaccacaucuugcucugc

SEQ ID NO: 3808503 - RNA, 17 nt, Human
gaaugaaccuucuggcc

SEQ ID NO: 3808504 - RNA, 21 nt, Human
gaaugaagauaccaucagcaa

SEQ ID NO: 3808505 - RNA, 17 nt, Human
gaaugaagauacugaaa

SEQ ID NO: 3808506 - RNA, 18 nt, Human
gaaugaaugcuguauaug

SEQ ID NO: 3808507 - RNA, 12 nt, Human
gaaugaauuuca

SEQ ID NO: 3808508 - RNA, 16 nt, Human
gaaugaccuuguaaug

SEQ ID NO: 3808509 - RNA, 16 nt, Human
gaaugagacuggcuug

SEQ ID NO: 3808510 - RNA, 20 nt, Human
gaaugagagacacacugaag

SEQ ID NO: 3808511 - RNA, 14 nt, Human
gaaugagaguguga

SEQ ID NO: 3808512 - RNA, 12 nt, Human
gaaugagcccag

SEQ ID NO: 3808513 - RNA, 16 nt, Human
gaaugagcccagagaa

SEQ ID NO: 3808514 - RNA, 11 nt, Human
gaaugagccuc

SEQ ID NO: 3808515 - RNA, 23 nt, Human
gaaugaggaaaauucuuaaaagg

SEQ ID NO: 3808516 - RNA, 23 nt, Human
gaaugaggaauaauaaguuaaac

SEQ ID NO: 3808517 - RNA, 18 nt, Human
gaaugaggcuugcugaga

SEQ ID NO: 3808518 - RNA, 17 nt, Human
gaaugagggggcucagu

SEQ ID NO: 3808519 - RNA, 14 nt, Human
gaaugaggucccag

SEQ ID NO: 3808520 - RNA, 18 nt, Human
gaaugaggucccaggcag

SEQ ID NO: 3808521 - RNA, 19 nt, Human
gaaugaggucccaggcaga

SEQ ID NO: 3808522 - RNA, 14 nt, Human
gaaugagugugcau

SEQ ID NO: 3808523 - RNA, 16 nt, Human
gaaugaguuucuuaga

SEQ ID NO: 3808524 - RNA, 18 nt, Human
gaaugaguuucuuagacu

SEQ ID NO: 3808525 - RNA, 23 nt, Human
gaaugaugcucaaaaucuuucca

SEQ ID NO: 3808526 - RNA, 21 nt, Human
gaaugaugguuuccaauuuca

SEQ ID NO: 3808527 - RNA, 18 nt, Human
gaaugauuuuucuuuaca

SEQ ID NO: 3808528 - RNA, 19 nt, Human
gaaugcaaccaagucacac

SEQ ID NO: 3808529 - RNA, 20 nt, Human
gaaugcacaaacagaggccg

SEQ ID NO: 3808530 - RNA, 21 nt, Human
gaaugcacaaacagaggccgc

SEQ ID NO: 3808531 - RNA, 18 nt, Human
gaaugcacaagaauggau

SEQ ID NO: 3808532 - RNA, 21 nt, Human
gaaugcacaagaauggaucac

SEQ ID NO: 3808533 - RNA, 17 nt, Human
gaaugcacagauauacu

SEQ ID NO: 3808534 - RNA, 21 nt, Human
gaaugcaccauacucaugcau

SEQ ID NO: 3808535 - RNA, 12 nt, Human
gaaugcauugau

SEQ ID NO: 3808536 - RNA, 21 nt, Human
gaaugcauugauauugugaac

SEQ ID NO: 3808537 - RNA, 20 nt, Human
gaaugccagugugcugaugg

SEQ ID NO: 3808538 - RNA, 23 nt, Human
gaaugccauagucaaagagaguu

SEQ ID NO: 3808539 - RNA, 17 nt, Human
gaaugcccacaggcaaa

SEQ ID NO: 3808540 - RNA, 14 nt, Human
gaaugcccucaggg

SEQ ID NO: 3808541 - RNA, 18 nt, Human
gaaugccgcgauggguca

SEQ ID NO: 3808542 - RNA, 13 nt, Human
gaaugccuccucc

SEQ ID NO: 3808543 - RNA, 14 nt, Human
gaaugccuccugug

SEQ ID NO: 3808544 - RNA, 16 nt, Human
gaaugccugagugccu

SEQ ID NO: 3808545 - RNA, 16 nt, Human
gaaugcuaacaguuca

SEQ ID NO: 3808546 - RNA, 22 nt, Human
gaaugcucaaguuuuucagaaa

SEQ ID NO: 3808547 - RNA, 13 nt, Human
gaaugcugaaacc

SEQ ID NO: 3808548 - RNA, 15 nt, Human
gaaugcugaaaccaa

SEQ ID NO: 3808549 - RNA, 21 nt, Human
gaaugcugcaggacuugagaa

SEQ ID NO: 3808550 - RNA, 14 nt, Human
gaaugcugggacuc

SEQ ID NO: 3808551 - RNA, 19 nt, Human
gaaugcugggacucagccu

SEQ ID NO: 3808552 - RNA, 13 nt, Human
gaaugcuguacau

SEQ ID NO: 3808553 - RNA, 21 nt, Human
gaaugcuuaaagaauucaaau

SEQ ID NO: 3808554 - RNA, 12 nt, Human
gaaugcuucuca

SEQ ID NO: 3808555 - RNA, 18 nt, Human
gaaugcuucugacuucau

SEQ ID NO: 3808556 - RNA, 16 nt, Human
gaaugcuugaaaaaug

SEQ ID NO: 3808557 - RNA, 19 nt, Human
gaaugcuuggaauaucugc

SEQ ID NO: 3808558 - RNA, 13 nt, Human
gaaugcuuuagga

SEQ ID NO: 3808559 - RNA, 18 nt, Human
gaauggaagguggagaag

SEQ ID NO: 3808560 - RNA, 15 nt, Human
gaauggacauuucua

SEQ ID NO: 3808561 - RNA, 15 nt, Human
gaauggaggggcaga

SEQ ID NO: 3808562 - RNA, 20 nt, Human
gaauggauuggauuauuuaa

SEQ ID NO: 3808563 - RNA, 18 nt, Human
gaauggcaauguuuugcu

SEQ ID NO: 3808564 - RNA, 17 nt, Human
gaauggcacagcccaaa

SEQ ID NO: 3808565 - RNA, 22 nt, Human
gaauggcacagcccaaagaagg

SEQ ID NO: 3808566 - RNA, 13 nt, Human
gaauggcagcugc

SEQ ID NO: 3808567 - RNA, 16 nt, Human
gaauggcagcugccac

SEQ ID NO: 3808568 - RNA, 18 nt, Human
gaauggccuccucccuua

SEQ ID NO: 3808569 - RNA, 21 nt, Human
gaauggccugccuugaagcca

SEQ ID NO: 3808570 - RNA, 17 nt, Human
gaauggcuauguuuuua

SEQ ID NO: 3808571 - RNA, 17 nt, Human
gaauggcuuuguauaga

SEQ ID NO: 3808572 - RNA, 13 nt, Human
gaaugggaaaaga

SEQ ID NO: 3808573 - RNA, 17 nt, Human
gaaugggaucaugaaag

SEQ ID NO: 3808574 - RNA, 17 nt, Human
gaaugggcuguuuuugg

SEQ ID NO: 3808575 - RNA, 20 nt, Human
gaaugguacaugucuuccau

SEQ ID NO: 3808576 - RNA, 13 nt, Human
gaaugguagucua

SEQ ID NO: 3808577 - RNA, 13 nt, Human
gaaugguccaggg

SEQ ID NO: 3808578 - RNA, 21 nt, Human
gaauggugugggagagggaug

SEQ ID NO: 3808579 - RNA, 17 nt, Human
gaaugguuauaaaagug

SEQ ID NO: 3808580 - RNA, 19 nt, Human
gaaugguuccaugccugag

SEQ ID NO: 3808581 - RNA, 22 nt, Human
gaaugguuccaugccugagggu

SEQ ID NO: 3808582 - RNA, 22 nt, Human
gaauguaaaagaacuuacugau

SEQ ID NO: 3808583 - RNA, 13 nt, Human
gaauguaaauguc

SEQ ID NO: 3808584 - RNA, 15 nt, Human
gaauguaacugcuga

SEQ ID NO: 3808585 - RNA, 18 nt, Human
gaauguaacugcugaaaa

SEQ ID NO: 3808586 - RNA, 18 nt, Human
gaauguaagaacuacaaa

SEQ ID NO: 3808587 - RNA, 14 nt, Human
gaauguacguccag

SEQ ID NO: 3808588 - RNA, 14 nt, Human
gaauguacucuguu

SEQ ID NO: 3808589 - RNA, 22 nt, Human
gaauguaggcuggcuuucagag

SEQ ID NO: 3808590 - RNA, 17 nt, Human
gaauguauaguauuuga

SEQ ID NO: 3808591 - RNA, 19 nt, Human
gaauguauaguauuugaaa

SEQ ID NO: 3808592 - RNA, 16 nt, Human
gaauguaucaggaaau

SEQ ID NO: 3808593 - RNA, 17 nt, Human
gaauguaucaggaaaua

SEQ ID NO: 3808594 - RNA, 14 nt, Human
gaauguaucuguga

SEQ ID NO: 3808595 - RNA, 17 nt, Human
gaauguaucugugaagu

SEQ ID NO: 3808596 - RNA, 11 nt, Human
gaauguaugua

SEQ ID NO: 3808597 - RNA, 17 nt, Human
gaauguauguaaugugu

SEQ ID NO: 3808598 - RNA, 16 nt, Human
gaauguauuauucugc

SEQ ID NO: 3808599 - RNA, 17 nt, Human
gaauguauuauucugca

SEQ ID NO: 3808600 - RNA, 18 nt, Human
gaauguauuauucugcag

SEQ ID NO: 3808601 - RNA, 15 nt, Human
gaauguauuguaccu

SEQ ID NO: 3808602 - RNA, 16 nt, Human
gaauguauuuauuugg

SEQ ID NO: 3808603 - RNA, 19 nt, Human
gaaugucagauuccuuucc

SEQ ID NO: 3808604 - RNA, 21 nt, Human
gaaugucaguuguuauuuauu

SEQ ID NO: 3808605 - RNA, 16 nt, Human
gaaugucuuuugaaua

SEQ ID NO: 3808606 - RNA, 14 nt, Human
gaaugugaaagcac

SEQ ID NO: 3808607 - RNA, 14 nt, Human
gaaugugaagccuu

SEQ ID NO: 3808608 - RNA, 15 nt, Human
gaaugugaagccuuc

SEQ ID NO: 3808609 - RNA, 20 nt, Human
gaaugugaagccuuccccuu

SEQ ID NO: 3808610 - RNA, 19 nt, Human
gaaugugauuuuaaagagu

SEQ ID NO: 3808611 - RNA, 21 nt, Human
gaaugugggcacuggcccagg

SEQ ID NO: 3808612 - RNA, 13 nt, Human
gaauguguuucaa

SEQ ID NO: 3808613 - RNA, 18 nt, Human
gaauguguuucaaacugu

SEQ ID NO: 3808614 - RNA, 21 nt, Human
gaauguguuucacaguuugaa

SEQ ID NO: 3808615 - RNA, 16 nt, Human
gaauguuaaagucagu

SEQ ID NO: 3808616 - RNA, 18 nt, Human
gaauguuaaauaaauugu

SEQ ID NO: 3808617 - RNA, 23 nt, Human
gaauguuaauuuuuugguacaaa

SEQ ID NO: 3808618 - RNA, 14 nt, Human
gaauguuagagcac

SEQ ID NO: 3808619 - RNA, 23 nt, Human
gaauguuagaguaaugaaaugga

SEQ ID NO: 3808620 - RNA, 19 nt, Human
gaauguucugacauuaaca

SEQ ID NO: 3808621 - RNA, 20 nt, Human
gaauguucugacauuaacag

SEQ ID NO: 3808622 - RNA, 18 nt, Human
gaauguugguuuacuuuc

SEQ ID NO: 3808623 - RNA, 15 nt, Human
gaauguuucauuugc

SEQ ID NO: 3808624 - RNA, 23 nt, Human
gaauguuucuuaacuauaaauau

SEQ ID NO: 3808625 - RNA, 15 nt, Human
gaauguuugccucug

SEQ ID NO: 3808626 - RNA, 16 nt, Human
gaauguuuuaaauucu

SEQ ID NO: 3808627 - RNA, 14 nt, Human
gaauguuuuucuaa

SEQ ID NO: 3808628 - RNA, 14 nt, Human
gaauuaaaaaagca

SEQ ID NO: 3808629 - RNA, 12 nt, Human
gaauuaaaacuu

SEQ ID NO: 3808630 - RNA, 19 nt, Human
gaauuaaaacuucuuaaau

SEQ ID NO: 3808631 - RNA, 22 nt, Human
gaauuaaaacuucuuaaauauc

SEQ ID NO: 3808632 - RNA, 11 nt, Human
gaauuaaaagu

SEQ ID NO: 3808633 - RNA, 12 nt, Human
gaauuaaauaaa

SEQ ID NO: 3808634 - RNA, 20 nt, Human
gaauuaaauaaacccuuccu

SEQ ID NO: 3808635 - RNA, 21 nt, Human
gaauuaaauuaggaauaaaua

SEQ ID NO: 3808636 - RNA, 15 nt, Human
gaauuaacacaugau

SEQ ID NO: 3808637 - RNA, 15 nt, Human
gaauuaaccuggugc

SEQ ID NO: 3808638 - RNA, 17 nt, Human
gaauuaagauacaaauu

SEQ ID NO: 3808639 - RNA, 15 nt, Human
gaauuaauagcuuuu

SEQ ID NO: 3808640 - RNA, 21 nt, Human
gaauuaauaucccuacaugua

SEQ ID NO: 3808641 - RNA, 22 nt, Human
gaauuaccuuagauuagcucug

SEQ ID NO: 3808642 - RNA, 15 nt, Human
gaauuacgugcucug

SEQ ID NO: 3808643 - RNA, 14 nt, Human
gaauuacuaacuuc

SEQ ID NO: 3808644 - RNA, 13 nt, Human
gaauuauaacugu

SEQ ID NO: 3808645 - RNA, 18 nt, Human
gaauuauaauuaguuccu

SEQ ID NO: 3808646 - RNA, 15 nt, Human
gaauuaucagcaaag

SEQ ID NO: 3808647 - RNA, 16 nt, Human
gaauuaucagcaaaga

SEQ ID NO: 3808648 - RNA, 17 nt, Human
gaauuaucagcaaagaa

SEQ ID NO: 3808649 - RNA, 20 nt, Human
gaauuaucuugguugaaaau

SEQ ID NO: 3808650 - RNA, 14 nt, Human
gaauuaugaaacuu

SEQ ID NO: 3808651 - RNA, 19 nt, Human
gaauuauuacaguguuuau

SEQ ID NO: 3808652 - RNA, 12 nt, Human
gaauuauugaca

SEQ ID NO: 3808653 - RNA, 14 nt, Human
gaauuauugacacu

SEQ ID NO: 3808654 - RNA, 21 nt, Human
gaauuauuucugucacaguaa

SEQ ID NO: 3808655 - RNA, 18 nt, Human
gaauuauuuuaaaagaua

SEQ ID NO: 3808656 - RNA, 18 nt, Human
gaauucaaacuggggccu

SEQ ID NO: 3808657 - RNA, 22 nt, Human
gaauucaaacuggggccuccag

SEQ ID NO: 3808658 - RNA, 23 nt, Human
gaauucaaacuggggccuccaga

SEQ ID NO: 3808659 - RNA, 19 nt, Human
gaauucaccacagacuuua

SEQ ID NO: 3808660 - RNA, 16 nt, Human
gaauucagauuuuaaa

SEQ ID NO: 3808661 - RNA, 14 nt, Human
gaauucagcugccc

SEQ ID NO: 3808662 - RNA, 20 nt, Human
gaauucauucacucaacaaa

SEQ ID NO: 3808663 - RNA, 21 nt, Human
gaauucauucuggucucucua

SEQ ID NO: 3808664 - RNA, 15 nt, Human
gaauuccaaagcaaa

SEQ ID NO: 3808665 - RNA, 12 nt, Human
gaauuccaagga

SEQ ID NO: 3808666 - RNA, 16 nt, Human
gaauuccaaggaguuc

SEQ ID NO: 3808667 - RNA, 17 nt, Human
gaauuccauuugaggau

SEQ ID NO: 3808668 - RNA, 20 nt, Human
gaauucccucacucgucucc

SEQ ID NO: 3808669 - RNA, 21 nt, Human
gaauucccucacucgucuccc

SEQ ID NO: 3808670 - RNA, 18 nt, Human
gaauuccuaacuuuucaa

SEQ ID NO: 3808671 - RNA, 14 nt, Human
gaauucuagugcug

SEQ ID NO: 3808672 - RNA, 15 nt, Human
gaauucuauuugcug

SEQ ID NO: 3808673 - RNA, 17 nt, Human
gaauucucuaguuugau

SEQ ID NO: 3808674 - RNA, 20 nt, Human
cuaugugauuuuaacucugu

SEQ ID NO: 3808675 - RNA, 22 nt, Human
cuaugugauuuuaacucugucu

SEQ ID NO: 3808676 - RNA, 19 nt, Human
cuauguggaaguggggcgg

SEQ ID NO: 3808677 - RNA, 19 nt, Human
cuauguggauuuuuuccua

SEQ ID NO: 3808678 - RNA, 14 nt, Human
cuaugugugugcuu

SEQ ID NO: 3808679 - RNA, 14 nt, Human
cuauguguuuuucu

SEQ ID NO: 3808680 - RNA, 22 nt, Human
cuauguguuuuucucauauuug

SEQ ID NO: 3808681 - RNA, 21 nt, Human
cuauguuaauauuuuaggugu

SEQ ID NO: 3808682 - RNA, 16 nt, Human
cuauguuacuauuuuc

SEQ ID NO: 3808683 - RNA, 18 nt, Human
cuauguuacuauuuucua

SEQ ID NO: 3808684 - RNA, 22 nt, Human
cuauguuacuauuuucuacaau

SEQ ID NO: 3808685 - RNA, 16 nt, Human
cuauguugcccaggca

SEQ ID NO: 3808686 - RNA, 22 nt, Human
cuauguugcccaggcaggucuu

SEQ ID NO: 3808687 - RNA, 18 nt, Human
cuauguugugguccauca

SEQ ID NO: 3808688 - RNA, 20 nt, Human
cuauguuuacaaauggacau

SEQ ID NO: 3808689 - RNA, 11 nt, Human
cuauguuuacu

SEQ ID NO: 3808690 - RNA, 14 nt, Human
cuauguuucaucuu

SEQ ID NO: 3808691 - RNA, 13 nt, Human
cuauguuuuacca

SEQ ID NO: 3808692 - RNA, 22 nt, Human
cuauguuuuuguucaaagccag

SEQ ID NO: 3808693 - RNA, 13 nt, Human
cuauuaaaacuca

SEQ ID NO: 3808694 - RNA, 14 nt, Human
cuauuaaaagacuc

SEQ ID NO: 3808695 - RNA, 15 nt, Human
cuauuaaaagacuca

SEQ ID NO: 3808696 - RNA, 21 nt, Human
cuauuaaacaugcuguacaua

SEQ ID NO: 3808697 - RNA, 15 nt, Human
cuauuaaaggaauaa

SEQ ID NO: 3808698 - RNA, 21 nt, Human
cuauuaaagugcuaagguucu

SEQ ID NO: 3808699 - RNA, 23 nt, Human
cuauuaaagugcuaagguucuaa

SEQ ID NO: 3808700 - RNA, 22 nt, Human
cuauuaaauaguuauauaauuc

SEQ ID NO: 3808701 - RNA, 20 nt, Human
cuauuaacaauuaauugucu

SEQ ID NO: 3808702 - RNA, 23 nt, Human
cuauuaagauuuccaagugccaa

SEQ ID NO: 3808703 - RNA, 16 nt, Human
cuauuaagcaguaaaa

SEQ ID NO: 3808704 - RNA, 20 nt, Human
cuauuaagcaguaaaaacug

SEQ ID NO: 3808705 - RNA, 21 nt, Human
cuauuaagcaguaaaaacugu

SEQ ID NO: 3808706 - RNA, 21 nt, Human
cuauuaaggugauauauuuaa

SEQ ID NO: 3808707 - RNA, 14 nt, Human
cuauuaauauaugu

SEQ ID NO: 3808708 - RNA, 12 nt, Human
cuauuaauauuu

SEQ ID NO: 3808709 - RNA, 13 nt, Human
cuauuaauauuug

SEQ ID NO: 3808710 - RNA, 17 nt, Human
cuauuacauuuucagug

SEQ ID NO: 3808711 - RNA, 18 nt, Human
cuauuacgaaguucaaga

SEQ ID NO: 3808712 - RNA, 23 nt, Human
cuauuacgaaguucaagaucaaa

SEQ ID NO: 3808713 - RNA, 23 nt, Human
cuauuacugucugguuuuaacaa

SEQ ID NO: 3808714 - RNA, 14 nt, Human
cuauuaguguuaua

SEQ ID NO: 3808715 - RNA, 18 nt, Human
cuauuaguguuauaugaa

SEQ ID NO: 3808716 - RNA, 21 nt, Human
cuauuauaauuuaaugcaugu

SEQ ID NO: 3808717 - RNA, 18 nt, Human
cuauuauagccacauccc

SEQ ID NO: 3808718 - RNA, 19 nt, Human
cuauuaucugucagcugca

SEQ ID NO: 3808719 - RNA, 15 nt, Human
cuauuauggaaaacu

SEQ ID NO: 3808720 - RNA, 18 nt, Human
cuauuauggaaaacugug

SEQ ID NO: 3808721 - RNA, 22 nt, Human
cuauucaagguggccaaauuau

SEQ ID NO: 3808722 - RNA, 13 nt, Human
cuauucagacaag

SEQ ID NO: 3808723 - RNA, 23 nt, Human
cuauucaguaauaacucuacccu

SEQ ID NO: 3808724 - RNA, 19 nt, Human
cuauucaguggcgagaaau

SEQ ID NO: 3808725 - RNA, 18 nt, Human
cuauucaguucccagaau

SEQ ID NO: 3808726 - RNA, 21 nt, Human
cuauucaguucccagaaucaa

SEQ ID NO: 3808727 - RNA, 11 nt, Human
cuauucaguug

SEQ ID NO: 3808728 - RNA, 12 nt, Human
cuauuccaauaa

SEQ ID NO: 3808729 - RNA, 23 nt, Human
cuauuccagcucauucauuuuau

SEQ ID NO: 3808730 - RNA, 23 nt, Human
cuauuccccacccuccccuuccc

SEQ ID NO: 3808731 - RNA, 17 nt, Human
cuauuccgagcccuuag

SEQ ID NO: 3808732 - RNA, 17 nt, Human
cuauuccuguaaugaaa

SEQ ID NO: 3808733 - RNA, 12 nt, Human
cuauuccuuucc

SEQ ID NO: 3808734 - RNA, 16 nt, Human
cuauuccuuucccuuc

SEQ ID NO: 3808735 - RNA, 17 nt, Human
cuauucgaaugaaaaga

SEQ ID NO: 3808736 - RNA, 21 nt, Human
cuauucgccacacaguauuuu

SEQ ID NO: 3808737 - RNA, 23 nt, Human
cuauucuagccugcauugagcuu

SEQ ID NO: 3808738 - RNA, 21 nt, Human
cuauucucuccaaaaaugcac

SEQ ID NO: 3808739 - RNA, 14 nt, Human
cuauucucuccuca

SEQ ID NO: 3808740 - RNA, 12 nt, Human
cuauucucucuu

SEQ ID NO: 3808741 - RNA, 14 nt, Human
cuauucugucccua

SEQ ID NO: 3808742 - RNA, 20 nt, Human
cuauucuugauguaaaaucu

SEQ ID NO: 3808743 - RNA, 17 nt, Human
cuauugacaagucauuu

SEQ ID NO: 3808744 - RNA, 14 nt, Human
cuauugacaauaaa

SEQ ID NO: 3808745 - RNA, 18 nt, Human
cuauugacaauaaaauau

SEQ ID NO: 3808746 - RNA, 22 nt, Human
cuauugacaucagcaucaccua

SEQ ID NO: 3808747 - RNA, 16 nt, Human
cuauugacuucaauga

SEQ ID NO: 3808748 - RNA, 18 nt, Human
cuauugauacucuuucua

SEQ ID NO: 3808749 - RNA, 21 nt, Human
cuauugauauaaauaaaacau

SEQ ID NO: 3808750 - RNA, 17 nt, Human
cuauugauguacagucu

SEQ ID NO: 3808751 - RNA, 21 nt, Human
cuauugcaaagguuccaacug

SEQ ID NO: 3808752 - RNA, 20 nt, Human
cuauugcagcaauuaaaaau

SEQ ID NO: 3808753 - RNA, 17 nt, Human
cuauugcagcugggaga

SEQ ID NO: 3808754 - RNA, 17 nt, Human
cuauugccucugagagc

SEQ ID NO: 3808755 - RNA, 13 nt, Human
cuauuguaaauau

SEQ ID NO: 3808756 - RNA, 20 nt, Human
cuauuguaagauaaaaaagc

SEQ ID NO: 3808757 - RNA, 16 nt, Human
cuauuguagcauuucu

SEQ ID NO: 3808758 - RNA, 13 nt, Human
cuauugugauuug

SEQ ID NO: 3808759 - RNA, 18 nt, Human
cuauugugauuugacugu

SEQ ID NO: 3808760 - RNA, 22 nt, Human
cuauuguuuauucuuuuuaaag

SEQ ID NO: 3808761 - RNA, 21 nt, Human
cuauuguuucuuuaagaaagu

SEQ ID NO: 3808762 - RNA, 15 nt, Human
cuauuuaaaaaagag

SEQ ID NO: 3808763 - RNA, 15 nt, Human
cuauuuaaauucuuu

SEQ ID NO: 3808764 - RNA, 15 nt, Human
cuauuuaacuugagg

SEQ ID NO: 3808765 - RNA, 14 nt, Human
cuauuuaagaugug

SEQ ID NO: 3808766 - RNA, 12 nt, Human
cuauuuaauuuu

SEQ ID NO: 3808767 - RNA, 13 nt, Human
cuauuuagcauga

SEQ ID NO: 3808768 - RNA, 18 nt, Human
cuauuuagcaugacaagc

SEQ ID NO: 3808769 - RNA, 17 nt, Human
cuauuuaguuuuuguaa

SEQ ID NO: 3808770 - RNA, 16 nt, Human
cuauuuaucuguguuu

SEQ ID NO: 3808771 - RNA, 20 nt, Human
cuauuuaugccuugaugauu

SEQ ID NO: 3808772 - RNA, 22 nt, Human
cuauuuaugugauccuuuugga

SEQ ID NO: 3808773 - RNA, 22 nt, Human
cuauuuauuaaguucucaaugu

SEQ ID NO: 3808774 - RNA, 21 nt, Human
cuauuuauuaauauuuaacau

SEQ ID NO: 3808775 - RNA, 19 nt, Human
cuauuuauugacucugggu

SEQ ID NO: 3808776 - RNA, 14 nt, Human
cuauuuauuuacaa

SEQ ID NO: 3808777 - RNA, 15 nt, Human
cuauuuauuuacaaa

SEQ ID NO: 3808778 - RNA, 15 nt, Human
cuauuuauuuacuga

SEQ ID NO: 3808779 - RNA, 18 nt, Human
cuauuuauuuacugagcu

SEQ ID NO: 3808780 - RNA, 16 nt, Human
cuauuuauuuuccuaa

SEQ ID NO: 3808781 - RNA, 19 nt, Human
cuauuuauuuuccuaaaga

SEQ ID NO: 3808782 - RNA, 14 nt, Human
cuauuuauuuuuac

SEQ ID NO: 3808783 - RNA, 14 nt, Human
cuauuucacuggag

SEQ ID NO: 3808784 - RNA, 16 nt, Human
cuauuucagugccaau

SEQ ID NO: 3808785 - RNA, 22 nt, Human
cuauuuccccaggggaaaauga

SEQ ID NO: 3808786 - RNA, 18 nt, Human
cuauuucccccuuucuuc

SEQ ID NO: 3808787 - RNA, 21 nt, Human
cuauuucccccuuucuuccuc

SEQ ID NO: 3808788 - RNA, 16 nt, Human
cuauuucuauauuuuc

SEQ ID NO: 3808789 - RNA, 18 nt, Human
cuauuucuauauuuucau

SEQ ID NO: 3808790 - RNA, 15 nt, Human
cuauuucuccuccau

SEQ ID NO: 3808791 - RNA, 16 nt, Human
cuauuucuccuccaug

SEQ ID NO: 3808792 - RNA, 22 nt, Human
cuauuucugggucuuuugcuac

SEQ ID NO: 3808793 - RNA, 11 nt, Human
cuauuucuuga

SEQ ID NO: 3808794 - RNA, 19 nt, Human
cuauuugaaaugaauuccu

SEQ ID NO: 3808795 - RNA, 22 nt, Human
cuauuugccaugggcuucacug

SEQ ID NO: 3808796 - RNA, 18 nt, Human
cuauuugcuuauuuaaua

SEQ ID NO: 3808797 - RNA, 22 nt, Human
cuauuuguauauauacauaaca

SEQ ID NO: 3808798 - RNA, 22 nt, Human
cuauuuguugaugcuuguguca

SEQ ID NO: 3808799 - RNA, 23 nt, Human
cuauuuguuuucuucuguauguu

SEQ ID NO: 3808800 - RNA, 14 nt, Human
cuauuuuaaaauaa

SEQ ID NO: 3808801 - RNA, 22 nt, Human
cuauuuuaaaauaaauuaguug

SEQ ID NO: 3808802 - RNA, 15 nt, Human
cuauuuuacugucuu

SEQ ID NO: 3808803 - RNA, 17 nt, Human
cuauuuuacugucuuaa

SEQ ID NO: 3808804 - RNA, 21 nt, Human
cuauuuuacugucuuaauuaa

SEQ ID NO: 3808805 - RNA, 12 nt, Human
cuauuuucagaa

SEQ ID NO: 3808806 - RNA, 14 nt, Human
cuauuuucagaauc

SEQ ID NO: 3808807 - RNA, 15 nt, Human
cuauuuucagaaucu

SEQ ID NO: 3808808 - RNA, 22 nt, Human
cuauuuucagaugugaaccauu

SEQ ID NO: 3808809 - RNA, 21 nt, Human
cuauuuuccaggcuucugcug

SEQ ID NO: 3808810 - RNA, 16 nt, Human
cuauuuucucugauac

SEQ ID NO: 3808811 - RNA, 17 nt, Human
cuauuuucucugauacu

SEQ ID NO: 3808812 - RNA, 18 nt, Human
cuauuuugaaaaauuccu

SEQ ID NO: 3808813 - RNA, 12 nt, Human
cuauuuugaagu

SEQ ID NO: 3808814 - RNA, 15 nt, Human
cuauuuugaugcagc

SEQ ID NO: 3808815 - RNA, 19 nt, Human
cuauuuuguaaacucaaaa

SEQ ID NO: 3808816 - RNA, 14 nt, Human
cuauuuuuaaauaa

SEQ ID NO: 3808817 - RNA, 23 nt, Human
cuauuuuuaaauaauuuccuaca

SEQ ID NO: 3808818 - RNA, 20 nt, Human
cuauuuuuacuaaucuuucu

SEQ ID NO: 3808819 - RNA, 14 nt, Human
cuauuuuucagaau

SEQ ID NO: 3808820 - RNA, 17 nt, Human
cuauuuuucauccuaaa

SEQ ID NO: 3808821 - RNA, 12 nt, Human
cuauuuuucuaa

SEQ ID NO: 3808822 - RNA, 20 nt, Human
cuauuuuucuaacuacaaag

SEQ ID NO: 3808823 - RNA, 21 nt, Human
gaagggcuuggacucaagcaa

SEQ ID NO: 3808824 - RNA, 23 nt, Human
gaaggggcccugguccuuccagg

SEQ ID NO: 3808825 - RNA, 20 nt, Human
gaagggggccaugaggccuc

SEQ ID NO: 3808826 - RNA, 22 nt, Human
gaagggggccaugaggccucag

SEQ ID NO: 3808827 - RNA, 16 nt, Human
gaagggggcugggaca

SEQ ID NO: 3808828 - RNA, 23 nt, Human
gaagggggguugcaguggagagg

SEQ ID NO: 3808829 - RNA, 17 nt, Human
gaagggggucaaagcaa

SEQ ID NO: 3808830 - RNA, 17 nt, Human
gaagggguuggauugca

SEQ ID NO: 3808831 - RNA, 17 nt, Human
gaaggguaaacaauaua

SEQ ID NO: 3808832 - RNA, 14 nt, Human
gaaggguccuuccc

SEQ ID NO: 3808833 - RNA, 21 nt, Human
gaaggguuuguggcugggggc

SEQ ID NO: 3808834 - RNA, 20 nt, Human
gaagguacugucaugggcua

SEQ ID NO: 3808835 - RNA, 16 nt, Human
gaagguagaauguuuu

SEQ ID NO: 3808836 - RNA, 18 nt, Human
gaaggucggaggcuuggg

SEQ ID NO: 3808837 - RNA, 21 nt, Human
gaaggugaggagcuugaaacc

SEQ ID NO: 3808838 - RNA, 17 nt, Human
gaaggugauaagggaaa

SEQ ID NO: 3808839 - RNA, 17 nt, Human
gaaggugcuggaggugg

SEQ ID NO: 3808840 - RNA, 22 nt, Human
gaaggugucuggacauucagaa

SEQ ID NO: 3808841 - RNA, 22 nt, Human
gaagguuggugaauuucacaag

SEQ ID NO: 3808842 - RNA, 20 nt, Human
gaagguuuacaauuuacaaa

SEQ ID NO: 3808843 - RNA, 16 nt, Human
gaagguuuguauauug

SEQ ID NO: 3808844 - RNA, 13 nt, Human
gaagguuuuaagu

SEQ ID NO: 3808845 - RNA, 14 nt, Human
gaagguuuuugaua

SEQ ID NO: 3808846 - RNA, 19 nt, Human
gaaguaaaagcaaaaaaga

SEQ ID NO: 3808847 - RNA, 15 nt, Human
gaaguaaagaacugc

SEQ ID NO: 3808848 - RNA, 14 nt, Human
gaaguaacuacagu

SEQ ID NO: 3808849 - RNA, 18 nt, Human
gaaguaacuggugauaua

SEQ ID NO: 3808850 - RNA, 19 nt, Human
gaaguaauaugcacacauu

SEQ ID NO: 3808851 - RNA, 22 nt, Human
gaaguaauaugcacacauuuuu

SEQ ID NO: 3808852 - RNA, 16 nt, Human
gaaguacaugaauaca

SEQ ID NO: 3808853 - RNA, 13 nt, Human
gaaguaccagacu

SEQ ID NO: 3808854 - RNA, 19 nt, Human
gaaguacuugccagaaguu

SEQ ID NO: 3808855 - RNA, 13 nt, Human
gaaguaggaagua

SEQ ID NO: 3808856 - RNA, 23 nt, Human
gaaguaggaagugaaaauaggua

SEQ ID NO: 3808857 - RNA, 18 nt, Human
gaaguagggguggcccga

SEQ ID NO: 3808858 - RNA, 23 nt, Human
gaaguagugucuggaucaguaaa

SEQ ID NO: 3808859 - RNA, 18 nt, Human
gaaguaguuaucauguua

SEQ ID NO: 3808860 - RNA, 15 nt, Human
gaaguaguucuguuu

SEQ ID NO: 3808861 - RNA, 14 nt, Human
gaaguauaaagaau

SEQ ID NO: 3808862 - RNA, 14 nt, Human
gaaguauaccugau

SEQ ID NO: 3808863 - RNA, 12 nt, Human
gaaguaugggaa

SEQ ID NO: 3808864 - RNA, 20 nt, Human
gaaguauuauaaauuauguu

SEQ ID NO: 3808865 - RNA, 19 nt, Human
gaaguauuuuuagaauaag

SEQ ID NO: 3808866 - RNA, 21 nt, Human
gaaguauuuuuucaguauuau

SEQ ID NO: 3808867 - RNA, 16 nt, Human
gaagucaaagcaagga

SEQ ID NO: 3808868 - RNA, 16 nt, Human
gaagucaagcucaaca

SEQ ID NO: 3808869 - RNA, 13 nt, Human
gaagucacacagu

SEQ ID NO: 3808870 - RNA, 13 nt, Human
gaagucacagggc

SEQ ID NO: 3808871 - RNA, 18 nt, Human
gaagucacucaauuguuu

SEQ ID NO: 3808872 - RNA, 20 nt, Human
gaagucacucaauuguuuuu

SEQ ID NO: 3808873 - RNA, 13 nt, Human
gaagucagagagg

SEQ ID NO: 3808874 - RNA, 22 nt, Human
gaagucagaucugccuaaggac

SEQ ID NO: 3808875 - RNA, 23 nt, Human
gaagucagaucugccuaaggacu

SEQ ID NO: 3808876 - RNA, 12 nt, Human
gaagucauaugu

SEQ ID NO: 3808877 - RNA, 15 nt, Human
gaagucaucuugcua

SEQ ID NO: 3808878 - RNA, 14 nt, Human
gaaguccaaugugg

SEQ ID NO: 3808879 - RNA, 17 nt, Human
gaaguccccaggcccca

SEQ ID NO: 3808880 - RNA, 18 nt, Human
gaaguccccucuccucca

SEQ ID NO: 3808881 - RNA, 23 nt, Human
gaaguccccucuccuccacauuu

SEQ ID NO: 3808882 - RNA, 18 nt, Human
gaaguccuauggaaaccc

SEQ ID NO: 3808883 - RNA, 24 nt, Human
gaagucguccuuacuccuguggga

SEQ ID NO: 3808884 - RNA, 20 nt, Human
gaagucuaggagcugggagg

SEQ ID NO: 3808885 - RNA, 13 nt, Human
gaagucucagcua

SEQ ID NO: 3808886 - RNA, 18 nt, Human
gaagucucaucuggggag

SEQ ID NO: 3808887 - RNA, 15 nt, Human
gaagucucuuuucuu

SEQ ID NO: 3808888 - RNA, 23 nt, Human
gaagucucuuuuuuuggcccagg

SEQ ID NO: 3808889 - RNA, 11 nt, Human
gaagucugaaa

SEQ ID NO: 3808890 - RNA, 17 nt, Human
gaagucuucuauuuauu

SEQ ID NO: 3808891 - RNA, 11 nt, Human
gaagucuugua

SEQ ID NO: 3808892 - RNA, 12 nt, Human
gaagucuuguau

SEQ ID NO: 3808893 - RNA, 17 nt, Human
gaagucuuucaagaaug

SEQ ID NO: 3808894 - RNA, 18 nt, Human
gaagugacaaggccccag

SEQ ID NO: 3808895 - RNA, 21 nt, Human
gaagugacaaggccccagaga

SEQ ID NO: 3808896 - RNA, 24 nt, Human
gaagugacaaggccccagagacuc

SEQ ID NO: 3808897 - RNA, 12 nt, Human
gaagugacaggg

SEQ ID NO: 3808898 - RNA, 21 nt, Human
gaagugacagggaagcuacag

SEQ ID NO: 3808899 - RNA, 22 nt, Human
gaagugacagggaagcuacagg

SEQ ID NO: 3808900 - RNA, 16 nt, Human
gaagugaccaaggagg

SEQ ID NO: 3808901 - RNA, 22 nt, Human
gaagugacgguuccuacacagg

SEQ ID NO: 3808902 - RNA, 15 nt, Human
gaagugacuuuggcu

SEQ ID NO: 3808903 - RNA, 22 nt, Human
gaagugauacuauccaguuacu

SEQ ID NO: 3808904 - RNA, 18 nt, Human
gaagugcaaauuugauac

SEQ ID NO: 3808905 - RNA, 17 nt, Human
gaagugcagaacugcag

SEQ ID NO: 3808906 - RNA, 20 nt, Human
gaagugcagaacugcaguca

SEQ ID NO: 3808907 - RNA, 14 nt, Human
gaagugcauuucug

SEQ ID NO: 3808908 - RNA, 16 nt, Human
gaagugcccccucccc

SEQ ID NO: 3808909 - RNA, 15 nt, Human
gaagugccccugcug

SEQ ID NO: 3808910 - RNA, 18 nt, Human
gaagugccccugcugccu

SEQ ID NO: 3808911 - RNA, 23 nt, Human
gaagugccccugcugccucccca

SEQ ID NO: 3808912 - RNA, 20 nt, Human
gaagugcuccccucugaaag

SEQ ID NO: 3808913 - RNA, 12 nt, Human
gaaguggaaugg

SEQ ID NO: 3808914 - RNA, 17 nt, Human
gaaguggacuggccccu

SEQ ID NO: 3808915 - RNA, 18 nt, Human
gaagugggccaggacagg

SEQ ID NO: 3808916 - RNA, 14 nt, Human
gaagugguccaucu

SEQ ID NO: 3808917 - RNA, 15 nt, Human
gaaguguaacagcug

SEQ ID NO: 3808918 - RNA, 20 nt, Human
gaaguguccgagaacuaaag

SEQ ID NO: 3808919 - RNA, 13 nt, Human
gaaguguggggau

SEQ ID NO: 3808920 - RNA, 18 nt, Human
gaagugugggucugugug

SEQ ID NO: 3808921 - RNA, 20 nt, Human
gaaguuaaaagcacaaagga

SEQ ID NO: 3808922 - RNA, 21 nt, Human
gaaguuaaagggaagaaaaca

SEQ ID NO: 3808923 - RNA, 23 nt, Human
gaaguuacacagaaaugcugcug

SEQ ID NO: 3808924 - RNA, 18 nt, Human
gaaguuacuguuauagag

SEQ ID NO: 3808925 - RNA, 20 nt, Human
gaaguuacuuuauguuuguc

SEQ ID NO: 3808926 - RNA, 20 nt, Human
gaaguuacuuucuuaaugug

SEQ ID NO: 3808927 - RNA, 13 nt, Human
gaaguuagaauuc

SEQ ID NO: 3808928 - RNA, 18 nt, Human
gaaguuagccuuuaucua

SEQ ID NO: 3808929 - RNA, 22 nt, Human
gaaguuagguucuuaaaagugc

SEQ ID NO: 3808930 - RNA, 15 nt, Human
gaaguuaguuuguau

SEQ ID NO: 3808931 - RNA, 20 nt, Human
gaaguuauguguaugugagu

SEQ ID NO: 3808932 - RNA, 14 nt, Human
gaaguuauuuucca

SEQ ID NO: 3808933 - RNA, 23 nt, Human
gaaguucauaccuaaguacugua

SEQ ID NO: 3808934 - RNA, 16 nt, Human
gaaguucuauuuauuu

SEQ ID NO: 3808935 - RNA, 23 nt, Human
gaaguugacuuauaguacaugau

SEQ ID NO: 3808936 - RNA, 17 nt, Human
gaaguugcagugagcug

SEQ ID NO: 3808937 - RNA, 23 nt, Human
gaaguuggacagcaaaaccauug

SEQ ID NO: 3808938 - RNA, 21 nt, Human
gaaguuguuacuaacuaaacu

SEQ ID NO: 3808939 - RNA, 22 nt, Human
gaaguuguuacuaacuaaacuc

SEQ ID NO: 3808940 - RNA, 18 nt, Human
gaaguuuaauugacuuau

SEQ ID NO: 3808941 - RNA, 17 nt, Human
gaaguuuacauuguaaa

SEQ ID NO: 3808942 - RNA, 21 nt, Human
gaaguuuacauuuuuauuuau

SEQ ID NO: 3808943 - RNA, 22 nt, Human
gaaguuuacauuuuuauuuaug

SEQ ID NO: 3808944 - RNA, 14 nt, Human
gaaguuucacauga

SEQ ID NO: 3808945 - RNA, 14 nt, Human
gaaguuucauuuau

SEQ ID NO: 3808946 - RNA, 21 nt, Human
gaaguuucauuuaugauacaa

SEQ ID NO: 3808947 - RNA, 21 nt, Human
gaaguuucugccgcagcccug

SEQ ID NO: 3808948 - RNA, 15 nt, Human
gaaguuugauaaaua

SEQ ID NO: 3808949 - RNA, 16 nt, Human
gaaguuuguccauuug

SEQ ID NO: 3808950 - RNA, 13 nt, Human
gaaguuuuacauu

SEQ ID NO: 3808951 - RNA, 12 nt, Human
gaaguuuuccua

SEQ ID NO: 3808952 - RNA, 14 nt, Human
gaaguuuuuguacu

SEQ ID NO: 3808953 - RNA, 16 nt, Human
gaauaaaaauuccaga

SEQ ID NO: 3808954 - RNA, 21 nt, Human
gaauaaaaggcuugaagcugu

SEQ ID NO: 3808955 - RNA, 12 nt, Human
gaauaaaagugc

SEQ ID NO: 3808956 - RNA, 23 nt, Human
gaauaaaauacuauuuuuacugc

SEQ ID NO: 3808957 - RNA, 20 nt, Human
gaauaaaauccuaagacaca

SEQ ID NO: 3808958 - RNA, 22 nt, Human
gaauaaaauuguaaaauuguau

SEQ ID NO: 3808959 - RNA, 16 nt, Human
gaauaaacuagauuac

SEQ ID NO: 3808960 - RNA, 14 nt, Human
gaauaaacuucagc

SEQ ID NO: 3808961 - RNA, 15 nt, Human
gaauaaagaauacuu

SEQ ID NO: 3808962 - RNA, 17 nt, Human
gaauaaagaauacuuga

SEQ ID NO: 3808963 - RNA, 19 nt, Human
gaauaaagaauacuugaac

SEQ ID NO: 3808964 - RNA, 12 nt, Human
gaauaaagcaau

SEQ ID NO: 3808965 - RNA, 13 nt, Human
gaauaaagcaauu

SEQ ID NO: 3808966 - RNA, 21 nt, Human
gaauaaagcaauuuuccuuga

SEQ ID NO: 3808967 - RNA, 17 nt, Human
gaauaaagccugcuuuu

SEQ ID NO: 3808968 - RNA, 14 nt, Human
gaauaaaggcagcu

SEQ ID NO: 3808969 - RNA, 16 nt, Human
gaauaaaggcaguuuu

SEQ ID NO: 3808970 - RNA, 19 nt, Human
gaauaaaggcaguuuucua

SEQ ID NO: 3808971 - RNA, 14 nt, Human
gaauaaaguugaag

SEQ ID NO: 3808972 - RNA, 15 nt, Human
gaauucugauugauu

SEQ ID NO: 3808973 - RNA, 19 nt, Human
gaauucugcuaccucacug

SEQ ID NO: 3808974 - RNA, 14 nt, Human
gaauucuguucauu

SEQ ID NO: 3808975 - RNA, 18 nt, Human
gaauucuuacauguuuuc

SEQ ID NO: 3808976 - RNA, 21 nt, Human
gaauucuuaugcuuauaauau

SEQ ID NO: 3808977 - RNA, 23 nt, Human
gaauucuugaaggaaaaugauac

SEQ ID NO: 3808978 - RNA, 19 nt, Human
gaauucuuuaaaauuacaa

SEQ ID NO: 3808979 - RNA, 14 nt, Human
gaauugaaaaacca

SEQ ID NO: 3808980 - RNA, 22 nt, Human
gaauugaaaaguuuuuguuugg

SEQ ID NO: 3808981 - RNA, 13 nt, Human
gaauugaaacacu

SEQ ID NO: 3808982 - RNA, 15 nt, Human
gaauugaacccagga

SEQ ID NO: 3808983 - RNA, 22 nt, Human
gaauugaaucgcugcgauacug

SEQ ID NO: 3808984 - RNA, 16 nt, Human
gaauugacccacaaga

SEQ ID NO: 3808985 - RNA, 16 nt, Human
gaauugagcugcagaa

SEQ ID NO: 3808986 - RNA, 15 nt, Human
gaauugaguguuuaa

SEQ ID NO: 3808987 - RNA, 20 nt, Human
gaauugauuucccuucuucu

SEQ ID NO: 3808988 - RNA, 23 nt, Human
gaauugauuuugaggagugguuu

SEQ ID NO: 3808989 - RNA, 14 nt, Human
gaauugcagaguac

SEQ ID NO: 3808990 - RNA, 16 nt, Human
gaauugccugcagaga

SEQ ID NO: 3808991 - RNA, 16 nt, Human
gaauuggagcucgugg

SEQ ID NO: 3808992 - RNA, 12 nt, Human
gaauuguacaga

SEQ ID NO: 3808993 - RNA, 14 nt, Human
gaauuguccccagu

SEQ ID NO: 3808994 - RNA, 12 nt, Human
gaauugugcaaa

SEQ ID NO: 3808995 - RNA, 16 nt, Human
gaauugugcucaaaau

SEQ ID NO: 3808996 - RNA, 15 nt, Human
gaauuguguuuauaa

SEQ ID NO: 3808997 - RNA, 22 nt, Human
gaauuguugacaaauguaaaca

SEQ ID NO: 3808998 - RNA, 22 nt, Human
gaauuguugagauacuuuacua

SEQ ID NO: 3808999 - RNA, 9 nt, Human
gaauuguuu

SEQ ID NO: 3809000 - RNA, 20 nt, Human
gaauuguuuucuuuaaagau

SEQ ID NO: 3809001 - RNA, 20 nt, Human
gaauuuaaauauaauucugu

SEQ ID NO: 3809002 - RNA, 22 nt, Human
gaauuuaaauauaauucuguaa

SEQ ID NO: 3809003 - RNA, 23 nt, Human
gaauuuaaauauaauucuguaaa

SEQ ID NO: 3809004 - RNA, 18 nt, Human
gaauuuaacaaugcgaau

SEQ ID NO: 3809005 - RNA, 22 nt, Human
gaauuuaagccucaaauuugaa

SEQ ID NO: 3809006 - RNA, 16 nt, Human
gaauuuaauaaucugu

SEQ ID NO: 3809007 - RNA, 16 nt, Human
gaauuuagguuuuuau

SEQ ID NO: 3809008 - RNA, 17 nt, Human
gaauuuaguauuaucaa

SEQ ID NO: 3809009 - RNA, 18 nt, Human
gaauuuaguauuaucaaa

SEQ ID NO: 3809010 - RNA, 13 nt, Human
gaauuuauaauuc

SEQ ID NO: 3809011 - RNA, 18 nt, Human
gaauuuauaauucaguau

SEQ ID NO: 3809012 - RNA, 20 nt, Human
gaauuuaucacacuucugug

SEQ ID NO: 3809013 - RNA, 13 nt, Human
gaauuuauucaau

SEQ ID NO: 3809014 - RNA, 23 nt, Human
gaauuuauucaauuccucuggga

SEQ ID NO: 3809015 - RNA, 20 nt, Human
gaauuuauuggcuuuucuga

SEQ ID NO: 3809016 - RNA, 21 nt, Human
gaauuuauuggcuuuucugau

SEQ ID NO: 3809017 - RNA, 17 nt, Human
gaauuucaccuguaaac

SEQ ID NO: 3809018 - RNA, 21 nt, Human
gaauuucaccuguaaaccuga

SEQ ID NO: 3809019 - RNA, 16 nt, Human
gaauuucacugucuuu

SEQ ID NO: 3809020 - RNA, 16 nt, Human
gaauuucccaggaccc

SEQ ID NO: 3809021 - RNA, 17 nt, Human
gaauuucccaggacccu

SEQ ID NO: 3809022 - RNA, 14 nt, Human
gaauuucccucucu

SEQ ID NO: 3809023 - RNA, 21 nt, Human
gaauuuccucuauugauguac

SEQ ID NO: 3809024 - RNA, 13 nt, Human
gaauuucucuaca

SEQ ID NO: 3809025 - RNA, 15 nt, Human
gaauuucuuaacuuc

SEQ ID NO: 3809026 - RNA, 21 nt, Human
gaauuucuucaacucccugcc

SEQ ID NO: 3809027 - RNA, 12 nt, Human
gaauuucuuggu

SEQ ID NO: 3809028 - RNA, 21 nt, Human
gaauuucuugguaagaagccg

SEQ ID NO: 3809029 - RNA, 22 nt, Human
gaauuucuuuugccguuauuaa

SEQ ID NO: 3809030 - RNA, 16 nt, Human
gaauuugaaucucaau

SEQ ID NO: 3809031 - RNA, 17 nt, Human
gaauuugaaugaaaaau

SEQ ID NO: 3809032 - RNA, 20 nt, Human
gaauuugauaugugaacagu

SEQ ID NO: 3809033 - RNA, 14 nt, Human
gaauuugcaaagua

SEQ ID NO: 3809034 - RNA, 17 nt, Human
gaauuugcaaaguacug

SEQ ID NO: 3809035 - RNA, 18 nt, Human
gaauuugcaaaguacugu

SEQ ID NO: 3809036 - RNA, 14 nt, Human
gaauuugcccuggg

SEQ ID NO: 3809037 - RNA, 23 nt, Human
gaauuugcccugggaaaccccuu

SEQ ID NO: 3809038 - RNA, 14 nt, Human
gaauuugccugcug

SEQ ID NO: 3809039 - RNA, 13 nt, Human
gaauuuggaaauc

SEQ ID NO: 3809040 - RNA, 14 nt, Human
gaauuuggaaaucc

SEQ ID NO: 3809041 - RNA, 20 nt, Human
gaauuugggacccugcuuua

SEQ ID NO: 3809042 - RNA, 21 nt, Human
gaauuugggacccugcuuuag

SEQ ID NO: 3809043 - RNA, 18 nt, Human
gaauuuggggcuuccaag

SEQ ID NO: 3809044 - RNA, 20 nt, Human
gaauuuguaaugucuugagc

SEQ ID NO: 3809045 - RNA, 20 nt, Human
gaauuugugaagguggaaau

SEQ ID NO: 3809046 - RNA, 13 nt, Human
gaauuuuaaagua

SEQ ID NO: 3809047 - RNA, 13 nt, Human
gaauuuuaagccu

SEQ ID NO: 3809048 - RNA, 14 nt, Human
gaauuuuaggaacu

SEQ ID NO: 3809049 - RNA, 19 nt, Human
gaauuuuaggaacuucaga

SEQ ID NO: 3809050 - RNA, 22 nt, Human
gaauuuuauacuuucccuaccc

SEQ ID NO: 3809051 - RNA, 14 nt, Human
gaauuuucagaccc

SEQ ID NO: 3809052 - RNA, 23 nt, Human
gaauuuucagaccccagcggcug

SEQ ID NO: 3809053 - RNA, 11 nt, Human
gaauuuucauu

SEQ ID NO: 3809054 - RNA, 12 nt, Human
gaauuuucauuu

SEQ ID NO: 3809055 - RNA, 13 nt, Human
gaauuuucauuuu

SEQ ID NO: 3809056 - RNA, 15 nt, Human
gaauuuucuaaaagc

SEQ ID NO: 3809057 - RNA, 21 nt, Human
gaauuuugcaaagauuuaauc

SEQ ID NO: 3809058 - RNA, 13 nt, Human
gaauuuuguguua

SEQ ID NO: 3809059 - RNA, 19 nt, Human
gaauuuuguuuucuugauu

SEQ ID NO: 3809060 - RNA, 15 nt, Human
gaauuuuuaugugug

SEQ ID NO: 3809061 - RNA, 16 nt, Human
gaauuuuucauugaua

SEQ ID NO: 3809062 - RNA, 14 nt, Human
gaauuuuucucuaa

SEQ ID NO: 3809063 - RNA, 16 nt, Human
gaauuuuugcaauaau

SEQ ID NO: 3809064 - RNA, 20 nt, Human
gaauuuuugcaauaaugcag

SEQ ID NO: 3809065 - RNA, 23 nt, Human
gaauuuuugcuugacuucaguua

SEQ ID NO: 3809066 - RNA, 18 nt, Human
gaauuuuuuauucuugug

SEQ ID NO: 3809067 - RNA, 22 nt, Human
gaauuuuuuauucuugugaaua

SEQ ID NO: 3809068 - RNA, 16 nt, Human
gaauuuuuuucaucuu

SEQ ID NO: 3809069 - RNA, 13 nt, Human
gaauuuuuuugua

SEQ ID NO: 3809070 - RNA, 14 nt, Human
gaauuuuuuuguaa

SEQ ID NO: 3809071 - RNA, 20 nt, Human
gaauuuuuuuuaacauuccu

SEQ ID NO: 3809072 - RNA, 23 nt, Human
gaauuuuuuuuguuguuucagug

SEQ ID NO: 3809073 - RNA, 22 nt, Human
gaauuuuuuuuuccuagcccuc

SEQ ID NO: 3809074 - RNA, 18 nt, Human
gacaaaaacagccucaca

SEQ ID NO: 3809075 - RNA, 20 nt, Human
gacaaaaacagccucacaga

SEQ ID NO: 3809076 - RNA, 16 nt, Human
gacaaaaaguauauua

SEQ ID NO: 3809077 - RNA, 18 nt, Human
gacaaaaaguauauuaaa

SEQ ID NO: 3809078 - RNA, 13 nt, Human
gacaaaaauacuc

SEQ ID NO: 3809079 - RNA, 21 nt, Human
gacaaaaauacucuaauucua

SEQ ID NO: 3809080 - RNA, 21 nt, Human
gacaaaaaugaacugaaguuu

SEQ ID NO: 3809081 - RNA, 15 nt, Human
gacaaaacuagagac

SEQ ID NO: 3809082 - RNA, 21 nt, Human
gacaaaacuucuugucagaca

SEQ ID NO: 3809083 - RNA, 17 nt, Human
gacaaaagucugucuuu

SEQ ID NO: 3809084 - RNA, 15 nt, Human
gacaaaauggaauac

SEQ ID NO: 3809085 - RNA, 17 nt, Human
gacaaaauggauacaua

SEQ ID NO: 3809086 - RNA, 13 nt, Human
gacaaaauguuuu

SEQ ID NO: 3809087 - RNA, 16 nt, Human
gacaaacaccucccag

SEQ ID NO: 3809088 - RNA, 14 nt, Human
gacaaacagcucag

SEQ ID NO: 3809089 - RNA, 19 nt, Human
gacaaacugcauauguacu

SEQ ID NO: 3809090 - RNA, 13 nt, Human
gacaaagaaccuu

SEQ ID NO: 3809091 - RNA, 21 nt, Human
gacaaagaauuccaaagcaaa

SEQ ID NO: 3809092 - RNA, 20 nt, Human
gacaaagccaaacucugcca

SEQ ID NO: 3809093 - RNA, 18 nt, Human
gacaaagcugcuaaaucu

SEQ ID NO: 3809094 - RNA, 23 nt, Human
gacaaagcuuggaagagccugca

SEQ ID NO: 3809095 - RNA, 14 nt, Human
gacaaaggagccug

SEQ ID NO: 3809096 - RNA, 15 nt, Human
gacaaaggagccugu

SEQ ID NO: 3809097 - RNA, 17 nt, Human
gacaaagucuccagccc

SEQ ID NO: 3809098 - RNA, 17 nt, Human
gacaaagugccaaagaa

SEQ ID NO: 3809099 - RNA, 17 nt, Human
gacaaauacucaugugu

SEQ ID NO: 3809100 - RNA, 18 nt, Human
gacaaauacucaugugua

SEQ ID NO: 3809101 - RNA, 20 nt, Human
gacaaauacucauguguaug

SEQ ID NO: 3809102 - RNA, 17 nt, Human
gacaaauaguaggcaag

SEQ ID NO: 3809103 - RNA, 21 nt, Human
gacaaauaguaggcaagaugg

SEQ ID NO: 3809104 - RNA, 19 nt, Human
gacaaaucaacagaagcau

SEQ ID NO: 3809105 - RNA, 21 nt, Human
gacaaaucaacagaagcauuu

SEQ ID NO: 3809106 - RNA, 23 nt, Human
gacaaaucaacagaagcauuugu

SEQ ID NO: 3809107 - RNA, 17 nt, Human
gacaaaucaagcuucag

SEQ ID NO: 3809108 - RNA, 20 nt, Human
gacaaaucaaguuuccaagc

SEQ ID NO: 3809109 - RNA, 16 nt, Human
gacaaaucacauauuu

SEQ ID NO: 3809110 - RNA, 18 nt, Human
gacaaaucacauauuuua

SEQ ID NO: 3809111 - RNA, 15 nt, Human
gacaaaucugucugc

SEQ ID NO: 3809112 - RNA, 14 nt, Human
gacaaaucugugua

SEQ ID NO: 3809113 - RNA, 16 nt, Human
gacaaauguaaacauu

SEQ ID NO: 3809114 - RNA, 11 nt, Human
gacaaauguga

SEQ ID NO: 3809115 - RNA, 16 nt, Human
gacaaauugcacagaa

SEQ ID NO: 3809116 - RNA, 19 nt, Human
gacaacacugggaaacaga

SEQ ID NO: 3809117 - RNA, 22 nt, Human
gacaacagaagucaugaagccc

SEQ ID NO: 3809118 - RNA, 11 nt, Human
gacaacaucug

SEQ ID NO: 3809119 - RNA, 17 nt, Human
gacaaccacuggucugu

SEQ ID NO: 3809120 - RNA, 18 nt, Human
gacaaccauuaaagucag

SEQ ID NO: 3809121 - RNA, 20 nt, Human
gacaacccugcaaaggacug

SEQ ID NO: 3809122 - RNA, 22 nt, Human
cuauuuuuggcagucugaauuu

SEQ ID NO: 3809123 - RNA, 13 nt, Human
cuauuuuuguaaa

SEQ ID NO: 3809124 - RNA, 21 nt, Human
cuauuuuuguaaacuggaauu

SEQ ID NO: 3809125 - RNA, 19 nt, Human
cuauuuuuguaaaguuucc

SEQ ID NO: 3809126 - RNA, 15 nt, Human
cuauuuuuguuuuua

SEQ ID NO: 3809127 - RNA, 18 nt, Human
cuauuuuuuauuuuacuu

SEQ ID NO: 3809128 - RNA, 20 nt, Human
cuauuuuuuuaaaaucacua

SEQ ID NO: 3809129 - RNA, 20 nt, Human
cuauuuuuuuucuguuauau

SEQ ID NO: 3809130 - RNA, 20 nt, Human
cucaaaaauacaaaauaaaa

SEQ ID NO: 3809131 - RNA, 13 nt, Human
cucaaaacaaagg

SEQ ID NO: 3809132 - RNA, 19 nt, Human
cucaaaacccaucugggcu

SEQ ID NO: 3809133 - RNA, 22 nt, Human
cucaaaacccaucugggcuccu

SEQ ID NO: 3809134 - RNA, 16 nt, Human
cucaaaacuuaacaua

SEQ ID NO: 3809135 - RNA, 14 nt, Human
cucaaaagcauuua

SEQ ID NO: 3809136 - RNA, 18 nt, Human
cucaaaauaaagaaguau

SEQ ID NO: 3809137 - RNA, 13 nt, Human
cucaaaauauuug

SEQ ID NO: 3809138 - RNA, 12 nt, Human
cucaaaaugaca

SEQ ID NO: 3809139 - RNA, 16 nt, Human
cucaaaaugacagcca

SEQ ID NO: 3809140 - RNA, 13 nt, Human
cucaaaauuagau

SEQ ID NO: 3809141 - RNA, 15 nt, Human
cucaaacaaugacaa

SEQ ID NO: 3809142 - RNA, 14 nt, Human
cucaaacacagaga

SEQ ID NO: 3809143 - RNA, 21 nt, Human
cucaaacacaguuacacuugu

SEQ ID NO: 3809144 - RNA, 14 nt, Human
cucaaacacugcag

SEQ ID NO: 3809145 - RNA, 19 nt, Human
cucaaaccaaaucacugaa

SEQ ID NO: 3809146 - RNA, 20 nt, Human
cucaaaccuccaaaagcccu

SEQ ID NO: 3809147 - RNA, 13 nt, Human
cucaaaccuccuc

SEQ ID NO: 3809148 - RNA, 14 nt, Human
cucaaaccuccucu

SEQ ID NO: 3809149 - RNA, 15 nt, Human
cucaaaccuguuuaa

SEQ ID NO: 3809150 - RNA, 13 nt, Human
cucaaacguggcu

SEQ ID NO: 3809151 - RNA, 15 nt, Human
cucaaacguggcuuu

SEQ ID NO: 3809152 - RNA, 20 nt, Human
cucaaacuaaaagacauuug

SEQ ID NO: 3809153 - RNA, 21 nt, Human
cucaaacuaacaggcuuagug

SEQ ID NO: 3809154 - RNA, 17 nt, Human
cucaaacuccauucucc

SEQ ID NO: 3809155 - RNA, 19 nt, Human
cucaaacuccugaccucag

SEQ ID NO: 3809156 - RNA, 22 nt, Human
cucaaacugaggaauuucaccu

SEQ ID NO: 3809157 - RNA, 13 nt, Human
cucaaagaaagug

SEQ ID NO: 3809158 - RNA, 23 nt, Human
cucaaagaaaucuacuauauccc

SEQ ID NO: 3809159 - RNA, 19 nt, Human
cucaaagccccauuaacug

SEQ ID NO: 3809160 - RNA, 15 nt, Human
cucaaagucugcaac

SEQ ID NO: 3809161 - RNA, 15 nt, Human
cucaaaguuugacag

SEQ ID NO: 3809162 - RNA, 14 nt, Human
cucaaaguuuugaa

SEQ ID NO: 3809163 - RNA, 21 nt, Human
cucaaaguuuugaaaagcuau

SEQ ID NO: 3809164 - RNA, 21 nt, Human
cucaaauaaaaagugcuuuug

SEQ ID NO: 3809165 - RNA, 15 nt, Human
cucaaauacacauuu

SEQ ID NO: 3809166 - RNA, 16 nt, Human
cucaaauacacauuug

SEQ ID NO: 3809167 - RNA, 17 nt, Human
cucaaauacacauuugc

SEQ ID NO: 3809168 - RNA, 21 nt, Human
cucaaauaggcuauuaaaaaa

SEQ ID NO: 3809169 - RNA, 16 nt, Human
cucaaauccaggaccc

SEQ ID NO: 3809170 - RNA, 22 nt, Human
cucaaauccaggacccugccag

SEQ ID NO: 3809171 - RNA, 19 nt, Human
cucaaaucguccagcgacc

SEQ ID NO: 3809172 - RNA, 13 nt, Human
cucaaaucuauuc

SEQ ID NO: 3809173 - RNA, 16 nt, Human
cucaaaucuauucaga

SEQ ID NO: 3809174 - RNA, 15 nt, Human
cucaaaucugaggga

SEQ ID NO: 3809175 - RNA, 16 nt, Human
cucaaaugaguaacau

SEQ ID NO: 3809176 - RNA, 22 nt, Human
cucaaaugcggggugggggcag

SEQ ID NO: 3809177 - RNA, 22 nt, Human
cucaaaugcucagaccagcucu

SEQ ID NO: 3809178 - RNA, 17 nt, Human
cucaaauggggccagau

SEQ ID NO: 3809179 - RNA, 13 nt, Human
cucaaauguucua

SEQ ID NO: 3809180 - RNA, 19 nt, Human
cucaaauguucuaaguuuc

SEQ ID NO: 3809181 - RNA, 24 nt, Human
cucaaauguucuaaguuucuaaga

SEQ ID NO: 3809182 - RNA, 17 nt, Human
cucaaauugucagcaau

SEQ ID NO: 3809183 - RNA, 21 nt, Human
cucaaauuuuuugacuuuuuu

SEQ ID NO: 3809184 - RNA, 20 nt, Human
cucaacaaaagugcuuugga

SEQ ID NO: 3809185 - RNA, 14 nt, Human
cucaacacccaguu

SEQ ID NO: 3809186 - RNA, 22 nt, Human
cucaaccaaugccaaaaaaaga

SEQ ID NO: 3809187 - RNA, 22 nt, Human
cucaaccccaccauaugaauug

SEQ ID NO: 3809188 - RNA, 19 nt, Human
cucaaccccuccccuccau

SEQ ID NO: 3809189 - RNA, 16 nt, Human
cucaacccucccucag

SEQ ID NO: 3809190 - RNA, 18 nt, Human
cucaacccucccucagcc

SEQ ID NO: 3809191 - RNA, 19 nt, Human
cucaacccucccucagccc

SEQ ID NO: 3809192 - RNA, 12 nt, Human
cucaaccucauc

SEQ ID NO: 3809193 - RNA, 13 nt, Human
cucaaccucaucc

SEQ ID NO: 3809194 - RNA, 14 nt, Human
cucaaccuccugug

SEQ ID NO: 3809195 - RNA, 12 nt, Human
cucaaccucuuc

SEQ ID NO: 3809196 - RNA, 18 nt, Human
cucaaccuguaaauuauu

SEQ ID NO: 3809197 - RNA, 13 nt, Human
cucaaccugugau

SEQ ID NO: 3809198 - RNA, 18 nt, Human
cucaacguugcuccccau

SEQ ID NO: 3809199 - RNA, 15 nt, Human
cucaacuaaauccaa

SEQ ID NO: 3809200 - RNA, 17 nt, Human
cucaacucaccuaaugu

SEQ ID NO: 3809201 - RNA, 14 nt, Human
cucaacuccuccca

SEQ ID NO: 3809202 - RNA, 15 nt, Human
cucaacuccucccau

SEQ ID NO: 3809203 - RNA, 19 nt, Human
cucaacucugcugaggguc

SEQ ID NO: 3809204 - RNA, 17 nt, Human
cucaacuggguccagaa

SEQ ID NO: 3809205 - RNA, 17 nt, Human
cucaacuuucuguugga

SEQ ID NO: 3809206 - RNA, 19 nt, Human
cucaagaagaagaggggca

SEQ ID NO: 3809207 - RNA, 20 nt, Human
cucaagaagaagaggggcau

SEQ ID NO: 3809208 - RNA, 19 nt, Human
cucaagaagacauggagac

SEQ ID NO: 3809209 - RNA, 22 nt, Human
cucaagaagacauggagacucc

SEQ ID NO: 3809210 - RNA, 14 nt, Human
cucaagaagcaggc

SEQ ID NO: 3809211 - RNA, 15 nt, Human
cucaagaagcaggcu

SEQ ID NO: 3809212 - RNA, 18 nt, Human
cucaagaccaaauggaaa

SEQ ID NO: 3809213 - RNA, 21 nt, Human
cucaagaccaaauggaaacag

SEQ ID NO: 3809214 - RNA, 14 nt, Human
cucaagacuuccag

SEQ ID NO: 3809215 - RNA, 15 nt, Human
cucaagagaucccaa

SEQ ID NO: 3809216 - RNA, 17 nt, Human
cucaagaggcugaggca

SEQ ID NO: 3809217 - RNA, 17 nt, Human
cucaagagggcacuggu

SEQ ID NO: 3809218 - RNA, 19 nt, Human
cucaagagggcacuggugg

SEQ ID NO: 3809219 - RNA, 17 nt, Human
cucaagaucaaugaaau

SEQ ID NO: 3809220 - RNA, 15 nt, Human
cucaagaugggggca

SEQ ID NO: 3809221 - RNA, 13 nt, Human
cucaagauuccca

SEQ ID NO: 3809222 - RNA, 18 nt, Human
cucaagcaauccuccuga

SEQ ID NO: 3809223 - RNA, 21 nt, Human
cucaagcaauccuccugagug

SEQ ID NO: 3809224 - RNA, 21 nt, Human
cucaagccaagcagccaagcu

SEQ ID NO: 3809225 - RNA, 22 nt, Human
cucaagcccugcagucacagcu

SEQ ID NO: 3809226 - RNA, 16 nt, Human
cucaaggacaaagucu

SEQ ID NO: 3809227 - RNA, 17 nt, Human
cucaaggacaaagucuc

SEQ ID NO: 3809228 - RNA, 20 nt, Human
cucaaggacaaagucuccag

SEQ ID NO: 3809229 - RNA, 15 nt, Human
cucaaggccucccac

SEQ ID NO: 3809230 - RNA, 19 nt, Human
cucaaggccucccacagug

SEQ ID NO: 3809231 - RNA, 17 nt, Human
cucaaggcggugcuuga

SEQ ID NO: 3809232 - RNA, 23 nt, Human
cucaaggcggugcuugauagaaa

SEQ ID NO: 3809233 - RNA, 20 nt, Human
cucaaggggccauccugucc

SEQ ID NO: 3809234 - RNA, 14 nt, Human
cucaagguuuuagg

SEQ ID NO: 3809235 - RNA, 20 nt, Human
cucaagucacucccaagccc

SEQ ID NO: 3809236 - RNA, 22 nt, Human
cucaaguccccgucugccuggc

SEQ ID NO: 3809237 - RNA, 16 nt, Human
cucaagucuucccuga

SEQ ID NO: 3809238 - RNA, 16 nt, Human
cucaagucuuucucuu

SEQ ID NO: 3809239 - RNA, 17 nt, Human
cucaagugauucuccug

SEQ ID NO: 3809240 - RNA, 22 nt, Human
cucaagugggaacgacugggca

SEQ ID NO: 3809241 - RNA, 22 nt, Human
cucaagugucucaguccaccug

SEQ ID NO: 3809242 - RNA, 19 nt, Human
cucaaguucaaggaccaac

SEQ ID NO: 3809243 - RNA, 18 nt, Human
cucaaguuuaugucucag

SEQ ID NO: 3809244 - RNA, 13 nt, Human
cucaauaaaauca

SEQ ID NO: 3809245 - RNA, 23 nt, Human
cucaauaaaaucauguacauuuc

SEQ ID NO: 3809246 - RNA, 20 nt, Human
cucaauaaaauuauagcucu

SEQ ID NO: 3809247 - RNA, 17 nt, Human
cucaauaaacauuucau

SEQ ID NO: 3809248 - RNA, 21 nt, Human
cucaauaaacauuucauuucc

SEQ ID NO: 3809249 - RNA, 13 nt, Human
cucaauaaagauu

SEQ ID NO: 3809250 - RNA, 14 nt, Human
cucaauaagccuug

SEQ ID NO: 3809251 - RNA, 16 nt, Human
cucaauagaucuccag

SEQ ID NO: 3809252 - RNA, 21 nt, Human
cucaauaggaccaggauccag

SEQ ID NO: 3809253 - RNA, 16 nt, Human
cucaauaguaaaagau

SEQ ID NO: 3809254 - RNA, 11 nt, Human
cucaauauuuu

SEQ ID NO: 3809255 - RNA, 18 nt, Human
cucaauauuuuccaugaa

SEQ ID NO: 3809256 - RNA, 14 nt, Human
cucaauccauguuc

SEQ ID NO: 3809257 - RNA, 13 nt, Human
cucaaugaaaaau

SEQ ID NO: 3809258 - RNA, 22 nt, Human
cucaaugaaaaauagugucuuu

SEQ ID NO: 3809259 - RNA, 19 nt, Human
cucaaugaaccauaaauuc

SEQ ID NO: 3809260 - RNA, 20 nt, Human
cucaaugaaccauaaauuca

SEQ ID NO: 3809261 - RNA, 15 nt, Human
cucaaugagcauguu

SEQ ID NO: 3809262 - RNA, 16 nt, Human
cucaaugagcucuucc

SEQ ID NO: 3809263 - RNA, 13 nt, Human
cucaaugcucaua

SEQ ID NO: 3809264 - RNA, 15 nt, Human
cucaaugcucauaac

SEQ ID NO: 3809265 - RNA, 21 nt, Human
cucaaugugugccgagcccuu

SEQ ID NO: 3809266 - RNA, 19 nt, Human
cucaauguuacuaucugcu

SEQ ID NO: 3809267 - RNA, 14 nt, Human
cucaauucuucccu

SEQ ID NO: 3809268 - RNA, 19 nt, Human
cucaauucuucccuaucuu

SEQ ID NO: 3809269 - RNA, 13 nt, Human
cucaauuguuuuu

SEQ ID NO: 3809270 - RNA, 15 nt, Human
cucaauuguuuuugu

SEQ ID NO: 3809271 - RNA, 12 nt, Human
cucaauuucaau

SEQ ID NO: 3809272 - RNA, 21 nt, Human
gaauaaauaugccucuccuuu

SEQ ID NO: 3809273 - RNA, 11 nt, Human
gaauaaauguc

SEQ ID NO: 3809274 - RNA, 14 nt, Human
gaauaaaugucacu

SEQ ID NO: 3809275 - RNA, 16 nt, Human
gaauaaaugucacuuu

SEQ ID NO: 3809276 - RNA, 14 nt, Human
gaauaaaugucuuu

SEQ ID NO: 3809277 - RNA, 20 nt, Human
gaauaaauuguacagccggc

SEQ ID NO: 3809278 - RNA, 18 nt, Human
gaauaacauguaauuaag

SEQ ID NO: 3809279 - RNA, 22 nt, Human
gaauaaccacuuaaaaaauguc

SEQ ID NO: 3809280 - RNA, 23 nt, Human
gaauaagaaaacaaucacacuca

SEQ ID NO: 3809281 - RNA, 23 nt, Human
gaauaagcucuaguucuuaacaa

SEQ ID NO: 3809282 - RNA, 20 nt, Human
gaauaagguacaagaagcau

SEQ ID NO: 3809283 - RNA, 23 nt, Human
gaauaagguacaagaagcauuuu

SEQ ID NO: 3809284 - RNA, 12 nt, Human
gaauaauagaag

SEQ ID NO: 3809285 - RNA, 21 nt, Human
gaauaaucacgcuuuccugaa

SEQ ID NO: 3809286 - RNA, 22 nt, Human
gaauaauccuaaacauaugaau

SEQ ID NO: 3809287 - RNA, 13 nt, Human
gaauaaugggcuu

SEQ ID NO: 3809288 - RNA, 20 nt, Human
gaauaaugugggaagaaaca

SEQ ID NO: 3809289 - RNA, 18 nt, Human
gaauaauuauuuauuuaa

SEQ ID NO: 3809290 - RNA, 21 nt, Human
gaauaauugcuuuuucacagu

SEQ ID NO: 3809291 - RNA, 14 nt, Human
gaauacagaaagau

SEQ ID NO: 3809292 - RNA, 21 nt, Human
gaauacagcagcaagaaaaaa

SEQ ID NO: 3809293 - RNA, 20 nt, Human
gaauacaguguuauuuucuu

SEQ ID NO: 3809294 - RNA, 22 nt, Human
gaauaccacaucaaauaagaaa

SEQ ID NO: 3809295 - RNA, 23 nt, Human
gaauaccacucuguaauugcaaa

SEQ ID NO: 3809296 - RNA, 21 nt, Human
gaauaccauuaaaacugcuuu

SEQ ID NO: 3809297 - RNA, 22 nt, Human
gaauaccauuaaaacugcuuuu

SEQ ID NO: 3809298 - RNA, 12 nt, Human
gaauacccuuuu

SEQ ID NO: 3809299 - RNA, 15 nt, Human
gaauaccuguccccc

SEQ ID NO: 3809300 - RNA, 20 nt, Human
gaauacuacuuaugaaaugu

SEQ ID NO: 3809301 - RNA, 13 nt, Human
gaauacugaacau

SEQ ID NO: 3809302 - RNA, 13 nt, Human
gaauacugcuaca

SEQ ID NO: 3809303 - RNA, 18 nt, Human
gaauacuguuaaaggaaa

SEQ ID NO: 3809304 - RNA, 20 nt, Human
gaauacuguuaaaggaaaaa

SEQ ID NO: 3809305 - RNA, 17 nt, Human
gaauacuuugaaugugu

SEQ ID NO: 3809306 - RNA, 19 nt, Human
gaauacuuuugcccuuuga

SEQ ID NO: 3809307 - RNA, 15 nt, Human
gaauagaaagaaagu

SEQ ID NO: 3809308 - RNA, 16 nt, Human
gaauagaaagaaaguc

SEQ ID NO: 3809309 - RNA, 17 nt, Human
gaauagaagcuaagguu

SEQ ID NO: 3809310 - RNA, 16 nt, Human
gaauagauaugaaagc

SEQ ID NO: 3809311 - RNA, 18 nt, Human
gaauagcaucuguacaaa

SEQ ID NO: 3809312 - RNA, 21 nt, Human
gaauaggacuuguuuuuguuu

SEQ ID NO: 3809313 - RNA, 16 nt, Human
gaauaggcacuuuaaa

SEQ ID NO: 3809314 - RNA, 16 nt, Human
gaauaggcgaucacaa

SEQ ID NO: 3809315 - RNA, 22 nt, Human
gaauaggcgaucacaacgugca

SEQ ID NO: 3809316 - RNA, 21 nt, Human
gaauagggcccaugggaggga

SEQ ID NO: 3809317 - RNA, 18 nt, Human
gaauaguauccuccaggu

SEQ ID NO: 3809318 - RNA, 19 nt, Human
gaauaguauccuccagguu

SEQ ID NO: 3809319 - RNA, 14 nt, Human
gaauaguauugugu

SEQ ID NO: 3809320 - RNA, 16 nt, Human
gaauaguugagcccca

SEQ ID NO: 3809321 - RNA, 21 nt, Human
gaauaguuggucaucuagcaa

SEQ ID NO: 3809322 - RNA, 13 nt, Human
gaauauaaaaaau

SEQ ID NO: 3809323 - RNA, 21 nt, Human
gaauauaaacacuauauggca

SEQ ID NO: 3809324 - RNA, 16 nt, Human
gaauauaauacuguau

SEQ ID NO: 3809325 - RNA, 12 nt, Human
gaauauaaugga

SEQ ID NO: 3809326 - RNA, 20 nt, Human
gaauauaauuguuuuaucug

SEQ ID NO: 3809327 - RNA, 20 nt, Human
gaauauacucauuagaauua

SEQ ID NO: 3809328 - RNA, 23 nt, Human
gaauauaggucucuucucccaga

SEQ ID NO: 3809329 - RNA, 11 nt, Human
gaauauauuau

SEQ ID NO: 3809330 - RNA, 12 nt, Human
gaauauauuaua

SEQ ID NO: 3809331 - RNA, 16 nt, Human
gaauauauuuauuuaa

SEQ ID NO: 3809332 - RNA, 19 nt, Human
gaauaucaauagauauuua

SEQ ID NO: 3809333 - RNA, 17 nt, Human
gaauauccccucccagu

SEQ ID NO: 3809334 - RNA, 22 nt, Human
gaauauccccucccagucaccu

SEQ ID NO: 3809335 - RNA, 17 nt, Human
gaauaucuauuaauaua

SEQ ID NO: 3809336 - RNA, 14 nt, Human
gaauaugaaacaua

SEQ ID NO: 3809337 - RNA, 17 nt, Human
gaauaugaaacauagau

SEQ ID NO: 3809338 - RNA, 20 nt, Human
gaauaugaaagucuuauuaa

SEQ ID NO: 3809339 - RNA, 15 nt, Human
gaauaugacggaaga

SEQ ID NO: 3809340 - RNA, 18 nt, Human
gaauaugauuaguaaaga

SEQ ID NO: 3809341 - RNA, 19 nt, Human
gaauaugauuaguaaagaa

SEQ ID NO: 3809342 - RNA, 19 nt, Human
gaauauguuuccuuguuua

SEQ ID NO: 3809343 - RNA, 21 nt, Human
gaauauuagcuuuacuguuug

SEQ ID NO: 3809344 - RNA, 19 nt, Human
gaauauuauauuuggaugc

SEQ ID NO: 3809345 - RNA, 15 nt, Human
gaauauucaggacuu

SEQ ID NO: 3809346 - RNA, 16 nt, Human
gaauauucauauugga

SEQ ID NO: 3809347 - RNA, 20 nt, Human
gaauauugagcaauauguca

SEQ ID NO: 3809348 - RNA, 20 nt, Human
gaauauugcugauggugcaa

SEQ ID NO: 3809349 - RNA, 21 nt, Human
gaauauuguuccuaaguucuu

SEQ ID NO: 3809350 - RNA, 15 nt, Human
gaauauuguuucuuu

SEQ ID NO: 3809351 - RNA, 10 nt, Human
gaauauuuau

SEQ ID NO: 3809352 - RNA, 16 nt, Human
gaauauuuauaacagc

SEQ ID NO: 3809353 - RNA, 15 nt, Human
gaauauuuauuaccu

SEQ ID NO: 3809354 - RNA, 12 nt, Human
gaauauuugaau

SEQ ID NO: 3809355 - RNA, 14 nt, Human
gaauauuugaaucu

SEQ ID NO: 3809356 - RNA, 22 nt, Human
gaauauuuguuauguagauaac

SEQ ID NO: 3809357 - RNA, 18 nt, Human
gaauauuuuaaguauugc

SEQ ID NO: 3809358 - RNA, 14 nt, Human
gaauauuuuaucuu

SEQ ID NO: 3809359 - RNA, 16 nt, Human
gaauauuuuauucaag

SEQ ID NO: 3809360 - RNA, 22 nt, Human
gaauauuuuuugaggcuaaaga

SEQ ID NO: 3809361 - RNA, 21 nt, Human
gaaucaaaaauugaagagaga

SEQ ID NO: 3809362 - RNA, 14 nt, Human
gaaucaaaagugcc

SEQ ID NO: 3809363 - RNA, 23 nt, Human
gaaucaaaagugccucaagagga

SEQ ID NO: 3809364 - RNA, 14 nt, Human
gaaucaaacauuuu

SEQ ID NO: 3809365 - RNA, 14 nt, Human
gaaucaagagcugc

SEQ ID NO: 3809366 - RNA, 20 nt, Human
gaaucaagaugucagacugg

SEQ ID NO: 3809367 - RNA, 21 nt, Human
gaaucaagaugucagacuggc

SEQ ID NO: 3809368 - RNA, 21 nt, Human
gaaucaauaauauauuuucug

SEQ ID NO: 3809369 - RNA, 22 nt, Human
gaaucacaggcugggcugggca

SEQ ID NO: 3809370 - RNA, 19 nt, Human
gaaucaccuaauuaauuuc

SEQ ID NO: 3809371 - RNA, 22 nt, Human
gaaucagacccuaccccaccac

SEQ ID NO: 3809372 - RNA, 17 nt, Human
gaaucagaguagaaaua

SEQ ID NO: 3809373 - RNA, 13 nt, Human
gaaucagcacaga

SEQ ID NO: 3809374 - RNA, 12 nt, Human
gaaucagcuucu

SEQ ID NO: 3809375 - RNA, 20 nt, Human
gaaucaguauugggagccgg

SEQ ID NO: 3809376 - RNA, 22 nt, Human
gaaucaguuuccaauuauuuga

SEQ ID NO: 3809377 - RNA, 19 nt, Human
gaaucauacuuagcaaagu

SEQ ID NO: 3809378 - RNA, 20 nt, Human
gaaucaugagccugcuggaa

SEQ ID NO: 3809379 - RNA, 13 nt, Human
gaaucauuauuua

SEQ ID NO: 3809380 - RNA, 17 nt, Human
gaaucauucucgauuua

SEQ ID NO: 3809381 - RNA, 14 nt, Human
gaaucauugcuuau

SEQ ID NO: 3809382 - RNA, 13 nt, Human
gaaucauuuagca

SEQ ID NO: 3809383 - RNA, 24 nt, Human
gaaucauuuagcauguuguugaaa

SEQ ID NO: 3809384 - RNA, 14 nt, Human
gaaucauuuguuca

SEQ ID NO: 3809385 - RNA, 23 nt, Human
gaaucauuuguucaaagcuguug

SEQ ID NO: 3809386 - RNA, 17 nt, Human
gaauccaaaagaaaaac

SEQ ID NO: 3809387 - RNA, 20 nt, Human
gaauccaagccuccacagcg

SEQ ID NO: 3809388 - RNA, 17 nt, Human
gaauccaagcucccugc

SEQ ID NO: 3809389 - RNA, 18 nt, Human
gaauccaagcucccugcc

SEQ ID NO: 3809390 - RNA, 20 nt, Human
gaauccaagcucccugcccc

SEQ ID NO: 3809391 - RNA, 17 nt, Human
gaauccaagugaacacu

SEQ ID NO: 3809392 - RNA, 24 nt, Human
gaauccacccauccuaccaaugca

SEQ ID NO: 3809393 - RNA, 19 nt, Human
gaaucccaaauuugauuga

SEQ ID NO: 3809394 - RNA, 18 nt, Human
gaaucccacccacaugug

SEQ ID NO: 3809395 - RNA, 22 nt, Human
gaaucccacccacaugugacac

SEQ ID NO: 3809396 - RNA, 17 nt, Human
gaaucccacuguaugau

SEQ ID NO: 3809397 - RNA, 22 nt, Human
gaaucccagcccccugaccacu

SEQ ID NO: 3809398 - RNA, 23 nt, Human
gaaucccccuugccaccccaccc

SEQ ID NO: 3809399 - RNA, 14 nt, Human
gaaucccuguucau

SEQ ID NO: 3809400 - RNA, 18 nt, Human
gaaucccuguucauugua

SEQ ID NO: 3809401 - RNA, 10 nt, Human
gaauccuccu

SEQ ID NO: 3809402 - RNA, 16 nt, Human
gaaucgcuccugcagc

SEQ ID NO: 3809403 - RNA, 20 nt, Human
gaaucgcuccugcagcccca

SEQ ID NO: 3809404 - RNA, 15 nt, Human
gaaucuacuaauucc

SEQ ID NO: 3809405 - RNA, 14 nt, Human
gaaucuagaagaaa

SEQ ID NO: 3809406 - RNA, 19 nt, Human
gaaucuagaagaaaugaaa

SEQ ID NO: 3809407 - RNA, 17 nt, Human
gaaucuagccagugaac

SEQ ID NO: 3809408 - RNA, 13 nt, Human
gaaucuauauuua

SEQ ID NO: 3809409 - RNA, 21 nt, Human
gaaucuaucugcuuaugcagu

SEQ ID NO: 3809410 - RNA, 19 nt, Human
gaaucuaugccaaagauca

SEQ ID NO: 3809411 - RNA, 22 nt, Human
gaaucuaugccaaagaucacuu

SEQ ID NO: 3809412 - RNA, 15 nt, Human
gaaucuauuuaagua

SEQ ID NO: 3809413 - RNA, 18 nt, Human
gaaucuauuuaucuucau

SEQ ID NO: 3809414 - RNA, 19 nt, Human
gaaucuauuuucuauguac

SEQ ID NO: 3809415 - RNA, 14 nt, Human
gaaucucugugccu

SEQ ID NO: 3809416 - RNA, 15 nt, Human
gaaucucugugccuu

SEQ ID NO: 3809417 - RNA, 21 nt, Human
gaaucugcaauucaaaaguuc

SEQ ID NO: 3809418 - RNA, 16 nt, Human
gaaucugcucacuuua

SEQ ID NO: 3809419 - RNA, 21 nt, Human
gaaucuggaccccaucuguga

SEQ ID NO: 3809420 - RNA, 14 nt, Human
gacaacgaggaagc

SEQ ID NO: 3809421 - RNA, 16 nt, Human
gacaacgaggaagccc

SEQ ID NO: 3809422 - RNA, 22 nt, Human
gacaacugcucccaccuccuga

SEQ ID NO: 3809423 - RNA, 15 nt, Human
gacaacuggcaggca

SEQ ID NO: 3809424 - RNA, 18 nt, Human
gacaacuggcaggcaggc

SEQ ID NO: 3809425 - RNA, 12 nt, Human
gacaacugugac

SEQ ID NO: 3809426 - RNA, 18 nt, Human
gacaacuuugccagcuuu

SEQ ID NO: 3809427 - RNA, 15 nt, Human
gacaagaaaaucagg

SEQ ID NO: 3809428 - RNA, 15 nt, Human
gacaagacccccagc

SEQ ID NO: 3809429 - RNA, 24 nt, Human
gacaagacuucgggaaggugucug

SEQ ID NO: 3809430 - RNA, 14 nt, Human
gacaagagauggga

SEQ ID NO: 3809431 - RNA, 18 nt, Human
gacaagagaugggaauga

SEQ ID NO: 3809432 - RNA, 21 nt, Human
gacaagcauggucccacaucc

SEQ ID NO: 3809433 - RNA, 15 nt, Human
gacaagcucacagac

SEQ ID NO: 3809434 - RNA, 20 nt, Human
gacaaggaccgucuccugcg

SEQ ID NO: 3809435 - RNA, 21 nt, Human
gacaaggauugcuacuguccu

SEQ ID NO: 3809436 - RNA, 14 nt, Human
gacaaggccccaga

SEQ ID NO: 3809437 - RNA, 16 nt, Human
gacaaggccccagaga

SEQ ID NO: 3809438 - RNA, 13 nt, Human
gacaagggcugac

SEQ ID NO: 3809439 - RNA, 21 nt, Human
gacaagggcugaccugccucu

SEQ ID NO: 3809440 - RNA, 14 nt, Human
gacaagguagcccu

SEQ ID NO: 3809441 - RNA, 23 nt, Human
gacaagguagcccuggccagagg

SEQ ID NO: 3809442 - RNA, 20 nt, Human
gacaaguggacucagggcag

SEQ ID NO: 3809443 - RNA, 14 nt, Human
gacaauaaaacauu

SEQ ID NO: 3809444 - RNA, 19 nt, Human
gacaauaaagcuuguugac

SEQ ID NO: 3809445 - RNA, 19 nt, Human
gacaauaugugagugccuu

SEQ ID NO: 3809446 - RNA, 21 nt, Human
gacaauaugugccaaucaaua

SEQ ID NO: 3809447 - RNA, 19 nt, Human
gacaaucaguccccuccca

SEQ ID NO: 3809448 - RNA, 19 nt, Human
gacaaucaugaaauaugca

SEQ ID NO: 3809449 - RNA, 20 nt, Human
gacaaucaugaaauaugcau

SEQ ID NO: 3809450 - RNA, 20 nt, Human
gacaaucauuguuuugaaua

SEQ ID NO: 3809451 - RNA, 16 nt, Human
gacaaugacccagugg

SEQ ID NO: 3809452 - RNA, 18 nt, Human
gacaaugcaaaccaucau

SEQ ID NO: 3809453 - RNA, 22 nt, Human
gacaaugcaccuagcugugcaa

SEQ ID NO: 3809454 - RNA, 16 nt, Human
gacaaugcagaugcca

SEQ ID NO: 3809455 - RNA, 19 nt, Human
gacaaugcagaugccagag

SEQ ID NO: 3809456 - RNA, 14 nt, Human
gacaauggaccgga

SEQ ID NO: 3809457 - RNA, 19 nt, Human
gacaaugugaaaagaaaaa

SEQ ID NO: 3809458 - RNA, 17 nt, Human
gacaauguuguaguguc

SEQ ID NO: 3809459 - RNA, 18 nt, Human
gacaauguuguagugucc

SEQ ID NO: 3809460 - RNA, 13 nt, Human
gacaauguuuaca

SEQ ID NO: 3809461 - RNA, 21 nt, Human
gacaauuccuagauaaaaaga

SEQ ID NO: 3809462 - RNA, 15 nt, Human
gacaauugucuuuuu

SEQ ID NO: 3809463 - RNA, 22 nt, Human
gacaauuuauauuuaauaaaau

SEQ ID NO: 3809464 - RNA, 19 nt, Human
gacaauuuauuauggcaca

SEQ ID NO: 3809465 - RNA, 16 nt, Human
gacacaaaaaguagau

SEQ ID NO: 3809466 - RNA, 14 nt, Human
gacacaaaccugcc

SEQ ID NO: 3809467 - RNA, 14 nt, Human
gacacaaaggaagu

SEQ ID NO: 3809468 - RNA, 16 nt, Human
gacacaagccuucggc

SEQ ID NO: 3809469 - RNA, 13 nt, Human
gacacacaaagca

SEQ ID NO: 3809470 - RNA, 14 nt, Human
gacacacacacgca

SEQ ID NO: 3809471 - RNA, 19 nt, Human
gacacacacacgcacgcac

SEQ ID NO: 3809472 - RNA, 20 nt, Human
gacacacacacgcacgcaca

SEQ ID NO: 3809473 - RNA, 14 nt, Human
gacacacagcucug

SEQ ID NO: 3809474 - RNA, 15 nt, Human
gacacacagcucugu

SEQ ID NO: 3809475 - RNA, 21 nt, Human
gacacacagcucuguccuggg

SEQ ID NO: 3809476 - RNA, 12 nt, Human
gacacacaugaa

SEQ ID NO: 3809477 - RNA, 18 nt, Human
gacacacuaaccaagcug

SEQ ID NO: 3809478 - RNA, 19 nt, Human
gacacacuaaccaagcuga

SEQ ID NO: 3809479 - RNA, 19 nt, Human
gacacacuacaccacacac

SEQ ID NO: 3809480 - RNA, 22 nt, Human
gacacacuaucauaguuaacau

SEQ ID NO: 3809481 - RNA, 16 nt, Human
gacacacugaagaagc

SEQ ID NO: 3809482 - RNA, 16 nt, Human
gacacagaaaauguug

SEQ ID NO: 3809483 - RNA, 18 nt, Human
gacacagaaaauguugag

SEQ ID NO: 3809484 - RNA, 19 nt, Human
gacacagaaaauguugaga

SEQ ID NO: 3809485 - RNA, 12 nt, Human
gacacagauaau

SEQ ID NO: 3809486 - RNA, 15 nt, Human
gacacagaugaaaca

SEQ ID NO: 3809487 - RNA, 15 nt, Human
gacacagauuggcca

SEQ ID NO: 3809488 - RNA, 18 nt, Human
gacacagcagcuucacca

SEQ ID NO: 3809489 - RNA, 19 nt, Human
gacacagcagcuucaccag

SEQ ID NO: 3809490 - RNA, 21 nt, Human
gacacagcagcuucaccagag

SEQ ID NO: 3809491 - RNA, 12 nt, Human
gacacagcucuu

SEQ ID NO: 3809492 - RNA, 14 nt, Human
gacacagcucuucu

SEQ ID NO: 3809493 - RNA, 19 nt, Human
gacacagcucuucuccagg

SEQ ID NO: 3809494 - RNA, 21 nt, Human
gacacaggauagauaacucuu

SEQ ID NO: 3809495 - RNA, 17 nt, Human
gacacaggaugaaggca

SEQ ID NO: 3809496 - RNA, 15 nt, Human
gacacaggcccggcu

SEQ ID NO: 3809497 - RNA, 18 nt, Human
gacacaggcccggcucca

SEQ ID NO: 3809498 - RNA, 19 nt, Human
gacacaggcccggcuccag

SEQ ID NO: 3809499 - RNA, 16 nt, Human
gacaacagacuucuga

SEQ ID NO: 3809500 - RNA, 14 nt, Human
gacaacauguuuaa

SEQ ID NO: 3809501 - RNA, 14 nt, Human
gacaacauuguaag

SEQ ID NO: 3809502 - RNA, 17 nt, Human
gacaaccaccgcucccc

SEQ ID NO: 3809503 - RNA, 23 nt, Human
gacaaccaccgcuccccagccca

SEQ ID NO: 3809504 - RNA, 19 nt, Human
gacaaccacuggucuguag

SEQ ID NO: 3809505 - RNA, 19 nt, Human
gacaaccauauuuagcagu

SEQ ID NO: 3809506 - RNA, 16 nt, Human
gacaaccauuaaaguc

SEQ ID NO: 3809507 - RNA, 13 nt, Human
gacaacccugcaa

SEQ ID NO: 3809508 - RNA, 18 nt, Human
gacaaccgaugcuccagc

SEQ ID NO: 3809509 - RNA, 20 nt, Human
gacaaccgaugcuccagcca

SEQ ID NO: 3809510 - RNA, 22 nt, Human
gacaaccuuggcuuggcccugg

SEQ ID NO: 3809511 - RNA, 15 nt, Human
gacaacgaggaagcc

SEQ ID NO: 3809512 - RNA, 15 nt, Human
gacaacuacagaaaa

SEQ ID NO: 3809513 - RNA, 19 nt, Human
gacaacugcucccaccucc

SEQ ID NO: 3809514 - RNA, 21 nt, Human
gacaacugcucccaccuccug

SEQ ID NO: 3809515 - RNA, 13 nt, Human
gacaacuggcagg

SEQ ID NO: 3809516 - RNA, 21 nt, Human
gacaacuucuaauugccaugu

SEQ ID NO: 3809517 - RNA, 13 nt, Human
gacaagaaaauca

SEQ ID NO: 3809518 - RNA, 16 nt, Human
gacaagacccccagca

SEQ ID NO: 3809519 - RNA, 16 nt, Human
gacaagacuucaguau

SEQ ID NO: 3809520 - RNA, 20 nt, Human
gacaagagaugggaaugagg

SEQ ID NO: 3809521 - RNA, 22 nt, Human
gacaagagccugaucucuuccu

SEQ ID NO: 3809522 - RNA, 18 nt, Human
gacaagauauuguacaua

SEQ ID NO: 3809523 - RNA, 15 nt, Human
gacaagcacagucag

SEQ ID NO: 3809524 - RNA, 16 nt, Human
gacaagccccaggcag

SEQ ID NO: 3809525 - RNA, 20 nt, Human
gacaaggaaaaaauaacaau

SEQ ID NO: 3809526 - RNA, 21 nt, Human
gacaaggaugaucuaggaaga

SEQ ID NO: 3809527 - RNA, 18 nt, Human
gacaaggauugcuacugu

SEQ ID NO: 3809528 - RNA, 19 nt, Human
gacaaggauugcuacuguc

SEQ ID NO: 3809529 - RNA, 20 nt, Human
gacaaggccccagagacuca

SEQ ID NO: 3809530 - RNA, 23 nt, Human
gacaaggccccagagacucagag

SEQ ID NO: 3809531 - RNA, 12 nt, Human
gacaagggcuga

SEQ ID NO: 3809532 - RNA, 16 nt, Human
gacaaggugcaggcag

SEQ ID NO: 3809533 - RNA, 15 nt, Human
gacaaguaauuucag

SEQ ID NO: 3809534 - RNA, 20 nt, Human
gacaagugcugaacagugga

SEQ ID NO: 3809535 - RNA, 14 nt, Human
gacaaguuccaugg

SEQ ID NO: 3809536 - RNA, 15 nt, Human
gacaauaaaauauua

SEQ ID NO: 3809537 - RNA, 22 nt, Human
gacaauaaacccucagagccuc

SEQ ID NO: 3809538 - RNA, 15 nt, Human
gacaauaaucucacu

SEQ ID NO: 3809539 - RNA, 19 nt, Human
gacaauaauucuggagaua

SEQ ID NO: 3809540 - RNA, 13 nt, Human
gacaauaauuuca

SEQ ID NO: 3809541 - RNA, 19 nt, Human
gacaauacuguaugucguc

SEQ ID NO: 3809542 - RNA, 18 nt, Human
gacaaucaguccccuccc

SEQ ID NO: 3809543 - RNA, 21 nt, Human
gacaaucaugaaauaugcauc

SEQ ID NO: 3809544 - RNA, 14 nt, Human
gacaaucaugugug

SEQ ID NO: 3809545 - RNA, 15 nt, Human
gacaaucaugugugu

SEQ ID NO: 3809546 - RNA, 17 nt, Human
gacaaugacuuacugua

SEQ ID NO: 3809547 - RNA, 14 nt, Human
gacaaugucugaac

SEQ ID NO: 3809548 - RNA, 19 nt, Human
gacaaugucugcagcccug

SEQ ID NO: 3809549 - RNA, 12 nt, Human
gacaaugugaaa

SEQ ID NO: 3809550 - RNA, 19 nt, Human
gacaauguuguaguguccc

SEQ ID NO: 3809551 - RNA, 22 nt, Human
gacaauuagauaaauguccauu

SEQ ID NO: 3809552 - RNA, 16 nt, Human
gacaauucaugaacuu

SEQ ID NO: 3809553 - RNA, 22 nt, Human
gacaauucuuuauacaacagug

SEQ ID NO: 3809554 - RNA, 22 nt, Human
gacaauugagguaaguuuuuug

SEQ ID NO: 3809555 - RNA, 21 nt, Human
gacaauuguuuuaaucugaaa

SEQ ID NO: 3809556 - RNA, 13 nt, Human
gacaauuuauuau

SEQ ID NO: 3809557 - RNA, 20 nt, Human
gacaauuucaaaaaaauaaa

SEQ ID NO: 3809558 - RNA, 16 nt, Human
gacaauuugauacaua

SEQ ID NO: 3809559 - RNA, 17 nt, Human
gacaauuugauacauaa

SEQ ID NO: 3809560 - RNA, 18 nt, Human
gacaauuugauacauaau

SEQ ID NO: 3809561 - RNA, 22 nt, Human
gacaauuugauacauaauaaaa

SEQ ID NO: 3809562 - RNA, 21 nt, Human
gacacaaaacuccgcccccag

SEQ ID NO: 3809563 - RNA, 15 nt, Human
gacacaaacacacac

SEQ ID NO: 3809564 - RNA, 17 nt, Human
gacacaaaccugccugg

SEQ ID NO: 3809565 - RNA, 20 nt, Human
gacacaaaccugccuggguu

SEQ ID NO: 3809566 - RNA, 15 nt, Human
gacacaaacugccaa

SEQ ID NO: 3809567 - RNA, 13 nt, Human
gacacaaaugcau

SEQ ID NO: 3809568 - RNA, 14 nt, Human
gacacaacaacucc

SEQ ID NO: 3809569 - RNA, 12 nt, Human
gacacacacacg

SEQ ID NO: 3809570 - RNA, 13 nt, Human
gacacacacacgc

SEQ ID NO: 3809571 - RNA, 15 nt, Human
gacacacacacgcac

SEQ ID NO: 3809572 - RNA, 21 nt, Human
gacacacacacgcacgcacac

SEQ ID NO: 3809573 - RNA, 17 nt, Human
gacacacacagacuauu

SEQ ID NO: 3809574 - RNA, 13 nt, Human
gacacacacagcu

SEQ ID NO: 3809575 - RNA, 13 nt, Human
gacacacagcucu

SEQ ID NO: 3809576 - RNA, 17 nt, Human
gacacacagcucugucc

SEQ ID NO: 3809577 - RNA, 21 nt, Human
gacacacuacaccacacacaa

SEQ ID NO: 3809578 - RNA, 13 nt, Human
gacacacugaaga

SEQ ID NO: 3809579 - RNA, 11 nt, Human
gacacagaaaa

SEQ ID NO: 3809580 - RNA, 21 nt, Human
gacacagaaaauguugagaau

SEQ ID NO: 3809581 - RNA, 15 nt, Human
gacacagaacacaga

SEQ ID NO: 3809582 - RNA, 21 nt, Human
gacacagcucuucuccaggcu

SEQ ID NO: 3809583 - RNA, 17 nt, Human
gacacaggcccucccug

SEQ ID NO: 3809584 - RNA, 15 nt, Human
gacacaggccugugu

SEQ ID NO: 3809585 - RNA, 23 nt, Human
gacacagggugacggugacaaag

SEQ ID NO: 3809586 - RNA, 15 nt, Human
gacacauguccaaga

SEQ ID NO: 3809587 - RNA, 20 nt, Human
gacacauucaacccuggaga

SEQ ID NO: 3809588 - RNA, 21 nt, Human
gacacauucaacccuggagag

SEQ ID NO: 3809589 - RNA, 23 nt, Human
gacacauuuuuuaggaaauguuu

SEQ ID NO: 3809590 - RNA, 15 nt, Human
gacaccaaagccacc

SEQ ID NO: 3809591 - RNA, 14 nt, Human
gacaccacacccag

SEQ ID NO: 3809592 - RNA, 18 nt, Human
gacaccacacccagccuc

SEQ ID NO: 3809593 - RNA, 20 nt, Human
gacaccacacccagccucag

SEQ ID NO: 3809594 - RNA, 14 nt, Human
gacaccagagcaga

SEQ ID NO: 3809595 - RNA, 22 nt, Human
gacaccagagcagaugcagaga

SEQ ID NO: 3809596 - RNA, 17 nt, Human
gacaccagccaggcucu

SEQ ID NO: 3809597 - RNA, 22 nt, Human
gacaccagccuuucucccaggc

SEQ ID NO: 3809598 - RNA, 12 nt, Human
gacacccagaaa

SEQ ID NO: 3809599 - RNA, 19 nt, Human
gacacccauguuucucugg

SEQ ID NO: 3809600 - RNA, 14 nt, Human
gacaccccacuuag

SEQ ID NO: 3809601 - RNA, 17 nt, Human
gacaccccuuauccagg

SEQ ID NO: 3809602 - RNA, 19 nt, Human
gacaccccuuauccaggac

SEQ ID NO: 3809603 - RNA, 21 nt, Human
gacaccccuuauccaggacuc

SEQ ID NO: 3809604 - RNA, 13 nt, Human
gacacccugugau

SEQ ID NO: 3809605 - RNA, 22 nt, Human
gacacccugugauggggcccug

SEQ ID NO: 3809606 - RNA, 23 nt, Human
gacacccuucucccacucuccua

SEQ ID NO: 3809607 - RNA, 15 nt, Human
gacaccuaacucuuc

SEQ ID NO: 3809608 - RNA, 16 nt, Human
gacaccuaacucuucu

SEQ ID NO: 3809609 - RNA, 21 nt, Human
gacauuccuucucccaucucu

SEQ ID NO: 3809610 - RNA, 22 nt, Human
gacauucugaaugcuucuaagu

SEQ ID NO: 3809611 - RNA, 14 nt, Human
gacauucugccagg

SEQ ID NO: 3809612 - RNA, 11 nt, Human
gacauucuguc

SEQ ID NO: 3809613 - RNA, 24 nt, Human
gacauucuuguaaggcuuugauua

SEQ ID NO: 3809614 - RNA, 14 nt, Human
gacauugaaaucua

SEQ ID NO: 3809615 - RNA, 22 nt, Human
gacauugacuauuuuuguuuuu

SEQ ID NO: 3809616 - RNA, 15 nt, Human
gacauugaggaccuc

SEQ ID NO: 3809617 - RNA, 23 nt, Human
gacauugcggacagccacggcca

SEQ ID NO: 3809618 - RNA, 14 nt, Human
gacauugucaauaa

SEQ ID NO: 3809619 - RNA, 12 nt, Human
gacauugucucc

SEQ ID NO: 3809620 - RNA, 21 nt, Human
gacauugucuccuauauauuu

SEQ ID NO: 3809621 - RNA, 19 nt, Human
gacauuguuggccaaagcc

SEQ ID NO: 3809622 - RNA, 14 nt, Human
gacauuguuuugcc

SEQ ID NO: 3809623 - RNA, 13 nt, Human
gacauuuaauuua

SEQ ID NO: 3809624 - RNA, 18 nt, Human
gacauuuauacucuuuuu

SEQ ID NO: 3809625 - RNA, 20 nt, Human
gacauuucucuuacugcaaa

SEQ ID NO: 3809626 - RNA, 21 nt, Human
gacauuucuuuucuuuuuaca

SEQ ID NO: 3809627 - RNA, 16 nt, Human
gacauuuggagagggg

SEQ ID NO: 3809628 - RNA, 16 nt, Human
gacauuugucauuuuc

SEQ ID NO: 3809629 - RNA, 17 nt, Human
gacauuugucauuuuca

SEQ ID NO: 3809630 - RNA, 16 nt, Human
gacauuuuaacaagaa

SEQ ID NO: 3809631 - RNA, 20 nt, Human
gacauuuuaacaagaagaug

SEQ ID NO: 3809632 - RNA, 22 nt, Human
gacauuuuaacaagaagaugaa

SEQ ID NO: 3809633 - RNA, 13 nt, Human
gacauuuuacauu

SEQ ID NO: 3809634 - RNA, 14 nt, Human
gacauuuuacauua

SEQ ID NO: 3809635 - RNA, 20 nt, Human
gacauuuuaugucuuucuug

SEQ ID NO: 3809636 - RNA, 20 nt, Human
gacauuuucuuucaugggca

SEQ ID NO: 3809637 - RNA, 17 nt, Human
gacauuuugccaaaauu

SEQ ID NO: 3809638 - RNA, 14 nt, Human
gaccaaaaaaauaa

SEQ ID NO: 3809639 - RNA, 17 nt, Human
gaccaaaaugacaauga

SEQ ID NO: 3809640 - RNA, 17 nt, Human
gaccaaaccuagccccu

SEQ ID NO: 3809641 - RNA, 21 nt, Human
gaccaaagggagucugccagg

SEQ ID NO: 3809642 - RNA, 13 nt, Human
gaccaaauggaaa

SEQ ID NO: 3809643 - RNA, 23 nt, Human
gaccaaauuccuuggcaugccuu

SEQ ID NO: 3809644 - RNA, 18 nt, Human
gaccaacaagggcagugg

SEQ ID NO: 3809645 - RNA, 17 nt, Human
gaccaacauggagaaac

SEQ ID NO: 3809646 - RNA, 21 nt, Human
gaccaacauggagaaacccug

SEQ ID NO: 3809647 - RNA, 17 nt, Human
gaccaacccuguuuccu

SEQ ID NO: 3809648 - RNA, 13 nt, Human
gaccaaccugacc

SEQ ID NO: 3809649 - RNA, 20 nt, Human
gaccaacguuacucagggcu

SEQ ID NO: 3809650 - RNA, 17 nt, Human
gaccaacuagacauucu

SEQ ID NO: 3809651 - RNA, 18 nt, Human
gaccaacuagacauucug

SEQ ID NO: 3809652 - RNA, 18 nt, Human
gaccaacuguguuguauu

SEQ ID NO: 3809653 - RNA, 21 nt, Human
gaccaacuguguuguauuaac

SEQ ID NO: 3809654 - RNA, 15 nt, Human
gaccaagaacugcau

SEQ ID NO: 3809655 - RNA, 18 nt, Human
gaccaagagagaaagaag

SEQ ID NO: 3809656 - RNA, 13 nt, Human
gaccaaggacccc

SEQ ID NO: 3809657 - RNA, 16 nt, Human
gaccaaggaccccuca

SEQ ID NO: 3809658 - RNA, 19 nt, Human
gaccaaggaccccucaccu

SEQ ID NO: 3809659 - RNA, 16 nt, Human
gaccaaggagaugaag

SEQ ID NO: 3809660 - RNA, 23 nt, Human
gaccaaggcaaggcaggugccuc

SEQ ID NO: 3809661 - RNA, 18 nt, Human
gaccaaggggugggccac

SEQ ID NO: 3809662 - RNA, 18 nt, Human
gaccaagguuccagcuca

SEQ ID NO: 3809663 - RNA, 17 nt, Human
gaccaaguauaaacuuu

SEQ ID NO: 3809664 - RNA, 12 nt, Human
gaccaauaaaga

SEQ ID NO: 3809665 - RNA, 13 nt, Human
gaccaauugugcu

SEQ ID NO: 3809666 - RNA, 15 nt, Human
gaccaauugugcugc

SEQ ID NO: 3809667 - RNA, 18 nt, Human
gaccacaaaacuuuucua

SEQ ID NO: 3809668 - RNA, 14 nt, Human
gaccacaacaugag

SEQ ID NO: 3809669 - RNA, 14 nt, Human
gaccacacuccagc

SEQ ID NO: 3809670 - RNA, 22 nt, Human
gaccacacuuccuguccagaga

SEQ ID NO: 3809671 - RNA, 11 nt, Human
gaccacagcaa

SEQ ID NO: 3809672 - RNA, 15 nt, Human
gaccacagcacagcc

SEQ ID NO: 3809673 - RNA, 19 nt, Human
gaccacaggugcccgccac

SEQ ID NO: 3809674 - RNA, 13 nt, Human
gaccaccaagccu

SEQ ID NO: 3809675 - RNA, 22 nt, Human
gaccaccaagccuugauuggug

SEQ ID NO: 3809676 - RNA, 19 nt, Human
gaccaccagggcaucucug

SEQ ID NO: 3809677 - RNA, 23 nt, Human
gaccaccagggcaucucugggcu

SEQ ID NO: 3809678 - RNA, 19 nt, Human
gaccaccccgccugcccuc

SEQ ID NO: 3809679 - RNA, 14 nt, Human
gaccaccccugccu

SEQ ID NO: 3809680 - RNA, 14 nt, Human
gaccacccucacug

SEQ ID NO: 3809681 - RNA, 15 nt, Human
gaccacccugagccg

SEQ ID NO: 3809682 - RNA, 16 nt, Human
gaccaccucucaauau

SEQ ID NO: 3809683 - RNA, 17 nt, Human
gaccacgcccguccugc

SEQ ID NO: 3809684 - RNA, 13 nt, Human
gaccacggcucga

SEQ ID NO: 3809685 - RNA, 21 nt, Human
gaccacucagagacaugcaga

SEQ ID NO: 3809686 - RNA, 14 nt, Human
gaccacucagcccc

SEQ ID NO: 3809687 - RNA, 16 nt, Human
gaccacucagccccua

SEQ ID NO: 3809688 - RNA, 19 nt, Human
gaccacucagccccuagga

SEQ ID NO: 3809689 - RNA, 18 nt, Human
gaccacugcagaagacag

SEQ ID NO: 3809690 - RNA, 19 nt, Human
gaccacuguuucuugcuug

SEQ ID NO: 3809691 - RNA, 20 nt, Human
gaccacuguuucuugcuugu

SEQ ID NO: 3809692 - RNA, 22 nt, Human
gaccacuuccaggggaaccugc

SEQ ID NO: 3809693 - RNA, 16 nt, Human
gaccacuugaggccug

SEQ ID NO: 3809694 - RNA, 17 nt, Human
gaccacuugaggccuga

SEQ ID NO: 3809695 - RNA, 16 nt, Human
gaccagaagccaaaga

SEQ ID NO: 3809696 - RNA, 20 nt, Human
gaccagaagcucccccagca

SEQ ID NO: 3809697 - RNA, 23 nt, Human
gaccagacaccuugacagggcac

SEQ ID NO: 3809698 - RNA, 21 nt, Human
gaccagagccccacacggagg

SEQ ID NO: 3809699 - RNA, 14 nt, Human
gaccagagcugcca

SEQ ID NO: 3809700 - RNA, 15 nt, Human
gaccagagcugccac

SEQ ID NO: 3809701 - RNA, 17 nt, Human
gaccagagcugccaccu

SEQ ID NO: 3809702 - RNA, 20 nt, Human
gaccagcaccaucucuccuc

SEQ ID NO: 3809703 - RNA, 14 nt, Human
gaccagcagcgccu

SEQ ID NO: 3809704 - RNA, 19 nt, Human
gaccagcauccuuaaguau

SEQ ID NO: 3809705 - RNA, 18 nt, Human
gaccagccagcagcagcc

SEQ ID NO: 3809706 - RNA, 12 nt, Human
gaccagcccacg

SEQ ID NO: 3809707 - RNA, 16 nt, Human
gaccagcccacgcuga

SEQ ID NO: 3809708 - RNA, 18 nt, Human
gaccagccgugagcaugu

SEQ ID NO: 3809709 - RNA, 22 nt, Human
gaccagccgugagcauguuugg

SEQ ID NO: 3809710 - RNA, 22 nt, Human
gaccagccuccaugcugccucc

SEQ ID NO: 3809711 - RNA, 22 nt, Human
gaccagccucccugucggccug

SEQ ID NO: 3809712 - RNA, 17 nt, Human
gaccagccugggcagca

SEQ ID NO: 3809713 - RNA, 18 nt, Human
gaccagcucccccucccu

SEQ ID NO: 3809714 - RNA, 21 nt, Human
gaccagcucccccucccuccc

SEQ ID NO: 3809715 - RNA, 15 nt, Human
gaccagcugcuccga

SEQ ID NO: 3809716 - RNA, 19 nt, Human
gaccagcugcuccgaggac

SEQ ID NO: 3809717 - RNA, 23 nt, Human
gaccagcuggggcguggggaggg

SEQ ID NO: 3809718 - RNA, 22 nt, Human
gaccaggacuauagcccagguc

SEQ ID NO: 3809719 - RNA, 10 nt, Human
gaccaggagu

SEQ ID NO: 3809720 - RNA, 18 nt, Human
gaccaggagugggugggg

SEQ ID NO: 3809721 - RNA, 13 nt, Human
gaccaggauccag

SEQ ID NO: 3809722 - RNA, 23 nt, Human
gaccaggcauccuccacaauagc

SEQ ID NO: 3809723 - RNA, 19 nt, Human
gaccaggccauucugccgc

SEQ ID NO: 3809724 - RNA, 15 nt, Human
gaccaggcuguagga

SEQ ID NO: 3809725 - RNA, 15 nt, Human
gaccaggcugugucc

SEQ ID NO: 3809726 - RNA, 16 nt, Human
gaccaggcuuggccuu

SEQ ID NO: 3809727 - RNA, 22 nt, Human
gaccagggagccuuugguucug

SEQ ID NO: 3809728 - RNA, 22 nt, Human
gaccaggggugauuucagagag

SEQ ID NO: 3809729 - RNA, 23 nt, Human
gaccaggggugauuucagagagg

SEQ ID NO: 3809730 - RNA, 23 nt, Human
gaccaguugaauaaaagugcaca

SEQ ID NO: 3809731 - RNA, 19 nt, Human
gaccauaacagccaacagg

SEQ ID NO: 3809732 - RNA, 23 nt, Human
gaccaucauuucaccugcugcuu

SEQ ID NO: 3809733 - RNA, 23 nt, Human
gaccauccacucuacccucccac

SEQ ID NO: 3809734 - RNA, 12 nt, Human
gaccaucccuga

SEQ ID NO: 3809735 - RNA, 17 nt, Human
gaccaucccugaaggcc

SEQ ID NO: 3809736 - RNA, 20 nt, Human
gaccaucccugaaggccccg

SEQ ID NO: 3809737 - RNA, 22 nt, Human
gaccaucccugaaggccccgcc

SEQ ID NO: 3809738 - RNA, 13 nt, Human
gaccauccuggcu

SEQ ID NO: 3809739 - RNA, 19 nt, Human
gaccaucuggaauugguuu

SEQ ID NO: 3809740 - RNA, 20 nt, Human
gaccaugcugucuggcacag

SEQ ID NO: 3809741 - RNA, 21 nt, Human
gaccauggacacuacacccag

SEQ ID NO: 3809742 - RNA, 22 nt, Human
gaccauggaguggcagcccagc

SEQ ID NO: 3809743 - RNA, 12 nt, Human
gaccauguggcc

SEQ ID NO: 3809744 - RNA, 12 nt, Human
gaccauguguca

SEQ ID NO: 3809745 - RNA, 16 nt, Human
gaccauucuccaccug

SEQ ID NO: 3809746 - RNA, 17 nt, Human
gaccauuggggcuccca

SEQ ID NO: 3809747 - RNA, 20 nt, Human
gaccauuggggcucccagcc

SEQ ID NO: 3809748 - RNA, 16 nt, Human
gaccauugucucagag

SEQ ID NO: 3809749 - RNA, 17 nt, Human
gaccauuuaacaugcaa

SEQ ID NO: 3809750 - RNA, 14 nt, Human
gaccauuuuccugc

SEQ ID NO: 3809751 - RNA, 19 nt, Human
gaccauuuuccugcauugg

SEQ ID NO: 3809752 - RNA, 19 nt, Human
gaccauuuuuuaauuuacu

SEQ ID NO: 3809753 - RNA, 23 nt, Human
gaccauuuuuuaauuuacuuguu

SEQ ID NO: 3809754 - RNA, 18 nt, Human
gacccaaaaggcagaagc

SEQ ID NO: 3809755 - RNA, 13 nt, Human
gacccaaagacca

SEQ ID NO: 3809756 - RNA, 16 nt, Human
gacccaaggaaaacug

SEQ ID NO: 3809757 - RNA, 15 nt, Human
gacccacaagaaaug

SEQ ID NO: 3809758 - RNA, 16 nt, Human
gacaccuaggcuaggg

SEQ ID NO: 3809759 - RNA, 13 nt, Human
gacaccucuuuuu

SEQ ID NO: 3809760 - RNA, 15 nt, Human
gacaccugcaccucc

SEQ ID NO: 3809761 - RNA, 10 nt, Human
gacaccugcc

SEQ ID NO: 3809762 - RNA, 11 nt, Human
gacaccugccc

SEQ ID NO: 3809763 - RNA, 14 nt, Human
gacaccugcccugc

SEQ ID NO: 3809764 - RNA, 22 nt, Human
gacaccugcccugcccugccac

SEQ ID NO: 3809765 - RNA, 17 nt, Human
gacaccuugacagggca

SEQ ID NO: 3809766 - RNA, 20 nt, Human
gacaccuugacagggcacac

SEQ ID NO: 3809767 - RNA, 17 nt, Human
gacacgaauauugcuga

SEQ ID NO: 3809768 - RNA, 22 nt, Human
gacacgaauauugcugauggug

SEQ ID NO: 3809769 - RNA, 23 nt, Human
gacacgcgccccccucccagagg

SEQ ID NO: 3809770 - RNA, 21 nt, Human
gacacgggccuguccacaggc

SEQ ID NO: 3809771 - RNA, 22 nt, Human
gacacgggccuguccacaggcu

SEQ ID NO: 3809772 - RNA, 18 nt, Human
gacacggguggggaaagg

SEQ ID NO: 3809773 - RNA, 14 nt, Human
gacacguccacccc

SEQ ID NO: 3809774 - RNA, 15 nt, Human
gacacguccacccca

SEQ ID NO: 3809775 - RNA, 18 nt, Human
gacacgugggcuccccuc

SEQ ID NO: 3809776 - RNA, 15 nt, Human
gacacuaaccacgcu

SEQ ID NO: 3809777 - RNA, 20 nt, Human
gacacuaaccacgcuggacc

SEQ ID NO: 3809778 - RNA, 21 nt, Human
gacacuaaccacgcuggaccu

SEQ ID NO: 3809779 - RNA, 20 nt, Human
gacacuaaguuauaguauau

SEQ ID NO: 3809780 - RNA, 15 nt, Human
gacacuacacccagc

SEQ ID NO: 3809781 - RNA, 19 nt, Human
gacacuacacccagcaaua

SEQ ID NO: 3809782 - RNA, 16 nt, Human
gacacuagaagauuuu

SEQ ID NO: 3809783 - RNA, 13 nt, Human
gacacuauaucug

SEQ ID NO: 3809784 - RNA, 13 nt, Human
gacacucagaccu

SEQ ID NO: 3809785 - RNA, 14 nt, Human
gacacuccagugcc

SEQ ID NO: 3809786 - RNA, 16 nt, Human
gacacucccacccagu

SEQ ID NO: 3809787 - RNA, 16 nt, Human
gacacuccccgaaguc

SEQ ID NO: 3809788 - RNA, 21 nt, Human
gacacucccuugggcucccug

SEQ ID NO: 3809789 - RNA, 15 nt, Human
gacacucucuggaag

SEQ ID NO: 3809790 - RNA, 12 nt, Human
gacacucugcuc

SEQ ID NO: 3809791 - RNA, 16 nt, Human
gacacucugcucugcc

SEQ ID NO: 3809792 - RNA, 13 nt, Human
gacacugaugggc

SEQ ID NO: 3809793 - RNA, 16 nt, Human
gacacugcggggcuug

SEQ ID NO: 3809794 - RNA, 20 nt, Human
gacacugcggggcuuggcug

SEQ ID NO: 3809795 - RNA, 20 nt, Human
gacacugcucuaacagcccu

SEQ ID NO: 3809796 - RNA, 17 nt, Human
gacacugggaggccagu

SEQ ID NO: 3809797 - RNA, 14 nt, Human
gacacuggugggga

SEQ ID NO: 3809798 - RNA, 12 nt, Human
gacacuguacaa

SEQ ID NO: 3809799 - RNA, 13 nt, Human
gacacuguacaag

SEQ ID NO: 3809800 - RNA, 23 nt, Human
gacacugugcccagcccggaccu

SEQ ID NO: 3809801 - RNA, 17 nt, Human
gacacuuaauucuguuc

SEQ ID NO: 3809802 - RNA, 23 nt, Human
gacacuuauccacgagagcgcag

SEQ ID NO: 3809803 - RNA, 17 nt, Human
gacacuucagagagcug

SEQ ID NO: 3809804 - RNA, 20 nt, Human
gacacuucagagagcuggua

SEQ ID NO: 3809805 - RNA, 23 nt, Human
gacacuucagagagcugguaguu

SEQ ID NO: 3809806 - RNA, 12 nt, Human
gacacuuccugc

SEQ ID NO: 3809807 - RNA, 14 nt, Human
gacacuugucccca

SEQ ID NO: 3809808 - RNA, 19 nt, Human
gacacuuugaaauguguuu

SEQ ID NO: 3809809 - RNA, 19 nt, Human
gacacuuuuuugaguggau

SEQ ID NO: 3809810 - RNA, 12 nt, Human
gacagaaagcag

SEQ ID NO: 3809811 - RNA, 20 nt, Human
gacagaaagcagaacaguga

SEQ ID NO: 3809812 - RNA, 21 nt, Human
gacagaaagcagaacagugau

SEQ ID NO: 3809813 - RNA, 13 nt, Human
gacagaagaaggc

SEQ ID NO: 3809814 - RNA, 16 nt, Human
gacagaaggaccagcc

SEQ ID NO: 3809815 - RNA, 14 nt, Human
gacagaaggcuccu

SEQ ID NO: 3809816 - RNA, 16 nt, Human
gacagaaggcuccugc

SEQ ID NO: 3809817 - RNA, 15 nt, Human
gacagaagucuccuc

SEQ ID NO: 3809818 - RNA, 22 nt, Human
gacagaaguuugcacuaucuuu

SEQ ID NO: 3809819 - RNA, 21 nt, Human
gacagaauuuuuuuuguuguu

SEQ ID NO: 3809820 - RNA, 15 nt, Human
gacagacacaggccc

SEQ ID NO: 3809821 - RNA, 16 nt, Human
gacagacacaggcccg

SEQ ID NO: 3809822 - RNA, 17 nt, Human
gacagacacaggcccgg

SEQ ID NO: 3809823 - RNA, 22 nt, Human
gacagacacaggcccggcucca

SEQ ID NO: 3809824 - RNA, 15 nt, Human
gacagacaggcucuu

SEQ ID NO: 3809825 - RNA, 21 nt, Human
gacagacaggcucuuagcagc

SEQ ID NO: 3809826 - RNA, 18 nt, Human
gacagacaucucugcacc

SEQ ID NO: 3809827 - RNA, 18 nt, Human
gacagagacaccugcacc

SEQ ID NO: 3809828 - RNA, 20 nt, Human
gacagagacccucugccacc

SEQ ID NO: 3809829 - RNA, 15 nt, Human
gacagagaccuccug

SEQ ID NO: 3809830 - RNA, 21 nt, Human
gacagagcaagugagacccug

SEQ ID NO: 3809831 - RNA, 15 nt, Human
gacagagccaggaga

SEQ ID NO: 3809832 - RNA, 21 nt, Human
gacagagccccacccucagau

SEQ ID NO: 3809833 - RNA, 15 nt, Human
gacagagccugcccc

SEQ ID NO: 3809834 - RNA, 16 nt, Human
gacagagccugcccca

SEQ ID NO: 3809835 - RNA, 12 nt, Human
gacagaggaggg

SEQ ID NO: 3809836 - RNA, 12 nt, Human
gacagaggcagc

SEQ ID NO: 3809837 - RNA, 13 nt, Human
gacagaggcccuc

SEQ ID NO: 3809838 - RNA, 17 nt, Human
gacagaggggacucugg

SEQ ID NO: 3809839 - RNA, 18 nt, Human
gacagagggucacagugu

SEQ ID NO: 3809840 - RNA, 13 nt, Human
gacagagucuggg

SEQ ID NO: 3809841 - RNA, 21 nt, Human
gacagaguucacuauaaaugg

SEQ ID NO: 3809842 - RNA, 16 nt, Human
gacagaguugauuuuu

SEQ ID NO: 3809843 - RNA, 17 nt, Human
gacagauaccuccaacc

SEQ ID NO: 3809844 - RNA, 22 nt, Human
gacagauaccuccaacccugcc

SEQ ID NO: 3809845 - RNA, 15 nt, Human
gacagaucauagauu

SEQ ID NO: 3809846 - RNA, 21 nt, Human
gacagaucauagauuucugau

SEQ ID NO: 3809847 - RNA, 23 nt, Human
gacagaucauagauuucugauuu

SEQ ID NO: 3809848 - RNA, 23 nt, Human
gacagaucucugcuuuggaaauc

SEQ ID NO: 3809849 - RNA, 19 nt, Human
gacagaugaaugccgugga

SEQ ID NO: 3809850 - RNA, 18 nt, Human
gacagaugccccagagcu

SEQ ID NO: 3809851 - RNA, 17 nt, Human
gacagaugucagccgag

SEQ ID NO: 3809852 - RNA, 18 nt, Human
gacagaugucagccgagc

SEQ ID NO: 3809853 - RNA, 16 nt, Human
gacagcaaaaccauug

SEQ ID NO: 3809854 - RNA, 21 nt, Human
gacagcaaaaccauugcuuca

SEQ ID NO: 3809855 - RNA, 14 nt, Human
gacagcagcucagg

SEQ ID NO: 3809856 - RNA, 18 nt, Human
gacagcagcucaggcaca

SEQ ID NO: 3809857 - RNA, 12 nt, Human
gacagcaggcag

SEQ ID NO: 3809858 - RNA, 19 nt, Human
gacagcagucuuaugcuuc

SEQ ID NO: 3809859 - RNA, 19 nt, Human
gacagcaugugcccuccug

SEQ ID NO: 3809860 - RNA, 21 nt, Human
gacagcaugugcccuccugag

SEQ ID NO: 3809861 - RNA, 17 nt, Human
gacagcccacugagaag

SEQ ID NO: 3809862 - RNA, 23 nt, Human
gacagcccaggauacuggcacag

SEQ ID NO: 3809863 - RNA, 14 nt, Human
gacagccccacccu

SEQ ID NO: 3809864 - RNA, 19 nt, Human
gacagccccagagcagggu

SEQ ID NO: 3809865 - RNA, 24 nt, Human
gacagcccgauccuccccuggacu

SEQ ID NO: 3809866 - RNA, 22 nt, Human
gacagcccgggcucugccuccc

SEQ ID NO: 3809867 - RNA, 15 nt, Human
gacagccgccuggag

SEQ ID NO: 3809868 - RNA, 12 nt, Human
gacagccuggca

SEQ ID NO: 3809869 - RNA, 19 nt, Human
gacagccuggcacagggca

SEQ ID NO: 3809870 - RNA, 11 nt, Human
gacagccugua

SEQ ID NO: 3809871 - RNA, 22 nt, Human
gacagccuguggcggugccugg

SEQ ID NO: 3809872 - RNA, 18 nt, Human
gacagcgcacagcugcuc

SEQ ID NO: 3809873 - RNA, 14 nt, Human
gacagcuccuucug

SEQ ID NO: 3809874 - RNA, 15 nt, Human
gacagcuccuucugu

SEQ ID NO: 3809875 - RNA, 18 nt, Human
gacagcuccuucuguccu

SEQ ID NO: 3809876 - RNA, 15 nt, Human
gacagcucugccugu

SEQ ID NO: 3809877 - RNA, 20 nt, Human
gacagcucuuuuugugaagu

SEQ ID NO: 3809878 - RNA, 14 nt, Human
gacagcugccuggg

SEQ ID NO: 3809879 - RNA, 21 nt, Human
gacagcugccugggaucccuc

SEQ ID NO: 3809880 - RNA, 14 nt, Human
gacagcugucccug

SEQ ID NO: 3809881 - RNA, 17 nt, Human
gacagcugucccuguca

SEQ ID NO: 3809882 - RNA, 13 nt, Human
gacagcugugccu

SEQ ID NO: 3809883 - RNA, 15 nt, Human
gacagcugugccucg

SEQ ID NO: 3809884 - RNA, 17 nt, Human
gacagcugugccucgcu

SEQ ID NO: 3809885 - RNA, 21 nt, Human
gacagcuucucauccugcagg

SEQ ID NO: 3809886 - RNA, 22 nt, Human
gacagcuugagccgggccccug

SEQ ID NO: 3809887 - RNA, 12 nt, Human
gacaggaaaggg

SEQ ID NO: 3809888 - RNA, 23 nt, Human
gacaggacagugcuucagccuga

SEQ ID NO: 3809889 - RNA, 15 nt, Human
gacaggaccagggau

SEQ ID NO: 3809890 - RNA, 15 nt, Human
gacaggaccccagcu

SEQ ID NO: 3809891 - RNA, 20 nt, Human
gacaggaccccagcucugcg

SEQ ID NO: 3809892 - RNA, 14 nt, Human
gacaggaccccugc

SEQ ID NO: 3809893 - RNA, 21 nt, Human
gacaggacgcugaccguggag

SEQ ID NO: 3809894 - RNA, 22 nt, Human
gacaggacgcugaccguggagc

SEQ ID NO: 3809895 - RNA, 22 nt, Human
gacaggacuaacacucagaagc

SEQ ID NO: 3809896 - RNA, 11 nt, Human
gacaggagaaa

SEQ ID NO: 3809897 - RNA, 18 nt, Human
gacaggagaccuggcacu

SEQ ID NO: 3809898 - RNA, 21 nt, Human
gacaggagaccuggcacugga

SEQ ID NO: 3809899 - RNA, 22 nt, Human
gacaggagagauuauuuacaag

SEQ ID NO: 3809900 - RNA, 22 nt, Human
gacaggagaugcugugccccug

SEQ ID NO: 3809901 - RNA, 15 nt, Human
gacaggauccaggcc

SEQ ID NO: 3809902 - RNA, 16 nt, Human
gacaggaugggggcug

SEQ ID NO: 3809903 - RNA, 23 nt, Human
gacaggaugggggcuggccucug

SEQ ID NO: 3809904 - RNA, 20 nt, Human
gacaggauguguuugcuuuc

SEQ ID NO: 3809905 - RNA, 17 nt, Human
gacaggcaagcaccucc

SEQ ID NO: 3809906 - RNA, 14 nt, Human
gacaggcaaugcug

SEQ ID NO: 3809907 - RNA, 17 nt, Human
gacaggcaaugcuggcu

SEQ ID NO: 3809908 - RNA, 21 nt, Human
cucagcaccccuuccaugugg

SEQ ID NO: 3809909 - RNA, 18 nt, Human
cucagcacugccugcucc

SEQ ID NO: 3809910 - RNA, 16 nt, Human
cucagcacuuggcccu

SEQ ID NO: 3809911 - RNA, 17 nt, Human
cucagcacuuggcccuu

SEQ ID NO: 3809912 - RNA, 18 nt, Human
cucagcacuuggcccuuc

SEQ ID NO: 3809913 - RNA, 13 nt, Human
cucagcagcccuc

SEQ ID NO: 3809914 - RNA, 19 nt, Human
cucagcagcgaccaccccu

SEQ ID NO: 3809915 - RNA, 20 nt, Human
cucagcagcugguaaucuug

SEQ ID NO: 3809916 - RNA, 17 nt, Human
cucagcauccuggcacc

SEQ ID NO: 3809917 - RNA, 18 nt, Human
cucagcauccuggcaccc

SEQ ID NO: 3809918 - RNA, 22 nt, Human
cucagcauccuggcacccggcc

SEQ ID NO: 3809919 - RNA, 16 nt, Human
cucagcaugcauccuu

SEQ ID NO: 3809920 - RNA, 20 nt, Human
cucagcauuaccucuuugga

SEQ ID NO: 3809921 - RNA, 22 nt, Human
cucagccaaccuuacuuacagc

SEQ ID NO: 3809922 - RNA, 17 nt, Human
cucagccaagcacagug

SEQ ID NO: 3809923 - RNA, 14 nt, Human
cucagccaagcuug

SEQ ID NO: 3809924 - RNA, 17 nt, Human
cucagccacccugaguu

SEQ ID NO: 3809925 - RNA, 12 nt, Human
cucagccagaga

SEQ ID NO: 3809926 - RNA, 14 nt, Human
cucagccagagaag

SEQ ID NO: 3809927 - RNA, 15 nt, Human
cucagccaugaggag

SEQ ID NO: 3809928 - RNA, 19 nt, Human
cucagccccaccccagggc

SEQ ID NO: 3809929 - RNA, 21 nt, Human
cucagccccaccccagggcag

SEQ ID NO: 3809930 - RNA, 11 nt, Human
cucagccccag

SEQ ID NO: 3809931 - RNA, 16 nt, Human
cucagccccagcccag

SEQ ID NO: 3809932 - RNA, 23 nt, Human
cucagccccagcccagcccagcu

SEQ ID NO: 3809933 - RNA, 16 nt, Human
cucagccccgagcugu

SEQ ID NO: 3809934 - RNA, 19 nt, Human
cucagccccgagcuguccc

SEQ ID NO: 3809935 - RNA, 17 nt, Human
cucagccccgcguggaa

SEQ ID NO: 3809936 - RNA, 11 nt, Human
cucagccccua

SEQ ID NO: 3809937 - RNA, 12 nt, Human
cucagccccuag

SEQ ID NO: 3809938 - RNA, 13 nt, Human
cucagccccucuu

SEQ ID NO: 3809939 - RNA, 23 nt, Human
cucagccccugauccugugaagu

SEQ ID NO: 3809940 - RNA, 17 nt, Human
cucagcccucacacacc

SEQ ID NO: 3809941 - RNA, 14 nt, Human
cucagcccucccug

SEQ ID NO: 3809942 - RNA, 19 nt, Human
cucagcccugacuggugcu

SEQ ID NO: 3809943 - RNA, 14 nt, Human
cucagcccugaggu

SEQ ID NO: 3809944 - RNA, 15 nt, Human
cucagcccugcacca

SEQ ID NO: 3809945 - RNA, 11 nt, Human
cucagcccugg

SEQ ID NO: 3809946 - RNA, 22 nt, Human
cucagcccuggaggugccagca

SEQ ID NO: 3809947 - RNA, 19 nt, Human
cucagcccugggccccacc

SEQ ID NO: 3809948 - RNA, 21 nt, Human
cucagcccugggccccaccac

SEQ ID NO: 3809949 - RNA, 17 nt, Human
cucagccucccaaagug

SEQ ID NO: 3809950 - RNA, 22 nt, Human
cucagccuccuguguagcuggg

SEQ ID NO: 3809951 - RNA, 14 nt, Human
cucagccugcugcc

SEQ ID NO: 3809952 - RNA, 15 nt, Human
cucagccugcugccc

SEQ ID NO: 3809953 - RNA, 14 nt, Human
cucagccuggccag

SEQ ID NO: 3809954 - RNA, 12 nt, Human
cucagccugggc

SEQ ID NO: 3809955 - RNA, 14 nt, Human
cucagccugggcgc

SEQ ID NO: 3809956 - RNA, 16 nt, Human
cucagccuggugggcc

SEQ ID NO: 3809957 - RNA, 19 nt, Human
cucagccuggugggccucc

SEQ ID NO: 3809958 - RNA, 18 nt, Human
cucagccuuacauuugug

SEQ ID NO: 3809959 - RNA, 22 nt, Human
cucagccuuccccuugcccagg

SEQ ID NO: 3809960 - RNA, 23 nt, Human
cucagccuuccccuugcccaggg

SEQ ID NO: 3809961 - RNA, 15 nt, Human
cucagccuugccaga

SEQ ID NO: 3809962 - RNA, 16 nt, Human
cucagccuugccagag

SEQ ID NO: 3809963 - RNA, 18 nt, Human
cucagccuugccagagau

SEQ ID NO: 3809964 - RNA, 20 nt, Human
cucagccuugccagagaucc

SEQ ID NO: 3809965 - RNA, 21 nt, Human
cucagccuugccagagaucca

SEQ ID NO: 3809966 - RNA, 22 nt, Human
cucagccuugccagagauccaa

SEQ ID NO: 3809967 - RNA, 20 nt, Human
cucagcggcgaccgcccucc

SEQ ID NO: 3809968 - RNA, 20 nt, Human
cucagcggggacagcuccuu

SEQ ID NO: 3809969 - RNA, 21 nt, Human
cucagcggggacagcuccuuc

SEQ ID NO: 3809970 - RNA, 15 nt, Human
cucagcuaagcucac

SEQ ID NO: 3809971 - RNA, 14 nt, Human
cucagcucaaugca

SEQ ID NO: 3809972 - RNA, 14 nt, Human
cucagcucauccau

SEQ ID NO: 3809973 - RNA, 22 nt, Human
cucagcuccagacguaggggag

SEQ ID NO: 3809974 - RNA, 19 nt, Human
cucagcuccagguggcucu

SEQ ID NO: 3809975 - RNA, 20 nt, Human
cucagcuccagguggcucug

SEQ ID NO: 3809976 - RNA, 10 nt, Human
cucagcuccc

SEQ ID NO: 3809977 - RNA, 16 nt, Human
cucagcucccauuucu

SEQ ID NO: 3809978 - RNA, 11 nt, Human
cucagcucccc

SEQ ID NO: 3809979 - RNA, 16 nt, Human
cucagcuccccagagu

SEQ ID NO: 3809980 - RNA, 20 nt, Human
cucagcucccccuguccccu

SEQ ID NO: 3809981 - RNA, 13 nt, Human
cucagcucggcuc

SEQ ID NO: 3809982 - RNA, 14 nt, Human
cucagcucggcuca

SEQ ID NO: 3809983 - RNA, 18 nt, Human
cucagcucggcucagcuc

SEQ ID NO: 3809984 - RNA, 15 nt, Human
cucagcucuggcuca

SEQ ID NO: 3809985 - RNA, 15 nt, Human
cucagcucugggaga

SEQ ID NO: 3809986 - RNA, 18 nt, Human
cucagcucugggagagga

SEQ ID NO: 3809987 - RNA, 12 nt, Human
cucagcugccuc

SEQ ID NO: 3809988 - RNA, 18 nt, Human
cucagcugccucacuucc

SEQ ID NO: 3809989 - RNA, 19 nt, Human
cucagcugucaaggcucag

SEQ ID NO: 3809990 - RNA, 17 nt, Human
cucagcuguccugcagc

SEQ ID NO: 3809991 - RNA, 18 nt, Human
cucagcuguccugcagca

SEQ ID NO: 3809992 - RNA, 17 nt, Human
cucagcuuccccaacac

SEQ ID NO: 3809993 - RNA, 19 nt, Human
cucagcuuccccaguagcu

SEQ ID NO: 3809994 - RNA, 14 nt, Human
cucagcuuccuacc

SEQ ID NO: 3809995 - RNA, 17 nt, Human
cucagcuuuuugucuuu

SEQ ID NO: 3809996 - RNA, 21 nt, Human
cucagcuuuuugucuuuucug

SEQ ID NO: 3809997 - RNA, 22 nt, Human
cucaggaaacgagacuuuccau

SEQ ID NO: 3809998 - RNA, 21 nt, Human
cucaggaaagaauagaaagaa

SEQ ID NO: 3809999 - RNA, 15 nt, Human
cucaggaaaugcuga

SEQ ID NO: 3810000 - RNA, 20 nt, Human
cucaggaaaugcugacccau

SEQ ID NO: 3810001 - RNA, 17 nt, Human
cucaggaaccgaggcag

SEQ ID NO: 3810002 - RNA, 12 nt, Human
cucaggaagaac

SEQ ID NO: 3810003 - RNA, 14 nt, Human
cucaggaagaacac

SEQ ID NO: 3810004 - RNA, 19 nt, Human
cucaggaagcccccaaguu

SEQ ID NO: 3810005 - RNA, 20 nt, Human
cucaggacacaggccugugu

SEQ ID NO: 3810006 - RNA, 21 nt, Human
cucaggacacaggccugugua

SEQ ID NO: 3810007 - RNA, 18 nt, Human
cucaggacagaugccaca

SEQ ID NO: 3810008 - RNA, 14 nt, Human
cucaggacccucgc

SEQ ID NO: 3810009 - RNA, 17 nt, Human
cucaggacccucgcugg

SEQ ID NO: 3810010 - RNA, 19 nt, Human
cucaggacccucgcuggcc

SEQ ID NO: 3810011 - RNA, 12 nt, Human
cucaggaccuag

SEQ ID NO: 3810012 - RNA, 16 nt, Human
cucaggacucagaagc

SEQ ID NO: 3810013 - RNA, 17 nt, Human
cucaggacuccagccca

SEQ ID NO: 3810014 - RNA, 12 nt, Human
cucaggagcaca

SEQ ID NO: 3810015 - RNA, 14 nt, Human
cucaggagcacagg

SEQ ID NO: 3810016 - RNA, 12 nt, Human
cucaggagccau

SEQ ID NO: 3810017 - RNA, 13 nt, Human
cucaggagcccug

SEQ ID NO: 3810018 - RNA, 22 nt, Human
cucaggagcccugggaggcucu

SEQ ID NO: 3810019 - RNA, 13 nt, Human
cucaggaggcuga

SEQ ID NO: 3810020 - RNA, 17 nt, Human
cucaggaggcugaggca

SEQ ID NO: 3810021 - RNA, 19 nt, Human
cucaggaggcugaggcaga

SEQ ID NO: 3810022 - RNA, 23 nt, Human
cucaggaggcugaggcagaagaa

SEQ ID NO: 3810023 - RNA, 22 nt, Human
cucaggaggcugaggcaggagg

SEQ ID NO: 3810024 - RNA, 18 nt, Human
cucaggauccaagcuaag

SEQ ID NO: 3810025 - RNA, 20 nt, Human
cucaggauccaagcuaagca

SEQ ID NO: 3810026 - RNA, 22 nt, Human
cucaggaugcccagggccacuc

SEQ ID NO: 3810027 - RNA, 14 nt, Human
cucaggcacacagc

SEQ ID NO: 3810028 - RNA, 14 nt, Human
cucaggcaccaguc

SEQ ID NO: 3810029 - RNA, 15 nt, Human
cucaggcaggggccu

SEQ ID NO: 3810030 - RNA, 21 nt, Human
cucaggcauaggccugggugc

SEQ ID NO: 3810031 - RNA, 22 nt, Human
cucaggcauaggccugggugcu

SEQ ID NO: 3810032 - RNA, 18 nt, Human
cucaggcaucauuccacc

SEQ ID NO: 3810033 - RNA, 15 nt, Human
cucaggcaugccugu

SEQ ID NO: 3810034 - RNA, 20 nt, Human
cucaggccaagaaacgucuu

SEQ ID NO: 3810035 - RNA, 22 nt, Human
cucaggccaccugcccccuucu

SEQ ID NO: 3810036 - RNA, 23 nt, Human
cucaggccaccugcccccuucuc

SEQ ID NO: 3810037 - RNA, 16 nt, Human
cucaggccagagccaa

SEQ ID NO: 3810038 - RNA, 17 nt, Human
cucaggccagagccaag

SEQ ID NO: 3810039 - RNA, 13 nt, Human
cucaggccagcug

SEQ ID NO: 3810040 - RNA, 14 nt, Human
cucaggccagcugc

SEQ ID NO: 3810041 - RNA, 17 nt, Human
cucaggccagcugcuug

SEQ ID NO: 3810042 - RNA, 21 nt, Human
cucaggccagcugcuugggcu

SEQ ID NO: 3810043 - RNA, 16 nt, Human
cucaggcccaaagccu

SEQ ID NO: 3810044 - RNA, 23 nt, Human
cucaggccgaaggaggagucagg

SEQ ID NO: 3810045 - RNA, 21 nt, Human
cucaggccggcagccccagcc

SEQ ID NO: 3810046 - RNA, 22 nt, Human
cucaggccggcagccccagccu

SEQ ID NO: 3810047 - RNA, 23 nt, Human
cucaggccuauaaccccagcucc

SEQ ID NO: 3810048 - RNA, 18 nt, Human
cucaggccucugugccgc

SEQ ID NO: 3810049 - RNA, 20 nt, Human
cucaggccugacucucagca

SEQ ID NO: 3810050 - RNA, 20 nt, Human
cucaggccugggggcugggc

SEQ ID NO: 3810051 - RNA, 21 nt, Human
cucaggcgggacagugcugca

SEQ ID NO: 3810052 - RNA, 17 nt, Human
cucaggcucugcccugc

SEQ ID NO: 3810053 - RNA, 18 nt, Human
cucaggcugcagcuggac

SEQ ID NO: 3810054 - RNA, 19 nt, Human
cucaggcugcagcuggaca

SEQ ID NO: 3810055 - RNA, 21 nt, Human
cucaggcugcagcuggacaga

SEQ ID NO: 3810056 - RNA, 23 nt, Human
cucaggcugcagcuggacagagg

SEQ ID NO: 3810057 - RNA, 22 nt, Human
gacccacaagaaaugaaagcag

SEQ ID NO: 3810058 - RNA, 23 nt, Human
gacccacagacugguuuugcaac

SEQ ID NO: 3810059 - RNA, 14 nt, Human
gacccacagccucu

SEQ ID NO: 3810060 - RNA, 14 nt, Human
gacccacaugccau

SEQ ID NO: 3810061 - RNA, 23 nt, Human
gacccacaugccauuuguacuga

SEQ ID NO: 3810062 - RNA, 12 nt, Human
gacccaccccug

SEQ ID NO: 3810063 - RNA, 14 nt, Human
gacccaccccugug

SEQ ID NO: 3810064 - RNA, 20 nt, Human
gacccacgaaacugcccugg

SEQ ID NO: 3810065 - RNA, 19 nt, Human
gacccacuggacucaccuc

SEQ ID NO: 3810066 - RNA, 23 nt, Human
gacccacuucacacacaggcaac

SEQ ID NO: 3810067 - RNA, 21 nt, Human
gacccacuucucaucacacac

SEQ ID NO: 3810068 - RNA, 23 nt, Human
gacccacuucucaucacacacau

SEQ ID NO: 3810069 - RNA, 14 nt, Human
gacccagacccagu

SEQ ID NO: 3810070 - RNA, 20 nt, Human
gacccagauccucacaacca

SEQ ID NO: 3810071 - RNA, 17 nt, Human
gacccagcacugcccaa

SEQ ID NO: 3810072 - RNA, 22 nt, Human
gacccagccaggcccagccgac

SEQ ID NO: 3810073 - RNA, 22 nt, Human
gacccagccccuugagaaaccu

SEQ ID NO: 3810074 - RNA, 17 nt, Human
gacccagcccucauccc

SEQ ID NO: 3810075 - RNA, 11 nt, Human
gacccaggcac

SEQ ID NO: 3810076 - RNA, 19 nt, Human
gacccaggccgcagcucuu

SEQ ID NO: 3810077 - RNA, 12 nt, Human
gacccaggcucc

SEQ ID NO: 3810078 - RNA, 23 nt, Human
gacccaggcuccgcccuuagucc

SEQ ID NO: 3810079 - RNA, 13 nt, Human
gacccaggcuggg

SEQ ID NO: 3810080 - RNA, 20 nt, Human
gacccagggaacagccacuc

SEQ ID NO: 3810081 - RNA, 16 nt, Human
gacccaggguucccgc

SEQ ID NO: 3810082 - RNA, 16 nt, Human
gacccagucccugggg

SEQ ID NO: 3810083 - RNA, 22 nt, Human
gacccaguggcagggcacaggg

SEQ ID NO: 3810084 - RNA, 23 nt, Human
gacccaguggcagggcacagggc

SEQ ID NO: 3810085 - RNA, 14 nt, Human
gacccaugcugccc

SEQ ID NO: 3810086 - RNA, 15 nt, Human
gacccauuccuuccc

SEQ ID NO: 3810087 - RNA, 20 nt, Human
gacccauucuacacagagca

SEQ ID NO: 3810088 - RNA, 15 nt, Human
gaccccaccagccuc

SEQ ID NO: 3810089 - RNA, 12 nt, Human
gaccccagcugg

SEQ ID NO: 3810090 - RNA, 13 nt, Human
gaccccagcuggg

SEQ ID NO: 3810091 - RNA, 18 nt, Human
gaccccagcugugagccu

SEQ ID NO: 3810092 - RNA, 15 nt, Human
gaccccaggcccacu

SEQ ID NO: 3810093 - RNA, 17 nt, Human
gaccccaggcccacuca

SEQ ID NO: 3810094 - RNA, 13 nt, Human
gaccccagggcac

SEQ ID NO: 3810095 - RNA, 16 nt, Human
gaccccagggcacagg

SEQ ID NO: 3810096 - RNA, 19 nt, Human
gaccccagggcacaggagc

SEQ ID NO: 3810097 - RNA, 18 nt, Human
gaccccaucugcccagga

SEQ ID NO: 3810098 - RNA, 12 nt, Human
gacccccaacca

SEQ ID NO: 3810099 - RNA, 13 nt, Human
gacccccacaccu

SEQ ID NO: 3810100 - RNA, 13 nt, Human
gacccccaccccu

SEQ ID NO: 3810101 - RNA, 19 nt, Human
gacccccaccccuucccca

SEQ ID NO: 3810102 - RNA, 18 nt, Human
gacccccacucucauucc

SEQ ID NO: 3810103 - RNA, 20 nt, Human
gaccccccaccaccagccgg

SEQ ID NO: 3810104 - RNA, 15 nt, Human
gacccccccagcuuc

SEQ ID NO: 3810105 - RNA, 11 nt, Human
gacccccgccc

SEQ ID NO: 3810106 - RNA, 12 nt, Human
gacccccuggag

SEQ ID NO: 3810107 - RNA, 14 nt, Human
gacccccuuccccu

SEQ ID NO: 3810108 - RNA, 14 nt, Human
gaccccuaguuccc

SEQ ID NO: 3810109 - RNA, 21 nt, Human
gaccccuaugaaguaaagaac

SEQ ID NO: 3810110 - RNA, 14 nt, Human
gaccccuccaugug

SEQ ID NO: 3810111 - RNA, 18 nt, Human
gaccccuccaugugggcu

SEQ ID NO: 3810112 - RNA, 21 nt, Human
gaccccuccaugugggcuagu

SEQ ID NO: 3810113 - RNA, 19 nt, Human
gaccccuccucacuggcca

SEQ ID NO: 3810114 - RNA, 16 nt, Human
gaccccuccucccuuu

SEQ ID NO: 3810115 - RNA, 19 nt, Human
gaccccuccuggggccagg

SEQ ID NO: 3810116 - RNA, 20 nt, Human
gaccccuccuggggccaggc

SEQ ID NO: 3810117 - RNA, 22 nt, Human
gaccccuccuggggccaggccg

SEQ ID NO: 3810118 - RNA, 16 nt, Human
gaccccugagcuugca

SEQ ID NO: 3810119 - RNA, 19 nt, Human
gaccccugagcuugcagag

SEQ ID NO: 3810120 - RNA, 20 nt, Human
gaccccugcaguuccccugg

SEQ ID NO: 3810121 - RNA, 23 nt, Human
gaccccugcccagaucagccaga

SEQ ID NO: 3810122 - RNA, 23 nt, Human
gaccccugcucaguaaagcacuu

SEQ ID NO: 3810123 - RNA, 12 nt, Human
gaccccuggcug

SEQ ID NO: 3810124 - RNA, 12 nt, Human
gaccccugucuu

SEQ ID NO: 3810125 - RNA, 20 nt, Human
gaccccuuuucagcuucugc

SEQ ID NO: 3810126 - RNA, 16 nt, Human
gacccgcucuggacca

SEQ ID NO: 3810127 - RNA, 21 nt, Human
gacccggagcuaacacuggcc

SEQ ID NO: 3810128 - RNA, 22 nt, Human
gacccggagcuaacacuggccc

SEQ ID NO: 3810129 - RNA, 17 nt, Human
gacccggaggggccugg

SEQ ID NO: 3810130 - RNA, 19 nt, Human
gacccggaggggccuggca

SEQ ID NO: 3810131 - RNA, 20 nt, Human
gacccggcacccccugcagc

SEQ ID NO: 3810132 - RNA, 21 nt, Human
gacccggcacccccugcagcu

SEQ ID NO: 3810133 - RNA, 14 nt, Human
gacccguccauuug

SEQ ID NO: 3810134 - RNA, 14 nt, Human
gacccgucuccagc

SEQ ID NO: 3810135 - RNA, 15 nt, Human
gacccgucuccagcu

SEQ ID NO: 3810136 - RNA, 23 nt, Human
gacccguucaugggggagggggc

SEQ ID NO: 3810137 - RNA, 17 nt, Human
gacccuaaaucugagga

SEQ ID NO: 3810138 - RNA, 16 nt, Human
gacccuaaaucuugac

SEQ ID NO: 3810139 - RNA, 14 nt, Human
gacccuaccccacc

SEQ ID NO: 3810140 - RNA, 17 nt, Human
gacccuacuuccugcac

SEQ ID NO: 3810141 - RNA, 16 nt, Human
gacccuauugcugcuu

SEQ ID NO: 3810142 - RNA, 23 nt, Human
gacccucaugcugccaauauccu

SEQ ID NO: 3810143 - RNA, 11 nt, Human
gacccuccaaa

SEQ ID NO: 3810144 - RNA, 15 nt, Human
gacccuccaaggcca

SEQ ID NO: 3810145 - RNA, 19 nt, Human
gacccuccuccucccccag

SEQ ID NO: 3810146 - RNA, 15 nt, Human
gacccuccuguugca

SEQ ID NO: 3810147 - RNA, 18 nt, Human
gacccuccuguugcaccc

SEQ ID NO: 3810148 - RNA, 18 nt, Human
gacccucguggccuuccc

SEQ ID NO: 3810149 - RNA, 14 nt, Human
gacccucuaaccuc

SEQ ID NO: 3810150 - RNA, 11 nt, Human
gacccucucaa

SEQ ID NO: 3810151 - RNA, 21 nt, Human
gacccucucaaacuaacaggc

SEQ ID NO: 3810152 - RNA, 20 nt, Human
gacccucugacccuagcucu

SEQ ID NO: 3810153 - RNA, 14 nt, Human
gacccucugccacc

SEQ ID NO: 3810154 - RNA, 16 nt, Human
gacccucugccaccag

SEQ ID NO: 3810155 - RNA, 14 nt, Human
gacccucugggaac

SEQ ID NO: 3810156 - RNA, 21 nt, Human
gacccucugggaaccucccag

SEQ ID NO: 3810157 - RNA, 13 nt, Human
gacccugaaaugu

SEQ ID NO: 3810158 - RNA, 16 nt, Human
gacccugaaggggcca

SEQ ID NO: 3810159 - RNA, 20 nt, Human
gacccugagcugaccagccg

SEQ ID NO: 3810160 - RNA, 11 nt, Human
gacccugaggc

SEQ ID NO: 3810161 - RNA, 22 nt, Human
gacccugcaaacagaacagggu

SEQ ID NO: 3810162 - RNA, 16 nt, Human
gacccugcacccuccu

SEQ ID NO: 3810163 - RNA, 16 nt, Human
gacccugccaggcaca

SEQ ID NO: 3810164 - RNA, 17 nt, Human
gacccugccaggcacag

SEQ ID NO: 3810165 - RNA, 19 nt, Human
gacccugccaggcacaggc

SEQ ID NO: 3810166 - RNA, 20 nt, Human
gacccugccaggcacaggca

SEQ ID NO: 3810167 - RNA, 21 nt, Human
gacccugccaggcacaggcag

SEQ ID NO: 3810168 - RNA, 22 nt, Human
gacccugccaggcacaggcagg

SEQ ID NO: 3810169 - RNA, 22 nt, Human
gacccugcccugugggccccca

SEQ ID NO: 3810170 - RNA, 13 nt, Human
gacccugccucuc

SEQ ID NO: 3810171 - RNA, 20 nt, Human
gacccugcgaaggggcccug

SEQ ID NO: 3810172 - RNA, 21 nt, Human
gacccugcgaaggggcccugg

SEQ ID NO: 3810173 - RNA, 16 nt, Human
gacccugcuuuagagc

SEQ ID NO: 3810174 - RNA, 13 nt, Human
gacccuggcuccu

SEQ ID NO: 3810175 - RNA, 23 nt, Human
gacccuggcuccuugugccagag

SEQ ID NO: 3810176 - RNA, 19 nt, Human
gacccugggugggcucugu

SEQ ID NO: 3810177 - RNA, 21 nt, Human
gacccugggugggcucugugc

SEQ ID NO: 3810178 - RNA, 17 nt, Human
gacccuguauauagccc

SEQ ID NO: 3810179 - RNA, 12 nt, Human
gacccugucuca

SEQ ID NO: 3810180 - RNA, 23 nt, Human
gacccugucucaaaaaaagaaaa

SEQ ID NO: 3810181 - RNA, 21 nt, Human
gacccugugacauggugccug

SEQ ID NO: 3810182 - RNA, 22 nt, Human
gacccugugacauggugccuga

SEQ ID NO: 3810183 - RNA, 14 nt, Human
gacccuguggaagc

SEQ ID NO: 3810184 - RNA, 16 nt, Human
gacccuguugcuaagc

SEQ ID NO: 3810185 - RNA, 21 nt, Human
gacccuucccaaucagcacug

SEQ ID NO: 3810186 - RNA, 19 nt, Human
gacccuucccuugagcccu

SEQ ID NO: 3810187 - RNA, 21 nt, Human
gacccuugacaccugcugaga

SEQ ID NO: 3810188 - RNA, 19 nt, Human
gacccuugccgucuaccug

SEQ ID NO: 3810189 - RNA, 15 nt, Human
gacccuugugguccc

SEQ ID NO: 3810190 - RNA, 19 nt, Human
gacccuuguggucccaccc

SEQ ID NO: 3810191 - RNA, 18 nt, Human
gaccgaggagggagaguc

SEQ ID NO: 3810192 - RNA, 16 nt, Human
gaccgccagauggggc

SEQ ID NO: 3810193 - RNA, 20 nt, Human
gaccgccagauggggccucu

SEQ ID NO: 3810194 - RNA, 14 nt, Human
gaccgcccccuccu

SEQ ID NO: 3810195 - RNA, 17 nt, Human
gaccgcccuuuuccccu

SEQ ID NO: 3810196 - RNA, 20 nt, Human
gaccgcuuguggggacccag

SEQ ID NO: 3810197 - RNA, 18 nt, Human
gaccggccugccaggagg

SEQ ID NO: 3810198 - RNA, 15 nt, Human
gaccggcggcucgga

SEQ ID NO: 3810199 - RNA, 15 nt, Human
gaccgguacagaaag

SEQ ID NO: 3810200 - RNA, 19 nt, Human
gaccgugaagauacuuugu

SEQ ID NO: 3810201 - RNA, 15 nt, Human
gaccgugaggccaga

SEQ ID NO: 3810202 - RNA, 18 nt, Human
gaccgugggcggggccuu

SEQ ID NO: 3810203 - RNA, 16 nt, Human
gaccuaaauggccuca

SEQ ID NO: 3810204 - RNA, 15 nt, Human
gaccuaaugcuccuu

SEQ ID NO: 3810205 - RNA, 13 nt, Human
gaccuaccucagg

SEQ ID NO: 3810206 - RNA, 13 nt, Human
gaccuacucucau

SEQ ID NO: 3810207 - RNA, 24 nt, Human
gacaggcaaugcuggcuguuggcu

SEQ ID NO: 3810208 - RNA, 20 nt, Human
gacaggcauguucucugagg

SEQ ID NO: 3810209 - RNA, 21 nt, Human
gacaggcauguucucugagga

SEQ ID NO: 3810210 - RNA, 11 nt, Human
gacaggcccaa

SEQ ID NO: 3810211 - RNA, 14 nt, Human
gacaggcccaagag

SEQ ID NO: 3810212 - RNA, 16 nt, Human
gacaggcccaagagau

SEQ ID NO: 3810213 - RNA, 21 nt, Human
gacaggcccaagagaugaaga

SEQ ID NO: 3810214 - RNA, 22 nt, Human
gacaggcccaagagaugaagag

SEQ ID NO: 3810215 - RNA, 13 nt, Human
gacaggcccuggc

SEQ ID NO: 3810216 - RNA, 19 nt, Human
gacaggccucaccucuacc

SEQ ID NO: 3810217 - RNA, 20 nt, Human
gacaggccucaccucuaccc

SEQ ID NO: 3810218 - RNA, 15 nt, Human
gacaggccugaagau

SEQ ID NO: 3810219 - RNA, 19 nt, Human
gacaggccugaagauauua

SEQ ID NO: 3810220 - RNA, 16 nt, Human
gacaggcgaaagaaaa

SEQ ID NO: 3810221 - RNA, 15 nt, Human
gacaggcgagagagg

SEQ ID NO: 3810222 - RNA, 21 nt, Human
gacaggcgagagaggagccag

SEQ ID NO: 3810223 - RNA, 17 nt, Human
gacagggaggacgcucu

SEQ ID NO: 3810224 - RNA, 18 nt, Human
gacagggaggacgcucuc

SEQ ID NO: 3810225 - RNA, 16 nt, Human
gacagggaggugaccc

SEQ ID NO: 3810226 - RNA, 14 nt, Human
gacagggaugagca

SEQ ID NO: 3810227 - RNA, 21 nt, Human
gacagggaugagcauggagcu

SEQ ID NO: 3810228 - RNA, 20 nt, Human
gacagggcauggccaggugg

SEQ ID NO: 3810229 - RNA, 22 nt, Human
gacagggcauggccagguggcc

SEQ ID NO: 3810230 - RNA, 14 nt, Human
gacagggccagugg

SEQ ID NO: 3810231 - RNA, 16 nt, Human
gacagggccagugggg

SEQ ID NO: 3810232 - RNA, 18 nt, Human
gacagggcggggguggcg

SEQ ID NO: 3810233 - RNA, 20 nt, Human
gacagggcuggcccagcccu

SEQ ID NO: 3810234 - RNA, 22 nt, Human
gacagggcuggcccagcccugc

SEQ ID NO: 3810235 - RNA, 20 nt, Human
gacaggggcaggaggaaggg

SEQ ID NO: 3810236 - RNA, 17 nt, Human
gacagggggccagaaca

SEQ ID NO: 3810237 - RNA, 12 nt, Human
gacaggguuuca

SEQ ID NO: 3810238 - RNA, 17 nt, Human
gacaggguuucaccaug

SEQ ID NO: 3810239 - RNA, 22 nt, Human
gacaggguuuugccauguuggc

SEQ ID NO: 3810240 - RNA, 14 nt, Human
gacaggucugggag

SEQ ID NO: 3810241 - RNA, 16 nt, Human
gacagguuagcugcuc

SEQ ID NO: 3810242 - RNA, 17 nt, Human
gacaguaucacugucuu

SEQ ID NO: 3810243 - RNA, 21 nt, Human
gacaguaucacugucuuuccu

SEQ ID NO: 3810244 - RNA, 21 nt, Human
gacaguaugagucaaugugca

SEQ ID NO: 3810245 - RNA, 17 nt, Human
gacagucaaggaguggc

SEQ ID NO: 3810246 - RNA, 14 nt, Human
gacagucaccccag

SEQ ID NO: 3810247 - RNA, 17 nt, Human
gacagucaccucaugga

SEQ ID NO: 3810248 - RNA, 18 nt, Human
gacagucaccucauggaa

SEQ ID NO: 3810249 - RNA, 16 nt, Human
gacaguccagccugga

SEQ ID NO: 3810250 - RNA, 19 nt, Human
gacaguccagccuggagau

SEQ ID NO: 3810251 - RNA, 12 nt, Human
gacagucccugc

SEQ ID NO: 3810252 - RNA, 20 nt, Human
gacagucccugccaauggac

SEQ ID NO: 3810253 - RNA, 16 nt, Human
gacaguccucuccacc

SEQ ID NO: 3810254 - RNA, 17 nt, Human
gacaguccucuccaccu

SEQ ID NO: 3810255 - RNA, 23 nt, Human
gacaguccugggagaaccucagg

SEQ ID NO: 3810256 - RNA, 23 nt, Human
gacagucucaccauuuccccagg

SEQ ID NO: 3810257 - RNA, 13 nt, Human
gacagucuugugc

SEQ ID NO: 3810258 - RNA, 14 nt, Human
gacagugaaagaaa

SEQ ID NO: 3810259 - RNA, 16 nt, Human
gacagugaauauucaa

SEQ ID NO: 3810260 - RNA, 17 nt, Human
gacagugccugggaaug

SEQ ID NO: 3810261 - RNA, 22 nt, Human
gacagugcugcagcucccuggc

SEQ ID NO: 3810262 - RNA, 13 nt, Human
gacaguggcagga

SEQ ID NO: 3810263 - RNA, 15 nt, Human
gacaguggcaggaca

SEQ ID NO: 3810264 - RNA, 23 nt, Human
gacaguguugaaaauguucagaa

SEQ ID NO: 3810265 - RNA, 22 nt, Human
gacaguuaagagaaaugagcuu

SEQ ID NO: 3810266 - RNA, 21 nt, Human
gacaguuauacugucgguuuu

SEQ ID NO: 3810267 - RNA, 19 nt, Human
gacaguucacacccugcaa

SEQ ID NO: 3810268 - RNA, 21 nt, Human
gacaguuccagaagugugacu

SEQ ID NO: 3810269 - RNA, 15 nt, Human
gacaguucugaagaa

SEQ ID NO: 3810270 - RNA, 18 nt, Human
gacaguugggugagaaca

SEQ ID NO: 3810271 - RNA, 18 nt, Human
gacaguugucuagagaua

SEQ ID NO: 3810272 - RNA, 23 nt, Human
gacaguuuaucaugaagccugug

SEQ ID NO: 3810273 - RNA, 16 nt, Human
gacaguuuauuuguug

SEQ ID NO: 3810274 - RNA, 20 nt, Human
gacaguuucuuagcuuuuua

SEQ ID NO: 3810275 - RNA, 20 nt, Human
gacaguuuguaaauguuauu

SEQ ID NO: 3810276 - RNA, 20 nt, Human
gacaguuuuccauaaagaag

SEQ ID NO: 3810277 - RNA, 17 nt, Human
gacauaaaaacaacuuu

SEQ ID NO: 3810278 - RNA, 11 nt, Human
gacauaaagcc

SEQ ID NO: 3810279 - RNA, 15 nt, Human
gacauaacagugcag

SEQ ID NO: 3810280 - RNA, 23 nt, Human
gacauaacguuuuuccuuuaaaa

SEQ ID NO: 3810281 - RNA, 19 nt, Human
gacauaacugacuuaguuc

SEQ ID NO: 3810282 - RNA, 12 nt, Human
gacauacgaaac

SEQ ID NO: 3810283 - RNA, 17 nt, Human
gacauacgaaacacaaa

SEQ ID NO: 3810284 - RNA, 16 nt, Human
gacauacgcuuuuaau

SEQ ID NO: 3810285 - RNA, 15 nt, Human
gacauacuaaccagc

SEQ ID NO: 3810286 - RNA, 23 nt, Human
gacauacuaaccagcagaaaugc

SEQ ID NO: 3810287 - RNA, 14 nt, Human
gacauacuugaagg

SEQ ID NO: 3810288 - RNA, 17 nt, Human
gacauacuugaagggcc

SEQ ID NO: 3810289 - RNA, 18 nt, Human
gacauacuugaagggcca

SEQ ID NO: 3810290 - RNA, 20 nt, Human
gacauagaauuaacacauga

SEQ ID NO: 3810291 - RNA, 20 nt, Human
gacauagagagggagaagaa

SEQ ID NO: 3810292 - RNA, 22 nt, Human
gacauagagagggagaagaagu

SEQ ID NO: 3810293 - RNA, 21 nt, Human
gacauagcauccaaguggcau

SEQ ID NO: 3810294 - RNA, 13 nt, Human
gacauauucauuu

SEQ ID NO: 3810295 - RNA, 12 nt, Human
gacauauuuaau

SEQ ID NO: 3810296 - RNA, 19 nt, Human
gacaucaaacucaaugcuu

SEQ ID NO: 3810297 - RNA, 16 nt, Human
gacaucaacugcauca

SEQ ID NO: 3810298 - RNA, 16 nt, Human
gacaucacuuguacaa

SEQ ID NO: 3810299 - RNA, 12 nt, Human
gacaucagccag

SEQ ID NO: 3810300 - RNA, 15 nt, Human
gacauccaagcuucc

SEQ ID NO: 3810301 - RNA, 13 nt, Human
gacauccagcaga

SEQ ID NO: 3810302 - RNA, 16 nt, Human
gacauccauaaagaag

SEQ ID NO: 3810303 - RNA, 17 nt, Human
gacauccccugcuggcc

SEQ ID NO: 3810304 - RNA, 18 nt, Human
gacauccccugcuggccg

SEQ ID NO: 3810305 - RNA, 15 nt, Human
gacauccuccuccca

SEQ ID NO: 3810306 - RNA, 18 nt, Human
gacauccuccucccaccc

SEQ ID NO: 3810307 - RNA, 23 nt, Human
gacauccucuucugcuuaggaga

SEQ ID NO: 3810308 - RNA, 21 nt, Human
gacauccuguauaagcacuga

SEQ ID NO: 3810309 - RNA, 24 nt, Human
gacauccugucaucugagaaugaa

SEQ ID NO: 3810310 - RNA, 20 nt, Human
gacaucucaggggccagagg

SEQ ID NO: 3810311 - RNA, 17 nt, Human
gacaucucugcacccug

SEQ ID NO: 3810312 - RNA, 14 nt, Human
gacaucuggaaucu

SEQ ID NO: 3810313 - RNA, 19 nt, Human
gacaucuggaaucuggaga

SEQ ID NO: 3810314 - RNA, 16 nt, Human
gacaucuuaguauuug

SEQ ID NO: 3810315 - RNA, 19 nt, Human
gacaucuuaguauuugcau

SEQ ID NO: 3810316 - RNA, 22 nt, Human
gacaucuuaguauuugcauauu

SEQ ID NO: 3810317 - RNA, 22 nt, Human
gacaugaagccacgggugccag

SEQ ID NO: 3810318 - RNA, 16 nt, Human
gacaugaagcuguugu

SEQ ID NO: 3810319 - RNA, 14 nt, Human
gacaugaauaugau

SEQ ID NO: 3810320 - RNA, 21 nt, Human
gacaugaauuuuagcuuuugu

SEQ ID NO: 3810321 - RNA, 19 nt, Human
gacaugagugcgugcucag

SEQ ID NO: 3810322 - RNA, 21 nt, Human
gacaugauggagcgcaccugc

SEQ ID NO: 3810323 - RNA, 16 nt, Human
gacaugauuccuuccu

SEQ ID NO: 3810324 - RNA, 19 nt, Human
gacaugauuuccuugaaug

SEQ ID NO: 3810325 - RNA, 20 nt, Human
gacaugauuuccuugaaugu

SEQ ID NO: 3810326 - RNA, 19 nt, Human
gacaugcaauaaaauuuaa

SEQ ID NO: 3810327 - RNA, 15 nt, Human
gacaugcacugaccc

SEQ ID NO: 3810328 - RNA, 20 nt, Human
gacaugcacugacccuucca

SEQ ID NO: 3810329 - RNA, 18 nt, Human
gacaugccuauaugagaa

SEQ ID NO: 3810330 - RNA, 22 nt, Human
gacaugccuauaugagaagaau

SEQ ID NO: 3810331 - RNA, 18 nt, Human
gacaugcgggcugggcag

SEQ ID NO: 3810332 - RNA, 21 nt, Human
gacaugcgggcugggcagcug

SEQ ID NO: 3810333 - RNA, 18 nt, Human
gacaugcgguagccagca

SEQ ID NO: 3810334 - RNA, 16 nt, Human
gacauggacccggagc

SEQ ID NO: 3810335 - RNA, 14 nt, Human
gacauggagguucu

SEQ ID NO: 3810336 - RNA, 23 nt, Human
gacauggcucccccuccaccugc

SEQ ID NO: 3810337 - RNA, 19 nt, Human
gacauggcuccggccucug

SEQ ID NO: 3810338 - RNA, 20 nt, Human
gacauggcuccggccucugc

SEQ ID NO: 3810339 - RNA, 23 nt, Human
gacauggcucuggacucuaaaga

SEQ ID NO: 3810340 - RNA, 20 nt, Human
gacauggcuuucagaaaacg

SEQ ID NO: 3810341 - RNA, 17 nt, Human
gacaugggacauuugcu

SEQ ID NO: 3810342 - RNA, 22 nt, Human
gacaugggacauuugcucaugg

SEQ ID NO: 3810343 - RNA, 16 nt, Human
gacauggggaggaagg

SEQ ID NO: 3810344 - RNA, 21 nt, Human
gacaugggucgcccaugagag

SEQ ID NO: 3810345 - RNA, 23 nt, Human
gacaugggucgcccaugagagcg

SEQ ID NO: 3810346 - RNA, 18 nt, Human
gacauggugccugagagg

SEQ ID NO: 3810347 - RNA, 12 nt, Human
gacauggugggg

SEQ ID NO: 3810348 - RNA, 15 nt, Human
gacaugucuguucua

SEQ ID NO: 3810349 - RNA, 17 nt, Human
gacaugucuguucuaca

SEQ ID NO: 3810350 - RNA, 12 nt, Human
gacaugugacau

SEQ ID NO: 3810351 - RNA, 16 nt, Human
gacaugugacauuuau

SEQ ID NO: 3810352 - RNA, 20 nt, Human
gacaugugacauuuauauau

SEQ ID NO: 3810353 - RNA, 16 nt, Human
gacauguggugggaca

SEQ ID NO: 3810354 - RNA, 15 nt, Human
gacauguuauauauu

SEQ ID NO: 3810355 - RNA, 14 nt, Human
cucaggcugccuga

SEQ ID NO: 3810356 - RNA, 14 nt, Human
cucaggcugcugga

SEQ ID NO: 3810357 - RNA, 17 nt, Human
cucaggcugcuggagga

SEQ ID NO: 3810358 - RNA, 21 nt, Human
cucagggaagcccagcuccag

SEQ ID NO: 3810359 - RNA, 23 nt, Human
cucagggacagagacaccugcac

SEQ ID NO: 3810360 - RNA, 18 nt, Human
cucagggacagagccaug

SEQ ID NO: 3810361 - RNA, 17 nt, Human
cucagggaccacagcaa

SEQ ID NO: 3810362 - RNA, 18 nt, Human
cucagggaccacagcaag

SEQ ID NO: 3810363 - RNA, 16 nt, Human
cucagggaccauggcu

SEQ ID NO: 3810364 - RNA, 17 nt, Human
cucagggaccauggcuu

SEQ ID NO: 3810365 - RNA, 23 nt, Human
cucagggacucaucuuucccucc

SEQ ID NO: 3810366 - RNA, 21 nt, Human
cucagggagcagggaaggccu

SEQ ID NO: 3810367 - RNA, 22 nt, Human
cucagggagcagggaaggccug

SEQ ID NO: 3810368 - RNA, 23 nt, Human
cucagggagcagggaaggccuga

SEQ ID NO: 3810369 - RNA, 22 nt, Human
cucagggauggccguuggccac

SEQ ID NO: 3810370 - RNA, 14 nt, Human
cucagggcaaagcc

SEQ ID NO: 3810371 - RNA, 15 nt, Human
cucagggcaaagcca

SEQ ID NO: 3810372 - RNA, 17 nt, Human
cucagggcaaagccagg

SEQ ID NO: 3810373 - RNA, 14 nt, Human
cucagggcagccuc

SEQ ID NO: 3810374 - RNA, 19 nt, Human
cucagggcagccugccugg

SEQ ID NO: 3810375 - RNA, 20 nt, Human
cucagggcagccugccugga

SEQ ID NO: 3810376 - RNA, 14 nt, Human
cucagggccaggcc

SEQ ID NO: 3810377 - RNA, 15 nt, Human
cucagggccaugcug

SEQ ID NO: 3810378 - RNA, 14 nt, Human
cucagggccccagc

SEQ ID NO: 3810379 - RNA, 19 nt, Human
cucagggccuggcucaggu

SEQ ID NO: 3810380 - RNA, 22 nt, Human
cucagggcuaaacgggcauugc

SEQ ID NO: 3810381 - RNA, 16 nt, Human
cucagggcuccuccca

SEQ ID NO: 3810382 - RNA, 16 nt, Human
cucagggcuccugccu

SEQ ID NO: 3810383 - RNA, 23 nt, Human
cucagggcuccugccuucugucc

SEQ ID NO: 3810384 - RNA, 14 nt, Human
cucagggcuccugg

SEQ ID NO: 3810385 - RNA, 15 nt, Human
cucagggcuccuggg

SEQ ID NO: 3810386 - RNA, 22 nt, Human
cucagggcuccuugugggccug

SEQ ID NO: 3810387 - RNA, 19 nt, Human
cucaggggaaaacuguuac

SEQ ID NO: 3810388 - RNA, 13 nt, Human
cucaggggccaga

SEQ ID NO: 3810389 - RNA, 17 nt, Human
cucaggggccagaggaa

SEQ ID NO: 3810390 - RNA, 18 nt, Human
cucaggggccagaggaac

SEQ ID NO: 3810391 - RNA, 19 nt, Human
cucaggggcccuggagcag

SEQ ID NO: 3810392 - RNA, 15 nt, Human
cucaggggcuguuug

SEQ ID NO: 3810393 - RNA, 23 nt, Human
cucagggggcgccugugguucug

SEQ ID NO: 3810394 - RNA, 19 nt, Human
cucaggggucacugaggcc

SEQ ID NO: 3810395 - RNA, 16 nt, Human
cucaggggugugccug

SEQ ID NO: 3810396 - RNA, 12 nt, Human
cucagggucccu

SEQ ID NO: 3810397 - RNA, 15 nt, Human
cucagggucccuggu

SEQ ID NO: 3810398 - RNA, 18 nt, Human
cucagggucccugguggc

SEQ ID NO: 3810399 - RNA, 22 nt, Human
cucagggucccugguggcagcu

SEQ ID NO: 3810400 - RNA, 16 nt, Human
cucagggucucugcug

SEQ ID NO: 3810401 - RNA, 15 nt, Human
cucaggguggucucu

SEQ ID NO: 3810402 - RNA, 16 nt, Human
cucaggguggucucuu

SEQ ID NO: 3810403 - RNA, 22 nt, Human
cucagguaaucgaccugccucg

SEQ ID NO: 3810404 - RNA, 18 nt, Human
cucagguacagagaagga

SEQ ID NO: 3810405 - RNA, 19 nt, Human
cucagguacagagaaggaa

SEQ ID NO: 3810406 - RNA, 17 nt, Human
cucagguagaagguuga

SEQ ID NO: 3810407 - RNA, 23 nt, Human
cucaggucccaggcuccuaugca

SEQ ID NO: 3810408 - RNA, 15 nt, Human
cucaggucuguuuuc

SEQ ID NO: 3810409 - RNA, 13 nt, Human
cucaggugaccaa

SEQ ID NO: 3810410 - RNA, 16 nt, Human
cucaggugagaagcag

SEQ ID NO: 3810411 - RNA, 13 nt, Human
cucaggugcuggg

SEQ ID NO: 3810412 - RNA, 19 nt, Human
cucagguggccaugccuca

SEQ ID NO: 3810413 - RNA, 20 nt, Human
cucagguggccaugccucag

SEQ ID NO: 3810414 - RNA, 21 nt, Human
cucagguggccaugccucagc

SEQ ID NO: 3810415 - RNA, 19 nt, Human
cucagguggggucacucug

SEQ ID NO: 3810416 - RNA, 22 nt, Human
cucagguggggucacucuggca

SEQ ID NO: 3810417 - RNA, 14 nt, Human
cucagguguugcca

SEQ ID NO: 3810418 - RNA, 15 nt, Human
cucagguguugccaa

SEQ ID NO: 3810419 - RNA, 22 nt, Human
cucagguguuuuuuaugaagug

SEQ ID NO: 3810420 - RNA, 12 nt, Human
cucagguuccua

SEQ ID NO: 3810421 - RNA, 21 nt, Human
cucagguugcugguugcugug

SEQ ID NO: 3810422 - RNA, 12 nt, Human
cucaguaaacgg

SEQ ID NO: 3810423 - RNA, 16 nt, Human
cucaguaaagcacuug

SEQ ID NO: 3810424 - RNA, 21 nt, Human
cucaguaagacgacaaggaaa

SEQ ID NO: 3810425 - RNA, 21 nt, Human
cucaguaaguaucuggaggaa

SEQ ID NO: 3810426 - RNA, 13 nt, Human
cucaguaauuugu

SEQ ID NO: 3810427 - RNA, 12 nt, Human
cucaguacuuug

SEQ ID NO: 3810428 - RNA, 20 nt, Human
cucaguacuuuggaggcccc

SEQ ID NO: 3810429 - RNA, 13 nt, Human
cucaguagucccu

SEQ ID NO: 3810430 - RNA, 13 nt, Human
cucagucauaauc

SEQ ID NO: 3810431 - RNA, 16 nt, Human
cucagucaugcauaaa

SEQ ID NO: 3810432 - RNA, 22 nt, Human
cucagucaugcauaaauaugca

SEQ ID NO: 3810433 - RNA, 17 nt, Human
cucaguccauagcagag

SEQ ID NO: 3810434 - RNA, 23 nt, Human
cucaguccauuuauauaugaaaa

SEQ ID NO: 3810435 - RNA, 17 nt, Human
cucagucccccaacaga

SEQ ID NO: 3810436 - RNA, 16 nt, Human
cucagucucaggagca

SEQ ID NO: 3810437 - RNA, 13 nt, Human
cucagucucccuc

SEQ ID NO: 3810438 - RNA, 17 nt, Human
cucagucucccucccuu

SEQ ID NO: 3810439 - RNA, 13 nt, Human
cucagucucccuu

SEQ ID NO: 3810440 - RNA, 13 nt, Human
cucagucucugag

SEQ ID NO: 3810441 - RNA, 20 nt, Human
cucagucucugagcagugaa

SEQ ID NO: 3810442 - RNA, 18 nt, Human
cucagucuggcccuuccu

SEQ ID NO: 3810443 - RNA, 20 nt, Human
cucagucuucccuagggcug

SEQ ID NO: 3810444 - RNA, 18 nt, Human
cucagugaagaauacuuc

SEQ ID NO: 3810445 - RNA, 14 nt, Human
cucagugaagacua

SEQ ID NO: 3810446 - RNA, 16 nt, Human
cucagugcaaccucug

SEQ ID NO: 3810447 - RNA, 11 nt, Human
cucagugcaga

SEQ ID NO: 3810448 - RNA, 14 nt, Human
cucagugcauuugu

SEQ ID NO: 3810449 - RNA, 19 nt, Human
cucagugccaacuguggcu

SEQ ID NO: 3810450 - RNA, 21 nt, Human
cucagugccaacuguggcugg

SEQ ID NO: 3810451 - RNA, 20 nt, Human
cucaguggacuuuccacccc

SEQ ID NO: 3810452 - RNA, 22 nt, Human
cucaguggguuaacaucaguuu

SEQ ID NO: 3810453 - RNA, 12 nt, Human
cucaguguuuug

SEQ ID NO: 3810454 - RNA, 22 nt, Human
cucaguguuuuggacuccaucu

SEQ ID NO: 3810455 - RNA, 15 nt, Human
cucaguucccuuggc

SEQ ID NO: 3810456 - RNA, 16 nt, Human
cucaguucccuuggcc

SEQ ID NO: 3810457 - RNA, 15 nt, Human
cucaguucuagucuc

SEQ ID NO: 3810458 - RNA, 21 nt, Human
cucaguucuagucucucuggg

SEQ ID NO: 3810459 - RNA, 15 nt, Human
cucaguugauuuucu

SEQ ID NO: 3810460 - RNA, 18 nt, Human
cucaguugauuuucugga

SEQ ID NO: 3810461 - RNA, 13 nt, Human
cucaguuggaaau

SEQ ID NO: 3810462 - RNA, 15 nt, Human
cucaguugugcagcu

SEQ ID NO: 3810463 - RNA, 17 nt, Human
cucaguuuaauccuucu

SEQ ID NO: 3810464 - RNA, 13 nt, Human
cucaguuucccua

SEQ ID NO: 3810465 - RNA, 13 nt, Human
cucaguuugucag

SEQ ID NO: 3810466 - RNA, 17 nt, Human
cucaguuuuaucauuuu

SEQ ID NO: 3810467 - RNA, 12 nt, Human
cucaguuuuucu

SEQ ID NO: 3810468 - RNA, 16 nt, Human
cucauaaauuuacuuu

SEQ ID NO: 3810469 - RNA, 21 nt, Human
cucauaacggaucagaaauac

SEQ ID NO: 3810470 - RNA, 15 nt, Human
cucauaacucauugu

SEQ ID NO: 3810471 - RNA, 17 nt, Human
cucauacacucguauga

SEQ ID NO: 3810472 - RNA, 16 nt, Human
cucauacccaccccca

SEQ ID NO: 3810473 - RNA, 18 nt, Human
cucauaccuuuaaaggaa

SEQ ID NO: 3810474 - RNA, 14 nt, Human
cucauacguccacc

SEQ ID NO: 3810475 - RNA, 15 nt, Human
cucauacguccacca

SEQ ID NO: 3810476 - RNA, 14 nt, Human
cucauacucaccuc

SEQ ID NO: 3810477 - RNA, 22 nt, Human
cucauacucaccucaccccacu

SEQ ID NO: 3810478 - RNA, 13 nt, Human
cucauacugugcu

SEQ ID NO: 3810479 - RNA, 12 nt, Human
cucauagcauua

SEQ ID NO: 3810480 - RNA, 23 nt, Human
cucauaggaaaaguacauuuaau

SEQ ID NO: 3810481 - RNA, 14 nt, Human
cucauagggaagac

SEQ ID NO: 3810482 - RNA, 19 nt, Human
cucauaguaugguggcugg

SEQ ID NO: 3810483 - RNA, 21 nt, Human
cucauaguaugguggcugggu

SEQ ID NO: 3810484 - RNA, 20 nt, Human
cucauauaauuauauguugu

SEQ ID NO: 3810485 - RNA, 21 nt, Human
cucauauccaguauuguuccu

SEQ ID NO: 3810486 - RNA, 19 nt, Human
cucauauggcccaguguca

SEQ ID NO: 3810487 - RNA, 12 nt, Human
cucauauuuaaa

SEQ ID NO: 3810488 - RNA, 12 nt, Human
cucauauuuugu

SEQ ID NO: 3810489 - RNA, 13 nt, Human
cucauauuuugua

SEQ ID NO: 3810490 - RNA, 18 nt, Human
cucaucaacaaagaaaua

SEQ ID NO: 3810491 - RNA, 14 nt, Human
cucaucaacugaau

SEQ ID NO: 3810492 - RNA, 21 nt, Human
cucaucaaucaaauaaguauu

SEQ ID NO: 3810493 - RNA, 13 nt, Human
cucaucacacaca

SEQ ID NO: 3810494 - RNA, 16 nt, Human
cucaucacacacaugg

SEQ ID NO: 3810495 - RNA, 17 nt, Human
cucaucacacacaugga

SEQ ID NO: 3810496 - RNA, 21 nt, Human
cucaucaccaacgucugugcc

SEQ ID NO: 3810497 - RNA, 14 nt, Human
cucaucacuccccu

SEQ ID NO: 3810498 - RNA, 12 nt, Human
cucaucacugug

SEQ ID NO: 3810499 - RNA, 15 nt, Human
cucaucacuguggcu

SEQ ID NO: 3810500 - RNA, 21 nt, Human
cucaucacuguggcugucugg

SEQ ID NO: 3810501 - RNA, 12 nt, Human
cucaucaggaug

SEQ ID NO: 3810502 - RNA, 24 nt, Human
cucaucaguguccucuugcucaaa

SEQ ID NO: 3810503 - RNA, 14 nt, Human
cucaucauaaaaua

SEQ ID NO: 3810504 - RNA, 17 nt, Human
cucaucaugucuauugu

SEQ ID NO: 3810505 - RNA, 17 nt, Human
cucaucauucucugucu

SEQ ID NO: 3810506 - RNA, 16 nt, Human
gacauguucccuucuc

SEQ ID NO: 3810507 - RNA, 14 nt, Human
gacauguuuugaua

SEQ ID NO: 3810508 - RNA, 16 nt, Human
gacauguuuugauaaa

SEQ ID NO: 3810509 - RNA, 23 nt, Human
gacauguuuugauaaaguaguaa

SEQ ID NO: 3810510 - RNA, 14 nt, Human
gacauguuuuuguu

SEQ ID NO: 3810511 - RNA, 13 nt, Human
gacauuaaauaau

SEQ ID NO: 3810512 - RNA, 14 nt, Human
gacauuaacaguuu

SEQ ID NO: 3810513 - RNA, 14 nt, Human
gacauuaacucauu

SEQ ID NO: 3810514 - RNA, 23 nt, Human
gacauuaguaacauaauaaauua

SEQ ID NO: 3810515 - RNA, 14 nt, Human
gacauuauagacau

SEQ ID NO: 3810516 - RNA, 20 nt, Human
gacauuauagacauugagga

SEQ ID NO: 3810517 - RNA, 21 nt, Human
gacauuaugugugcaugugug

SEQ ID NO: 3810518 - RNA, 22 nt, Human
gacauuaugugugcaugugugu

SEQ ID NO: 3810519 - RNA, 23 nt, Human
gacauuaugugugcaugugugua

SEQ ID NO: 3810520 - RNA, 17 nt, Human
gacauucaccugcccca

SEQ ID NO: 3810521 - RNA, 18 nt, Human
gacauucaccugccccaa

SEQ ID NO: 3810522 - RNA, 20 nt, Human
gacauuccuaaacuaucuuu

SEQ ID NO: 3810523 - RNA, 16 nt, Human
gacauuccugggcaca

SEQ ID NO: 3810524 - RNA, 12 nt, Human
gacauucugaau

SEQ ID NO: 3810525 - RNA, 21 nt, Human
gacauucuuguaaggcuuuga

SEQ ID NO: 3810526 - RNA, 21 nt, Human
gacauugaaaucuaggaaaau

SEQ ID NO: 3810527 - RNA, 18 nt, Human
gacauugauuugauuuuu

SEQ ID NO: 3810528 - RNA, 21 nt, Human
gacauugcguuugaccuuuua

SEQ ID NO: 3810529 - RNA, 12 nt, Human
gacauugucaau

SEQ ID NO: 3810530 - RNA, 17 nt, Human
gacauugucagcaaauu

SEQ ID NO: 3810531 - RNA, 13 nt, Human
gacauugucuccc

SEQ ID NO: 3810532 - RNA, 20 nt, Human
gacauugucucccgcccccc

SEQ ID NO: 3810533 - RNA, 22 nt, Human
gacauuguuggcagcauaaagg

SEQ ID NO: 3810534 - RNA, 22 nt, Human
gacauuguuuugccaacauugc

SEQ ID NO: 3810535 - RNA, 14 nt, Human
gacauuuaauuuag

SEQ ID NO: 3810536 - RNA, 18 nt, Human
gacauuuaccuuuuugaa

SEQ ID NO: 3810537 - RNA, 16 nt, Human
gacauuucuuugugcu

SEQ ID NO: 3810538 - RNA, 22 nt, Human
gacauuucuuuucuuuuuacau

SEQ ID NO: 3810539 - RNA, 23 nt, Human
gacauuucuuuucuuuuuacaua

SEQ ID NO: 3810540 - RNA, 12 nt, Human
gacauuugucau

SEQ ID NO: 3810541 - RNA, 19 nt, Human
gacauuugucauuuucauu

SEQ ID NO: 3810542 - RNA, 13 nt, Human
gacauuuguuugg

SEQ ID NO: 3810543 - RNA, 15 nt, Human
gacauuuuaacaaga

SEQ ID NO: 3810544 - RNA, 15 nt, Human
gacauuuuacauuaa

SEQ ID NO: 3810545 - RNA, 21 nt, Human
gacauuuuacauuaaauuuuu

SEQ ID NO: 3810546 - RNA, 15 nt, Human
gacauuuuuucaguc

SEQ ID NO: 3810547 - RNA, 17 nt, Human
gaccaaaaaaauaaggu

SEQ ID NO: 3810548 - RNA, 13 nt, Human
gaccaaaaaccag

SEQ ID NO: 3810549 - RNA, 14 nt, Human
gaccaaaaguuaca

SEQ ID NO: 3810550 - RNA, 19 nt, Human
gaccaaaaguuacauguuu

SEQ ID NO: 3810551 - RNA, 13 nt, Human
gaccaaaccuagc

SEQ ID NO: 3810552 - RNA, 18 nt, Human
gaccaaacuucacucugg

SEQ ID NO: 3810553 - RNA, 16 nt, Human
gaccaacauggagaaa

SEQ ID NO: 3810554 - RNA, 18 nt, Human
gaccaacccuguuuccug

SEQ ID NO: 3810555 - RNA, 13 nt, Human
gaccaacugggcc

SEQ ID NO: 3810556 - RNA, 19 nt, Human
gaccaacugggcccaagac

SEQ ID NO: 3810557 - RNA, 13 nt, Human
gaccaacuguguu

SEQ ID NO: 3810558 - RNA, 15 nt, Human
gaccaacuguguugu

SEQ ID NO: 3810559 - RNA, 12 nt, Human
gaccaagaacug

SEQ ID NO: 3810560 - RNA, 13 nt, Human
gaccaagaacugc

SEQ ID NO: 3810561 - RNA, 14 nt, Human
gaccaagcaggaag

SEQ ID NO: 3810562 - RNA, 20 nt, Human
gaccaagcaggaagcucaga

SEQ ID NO: 3810563 - RNA, 20 nt, Human
gaccaagcaucuuggggggg

SEQ ID NO: 3810564 - RNA, 18 nt, Human
gaccaaggcucugaaaua

SEQ ID NO: 3810565 - RNA, 18 nt, Human
gaccaauauucaaaugcg

SEQ ID NO: 3810566 - RNA, 17 nt, Human
gaccaauauuguacagu

SEQ ID NO: 3810567 - RNA, 10 nt, Human
gaccaaucag

SEQ ID NO: 3810568 - RNA, 16 nt, Human
gaccaauuauugauau

SEQ ID NO: 3810569 - RNA, 18 nt, Human
gaccaauuauugauauau

SEQ ID NO: 3810570 - RNA, 20 nt, Human
gaccaauuauugauauauau

SEQ ID NO: 3810571 - RNA, 18 nt, Human
gaccaauugugcugccau

SEQ ID NO: 3810572 - RNA, 16 nt, Human
gaccacacccuguacu

SEQ ID NO: 3810573 - RNA, 18 nt, Human
gaccacacuuccugucca

SEQ ID NO: 3810574 - RNA, 23 nt, Human
gaccacacuuccuguccagagag

SEQ ID NO: 3810575 - RNA, 12 nt, Human
gaccacagcaca

SEQ ID NO: 3810576 - RNA, 13 nt, Human
gaccacaggcuca

SEQ ID NO: 3810577 - RNA, 17 nt, Human
gaccacaucuuuaucug

SEQ ID NO: 3810578 - RNA, 14 nt, Human
gaccaccaagccuu

SEQ ID NO: 3810579 - RNA, 16 nt, Human
gaccaccaccucagag

SEQ ID NO: 3810580 - RNA, 12 nt, Human
gaccaccagagg

SEQ ID NO: 3810581 - RNA, 19 nt, Human
gaccaccccugccuccacc

SEQ ID NO: 3810582 - RNA, 17 nt, Human
gaccacccuccccucuc

SEQ ID NO: 3810583 - RNA, 19 nt, Human
gaccaccgccccuggccgc

SEQ ID NO: 3810584 - RNA, 20 nt, Human
gaccacggacguuuccauca

SEQ ID NO: 3810585 - RNA, 22 nt, Human
gaccacggacguuuccaucagg

SEQ ID NO: 3810586 - RNA, 19 nt, Human
gaccacgucuauuucauca

SEQ ID NO: 3810587 - RNA, 17 nt, Human
gaccacgugcuaccccc

SEQ ID NO: 3810588 - RNA, 14 nt, Human
gaccacucagagac

SEQ ID NO: 3810589 - RNA, 12 nt, Human
gaccacucagcc

SEQ ID NO: 3810590 - RNA, 13 nt, Human
gaccacucagccc

SEQ ID NO: 3810591 - RNA, 12 nt, Human
gaccacugcaug

SEQ ID NO: 3810592 - RNA, 14 nt, Human
gaccacuguuauca

SEQ ID NO: 3810593 - RNA, 23 nt, Human
gaccacuuccaggggaaccugcc

SEQ ID NO: 3810594 - RNA, 16 nt, Human
gaccagaaaucaaaaa

SEQ ID NO: 3810595 - RNA, 21 nt, Human
gaccagaaaucaaaaagggaa

SEQ ID NO: 3810596 - RNA, 19 nt, Human
gaccagaagggaaacaguc

SEQ ID NO: 3810597 - RNA, 17 nt, Human
gaccagacaagcuguug

SEQ ID NO: 3810598 - RNA, 22 nt, Human
gaccagacaccuugacagggca

SEQ ID NO: 3810599 - RNA, 21 nt, Human
gaccagagcugccaccugccu

SEQ ID NO: 3810600 - RNA, 19 nt, Human
gaccagaggagccuuuuua

SEQ ID NO: 3810601 - RNA, 21 nt, Human
gaccagaggagccuuuuuaaa

SEQ ID NO: 3810602 - RNA, 13 nt, Human
gaccagcaaauac

SEQ ID NO: 3810603 - RNA, 21 nt, Human
gaccagcaccaucucuccucc

SEQ ID NO: 3810604 - RNA, 23 nt, Human
gaccagcagacagagccaggaga

SEQ ID NO: 3810605 - RNA, 18 nt, Human
gaccagcagaucccagcu

SEQ ID NO: 3810606 - RNA, 12 nt, Human
gaccagcagccc

SEQ ID NO: 3810607 - RNA, 16 nt, Human
gaccagcagcgccuuu

SEQ ID NO: 3810608 - RNA, 17 nt, Human
gaccagcaggcuggccu

SEQ ID NO: 3810609 - RNA, 23 nt, Human
gaccagccagggaaagacuggca

SEQ ID NO: 3810610 - RNA, 11 nt, Human
gaccagcccac

SEQ ID NO: 3810611 - RNA, 14 nt, Human
gaccagccucccug

SEQ ID NO: 3810612 - RNA, 13 nt, Human
gaccagccuggcc

SEQ ID NO: 3810613 - RNA, 14 nt, Human
gaccagccuggccc

SEQ ID NO: 3810614 - RNA, 16 nt, Human
gaccagccuggcccac

SEQ ID NO: 3810615 - RNA, 12 nt, Human
gaccagcucagg

SEQ ID NO: 3810616 - RNA, 14 nt, Human
gaccagcucaggac

SEQ ID NO: 3810617 - RNA, 20 nt, Human
gaccagcugcuccgaggacc

SEQ ID NO: 3810618 - RNA, 23 nt, Human
gaccagcugcuccgaggacccag

SEQ ID NO: 3810619 - RNA, 22 nt, Human
gaccagcuuuucccaaaagccc

SEQ ID NO: 3810620 - RNA, 16 nt, Human
gaccaggacaggacca

SEQ ID NO: 3810621 - RNA, 19 nt, Human
gaccaggacucccuccuca

SEQ ID NO: 3810622 - RNA, 21 nt, Human
gaccaggacucccuccucacc

SEQ ID NO: 3810623 - RNA, 17 nt, Human
gaccaggauccagccuc

SEQ ID NO: 3810624 - RNA, 21 nt, Human
gaccagggccgaggaggugcc

SEQ ID NO: 3810625 - RNA, 11 nt, Human
gaccagggcuc

SEQ ID NO: 3810626 - RNA, 18 nt, Human
gaccagggcuccagcccc

SEQ ID NO: 3810627 - RNA, 21 nt, Human
gaccagggcuccagccccucu

SEQ ID NO: 3810628 - RNA, 18 nt, Human
gaccagggcuggggcagc

SEQ ID NO: 3810629 - RNA, 19 nt, Human
gaccagggcuggggcagcc

SEQ ID NO: 3810630 - RNA, 22 nt, Human
gaccagggcuggggcagccucu

SEQ ID NO: 3810631 - RNA, 20 nt, Human
gaccaggguuggcaccuucc

SEQ ID NO: 3810632 - RNA, 22 nt, Human
gaccaggucuuggagcugagcc

SEQ ID NO: 3810633 - RNA, 21 nt, Human
gaccagguuauuuuaaaaaga

SEQ ID NO: 3810634 - RNA, 15 nt, Human
gaccaguaauuguga

SEQ ID NO: 3810635 - RNA, 19 nt, Human
gaccagugagcgcuugggc

SEQ ID NO: 3810636 - RNA, 19 nt, Human
gaccaguugcagucacucu

SEQ ID NO: 3810637 - RNA, 22 nt, Human
gaccaguugcagucacucuagu

SEQ ID NO: 3810638 - RNA, 15 nt, Human
gaccaguugggagca

SEQ ID NO: 3810639 - RNA, 19 nt, Human
gaccaguuuaaccugaugc

SEQ ID NO: 3810640 - RNA, 15 nt, Human
gaccauaauguuaca

SEQ ID NO: 3810641 - RNA, 14 nt, Human
gaccaucccugaag

SEQ ID NO: 3810642 - RNA, 18 nt, Human
gaccaucccugaaggccc

SEQ ID NO: 3810643 - RNA, 19 nt, Human
gaccaucccugaaggcccc

SEQ ID NO: 3810644 - RNA, 14 nt, Human
gaccauccuggcua

SEQ ID NO: 3810645 - RNA, 16 nt, Human
gaccaucugauuaaaa

SEQ ID NO: 3810646 - RNA, 15 nt, Human
gaccaugcugucugg

SEQ ID NO: 3810647 - RNA, 22 nt, Human
gaccaugcugucuggcacagcc

SEQ ID NO: 3810648 - RNA, 23 nt, Human
gaccaugcugucuggcacagccu

SEQ ID NO: 3810649 - RNA, 18 nt, Human
gaccauggaguggcagcc

SEQ ID NO: 3810650 - RNA, 20 nt, Human
gaccauggaguggcagccca

SEQ ID NO: 3810651 - RNA, 22 nt, Human
gaccaugguuaagaguccaaga

SEQ ID NO: 3810652 - RNA, 13 nt, Human
gaccaugugucac

SEQ ID NO: 3810653 - RNA, 19 nt, Human
gaccauucuccaccugcca

SEQ ID NO: 3810654 - RNA, 20 nt, Human
gaccauucuccaccugccag

SEQ ID NO: 3810655 - RNA, 18 nt, Human
gacuauauuguacacacc

SEQ ID NO: 3810656 - RNA, 22 nt, Human
gacuauauuugggccugcucca

SEQ ID NO: 3810657 - RNA, 18 nt, Human
gacuaucaaacugaagcc

SEQ ID NO: 3810658 - RNA, 13 nt, Human
gacuaucagccca

SEQ ID NO: 3810659 - RNA, 22 nt, Human
gacuaucccaacagucauguuu

SEQ ID NO: 3810660 - RNA, 20 nt, Human
gacuaugcguggcuggaacc

SEQ ID NO: 3810661 - RNA, 18 nt, Human
gacuaugcuuuucucaaa

SEQ ID NO: 3810662 - RNA, 16 nt, Human
gacuauggagccuggc

SEQ ID NO: 3810663 - RNA, 20 nt, Human
gacuauuauguuguuagaga

SEQ ID NO: 3810664 - RNA, 22 nt, Human
gacuauucuugauguaaaaucu

SEQ ID NO: 3810665 - RNA, 22 nt, Human
gacuauuugcuuauuuaauaaa

SEQ ID NO: 3810666 - RNA, 22 nt, Human
gacucaaaacccaucugggcuc

SEQ ID NO: 3810667 - RNA, 23 nt, Human
gacucaaaacccaucugggcucc

SEQ ID NO: 3810668 - RNA, 19 nt, Human
gacucaaaucuccaguauu

SEQ ID NO: 3810669 - RNA, 15 nt, Human
gacucaaauguucua

SEQ ID NO: 3810670 - RNA, 20 nt, Human
gacucaagaagugaagaaug

SEQ ID NO: 3810671 - RNA, 12 nt, Human
gacucaagauuc

SEQ ID NO: 3810672 - RNA, 17 nt, Human
gacucaagauucccagg

SEQ ID NO: 3810673 - RNA, 22 nt, Human
gacucaagauucccaggaguuc

SEQ ID NO: 3810674 - RNA, 17 nt, Human
gacucaaguccuuaccu

SEQ ID NO: 3810675 - RNA, 17 nt, Human
gacucaauaaaaucaug

SEQ ID NO: 3810676 - RNA, 17 nt, Human
gacucaaugcacugaca

SEQ ID NO: 3810677 - RNA, 19 nt, Human
gacucacaaccugaaccua

SEQ ID NO: 3810678 - RNA, 17 nt, Human
gacucacaagaagacca

SEQ ID NO: 3810679 - RNA, 21 nt, Human
gacucacaagaagaccagacu

SEQ ID NO: 3810680 - RNA, 23 nt, Human
gacucacaccugaacugaacacc

SEQ ID NO: 3810681 - RNA, 13 nt, Human
gacucaccucugc

SEQ ID NO: 3810682 - RNA, 14 nt, Human
gacucaccucugcc

SEQ ID NO: 3810683 - RNA, 18 nt, Human
gacucaccucugccucaa

SEQ ID NO: 3810684 - RNA, 21 nt, Human
gacucacuggcagccccagca

SEQ ID NO: 3810685 - RNA, 22 nt, Human
gacucacuggcagccccagcac

SEQ ID NO: 3810686 - RNA, 23 nt, Human
gacucacuggcagccccagcacc

SEQ ID NO: 3810687 - RNA, 16 nt, Human
gacucagaaacuccau

SEQ ID NO: 3810688 - RNA, 17 nt, Human
gacucagaaagccaaca

SEQ ID NO: 3810689 - RNA, 17 nt, Human
gacucagacaggaaagg

SEQ ID NO: 3810690 - RNA, 11 nt, Human
gacucagagaa

SEQ ID NO: 3810691 - RNA, 15 nt, Human
gacucagcccugagg

SEQ ID NO: 3810692 - RNA, 16 nt, Human
gacucagcccugaggu

SEQ ID NO: 3810693 - RNA, 14 nt, Human
gacucagccuucag

SEQ ID NO: 3810694 - RNA, 20 nt, Human
gacucagccuucagacagag

SEQ ID NO: 3810695 - RNA, 16 nt, Human
cuccagcuuuccugua

SEQ ID NO: 3810696 - RNA, 18 nt, Human
cuccaggaaccacaccac

SEQ ID NO: 3810697 - RNA, 15 nt, Human
cuccaggaaggggcu

SEQ ID NO: 3810698 - RNA, 14 nt, Human
cuccaggagaggag

SEQ ID NO: 3810699 - RNA, 16 nt, Human
cuccaggagcagccac

SEQ ID NO: 3810700 - RNA, 17 nt, Human
cuccaggagcuucuugu

SEQ ID NO: 3810701 - RNA, 17 nt, Human
cuccaggcaccaucucc

SEQ ID NO: 3810702 - RNA, 13 nt, Human
cuccaggcaggcu

SEQ ID NO: 3810703 - RNA, 12 nt, Human
cuccaggccaaa

SEQ ID NO: 3810704 - RNA, 19 nt, Human
cuccaggcccaaggcuccc

SEQ ID NO: 3810705 - RNA, 14 nt, Human
cuccaggcccgucu

SEQ ID NO: 3810706 - RNA, 15 nt, Human
cuccaggcccgucug

SEQ ID NO: 3810707 - RNA, 18 nt, Human
cuccaggcccgucugucc

SEQ ID NO: 3810708 - RNA, 20 nt, Human
cuccaggcccgucuguccau

SEQ ID NO: 3810709 - RNA, 19 nt, Human
cuccaggccugccucccac

SEQ ID NO: 3810710 - RNA, 22 nt, Human
cuccaggccugccucccacuuc

SEQ ID NO: 3810711 - RNA, 18 nt, Human
cuccaggcgccggcgggc

SEQ ID NO: 3810712 - RNA, 16 nt, Human
cuccagggaauccaag

SEQ ID NO: 3810713 - RNA, 20 nt, Human
cuccagggaauccaagccuc

SEQ ID NO: 3810714 - RNA, 21 nt, Human
cuccagggaauccaagccucc

SEQ ID NO: 3810715 - RNA, 20 nt, Human
cuccagggacacacagccua

SEQ ID NO: 3810716 - RNA, 14 nt, Human
cuccagggacagca

SEQ ID NO: 3810717 - RNA, 18 nt, Human
cuccagggaguccccucc

SEQ ID NO: 3810718 - RNA, 11 nt, Human
cuccagggcca

SEQ ID NO: 3810719 - RNA, 16 nt, Human
cuccagggccacgugc

SEQ ID NO: 3810720 - RNA, 18 nt, Human
cuccagggccacgugcca

SEQ ID NO: 3810721 - RNA, 14 nt, Human
cuccagggcuggac

SEQ ID NO: 3810722 - RNA, 17 nt, Human
cuccagggcuggacuga

SEQ ID NO: 3810723 - RNA, 21 nt, Human
cuccaggggcugcuuccuccu

SEQ ID NO: 3810724 - RNA, 15 nt, Human
cuccagggguggcug

SEQ ID NO: 3810725 - RNA, 17 nt, Human
cuccagggguuuacagu

SEQ ID NO: 3810726 - RNA, 19 nt, Human
cuccaggguggcagcaaca

SEQ ID NO: 3810727 - RNA, 16 nt, Human
cuccagggugugugcu

SEQ ID NO: 3810728 - RNA, 18 nt, Human
cuccagguaccuugaccu

SEQ ID NO: 3810729 - RNA, 16 nt, Human
cuccaggucucacggg

SEQ ID NO: 3810730 - RNA, 18 nt, Human
cuccaggucucacgggca

SEQ ID NO: 3810731 - RNA, 20 nt, Human
cuccaggugcacaagcucca

SEQ ID NO: 3810732 - RNA, 16 nt, Human
cuccaggugcagaggu

SEQ ID NO: 3810733 - RNA, 18 nt, Human
cuccaggugcagagguac

SEQ ID NO: 3810734 - RNA, 17 nt, Human
cuccagguuuuucaauu

SEQ ID NO: 3810735 - RNA, 21 nt, Human
cuccagguuuuucaauuaaac

SEQ ID NO: 3810736 - RNA, 16 nt, Human
cuccagucaggaggca

SEQ ID NO: 3810737 - RNA, 22 nt, Human
cuccagucauuauguuaauauu

SEQ ID NO: 3810738 - RNA, 15 nt, Human
cuccaguccccagaa

SEQ ID NO: 3810739 - RNA, 17 nt, Human
cuccaguccccagaacu

SEQ ID NO: 3810740 - RNA, 22 nt, Human
cuccagucccccuauccuuggc

SEQ ID NO: 3810741 - RNA, 17 nt, Human
cuccaguccugcucucu

SEQ ID NO: 3810742 - RNA, 23 nt, Human
cuccaguccugcucucuacccag

SEQ ID NO: 3810743 - RNA, 15 nt, Human
cuccagucugcugcc

SEQ ID NO: 3810744 - RNA, 17 nt, Human
cuccagucugcugcccu

SEQ ID NO: 3810745 - RNA, 20 nt, Human
cuccagucugcugcccucca

SEQ ID NO: 3810746 - RNA, 20 nt, Human
cuccaguggggcaagauuuu

SEQ ID NO: 3810747 - RNA, 21 nt, Human
cuccaguguacauaguguaau

SEQ ID NO: 3810748 - RNA, 13 nt, Human
cuccaguguccug

SEQ ID NO: 3810749 - RNA, 14 nt, Human
cuccaguguccuga

SEQ ID NO: 3810750 - RNA, 17 nt, Human
cuccaguguccugagcu

SEQ ID NO: 3810751 - RNA, 19 nt, Human
cuccaguguccugagcuca

SEQ ID NO: 3810752 - RNA, 21 nt, Human
cuccaguguccugagcucagc

SEQ ID NO: 3810753 - RNA, 22 nt, Human
cuccaguguccugagcucagcg

SEQ ID NO: 3810754 - RNA, 18 nt, Human
cuccaguuugcaccuguc

SEQ ID NO: 3810755 - RNA, 21 nt, Human
cuccaguuugcaccugucccc

SEQ ID NO: 3810756 - RNA, 17 nt, Human
cuccaguuuucaguuga

SEQ ID NO: 3810757 - RNA, 18 nt, Human
cuccauaguuuggcauuu

SEQ ID NO: 3810758 - RNA, 19 nt, Human
cuccaucaguuagagcuga

SEQ ID NO: 3810759 - RNA, 12 nt, Human
cuccauccaagg

SEQ ID NO: 3810760 - RNA, 18 nt, Human
cuccauccaaggccaggu

SEQ ID NO: 3810761 - RNA, 17 nt, Human
cuccaucccaacagcca

SEQ ID NO: 3810762 - RNA, 23 nt, Human
cuccaucccccuuuacccucuuu

SEQ ID NO: 3810763 - RNA, 12 nt, Human
cuccaucccucu

SEQ ID NO: 3810764 - RNA, 13 nt, Human
cuccaucccuggc

SEQ ID NO: 3810765 - RNA, 19 nt, Human
cuccaucccuggcccccuc

SEQ ID NO: 3810766 - RNA, 20 nt, Human
cuccauccuacccccugugc

SEQ ID NO: 3810767 - RNA, 16 nt, Human
cuccauccuccuccuu

SEQ ID NO: 3810768 - RNA, 12 nt, Human
cuccauccugag

SEQ ID NO: 3810769 - RNA, 21 nt, Human
cuccauccuuucugccucuca

SEQ ID NO: 3810770 - RNA, 16 nt, Human
cuccaucuccacucca

SEQ ID NO: 3810771 - RNA, 20 nt, Human
cuccaucucucauccuccag

SEQ ID NO: 3810772 - RNA, 21 nt, Human
cuccaucucucauccuccagu

SEQ ID NO: 3810773 - RNA, 12 nt, Human
cuccaucucucu

SEQ ID NO: 3810774 - RNA, 13 nt, Human
cuccaucucucug

SEQ ID NO: 3810775 - RNA, 14 nt, Human
cuccaucugguaga

SEQ ID NO: 3810776 - RNA, 15 nt, Human
cuccaucugguagaa

SEQ ID NO: 3810777 - RNA, 23 nt, Human
cuccaucugguagaagggaaagc

SEQ ID NO: 3810778 - RNA, 12 nt, Human
cuccaucuguuu

SEQ ID NO: 3810779 - RNA, 17 nt, Human
cuccaucuucagcuucu

SEQ ID NO: 3810780 - RNA, 15 nt, Human
cuccaugcugccucc

SEQ ID NO: 3810781 - RNA, 14 nt, Human
cuccauggcaucuu

SEQ ID NO: 3810782 - RNA, 16 nt, Human
cuccauggcccugcca

SEQ ID NO: 3810783 - RNA, 18 nt, Human
cuccauggcuuccuccuc

SEQ ID NO: 3810784 - RNA, 21 nt, Human
cuccauggcuuccuccucccu

SEQ ID NO: 3810785 - RNA, 17 nt, Human
cuccauggugccucugg

SEQ ID NO: 3810786 - RNA, 14 nt, Human
cuccaugugggcua

SEQ ID NO: 3810787 - RNA, 20 nt, Human
cuccauuaaagucugaauca

SEQ ID NO: 3810788 - RNA, 22 nt, Human
cuccauuaggauuugccccuuc

SEQ ID NO: 3810789 - RNA, 18 nt, Human
cuccauucaauuucaggc

SEQ ID NO: 3810790 - RNA, 17 nt, Human
cuccauuccuggagccc

SEQ ID NO: 3810791 - RNA, 19 nt, Human
cuccauuccuggagcccga

SEQ ID NO: 3810792 - RNA, 20 nt, Human
cuccauuccuggagcccgag

SEQ ID NO: 3810793 - RNA, 14 nt, Human
cuccauucugacca

SEQ ID NO: 3810794 - RNA, 20 nt, Human
cuccauucugaccauuucag

SEQ ID NO: 3810795 - RNA, 15 nt, Human
cuccauucugcuccu

SEQ ID NO: 3810796 - RNA, 16 nt, Human
cuccauuguuuugccu

SEQ ID NO: 3810797 - RNA, 22 nt, Human
cuccauuugagaaaauaaagcu

SEQ ID NO: 3810798 - RNA, 17 nt, Human
cuccauuugcucuucag

SEQ ID NO: 3810799 - RNA, 20 nt, Human
cucccaaacgcccuuuccuc

SEQ ID NO: 3810800 - RNA, 14 nt, Human
cucccaaagagcug

SEQ ID NO: 3810801 - RNA, 20 nt, Human
cucccaaagugcugagauua

SEQ ID NO: 3810802 - RNA, 22 nt, Human
cucccaaagugcugagauuaca

SEQ ID NO: 3810803 - RNA, 22 nt, Human
cucccaaagugcugggauuaca

SEQ ID NO: 3810804 - RNA, 23 nt, Human
cucccaaagugcugggauuacag

SEQ ID NO: 3810805 - RNA, 15 nt, Human
cucccaacucacccc

SEQ ID NO: 3810806 - RNA, 17 nt, Human
cucccaacucaccccag

SEQ ID NO: 3810807 - RNA, 18 nt, Human
cucccaacucaccccagc

SEQ ID NO: 3810808 - RNA, 22 nt, Human
cucccaacucaccccagcccca

SEQ ID NO: 3810809 - RNA, 22 nt, Human
cucccaagacuucauugucccu

SEQ ID NO: 3810810 - RNA, 16 nt, Human
cucccaagcuggcugg

SEQ ID NO: 3810811 - RNA, 16 nt, Human
cucccaaggagaacaa

SEQ ID NO: 3810812 - RNA, 22 nt, Human
cucccaaggcugcgucuggagg

SEQ ID NO: 3810813 - RNA, 14 nt, Human
cucccaagggaugg

SEQ ID NO: 3810814 - RNA, 18 nt, Human
cucccaaggggccugagc

SEQ ID NO: 3810815 - RNA, 13 nt, Human
cucccaaguggug

SEQ ID NO: 3810816 - RNA, 18 nt, Human
cucccaaguggugccuaa

SEQ ID NO: 3810817 - RNA, 20 nt, Human
cucccaaguuuuaggacaaa

SEQ ID NO: 3810818 - RNA, 15 nt, Human
cucccacaagccuga

SEQ ID NO: 3810819 - RNA, 23 nt, Human
cucccacaagccugagggaaagg

SEQ ID NO: 3810820 - RNA, 21 nt, Human
cucccacacccaaagcugagc

SEQ ID NO: 3810821 - RNA, 13 nt, Human
cucccacagagac

SEQ ID NO: 3810822 - RNA, 20 nt, Human
cucccacaggcccuuccucu

SEQ ID NO: 3810823 - RNA, 20 nt, Human
cucccacagucccaucugcu

SEQ ID NO: 3810824 - RNA, 14 nt, Human
cucccacagugacu

SEQ ID NO: 3810825 - RNA, 22 nt, Human
cucccacagugacucgggcucc

SEQ ID NO: 3810826 - RNA, 14 nt, Human
cucccaccacagca

SEQ ID NO: 3810827 - RNA, 14 nt, Human
cucccacccaccgc

SEQ ID NO: 3810828 - RNA, 13 nt, Human
cucccaccccacc

SEQ ID NO: 3810829 - RNA, 19 nt, Human
cucccaccccacccccuuc

SEQ ID NO: 3810830 - RNA, 23 nt, Human
cucccaccccacccccuucagug

SEQ ID NO: 3810831 - RNA, 15 nt, Human
cucccacccccagcc

SEQ ID NO: 3810832 - RNA, 20 nt, Human
cucccacccccaucucuccc

SEQ ID NO: 3810833 - RNA, 18 nt, Human
cucccacccccuucucug

SEQ ID NO: 3810834 - RNA, 19 nt, Human
cucccacccggcugcagag

SEQ ID NO: 3810835 - RNA, 12 nt, Human
cucccacccucu

SEQ ID NO: 3810836 - RNA, 20 nt, Human
cucccacccucuuccuacug

SEQ ID NO: 3810837 - RNA, 20 nt, Human
cucccacccuguaccucauc

SEQ ID NO: 3810838 - RNA, 17 nt, Human
cucccaccucagccucc

SEQ ID NO: 3810839 - RNA, 15 nt, Human
cucccaccuccaguc

SEQ ID NO: 3810840 - RNA, 23 nt, Human
cucccaccucccccucccccuuc

SEQ ID NO: 3810841 - RNA, 18 nt, Human
cucccaccuccccuuggg

SEQ ID NO: 3810842 - RNA, 12 nt, Human
cucccaccucug

SEQ ID NO: 3810843 - RNA, 15 nt, Human
cucccaccucuguga

SEQ ID NO: 3810844 - RNA, 14 nt, Human
gacuggaauuuuua

SEQ ID NO: 3810845 - RNA, 13 nt, Human
gacuggacagcuu

SEQ ID NO: 3810846 - RNA, 14 nt, Human
gacuggacagcuug

SEQ ID NO: 3810847 - RNA, 18 nt, Human
gacuggaccugguggcua

SEQ ID NO: 3810848 - RNA, 20 nt, Human
gacuggaggaccacacucaa

SEQ ID NO: 3810849 - RNA, 20 nt, Human
gacuggaggccccuggagcc

SEQ ID NO: 3810850 - RNA, 22 nt, Human
gacuggcauacuauguggaugu

SEQ ID NO: 3810851 - RNA, 24 nt, Human
gacuggcauacuauguggauguga

SEQ ID NO: 3810852 - RNA, 23 nt, Human
gacuggccaagguuuggggaaga

SEQ ID NO: 3810853 - RNA, 15 nt, Human
gacuggccagggcca

SEQ ID NO: 3810854 - RNA, 14 nt, Human
gacuggccccuggg

SEQ ID NO: 3810855 - RNA, 14 nt, Human
gacuggccugagga

SEQ ID NO: 3810856 - RNA, 16 nt, Human
gacuggcuggcugcag

SEQ ID NO: 3810857 - RNA, 17 nt, Human
gacuggcuggcugcagu

SEQ ID NO: 3810858 - RNA, 21 nt, Human
gacuggcuguccuuuccagug

SEQ ID NO: 3810859 - RNA, 19 nt, Human
gacuggcuuugucccacag

SEQ ID NO: 3810860 - RNA, 20 nt, Human
gacuggcuuugucccacagc

SEQ ID NO: 3810861 - RNA, 20 nt, Human
gacuggcuuuuauuaaugca

SEQ ID NO: 3810862 - RNA, 23 nt, Human
gacuggcuuuuauuaaugcacuu

SEQ ID NO: 3810863 - RNA, 20 nt, Human
gacugggaagauaggcucug

SEQ ID NO: 3810864 - RNA, 18 nt, Human
gacugggagcccccagcc

SEQ ID NO: 3810865 - RNA, 23 nt, Human
gacugggagcccccagccuguca

SEQ ID NO: 3810866 - RNA, 16 nt, Human
gacugggccaggggag

SEQ ID NO: 3810867 - RNA, 17 nt, Human
gacuggggaugugggag

SEQ ID NO: 3810868 - RNA, 21 nt, Human
gacuggguaggaaagaggaag

SEQ ID NO: 3810869 - RNA, 14 nt, Human
gacuggugagcaga

SEQ ID NO: 3810870 - RNA, 18 nt, Human
gacuggugcuaaugucaa

SEQ ID NO: 3810871 - RNA, 22 nt, Human
gacugguguuaucaccgugggc

SEQ ID NO: 3810872 - RNA, 17 nt, Human
gacuguaaacacagaca

SEQ ID NO: 3810873 - RNA, 20 nt, Human
gacuguaaguugggcuugcu

SEQ ID NO: 3810874 - RNA, 21 nt, Human
gacuguaaguugggcuugcua

SEQ ID NO: 3810875 - RNA, 18 nt, Human
gacuguacacacuuuauu

SEQ ID NO: 3810876 - RNA, 18 nt, Human
gacuguacuccucccagg

SEQ ID NO: 3810877 - RNA, 20 nt, Human
gacuguacuccucccaggcg

SEQ ID NO: 3810878 - RNA, 13 nt, Human
gacuguagaagaa

SEQ ID NO: 3810879 - RNA, 13 nt, Human
gacuguagggagg

SEQ ID NO: 3810880 - RNA, 14 nt, Human
gacuguaucugugu

SEQ ID NO: 3810881 - RNA, 16 nt, Human
gacuguauuugugacu

SEQ ID NO: 3810882 - RNA, 17 nt, Human
gacuguauuugugacua

SEQ ID NO: 3810883 - RNA, 19 nt, Human
gacuguauuugugacuaau

SEQ ID NO: 3810884 - RNA, 20 nt, Human
gacuguauuugugacuaauu

SEQ ID NO: 3810885 - RNA, 22 nt, Human
gacuguauuugugacuaauugu

SEQ ID NO: 3810886 - RNA, 16 nt, Human
gacuguccucuccccu

SEQ ID NO: 3810887 - RNA, 20 nt, Human
gacuguccucuccccuccag

SEQ ID NO: 3810888 - RNA, 22 nt, Human
gacugucucaagagggcacugg

SEQ ID NO: 3810889 - RNA, 18 nt, Human
gacugucuccauggcccu

SEQ ID NO: 3810890 - RNA, 15 nt, Human
gacugucuggggagc

SEQ ID NO: 3810891 - RNA, 20 nt, Human
gacugugacaggcagcagag

SEQ ID NO: 3810892 - RNA, 19 nt, Human
gacugugaugccacacaga

SEQ ID NO: 3810893 - RNA, 17 nt, Human
gacuguggcacuugccu

SEQ ID NO: 3810894 - RNA, 13 nt, Human
gacuguggugacu

SEQ ID NO: 3810895 - RNA, 14 nt, Human
gacuguggugacuu

SEQ ID NO: 3810896 - RNA, 16 nt, Human
gacugugugcucagga

SEQ ID NO: 3810897 - RNA, 20 nt, Human
gacugugugcucaggagccc

SEQ ID NO: 3810898 - RNA, 17 nt, Human
gacugugugugcccucu

SEQ ID NO: 3810899 - RNA, 18 nt, Human
gacugugugugcccucug

SEQ ID NO: 3810900 - RNA, 22 nt, Human
gacuguguguugccacaggaca

SEQ ID NO: 3810901 - RNA, 18 nt, Human
gacuguucaagagcacac

SEQ ID NO: 3810902 - RNA, 19 nt, Human
gacuguucaagagcacacu

SEQ ID NO: 3810903 - RNA, 14 nt, Human
gacuguuccugucu

SEQ ID NO: 3810904 - RNA, 20 nt, Human
gacuguuguuaucuguuuga

SEQ ID NO: 3810905 - RNA, 13 nt, Human
gacuguuuggaaa

SEQ ID NO: 3810906 - RNA, 20 nt, Human
gacuguuuuuuccugagcuu

SEQ ID NO: 3810907 - RNA, 23 nt, Human
gacuuaaagggcccaaugaauua

SEQ ID NO: 3810908 - RNA, 14 nt, Human
gacuuaacggcucc

SEQ ID NO: 3810909 - RNA, 16 nt, Human
gacuuaacuccuucca

SEQ ID NO: 3810910 - RNA, 20 nt, Human
gacuuaacugcauuuuuaga

SEQ ID NO: 3810911 - RNA, 20 nt, Human
gacuuaagcaaaagaaaaag

SEQ ID NO: 3810912 - RNA, 19 nt, Human
gacuuaagcacacuugaca

SEQ ID NO: 3810913 - RNA, 19 nt, Human
gacuuaagugugcaaaaua

SEQ ID NO: 3810914 - RNA, 23 nt, Human
gacuuaaugagacuuuaaaagca

SEQ ID NO: 3810915 - RNA, 12 nt, Human
gacuuacucuaa

SEQ ID NO: 3810916 - RNA, 15 nt, Human
gacuuacucuaagau

SEQ ID NO: 3810917 - RNA, 16 nt, Human
gacuuagaaagcaggg

SEQ ID NO: 3810918 - RNA, 20 nt, Human
gacuuagaaucccuguguua

SEQ ID NO: 3810919 - RNA, 23 nt, Human
gacuuagaaucccuguguuaauu

SEQ ID NO: 3810920 - RNA, 15 nt, Human
gacuuauuacaauuu

SEQ ID NO: 3810921 - RNA, 16 nt, Human
gacuuauuuauauaaa

SEQ ID NO: 3810922 - RNA, 14 nt, Human
gacuucacacugca

SEQ ID NO: 3810923 - RNA, 17 nt, Human
gacuucacauaagcuca

SEQ ID NO: 3810924 - RNA, 14 nt, Human
gacuucacuuauua

SEQ ID NO: 3810925 - RNA, 12 nt, Human
gacuucagauug

SEQ ID NO: 3810926 - RNA, 14 nt, Human
gacuucagcucugu

SEQ ID NO: 3810927 - RNA, 14 nt, Human
gacuucagggcagg

SEQ ID NO: 3810928 - RNA, 22 nt, Human
gacuucagggcagggcucugau

SEQ ID NO: 3810929 - RNA, 19 nt, Human
gacuucaggggcugcccgc

SEQ ID NO: 3810930 - RNA, 20 nt, Human
gacuucaggggcugcccgcu

SEQ ID NO: 3810931 - RNA, 21 nt, Human
gacuucaggggcugcccgcuc

SEQ ID NO: 3810932 - RNA, 17 nt, Human
gacuucaguauguuguc

SEQ ID NO: 3810933 - RNA, 21 nt, Human
gacuucauagauuuccuuccc

SEQ ID NO: 3810934 - RNA, 20 nt, Human
gacuucaucccucuggggcu

SEQ ID NO: 3810935 - RNA, 15 nt, Human
gacuuccaugccuua

SEQ ID NO: 3810936 - RNA, 18 nt, Human
gacuucccacggcuccuc

SEQ ID NO: 3810937 - RNA, 18 nt, Human
gacuucccagcuaggaag

SEQ ID NO: 3810938 - RNA, 21 nt, Human
gacuucccuaacacuuacccc

SEQ ID NO: 3810939 - RNA, 22 nt, Human
gacuuccugauugguuucucuu

SEQ ID NO: 3810940 - RNA, 14 nt, Human
gacuuccuuacuaa

SEQ ID NO: 3810941 - RNA, 14 nt, Human
gacuucggaccgcu

SEQ ID NO: 3810942 - RNA, 16 nt, Human
gacuucuaaguaaaac

SEQ ID NO: 3810943 - RNA, 17 nt, Human
gacuucuaaguaaaacc

SEQ ID NO: 3810944 - RNA, 24 nt, Human
gacuucuaaguaaaaccacagcag

SEQ ID NO: 3810945 - RNA, 14 nt, Human
gacuucucuuugcc

SEQ ID NO: 3810946 - RNA, 18 nt, Human
gacuucucuuugccucaa

SEQ ID NO: 3810947 - RNA, 13 nt, Human
gacuucugagauc

SEQ ID NO: 3810948 - RNA, 15 nt, Human
gacuucugccuggag

SEQ ID NO: 3810949 - RNA, 17 nt, Human
gacuucugccuggagac

SEQ ID NO: 3810950 - RNA, 17 nt, Human
gacuucugcuuuccaca

SEQ ID NO: 3810951 - RNA, 14 nt, Human
gacuucuguuuuca

SEQ ID NO: 3810952 - RNA, 17 nt, Human
gacuucuguuuucaauc

SEQ ID NO: 3810953 - RNA, 16 nt, Human
gacuucuuuaauuuug

SEQ ID NO: 3810954 - RNA, 17 nt, Human
gacuucuuuaauuuugg

SEQ ID NO: 3810955 - RNA, 18 nt, Human
gacuucuuuaauuuugga

SEQ ID NO: 3810956 - RNA, 21 nt, Human
gacuucuuuaauuuuggaauu

SEQ ID NO: 3810957 - RNA, 22 nt, Human
gacuucuuucaaauugagagaa

SEQ ID NO: 3810958 - RNA, 12 nt, Human
gacuucuuuuca

SEQ ID NO: 3810959 - RNA, 15 nt, Human
gacuucuuuucacau

SEQ ID NO: 3810960 - RNA, 21 nt, Human
gacuucuuuucacauucuuau

SEQ ID NO: 3810961 - RNA, 22 nt, Human
gacuugaaaagagacaggcagg

SEQ ID NO: 3810962 - RNA, 16 nt, Human
gacuugaaagaaaggg

SEQ ID NO: 3810963 - RNA, 21 nt, Human
gacuugaaagcauccaugugu

SEQ ID NO: 3810964 - RNA, 11 nt, Human
gacuugaaguu

SEQ ID NO: 3810965 - RNA, 19 nt, Human
gacuugaauuuucccacug

SEQ ID NO: 3810966 - RNA, 13 nt, Human
gacuugaccccga

SEQ ID NO: 3810967 - RNA, 23 nt, Human
gacuugagaaacaaauaauuugu

SEQ ID NO: 3810968 - RNA, 19 nt, Human
gacuugaggauuuugagua

SEQ ID NO: 3810969 - RNA, 18 nt, Human
gacuugcaauuucuaccu

SEQ ID NO: 3810970 - RNA, 16 nt, Human
gacuuggaagcuccgc

SEQ ID NO: 3810971 - RNA, 19 nt, Human
gacuuggcaacagaagcag

SEQ ID NO: 3810972 - RNA, 15 nt, Human
gacuuggccccugcc

SEQ ID NO: 3810973 - RNA, 15 nt, Human
gacuuggccucucuc

SEQ ID NO: 3810974 - RNA, 21 nt, Human
gacuugggcacccccagccug

SEQ ID NO: 3810975 - RNA, 19 nt, Human
gacuuggucaccagcuccu

SEQ ID NO: 3810976 - RNA, 17 nt, Human
gacuugguugguagggu

SEQ ID NO: 3810977 - RNA, 19 nt, Human
gacuuguagggaugccuuu

SEQ ID NO: 3810978 - RNA, 23 nt, Human
gacuuguauagcaugaaauaaaa

SEQ ID NO: 3810979 - RNA, 18 nt, Human
gacuuguauauucuauuu

SEQ ID NO: 3810980 - RNA, 18 nt, Human
gacuuguauauuuguaca

SEQ ID NO: 3810981 - RNA, 18 nt, Human
gacuugugcacaggcaga

SEQ ID NO: 3810982 - RNA, 23 nt, Human
gacuuguuggcguaggcuacaga

SEQ ID NO: 3810983 - RNA, 21 nt, Human
gacuuuacacucggcuuugga

SEQ ID NO: 3810984 - RNA, 18 nt, Human
gacuuuagaaauaaaugu

SEQ ID NO: 3810985 - RNA, 11 nt, Human
gacuuuauaaa

SEQ ID NO: 3810986 - RNA, 17 nt, Human
gacuuuauguaguuuuu

SEQ ID NO: 3810987 - RNA, 11 nt, Human
gacuuuauuag

SEQ ID NO: 3810988 - RNA, 15 nt, Human
gacuuuauuauuuau

SEQ ID NO: 3810989 - RNA, 17 nt, Human
gacuuucaguaaacaua

SEQ ID NO: 3810990 - RNA, 13 nt, Human
gacuuuccacccc

SEQ ID NO: 3810991 - RNA, 15 nt, Human
gacuuuccacccccu

SEQ ID NO: 3810992 - RNA, 16 nt, Human
gacuuuccuaaauguu

SEQ ID NO: 3810993 - RNA, 18 nt, Human
gacucagcuccccagagu

SEQ ID NO: 3810994 - RNA, 15 nt, Human
gacucaggagccugu

SEQ ID NO: 3810995 - RNA, 16 nt, Human
gacucaggagccugug

SEQ ID NO: 3810996 - RNA, 18 nt, Human
gacucaggaugcccaggg

SEQ ID NO: 3810997 - RNA, 23 nt, Human
gacucaggaugcccagggccacu

SEQ ID NO: 3810998 - RNA, 23 nt, Human
gacucagggcagcgccaggcuga

SEQ ID NO: 3810999 - RNA, 19 nt, Human
gacucagggccaugccugc

SEQ ID NO: 3811000 - RNA, 20 nt, Human
gacucagggccaugccugcc

SEQ ID NO: 3811001 - RNA, 21 nt, Human
gacucagggccaugccugccc

SEQ ID NO: 3811002 - RNA, 22 nt, Human
gacucagggccaugccugcccc

SEQ ID NO: 3811003 - RNA, 20 nt, Human
gacucagggccccagcacua

SEQ ID NO: 3811004 - RNA, 15 nt, Human
gacucaguggggagg

SEQ ID NO: 3811005 - RNA, 19 nt, Human
gacucaucuuucccuccuu

SEQ ID NO: 3811006 - RNA, 22 nt, Human
gacucaucuuucccuccuuggu

SEQ ID NO: 3811007 - RNA, 15 nt, Human
gacucaugaggaggg

SEQ ID NO: 3811008 - RNA, 18 nt, Human
gacucaugaggaggggcc

SEQ ID NO: 3811009 - RNA, 19 nt, Human
gacucaugguguguuacac

SEQ ID NO: 3811010 - RNA, 14 nt, Human
gacucauucuucug

SEQ ID NO: 3811011 - RNA, 18 nt, Human
gacuccaaagaaauguaa

SEQ ID NO: 3811012 - RNA, 19 nt, Human
gacuccacgauccugccac

SEQ ID NO: 3811013 - RNA, 11 nt, Human
gacuccagaaa

SEQ ID NO: 3811014 - RNA, 16 nt, Human
gacuccagccagcgcc

SEQ ID NO: 3811015 - RNA, 21 nt, Human
gacuccagccagcgccucccu

SEQ ID NO: 3811016 - RNA, 22 nt, Human
gacuccagccagcgccucccuc

SEQ ID NO: 3811017 - RNA, 16 nt, Human
gacuccaggagaggag

SEQ ID NO: 3811018 - RNA, 20 nt, Human
gacuccaguggggcaagauu

SEQ ID NO: 3811019 - RNA, 17 nt, Human
gacucccaugaagccuu

SEQ ID NO: 3811020 - RNA, 21 nt, Human
gacucccaugaagccuuuuga

SEQ ID NO: 3811021 - RNA, 18 nt, Human
gacucccaugagggagau

SEQ ID NO: 3811022 - RNA, 12 nt, Human
gacucccuccuc

SEQ ID NO: 3811023 - RNA, 13 nt, Human
gacucccuccuca

SEQ ID NO: 3811024 - RNA, 16 nt, Human
gacucccuccucaccu

SEQ ID NO: 3811025 - RNA, 22 nt, Human
gacucccuuaaaauagaaauaa

SEQ ID NO: 3811026 - RNA, 14 nt, Human
gacuccggcccucc

SEQ ID NO: 3811027 - RNA, 22 nt, Human
gacuccggcccuccuacccugc

SEQ ID NO: 3811028 - RNA, 17 nt, Human
gacuccggcugugcugg

SEQ ID NO: 3811029 - RNA, 17 nt, Human
gacuccuaccugcccug

SEQ ID NO: 3811030 - RNA, 15 nt, Human
gacuccuagcugucc

SEQ ID NO: 3811031 - RNA, 19 nt, Human
gacuccuaggcaggacaug

SEQ ID NO: 3811032 - RNA, 23 nt, Human
gacuccuaggcaggacaugcuga

SEQ ID NO: 3811033 - RNA, 20 nt, Human
gacuccuccccacccuccug

SEQ ID NO: 3811034 - RNA, 22 nt, Human
gacuccuccccacccuccuggc

SEQ ID NO: 3811035 - RNA, 13 nt, Human
gacuccuccuuuu

SEQ ID NO: 3811036 - RNA, 17 nt, Human
gacuccuccuuuuucca

SEQ ID NO: 3811037 - RNA, 11 nt, Human
gacuccucugu

SEQ ID NO: 3811038 - RNA, 18 nt, Human
gacuccugaggacagcug

SEQ ID NO: 3811039 - RNA, 13 nt, Human
gacuccugcaggc

SEQ ID NO: 3811040 - RNA, 19 nt, Human
gacuccugcaggcagccag

SEQ ID NO: 3811041 - RNA, 21 nt, Human
gacuccugcaggcagccaggc

SEQ ID NO: 3811042 - RNA, 13 nt, Human
gacuccugcccug

SEQ ID NO: 3811043 - RNA, 17 nt, Human
gacuccuggguugagcu

SEQ ID NO: 3811044 - RNA, 16 nt, Human
gacucgacucugugcc

SEQ ID NO: 3811045 - RNA, 16 nt, Human
gacucgagaacuuuca

SEQ ID NO: 3811046 - RNA, 17 nt, Human
gacucgcgacaaugcaa

SEQ ID NO: 3811047 - RNA, 16 nt, Human
gacucggaaucuauuu

SEQ ID NO: 3811048 - RNA, 20 nt, Human
gacucgggcuccugugcccu

SEQ ID NO: 3811049 - RNA, 14 nt, Human
gacucggggguggg

SEQ ID NO: 3811050 - RNA, 16 nt, Human
gacucgggggugggga

SEQ ID NO: 3811051 - RNA, 13 nt, Human
gacucgguuucuc

SEQ ID NO: 3811052 - RNA, 14 nt, Human
gacucuaaagacca

SEQ ID NO: 3811053 - RNA, 16 nt, Human
gacucuaaagaccaaa

SEQ ID NO: 3811054 - RNA, 17 nt, Human
gacucuaaagaccaaac

SEQ ID NO: 3811055 - RNA, 21 nt, Human
gacucuaaauucuuuauuucu

SEQ ID NO: 3811056 - RNA, 14 nt, Human
gacucuaagaaaga

SEQ ID NO: 3811057 - RNA, 18 nt, Human
gacucuacaugcuuguug

SEQ ID NO: 3811058 - RNA, 20 nt, Human
gacucuaccagacuguguau

SEQ ID NO: 3811059 - RNA, 18 nt, Human
gacucuagaguccaaggu

SEQ ID NO: 3811060 - RNA, 19 nt, Human
gacucuaguacugugaauc

SEQ ID NO: 3811061 - RNA, 14 nt, Human
gacucuauucuuua

SEQ ID NO: 3811062 - RNA, 21 nt, Human
gacucucagcccagaagaaaa

SEQ ID NO: 3811063 - RNA, 12 nt, Human
gacucuccaggg

SEQ ID NO: 3811064 - RNA, 24 nt, Human
gacucuccagggguccuaggccuc

SEQ ID NO: 3811065 - RNA, 15 nt, Human
gacucucugugaccu

SEQ ID NO: 3811066 - RNA, 19 nt, Human
gacucucugugaccugccc

SEQ ID NO: 3811067 - RNA, 19 nt, Human
gacucugaaauaucccggg

SEQ ID NO: 3811068 - RNA, 15 nt, Human
gacucugaaaucuga

SEQ ID NO: 3811069 - RNA, 15 nt, Human
gacucugaagccucu

SEQ ID NO: 3811070 - RNA, 17 nt, Human
gacucugaagccucugg

SEQ ID NO: 3811071 - RNA, 21 nt, Human
gacucugaaucuuuuucagaa

SEQ ID NO: 3811072 - RNA, 17 nt, Human
gacucugagcgggaggc

SEQ ID NO: 3811073 - RNA, 19 nt, Human
gacucugagcgggaggcag

SEQ ID NO: 3811074 - RNA, 20 nt, Human
gacucugagcgggaggcaga

SEQ ID NO: 3811075 - RNA, 22 nt, Human
gacucugagcgggaggcagagu

SEQ ID NO: 3811076 - RNA, 12 nt, Human
gacucugcacau

SEQ ID NO: 3811077 - RNA, 13 nt, Human
gacucugcagccu

SEQ ID NO: 3811078 - RNA, 14 nt, Human
gacucugcagccuc

SEQ ID NO: 3811079 - RNA, 15 nt, Human
gacucugcagccuca

SEQ ID NO: 3811080 - RNA, 12 nt, Human
gacucugccccc

SEQ ID NO: 3811081 - RNA, 15 nt, Human
gacucugcccccugc

SEQ ID NO: 3811082 - RNA, 16 nt, Human
gacucugcccccugcu

SEQ ID NO: 3811083 - RNA, 22 nt, Human
gacucugcccccugcuggcucu

SEQ ID NO: 3811084 - RNA, 16 nt, Human
gacucugccuccucuu

SEQ ID NO: 3811085 - RNA, 16 nt, Human
gacucugcucuugcau

SEQ ID NO: 3811086 - RNA, 22 nt, Human
gacucuggacuuucucuaauaa

SEQ ID NO: 3811087 - RNA, 16 nt, Human
gacucuggcaaagcuu

SEQ ID NO: 3811088 - RNA, 12 nt, Human
gacucuggcccu

SEQ ID NO: 3811089 - RNA, 14 nt, Human
gacucuggcccugg

SEQ ID NO: 3811090 - RNA, 17 nt, Human
gacucuggcccuggccc

SEQ ID NO: 3811091 - RNA, 15 nt, Human
gacucuggccuccac

SEQ ID NO: 3811092 - RNA, 20 nt, Human
gacucugggcuauggacaca

SEQ ID NO: 3811093 - RNA, 17 nt, Human
gacucuguaacaucacu

SEQ ID NO: 3811094 - RNA, 22 nt, Human
gacucugucaauuucccugacu

SEQ ID NO: 3811095 - RNA, 12 nt, Human
gacucugucuca

SEQ ID NO: 3811096 - RNA, 14 nt, Human
gacucugugcuggc

SEQ ID NO: 3811097 - RNA, 14 nt, Human
gacucuuaagaaga

SEQ ID NO: 3811098 - RNA, 15 nt, Human
gacucuuacuuuuua

SEQ ID NO: 3811099 - RNA, 15 nt, Human
gacucuucaaaaacu

SEQ ID NO: 3811100 - RNA, 17 nt, Human
gacucuucugagcaccu

SEQ ID NO: 3811101 - RNA, 14 nt, Human
gacucuugggaggg

SEQ ID NO: 3811102 - RNA, 9 nt, Human
gacucuugu

SEQ ID NO: 3811103 - RNA, 20 nt, Human
gacucuuuagcaaaaaaaac

SEQ ID NO: 3811104 - RNA, 16 nt, Human
gacucuuuaugcuugc

SEQ ID NO: 3811105 - RNA, 20 nt, Human
gacugaaaaccucuccucau

SEQ ID NO: 3811106 - RNA, 15 nt, Human
gacugaaaguagggg

SEQ ID NO: 3811107 - RNA, 16 nt, Human
gacugaagccugcagg

SEQ ID NO: 3811108 - RNA, 21 nt, Human
gacugacagcaugugcccucc

SEQ ID NO: 3811109 - RNA, 23 nt, Human
gacugacagcaugugcccuccug

SEQ ID NO: 3811110 - RNA, 14 nt, Human
gacugaccagcagc

SEQ ID NO: 3811111 - RNA, 15 nt, Human
gacugaccagcagcu

SEQ ID NO: 3811112 - RNA, 16 nt, Human
gacugacccugaucag

SEQ ID NO: 3811113 - RNA, 19 nt, Human
gacugaccugguccacagg

SEQ ID NO: 3811114 - RNA, 20 nt, Human
gacugaccugguccacaggg

SEQ ID NO: 3811115 - RNA, 22 nt, Human
gacugaccugguccacagggca

SEQ ID NO: 3811116 - RNA, 21 nt, Human
gacugaccuuguaaaagacag

SEQ ID NO: 3811117 - RNA, 21 nt, Human
gacugacuuguuugucuucca

SEQ ID NO: 3811118 - RNA, 21 nt, Human
gacugagcaagacccugucuc

SEQ ID NO: 3811119 - RNA, 16 nt, Human
gacugagcacccucug

SEQ ID NO: 3811120 - RNA, 19 nt, Human
gacugagcagacuggugag

SEQ ID NO: 3811121 - RNA, 17 nt, Human
gacugagccagucccag

SEQ ID NO: 3811122 - RNA, 22 nt, Human
gacugagccccgcagaccuccc

SEQ ID NO: 3811123 - RNA, 12 nt, Human
gacugaggacaa

SEQ ID NO: 3811124 - RNA, 23 nt, Human
gacugaggccugagcgcuccugc

SEQ ID NO: 3811125 - RNA, 15 nt, Human
gacugagggacucug

SEQ ID NO: 3811126 - RNA, 21 nt, Human
gacugagggacucugaagccu

SEQ ID NO: 3811127 - RNA, 16 nt, Human
gacugaggggagggga

SEQ ID NO: 3811128 - RNA, 18 nt, Human
gacugagggggccuggau

SEQ ID NO: 3811129 - RNA, 21 nt, Human
gacugaguaagaaaugcugcc

SEQ ID NO: 3811130 - RNA, 18 nt, Human
gacugaguacguugugca

SEQ ID NO: 3811131 - RNA, 22 nt, Human
gacugagugggaagcccauccu

SEQ ID NO: 3811132 - RNA, 21 nt, Human
gacugauguuaggcugggccc

SEQ ID NO: 3811133 - RNA, 16 nt, Human
gacugauuucagagug

SEQ ID NO: 3811134 - RNA, 17 nt, Human
gacugcaagugagcaaa

SEQ ID NO: 3811135 - RNA, 19 nt, Human
gacugcaccauugcugcuc

SEQ ID NO: 3811136 - RNA, 14 nt, Human
gacugcacccagga

SEQ ID NO: 3811137 - RNA, 17 nt, Human
gacugcacccaggaggg

SEQ ID NO: 3811138 - RNA, 18 nt, Human
gacugcacccaggagggg

SEQ ID NO: 3811139 - RNA, 22 nt, Human
gacugcagguuggaccccagag

SEQ ID NO: 3811140 - RNA, 24 nt, Human
gacugcauuauauuuauuacugua

SEQ ID NO: 3811141 - RNA, 19 nt, Human
gacugccaagacugcugug

SEQ ID NO: 3811142 - RNA, 13 nt, Human
cucccaccuggcu

SEQ ID NO: 3811143 - RNA, 21 nt, Human
cucccacucuccuaggcauuc

SEQ ID NO: 3811144 - RNA, 19 nt, Human
cucccacuucccugacacu

SEQ ID NO: 3811145 - RNA, 15 nt, Human
cucccacuucugcca

SEQ ID NO: 3811146 - RNA, 16 nt, Human
cucccacuucugccag

SEQ ID NO: 3811147 - RNA, 22 nt, Human
cucccacuuggccaagcaggga

SEQ ID NO: 3811148 - RNA, 20 nt, Human
cucccacuuugcuguuccuu

SEQ ID NO: 3811149 - RNA, 16 nt, Human
cucccagaacacacuc

SEQ ID NO: 3811150 - RNA, 24 nt, Human
cucccagaacacacuccaucagcu

SEQ ID NO: 3811151 - RNA, 13 nt, Human
cucccagaauccc

SEQ ID NO: 3811152 - RNA, 16 nt, Human
cucccagaaucccagc

SEQ ID NO: 3811153 - RNA, 19 nt, Human
cucccagaaucccagccgg

SEQ ID NO: 3811154 - RNA, 21 nt, Human
cucccagaaucccagccggcc

SEQ ID NO: 3811155 - RNA, 17 nt, Human
cucccagaccugccucu

SEQ ID NO: 3811156 - RNA, 20 nt, Human
cucccagaccugccucuucc

SEQ ID NO: 3811157 - RNA, 15 nt, Human
cucccagaggagcca

SEQ ID NO: 3811158 - RNA, 19 nt, Human
cucccagaggagccaccag

SEQ ID NO: 3811159 - RNA, 21 nt, Human
cucccagaggagccaccaguu

SEQ ID NO: 3811160 - RNA, 12 nt, Human
cucccagaggcg

SEQ ID NO: 3811161 - RNA, 16 nt, Human
cucccagagguccagc

SEQ ID NO: 3811162 - RNA, 17 nt, Human
cucccagagguccagcc

SEQ ID NO: 3811163 - RNA, 20 nt, Human
cucccagagguccagcccau

SEQ ID NO: 3811164 - RNA, 19 nt, Human
cucccagcaucgcacucug

SEQ ID NO: 3811165 - RNA, 11 nt, Human
cucccagccuc

SEQ ID NO: 3811166 - RNA, 11 nt, Human
cucccagccug

SEQ ID NO: 3811167 - RNA, 21 nt, Human
cucccagcugacaguccucuc

SEQ ID NO: 3811168 - RNA, 11 nt, Human
cucccaggaac

SEQ ID NO: 3811169 - RNA, 12 nt, Human
cucccaggacac

SEQ ID NO: 3811170 - RNA, 21 nt, Human
cucccaggacucugaccccag

SEQ ID NO: 3811171 - RNA, 19 nt, Human
cucccaggagacaguucaa

SEQ ID NO: 3811172 - RNA, 18 nt, Human
cucccaggagccugccca

SEQ ID NO: 3811173 - RNA, 16 nt, Human
cucccaggcacugucu

SEQ ID NO: 3811174 - RNA, 17 nt, Human
cucccaggcauucccca

SEQ ID NO: 3811175 - RNA, 16 nt, Human
cucccaggccccauga

SEQ ID NO: 3811176 - RNA, 19 nt, Human
cucccaggccccaugaccu

SEQ ID NO: 3811177 - RNA, 14 nt, Human
cucccaggcgcccc

SEQ ID NO: 3811178 - RNA, 12 nt, Human
cucccaggcucu

SEQ ID NO: 3811179 - RNA, 22 nt, Human
cucccagggagcaagggcaggg

SEQ ID NO: 3811180 - RNA, 16 nt, Human
cucccagggccagggc

SEQ ID NO: 3811181 - RNA, 17 nt, Human
cucccagggccagggcc

SEQ ID NO: 3811182 - RNA, 14 nt, Human
cucccagggccaug

SEQ ID NO: 3811183 - RNA, 23 nt, Human
cucccagggccuuaaaagccauc

SEQ ID NO: 3811184 - RNA, 19 nt, Human
cucccaggggcucccuccg

SEQ ID NO: 3811185 - RNA, 21 nt, Human
cucccaggggucucccuggcu

SEQ ID NO: 3811186 - RNA, 12 nt, Human
cucccaggguuu

SEQ ID NO: 3811187 - RNA, 15 nt, Human
cucccaggguuuuaa

SEQ ID NO: 3811188 - RNA, 16 nt, Human
cucccaggguuuuaac

SEQ ID NO: 3811189 - RNA, 21 nt, Human
cucccaggguuuuaacuuugu

SEQ ID NO: 3811190 - RNA, 19 nt, Human
cucccagguaccagcugcg

SEQ ID NO: 3811191 - RNA, 21 nt, Human
cucccagguaccagcugcgcu

SEQ ID NO: 3811192 - RNA, 22 nt, Human
cucccagguaccagcugcgcuu

SEQ ID NO: 3811193 - RNA, 16 nt, Human
cucccaguaccuccug

SEQ ID NO: 3811194 - RNA, 22 nt, Human
cucccagucaccuuguggcaag

SEQ ID NO: 3811195 - RNA, 19 nt, Human
cucccagucuacccagaga

SEQ ID NO: 3811196 - RNA, 12 nt, Human
cucccagugucu

SEQ ID NO: 3811197 - RNA, 21 nt, Human
cucccagugucuuccuguggg

SEQ ID NO: 3811198 - RNA, 16 nt, Human
cucccaucacuucccu

SEQ ID NO: 3811199 - RNA, 23 nt, Human
cucccaucaugcccggucccacc

SEQ ID NO: 3811200 - RNA, 21 nt, Human
cucccaucauuacccuucccu

SEQ ID NO: 3811201 - RNA, 14 nt, Human
cucccauccagggc

SEQ ID NO: 3811202 - RNA, 15 nt, Human
cucccauccagggcc

SEQ ID NO: 3811203 - RNA, 12 nt, Human
cucccauccccc

SEQ ID NO: 3811204 - RNA, 14 nt, Human
cucccaucccccug

SEQ ID NO: 3811205 - RNA, 18 nt, Human
cucccaucccccugcccu

SEQ ID NO: 3811206 - RNA, 13 nt, Human
cucccauccccug

SEQ ID NO: 3811207 - RNA, 15 nt, Human
cucccauccccugga

SEQ ID NO: 3811208 - RNA, 23 nt, Human
cucccauccccuggacugggagg

SEQ ID NO: 3811209 - RNA, 15 nt, Human
cucccaucucacaca

SEQ ID NO: 3811210 - RNA, 18 nt, Human
cucccaucucacacauga

SEQ ID NO: 3811211 - RNA, 13 nt, Human
cucccaucuggga

SEQ ID NO: 3811212 - RNA, 15 nt, Human
cucccaucugggagu

SEQ ID NO: 3811213 - RNA, 11 nt, Human
cucccaucugu

SEQ ID NO: 3811214 - RNA, 17 nt, Human
cucccaucuuaacucuu

SEQ ID NO: 3811215 - RNA, 18 nt, Human
cucccaucuuaacucuuu

SEQ ID NO: 3811216 - RNA, 20 nt, Human
cucccaugagggagaugcca

SEQ ID NO: 3811217 - RNA, 22 nt, Human
cucccaugagggagaugccaug

SEQ ID NO: 3811218 - RNA, 20 nt, Human
cucccauggcuuaaugcuuc

SEQ ID NO: 3811219 - RNA, 14 nt, Human
cucccauguaugga

SEQ ID NO: 3811220 - RNA, 16 nt, Human
cucccauuccugaaga

SEQ ID NO: 3811221 - RNA, 17 nt, Human
cucccauugucccucug

SEQ ID NO: 3811222 - RNA, 14 nt, Human
cucccauuuccuga

SEQ ID NO: 3811223 - RNA, 16 nt, Human
cucccauuuuggaauu

SEQ ID NO: 3811224 - RNA, 12 nt, Human
cuccccaaaaac

SEQ ID NO: 3811225 - RNA, 19 nt, Human
cuccccaaaggcuuugccc

SEQ ID NO: 3811226 - RNA, 12 nt, Human
cuccccaacccu

SEQ ID NO: 3811227 - RNA, 19 nt, Human
cuccccaacccugccccug

SEQ ID NO: 3811228 - RNA, 17 nt, Human
cuccccaaggcccccug

SEQ ID NO: 3811229 - RNA, 21 nt, Human
cuccccaaggcccccugccug

SEQ ID NO: 3811230 - RNA, 18 nt, Human
cuccccaaugagacuugc

SEQ ID NO: 3811231 - RNA, 23 nt, Human
cuccccaaugagacuugccuucc

SEQ ID NO: 3811232 - RNA, 11 nt, Human
cuccccacagc

SEQ ID NO: 3811233 - RNA, 19 nt, Human
cuccccacagcgucccugg

SEQ ID NO: 3811234 - RNA, 12 nt, Human
cuccccaccccu

SEQ ID NO: 3811235 - RNA, 21 nt, Human
cuccccaccuucaauuccugg

SEQ ID NO: 3811236 - RNA, 20 nt, Human
cuccccacggccgcuccagg

SEQ ID NO: 3811237 - RNA, 21 nt, Human
cuccccacggccgcuccaggg

SEQ ID NO: 3811238 - RNA, 22 nt, Human
cuccccacggccgcuccagggg

SEQ ID NO: 3811239 - RNA, 23 nt, Human
cuccccacggggccucgggaccu

SEQ ID NO: 3811240 - RNA, 14 nt, Human
cuccccacucugcu

SEQ ID NO: 3811241 - RNA, 15 nt, Human
cuccccagagcacug

SEQ ID NO: 3811242 - RNA, 16 nt, Human
cuccccagagcacugg

SEQ ID NO: 3811243 - RNA, 17 nt, Human
cuccccagagcacuggg

SEQ ID NO: 3811244 - RNA, 23 nt, Human
cuccccagcauuccagccccucu

SEQ ID NO: 3811245 - RNA, 16 nt, Human
cuccccagccagccug

SEQ ID NO: 3811246 - RNA, 17 nt, Human
cuccccagccagccugg

SEQ ID NO: 3811247 - RNA, 18 nt, Human
cuccccagccagccuggc

SEQ ID NO: 3811248 - RNA, 14 nt, Human
cuccccagcccaga

SEQ ID NO: 3811249 - RNA, 18 nt, Human
cuccccagcccagagaca

SEQ ID NO: 3811250 - RNA, 16 nt, Human
cuccccagcccagggu

SEQ ID NO: 3811251 - RNA, 22 nt, Human
cuccccagcccaggguuccccc

SEQ ID NO: 3811252 - RNA, 20 nt, Human
cuccccagccccaucccaaa

SEQ ID NO: 3811253 - RNA, 17 nt, Human
cuccccagccccuagcc

SEQ ID NO: 3811254 - RNA, 19 nt, Human
cuccccagccccuagccca

SEQ ID NO: 3811255 - RNA, 13 nt, Human
cuccccagccugg

SEQ ID NO: 3811256 - RNA, 12 nt, Human
cuccccagcuca

SEQ ID NO: 3811257 - RNA, 14 nt, Human
cuccccagcuccca

SEQ ID NO: 3811258 - RNA, 18 nt, Human
cuccccaggaauuuggga

SEQ ID NO: 3811259 - RNA, 15 nt, Human
cuccccaggccaggc

SEQ ID NO: 3811260 - RNA, 18 nt, Human
cuccccagggaagcagca

SEQ ID NO: 3811261 - RNA, 22 nt, Human
cuccccagggaagcagcagccu

SEQ ID NO: 3811262 - RNA, 16 nt, Human
cuccccagguccagcu

SEQ ID NO: 3811263 - RNA, 17 nt, Human
cuccccagguccagcuc

SEQ ID NO: 3811264 - RNA, 16 nt, Human
cuccccaguguauguc

SEQ ID NO: 3811265 - RNA, 11 nt, Human
cuccccaguuc

SEQ ID NO: 3811266 - RNA, 15 nt, Human
cuccccaugcaggug

SEQ ID NO: 3811267 - RNA, 14 nt, Human
cuccccaugugucc

SEQ ID NO: 3811268 - RNA, 21 nt, Human
cuccccauguguccugguucc

SEQ ID NO: 3811269 - RNA, 21 nt, Human
cuccccauuucccaucugcac

SEQ ID NO: 3811270 - RNA, 21 nt, Human
cucccccaacccccaccccac

SEQ ID NO: 3811271 - RNA, 14 nt, Human
cucccccacccccu

SEQ ID NO: 3811272 - RNA, 13 nt, Human
cucccccacuuuc

SEQ ID NO: 3811273 - RNA, 15 nt, Human
cucccccagccccau

SEQ ID NO: 3811274 - RNA, 11 nt, Human
cucccccaucc

SEQ ID NO: 3811275 - RNA, 17 nt, Human
cucccccauccuccccu

SEQ ID NO: 3811276 - RNA, 13 nt, Human
cucccccaucucu

SEQ ID NO: 3811277 - RNA, 15 nt, Human
cuccccccacugcag

SEQ ID NO: 3811278 - RNA, 17 nt, Human
cuccccccccccuccaa

SEQ ID NO: 3811279 - RNA, 19 nt, Human
cucccccccggggcugggu

SEQ ID NO: 3811280 - RNA, 21 nt, Human
cucccccccggggcuggguug

SEQ ID NO: 3811281 - RNA, 17 nt, Human
cucccccgggaggggcc

SEQ ID NO: 3811282 - RNA, 22 nt, Human
cucccccgggaggggcccgcuu

SEQ ID NO: 3811283 - RNA, 21 nt, Human
cucccccguguuccccucuug

SEQ ID NO: 3811284 - RNA, 21 nt, Human
cucccccuaaaccccuguccc

SEQ ID NO: 3811285 - RNA, 20 nt, Human
cucccccuccuucccagcug

SEQ ID NO: 3811286 - RNA, 18 nt, Human
cucccccugccagugccu

SEQ ID NO: 3811287 - RNA, 12 nt, Human
cucccccugggc

SEQ ID NO: 3811288 - RNA, 13 nt, Human
cucccccuguccc

SEQ ID NO: 3811289 - RNA, 16 nt, Human
cucccccuuaccccac

SEQ ID NO: 3811290 - RNA, 17 nt, Human
cuccccgccuguucccc

SEQ ID NO: 3811291 - RNA, 18 nt, Human
cuccccgccuguuccccc

SEQ ID NO: 3811292 - RNA, 16 nt, Human
gacugccaagccaugg

SEQ ID NO: 3811293 - RNA, 14 nt, Human
gacugccacaagga

SEQ ID NO: 3811294 - RNA, 12 nt, Human
gacugccaccuc

SEQ ID NO: 3811295 - RNA, 13 nt, Human
gacugccaccucc

SEQ ID NO: 3811296 - RNA, 13 nt, Human
gacugccagcucu

SEQ ID NO: 3811297 - RNA, 19 nt, Human
gacugccagcucuuccuag

SEQ ID NO: 3811298 - RNA, 21 nt, Human
gacugccccgugcagacugga

SEQ ID NO: 3811299 - RNA, 16 nt, Human
gacugcccggcacaga

SEQ ID NO: 3811300 - RNA, 23 nt, Human
gacugccgaccgaggcuggagcu

SEQ ID NO: 3811301 - RNA, 14 nt, Human
gacugccucugcca

SEQ ID NO: 3811302 - RNA, 20 nt, Human
gacugcgaucuucagagcag

SEQ ID NO: 3811303 - RNA, 15 nt, Human
gacugcggaggaagg

SEQ ID NO: 3811304 - RNA, 23 nt, Human
gacugcggaggaaggaggaccca

SEQ ID NO: 3811305 - RNA, 14 nt, Human
gacugcguucugca

SEQ ID NO: 3811306 - RNA, 14 nt, Human
gacugcuaaauaaa

SEQ ID NO: 3811307 - RNA, 17 nt, Human
gacugcuaaauaaaauu

SEQ ID NO: 3811308 - RNA, 18 nt, Human
gacugcuaaauaaaauuu

SEQ ID NO: 3811309 - RNA, 15 nt, Human
gacugcuagggagug

SEQ ID NO: 3811310 - RNA, 20 nt, Human
gacugcuaguguucugucua

SEQ ID NO: 3811311 - RNA, 19 nt, Human
gacugcucagaacuugcug

SEQ ID NO: 3811312 - RNA, 21 nt, Human
gacugcuccccagcccuggcu

SEQ ID NO: 3811313 - RNA, 14 nt, Human
gacugcuccugagc

SEQ ID NO: 3811314 - RNA, 20 nt, Human
gacugcugggagguuaaaaa

SEQ ID NO: 3811315 - RNA, 12 nt, Human
gacugcuguggc

SEQ ID NO: 3811316 - RNA, 18 nt, Human
gacugcuguggccaggag

SEQ ID NO: 3811317 - RNA, 12 nt, Human
gacugcuuccca

SEQ ID NO: 3811318 - RNA, 13 nt, Human
gacugcuucccau

SEQ ID NO: 3811319 - RNA, 22 nt, Human
gacugcuucccauccuacccuc

SEQ ID NO: 3811320 - RNA, 12 nt, Human
gacugcuugccc

SEQ ID NO: 3811321 - RNA, 13 nt, Human
gacugcuugcccu

SEQ ID NO: 3811322 - RNA, 17 nt, Human
gacugcuugcccuaagc

SEQ ID NO: 3811323 - RNA, 15 nt, Human
gacuggaacacuaga

SEQ ID NO: 3811324 - RNA, 17 nt, Human
gacuggaaccagggaga

SEQ ID NO: 3811325 - RNA, 21 nt, Human
gacuggaagcuaauuugcauu

SEQ ID NO: 3811326 - RNA, 14 nt, Human
gacuggaaggacca

SEQ ID NO: 3811327 - RNA, 13 nt, Human
gacuggaaguuca

SEQ ID NO: 3811328 - RNA, 12 nt, Human
gacuggaauuuu

SEQ ID NO: 3811329 - RNA, 15 nt, Human
gacuggaauuuuuau

SEQ ID NO: 3811330 - RNA, 23 nt, Human
gacuggaggccccuggagccaga

SEQ ID NO: 3811331 - RNA, 22 nt, Human
gacuggauaguccgucucugcu

SEQ ID NO: 3811332 - RNA, 17 nt, Human
gacuggauguaccacca

SEQ ID NO: 3811333 - RNA, 16 nt, Human
gacuggcaagaaaaga

SEQ ID NO: 3811334 - RNA, 12 nt, Human
gacuggccaggg

SEQ ID NO: 3811335 - RNA, 18 nt, Human
gacuggccugaggagcag

SEQ ID NO: 3811336 - RNA, 20 nt, Human
gacuggcuagaguccucacu

SEQ ID NO: 3811337 - RNA, 10 nt, Human
gacuggcuuu

SEQ ID NO: 3811338 - RNA, 19 nt, Human
gacugggagcccccagccu

SEQ ID NO: 3811339 - RNA, 20 nt, Human
gacugggagcccccagccug

SEQ ID NO: 3811340 - RNA, 21 nt, Human
gacugggagcccccagccugu

SEQ ID NO: 3811341 - RNA, 18 nt, Human
gacugggagccgcagcag

SEQ ID NO: 3811342 - RNA, 14 nt, Human
gacugggcccugcc

SEQ ID NO: 3811343 - RNA, 17 nt, Human
gacugggcccugccucu

SEQ ID NO: 3811344 - RNA, 14 nt, Human
gacugggcugaggg

SEQ ID NO: 3811345 - RNA, 18 nt, Human
gacuggggaugugggagg

SEQ ID NO: 3811346 - RNA, 14 nt, Human
gacuggggcagggu

SEQ ID NO: 3811347 - RNA, 14 nt, Human
gacugggggccaga

SEQ ID NO: 3811348 - RNA, 14 nt, Human
gacuggguuucuag

SEQ ID NO: 3811349 - RNA, 16 nt, Human
gacugguaaguaacug

SEQ ID NO: 3811350 - RNA, 15 nt, Human
gacugguccugugug

SEQ ID NO: 3811351 - RNA, 12 nt, Human
gacuggugacug

SEQ ID NO: 3811352 - RNA, 10 nt, Human
gacuggugcc

SEQ ID NO: 3811353 - RNA, 22 nt, Human
gacuggugcuauaggcuggaga

SEQ ID NO: 3811354 - RNA, 23 nt, Human
gacuggugcuauaggcuggagaa

SEQ ID NO: 3811355 - RNA, 17 nt, Human
gacugguuuacaggccc

SEQ ID NO: 3811356 - RNA, 19 nt, Human
gacugguuuacaggcccug

SEQ ID NO: 3811357 - RNA, 18 nt, Human
gacuguaaacacagacag

SEQ ID NO: 3811358 - RNA, 13 nt, Human
gacuguaaguugg

SEQ ID NO: 3811359 - RNA, 23 nt, Human
gacuguacacacuuuauuuacuu

SEQ ID NO: 3811360 - RNA, 16 nt, Human
gacuguacuccuccca

SEQ ID NO: 3811361 - RNA, 20 nt, Human
gacuguagauauguauucuu

SEQ ID NO: 3811362 - RNA, 20 nt, Human
gacuguagauugcuucugua

SEQ ID NO: 3811363 - RNA, 22 nt, Human
gacuguagggagggcggcaggg

SEQ ID NO: 3811364 - RNA, 23 nt, Human
gacuguagggagggcggcagggg

SEQ ID NO: 3811365 - RNA, 16 nt, Human
gacuguaucuguguag

SEQ ID NO: 3811366 - RNA, 19 nt, Human
gacuguaucuguguagacu

SEQ ID NO: 3811367 - RNA, 22 nt, Human
gacuguauuauacauggguagc

SEQ ID NO: 3811368 - RNA, 14 nt, Human
gacuguauuuguga

SEQ ID NO: 3811369 - RNA, 23 nt, Human
gacuguauuugugacuaauugua

SEQ ID NO: 3811370 - RNA, 23 nt, Human
gacuguccucuccccuccagccu

SEQ ID NO: 3811371 - RNA, 17 nt, Human
gacugugacaggcagca

SEQ ID NO: 3811372 - RNA, 19 nt, Human
gacugugacaggcagcaga

SEQ ID NO: 3811373 - RNA, 13 nt, Human
gacugugaugcca

SEQ ID NO: 3811374 - RNA, 14 nt, Human
gacuguggcugcua

SEQ ID NO: 3811375 - RNA, 15 nt, Human
gacuguggcugcuag

SEQ ID NO: 3811376 - RNA, 22 nt, Human
gacuguguauucuaguuuuguc

SEQ ID NO: 3811377 - RNA, 14 nt, Human
gacugugugcucag

SEQ ID NO: 3811378 - RNA, 22 nt, Human
gacugugugcucaggagcccug

SEQ ID NO: 3811379 - RNA, 21 nt, Human
gacugugugugcccucugggc

SEQ ID NO: 3811380 - RNA, 21 nt, Human
gacuguugggguggguauaaa

SEQ ID NO: 3811381 - RNA, 13 nt, Human
gacuguugucccu

SEQ ID NO: 3811382 - RNA, 16 nt, Human
gacuguugucccugca

SEQ ID NO: 3811383 - RNA, 20 nt, Human
gacuguugucccugcacucu

SEQ ID NO: 3811384 - RNA, 13 nt, Human
gacuguuucaaac

SEQ ID NO: 3811385 - RNA, 16 nt, Human
gacuguuuucucuuga

SEQ ID NO: 3811386 - RNA, 21 nt, Human
gacuuaacauagccaaaaugu

SEQ ID NO: 3811387 - RNA, 16 nt, Human
gacuuaauagaaacau

SEQ ID NO: 3811388 - RNA, 23 nt, Human
gacuuaaugugauuacugcucua

SEQ ID NO: 3811389 - RNA, 18 nt, Human
gacuuacagcaaauccuu

SEQ ID NO: 3811390 - RNA, 14 nt, Human
gacuuacaugauuc

SEQ ID NO: 3811391 - RNA, 15 nt, Human
gacuuacaugauuca

SEQ ID NO: 3811392 - RNA, 12 nt, Human
gacuuacuguac

SEQ ID NO: 3811393 - RNA, 15 nt, Human
gacuuacuguacaug

SEQ ID NO: 3811394 - RNA, 23 nt, Human
gacuuacuguacaugaaaacaca

SEQ ID NO: 3811395 - RNA, 12 nt, Human
gacuuagaaucc

SEQ ID NO: 3811396 - RNA, 21 nt, Human
gacuuagaaucccuguguuaa

SEQ ID NO: 3811397 - RNA, 16 nt, Human
gacuuagggcaccagg

SEQ ID NO: 3811398 - RNA, 17 nt, Human
gacuuaguauauuuucu

SEQ ID NO: 3811399 - RNA, 22 nt, Human
gacuuaguugcguuacacccuu

SEQ ID NO: 3811400 - RNA, 16 nt, Human
gacuuauaguacauga

SEQ ID NO: 3811401 - RNA, 17 nt, Human
gacuuauaguacaugau

SEQ ID NO: 3811402 - RNA, 13 nt, Human
gacuuaugggccc

SEQ ID NO: 3811403 - RNA, 15 nt, Human
gacuuauuuucucug

SEQ ID NO: 3811404 - RNA, 12 nt, Human
gacuucaaagca

SEQ ID NO: 3811405 - RNA, 17 nt, Human
gacuucaaagcaagcug

SEQ ID NO: 3811406 - RNA, 16 nt, Human
gacuucacacugcaag

SEQ ID NO: 3811407 - RNA, 21 nt, Human
gacuucacauaagcucagaau

SEQ ID NO: 3811408 - RNA, 22 nt, Human
gacuucagggagucagcuguuu

SEQ ID NO: 3811409 - RNA, 17 nt, Human
gacuucaggggcugccc

SEQ ID NO: 3811410 - RNA, 13 nt, Human
gacuucaguaugu

SEQ ID NO: 3811411 - RNA, 20 nt, Human
gacuucaguauguugucaaa

SEQ ID NO: 3811412 - RNA, 24 nt, Human
gacuucaucucccaccuagcagca

SEQ ID NO: 3811413 - RNA, 15 nt, Human
gacuucauuuuuccu

SEQ ID NO: 3811414 - RNA, 16 nt, Human
gacuuccaaagaaugu

SEQ ID NO: 3811415 - RNA, 15 nt, Human
gacuucccaacugca

SEQ ID NO: 3811416 - RNA, 19 nt, Human
gacuucccacucuagggca

SEQ ID NO: 3811417 - RNA, 13 nt, Human
gacuucccagcuu

SEQ ID NO: 3811418 - RNA, 17 nt, Human
gacuuccccaauaucuu

SEQ ID NO: 3811419 - RNA, 20 nt, Human
gacuuccccaauaucuugcu

SEQ ID NO: 3811420 - RNA, 19 nt, Human
gacuuccucgccucuccca

SEQ ID NO: 3811421 - RNA, 21 nt, Human
gacuuccuguccagcuccaac

SEQ ID NO: 3811422 - RNA, 15 nt, Human
gacuuccuugagaca

SEQ ID NO: 3811423 - RNA, 16 nt, Human
gacuuccuugagacac

SEQ ID NO: 3811424 - RNA, 20 nt, Human
gacuuccuugagacacggag

SEQ ID NO: 3811425 - RNA, 14 nt, Human
gacuuccuugcucu

SEQ ID NO: 3811426 - RNA, 18 nt, Human
gacuuccuugcucucccu

SEQ ID NO: 3811427 - RNA, 16 nt, Human
gacuucgacucaggau

SEQ ID NO: 3811428 - RNA, 18 nt, Human
gacuucgacugugaccug

SEQ ID NO: 3811429 - RNA, 19 nt, Human
gacuucuaaguaaaaccac

SEQ ID NO: 3811430 - RNA, 15 nt, Human
gacuucuaccugccc

SEQ ID NO: 3811431 - RNA, 17 nt, Human
gacuucuauuuuaaaga

SEQ ID NO: 3811432 - RNA, 22 nt, Human
gacuucuccaggucucacgggc

SEQ ID NO: 3811433 - RNA, 14 nt, Human
gacuucugcuggca

SEQ ID NO: 3811434 - RNA, 20 nt, Human
gacuucugucuucacaacag

SEQ ID NO: 3811435 - RNA, 16 nt, Human
gacuucuguuuucaau

SEQ ID NO: 3811436 - RNA, 23 nt, Human
gacuucuguuuucaaucucguau

SEQ ID NO: 3811437 - RNA, 21 nt, Human
gacuugaaaagagacaggcag

SEQ ID NO: 3811438 - RNA, 13 nt, Human
gacuugaaagaaa

SEQ ID NO: 3811439 - RNA, 14 nt, Human
gacuugaaagcauc

SEQ ID NO: 3811440 - RNA, 23 nt, Human
gacuugaggauuuugaguaucuc

SEQ ID NO: 3811441 - RNA, 18 nt, Human
gacuugcaugaagagaag

SEQ ID NO: 3811442 - RNA, 20 nt, Human
gacuuucucuaauaauaaau

SEQ ID NO: 3811443 - RNA, 12 nt, Human
gacuuucugccu

SEQ ID NO: 3811444 - RNA, 14 nt, Human
gacuuucugccugg

SEQ ID NO: 3811445 - RNA, 16 nt, Human
gacuuucugccuggag

SEQ ID NO: 3811446 - RNA, 18 nt, Human
gacuuucugccuggagug

SEQ ID NO: 3811447 - RNA, 13 nt, Human
gacuuucuguugg

SEQ ID NO: 3811448 - RNA, 23 nt, Human
gacuuucuuuuuguagcuggggc

SEQ ID NO: 3811449 - RNA, 22 nt, Human
gacuuucuuuuuugauauagaa

SEQ ID NO: 3811450 - RNA, 22 nt, Human
gacuuugaugucagcaguugcu

SEQ ID NO: 3811451 - RNA, 14 nt, Human
gacuuugcuccuca

SEQ ID NO: 3811452 - RNA, 14 nt, Human
gacuuuggaaagac

SEQ ID NO: 3811453 - RNA, 20 nt, Human
acggcucuguccccagccug

SEQ ID NO: 3811454 - RNA, 11 nt, Human
acggcugggca

SEQ ID NO: 3811455 - RNA, 18 nt, Human
acgggaacaugcccccug

SEQ ID NO: 3811456 - RNA, 15 nt, Human
acgggaagcaaccuc

SEQ ID NO: 3811457 - RNA, 17 nt, Human
acgggaaguuuagagag

SEQ ID NO: 3811458 - RNA, 13 nt, Human
acgggaccgggcc

SEQ ID NO: 3811459 - RNA, 17 nt, Human
acgggcagccuggcucc

SEQ ID NO: 3811460 - RNA, 22 nt, Human
acgggcagccuggcucccagga

SEQ ID NO: 3811461 - RNA, 17 nt, Human
acgggccuguccacagg

SEQ ID NO: 3811462 - RNA, 14 nt, Human
acgggcugcccugc

SEQ ID NO: 3811463 - RNA, 23 nt, Human
acgggcuuguugcuguugauguu

SEQ ID NO: 3811464 - RNA, 12 nt, Human
acggggagaaaa

SEQ ID NO: 3811465 - RNA, 21 nt, Human
acggggccgacauugucuccc

SEQ ID NO: 3811466 - RNA, 14 nt, Human
acggggccggccag

SEQ ID NO: 3811467 - RNA, 15 nt, Human
acggggggccccagu

SEQ ID NO: 3811468 - RNA, 16 nt, Human
acggggggccccaguc

SEQ ID NO: 3811469 - RNA, 18 nt, Human
acgggugggcggcuggag

SEQ ID NO: 3811470 - RNA, 16 nt, Human
acggucagguuuaaca

SEQ ID NO: 3811471 - RNA, 23 nt, Human
acggucagguuuaacauuugccu

SEQ ID NO: 3811472 - RNA, 16 nt, Human
acggugaauggcuuug

SEQ ID NO: 3811473 - RNA, 20 nt, Human
acggugaauggcuuuguaua

SEQ ID NO: 3811474 - RNA, 18 nt, Human
acggugcuccaggcaggc

SEQ ID NO: 3811475 - RNA, 20 nt, Human
acggugggccuugcugggga

SEQ ID NO: 3811476 - RNA, 17 nt, Human
acggugucuuguucugu

SEQ ID NO: 3811477 - RNA, 20 nt, Human
acggugucuuguucugucac

SEQ ID NO: 3811478 - RNA, 16 nt, Human
acgguucaccagccuc

SEQ ID NO: 3811479 - RNA, 21 nt, Human
acgguucaguuucuucugcgc

SEQ ID NO: 3811480 - RNA, 10 nt, Human
acgguuccua

SEQ ID NO: 3811481 - RNA, 14 nt, Human
acgguuuccaggga

SEQ ID NO: 3811482 - RNA, 17 nt, Human
acgguuuccagggaggg

SEQ ID NO: 3811483 - RNA, 17 nt, Human
acgguuugaagccugga

SEQ ID NO: 3811484 - RNA, 12 nt, Human
acguaaagaacu

SEQ ID NO: 3811485 - RNA, 15 nt, Human
acguaaagaacuuuu

SEQ ID NO: 3811486 - RNA, 17 nt, Human
acguaaagcuagaaaug

SEQ ID NO: 3811487 - RNA, 16 nt, Human
acguaaaguacuugua

SEQ ID NO: 3811488 - RNA, 13 nt, Human
acguaagcacugu

SEQ ID NO: 3811489 - RNA, 15 nt, Human
acguaagcacuguuu

SEQ ID NO: 3811490 - RNA, 24 nt, Human
acguacaaguaguucuguauuuga

SEQ ID NO: 3811491 - RNA, 12 nt, Human
acguacacauuu

SEQ ID NO: 3811492 - RNA, 14 nt, Human
acguacacauuuua

SEQ ID NO: 3811493 - RNA, 14 nt, Human
acguacucugguua

SEQ ID NO: 3811494 - RNA, 22 nt, Human
acguauaaaagccuguuuaaga

SEQ ID NO: 3811495 - RNA, 16 nt, Human
acguauugguccagcu

SEQ ID NO: 3811496 - RNA, 19 nt, Human
acucuuucuauuguuucuu

SEQ ID NO: 3811497 - RNA, 17 nt, Human
acucuuucugagugccu

SEQ ID NO: 3811498 - RNA, 21 nt, Human
acucuuucugagugccuucug

SEQ ID NO: 3811499 - RNA, 22 nt, Human
acucuuucugagugccuucugu

SEQ ID NO: 3811500 - RNA, 14 nt, Human
acucuuucuguaua

SEQ ID NO: 3811501 - RNA, 18 nt, Human
acucuuugagaaacaaca

SEQ ID NO: 3811502 - RNA, 22 nt, Human
acucuuugagauagaagaacug

SEQ ID NO: 3811503 - RNA, 14 nt, Human
acucuuuggucguu

SEQ ID NO: 3811504 - RNA, 14 nt, Human
acucuuugguggcu

SEQ ID NO: 3811505 - RNA, 13 nt, Human
acucuuuuuguac

SEQ ID NO: 3811506 - RNA, 16 nt, Human
acucuuuuuguaccug

SEQ ID NO: 3811507 - RNA, 13 nt, Human
acugaaaaaauau

SEQ ID NO: 3811508 - RNA, 14 nt, Human
acugaaaaaauaua

SEQ ID NO: 3811509 - RNA, 18 nt, Human
acugaaaacaucuggaag

SEQ ID NO: 3811510 - RNA, 14 nt, Human
acucauacaucugg

SEQ ID NO: 3811511 - RNA, 18 nt, Human
acucauagacacugaucu

SEQ ID NO: 3811512 - RNA, 18 nt, Human
acucauauaauuauaugu

SEQ ID NO: 3811513 - RNA, 19 nt, Human
acucauauaauuauauguu

SEQ ID NO: 3811514 - RNA, 14 nt, Human
acucaucauaaaau

SEQ ID NO: 3811515 - RNA, 21 nt, Human
acucaucuagguaaauuacag

SEQ ID NO: 3811516 - RNA, 23 nt, Human
acucaucuagguaaauuacaguu

SEQ ID NO: 3811517 - RNA, 19 nt, Human
acucaucuuacuguaccug

SEQ ID NO: 3811518 - RNA, 18 nt, Human
acucaucuuagugccuga

SEQ ID NO: 3811519 - RNA, 19 nt, Human
acucaucuuauaugggaaa

SEQ ID NO: 3811520 - RNA, 16 nt, Human
acucaucuuucccucc

SEQ ID NO: 3811521 - RNA, 21 nt, Human
acucaugaucuugugacauau

SEQ ID NO: 3811522 - RNA, 18 nt, Human
acucauggccuugucuaa

SEQ ID NO: 3811523 - RNA, 22 nt, Human
acucauggugaggcuuaacaau

SEQ ID NO: 3811524 - RNA, 13 nt, Human
acucauguguaug

SEQ ID NO: 3811525 - RNA, 15 nt, Human
acucauguuauuuuu

SEQ ID NO: 3811526 - RNA, 23 nt, Human
acucauuagaauuaccauuuguu

SEQ ID NO: 3811527 - RNA, 13 nt, Human
acucauuagacug

SEQ ID NO: 3811528 - RNA, 13 nt, Human
acucauucaaaag

SEQ ID NO: 3811529 - RNA, 23 nt, Human
acucauucagggauagcacugag

SEQ ID NO: 3811530 - RNA, 14 nt, Human
acucauugaaaugu

SEQ ID NO: 3811531 - RNA, 19 nt, Human
acucauugaaaugucacgu

SEQ ID NO: 3811532 - RNA, 14 nt, Human
acucauugaccuga

SEQ ID NO: 3811533 - RNA, 15 nt, Human
acucauugaccugag

SEQ ID NO: 3811534 - RNA, 16 nt, Human
acucauugaccugagg

SEQ ID NO: 3811535 - RNA, 21 nt, Human
acucauugcugagccucugcu

SEQ ID NO: 3811536 - RNA, 12 nt, Human
acucauuucauc

SEQ ID NO: 3811537 - RNA, 13 nt, Human
acucauuucaucu

SEQ ID NO: 3811538 - RNA, 15 nt, Human
acucauuucaucuca

SEQ ID NO: 3811539 - RNA, 17 nt, Human
acucauuucaucucauu

SEQ ID NO: 3811540 - RNA, 17 nt, Human
acucauuucuaaaagaa

SEQ ID NO: 3811541 - RNA, 21 nt, Human
acucauuucuaaaagaauauu

SEQ ID NO: 3811542 - RNA, 22 nt, Human
acucauuuguuaaaauuaucaa

SEQ ID NO: 3811543 - RNA, 19 nt, Human
acucauuuuaaugauuguu

SEQ ID NO: 3811544 - RNA, 21 nt, Human
acucauuuucuauaacagaua

SEQ ID NO: 3811545 - RNA, 12 nt, Human
acucauuuugcu

SEQ ID NO: 3811546 - RNA, 23 nt, Human
acucauuuuucaugauaaugaac

SEQ ID NO: 3811547 - RNA, 18 nt, Human
acuccaaaacccaugugg

SEQ ID NO: 3811548 - RNA, 13 nt, Human
acuccaaaauguu

SEQ ID NO: 3811549 - RNA, 21 nt, Human
acuccaaaccuccuguuagcu

SEQ ID NO: 3811550 - RNA, 21 nt, Human
acuccaaacugacucuuaaga

SEQ ID NO: 3811551 - RNA, 18 nt, Human
acuccaaagaaauguaag

SEQ ID NO: 3811552 - RNA, 16 nt, Human
acuccaacauccacuc

SEQ ID NO: 3811553 - RNA, 17 nt, Human
acuccaagcccagccca

SEQ ID NO: 3811554 - RNA, 12 nt, Human
acuccacacugc

SEQ ID NO: 3811555 - RNA, 21 nt, Human
acuccacacugcacaauaacu

SEQ ID NO: 3811556 - RNA, 15 nt, Human
acuccacaucugccu

SEQ ID NO: 3811557 - RNA, 14 nt, Human
acuccaccaagccu

SEQ ID NO: 3811558 - RNA, 19 nt, Human
acuccaccagauagcagag

SEQ ID NO: 3811559 - RNA, 13 nt, Human
acuccaccuuccc

SEQ ID NO: 3811560 - RNA, 18 nt, Human
acuccacgauccugccac

SEQ ID NO: 3811561 - RNA, 19 nt, Human
acuccacgauccugccacc

SEQ ID NO: 3811562 - RNA, 15 nt, Human
acuccagaauuuccc

SEQ ID NO: 3811563 - RNA, 13 nt, Human
acuccagaccccu

SEQ ID NO: 3811564 - RNA, 19 nt, Human
acuccagaccccuggcuuu

SEQ ID NO: 3811565 - RNA, 13 nt, Human
acuccagaucugc

SEQ ID NO: 3811566 - RNA, 12 nt, Human
acuccagcccau

SEQ ID NO: 3811567 - RNA, 20 nt, Human
acuccagccugagcaacaga

SEQ ID NO: 3811568 - RNA, 12 nt, Human
acuccagccugg

SEQ ID NO: 3811569 - RNA, 19 nt, Human
acuccagccuggcgacaga

SEQ ID NO: 3811570 - RNA, 13 nt, Human
acuccagccuggg

SEQ ID NO: 3811571 - RNA, 18 nt, Human
acuccagccugggcaaca

SEQ ID NO: 3811572 - RNA, 23 nt, Human
acuccagccugggcaacagagca

SEQ ID NO: 3811573 - RNA, 20 nt, Human
acuccagccugggcgacaga

SEQ ID NO: 3811574 - RNA, 13 nt, Human
acuccaggagagg

SEQ ID NO: 3811575 - RNA, 23 nt, Human
acuccaguagcgagagacggcac

SEQ ID NO: 3811576 - RNA, 19 nt, Human
acuccauagaccuuuucau

SEQ ID NO: 3811577 - RNA, 21 nt, Human
acuccaucucucauccuccag

SEQ ID NO: 3811578 - RNA, 13 nt, Human
acuccaugagcac

SEQ ID NO: 3811579 - RNA, 21 nt, Human
acuccaugcuuagucacugcc

SEQ ID NO: 3811580 - RNA, 12 nt, Human
acuccauucucc

SEQ ID NO: 3811581 - RNA, 13 nt, Human
acucccaaagagc

SEQ ID NO: 3811582 - RNA, 18 nt, Human
acucccaaagagcugccu

SEQ ID NO: 3811583 - RNA, 17 nt, Human
acucccaagaacagcag

SEQ ID NO: 3811584 - RNA, 21 nt, Human
acucccaagacccgagcuggg

SEQ ID NO: 3811585 - RNA, 14 nt, Human
acucccaaguaugg

SEQ ID NO: 3811586 - RNA, 16 nt, Human
acucccacacccaaga

SEQ ID NO: 3811587 - RNA, 20 nt, Human
acucccacccagucucugcu

SEQ ID NO: 3811588 - RNA, 22 nt, Human
acucccacccagucucugcucc

SEQ ID NO: 3811589 - RNA, 16 nt, Human
acucccaccugacaca

SEQ ID NO: 3811590 - RNA, 20 nt, Human
acucccacuucccugacacu

SEQ ID NO: 3811591 - RNA, 20 nt, Human
acucccagcaucgcacucug

SEQ ID NO: 3811592 - RNA, 13 nt, Human
acucccaggcagc

SEQ ID NO: 3811593 - RNA, 15 nt, Human
acucccaguccccag

SEQ ID NO: 3811594 - RNA, 13 nt, Human
acucccaugaagc

SEQ ID NO: 3811595 - RNA, 20 nt, Human
acucccaugaagccuuuuga

SEQ ID NO: 3811596 - RNA, 23 nt, Human
acucccaugagggagaugccaug

SEQ ID NO: 3811597 - RNA, 19 nt, Human
acuccccaggccaggccac

SEQ ID NO: 3811598 - RNA, 13 nt, Human
acuccccugcugg

SEQ ID NO: 3811599 - RNA, 23 nt, Human
acuccccuguuucaaucacuguc

SEQ ID NO: 3811600 - RNA, 15 nt, Human
acuccccuugagcug

SEQ ID NO: 3811601 - RNA, 19 nt, Human
acucccggcacuccaugcu

SEQ ID NO: 3811602 - RNA, 22 nt, Human
acucccguguaggaaccugcac

SEQ ID NO: 3811603 - RNA, 16 nt, Human
acucccuccagcacaa

SEQ ID NO: 3811604 - RNA, 22 nt, Human
acucccuccucaccucuggacu

SEQ ID NO: 3811605 - RNA, 21 nt, Human
acucccucgucgagcuggaug

SEQ ID NO: 3811606 - RNA, 13 nt, Human
acucccucucagg

SEQ ID NO: 3811607 - RNA, 21 nt, Human
acucccucucaggauccaagc

SEQ ID NO: 3811608 - RNA, 14 nt, Human
acucccugcagaug

SEQ ID NO: 3811609 - RNA, 18 nt, Human
acucccugccccccagcc

SEQ ID NO: 3811610 - RNA, 18 nt, Human
acucccuggcucucagaa

SEQ ID NO: 3811611 - RNA, 20 nt, Human
acucccuucuaccugccacu

SEQ ID NO: 3811612 - RNA, 22 nt, Human
acucccuucuaccugccacuca

SEQ ID NO: 3811613 - RNA, 16 nt, Human
acucccuugcuggccc

SEQ ID NO: 3811614 - RNA, 14 nt, Human
acucccuugggcuc

SEQ ID NO: 3811615 - RNA, 22 nt, Human
acucccuugguggcaagagccc

SEQ ID NO: 3811616 - RNA, 13 nt, Human
acucccuuucaac

SEQ ID NO: 3811617 - RNA, 16 nt, Human
acuccgagugaacugg

SEQ ID NO: 3811618 - RNA, 21 nt, Human
acuccgcccccagccuaugag

SEQ ID NO: 3811619 - RNA, 14 nt, Human
acuccgcuggaggu

SEQ ID NO: 3811620 - RNA, 22 nt, Human
acuccgcuggagguggggccug

SEQ ID NO: 3811621 - RNA, 23 nt, Human
acuccggauugcguuccuccccg

SEQ ID NO: 3811622 - RNA, 13 nt, Human
acuccggcccucc

SEQ ID NO: 3811623 - RNA, 19 nt, Human
acuccggcccuccagagcc

SEQ ID NO: 3811624 - RNA, 17 nt, Human
acuccggcugugcuggg

SEQ ID NO: 3811625 - RNA, 22 nt, Human
acuccggguuugagauggacac

SEQ ID NO: 3811626 - RNA, 16 nt, Human
acuccggugugccugc

SEQ ID NO: 3811627 - RNA, 21 nt, Human
acuccggugugccugcagccc

SEQ ID NO: 3811628 - RNA, 20 nt, Human
acuccuacaagauuuagaaa

SEQ ID NO: 3811629 - RNA, 17 nt, Human
acuccuacaccuaacuc

SEQ ID NO: 3811630 - RNA, 18 nt, Human
acuccuacaccuaacuca

SEQ ID NO: 3811631 - RNA, 16 nt, Human
acuccuaccucagccu

SEQ ID NO: 3811632 - RNA, 17 nt, Human
acuccuaccucagccua

SEQ ID NO: 3811633 - RNA, 18 nt, Human
acuccuaggcaggacaug

SEQ ID NO: 3811634 - RNA, 22 nt, Human
acuccuaguagggguaccacug

SEQ ID NO: 3811635 - RNA, 16 nt, Human
acuccuaugaucugag

SEQ ID NO: 3811636 - RNA, 20 nt, Human
acuccucaaaagcaaaugag

SEQ ID NO: 3811637 - RNA, 20 nt, Human
acuccucacacuuacuguaa

SEQ ID NO: 3811638 - RNA, 12 nt, Human
acuccucccagg

SEQ ID NO: 3811639 - RNA, 12 nt, Human
acuccucccucc

SEQ ID NO: 3811640 - RNA, 18 nt, Human
acucugaaauaucccggg

SEQ ID NO: 3811641 - RNA, 14 nt, Human
acucugaaaucuga

SEQ ID NO: 3811642 - RNA, 17 nt, Human
acucugaaaucugaaga

SEQ ID NO: 3811643 - RNA, 16 nt, Human
acucugaaaugaagau

SEQ ID NO: 3811644 - RNA, 14 nt, Human
acucugaagccucu

SEQ ID NO: 3811645 - RNA, 15 nt, Human
acucugaagccucug

SEQ ID NO: 3811646 - RNA, 20 nt, Human
acucugaagggcaucaugca

SEQ ID NO: 3811647 - RNA, 20 nt, Human
acucugaauaagcacuuuuu

SEQ ID NO: 3811648 - RNA, 17 nt, Human
acucugaauuuaucuuu

SEQ ID NO: 3811649 - RNA, 23 nt, Human
acucugacaacagacuucugaaa

SEQ ID NO: 3811650 - RNA, 14 nt, Human
acucugacaagggc

SEQ ID NO: 3811651 - RNA, 21 nt, Human
acucugacaagggcugaccug

SEQ ID NO: 3811652 - RNA, 23 nt, Human
acucugaggcucuuucugggcca

SEQ ID NO: 3811653 - RNA, 16 nt, Human
acucugaguuuaccau

SEQ ID NO: 3811654 - RNA, 21 nt, Human
acucugaguuuaccauuugua

SEQ ID NO: 3811655 - RNA, 23 nt, Human
acucugaugguucuucaccuccu

SEQ ID NO: 3811656 - RNA, 12 nt, Human
acucugauguaa

SEQ ID NO: 3811657 - RNA, 17 nt, Human
acucugcacaugucuug

SEQ ID NO: 3811658 - RNA, 14 nt, Human
acucugcacuacuc

SEQ ID NO: 3811659 - RNA, 24 nt, Human
acucugcagacugcuaguguucug

SEQ ID NO: 3811660 - RNA, 15 nt, Human
acucugcagccucag

SEQ ID NO: 3811661 - RNA, 15 nt, Human
acucugcauccagag

SEQ ID NO: 3811662 - RNA, 14 nt, Human
acucugcauguaga

SEQ ID NO: 3811663 - RNA, 20 nt, Human
acucugcauguagaggcuug

SEQ ID NO: 3811664 - RNA, 14 nt, Human
acucugccagcaaa

SEQ ID NO: 3811665 - RNA, 16 nt, Human
acucugccagcaaaga

SEQ ID NO: 3811666 - RNA, 13 nt, Human
acucugccagcca

SEQ ID NO: 3811667 - RNA, 12 nt, Human
acucugcccccu

SEQ ID NO: 3811668 - RNA, 15 nt, Human
acucugcccccugcu

SEQ ID NO: 3811669 - RNA, 17 nt, Human
acucugcccucuagagc

SEQ ID NO: 3811670 - RNA, 14 nt, Human
acucugccucugcc

SEQ ID NO: 3811671 - RNA, 16 nt, Human
acucugccugcccuuu

SEQ ID NO: 3811672 - RNA, 16 nt, Human
acucugccugcuuaca

SEQ ID NO: 3811673 - RNA, 15 nt, Human
acucugcucugaugc

SEQ ID NO: 3811674 - RNA, 14 nt, Human
acucugcucugccc

SEQ ID NO: 3811675 - RNA, 16 nt, Human
acauguuaaaccaugg

SEQ ID NO: 3811676 - RNA, 17 nt, Human
acauguuacugaccagc

SEQ ID NO: 3811677 - RNA, 21 nt, Human
acauguuacuggauaaauugu

SEQ ID NO: 3811678 - RNA, 22 nt, Human
acauguuacuggauaaauuguu

SEQ ID NO: 3811679 - RNA, 14 nt, Human
acauguuauauauu

SEQ ID NO: 3811680 - RNA, 15 nt, Human
acauguuauauauuu

SEQ ID NO: 3811681 - RNA, 14 nt, Human
acauguuauuugua

SEQ ID NO: 3811682 - RNA, 20 nt, Human
acauguugggaaacuuggcu

SEQ ID NO: 3811683 - RNA, 14 nt, Human
acauguuguaaauu

SEQ ID NO: 3811684 - RNA, 20 nt, Human
acauguuguaagcacugacu

SEQ ID NO: 3811685 - RNA, 13 nt, Human
acauguuuauaaa

SEQ ID NO: 3811686 - RNA, 23 nt, Human
acauguuuccagcauucccaggu

SEQ ID NO: 3811687 - RNA, 11 nt, Human
acauguuuccu

SEQ ID NO: 3811688 - RNA, 11 nt, Human
acauguuuuca

SEQ ID NO: 3811689 - RNA, 12 nt, Human
acauguuuucaa

SEQ ID NO: 3811690 - RNA, 16 nt, Human
acauguuuucaaaugg

SEQ ID NO: 3811691 - RNA, 13 nt, Human
acauguuuugaua

SEQ ID NO: 3811692 - RNA, 15 nt, Human
acauguuuugauaaa

SEQ ID NO: 3811693 - RNA, 17 nt, Human
acauguuuugauaaagu

SEQ ID NO: 3811694 - RNA, 22 nt, Human
acauguuuugauaaaguaguaa

SEQ ID NO: 3811695 - RNA, 19 nt, Human
acauguuuuuauacaaaau

SEQ ID NO: 3811696 - RNA, 19 nt, Human
acauguuuuucuucucccu

SEQ ID NO: 3811697 - RNA, 21 nt, Human
acauguuuuucuucucccuca

SEQ ID NO: 3811698 - RNA, 23 nt, Human
acauuaaaaaaaaucaucauuau

SEQ ID NO: 3811699 - RNA, 15 nt, Human
acauuaaaacaauau

SEQ ID NO: 3811700 - RNA, 12 nt, Human
acauuaaacaca

SEQ ID NO: 3811701 - RNA, 11 nt, Human
acauuaaagaa

SEQ ID NO: 3811702 - RNA, 12 nt, Human
acauuaaagcag

SEQ ID NO: 3811703 - RNA, 14 nt, Human
acauuaaagcaguc

SEQ ID NO: 3811704 - RNA, 21 nt, Human
acauuaaaggcauaaaugacu

SEQ ID NO: 3811705 - RNA, 13 nt, Human
acauuaaagguac

SEQ ID NO: 3811706 - RNA, 17 nt, Human
acauuaaaucuaugaag

SEQ ID NO: 3811707 - RNA, 21 nt, Human
acauuaaaugacucuucccuc

SEQ ID NO: 3811708 - RNA, 13 nt, Human
acauuaaaugucu

SEQ ID NO: 3811709 - RNA, 14 nt, Human
acauuaaaugucuu

SEQ ID NO: 3811710 - RNA, 14 nt, Human
acauuaacaaauaa

SEQ ID NO: 3811711 - RNA, 15 nt, Human
acauuaacaaauaaa

SEQ ID NO: 3811712 - RNA, 13 nt, Human
acauuaacucauu

SEQ ID NO: 3811713 - RNA, 15 nt, Human
acauuaacucauuag

SEQ ID NO: 3811714 - RNA, 22 nt, Human
acauuaacucauuagacuggaa

SEQ ID NO: 3811715 - RNA, 16 nt, Human
acauuaagaaaaucau

SEQ ID NO: 3811716 - RNA, 16 nt, Human
acauuaagcaucacaa

SEQ ID NO: 3811717 - RNA, 19 nt, Human
acauuaauagcagccuuuc

SEQ ID NO: 3811718 - RNA, 22 nt, Human
acauuaauccacauguuucaga

SEQ ID NO: 3811719 - RNA, 20 nt, Human
acauuaauggucuaaaaaua

SEQ ID NO: 3811720 - RNA, 21 nt, Human
acauuaauguuaauucagcac

SEQ ID NO: 3811721 - RNA, 17 nt, Human
acauuaauguugauuuc

SEQ ID NO: 3811722 - RNA, 18 nt, Human
acauuaauguugauuucu

SEQ ID NO: 3811723 - RNA, 19 nt, Human
acauuacucugccucugua

SEQ ID NO: 3811724 - RNA, 20 nt, Human
acauuacugaaaacuucauu

SEQ ID NO: 3811725 - RNA, 13 nt, Human
acauuagaacuuc

SEQ ID NO: 3811726 - RNA, 21 nt, Human
acauuagaagacaauugacaa

SEQ ID NO: 3811727 - RNA, 22 nt, Human
acauuagcaguuugcuuuguau

SEQ ID NO: 3811728 - RNA, 19 nt, Human
acauuaggcauugagacuu

SEQ ID NO: 3811729 - RNA, 16 nt, Human
acauuagguugugaau

SEQ ID NO: 3811730 - RNA, 14 nt, Human
acauuauaaacgcu

SEQ ID NO: 3811731 - RNA, 20 nt, Human
acauuauaaaugucucuuua

SEQ ID NO: 3811732 - RNA, 18 nt, Human
acauuauauugcaaugaa

SEQ ID NO: 3811733 - RNA, 18 nt, Human
acauuaucgggagcagug

SEQ ID NO: 3811734 - RNA, 22 nt, Human
acauuaucgggagcagugucuu

SEQ ID NO: 3811735 - RNA, 19 nt, Human
acauuaugugguuuuagau

SEQ ID NO: 3811736 - RNA, 21 nt, Human
acauuaugugguuuuagauuu

SEQ ID NO: 3811737 - RNA, 23 nt, Human
acauuaugugugcauguguguau

SEQ ID NO: 3811738 - RNA, 15 nt, Human
acauuauugcuuauu

SEQ ID NO: 3811739 - RNA, 14 nt, Human
acauuauuuauaug

SEQ ID NO: 3811740 - RNA, 16 nt, Human
acauuauuuauucagc

SEQ ID NO: 3811741 - RNA, 23 nt, Human
acauucaagauuaaacugaguga

SEQ ID NO: 3811742 - RNA, 23 nt, Human
acauucaauaagcaucaaacucu

SEQ ID NO: 3811743 - RNA, 13 nt, Human
acauucaccugcc

SEQ ID NO: 3811744 - RNA, 20 nt, Human
acauucaccugccccaacuc

SEQ ID NO: 3811745 - RNA, 22 nt, Human
acauucagcugagguucauuac

SEQ ID NO: 3811746 - RNA, 22 nt, Human
acauuccaacucguauagcaug

SEQ ID NO: 3811747 - RNA, 11 nt, Human
acauuccaaga

SEQ ID NO: 3811748 - RNA, 13 nt, Human
acauuccauccuu

SEQ ID NO: 3811749 - RNA, 19 nt, Human
acauucccaagguuacuua

SEQ ID NO: 3811750 - RNA, 14 nt, Human
acauuccuaaaaug

SEQ ID NO: 3811751 - RNA, 17 nt, Human
acauuccucaugaaugu

SEQ ID NO: 3811752 - RNA, 15 nt, Human
acauuccugaacagg

SEQ ID NO: 3811753 - RNA, 18 nt, Human
acauuccuugccugcaca

SEQ ID NO: 3811754 - RNA, 14 nt, Human
acauuccuugcuga

SEQ ID NO: 3811755 - RNA, 16 nt, Human
acauucgaucucauuc

SEQ ID NO: 3811756 - RNA, 17 nt, Human
acauucggcucccugga

SEQ ID NO: 3811757 - RNA, 20 nt, Human
acauucggcucccuggagcc

SEQ ID NO: 3811758 - RNA, 22 nt, Human
acauucuagaugcaagucucuu

SEQ ID NO: 3811759 - RNA, 18 nt, Human
acauucuauuucaacuuc

SEQ ID NO: 3811760 - RNA, 14 nt, Human
acauucucaguuuu

SEQ ID NO: 3811761 - RNA, 14 nt, Human
acauucucuaauaa

SEQ ID NO: 3811762 - RNA, 11 nt, Human
acauucugaau

SEQ ID NO: 3811763 - RNA, 18 nt, Human
acauucugaaugcuucua

SEQ ID NO: 3811764 - RNA, 20 nt, Human
acauucugacaucuuaguau

SEQ ID NO: 3811765 - RNA, 16 nt, Human
acauucugauuuggaa

SEQ ID NO: 3811766 - RNA, 19 nt, Human
acauucugauuuggaaaaa

SEQ ID NO: 3811767 - RNA, 12 nt, Human
acauucugcuuu

SEQ ID NO: 3811768 - RNA, 17 nt, Human
acauucuggucucgucu

SEQ ID NO: 3811769 - RNA, 18 nt, Human
acauucuggucucgucuu

SEQ ID NO: 3811770 - RNA, 22 nt, Human
acauucuggucucgucuuccgu

SEQ ID NO: 3811771 - RNA, 23 nt, Human
acauucugucgccuuagcauguu

SEQ ID NO: 3811772 - RNA, 14 nt, Human
acauucuuauaaau

SEQ ID NO: 3811773 - RNA, 22 nt, Human
acauucuuauaaauaugaagcu

SEQ ID NO: 3811774 - RNA, 21 nt, Human
acauucuuuuaacuucuuucu

SEQ ID NO: 3811775 - RNA, 23 nt, Human
acauucuuuuugcucuaaaauau

SEQ ID NO: 3811776 - RNA, 17 nt, Human
acauugaaaucuaggaa

SEQ ID NO: 3811777 - RNA, 20 nt, Human
acauugaaaucuaggaaaau

SEQ ID NO: 3811778 - RNA, 19 nt, Human
acauugaaguaaugaauuu

SEQ ID NO: 3811779 - RNA, 20 nt, Human
acauugaaguaaugaauuuu

SEQ ID NO: 3811780 - RNA, 14 nt, Human
acauugaauuagaa

SEQ ID NO: 3811781 - RNA, 17 nt, Human
acauugacgauuccuuc

SEQ ID NO: 3811782 - RNA, 20 nt, Human
acauugacgauuccuucucu

SEQ ID NO: 3811783 - RNA, 17 nt, Human
acauugacuauuuuugu

SEQ ID NO: 3811784 - RNA, 20 nt, Human
acauugagcugauauaaauu

SEQ ID NO: 3811785 - RNA, 14 nt, Human
acucuuuuuagggc

SEQ ID NO: 3811786 - RNA, 20 nt, Human
acucuuuuuagggccaggca

SEQ ID NO: 3811787 - RNA, 20 nt, Human
acucuuuuuguaccugguga

SEQ ID NO: 3811788 - RNA, 18 nt, Human
acucuuuuuguuuuuugu

SEQ ID NO: 3811789 - RNA, 16 nt, Human
acugaaaacaucugga

SEQ ID NO: 3811790 - RNA, 17 nt, Human
acugaaaacaucuggaa

SEQ ID NO: 3811791 - RNA, 15 nt, Human
acugaaaaccucucc

SEQ ID NO: 3811792 - RNA, 17 nt, Human
acugaaaaccucuccuc

SEQ ID NO: 3811793 - RNA, 14 nt, Human
acugaaaagaagga

SEQ ID NO: 3811794 - RNA, 15 nt, Human
acugaaaagagagca

SEQ ID NO: 3811795 - RNA, 23 nt, Human
acugaaaagagagcagagaauau

SEQ ID NO: 3811796 - RNA, 15 nt, Human
acugaaaaucuaaua

SEQ ID NO: 3811797 - RNA, 16 nt, Human
acugaaaaucuaauau

SEQ ID NO: 3811798 - RNA, 23 nt, Human
acugaaaaucuaauauuaaaaau

SEQ ID NO: 3811799 - RNA, 17 nt, Human
acugaaaauuauuuaaa

SEQ ID NO: 3811800 - RNA, 13 nt, Human
acugaaacagauu

SEQ ID NO: 3811801 - RNA, 20 nt, Human
acugaaagccuuagggaagc

SEQ ID NO: 3811802 - RNA, 13 nt, Human
acugaaagugguu

SEQ ID NO: 3811803 - RNA, 14 nt, Human
acugaaaucuguca

SEQ ID NO: 3811804 - RNA, 18 nt, Human
acugaaaugccuuacuuu

SEQ ID NO: 3811805 - RNA, 22 nt, Human
acugaaaugccuuacuuuguau

SEQ ID NO: 3811806 - RNA, 20 nt, Human
acugaacaccauugaaggcu

SEQ ID NO: 3811807 - RNA, 21 nt, Human
acugaacaccauugaaggcuu

SEQ ID NO: 3811808 - RNA, 15 nt, Human
acugaacaguaacau

SEQ ID NO: 3811809 - RNA, 19 nt, Human
acugaacauguacacuggu

SEQ ID NO: 3811810 - RNA, 13 nt, Human
acugaacauucca

SEQ ID NO: 3811811 - RNA, 19 nt, Human
acugaaccacuuguagauu

SEQ ID NO: 3811812 - RNA, 20 nt, Human
acugaaccacuuguagauuu

SEQ ID NO: 3811813 - RNA, 18 nt, Human
acugaaccggcuuuacca

SEQ ID NO: 3811814 - RNA, 22 nt, Human
acugaacuguguguaauuguuc

SEQ ID NO: 3811815 - RNA, 21 nt, Human
acugaacuuugcugagccugu

SEQ ID NO: 3811816 - RNA, 22 nt, Human
acugaagaagcaccaaucauga

SEQ ID NO: 3811817 - RNA, 12 nt, Human
acugaagagaca

SEQ ID NO: 3811818 - RNA, 16 nt, Human
acugaagauagaagaa

SEQ ID NO: 3811819 - RNA, 13 nt, Human
acugaagcagccu

SEQ ID NO: 3811820 - RNA, 14 nt, Human
acugaagcagccuc

SEQ ID NO: 3811821 - RNA, 12 nt, Human
acugaagccugc

SEQ ID NO: 3811822 - RNA, 13 nt, Human
acugaagcuuuuu

SEQ ID NO: 3811823 - RNA, 14 nt, Human
acugaagcuuuuua

SEQ ID NO: 3811824 - RNA, 20 nt, Human
acugaaggaaaaacacaagc

SEQ ID NO: 3811825 - RNA, 23 nt, Human
acugaaggcagcauguauaguug

SEQ ID NO: 3811826 - RNA, 13 nt, Human
acugaaggccacu

SEQ ID NO: 3811827 - RNA, 14 nt, Human
acugaaggcuuuca

SEQ ID NO: 3811828 - RNA, 15 nt, Human
acugaagucaguucu

SEQ ID NO: 3811829 - RNA, 23 nt, Human
acugaagucuuacuacagaaaug

SEQ ID NO: 3811830 - RNA, 17 nt, Human
acugaagugcuuagugu

SEQ ID NO: 3811831 - RNA, 21 nt, Human
acugaaguucugccucugaug

SEQ ID NO: 3811832 - RNA, 15 nt, Human
acugaaguuucacau

SEQ ID NO: 3811833 - RNA, 12 nt, Human
acugaaguuuga

SEQ ID NO: 3811834 - RNA, 15 nt, Human
acugaaguuugauaa

SEQ ID NO: 3811835 - RNA, 19 nt, Human
acugaaguuugauaaauag

SEQ ID NO: 3811836 - RNA, 15 nt, Human
acugcucuccuccac

SEQ ID NO: 3811837 - RNA, 19 nt, Human
acugcucuugggcaauauu

SEQ ID NO: 3811838 - RNA, 22 nt, Human
acugcucuugggcaauauucuc

SEQ ID NO: 3811839 - RNA, 15 nt, Human
acugcucuuguuucu

SEQ ID NO: 3811840 - RNA, 18 nt, Human
acugcugagauacauaca

SEQ ID NO: 3811841 - RNA, 20 nt, Human
acugcugagauacauacaga

SEQ ID NO: 3811842 - RNA, 22 nt, Human
acugcugagauacauacagaau

SEQ ID NO: 3811843 - RNA, 19 nt, Human
acugcugccccaaaggaag

SEQ ID NO: 3811844 - RNA, 22 nt, Human
acugcuggagaggccccagccg

SEQ ID NO: 3811845 - RNA, 14 nt, Human
acugcuggcugccu

SEQ ID NO: 3811846 - RNA, 15 nt, Human
acugcuggcugccuu

SEQ ID NO: 3811847 - RNA, 13 nt, Human
acugcugggacug

SEQ ID NO: 3811848 - RNA, 19 nt, Human
acugcugggacuggccagg

SEQ ID NO: 3811849 - RNA, 23 nt, Human
acugcugugaacaagugaacaca

SEQ ID NO: 3811850 - RNA, 23 nt, Human
acugcugugaacccuggggccug

SEQ ID NO: 3811851 - RNA, 15 nt, Human
acugcuguggccagg

SEQ ID NO: 3811852 - RNA, 19 nt, Human
acugcuguggccaggaggu

SEQ ID NO: 3811853 - RNA, 13 nt, Human
acugcuuaauuca

SEQ ID NO: 3811854 - RNA, 20 nt, Human
acugcuuaccuacuuucuuc

SEQ ID NO: 3811855 - RNA, 21 nt, Human
acugcuuaccuacuuucuuca

SEQ ID NO: 3811856 - RNA, 17 nt, Human
acugcuuacuuaugcca

SEQ ID NO: 3811857 - RNA, 22 nt, Human
acugcuucaaucucaauugcuu

SEQ ID NO: 3811858 - RNA, 21 nt, Human
acugcuuccagugaggcucug

SEQ ID NO: 3811859 - RNA, 22 nt, Human
acugcuuccagugaggcucugc

SEQ ID NO: 3811860 - RNA, 21 nt, Human
acugcuucccuuacuuugcug

SEQ ID NO: 3811861 - RNA, 21 nt, Human
acugcuuccuauaauuuugau

SEQ ID NO: 3811862 - RNA, 16 nt, Human
acugcuucuaccaacu

SEQ ID NO: 3811863 - RNA, 20 nt, Human
acugcuucuaccaacuggaa

SEQ ID NO: 3811864 - RNA, 14 nt, Human
acugcuugaggaaa

SEQ ID NO: 3811865 - RNA, 16 nt, Human
acugcuuguguuuuua

SEQ ID NO: 3811866 - RNA, 16 nt, Human
acugcuuucuguucca

SEQ ID NO: 3811867 - RNA, 14 nt, Human
acugcuuugagaaa

SEQ ID NO: 3811868 - RNA, 20 nt, Human
acugcuuuuaacuucugaua

SEQ ID NO: 3811869 - RNA, 14 nt, Human
acugcuuuuggccu

SEQ ID NO: 3811870 - RNA, 15 nt, Human
acugcuuuuggucug

SEQ ID NO: 3811871 - RNA, 18 nt, Human
acugcuuuuuuuuuucca

SEQ ID NO: 3811872 - RNA, 21 nt, Human
acugcuuuuuuuuuuccagca

SEQ ID NO: 3811873 - RNA, 20 nt, Human
acuggaaaacagaacacuua

SEQ ID NO: 3811874 - RNA, 21 nt, Human
acuggaaaggggagagccugc

SEQ ID NO: 3811875 - RNA, 22 nt, Human
acuggaaaggggagagccugcu

SEQ ID NO: 3811876 - RNA, 19 nt, Human
acuggaacacucuauaaca

SEQ ID NO: 3811877 - RNA, 14 nt, Human
acuggaacccuuuu

SEQ ID NO: 3811878 - RNA, 22 nt, Human
acuggaacccuuuuaaaguuga

SEQ ID NO: 3811879 - RNA, 12 nt, Human
acuggaacucuc

SEQ ID NO: 3811880 - RNA, 19 nt, Human
acuggaagcauguaggaga

SEQ ID NO: 3811881 - RNA, 21 nt, Human
acuggaagcauguaggagaau

SEQ ID NO: 3811882 - RNA, 21 nt, Human
acuggaaguucauaccuaagu

SEQ ID NO: 3811883 - RNA, 13 nt, Human
acuggaaguuuug

SEQ ID NO: 3811884 - RNA, 16 nt, Human
acuggaaguuuugcau

SEQ ID NO: 3811885 - RNA, 17 nt, Human
acuggaaguuuugcauu

SEQ ID NO: 3811886 - RNA, 18 nt, Human
acuggaauuuuuauuaug

SEQ ID NO: 3811887 - RNA, 18 nt, Human
acuggacauaacauuuuc

SEQ ID NO: 3811888 - RNA, 15 nt, Human
acuggacccuguugc

SEQ ID NO: 3811889 - RNA, 19 nt, Human
acuggacuccggcccuccu

SEQ ID NO: 3811890 - RNA, 18 nt, Human
acuggagacaaugcagau

SEQ ID NO: 3811891 - RNA, 14 nt, Human
acuggagagcaaca

SEQ ID NO: 3811892 - RNA, 13 nt, Human
acuggagcaccag

SEQ ID NO: 3811893 - RNA, 18 nt, Human
acuggagcaucugacuca

SEQ ID NO: 3811894 - RNA, 14 nt, Human
acuggagcccagga

SEQ ID NO: 3811895 - RNA, 16 nt, Human
acuggagcccaggagu

SEQ ID NO: 3811896 - RNA, 11 nt, Human
acuggagcccc

SEQ ID NO: 3811897 - RNA, 17 nt, Human
acuggaggagagaagaa

SEQ ID NO: 3811898 - RNA, 20 nt, Human
acuggaggagagaagaauga

SEQ ID NO: 3811899 - RNA, 13 nt, Human
acuggaggccagg

SEQ ID NO: 3811900 - RNA, 21 nt, Human
acuggaggccccuggagccag

SEQ ID NO: 3811901 - RNA, 21 nt, Human
acuggaggggacgcugguaga

SEQ ID NO: 3811902 - RNA, 20 nt, Human
acuggaggucacauucagga

SEQ ID NO: 3811903 - RNA, 19 nt, Human
acuggagguugaagccaag

SEQ ID NO: 3811904 - RNA, 17 nt, Human
acuggaguggagcauug

SEQ ID NO: 3811905 - RNA, 16 nt, Human
acuggagugugcgugg

SEQ ID NO: 3811906 - RNA, 17 nt, Human
acuggagugugcguggu

SEQ ID NO: 3811907 - RNA, 17 nt, Human
acuggaguuacauuaau

SEQ ID NO: 3811908 - RNA, 15 nt, Human
acuggaguucuaugc

SEQ ID NO: 3811909 - RNA, 14 nt, Human
acuggauaaauugu

SEQ ID NO: 3811910 - RNA, 18 nt, Human
acuggauacugcccgggg

SEQ ID NO: 3811911 - RNA, 18 nt, Human
acuggaucucuuaagaca

SEQ ID NO: 3811912 - RNA, 15 nt, Human
acuggauuauucagg

SEQ ID NO: 3811913 - RNA, 13 nt, Human
acuggauuguacu

SEQ ID NO: 3811914 - RNA, 13 nt, Human
acuggcaaacuuc

SEQ ID NO: 3811915 - RNA, 23 nt, Human
acuggcaaugguaguuucugugg

SEQ ID NO: 3811916 - RNA, 14 nt, Human
acuggcacagaggu

SEQ ID NO: 3811917 - RNA, 16 nt, Human
acuggcacugaauuaa

SEQ ID NO: 3811918 - RNA, 14 nt, Human
acuggcagacugug

SEQ ID NO: 3811919 - RNA, 18 nt, Human
acuggcagggauaacaaa

SEQ ID NO: 3811920 - RNA, 16 nt, Human
acuggcauaguuucau

SEQ ID NO: 3811921 - RNA, 17 nt, Human
acuggcauaguuucaua

SEQ ID NO: 3811922 - RNA, 21 nt, Human
acuggcauggauauaguuuua

SEQ ID NO: 3811923 - RNA, 23 nt, Human
acuggcauggauauaguuuuacu

SEQ ID NO: 3811924 - RNA, 17 nt, Human
acuggcauugucccugu

SEQ ID NO: 3811925 - RNA, 23 nt, Human
acuggcauuuuauagacacccug

SEQ ID NO: 3811926 - RNA, 14 nt, Human
acuggccaagcuga

SEQ ID NO: 3811927 - RNA, 18 nt, Human
acuggccaagcugaggug

SEQ ID NO: 3811928 - RNA, 16 nt, Human
acuggccacaguuguu

SEQ ID NO: 3811929 - RNA, 12 nt, Human
accaguugccuu

SEQ ID NO: 3811930 - RNA, 14 nt, Human
accaguugcugcuu

SEQ ID NO: 3811931 - RNA, 15 nt, Human
accaguugggagcac

SEQ ID NO: 3811932 - RNA, 20 nt, Human
accaguugggagcacuggag

SEQ ID NO: 3811933 - RNA, 21 nt, Human
accaguugggagcacuggagu

SEQ ID NO: 3811934 - RNA, 19 nt, Human
accaguuuaaccugaugca

SEQ ID NO: 3811935 - RNA, 24 nt, Human
accaguuuuuggauaaagaauacu

SEQ ID NO: 3811936 - RNA, 14 nt, Human
accauaaauucaac

SEQ ID NO: 3811937 - RNA, 16 nt, Human
accauaagcuacugcc

SEQ ID NO: 3811938 - RNA, 22 nt, Human
accauaagguuucguuucugua

SEQ ID NO: 3811939 - RNA, 22 nt, Human
accauaauguacugauuucagu

SEQ ID NO: 3811940 - RNA, 15 nt, Human
accauaauguuacau

SEQ ID NO: 3811941 - RNA, 15 nt, Human
accauaccuuccuuc

SEQ ID NO: 3811942 - RNA, 17 nt, Human
accauaccuuccuuccc

SEQ ID NO: 3811943 - RNA, 17 nt, Human
accauacucauuucuaa

SEQ ID NO: 3811944 - RNA, 19 nt, Human
accauacucauuucuaaaa

SEQ ID NO: 3811945 - RNA, 18 nt, Human
accauagcgcugcucuua

SEQ ID NO: 3811946 - RNA, 19 nt, Human
accauaguguucauugaua

SEQ ID NO: 3811947 - RNA, 23 nt, Human
accauauacuguucuucauuuua

SEQ ID NO: 3811948 - RNA, 13 nt, Human
accauaugauacu

SEQ ID NO: 3811949 - RNA, 19 nt, Human
accauauucagugcugugg

SEQ ID NO: 3811950 - RNA, 22 nt, Human
accauauugugcuucacaguag

SEQ ID NO: 3811951 - RNA, 17 nt, Human
accaucaaguugugcca

SEQ ID NO: 3811952 - RNA, 13 nt, Human
accaucaauccug

SEQ ID NO: 3811953 - RNA, 13 nt, Human
accaucacugagu

SEQ ID NO: 3811954 - RNA, 23 nt, Human
accaucagaaacacccucacacu

SEQ ID NO: 3811955 - RNA, 15 nt, Human
accaucagggacagg

SEQ ID NO: 3811956 - RNA, 12 nt, Human
accaucauccua

SEQ ID NO: 3811957 - RNA, 16 nt, Human
accaucaugucuggcu

SEQ ID NO: 3811958 - RNA, 15 nt, Human
accaucauugaaauc

SEQ ID NO: 3811959 - RNA, 22 nt, Human
accauccacucuacccucccac

SEQ ID NO: 3811960 - RNA, 15 nt, Human
accaucccuuuuuga

SEQ ID NO: 3811961 - RNA, 18 nt, Human
accaucccuuuuugaagu

SEQ ID NO: 3811962 - RNA, 17 nt, Human
accauccgccagggccc

SEQ ID NO: 3811963 - RNA, 16 nt, Human
accauccuauuuaacu

SEQ ID NO: 3811964 - RNA, 17 nt, Human
accauccugcagccucc

SEQ ID NO: 3811965 - RNA, 12 nt, Human
accauccuggcu

SEQ ID NO: 3811966 - RNA, 22 nt, Human
accauccuggcuaacaugguga

SEQ ID NO: 3811967 - RNA, 14 nt, Human
accauccuggcugc

SEQ ID NO: 3811968 - RNA, 17 nt, Human
accaucgcuggccccuu

SEQ ID NO: 3811969 - RNA, 19 nt, Human
accaucgucuucuuggcca

SEQ ID NO: 3811970 - RNA, 13 nt, Human
accaucuaauagc

SEQ ID NO: 3811971 - RNA, 16 nt, Human
accaucucaggccacc

SEQ ID NO: 3811972 - RNA, 21 nt, Human
accaucucaggccaccugccc

SEQ ID NO: 3811973 - RNA, 15 nt, Human
accaucucuccaacu

SEQ ID NO: 3811974 - RNA, 15 nt, Human
accaucugcugucuu

SEQ ID NO: 3811975 - RNA, 14 nt, Human
accaucugcuuuua

SEQ ID NO: 3811976 - RNA, 13 nt, Human
accaucuggccug

SEQ ID NO: 3811977 - RNA, 17 nt, Human
accaucuggccuggccu

SEQ ID NO: 3811978 - RNA, 14 nt, Human
accaugaaacaaag

SEQ ID NO: 3811979 - RNA, 19 nt, Human
accaugaaagacuucucua

SEQ ID NO: 3811980 - RNA, 18 nt, Human
accaugaacagaaaacau

SEQ ID NO: 3811981 - RNA, 15 nt, Human
accaugaagacagga

SEQ ID NO: 3811982 - RNA, 18 nt, Human
accaugagaagagggccu

SEQ ID NO: 3811983 - RNA, 18 nt, Human
accaugagcaauucuccu

SEQ ID NO: 3811984 - RNA, 19 nt, Human
accaugaguggcauggcca

SEQ ID NO: 3811985 - RNA, 18 nt, Human
accaugauggccaggcug

SEQ ID NO: 3811986 - RNA, 14 nt, Human
accaugauuccuuu

SEQ ID NO: 3811987 - RNA, 15 nt, Human
accaugauuccuuua

SEQ ID NO: 3811988 - RNA, 14 nt, Human
accaugcagagcgc

SEQ ID NO: 3811989 - RNA, 18 nt, Human
accaugcauuuuaccauc

SEQ ID NO: 3811990 - RNA, 19 nt, Human
accaugccaggcuaauuuu

SEQ ID NO: 3811991 - RNA, 20 nt, Human
accaugcccggcuaauuuuu

SEQ ID NO: 3811992 - RNA, 20 nt, Human
accaugccucacuaauuuuu

SEQ ID NO: 3811993 - RNA, 22 nt, Human
accaugcgacacugggaggcca

SEQ ID NO: 3811994 - RNA, 19 nt, Human
accaugcucaucugcuggu

SEQ ID NO: 3811995 - RNA, 18 nt, Human
accaugcugcuggggaag

SEQ ID NO: 3811996 - RNA, 22 nt, Human
accaugcugcuggggaagacag

SEQ ID NO: 3811997 - RNA, 23 nt, Human
accaugcugcuggggaagacagu

SEQ ID NO: 3811998 - RNA, 20 nt, Human
accaugcugucuggcacagc

SEQ ID NO: 3811999 - RNA, 21 nt, Human
accaugcugucuggcacagcc

SEQ ID NO: 3812000 - RNA, 23 nt, Human
accauggacacuacacccagcaa

SEQ ID NO: 3812001 - RNA, 24 nt, Human
accauggacacuacacccagcaau

SEQ ID NO: 3812002 - RNA, 16 nt, Human
accauggaguggcagc

SEQ ID NO: 3812003 - RNA, 21 nt, Human
accauggaguggcagcccagc

SEQ ID NO: 3812004 - RNA, 17 nt, Human
accaugggauaaaugcc

SEQ ID NO: 3812005 - RNA, 18 nt, Human
accaugggauaaaugcca

SEQ ID NO: 3812006 - RNA, 21 nt, Human
accaugguuaagaguccaaga

SEQ ID NO: 3812007 - RNA, 15 nt, Human
accauguaaaacaaa

SEQ ID NO: 3812008 - RNA, 20 nt, Human
accauguaaaacaaaaaaca

SEQ ID NO: 3812009 - RNA, 18 nt, Human
accaugucagcaaaaagc

SEQ ID NO: 3812010 - RNA, 19 nt, Human
accaugucagcaaaaagca

SEQ ID NO: 3812011 - RNA, 21 nt, Human
accaugucagcaaaaagcaaa

SEQ ID NO: 3812012 - RNA, 12 nt, Human
accaugucauuu

SEQ ID NO: 3812013 - RNA, 18 nt, Human
accaugucauuucagaag

SEQ ID NO: 3812014 - RNA, 16 nt, Human
accaugucuuucucuc

SEQ ID NO: 3812015 - RNA, 19 nt, Human
accaugugucacuugugcu

SEQ ID NO: 3812016 - RNA, 21 nt, Human
accaugugucacuugugcuuu

SEQ ID NO: 3812017 - RNA, 18 nt, Human
accauguuggccaggcug

SEQ ID NO: 3812018 - RNA, 23 nt, Human
accauguuggccaggcuugucuc

SEQ ID NO: 3812019 - RNA, 20 nt, Human
accauguuugagcucagacc

SEQ ID NO: 3812020 - RNA, 16 nt, Human
accauuaaaacugcuu

SEQ ID NO: 3812021 - RNA, 17 nt, Human
accauuaaaacugcuuu

SEQ ID NO: 3812022 - RNA, 13 nt, Human
accauuaaaguca

SEQ ID NO: 3812023 - RNA, 19 nt, Human
accauuauaaccuuaauuu

SEQ ID NO: 3812024 - RNA, 18 nt, Human
accauuaugaagaagaga

SEQ ID NO: 3812025 - RNA, 17 nt, Human
accauuauuaucaagua

SEQ ID NO: 3812026 - RNA, 21 nt, Human
accauucagugauuacuguca

SEQ ID NO: 3812027 - RNA, 21 nt, Human
accauucugacucgguuucuc

SEQ ID NO: 3812028 - RNA, 13 nt, Human
accauugaaggcu

SEQ ID NO: 3812029 - RNA, 22 nt, Human
accauugacacauccgccuuuu

SEQ ID NO: 3812030 - RNA, 22 nt, Human
accauugagaccgugaagauac

SEQ ID NO: 3812031 - RNA, 18 nt, Human
accauugauuuaauguaa

SEQ ID NO: 3812032 - RNA, 15 nt, Human
accauugcuucacua

SEQ ID NO: 3812033 - RNA, 15 nt, Human
accauugucucagag

SEQ ID NO: 3812034 - RNA, 13 nt, Human
accauugugcauu

SEQ ID NO: 3812035 - RNA, 14 nt, Human
accauuuaaaaaca

SEQ ID NO: 3812036 - RNA, 16 nt, Human
accauuuaaaaacagg

SEQ ID NO: 3812037 - RNA, 23 nt, Human
accauuuaaaaacaggcagcuca

SEQ ID NO: 3812038 - RNA, 11 nt, Human
accauuuauaa

SEQ ID NO: 3812039 - RNA, 21 nt, Human
accauuuauacaaauuagaaa

SEQ ID NO: 3812040 - RNA, 23 nt, Human
accauuuauacaaauuagaaaau

SEQ ID NO: 3812041 - RNA, 13 nt, Human
accauuuaucuug

SEQ ID NO: 3812042 - RNA, 15 nt, Human
acuugacccugagcu

SEQ ID NO: 3812043 - RNA, 17 nt, Human
acuugacuuuuaaggcu

SEQ ID NO: 3812044 - RNA, 21 nt, Human
acuugagaacuuuccauuuug

SEQ ID NO: 3812045 - RNA, 21 nt, Human
acuugagaccuaaucucugua

SEQ ID NO: 3812046 - RNA, 19 nt, Human
acuugagcccagagugaac

SEQ ID NO: 3812047 - RNA, 23 nt, Human
acuugagcuuuaaaaaucauugu

SEQ ID NO: 3812048 - RNA, 11 nt, Human
acuugaggaca

SEQ ID NO: 3812049 - RNA, 13 nt, Human
acuugaggccuga

SEQ ID NO: 3812050 - RNA, 19 nt, Human
acuugagggcccagagcag

SEQ ID NO: 3812051 - RNA, 20 nt, Human
acuugagggcccagagcagg

SEQ ID NO: 3812052 - RNA, 17 nt, Human
acuugaggguaauaaac

SEQ ID NO: 3812053 - RNA, 18 nt, Human
acuugaggguaauaaacu

SEQ ID NO: 3812054 - RNA, 22 nt, Human
acuugagguggccuccuugcuu

SEQ ID NO: 3812055 - RNA, 22 nt, Human
acuugaguggagguuuauaguu

SEQ ID NO: 3812056 - RNA, 22 nt, Human
acuugaguguaauguuuguuac

SEQ ID NO: 3812057 - RNA, 21 nt, Human
acuugaguuuuauuuauuuua

SEQ ID NO: 3812058 - RNA, 18 nt, Human
acuugauccauuucuaau

SEQ ID NO: 3812059 - RNA, 19 nt, Human
acuugauccauuucuaauu

SEQ ID NO: 3812060 - RNA, 13 nt, Human
acuugaugcaugu

SEQ ID NO: 3812061 - RNA, 22 nt, Human
acuugauggcuaacuuacaaag

SEQ ID NO: 3812062 - RNA, 16 nt, Human
acuugauggcugcgaa

SEQ ID NO: 3812063 - RNA, 23 nt, Human
acuugauggucagacacaaacaa

SEQ ID NO: 3812064 - RNA, 16 nt, Human
acuugaugugccauuu

SEQ ID NO: 3812065 - RNA, 18 nt, Human
acuugaugugccauuuua

SEQ ID NO: 3812066 - RNA, 20 nt, Human
acuugaugugccauuuuaaa

SEQ ID NO: 3812067 - RNA, 14 nt, Human
acuugauuaagauu

SEQ ID NO: 3812068 - RNA, 16 nt, Human
acuugauuaagauuuu

SEQ ID NO: 3812069 - RNA, 21 nt, Human
acuugauuaagauuuuacaaa

SEQ ID NO: 3812070 - RNA, 13 nt, Human
acuugcaaaauca

SEQ ID NO: 3812071 - RNA, 16 nt, Human
acuugcaaaaucaguu

SEQ ID NO: 3812072 - RNA, 21 nt, Human
acuugcaaccgucuguuaugc

SEQ ID NO: 3812073 - RNA, 21 nt, Human
acccaaggaaaacugcaugga

SEQ ID NO: 3812074 - RNA, 13 nt, Human
acccaaggacuga

SEQ ID NO: 3812075 - RNA, 16 nt, Human
acccaaggagcacagg

SEQ ID NO: 3812076 - RNA, 22 nt, Human
acccaaggagcacaggucccac

SEQ ID NO: 3812077 - RNA, 23 nt, Human
acccaaggggauuuuuaugucug

SEQ ID NO: 3812078 - RNA, 18 nt, Human
acccaagguaccauccua

SEQ ID NO: 3812079 - RNA, 14 nt, Human
acccacaaaaaugu

SEQ ID NO: 3812080 - RNA, 15 nt, Human
acccacaagaaauga

SEQ ID NO: 3812081 - RNA, 16 nt, Human
acccacaccucugcca

SEQ ID NO: 3812082 - RNA, 17 nt, Human
acccacaccucugccag

SEQ ID NO: 3812083 - RNA, 22 nt, Human
acccacacucagauccuccuca

SEQ ID NO: 3812084 - RNA, 19 nt, Human
acccacacugcaacaggaa

SEQ ID NO: 3812085 - RNA, 13 nt, Human
acccacagaaaga

SEQ ID NO: 3812086 - RNA, 13 nt, Human
acccacagccucu

SEQ ID NO: 3812087 - RNA, 18 nt, Human
acccacaggcccacagua

SEQ ID NO: 3812088 - RNA, 23 nt, Human
acccacaugccauuuguacugac

SEQ ID NO: 3812089 - RNA, 18 nt, Human
acccaccaacccucaggg

SEQ ID NO: 3812090 - RNA, 19 nt, Human
acccaccaacccucagggc

SEQ ID NO: 3812091 - RNA, 16 nt, Human
acccaccaguugaauu

SEQ ID NO: 3812092 - RNA, 17 nt, Human
acccaccccaccugcag

SEQ ID NO: 3812093 - RNA, 15 nt, Human
acccacccuccuuuc

SEQ ID NO: 3812094 - RNA, 15 nt, Human
acccaccgcccuugc

SEQ ID NO: 3812095 - RNA, 18 nt, Human
acccaccgggccacuccu

SEQ ID NO: 3812096 - RNA, 17 nt, Human
acccaccguccgcccug

SEQ ID NO: 3812097 - RNA, 13 nt, Human
acccaccuagaac

SEQ ID NO: 3812098 - RNA, 14 nt, Human
acccaccucacccc

SEQ ID NO: 3812099 - RNA, 13 nt, Human
acccaccugagcu

SEQ ID NO: 3812100 - RNA, 11 nt, Human
acccaccugcu

SEQ ID NO: 3812101 - RNA, 21 nt, Human
acccaccugcuagugugaauu

SEQ ID NO: 3812102 - RNA, 23 nt, Human
acccaccuuguuggagccugcag

SEQ ID NO: 3812103 - RNA, 17 nt, Human
acccacgauuuucucca

SEQ ID NO: 3812104 - RNA, 18 nt, Human
acccacgauuuucuccag

SEQ ID NO: 3812105 - RNA, 18 nt, Human
acccacuauccuucguga

SEQ ID NO: 3812106 - RNA, 15 nt, Human
acccacucaucagaa

SEQ ID NO: 3812107 - RNA, 14 nt, Human
acccacugcucugg

SEQ ID NO: 3812108 - RNA, 22 nt, Human
acccacugguuccuucuuccug

SEQ ID NO: 3812109 - RNA, 17 nt, Human
acccacuucucaucaca

SEQ ID NO: 3812110 - RNA, 20 nt, Human
acccacuucucaucacacac

SEQ ID NO: 3812111 - RNA, 13 nt, Human
acccacuucugca

SEQ ID NO: 3812112 - RNA, 22 nt, Human
acccacuugucacugacacaaa

SEQ ID NO: 3812113 - RNA, 23 nt, Human
acccacuugucacugacacaaag

SEQ ID NO: 3812114 - RNA, 19 nt, Human
acccagaaugagacaucca

SEQ ID NO: 3812115 - RNA, 20 nt, Human
acccagaaugagacauccag

SEQ ID NO: 3812116 - RNA, 15 nt, Human
acccagacagcuccc

SEQ ID NO: 3812117 - RNA, 20 nt, Human
acccagacauaaaggaaaag

SEQ ID NO: 3812118 - RNA, 14 nt, Human
acccagacccagug

SEQ ID NO: 3812119 - RNA, 21 nt, Human
acccagacggcuccacuagga

SEQ ID NO: 3812120 - RNA, 18 nt, Human
acccagagaauauauaca

SEQ ID NO: 3812121 - RNA, 19 nt, Human
acccagaguuuuuauguag

SEQ ID NO: 3812122 - RNA, 20 nt, Human
acccagauuuugcuguauau

SEQ ID NO: 3812123 - RNA, 14 nt, Human
acccagcaauagag

SEQ ID NO: 3812124 - RNA, 13 nt, Human
acccagccaggcc

SEQ ID NO: 3812125 - RNA, 14 nt, Human
acccagccaggccc

SEQ ID NO: 3812126 - RNA, 18 nt, Human
acccagccaggcccagcc

SEQ ID NO: 3812127 - RNA, 18 nt, Human
acccagccaucugcccag

SEQ ID NO: 3812128 - RNA, 21 nt, Human
acccagccaucugcccagggg

SEQ ID NO: 3812129 - RNA, 15 nt, Human
acccagcccacuucu

SEQ ID NO: 3812130 - RNA, 18 nt, Human
acccagcccacuucugcc

SEQ ID NO: 3812131 - RNA, 14 nt, Human
acccagcccaucuu

SEQ ID NO: 3812132 - RNA, 17 nt, Human
acccagccccuugagaa

SEQ ID NO: 3812133 - RNA, 20 nt, Human
acccagccccuugagaaacc

SEQ ID NO: 3812134 - RNA, 21 nt, Human
acccagccccuugagaaaccu

SEQ ID NO: 3812135 - RNA, 15 nt, Human
acccagcccucaucc

SEQ ID NO: 3812136 - RNA, 19 nt, Human
acccagcccuggucucagc

SEQ ID NO: 3812137 - RNA, 12 nt, Human
acccagccucag

SEQ ID NO: 3812138 - RNA, 15 nt, Human
acccagccuguuuua

SEQ ID NO: 3812139 - RNA, 13 nt, Human
acccagcucuggu

SEQ ID NO: 3812140 - RNA, 14 nt, Human
acccaggacaggau

SEQ ID NO: 3812141 - RNA, 17 nt, Human
acccaggacaggaucca

SEQ ID NO: 3812142 - RNA, 15 nt, Human
acccaggacuccucc

SEQ ID NO: 3812143 - RNA, 23 nt, Human
acccaggacuuauuuaaacucug

SEQ ID NO: 3812144 - RNA, 22 nt, Human
acccaggagcauccaccuccuu

SEQ ID NO: 3812145 - RNA, 23 nt, Human
acccaggagcauccaccuccuuc

SEQ ID NO: 3812146 - RNA, 13 nt, Human
acccaggagcccc

SEQ ID NO: 3812147 - RNA, 15 nt, Human
acccaggagccccga

SEQ ID NO: 3812148 - RNA, 23 nt, Human
acccaggaggcagagguugcagu

SEQ ID NO: 3812149 - RNA, 14 nt, Human
acccaggaucccca

SEQ ID NO: 3812150 - RNA, 15 nt, Human
acccaggcaccugca

SEQ ID NO: 3812151 - RNA, 17 nt, Human
acccaggccuauguuga

SEQ ID NO: 3812152 - RNA, 16 nt, Human
acccaggcuccgcccu

SEQ ID NO: 3812153 - RNA, 20 nt, Human
acccaggcuccgcccuuagu

SEQ ID NO: 3812154 - RNA, 23 nt, Human
acccaggcuccgcccuuaguccc

SEQ ID NO: 3812155 - RNA, 18 nt, Human
acccaggcuggagugcag

SEQ ID NO: 3812156 - RNA, 22 nt, Human
acccaggcugggcaaggaggcc

SEQ ID NO: 3812157 - RNA, 22 nt, Human
acccagggaacagccacucccc

SEQ ID NO: 3812158 - RNA, 12 nt, Human
acccagggccug

SEQ ID NO: 3812159 - RNA, 15 nt, Human
acccagggccugcag

SEQ ID NO: 3812160 - RNA, 18 nt, Human
acccagggcucugcccca

SEQ ID NO: 3812161 - RNA, 20 nt, Human
acccagggcucugccccagu

SEQ ID NO: 3812162 - RNA, 15 nt, Human
acccaggggcagccc

SEQ ID NO: 3812163 - RNA, 15 nt, Human
acccaggguggagug

SEQ ID NO: 3812164 - RNA, 21 nt, Human
acccaggguucccgcggggcu

SEQ ID NO: 3812165 - RNA, 14 nt, Human
acccagguccccuc

SEQ ID NO: 3812166 - RNA, 11 nt, Human
acccaggugcu

SEQ ID NO: 3812167 - RNA, 23 nt, Human
acccaggugcuaggaacacuccu

SEQ ID NO: 3812168 - RNA, 17 nt, Human
acccagguuaagaaaau

SEQ ID NO: 3812169 - RNA, 20 nt, Human
acccagguuuugcacucuug

SEQ ID NO: 3812170 - RNA, 17 nt, Human
acccaguaacucaucug

SEQ ID NO: 3812171 - RNA, 18 nt, Human
acccaguaacucaucugu

SEQ ID NO: 3812172 - RNA, 18 nt, Human
acccagucaccucugucu

SEQ ID NO: 3812173 - RNA, 16 nt, Human
acccaguccacaaaau

SEQ ID NO: 3812174 - RNA, 14 nt, Human
acccagucccuggg

SEQ ID NO: 3812175 - RNA, 15 nt, Human
acccagucccugggg

SEQ ID NO: 3812176 - RNA, 13 nt, Human
acccagucgcccu

SEQ ID NO: 3812177 - RNA, 14 nt, Human
acccagugagcacu

SEQ ID NO: 3812178 - RNA, 17 nt, Human
acccagugcagaaugua

SEQ ID NO: 3812179 - RNA, 15 nt, Human
acccagugcccccac

SEQ ID NO: 3812180 - RNA, 14 nt, Human
acccagugcccucu

SEQ ID NO: 3812181 - RNA, 15 nt, Human
acccagugcccucuc

SEQ ID NO: 3812182 - RNA, 14 nt, Human
acccagugcugaau

SEQ ID NO: 3812183 - RNA, 14 nt, Human
acccaguggcaggg

SEQ ID NO: 3812184 - RNA, 17 nt, Human
acccaguggcagggcac

SEQ ID NO: 3812185 - RNA, 19 nt, Human
acccaguggcagggcacag

SEQ ID NO: 3812186 - RNA, 22 nt, Human
acccaguggcagggcacagggc

SEQ ID NO: 3812187 - RNA, 22 nt, Human
acccaguuucuaaacuggagac

SEQ ID NO: 3812188 - RNA, 23 nt, Human
acccaguuucuaaacuggagacu

SEQ ID NO: 3812189 - RNA, 17 nt, Human
acccauagaucuucuga

SEQ ID NO: 3812190 - RNA, 14 nt, Human
acccauaggaaauc

SEQ ID NO: 3812191 - RNA, 14 nt, Human
acccauaggcccac

SEQ ID NO: 3812192 - RNA, 17 nt, Human
acccauaggcccacaca

SEQ ID NO: 3812193 - RNA, 18 nt, Human
acccauaggcccacacac

SEQ ID NO: 3812194 - RNA, 19 nt, Human
acccauaggcccacacaca

SEQ ID NO: 3812195 - RNA, 20 nt, Human
acccauauccccucuccccc

SEQ ID NO: 3812196 - RNA, 16 nt, Human
acccauauuguaaaac

SEQ ID NO: 3812197 - RNA, 14 nt, Human
acccaucagaagga

SEQ ID NO: 3812198 - RNA, 19 nt, Human
acccaucagaaggagaagg

SEQ ID NO: 3812199 - RNA, 20 nt, Human
acccauccaccguccccucc

SEQ ID NO: 3812200 - RNA, 19 nt, Human
acccaucgguguccauuua

SEQ ID NO: 3812201 - RNA, 13 nt, Human
acuuuacccauuu

SEQ ID NO: 3812202 - RNA, 15 nt, Human
acuuuaccucucugu

SEQ ID NO: 3812203 - RNA, 22 nt, Human
acuuuaccucucugucaugugc

SEQ ID NO: 3812204 - RNA, 18 nt, Human
acuuuaccuuuuuuauac

SEQ ID NO: 3812205 - RNA, 15 nt, Human
acuuuacgcccaucu

SEQ ID NO: 3812206 - RNA, 15 nt, Human
acuuuacuaagauga

SEQ ID NO: 3812207 - RNA, 18 nt, Human
acuuuagaaagcugacau

SEQ ID NO: 3812208 - RNA, 15 nt, Human
acuuuagaaugagag

SEQ ID NO: 3812209 - RNA, 19 nt, Human
acuuuagaguagcaugaga

SEQ ID NO: 3812210 - RNA, 21 nt, Human
acuuuagaguagcaugagaga

SEQ ID NO: 3812211 - RNA, 14 nt, Human
acuuuagaugcuga

SEQ ID NO: 3812212 - RNA, 22 nt, Human
acuuuagcugcauccuccaaga

SEQ ID NO: 3812213 - RNA, 17 nt, Human
acuuuaggcuuucagcu

SEQ ID NO: 3812214 - RNA, 20 nt, Human
acuuuagguuuuuuuaauga

SEQ ID NO: 3812215 - RNA, 12 nt, Human
acuuuauacauu

SEQ ID NO: 3812216 - RNA, 22 nt, Human
acuuuauacauuaguaaauguc

SEQ ID NO: 3812217 - RNA, 19 nt, Human
acuuuauacccagaaaguu

SEQ ID NO: 3812218 - RNA, 20 nt, Human
acuuguuuuuguaaagaaaa

SEQ ID NO: 3812219 - RNA, 12 nt, Human
acuuuaaagcgu

SEQ ID NO: 3812220 - RNA, 16 nt, Human
acuuuaacauaagcua

SEQ ID NO: 3812221 - RNA, 12 nt, Human
acuuuaagagag

SEQ ID NO: 3812222 - RNA, 14 nt, Human
acuuuaagagagaa

SEQ ID NO: 3812223 - RNA, 16 nt, Human
acuuuaagagagaaau

SEQ ID NO: 3812224 - RNA, 23 nt, Human
acuuuaagagagaaaucugaaaa

SEQ ID NO: 3812225 - RNA, 14 nt, Human
acuuuaagaggaca

SEQ ID NO: 3812226 - RNA, 19 nt, Human
acuuuaagcagcucuugcu

SEQ ID NO: 3812227 - RNA, 23 nt, Human
acuuuaagcagcucuugcuaauc

SEQ ID NO: 3812228 - RNA, 13 nt, Human
acuuuaauaugua

SEQ ID NO: 3812229 - RNA, 22 nt, Human
acuuuaauauguauuuuaugua

SEQ ID NO: 3812230 - RNA, 20 nt, Human
acuuuaauuaccaaccuguu

SEQ ID NO: 3812231 - RNA, 22 nt, Human
acuuuaauuuauguaacuugaa

SEQ ID NO: 3812232 - RNA, 15 nt, Human
acuuuacacucggcu

SEQ ID NO: 3812233 - RNA, 14 nt, Human
acuuuacagaaaug

SEQ ID NO: 3812234 - RNA, 19 nt, Human
acuuuacagaaauggacug

SEQ ID NO: 3812235 - RNA, 15 nt, Human
acuuuaccaccccca

SEQ ID NO: 3812236 - RNA, 12 nt, Human
acuuuaccuuuu

SEQ ID NO: 3812237 - RNA, 22 nt, Human
acuuuaccuuuuuuauacauaa

SEQ ID NO: 3812238 - RNA, 23 nt, Human
acuuuaccuuuuuuauacauaaa

SEQ ID NO: 3812239 - RNA, 19 nt, Human
acuuuacugccugaauaaa

SEQ ID NO: 3812240 - RNA, 20 nt, Human
acuuuagaagugcauuucug

SEQ ID NO: 3812241 - RNA, 17 nt, Human
acuuuagaauaugccuu

SEQ ID NO: 3812242 - RNA, 13 nt, Human
acuuuagaugcug

SEQ ID NO: 3812243 - RNA, 20 nt, Human
acuuuagcagaaucaaaaug

SEQ ID NO: 3812244 - RNA, 18 nt, Human
acuuuaggcuuucagcuu

SEQ ID NO: 3812245 - RNA, 23 nt, Human
acuuuagggcuguaaaaugcaug

SEQ ID NO: 3812246 - RNA, 22 nt, Human
acuuuaggguaaaaauugccau

SEQ ID NO: 3812247 - RNA, 16 nt, Human
acuuuagucugcaaaa

SEQ ID NO: 3812248 - RNA, 17 nt, Human
acuuuagugcuacagaa

SEQ ID NO: 3812249 - RNA, 16 nt, Human
acuuuauaacuaacau

SEQ ID NO: 3812250 - RNA, 22 nt, Human
acuuuauaagucauuguauguu

SEQ ID NO: 3812251 - RNA, 21 nt, Human
acccuccuguaaaugguguac

SEQ ID NO: 3812252 - RNA, 13 nt, Human
acccuccugucuu

SEQ ID NO: 3812253 - RNA, 11 nt, Human
acccuccuucc

SEQ ID NO: 3812254 - RNA, 13 nt, Human
acccuccuuccca

SEQ ID NO: 3812255 - RNA, 21 nt, Human
acccucgaagcgcgccacucg

SEQ ID NO: 3812256 - RNA, 14 nt, Human
acccucgaggcgga

SEQ ID NO: 3812257 - RNA, 18 nt, Human
acccucgaggcggaucuu

SEQ ID NO: 3812258 - RNA, 19 nt, Human
acccucgaggcggaucuuu

SEQ ID NO: 3812259 - RNA, 13 nt, Human
acccucgccggac

SEQ ID NO: 3812260 - RNA, 12 nt, Human
acccucgcuggc

SEQ ID NO: 3812261 - RNA, 15 nt, Human
acccucgcuggcccc

SEQ ID NO: 3812262 - RNA, 20 nt, Human
acccucgcuggcccccacug

SEQ ID NO: 3812263 - RNA, 13 nt, Human
acccucgggccca

SEQ ID NO: 3812264 - RNA, 14 nt, Human
acccucgggcccac

SEQ ID NO: 3812265 - RNA, 17 nt, Human
acccucgggcccaccug

SEQ ID NO: 3812266 - RNA, 18 nt, Human
acccucgggcccaccugg

SEQ ID NO: 3812267 - RNA, 19 nt, Human
acccucgggcccaccuggc

SEQ ID NO: 3812268 - RNA, 21 nt, Human
acccucgggcccaccuggcca

SEQ ID NO: 3812269 - RNA, 22 nt, Human
acccucgggcccaccuggccac

SEQ ID NO: 3812270 - RNA, 20 nt, Human
acccucggggauguguccug

SEQ ID NO: 3812271 - RNA, 22 nt, Human
acccucguggacaccugcccug

SEQ ID NO: 3812272 - RNA, 15 nt, Human
acccucuaaccucgc

SEQ ID NO: 3812273 - RNA, 15 nt, Human
acccucucagcucca

SEQ ID NO: 3812274 - RNA, 14 nt, Human
acccucuccacccc

SEQ ID NO: 3812275 - RNA, 14 nt, Human
acccucucccagga

SEQ ID NO: 3812276 - RNA, 19 nt, Human
acccucugaaugguccagg

SEQ ID NO: 3812277 - RNA, 23 nt, Human
acccucuggagggguguggcucc

SEQ ID NO: 3812278 - RNA, 19 nt, Human
acccucugggaaccuccca

SEQ ID NO: 3812279 - RNA, 22 nt, Human
acccucugggaaccucccagag

SEQ ID NO: 3812280 - RNA, 12 nt, Human
acccucuguacc

SEQ ID NO: 3812281 - RNA, 20 nt, Human
acccucuguuccuucccugu

SEQ ID NO: 3812282 - RNA, 15 nt, Human
acccucuuccuacug

SEQ ID NO: 3812283 - RNA, 16 nt, Human
acccucuuccuacugg

SEQ ID NO: 3812284 - RNA, 16 nt, Human
acccucuuccugugau

SEQ ID NO: 3812285 - RNA, 19 nt, Human
acccucuuccugugaucca

SEQ ID NO: 3812286 - RNA, 15 nt, Human
acccucuuugcugca

SEQ ID NO: 3812287 - RNA, 14 nt, Human
acccugaaagcccu

SEQ ID NO: 3812288 - RNA, 16 nt, Human
acccugaaagcccuga

SEQ ID NO: 3812289 - RNA, 18 nt, Human
acccugaaagcccugagc

SEQ ID NO: 3812290 - RNA, 16 nt, Human
acccugaccuggcccc

SEQ ID NO: 3812291 - RNA, 17 nt, Human
acccugagccccuuccu

SEQ ID NO: 3812292 - RNA, 22 nt, Human
acccugagcugaccagccguga

SEQ ID NO: 3812293 - RNA, 13 nt, Human
acccugaggaguc

SEQ ID NO: 3812294 - RNA, 14 nt, Human
acccugaggagucu

SEQ ID NO: 3812295 - RNA, 15 nt, Human
acccugaggcccaga

SEQ ID NO: 3812296 - RNA, 17 nt, Human
acccugaggcccagagg

SEQ ID NO: 3812297 - RNA, 21 nt, Human
acccugaggcccagagggccu

SEQ ID NO: 3812298 - RNA, 11 nt, Human
acccugagggc

SEQ ID NO: 3812299 - RNA, 20 nt, Human
acccugaggucagggagugc

SEQ ID NO: 3812300 - RNA, 20 nt, Human
acccugauuuaggagaagcc

SEQ ID NO: 3812301 - RNA, 23 nt, Human
acccugauuuaggagaagccagg

SEQ ID NO: 3812302 - RNA, 19 nt, Human
acccugcaaacagaacagg

SEQ ID NO: 3812303 - RNA, 17 nt, Human
acccugcaaggcccaca

SEQ ID NO: 3812304 - RNA, 23 nt, Human
acccugcaaggcccacaggaggc

SEQ ID NO: 3812305 - RNA, 22 nt, Human
acccugcauggcugagcugccc

SEQ ID NO: 3812306 - RNA, 22 nt, Human
acccugccaggcacaggcaggg

SEQ ID NO: 3812307 - RNA, 23 nt, Human
acccugccauggaacuguuuccu

SEQ ID NO: 3812308 - RNA, 10 nt, Human
acccugcccc

SEQ ID NO: 3812309 - RNA, 15 nt, Human
acccugccccugccc

SEQ ID NO: 3812310 - RNA, 11 nt, Human
acccugcccug

SEQ ID NO: 3812311 - RNA, 15 nt, Human
acccugcccuguggg

SEQ ID NO: 3812312 - RNA, 17 nt, Human
acccugcccugugggcc

SEQ ID NO: 3812313 - RNA, 20 nt, Human
acccugcccuugacaucugg

SEQ ID NO: 3812314 - RNA, 11 nt, Human
acccugccucc

SEQ ID NO: 3812315 - RNA, 23 nt, Human
acccugccucccuugacuuugcu

SEQ ID NO: 3812316 - RNA, 14 nt, Human
acccugccuuaucu

SEQ ID NO: 3812317 - RNA, 22 nt, Human
acccugcgcccaguccuuccac

SEQ ID NO: 3812318 - RNA, 15 nt, Human
acccugcguggggac

SEQ ID NO: 3812319 - RNA, 16 nt, Human
acccugcguggggaca

SEQ ID NO: 3812320 - RNA, 14 nt, Human
acccugcugagucu

SEQ ID NO: 3812321 - RNA, 14 nt, Human
acccugcugccuuc

SEQ ID NO: 3812322 - RNA, 19 nt, Human
acccugcugcuggugcaca

SEQ ID NO: 3812323 - RNA, 17 nt, Human
acccugcuuggcccagg

SEQ ID NO: 3812324 - RNA, 18 nt, Human
acccugcuuggcccaggg

SEQ ID NO: 3812325 - RNA, 19 nt, Human
acccugcuuuagagcuagg

SEQ ID NO: 3812326 - RNA, 23 nt, Human
acccuggaaauggacugguuuga

SEQ ID NO: 3812327 - RNA, 17 nt, Human
acccuggaccagugguc

SEQ ID NO: 3812328 - RNA, 13 nt, Human
acccuggagccca

SEQ ID NO: 3812329 - RNA, 15 nt, Human
acccuggccccucuc

SEQ ID NO: 3812330 - RNA, 22 nt, Human
acccuggccgaguccaagcugg

SEQ ID NO: 3812331 - RNA, 12 nt, Human
acccugggaagg

SEQ ID NO: 3812332 - RNA, 14 nt, Human
acccugggagacag

SEQ ID NO: 3812333 - RNA, 15 nt, Human
acccugggcccuggg

SEQ ID NO: 3812334 - RNA, 17 nt, Human
acccugggcccugggcu

SEQ ID NO: 3812335 - RNA, 22 nt, Human
acccugggccuggcagcucagc

SEQ ID NO: 3812336 - RNA, 19 nt, Human
acccugggcucugggagca

SEQ ID NO: 3812337 - RNA, 19 nt, Human
acccugggcucugugggcu

SEQ ID NO: 3812338 - RNA, 18 nt, Human
acccuggggccuggaccu

SEQ ID NO: 3812339 - RNA, 21 nt, Human
acccuggggcuggcuuuucug

SEQ ID NO: 3812340 - RNA, 16 nt, Human
acccugggggcacagg

SEQ ID NO: 3812341 - RNA, 20 nt, Human
acccugggugggcucugugc

SEQ ID NO: 3812342 - RNA, 20 nt, Human
acccuggguguccccgcugc

SEQ ID NO: 3812343 - RNA, 19 nt, Human
acccuggugguugcuguuu

SEQ ID NO: 3812344 - RNA, 23 nt, Human
acccuguaaaauggagguggaaa

SEQ ID NO: 3812345 - RNA, 19 nt, Human
acccuguacauauguaaac

SEQ ID NO: 3812346 - RNA, 15 nt, Human
acccuguauauagcc

SEQ ID NO: 3812347 - RNA, 15 nt, Human
acccugucaaacauu

SEQ ID NO: 3812348 - RNA, 19 nt, Human
acccuguccaaacugccua

SEQ ID NO: 3812349 - RNA, 19 nt, Human
acccugucccccagcucug

SEQ ID NO: 3812350 - RNA, 11 nt, Human
acccugucucu

SEQ ID NO: 3812351 - RNA, 21 nt, Human
acccugucucuuaaagaaaaa

SEQ ID NO: 3812352 - RNA, 23 nt, Human
acccugucuguagagggcccugg

SEQ ID NO: 3812353 - RNA, 16 nt, Human
acccugugauggggcc

SEQ ID NO: 3812354 - RNA, 19 nt, Human
acccugugauggggcccug

SEQ ID NO: 3812355 - RNA, 14 nt, Human
acccugugcuggug

SEQ ID NO: 3812356 - RNA, 15 nt, Human
acccuguggcccugg

SEQ ID NO: 3812357 - RNA, 13 nt, Human
acccuguuccugc

SEQ ID NO: 3812358 - RNA, 14 nt, Human
acccuguuccugcu

SEQ ID NO: 3812359 - RNA, 16 nt, Human
acccuguuccugcugc

SEQ ID NO: 3812360 - RNA, 17 nt, Human
acccuguuccugcugcu

SEQ ID NO: 3812361 - RNA, 14 nt, Human
acccuguugcuaag

SEQ ID NO: 3812362 - RNA, 15 nt, Human
acccuguugcuaagc

SEQ ID NO: 3812363 - RNA, 17 nt, Human
acuuugggaggccaagg

SEQ ID NO: 3812364 - RNA, 19 nt, Human
acuuugggauucuuuccau

SEQ ID NO: 3812365 - RNA, 22 nt, Human
acuuugguaccagauaacuuuu

SEQ ID NO: 3812366 - RNA, 23 nt, Human
acuuugguagcugggaaagcaua

SEQ ID NO: 3812367 - RNA, 22 nt, Human
acuuuggugcgggcacaauaaa

SEQ ID NO: 3812368 - RNA, 18 nt, Human
acuuugguuucugucugu

SEQ ID NO: 3812369 - RNA, 13 nt, Human
acuuuguaaauag

SEQ ID NO: 3812370 - RNA, 14 nt, Human
acuuuguaaauucu

SEQ ID NO: 3812371 - RNA, 16 nt, Human
acuuuguaaauucuga

SEQ ID NO: 3812372 - RNA, 19 nt, Human
acuuuguaaauucugauuu

SEQ ID NO: 3812373 - RNA, 23 nt, Human
acuuuguaaauucugauuucuuu

SEQ ID NO: 3812374 - RNA, 17 nt, Human
acuuuguacauuuggga

SEQ ID NO: 3812375 - RNA, 12 nt, Human
acuuuguagugu

SEQ ID NO: 3812376 - RNA, 14 nt, Human
acuuuguauacaag

SEQ ID NO: 3812377 - RNA, 14 nt, Human
acuuuguauacuuu

SEQ ID NO: 3812378 - RNA, 21 nt, Human
acuuuguauacuuuaaauaau

SEQ ID NO: 3812379 - RNA, 14 nt, Human
acuuuguaugauau

SEQ ID NO: 3812380 - RNA, 15 nt, Human
acuuuguaugauauu

SEQ ID NO: 3812381 - RNA, 16 nt, Human
acuuuguaugauauuc

SEQ ID NO: 3812382 - RNA, 14 nt, Human
acuuuguauuuuga

SEQ ID NO: 3812383 - RNA, 18 nt, Human
acuuuguggaccaauuau

SEQ ID NO: 3812384 - RNA, 21 nt, Human
acuuuguggaccaauuauuga

SEQ ID NO: 3812385 - RNA, 21 nt, Human
acuuuguggaugucuuccuug

SEQ ID NO: 3812386 - RNA, 16 nt, Human
acuuuguguucaccuu

SEQ ID NO: 3812387 - RNA, 18 nt, Human
acuuuguguucaccuugu

SEQ ID NO: 3812388 - RNA, 22 nt, Human
acuuuguuaggccaaagacaaa

SEQ ID NO: 3812389 - RNA, 21 nt, Human
acuuuguuaguuucuccaagc

SEQ ID NO: 3812390 - RNA, 17 nt, Human
acuuuguucuggcucuu

SEQ ID NO: 3812391 - RNA, 23 nt, Human
acuuuguucuggcucuuccaggc

SEQ ID NO: 3812392 - RNA, 19 nt, Human
acuuuguucuuuaggagau

SEQ ID NO: 3812393 - RNA, 20 nt, Human
acuuuguugcaagaugugaa

SEQ ID NO: 3812394 - RNA, 14 nt, Human
acuuuguuuuauuu

SEQ ID NO: 3812395 - RNA, 15 nt, Human
acuuuuaaacaguga

SEQ ID NO: 3812396 - RNA, 14 nt, Human
acuuuuaaacugug

SEQ ID NO: 3812397 - RNA, 20 nt, Human
acuuuuaaccaaacaauuau

SEQ ID NO: 3812398 - RNA, 13 nt, Human
acuuuuaagacuu

SEQ ID NO: 3812399 - RNA, 20 nt, Human
acuuuuaaggauaaaucaua

SEQ ID NO: 3812400 - RNA, 13 nt, Human
acuuuuaauucau

SEQ ID NO: 3812401 - RNA, 21 nt, Human
acuuuuacaaguaacaaaaau

SEQ ID NO: 3812402 - RNA, 15 nt, Human
acuuuuacucugccu

SEQ ID NO: 3812403 - RNA, 21 nt, Human
acuuuuacucugccuacagaa

SEQ ID NO: 3812404 - RNA, 22 nt, Human
acuuuuagaugugguuaauuuu

SEQ ID NO: 3812405 - RNA, 15 nt, Human
acuuuuauaaacuuu

SEQ ID NO: 3812406 - RNA, 21 nt, Human
acuuuuauaaacuuuaccuuu

SEQ ID NO: 3812407 - RNA, 14 nt, Human
acuuuuauaaagca

SEQ ID NO: 3812408 - RNA, 23 nt, Human
acuuuuauacucuuucuguauau

SEQ ID NO: 3812409 - RNA, 23 nt, Human
acuuuuaugauacuugaaaauua

SEQ ID NO: 3812410 - RNA, 19 nt, Human
acccuuugugugcucucca

SEQ ID NO: 3812411 - RNA, 17 nt, Human
acccuuuguuucuuguu

SEQ ID NO: 3812412 - RNA, 11 nt, Human
acccuuuucau

SEQ ID NO: 3812413 - RNA, 17 nt, Human
acccuuuuccuuugugg

SEQ ID NO: 3812414 - RNA, 23 nt, Human
acccuuuuggcccccgagcuggg

SEQ ID NO: 3812415 - RNA, 19 nt, Human
acccuuuuggguuucugcc

SEQ ID NO: 3812416 - RNA, 14 nt, Human
acccuuuugucugc

SEQ ID NO: 3812417 - RNA, 19 nt, Human
accgaaaaacuaaaaauaa

SEQ ID NO: 3812418 - RNA, 21 nt, Human
accgaaaacguggcugcuuca

SEQ ID NO: 3812419 - RNA, 17 nt, Human
accgaaacagcgcuggg

SEQ ID NO: 3812420 - RNA, 18 nt, Human
accgaagcccagaggguc

SEQ ID NO: 3812421 - RNA, 12 nt, Human
accgaauaaaug

SEQ ID NO: 3812422 - RNA, 15 nt, Human
accgaauaaauguuu

SEQ ID NO: 3812423 - RNA, 18 nt, Human
accgacgcgucuccuguu

SEQ ID NO: 3812424 - RNA, 22 nt, Human
accgacggccagccgcugcgcu

SEQ ID NO: 3812425 - RNA, 18 nt, Human
accgacguugccaucaaa

SEQ ID NO: 3812426 - RNA, 22 nt, Human
accgacuagacacacaaagcag

SEQ ID NO: 3812427 - RNA, 18 nt, Human
accgagcgcuuucuggaa

SEQ ID NO: 3812428 - RNA, 20 nt, Human
accgagcgcuuucuggaaaa

SEQ ID NO: 3812429 - RNA, 23 nt, Human
accgaggagggagagucucccag

SEQ ID NO: 3812430 - RNA, 17 nt, Human
accgaggcuggagcugg

SEQ ID NO: 3812431 - RNA, 18 nt, Human
accgaggcuggagcuggc

SEQ ID NO: 3812432 - RNA, 17 nt, Human
accgaggggcucaggaa

SEQ ID NO: 3812433 - RNA, 19 nt, Human
accgagggggcugcuccca

SEQ ID NO: 3812434 - RNA, 20 nt, Human
accgagggggcugcucccac

SEQ ID NO: 3812435 - RNA, 13 nt, Human
accgaugcuccag

SEQ ID NO: 3812436 - RNA, 13 nt, Human
accgaugcuuuac

SEQ ID NO: 3812437 - RNA, 22 nt, Human
accgaugguggguggggcugca

SEQ ID NO: 3812438 - RNA, 16 nt, Human
accgauucuuuggagu

SEQ ID NO: 3812439 - RNA, 17 nt, Human
accgcacaugcacacac

SEQ ID NO: 3812440 - RNA, 20 nt, Human
accgcagaagccuccccagc

SEQ ID NO: 3812441 - RNA, 23 nt, Human
accgcagaagccuccccagcuca

SEQ ID NO: 3812442 - RNA, 12 nt, Human
accgcagaagga

SEQ ID NO: 3812443 - RNA, 14 nt, Human
accgcagacaggac

SEQ ID NO: 3812444 - RNA, 16 nt, Human
accgccagcucuguuc

SEQ ID NO: 3812445 - RNA, 20 nt, Human
accgcccagcggcuugccug

SEQ ID NO: 3812446 - RNA, 11 nt, Human
accgcccauca

SEQ ID NO: 3812447 - RNA, 20 nt, Human
accgccccaaaguaaaagaa

SEQ ID NO: 3812448 - RNA, 11 nt, Human
accgcccccuc

SEQ ID NO: 3812449 - RNA, 12 nt, Human
accgcccccucc

SEQ ID NO: 3812450 - RNA, 14 nt, Human
accgcccccuccuc

SEQ ID NO: 3812451 - RNA, 19 nt, Human
accgcccccuccucuagcu

SEQ ID NO: 3812452 - RNA, 15 nt, Human
accgcccgucugugu

SEQ ID NO: 3812453 - RNA, 21 nt, Human
accgccgacuuuguacccccc

SEQ ID NO: 3812454 - RNA, 19 nt, Human
accgccuaguuuacuguuu

SEQ ID NO: 3812455 - RNA, 14 nt, Human
accgccucuucccg

SEQ ID NO: 3812456 - RNA, 12 nt, Human
accgccuucucu

SEQ ID NO: 3812457 - RNA, 22 nt, Human
accgccuugcccagccuggaug

SEQ ID NO: 3812458 - RNA, 17 nt, Human
accgcgacuaauuucaa

SEQ ID NO: 3812459 - RNA, 20 nt, Human
accgcgacuaauuucaaaau

SEQ ID NO: 3812460 - RNA, 18 nt, Human
accgcgucuacccuggga

SEQ ID NO: 3812461 - RNA, 14 nt, Human
accgcuacaccacu

SEQ ID NO: 3812462 - RNA, 15 nt, Human
accgcucaccuagag

SEQ ID NO: 3812463 - RNA, 18 nt, Human
accgcucaccuagagcca

SEQ ID NO: 3812464 - RNA, 14 nt, Human
accgcuccccagcc

SEQ ID NO: 3812465 - RNA, 18 nt, Human
accgcuccccagcccagg

SEQ ID NO: 3812466 - RNA, 20 nt, Human
accgcucucuuuucuguacu

SEQ ID NO: 3812467 - RNA, 19 nt, Human
accgcugccuaaguggcug

SEQ ID NO: 3812468 - RNA, 15 nt, Human
accgcuucccuccug

SEQ ID NO: 3812469 - RNA, 14 nt, Human
accgcuuuggccug

SEQ ID NO: 3812470 - RNA, 14 nt, Human
accggaagcuccug

SEQ ID NO: 3812471 - RNA, 16 nt, Human
accggaccagccuggc

SEQ ID NO: 3812472 - RNA, 18 nt, Human
accggaccagccuggccc

SEQ ID NO: 3812473 - RNA, 19 nt, Human
accggagaguggggguggg

SEQ ID NO: 3812474 - RNA, 12 nt, Human
accggcaggugc

SEQ ID NO: 3812475 - RNA, 13 nt, Human
accggccugccag

SEQ ID NO: 3812476 - RNA, 23 nt, Human
accggcggaccccagccauccag

SEQ ID NO: 3812477 - RNA, 14 nt, Human
accggcuggccugg

SEQ ID NO: 3812478 - RNA, 15 nt, Human
accggcuggccuggc

SEQ ID NO: 3812479 - RNA, 17 nt, Human
accggcuggccuggccc

SEQ ID NO: 3812480 - RNA, 20 nt, Human
accgggccacagagaaagua

SEQ ID NO: 3812481 - RNA, 19 nt, Human
accgggccacuccuuccug

SEQ ID NO: 3812482 - RNA, 22 nt, Human
accgggccaguaucuauauaug

SEQ ID NO: 3812483 - RNA, 23 nt, Human
accgggcugggagcucugcagag

SEQ ID NO: 3812484 - RNA, 13 nt, Human
accggggccuggg

SEQ ID NO: 3812485 - RNA, 19 nt, Human
accggggccugggcaggag

SEQ ID NO: 3812486 - RNA, 21 nt, Human
accgggucuugauucagucac

SEQ ID NO: 3812487 - RNA, 23 nt, Human
accgggucuugauucagucacau

SEQ ID NO: 3812488 - RNA, 13 nt, Human
accgguacagaaa

SEQ ID NO: 3812489 - RNA, 14 nt, Human
accgguccagcugg

SEQ ID NO: 3812490 - RNA, 16 nt, Human
accgguccagcuggcc

SEQ ID NO: 3812491 - RNA, 21 nt, Human
accguccucaccccuguccuc

SEQ ID NO: 3812492 - RNA, 15 nt, Human
accguccucuuuuuc

SEQ ID NO: 3812493 - RNA, 14 nt, Human
accgugaagauacu

SEQ ID NO: 3812494 - RNA, 18 nt, Human
accgugaagauacuuugu

SEQ ID NO: 3812495 - RNA, 19 nt, Human
accgugaagauacuuugua

SEQ ID NO: 3812496 - RNA, 21 nt, Human
accgugaagauacuuuguauu

SEQ ID NO: 3812497 - RNA, 20 nt, Human
accgugagcaggaaggccug

SEQ ID NO: 3812498 - RNA, 21 nt, Human
accgugagcaggaaggccugg

SEQ ID NO: 3812499 - RNA, 18 nt, Human
accgugaggccagagaca

SEQ ID NO: 3812500 - RNA, 19 nt, Human
accgugccuggccacgccc

SEQ ID NO: 3812501 - RNA, 19 nt, Human
accguggcccugcccucuc

SEQ ID NO: 3812502 - RNA, 21 nt, Human
accguggcccugcccucuccu

SEQ ID NO: 3812503 - RNA, 19 nt, Human
accguggcccuuccuggac

SEQ ID NO: 3812504 - RNA, 19 nt, Human
accgugggcggggccuugc

SEQ ID NO: 3812505 - RNA, 16 nt, Human
accgugggcucccuga

SEQ ID NO: 3812506 - RNA, 14 nt, Human
accgugucaagcug

SEQ ID NO: 3812507 - RNA, 13 nt, Human
agacaauuugcac

SEQ ID NO: 3812508 - RNA, 18 nt, Human
agacacaacaacuccuag

SEQ ID NO: 3812509 - RNA, 14 nt, Human
agacacaacuauuu

SEQ ID NO: 3812510 - RNA, 20 nt, Human
agacacaacuauuuuuccaa

SEQ ID NO: 3812511 - RNA, 14 nt, Human
agacacacaaagca

SEQ ID NO: 3812512 - RNA, 10 nt, Human
agacacacac

SEQ ID NO: 3812513 - RNA, 11 nt, Human
agacacacaca

SEQ ID NO: 3812514 - RNA, 12 nt, Human
agacacacacac

SEQ ID NO: 3812515 - RNA, 13 nt, Human
agacacacacaca

SEQ ID NO: 3812516 - RNA, 18 nt, Human
agacacacacacgcacgc

SEQ ID NO: 3812517 - RNA, 21 nt, Human
agacacacacacgcacgcaca

SEQ ID NO: 3812518 - RNA, 23 nt, Human
agacacacacacgcacgcacaca

SEQ ID NO: 3812519 - RNA, 16 nt, Human
agacacacugaagaag

SEQ ID NO: 3812520 - RNA, 13 nt, Human
agacacacuuguc

SEQ ID NO: 3812521 - RNA, 14 nt, Human
agacacagaacaca

SEQ ID NO: 3812522 - RNA, 18 nt, Human
agacacagaagaggcugg

SEQ ID NO: 3812523 - RNA, 15 nt, Human
agacacagauaauaa

SEQ ID NO: 3812524 - RNA, 12 nt, Human
agacacagaugu

SEQ ID NO: 3812525 - RNA, 13 nt, Human
agacacagauguu

SEQ ID NO: 3812526 - RNA, 13 nt, Human
agacacaggcccg

SEQ ID NO: 3812527 - RNA, 19 nt, Human
agacacaggcccggcucca

SEQ ID NO: 3812528 - RNA, 23 nt, Human
agacacaggcccggcuccaggcu

SEQ ID NO: 3812529 - RNA, 15 nt, Human
agacacagggacuug

SEQ ID NO: 3812530 - RNA, 15 nt, Human
agacacagggcaucc

SEQ ID NO: 3812531 - RNA, 21 nt, Human
agacacagggcauccaacuga

SEQ ID NO: 3812532 - RNA, 16 nt, Human
agacacauaugagggg

SEQ ID NO: 3812533 - RNA, 12 nt, Human
agacacaugaag

SEQ ID NO: 3812534 - RNA, 23 nt, Human
agacacaugaagguaaauaaaaa

SEQ ID NO: 3812535 - RNA, 20 nt, Human
agacacauguccaagaagcc

SEQ ID NO: 3812536 - RNA, 13 nt, Human
agacacauuuaag

SEQ ID NO: 3812537 - RNA, 13 nt, Human
agacaccagagca

SEQ ID NO: 3812538 - RNA, 14 nt, Human
agacaccagccacu

SEQ ID NO: 3812539 - RNA, 19 nt, Human
agacacccucaaccucuuc

SEQ ID NO: 3812540 - RNA, 17 nt, Human
agacacccuuggagcuc

SEQ ID NO: 3812541 - RNA, 22 nt, Human
agacaccgccacauggcuuccu

SEQ ID NO: 3812542 - RNA, 17 nt, Human
agacaccguucauucag

SEQ ID NO: 3812543 - RNA, 14 nt, Human
agacaccugcaccu

SEQ ID NO: 3812544 - RNA, 21 nt, Human
agacacgcacggcagccacag

SEQ ID NO: 3812545 - RNA, 16 nt, Human
agacacgcucuucuau

SEQ ID NO: 3812546 - RNA, 15 nt, Human
agacacggaucugag

SEQ ID NO: 3812547 - RNA, 20 nt, Human
agacacuaacgaaauaucaa

SEQ ID NO: 3812548 - RNA, 16 nt, Human
agacacucaaauauga

SEQ ID NO: 3812549 - RNA, 17 nt, Human
agacacucugcucugcc

SEQ ID NO: 3812550 - RNA, 19 nt, Human
agacacugaccauccacuc

SEQ ID NO: 3812551 - RNA, 20 nt, Human
agacacugccacacaggguc

SEQ ID NO: 3812552 - RNA, 11 nt, Human
agacacugccu

SEQ ID NO: 3812553 - RNA, 12 nt, Human
agacacugccug

SEQ ID NO: 3812554 - RNA, 15 nt, Human
agacacugccugggc

SEQ ID NO: 3812555 - RNA, 18 nt, Human
agacacuggcugccagcu

SEQ ID NO: 3812556 - RNA, 20 nt, Human
agacacuguuuacaagaaaa

SEQ ID NO: 3812557 - RNA, 22 nt, Human
agacacuguuuacaagaaaaaa

SEQ ID NO: 3812558 - RNA, 20 nt, Human
agacacuuccgucacauccc

SEQ ID NO: 3812559 - RNA, 12 nt, Human
agacagaacacc

SEQ ID NO: 3812560 - RNA, 14 nt, Human
agacagaacaccua

SEQ ID NO: 3812561 - RNA, 18 nt, Human
agacagaaccuuguuauu

SEQ ID NO: 3812562 - RNA, 14 nt, Human
agacagaacuugaa

SEQ ID NO: 3812563 - RNA, 12 nt, Human
agacagaagaaa

SEQ ID NO: 3812564 - RNA, 16 nt, Human
agacagaagcaggcug

SEQ ID NO: 3812565 - RNA, 19 nt, Human
agacagaagcaggcuggag

SEQ ID NO: 3812566 - RNA, 20 nt, Human
agacagaagcaggcuggagg

SEQ ID NO: 3812567 - RNA, 18 nt, Human
agacagaagcugaagugc

SEQ ID NO: 3812568 - RNA, 16 nt, Human
agacagaagucuccuc

SEQ ID NO: 3812569 - RNA, 17 nt, Human
agacagaagucuccuca

SEQ ID NO: 3812570 - RNA, 18 nt, Human
agacagaaucucgcucug

SEQ ID NO: 3812571 - RNA, 15 nt, Human
agacagaauguaucu

SEQ ID NO: 3812572 - RNA, 18 nt, Human
agacagaauguaucugug

SEQ ID NO: 3812573 - RNA, 16 nt, Human
agacagacacacacac

SEQ ID NO: 3812574 - RNA, 14 nt, Human
agacagacuagaag

SEQ ID NO: 3812575 - RNA, 15 nt, Human
agacagacuugagaa

SEQ ID NO: 3812576 - RNA, 15 nt, Human
agacagagacaagua

SEQ ID NO: 3812577 - RNA, 13 nt, Human
agacagagaccug

SEQ ID NO: 3812578 - RNA, 15 nt, Human
agacagagaggacug

SEQ ID NO: 3812579 - RNA, 19 nt, Human
agacagagccaggagaagc

SEQ ID NO: 3812580 - RNA, 19 nt, Human
agacagagcgacagagcag

SEQ ID NO: 3812581 - RNA, 12 nt, Human
agacagagcugg

SEQ ID NO: 3812582 - RNA, 16 nt, Human
agacagaggcccucaa

SEQ ID NO: 3812583 - RNA, 18 nt, Human
agacagaggcccucaagu

SEQ ID NO: 3812584 - RNA, 19 nt, Human
agacagagggucacagugu

SEQ ID NO: 3812585 - RNA, 11 nt, Human
agacagagucu

SEQ ID NO: 3812586 - RNA, 23 nt, Human
agacagagucucacuguugccca

SEQ ID NO: 3812587 - RNA, 23 nt, Human
agacagagucuuccucugucucc

SEQ ID NO: 3812588 - RNA, 22 nt, Human
agacagauaccuccaacccugc

SEQ ID NO: 3812589 - RNA, 15 nt, Human
agacagauacuccuc

SEQ ID NO: 3812590 - RNA, 21 nt, Human
agacagauacuccuccaaggu

SEQ ID NO: 3812591 - RNA, 22 nt, Human
agacagauacuccuccaagguu

SEQ ID NO: 3812592 - RNA, 20 nt, Human
agacagaucuggaaugugaa

SEQ ID NO: 3812593 - RNA, 15 nt, Human
agacagaugccccag

SEQ ID NO: 3812594 - RNA, 15 nt, Human
agacagcauuugugu

SEQ ID NO: 3812595 - RNA, 18 nt, Human
agacagccacauugggca

SEQ ID NO: 3812596 - RNA, 12 nt, Human
agacagccccag

SEQ ID NO: 3812597 - RNA, 15 nt, Human
agacagccccagagc

SEQ ID NO: 3812598 - RNA, 17 nt, Human
agacagcccgggcucug

SEQ ID NO: 3812599 - RNA, 18 nt, Human
agacagcccgggcucugc

SEQ ID NO: 3812600 - RNA, 21 nt, Human
agacagcccgggcucugccuc

SEQ ID NO: 3812601 - RNA, 23 nt, Human
agacagcccgggcucugccuccc

SEQ ID NO: 3812602 - RNA, 20 nt, Human
agacagccuguaucuugggg

SEQ ID NO: 3812603 - RNA, 17 nt, Human
agacagcuccacccugg

SEQ ID NO: 3812604 - RNA, 19 nt, Human
agacagcucccucugccug

SEQ ID NO: 3812605 - RNA, 20 nt, Human
agacagcucccucugccuga

SEQ ID NO: 3812606 - RNA, 11 nt, Human
agacagcucuu

SEQ ID NO: 3812607 - RNA, 19 nt, Human
agacagcugauacuucauu

SEQ ID NO: 3812608 - RNA, 20 nt, Human
agacagcugauacuucauuu

SEQ ID NO: 3812609 - RNA, 22 nt, Human
agacagcuucucauccugcagg

SEQ ID NO: 3812610 - RNA, 23 nt, Human
agacagcuucucauccugcaggc

SEQ ID NO: 3812611 - RNA, 18 nt, Human
agacaggaaaauccucug

SEQ ID NO: 3812612 - RNA, 20 nt, Human
agacaggaaaauccucuggc

SEQ ID NO: 3812613 - RNA, 21 nt, Human
agacaggaaaauccucuggcu

SEQ ID NO: 3812614 - RNA, 19 nt, Human
agacaggaaaguucagagu

SEQ ID NO: 3812615 - RNA, 15 nt, Human
agacaggaccccugc

SEQ ID NO: 3812616 - RNA, 14 nt, Human
agacaggagaaaug

SEQ ID NO: 3812617 - RNA, 23 nt, Human
accugcccugcccugccaccugu

SEQ ID NO: 3812618 - RNA, 14 nt, Human
accugcccugccug

SEQ ID NO: 3812619 - RNA, 15 nt, Human
accugcccuggaaca

SEQ ID NO: 3812620 - RNA, 13 nt, Human
accugccucagga

SEQ ID NO: 3812621 - RNA, 21 nt, Human
accugccucccuucaugcaug

SEQ ID NO: 3812622 - RNA, 13 nt, Human
accugccuccugc

SEQ ID NO: 3812623 - RNA, 21 nt, Human
accugccugacauuuggagug

SEQ ID NO: 3812624 - RNA, 17 nt, Human
accugccugcgucuucc

SEQ ID NO: 3812625 - RNA, 20 nt, Human
accugccugcgucuuccgcc

SEQ ID NO: 3812626 - RNA, 10 nt, Human
accugccugg

SEQ ID NO: 3812627 - RNA, 13 nt, Human
accugccuggccg

SEQ ID NO: 3812628 - RNA, 15 nt, Human
accugccuggccggc

SEQ ID NO: 3812629 - RNA, 17 nt, Human
accugccuggccggcca

SEQ ID NO: 3812630 - RNA, 13 nt, Human
accugccuggguu

SEQ ID NO: 3812631 - RNA, 16 nt, Human
accugcggcccaaucc

SEQ ID NO: 3812632 - RNA, 16 nt, Human
accugcggcugcugug

SEQ ID NO: 3812633 - RNA, 21 nt, Human
accugcuagacacauuuuuaa

SEQ ID NO: 3812634 - RNA, 22 nt, Human
accugcuaggccagagcccacu

SEQ ID NO: 3812635 - RNA, 17 nt, Human
accugcucagcccugca

SEQ ID NO: 3812636 - RNA, 18 nt, Human
accugcuccgcugcuccu

SEQ ID NO: 3812637 - RNA, 17 nt, Human
accugcucuccucuugc

SEQ ID NO: 3812638 - RNA, 16 nt, Human
accugcucucuuguaa

SEQ ID NO: 3812639 - RNA, 19 nt, Human
accugcugagagacccaag

SEQ ID NO: 3812640 - RNA, 22 nt, Human
accugcugagagacccaaggag

SEQ ID NO: 3812641 - RNA, 13 nt, Human
accugcugagcuc

SEQ ID NO: 3812642 - RNA, 17 nt, Human
accugcugagcucugag

SEQ ID NO: 3812643 - RNA, 19 nt, Human
accugcugagcucugagag

SEQ ID NO: 3812644 - RNA, 23 nt, Human
accugcugagcucugagaggccc

SEQ ID NO: 3812645 - RNA, 20 nt, Human
accugcugagggaccagcca

SEQ ID NO: 3812646 - RNA, 13 nt, Human
accugcugcuucu

SEQ ID NO: 3812647 - RNA, 21 nt, Human
accugcugugauacgaugcuu

SEQ ID NO: 3812648 - RNA, 13 nt, Human
accugcuuuuuga

SEQ ID NO: 3812649 - RNA, 23 nt, Human
accuggaagaacaggccucucca

SEQ ID NO: 3812650 - RNA, 19 nt, Human
accuggaaggcccagcacc

SEQ ID NO: 3812651 - RNA, 21 nt, Human
accuggaagggcuagaaccug

SEQ ID NO: 3812652 - RNA, 18 nt, Human
agacaguuucuuagcuuu

SEQ ID NO: 3812653 - RNA, 20 nt, Human
agacaguuucuuagcuuuuu

SEQ ID NO: 3812654 - RNA, 22 nt, Human
agacaguuucuuagcuuuuuaa

SEQ ID NO: 3812655 - RNA, 11 nt, Human
agacaguuugu

SEQ ID NO: 3812656 - RNA, 17 nt, Human
agacaguuuguaaaugu

SEQ ID NO: 3812657 - RNA, 17 nt, Human
agacauaacguuuuucc

SEQ ID NO: 3812658 - RNA, 20 nt, Human
agacauaacguuuuuccuuu

SEQ ID NO: 3812659 - RNA, 15 nt, Human
agacauacccucccu

SEQ ID NO: 3812660 - RNA, 16 nt, Human
agacauacuugaaggg

SEQ ID NO: 3812661 - RNA, 20 nt, Human
agacauacuugaagggccag

SEQ ID NO: 3812662 - RNA, 23 nt, Human
agacauacuugaagggccagagc

SEQ ID NO: 3812663 - RNA, 13 nt, Human
agacauaucucua

SEQ ID NO: 3812664 - RNA, 14 nt, Human
agacauauuuaacu

SEQ ID NO: 3812665 - RNA, 14 nt, Human
agacaucagcccuu

SEQ ID NO: 3812666 - RNA, 16 nt, Human
agacaucagcccuugg

SEQ ID NO: 3812667 - RNA, 22 nt, Human
agacauccaaauuuuuuuuuaa

SEQ ID NO: 3812668 - RNA, 15 nt, Human
agacauccauaaaga

SEQ ID NO: 3812669 - RNA, 14 nt, Human
agacaucucugcac

SEQ ID NO: 3812670 - RNA, 17 nt, Human
agacaugaauaugauua

SEQ ID NO: 3812671 - RNA, 17 nt, Human
agacaugaaugcacacu

SEQ ID NO: 3812672 - RNA, 19 nt, Human
agacaugcagccuaaggcu

SEQ ID NO: 3812673 - RNA, 15 nt, Human
agacaugcugacuuu

SEQ ID NO: 3812674 - RNA, 18 nt, Human
agacauggagacuccugc

SEQ ID NO: 3812675 - RNA, 16 nt, Human
agacauggagguucua

SEQ ID NO: 3812676 - RNA, 19 nt, Human
agacauggggaggaaggac

SEQ ID NO: 3812677 - RNA, 17 nt, Human
agacauguaauuugugu

SEQ ID NO: 3812678 - RNA, 21 nt, Human
agacauguaauuuguguaaau

SEQ ID NO: 3812679 - RNA, 18 nt, Human
agacaugucuguucuaca

SEQ ID NO: 3812680 - RNA, 15 nt, Human
agacaugugacauuu

SEQ ID NO: 3812681 - RNA, 17 nt, Human
agacauguuuuagacaa

SEQ ID NO: 3812682 - RNA, 19 nt, Human
agacauguuuuagacaaau

SEQ ID NO: 3812683 - RNA, 16 nt, Human
agacauuccaaaacga

SEQ ID NO: 3812684 - RNA, 14 nt, Human
agacauucugccag

SEQ ID NO: 3812685 - RNA, 15 nt, Human
agacauucugccagg

SEQ ID NO: 3812686 - RNA, 12 nt, Human
agacauugcacc

SEQ ID NO: 3812687 - RNA, 22 nt, Human
agacauugggucuauuccagcu

SEQ ID NO: 3812688 - RNA, 17 nt, Human
agacauugucagcaaau

SEQ ID NO: 3812689 - RNA, 23 nt, Human
agacauuuauacucuuuuuucau

SEQ ID NO: 3812690 - RNA, 18 nt, Human
agaccaacguuacucagg

SEQ ID NO: 3812691 - RNA, 11 nt, Human
agaccaaggaa

SEQ ID NO: 3812692 - RNA, 12 nt, Human
agaccaaggaac

SEQ ID NO: 3812693 - RNA, 14 nt, Human
agaccaaggcggga

SEQ ID NO: 3812694 - RNA, 11 nt, Human
agaccaauaaa

SEQ ID NO: 3812695 - RNA, 22 nt, Human
agaccaauuuuuugugugugaa

SEQ ID NO: 3812696 - RNA, 14 nt, Human
agaccacaaauagu

SEQ ID NO: 3812697 - RNA, 21 nt, Human
agaccacaaauagugcucgcu

SEQ ID NO: 3812698 - RNA, 13 nt, Human
agaccaccaagcc

SEQ ID NO: 3812699 - RNA, 16 nt, Human
agaccaccaccucaga

SEQ ID NO: 3812700 - RNA, 17 nt, Human
agaccacccauaucaug

SEQ ID NO: 3812701 - RNA, 18 nt, Human
agaccacccauaucaugc

SEQ ID NO: 3812702 - RNA, 17 nt, Human
agaccaccucucaauau

SEQ ID NO: 3812703 - RNA, 21 nt, Human
agaccacgcccguccugccug

SEQ ID NO: 3812704 - RNA, 24 nt, Human
agaccacgcccguccugccugugg

SEQ ID NO: 3812705 - RNA, 14 nt, Human
agaccacguuucua

SEQ ID NO: 3812706 - RNA, 15 nt, Human
agaccacguuucuaa

SEQ ID NO: 3812707 - RNA, 12 nt, Human
agaccagaaauu

SEQ ID NO: 3812708 - RNA, 14 nt, Human
agaccagacugugg

SEQ ID NO: 3812709 - RNA, 16 nt, Human
agaccagacuguggag

SEQ ID NO: 3812710 - RNA, 22 nt, Human
agaccagacuguggagaaauaa

SEQ ID NO: 3812711 - RNA, 12 nt, Human
agaccagagcuc

SEQ ID NO: 3812712 - RNA, 19 nt, Human
agaccagagcucuggagcc

SEQ ID NO: 3812713 - RNA, 13 nt, Human
agaccagccuggc

SEQ ID NO: 3812714 - RNA, 12 nt, Human
agaccagcucuu

SEQ ID NO: 3812715 - RNA, 16 nt, Human
agaccaggcaaagcaa

SEQ ID NO: 3812716 - RNA, 15 nt, Human
agaccagggagccuu

SEQ ID NO: 3812717 - RNA, 14 nt, Human
agaccagucuggcc

SEQ ID NO: 3812718 - RNA, 16 nt, Human
agaccagugcuuagca

SEQ ID NO: 3812719 - RNA, 13 nt, Human
agaccaguuggga

SEQ ID NO: 3812720 - RNA, 14 nt, Human
agaccaucccugaa

SEQ ID NO: 3812721 - RNA, 21 nt, Human
agaccauccuggccaacauga

SEQ ID NO: 3812722 - RNA, 17 nt, Human
agaccaugcagagcgcc

SEQ ID NO: 3812723 - RNA, 23 nt, Human
agaccauggacacuacacccagc

SEQ ID NO: 3812724 - RNA, 23 nt, Human
agaccauuggggcucccagccag

SEQ ID NO: 3812725 - RNA, 16 nt, Human
agaccauuuaacaugc

SEQ ID NO: 3812726 - RNA, 18 nt, Human
agaccauuuaacaugcaa

SEQ ID NO: 3812727 - RNA, 17 nt, Human
agacccaaaaggcagaa

SEQ ID NO: 3812728 - RNA, 16 nt, Human
agacccaccccaccug

SEQ ID NO: 3812729 - RNA, 19 nt, Human
agacccaccccaccugcag

SEQ ID NO: 3812730 - RNA, 11 nt, Human
agacccaggac

SEQ ID NO: 3812731 - RNA, 13 nt, Human
agacccaggacuc

SEQ ID NO: 3812732 - RNA, 14 nt, Human
agacccaggacucc

SEQ ID NO: 3812733 - RNA, 19 nt, Human
agaccccaagaggaaguuc

SEQ ID NO: 3812734 - RNA, 20 nt, Human
agaccccacccaagcuuggc

SEQ ID NO: 3812735 - RNA, 17 nt, Human
agaccccaccuccuugg

SEQ ID NO: 3812736 - RNA, 14 nt, Human
agacccccacaccu

SEQ ID NO: 3812737 - RNA, 11 nt, Human
agacccccacc

SEQ ID NO: 3812738 - RNA, 14 nt, Human
agacccccaccccu

SEQ ID NO: 3812739 - RNA, 16 nt, Human
agacccccaccccuuc

SEQ ID NO: 3812740 - RNA, 19 nt, Human
agacccccaccccuucccc

SEQ ID NO: 3812741 - RNA, 20 nt, Human
agacccccaccccuucccca

SEQ ID NO: 3812742 - RNA, 14 nt, Human
agacccccuggaga

SEQ ID NO: 3812743 - RNA, 21 nt, Human
agaccccggcuuccuuuccca

SEQ ID NO: 3812744 - RNA, 19 nt, Human
agaccccucuggccaggau

SEQ ID NO: 3812745 - RNA, 14 nt, Human
agaccccuggccuc

SEQ ID NO: 3812746 - RNA, 14 nt, Human
agaccccuggcuuu

SEQ ID NO: 3812747 - RNA, 15 nt, Human
agaccccuggcuuuu

SEQ ID NO: 3812748 - RNA, 14 nt, Human
agaccccugucucc

SEQ ID NO: 3812749 - RNA, 17 nt, Human
agacccuaaaucugagg

SEQ ID NO: 3812750 - RNA, 19 nt, Human
agacccuaagccuccuuuu

SEQ ID NO: 3812751 - RNA, 19 nt, Human
agacccucaugcugccaau

SEQ ID NO: 3812752 - RNA, 15 nt, Human
agacccucugccacc

SEQ ID NO: 3812753 - RNA, 14 nt, Human
agacccucuugccc

SEQ ID NO: 3812754 - RNA, 20 nt, Human
agacccugcaaacagaacag

SEQ ID NO: 3812755 - RNA, 21 nt, Human
agacccugcaaacagaacagg

SEQ ID NO: 3812756 - RNA, 22 nt, Human
agacccugcaaacagaacaggg

SEQ ID NO: 3812757 - RNA, 21 nt, Human
agacccugcccugugggcccc

SEQ ID NO: 3812758 - RNA, 14 nt, Human
agacccuggaggcc

SEQ ID NO: 3812759 - RNA, 18 nt, Human
agacccuggugccuggcu

SEQ ID NO: 3812760 - RNA, 19 nt, Human
agacccuggugccuggcuc

SEQ ID NO: 3812761 - RNA, 22 nt, Human
agacccuuauugcuguccugga

SEQ ID NO: 3812762 - RNA, 18 nt, Human
agacccuugacaccugcu

SEQ ID NO: 3812763 - RNA, 15 nt, Human
agacccuuguggucc

SEQ ID NO: 3812764 - RNA, 19 nt, Human
agacccuuuuggguuucug

SEQ ID NO: 3812765 - RNA, 14 nt, Human
agaccgcucucuuu

SEQ ID NO: 3812766 - RNA, 19 nt, Human
agaccggccugccaggagg

SEQ ID NO: 3812767 - RNA, 17 nt, Human
agaccgggcccuggguu

SEQ ID NO: 3812768 - RNA, 18 nt, Human
agaccgucgggggcugag

SEQ ID NO: 3812769 - RNA, 13 nt, Human
agaccgucuuccu

SEQ ID NO: 3812770 - RNA, 15 nt, Human
agaccgucuuccucc

SEQ ID NO: 3812771 - RNA, 19 nt, Human
agaccgugaagauacuuug

SEQ ID NO: 3812772 - RNA, 20 nt, Human
agaccguuauaaagugugcc

SEQ ID NO: 3812773 - RNA, 21 nt, Human
agaccguuuaccuagaagaag

SEQ ID NO: 3812774 - RNA, 19 nt, Human
agaccuaaucucuguaaag

SEQ ID NO: 3812775 - RNA, 19 nt, Human
agaccuacagggggucugg

SEQ ID NO: 3812776 - RNA, 15 nt, Human
agaccuaccucaggu

SEQ ID NO: 3812777 - RNA, 23 nt, Human
agaccuaccucagguugcugguu

SEQ ID NO: 3812778 - RNA, 16 nt, Human
agaaugagggccaaga

SEQ ID NO: 3812779 - RNA, 14 nt, Human
agaaugagugaauc

SEQ ID NO: 3812780 - RNA, 14 nt, Human
agaaugaugcacau

SEQ ID NO: 3812781 - RNA, 17 nt, Human
agaaugauuaugaauua

SEQ ID NO: 3812782 - RNA, 15 nt, Human
agaaugcaaccaagu

SEQ ID NO: 3812783 - RNA, 22 nt, Human
agaaugcacaaacagaggccgc

SEQ ID NO: 3812784 - RNA, 19 nt, Human
agaaugcacaagaauggau

SEQ ID NO: 3812785 - RNA, 16 nt, Human
agaaugcacagauaua

SEQ ID NO: 3812786 - RNA, 17 nt, Human
agaaugcacagauauac

SEQ ID NO: 3812787 - RNA, 22 nt, Human
agaaugcacagauauacuuugu

SEQ ID NO: 3812788 - RNA, 23 nt, Human
agaaugcaguacuaacauuuauu

SEQ ID NO: 3812789 - RNA, 12 nt, Human
agaaugcauuga

SEQ ID NO: 3812790 - RNA, 20 nt, Human
agaaugcauugauauuguga

SEQ ID NO: 3812791 - RNA, 21 nt, Human
agaaugcauugauauugugaa

SEQ ID NO: 3812792 - RNA, 11 nt, Human
agaaugcugaa

SEQ ID NO: 3812793 - RNA, 22 nt, Human
agaaugcugcaggacuugagaa

SEQ ID NO: 3812794 - RNA, 18 nt, Human
agaaugcugguuuuccua

SEQ ID NO: 3812795 - RNA, 14 nt, Human
agaaugcuuaauca

SEQ ID NO: 3812796 - RNA, 13 nt, Human
agaauggaaaaga

SEQ ID NO: 3812797 - RNA, 18 nt, Human
agaauggaagagagaaag

SEQ ID NO: 3812798 - RNA, 13 nt, Human
agacaaugucugc

SEQ ID NO: 3812799 - RNA, 20 nt, Human
agacaaugugaaaagaaaaa

SEQ ID NO: 3812800 - RNA, 22 nt, Human
agacaauucuuuauacaacagu

SEQ ID NO: 3812801 - RNA, 17 nt, Human
agacaauuugauacaua

SEQ ID NO: 3812802 - RNA, 18 nt, Human
agacaauuugauacauaa

SEQ ID NO: 3812803 - RNA, 23 nt, Human
agacaauuugauacauaauaaaa

SEQ ID NO: 3812804 - RNA, 12 nt, Human
agacacaaaugc

SEQ ID NO: 3812805 - RNA, 19 nt, Human
agacacaacaacuccuagg

SEQ ID NO: 3812806 - RNA, 19 nt, Human
agacacaacuauuuuucca

SEQ ID NO: 3812807 - RNA, 13 nt, Human
agacacaagccuu

SEQ ID NO: 3812808 - RNA, 14 nt, Human
agacacacacacgc

SEQ ID NO: 3812809 - RNA, 20 nt, Human
agacacacacacgcacgcac

SEQ ID NO: 3812810 - RNA, 12 nt, Human
agacacacauga

SEQ ID NO: 3812811 - RNA, 14 nt, Human
agacacaccugagg

SEQ ID NO: 3812812 - RNA, 17 nt, Human
agacacagaagaggcug

SEQ ID NO: 3812813 - RNA, 12 nt, Human
agacacagacug

SEQ ID NO: 3812814 - RNA, 17 nt, Human
agacacaggauagauaa

SEQ ID NO: 3812815 - RNA, 23 nt, Human
agacacaggauagauaacucuuu

SEQ ID NO: 3812816 - RNA, 13 nt, Human
agacacaggauga

SEQ ID NO: 3812817 - RNA, 16 nt, Human
agacacaggcccggcu

SEQ ID NO: 3812818 - RNA, 13 nt, Human
agacacaggcccu

SEQ ID NO: 3812819 - RNA, 13 nt, Human
agacacaggggac

SEQ ID NO: 3812820 - RNA, 16 nt, Human
agacacauacucauuu

SEQ ID NO: 3812821 - RNA, 20 nt, Human
agacacaugaagguaaauaa

SEQ ID NO: 3812822 - RNA, 21 nt, Human
agacacaugaagguaaauaaa

SEQ ID NO: 3812823 - RNA, 22 nt, Human
agacacauguccaagaagccca

SEQ ID NO: 3812824 - RNA, 18 nt, Human
agacacauuaucuucugg

SEQ ID NO: 3812825 - RNA, 14 nt, Human
agacacauuuaagg

SEQ ID NO: 3812826 - RNA, 20 nt, Human
agacacauuuuuuaggaaau

SEQ ID NO: 3812827 - RNA, 12 nt, Human
agacaccaaagu

SEQ ID NO: 3812828 - RNA, 17 nt, Human
agacaccaaaguucuaa

SEQ ID NO: 3812829 - RNA, 18 nt, Human
agacaccaaaguucuaau

SEQ ID NO: 3812830 - RNA, 15 nt, Human
agacaccagagcaga

SEQ ID NO: 3812831 - RNA, 13 nt, Human
agacacccaggac

SEQ ID NO: 3812832 - RNA, 14 nt, Human
agacacccaggacu

SEQ ID NO: 3812833 - RNA, 21 nt, Human
agacacccucaaccucuucug

SEQ ID NO: 3812834 - RNA, 19 nt, Human
agacaccguucauucaggc

SEQ ID NO: 3812835 - RNA, 14 nt, Human
agacaccucagagc

SEQ ID NO: 3812836 - RNA, 16 nt, Human
agacaccucagagccc

SEQ ID NO: 3812837 - RNA, 21 nt, Human
agacaccugcaccucccccca

SEQ ID NO: 3812838 - RNA, 14 nt, Human
agacaccugguugc

SEQ ID NO: 3812839 - RNA, 21 nt, Human
agacaccuucauuuugagggg

SEQ ID NO: 3812840 - RNA, 18 nt, Human
agacaccuugacagggca

SEQ ID NO: 3812841 - RNA, 19 nt, Human
agacaccuugacagggcac

SEQ ID NO: 3812842 - RNA, 22 nt, Human
agacacgcacggcagccacagc

SEQ ID NO: 3812843 - RNA, 20 nt, Human
agacacggaucugagaaucu

SEQ ID NO: 3812844 - RNA, 20 nt, Human
agacacuccccgaagucuuu

SEQ ID NO: 3812845 - RNA, 16 nt, Human
agacacucugcucugc

SEQ ID NO: 3812846 - RNA, 16 nt, Human
agacacucuggcuggu

SEQ ID NO: 3812847 - RNA, 22 nt, Human
agacacugaaauauacacacag

SEQ ID NO: 3812848 - RNA, 18 nt, Human
agacacugaucuggcugc

SEQ ID NO: 3812849 - RNA, 13 nt, Human
agacacugccugg

SEQ ID NO: 3812850 - RNA, 14 nt, Human
agacacugccuggg

SEQ ID NO: 3812851 - RNA, 15 nt, Human
agacacuggccccuc

SEQ ID NO: 3812852 - RNA, 16 nt, Human
agacacuggccccuca

SEQ ID NO: 3812853 - RNA, 19 nt, Human
agacacuguugauaaaaac

SEQ ID NO: 3812854 - RNA, 18 nt, Human
agacacuguuuacaagaa

SEQ ID NO: 3812855 - RNA, 13 nt, Human
agacacuuccguc

SEQ ID NO: 3812856 - RNA, 15 nt, Human
agacacuugauacuu

SEQ ID NO: 3812857 - RNA, 13 nt, Human
agacacuuuggaa

SEQ ID NO: 3812858 - RNA, 15 nt, Human
agacacuuuggaagu

SEQ ID NO: 3812859 - RNA, 12 nt, Human
agacagaaaaaa

SEQ ID NO: 3812860 - RNA, 15 nt, Human
agacagaaccacagg

SEQ ID NO: 3812861 - RNA, 17 nt, Human
agacagaacuugaaugu

SEQ ID NO: 3812862 - RNA, 14 nt, Human
agacagaagaaaca

SEQ ID NO: 3812863 - RNA, 17 nt, Human
agacagaagaaacaagg

SEQ ID NO: 3812864 - RNA, 15 nt, Human
agacagaagcaggcu

SEQ ID NO: 3812865 - RNA, 22 nt, Human
agacagaaucucgcucugucgc

SEQ ID NO: 3812866 - RNA, 17 nt, Human
agacagaauguaucugu

SEQ ID NO: 3812867 - RNA, 20 nt, Human
agacagaauguaucugugaa

SEQ ID NO: 3812868 - RNA, 15 nt, Human
agacagacacacaca

SEQ ID NO: 3812869 - RNA, 17 nt, Human
agacagacccugaaaag

SEQ ID NO: 3812870 - RNA, 18 nt, Human
agacagagaauaugucug

SEQ ID NO: 3812871 - RNA, 14 nt, Human
agacagagacaagu

SEQ ID NO: 3812872 - RNA, 17 nt, Human
agacagagacaaguaau

SEQ ID NO: 3812873 - RNA, 22 nt, Human
agacagagacccucugccacca

SEQ ID NO: 3812874 - RNA, 13 nt, Human
agacagagccagg

SEQ ID NO: 3812875 - RNA, 14 nt, Human
agacagagccagga

SEQ ID NO: 3812876 - RNA, 21 nt, Human
agacagagccaggagaagcuc

SEQ ID NO: 3812877 - RNA, 16 nt, Human
agacagagccucgcuc

SEQ ID NO: 3812878 - RNA, 20 nt, Human
agacagagucuuacucuguu

SEQ ID NO: 3812879 - RNA, 20 nt, Human
agacagagucuuccucuguc

SEQ ID NO: 3812880 - RNA, 16 nt, Human
agacagauaccuccaa

SEQ ID NO: 3812881 - RNA, 16 nt, Human
agacagaugccccaga

SEQ ID NO: 3812882 - RNA, 16 nt, Human
agacagcagcucaggc

SEQ ID NO: 3812883 - RNA, 16 nt, Human
agacagcauguguuaa

SEQ ID NO: 3812884 - RNA, 22 nt, Human
agacagccaacuauggccugug

SEQ ID NO: 3812885 - RNA, 17 nt, Human
agacagccccagagcag

SEQ ID NO: 3812886 - RNA, 19 nt, Human
agacagccccagagcaggg

SEQ ID NO: 3812887 - RNA, 20 nt, Human
agacagccccagagcagggu

SEQ ID NO: 3812888 - RNA, 22 nt, Human
agacagcccgauccuccccugg

SEQ ID NO: 3812889 - RNA, 15 nt, Human
agacagcccgggcuc

SEQ ID NO: 3812890 - RNA, 21 nt, Human
agacagcuccacccuggccga

SEQ ID NO: 3812891 - RNA, 15 nt, Human
agacagcucccucug

SEQ ID NO: 3812892 - RNA, 14 nt, Human
agacagcuuuucuc

SEQ ID NO: 3812893 - RNA, 15 nt, Human
agacagcuuuucuca

SEQ ID NO: 3812894 - RNA, 18 nt, Human
agacagcuuuucucaacu

SEQ ID NO: 3812895 - RNA, 19 nt, Human
agacagcuuuucucaacug

SEQ ID NO: 3812896 - RNA, 18 nt, Human
agacaggaaagggaaggc

SEQ ID NO: 3812897 - RNA, 21 nt, Human
agacaggacagugcuucagcc

SEQ ID NO: 3812898 - RNA, 14 nt, Human
agacaggaccccug

SEQ ID NO: 3812899 - RNA, 16 nt, Human
agacaggaccuaggau

SEQ ID NO: 3812900 - RNA, 18 nt, Human
agacaggaccugacuauu

SEQ ID NO: 3812901 - RNA, 18 nt, Human
agacaggagaagaaagaa

SEQ ID NO: 3812902 - RNA, 21 nt, Human
agacaggagaagaaagaacua

SEQ ID NO: 3812903 - RNA, 23 nt, Human
agacaggagggcaagggccaugc

SEQ ID NO: 3812904 - RNA, 20 nt, Human
agacaggcaggugaucugcu

SEQ ID NO: 3812905 - RNA, 15 nt, Human
agacaggcccaagag

SEQ ID NO: 3812906 - RNA, 16 nt, Human
agacaggcccaagaga

SEQ ID NO: 3812907 - RNA, 15 nt, Human
agacaggcuggaaga

SEQ ID NO: 3812908 - RNA, 15 nt, Human
agacaggguccugcu

SEQ ID NO: 3812909 - RNA, 16 nt, Human
agacaggguccugcua

SEQ ID NO: 3812910 - RNA, 23 nt, Human
agacaggguuuggcugugucuaa

SEQ ID NO: 3812911 - RNA, 15 nt, Human
agacagguccugauu

SEQ ID NO: 3812912 - RNA, 18 nt, Human
agacaggugcgaaaggau

SEQ ID NO: 3812913 - RNA, 13 nt, Human
agacaguaaguau

SEQ ID NO: 3812914 - RNA, 18 nt, Human
agacaguauauuuauagu

SEQ ID NO: 3812915 - RNA, 20 nt, Human
agacagucaaggaguggcuu

SEQ ID NO: 3812916 - RNA, 15 nt, Human
agacagucacaaauu

SEQ ID NO: 3812917 - RNA, 17 nt, Human
agacagucaccccagga

SEQ ID NO: 3812918 - RNA, 15 nt, Human
agacaguccagccug

SEQ ID NO: 3812919 - RNA, 17 nt, Human
agacaguccagccugga

SEQ ID NO: 3812920 - RNA, 14 nt, Human
agacagucccugcc

SEQ ID NO: 3812921 - RNA, 16 nt, Human
agacagucccugccaa

SEQ ID NO: 3812922 - RNA, 18 nt, Human
agacagugaucuccauau

SEQ ID NO: 3812923 - RNA, 16 nt, Human
agacagugcacaugaa

SEQ ID NO: 3812924 - RNA, 23 nt, Human
agacaguguauguagaagcauga

SEQ ID NO: 3812925 - RNA, 15 nt, Human
agacaguucaagaaa

SEQ ID NO: 3812926 - RNA, 13 nt, Human
agacaguuuguaa

SEQ ID NO: 3812927 - RNA, 15 nt, Human
agacaguuuguaaau

SEQ ID NO: 3812928 - RNA, 18 nt, Human
agacaguuuguaaauguu

SEQ ID NO: 3812929 - RNA, 16 nt, Human
agacaguuuugagaac

SEQ ID NO: 3812930 - RNA, 16 nt, Human
agacauaaaggaaaag

SEQ ID NO: 3812931 - RNA, 16 nt, Human
agacauacgaaacaca

SEQ ID NO: 3812932 - RNA, 14 nt, Human
agacauacuugaag

SEQ ID NO: 3812933 - RNA, 21 nt, Human
agacauacuugaagggccaga

SEQ ID NO: 3812934 - RNA, 15 nt, Human
agacauauuuaacug

SEQ ID NO: 3812935 - RNA, 18 nt, Human
agacaucaacagauaaau

SEQ ID NO: 3812936 - RNA, 20 nt, Human
agacauccaaacuaaaagga

SEQ ID NO: 3812937 - RNA, 18 nt, Human
agacauccauaaagaagc

SEQ ID NO: 3812938 - RNA, 19 nt, Human
agacaucugagguuuuauu

SEQ ID NO: 3812939 - RNA, 13 nt, Human
agacaucuuucuc

SEQ ID NO: 3812940 - RNA, 16 nt, Human
agaccuacuguucuaa

SEQ ID NO: 3812941 - RNA, 17 nt, Human
agaccuacuguucuaaa

SEQ ID NO: 3812942 - RNA, 20 nt, Human
agaccuacuguucuaaagcu

SEQ ID NO: 3812943 - RNA, 19 nt, Human
agaccuagggaggaccuua

SEQ ID NO: 3812944 - RNA, 18 nt, Human
acuagccuuuggcucugg

SEQ ID NO: 3812945 - RNA, 23 nt, Human
acuagcuagaagugggccaggac

SEQ ID NO: 3812946 - RNA, 11 nt, Human
acuagcucuug

SEQ ID NO: 3812947 - RNA, 20 nt, Human
acuagcuuacaugagaacag

SEQ ID NO: 3812948 - RNA, 18 nt, Human
acuaggagaaccaaaucu

SEQ ID NO: 3812949 - RNA, 23 nt, Human
acuaggccuugcggcuccucagg

SEQ ID NO: 3812950 - RNA, 12 nt, Human
acuaggcugggu

SEQ ID NO: 3812951 - RNA, 13 nt, Human
acuaggcugggug

SEQ ID NO: 3812952 - RNA, 21 nt, Human
acuagggaagaaagcagaaca

SEQ ID NO: 3812953 - RNA, 15 nt, Human
acuagggagccaugu

SEQ ID NO: 3812954 - RNA, 19 nt, Human
acuagggagccauuugaga

SEQ ID NO: 3812955 - RNA, 20 nt, Human
acuagggaucccucaucugu

SEQ ID NO: 3812956 - RNA, 16 nt, Human
acuagggauucaggcu

SEQ ID NO: 3812957 - RNA, 16 nt, Human
acuagggccaagccca

SEQ ID NO: 3812958 - RNA, 16 nt, Human
acuaggguccugggga

SEQ ID NO: 3812959 - RNA, 14 nt, Human
acuagguaacuuca

SEQ ID NO: 3812960 - RNA, 16 nt, Human
acuaguacaaauuaua

SEQ ID NO: 3812961 - RNA, 22 nt, Human
acuaguacuguguacuguauag

SEQ ID NO: 3812962 - RNA, 14 nt, Human
acuaguaguucucu

SEQ ID NO: 3812963 - RNA, 15 nt, Human
acuagucugugugcu

SEQ ID NO: 3812964 - RNA, 23 nt, Human
acuagugacaagcuccuggucuu

SEQ ID NO: 3812965 - RNA, 14 nt, Human
acuagugacagcuu

SEQ ID NO: 3812966 - RNA, 15 nt, Human
acuagugacagcuug

SEQ ID NO: 3812967 - RNA, 23 nt, Human
acuaguguacauuucuauaaaua

SEQ ID NO: 3812968 - RNA, 16 nt, Human
acuaguguuuuuuaga

SEQ ID NO: 3812969 - RNA, 13 nt, Human
acuaguuacacau

SEQ ID NO: 3812970 - RNA, 22 nt, Human
acuaguuacacaucuucaacag

SEQ ID NO: 3812971 - RNA, 17 nt, Human
acuaguugugaccuuag

SEQ ID NO: 3812972 - RNA, 17 nt, Human
acuaguuuuaguuuucu

SEQ ID NO: 3812973 - RNA, 17 nt, Human
acuaguuuugugccagc

SEQ ID NO: 3812974 - RNA, 23 nt, Human
acuaguuuuuagaaaagaaagca

SEQ ID NO: 3812975 - RNA, 14 nt, Human
acuaguuuuuccua

SEQ ID NO: 3812976 - RNA, 12 nt, Human
acuauaaagaga

SEQ ID NO: 3812977 - RNA, 19 nt, Human
acuauaacauagaauugca

SEQ ID NO: 3812978 - RNA, 17 nt, Human
acuauaacauauguaca

SEQ ID NO: 3812979 - RNA, 13 nt, Human
acuauaagaacuu

SEQ ID NO: 3812980 - RNA, 19 nt, Human
acuauaagaacuuugagcu

SEQ ID NO: 3812981 - RNA, 12 nt, Human
acuauaauguaa

SEQ ID NO: 3812982 - RNA, 19 nt, Human
acuauaaugugaaauguaa

SEQ ID NO: 3812983 - RNA, 21 nt, Human
acuauaaugugaaauguaacu

SEQ ID NO: 3812984 - RNA, 16 nt, Human
acuauacuugaacaaa

SEQ ID NO: 3812985 - RNA, 17 nt, Human
acuauacuugaacaaaa

SEQ ID NO: 3812986 - RNA, 22 nt, Human
acuauagccuaggugacagagu

SEQ ID NO: 3812987 - RNA, 22 nt, Human
acuauaggcaugcgccaccaug

SEQ ID NO: 3812988 - RNA, 21 nt, Human
acuauaguccagcuuuguucu

SEQ ID NO: 3812989 - RNA, 13 nt, Human
acuauauacaugu

SEQ ID NO: 3812990 - RNA, 12 nt, Human
agagauuucaag

SEQ ID NO: 3812991 - RNA, 14 nt, Human
agagauuuggggcu

SEQ ID NO: 3812992 - RNA, 21 nt, Human
agagauuuggggcuaaagacu

SEQ ID NO: 3812993 - RNA, 14 nt, Human
agagauuugucuaa

SEQ ID NO: 3812994 - RNA, 15 nt, Human
agagauuuucaacau

SEQ ID NO: 3812995 - RNA, 21 nt, Human
agagauuuucaacauuucaaa

SEQ ID NO: 3812996 - RNA, 13 nt, Human
agagauuuuucau

SEQ ID NO: 3812997 - RNA, 23 nt, Human
agagauuuuuuuguuguuuguuu

SEQ ID NO: 3812998 - RNA, 20 nt, Human
agagauuuuuuuuuaaagaa

SEQ ID NO: 3812999 - RNA, 16 nt, Human
agagcaaagggccagg

SEQ ID NO: 3813000 - RNA, 19 nt, Human
agagcaaagggccaggaag

SEQ ID NO: 3813001 - RNA, 18 nt, Human
agagcaaccccuggaccc

SEQ ID NO: 3813002 - RNA, 21 nt, Human
agagcaaccccuggaccccag

SEQ ID NO: 3813003 - RNA, 23 nt, Human
agagcaaccccuggaccccagcc

SEQ ID NO: 3813004 - RNA, 19 nt, Human
agagcaagacgcugugcug

SEQ ID NO: 3813005 - RNA, 16 nt, Human
agagcaagagagcagc

SEQ ID NO: 3813006 - RNA, 17 nt, Human
agagcaagcuuuuuuau

SEQ ID NO: 3813007 - RNA, 23 nt, Human
agagcaaggaagguaaaaaguua

SEQ ID NO: 3813008 - RNA, 16 nt, Human
agagcaagucugcagg

SEQ ID NO: 3813009 - RNA, 16 nt, Human
agagcacaaacauuuu

SEQ ID NO: 3813010 - RNA, 17 nt, Human
agagcacaaacauuuuu

SEQ ID NO: 3813011 - RNA, 20 nt, Human
agagcacacuuggcccaagu

SEQ ID NO: 3813012 - RNA, 16 nt, Human
agagcacagcccuccc

SEQ ID NO: 3813013 - RNA, 17 nt, Human
agagcaccccucucugc

SEQ ID NO: 3813014 - RNA, 23 nt, Human
agagcaccuuagacagucccugc

SEQ ID NO: 3813015 - RNA, 20 nt, Human
agagcaccuuccucacuucc

SEQ ID NO: 3813016 - RNA, 21 nt, Human
agagcacgccuguacuagagc

SEQ ID NO: 3813017 - RNA, 15 nt, Human
agagcacugccacca

SEQ ID NO: 3813018 - RNA, 18 nt, Human
agagcacugccaccagua

SEQ ID NO: 3813019 - RNA, 21 nt, Human
agagcacuuaagagaauauuu

SEQ ID NO: 3813020 - RNA, 17 nt, Human
agagcagagaccauccc

SEQ ID NO: 3813021 - RNA, 14 nt, Human
agagcagaggcagc

SEQ ID NO: 3813022 - RNA, 12 nt, Human
agagcagagguc

SEQ ID NO: 3813023 - RNA, 14 nt, Human
agagcagaugcaga

SEQ ID NO: 3813024 - RNA, 23 nt, Human
agagcagcaccuccucagccuga

SEQ ID NO: 3813025 - RNA, 19 nt, Human
agagcagcagugaaaacaa

SEQ ID NO: 3813026 - RNA, 16 nt, Human
agagcagccuguggca

SEQ ID NO: 3813027 - RNA, 23 nt, Human
agagcagcggggcgaagcccagg

SEQ ID NO: 3813028 - RNA, 23 nt, Human
agagcagcuucugccacuuccca

SEQ ID NO: 3813029 - RNA, 13 nt, Human
agagcaggacucc

SEQ ID NO: 3813030 - RNA, 21 nt, Human
agagcaggacuccaggcccaa

SEQ ID NO: 3813031 - RNA, 17 nt, Human
agagcaggacugauguc

SEQ ID NO: 3813032 - RNA, 22 nt, Human
agagcaggacugaugucuccua

SEQ ID NO: 3813033 - RNA, 15 nt, Human
agagcaggaggcccc

SEQ ID NO: 3813034 - RNA, 22 nt, Human
agagcaggaggccccuggccca

SEQ ID NO: 3813035 - RNA, 19 nt, Human
agagcaggcacauggagga

SEQ ID NO: 3813036 - RNA, 15 nt, Human
agagcagugcuuuug

SEQ ID NO: 3813037 - RNA, 19 nt, Human
agagcaguugagaggacac

SEQ ID NO: 3813038 - RNA, 23 nt, Human
agagcaguuucuguccugcuggu

SEQ ID NO: 3813039 - RNA, 21 nt, Human
agagcaguuugguuucuagca

SEQ ID NO: 3813040 - RNA, 20 nt, Human
agagcauaauuuaaaaauau

SEQ ID NO: 3813041 - RNA, 19 nt, Human
agagcaucaggccuagagg

SEQ ID NO: 3813042 - RNA, 16 nt, Human
agagcaucggccuagg

SEQ ID NO: 3813043 - RNA, 14 nt, Human
agagcaugaaauuu

SEQ ID NO: 3813044 - RNA, 22 nt, Human
agagcauuacgugagccaggua

SEQ ID NO: 3813045 - RNA, 18 nt, Human
agagcauuccagucaggc

SEQ ID NO: 3813046 - RNA, 19 nt, Human
agagcauuccagucaggcu

SEQ ID NO: 3813047 - RNA, 12 nt, Human
agagccacacau

SEQ ID NO: 3813048 - RNA, 13 nt, Human
agagccacacaug

SEQ ID NO: 3813049 - RNA, 14 nt, Human
agagccacacaugg

SEQ ID NO: 3813050 - RNA, 11 nt, Human
agagccacagu

SEQ ID NO: 3813051 - RNA, 16 nt, Human
agagccagagaaguga

SEQ ID NO: 3813052 - RNA, 21 nt, Human
agagccagagaagugacaggg

SEQ ID NO: 3813053 - RNA, 16 nt, Human
agagccagcccucccu

SEQ ID NO: 3813054 - RNA, 21 nt, Human
agagccagcuaaggggugggg

SEQ ID NO: 3813055 - RNA, 12 nt, Human
agagccagcuug

SEQ ID NO: 3813056 - RNA, 12 nt, Human
agagccaggaga

SEQ ID NO: 3813057 - RNA, 22 nt, Human
agagccaggagaagcucagcug

SEQ ID NO: 3813058 - RNA, 15 nt, Human
agagccauacauaaa

SEQ ID NO: 3813059 - RNA, 18 nt, Human
agagccauacauaaaaga

SEQ ID NO: 3813060 - RNA, 19 nt, Human
agagccauacauaaaagaa

SEQ ID NO: 3813061 - RNA, 13 nt, Human
agagcccacgccc

SEQ ID NO: 3813062 - RNA, 22 nt, Human
agagcccagagguaacagaaca

SEQ ID NO: 3813063 - RNA, 22 nt, Human
agagcccagaguccccccacuc

SEQ ID NO: 3813064 - RNA, 12 nt, Human
agagcccagcuc

SEQ ID NO: 3813065 - RNA, 14 nt, Human
agagcccagcucca

SEQ ID NO: 3813066 - RNA, 15 nt, Human
agagcccaggccucc

SEQ ID NO: 3813067 - RNA, 20 nt, Human
agagcccaggcucggccugc

SEQ ID NO: 3813068 - RNA, 15 nt, Human
agagccccacacgga

SEQ ID NO: 3813069 - RNA, 13 nt, Human
agagccccacucu

SEQ ID NO: 3813070 - RNA, 22 nt, Human
agagccccgcaaaacccacuga

SEQ ID NO: 3813071 - RNA, 22 nt, Human
agagcccgaggaggugucucag

SEQ ID NO: 3813072 - RNA, 17 nt, Human
agagcccgggagcugcu

SEQ ID NO: 3813073 - RNA, 14 nt, Human
agagcccugaggcc

SEQ ID NO: 3813074 - RNA, 15 nt, Human
agagcccugggaccg

SEQ ID NO: 3813075 - RNA, 17 nt, Human
agagcccugggaccgcu

SEQ ID NO: 3813076 - RNA, 19 nt, Human
agagcccugucaguagagu

SEQ ID NO: 3813077 - RNA, 16 nt, Human
agagccgggaagcgau

SEQ ID NO: 3813078 - RNA, 19 nt, Human
agagccguaaaaacugaag

SEQ ID NO: 3813079 - RNA, 17 nt, Human
agagccgugaugccucc

SEQ ID NO: 3813080 - RNA, 21 nt, Human
agagccucccaaggagaacaa

SEQ ID NO: 3813081 - RNA, 20 nt, Human
agagccuccuuucuggcuuu

SEQ ID NO: 3813082 - RNA, 11 nt, Human
agagccugagg

SEQ ID NO: 3813083 - RNA, 19 nt, Human
agagccugaucucuuccug

SEQ ID NO: 3813084 - RNA, 16 nt, Human
agagccugcaggaucu

SEQ ID NO: 3813085 - RNA, 17 nt, Human
agagccugcaggaucuc

SEQ ID NO: 3813086 - RNA, 18 nt, Human
agagccugcaggugcugc

SEQ ID NO: 3813087 - RNA, 19 nt, Human
agagccugccccagcgcug

SEQ ID NO: 3813088 - RNA, 22 nt, Human
acucaaagcaugggauuauuag

SEQ ID NO: 3813089 - RNA, 14 nt, Human
acucaaaggccaga

SEQ ID NO: 3813090 - RNA, 20 nt, Human
acucaaaguuucagagacca

SEQ ID NO: 3813091 - RNA, 19 nt, Human
acucaaauacacauuugcu

SEQ ID NO: 3813092 - RNA, 23 nt, Human
acucaaauaugaguacaaaugcc

SEQ ID NO: 3813093 - RNA, 16 nt, Human
acucaaaugaguaaca

SEQ ID NO: 3813094 - RNA, 21 nt, Human
acucaaaugcucagaccagcu

SEQ ID NO: 3813095 - RNA, 12 nt, Human
acucaaaugcuu

SEQ ID NO: 3813096 - RNA, 19 nt, Human
acucaaaugcuuggcuucu

SEQ ID NO: 3813097 - RNA, 22 nt, Human
acucaaaugcuuggcuucucau

SEQ ID NO: 3813098 - RNA, 17 nt, Human
acucaaauggggccaga

SEQ ID NO: 3813099 - RNA, 22 nt, Human
acucaaauggggccagauccag

SEQ ID NO: 3813100 - RNA, 23 nt, Human
acucaaauggggccagauccagc

SEQ ID NO: 3813101 - RNA, 20 nt, Human
acucaaaugugaguguuuuu

SEQ ID NO: 3813102 - RNA, 22 nt, Human
acucaaauguucuaaguuucua

SEQ ID NO: 3813103 - RNA, 16 nt, Human
acucaacaugagucaa

SEQ ID NO: 3813104 - RNA, 21 nt, Human
acucaaccaaaugguacaaaa

SEQ ID NO: 3813105 - RNA, 23 nt, Human
acucaaccuuaagaccuacuguu

SEQ ID NO: 3813106 - RNA, 13 nt, Human
acucaagaagcag

SEQ ID NO: 3813107 - RNA, 23 nt, Human
acucaagaagugaagaaugcaca

SEQ ID NO: 3813108 - RNA, 12 nt, Human
acucaagcacug

SEQ ID NO: 3813109 - RNA, 14 nt, Human
acucaagccaagca

SEQ ID NO: 3813110 - RNA, 21 nt, Human
acucaagcggguggcucuggg

SEQ ID NO: 3813111 - RNA, 17 nt, Human
acucaaggacuuugcag

SEQ ID NO: 3813112 - RNA, 19 nt, Human
acucaagguucccagagau

SEQ ID NO: 3813113 - RNA, 16 nt, Human
acucaaguagcauuua

SEQ ID NO: 3813114 - RNA, 22 nt, Human
acucaagugucucaguccaccu

SEQ ID NO: 3813115 - RNA, 23 nt, Human
acucaagugucucaguccaccug

SEQ ID NO: 3813116 - RNA, 18 nt, Human
acucaaguugucucuuua

SEQ ID NO: 3813117 - RNA, 15 nt, Human
acucaauaaaaucau

SEQ ID NO: 3813118 - RNA, 18 nt, Human
acucaauauuuuccauga

SEQ ID NO: 3813119 - RNA, 21 nt, Human
acucaauauuuuccaugaaaa

SEQ ID NO: 3813120 - RNA, 23 nt, Human
acucaaucuccccuugcacuaaa

SEQ ID NO: 3813121 - RNA, 21 nt, Human
acucaaugcuuuauuuguaaa

SEQ ID NO: 3813122 - RNA, 23 nt, Human
acucaaugcuuuauuuguaaauu

SEQ ID NO: 3813123 - RNA, 16 nt, Human
acucaauuucucccca

SEQ ID NO: 3813124 - RNA, 17 nt, Human
acucaauuucuccccag

SEQ ID NO: 3813125 - RNA, 13 nt, Human
acucacaaaugau

SEQ ID NO: 3813126 - RNA, 17 nt, Human
acucacaacagcugccu

SEQ ID NO: 3813127 - RNA, 14 nt, Human
acucacaagaagac

SEQ ID NO: 3813128 - RNA, 18 nt, Human
acucacaagaagaccaga

SEQ ID NO: 3813129 - RNA, 21 nt, Human
acucacaagaagaccagacug

SEQ ID NO: 3813130 - RNA, 22 nt, Human
acucacacaggacccccuuccc

SEQ ID NO: 3813131 - RNA, 21 nt, Human
acucacaccugaacugaacac

SEQ ID NO: 3813132 - RNA, 14 nt, Human
acucacagaccugg

SEQ ID NO: 3813133 - RNA, 17 nt, Human
acucacagagucaaggc

SEQ ID NO: 3813134 - RNA, 19 nt, Human
acucacagagucaaggccu

SEQ ID NO: 3813135 - RNA, 22 nt, Human
acucacagagucaaggccugcu

SEQ ID NO: 3813136 - RNA, 18 nt, Human
acucacagccagcgaacu

SEQ ID NO: 3813137 - RNA, 22 nt, Human
acucacagccagcgaacugaca

SEQ ID NO: 3813138 - RNA, 23 nt, Human
acucacagguuggaagagaauca

SEQ ID NO: 3813139 - RNA, 16 nt, Human
acucacagugcuuuua

SEQ ID NO: 3813140 - RNA, 14 nt, Human
acucacaucuuuuu

SEQ ID NO: 3813141 - RNA, 13 nt, Human
acucacaugacac

SEQ ID NO: 3813142 - RNA, 18 nt, Human
acucacaugcuggacagg

SEQ ID NO: 3813143 - RNA, 19 nt, Human
acucacauggcuauguuuu

SEQ ID NO: 3813144 - RNA, 17 nt, Human
acucacauuagagaaca

SEQ ID NO: 3813145 - RNA, 20 nt, Human
acucacauuuauucugcuca

SEQ ID NO: 3813146 - RNA, 23 nt, Human
acucaccagccccacugccagca

SEQ ID NO: 3813147 - RNA, 11 nt, Human
agagcugggug

SEQ ID NO: 3813148 - RNA, 19 nt, Human
agagcugggugucaagagg

SEQ ID NO: 3813149 - RNA, 21 nt, Human
agagcugguaguuaguagcau

SEQ ID NO: 3813150 - RNA, 15 nt, Human
agagcuggugcccgg

SEQ ID NO: 3813151 - RNA, 16 nt, Human
agagcuggugcccgga

SEQ ID NO: 3813152 - RNA, 12 nt, Human
agagcuggugcg

SEQ ID NO: 3813153 - RNA, 17 nt, Human
agagcuguauuaagcca

SEQ ID NO: 3813154 - RNA, 19 nt, Human
agagcuguauuaagccacu

SEQ ID NO: 3813155 - RNA, 22 nt, Human
agagcuguucaacaucacugaa

SEQ ID NO: 3813156 - RNA, 13 nt, Human
agagcuuagaaac

SEQ ID NO: 3813157 - RNA, 18 nt, Human
agagcuuagggucucagg

SEQ ID NO: 3813158 - RNA, 12 nt, Human
agagcuucccug

SEQ ID NO: 3813159 - RNA, 19 nt, Human
agagcuucuguugcugccu

SEQ ID NO: 3813160 - RNA, 22 nt, Human
agagcuucuuccaggugcccag

SEQ ID NO: 3813161 - RNA, 13 nt, Human
agagcuuggacug

SEQ ID NO: 3813162 - RNA, 12 nt, Human
agagcuuucuuu

SEQ ID NO: 3813163 - RNA, 16 nt, Human
agagcuuucuuucaca

SEQ ID NO: 3813164 - RNA, 14 nt, Human
agagcuuuucagau

SEQ ID NO: 3813165 - RNA, 17 nt, Human
agaggaaaaugaauaau

SEQ ID NO: 3813166 - RNA, 20 nt, Human
agaggaaauauugcuggggu

SEQ ID NO: 3813167 - RNA, 11 nt, Human
agaggaaauca

SEQ ID NO: 3813168 - RNA, 14 nt, Human
agaggaaaucugua

SEQ ID NO: 3813169 - RNA, 21 nt, Human
agaggaaaucuguaacaggua

SEQ ID NO: 3813170 - RNA, 19 nt, Human
agaggaacuccuuggccua

SEQ ID NO: 3813171 - RNA, 21 nt, Human
agaggaacuccuuggccuagc

SEQ ID NO: 3813172 - RNA, 15 nt, Human
agaggaaggggccag

SEQ ID NO: 3813173 - RNA, 18 nt, Human
agaggaaggggccagagg

SEQ ID NO: 3813174 - RNA, 23 nt, Human
agaggaaggggccagaggcucgu

SEQ ID NO: 3813175 - RNA, 24 nt, Human
agaggaaucagacuucacacugca

SEQ ID NO: 3813176 - RNA, 21 nt, Human
agaggaauccuggcagcccag

SEQ ID NO: 3813177 - RNA, 15 nt, Human
agaggaaugaaaaaa

SEQ ID NO: 3813178 - RNA, 17 nt, Human
agaggaaugaaaaaagc

SEQ ID NO: 3813179 - RNA, 18 nt, Human
agaggaaugaaaaaagcu

SEQ ID NO: 3813180 - RNA, 12 nt, Human
agaggaccagca

SEQ ID NO: 3813181 - RNA, 14 nt, Human
agaggacgugggcg

SEQ ID NO: 3813182 - RNA, 22 nt, Human
agaggacuguagggagggcggc

SEQ ID NO: 3813183 - RNA, 14 nt, Human
agaggacuuuucuu

SEQ ID NO: 3813184 - RNA, 21 nt, Human
agaggacuuuucuuuguggcu

SEQ ID NO: 3813185 - RNA, 23 nt, Human
agaggacuuuucuuuguggcuuc

SEQ ID NO: 3813186 - RNA, 14 nt, Human
agaggagaaacaca

SEQ ID NO: 3813187 - RNA, 11 nt, Human
agaggagagag

SEQ ID NO: 3813188 - RNA, 17 nt, Human
agaggagagaggcagag

SEQ ID NO: 3813189 - RNA, 15 nt, Human
agaggagagccagag

SEQ ID NO: 3813190 - RNA, 13 nt, Human
agaggagaggggc

SEQ ID NO: 3813191 - RNA, 17 nt, Human
agaggagccaccaguuc

SEQ ID NO: 3813192 - RNA, 13 nt, Human
agaggagcccugc

SEQ ID NO: 3813193 - RNA, 15 nt, Human
agaggagcccugccu

SEQ ID NO: 3813194 - RNA, 22 nt, Human
agaggagccuuuuuaaaacaca

SEQ ID NO: 3813195 - RNA, 23 nt, Human
agaggagggcagcagaagggggu

SEQ ID NO: 3813196 - RNA, 21 nt, Human
agaggagggcgugacucaccc

SEQ ID NO: 3813197 - RNA, 14 nt, Human
agaggaggggccgc

SEQ ID NO: 3813198 - RNA, 14 nt, Human
agaggagugcuugu

SEQ ID NO: 3813199 - RNA, 15 nt, Human
agaggaguucaauga

SEQ ID NO: 3813200 - RNA, 18 nt, Human
agaggauaauuagcaucu

SEQ ID NO: 3813201 - RNA, 16 nt, Human
agaggauggccagugu

SEQ ID NO: 3813202 - RNA, 21 nt, Human
agaggauggucuuacagcagg

SEQ ID NO: 3813203 - RNA, 22 nt, Human
agaggauuagguuccauccuuu

SEQ ID NO: 3813204 - RNA, 18 nt, Human
agaggauuuuuuucugag

SEQ ID NO: 3813205 - RNA, 21 nt, Human
agaggauuuuuuucugagcga

SEQ ID NO: 3813206 - RNA, 24 nt, Human
agaggcaccacuaaaagaucgcag

SEQ ID NO: 3813207 - RNA, 11 nt, Human
agaggcaccag

SEQ ID NO: 3813208 - RNA, 13 nt, Human
agaggcaccagga

SEQ ID NO: 3813209 - RNA, 18 nt, Human
agaggcaccugucccaga

SEQ ID NO: 3813210 - RNA, 14 nt, Human
agaggcagagaaag

SEQ ID NO: 3813211 - RNA, 17 nt, Human
agaggcagagaaagaag

SEQ ID NO: 3813212 - RNA, 21 nt, Human
agaggcagagaaagaagagac

SEQ ID NO: 3813213 - RNA, 22 nt, Human
agaggcagagaaagaagagaca

SEQ ID NO: 3813214 - RNA, 12 nt, Human
agaggcagagag

SEQ ID NO: 3813215 - RNA, 15 nt, Human
agaggcagagagcgg

SEQ ID NO: 3813216 - RNA, 23 nt, Human
agaggcagagagcggucucaggc

SEQ ID NO: 3813217 - RNA, 13 nt, Human
agaggcagcccag

SEQ ID NO: 3813218 - RNA, 19 nt, Human
agaggcagcccaggaaguc

SEQ ID NO: 3813219 - RNA, 19 nt, Human
agaggcagccccauucugc

SEQ ID NO: 3813220 - RNA, 16 nt, Human
agaggcagcccgcaca

SEQ ID NO: 3813221 - RNA, 13 nt, Human
agaggcagggucu

SEQ ID NO: 3813222 - RNA, 18 nt, Human
agaggcaguugcccagcc

SEQ ID NO: 3813223 - RNA, 22 nt, Human
agaggcaguugcccagccucuu

SEQ ID NO: 3813224 - RNA, 21 nt, Human
agaggcaugggcuugcugugg

SEQ ID NO: 3813225 - RNA, 14 nt, Human
agaggcauuucccc

SEQ ID NO: 3813226 - RNA, 19 nt, Human
agaggccaacacugugggu

SEQ ID NO: 3813227 - RNA, 13 nt, Human
agaggccaaugcc

SEQ ID NO: 3813228 - RNA, 18 nt, Human
agaggccacauuacuaga

SEQ ID NO: 3813229 - RNA, 17 nt, Human
agaggccagccccaccc

SEQ ID NO: 3813230 - RNA, 18 nt, Human
agaggccagccccaccca

SEQ ID NO: 3813231 - RNA, 17 nt, Human
agauccccguuccugac

SEQ ID NO: 3813232 - RNA, 14 nt, Human
agauccccugagcc

SEQ ID NO: 3813233 - RNA, 15 nt, Human
agaucccgccucuuc

SEQ ID NO: 3813234 - RNA, 22 nt, Human
agaucccgccucuucuucuuca

SEQ ID NO: 3813235 - RNA, 22 nt, Human
agauccuaaaacaaaagcucau

SEQ ID NO: 3813236 - RNA, 14 nt, Human
agauccuaagaugu

SEQ ID NO: 3813237 - RNA, 21 nt, Human
agauccuaagggucgaaagcu

SEQ ID NO: 3813238 - RNA, 15 nt, Human
agauccuaccccuga

SEQ ID NO: 3813239 - RNA, 13 nt, Human
agauccuccucau

SEQ ID NO: 3813240 - RNA, 12 nt, Human
agauccuccugc

SEQ ID NO: 3813241 - RNA, 16 nt, Human
agauccucucuggggc

SEQ ID NO: 3813242 - RNA, 17 nt, Human
agauccugcgggugggg

SEQ ID NO: 3813243 - RNA, 18 nt, Human
agauccugcggguggggc

SEQ ID NO: 3813244 - RNA, 21 nt, Human
agauccugucuuuaaggaaaa

SEQ ID NO: 3813245 - RNA, 13 nt, Human
agauccugugagg

SEQ ID NO: 3813246 - RNA, 15 nt, Human
agauccugugaggag

SEQ ID NO: 3813247 - RNA, 15 nt, Human
agauccuuccuuuug

SEQ ID NO: 3813248 - RNA, 18 nt, Human
agauccuuguuucaaaca

SEQ ID NO: 3813249 - RNA, 20 nt, Human
agaucgagaccauccuggcu

SEQ ID NO: 3813250 - RNA, 21 nt, Human
agaucgagaccauccuggcua

SEQ ID NO: 3813251 - RNA, 14 nt, Human
agaucgcaguuugc

SEQ ID NO: 3813252 - RNA, 15 nt, Human
agaucgcaguuugcc

SEQ ID NO: 3813253 - RNA, 15 nt, Human
agaucgcgccacugc

SEQ ID NO: 3813254 - RNA, 20 nt, Human
agaucgcgccacugcacucc

SEQ ID NO: 3813255 - RNA, 18 nt, Human
agaucgguuaacaaauaa

SEQ ID NO: 3813256 - RNA, 16 nt, Human
agaucguuaguaucua

SEQ ID NO: 3813257 - RNA, 13 nt, Human
agaucuaaaaaua

SEQ ID NO: 3813258 - RNA, 11 nt, Human
agaucuaaaua

SEQ ID NO: 3813259 - RNA, 13 nt, Human
agaucucaggucc

SEQ ID NO: 3813260 - RNA, 18 nt, Human
agaucuccuggcaaaggc

SEQ ID NO: 3813261 - RNA, 22 nt, Human
agaucucgguuugccaaaauuc

SEQ ID NO: 3813262 - RNA, 14 nt, Human
agaucucuuucuaa

SEQ ID NO: 3813263 - RNA, 23 nt, Human
agaucugacaugauuccuuccug

SEQ ID NO: 3813264 - RNA, 21 nt, Human
agaucugcagggggugugucu

SEQ ID NO: 3813265 - RNA, 13 nt, Human
agaucuggaaccu

SEQ ID NO: 3813266 - RNA, 14 nt, Human
agaucuggaaccuc

SEQ ID NO: 3813267 - RNA, 16 nt, Human
agaucuggaaugugaa

SEQ ID NO: 3813268 - RNA, 18 nt, Human
agaucuguccucagccuu

SEQ ID NO: 3813269 - RNA, 13 nt, Human
agaucugugcccc

SEQ ID NO: 3813270 - RNA, 16 nt, Human
agaucugugccccaug

SEQ ID NO: 3813271 - RNA, 14 nt, Human
agaucuguuuugaa

SEQ ID NO: 3813272 - RNA, 23 nt, Human
agaucuguuuugugguuuggaau

SEQ ID NO: 3813273 - RNA, 13 nt, Human
agaucuuaaauuu

SEQ ID NO: 3813274 - RNA, 14 nt, Human
agaucuuaaauuuu

SEQ ID NO: 3813275 - RNA, 16 nt, Human
agaucuuaaauuuugu

SEQ ID NO: 3813276 - RNA, 13 nt, Human
agaucuuaauaua

SEQ ID NO: 3813277 - RNA, 15 nt, Human
agaucuuaauauaaa

SEQ ID NO: 3813278 - RNA, 19 nt, Human
agaucuuaauauaaauuca

SEQ ID NO: 3813279 - RNA, 17 nt, Human
agaucuucugaaaugaa

SEQ ID NO: 3813280 - RNA, 12 nt, Human
agaucuuucaga

SEQ ID NO: 3813281 - RNA, 16 nt, Human
agaucuuucagaaaua

SEQ ID NO: 3813282 - RNA, 19 nt, Human
agaucuuucagaaauauaa

SEQ ID NO: 3813283 - RNA, 20 nt, Human
agaucuuucagaaauauaac

SEQ ID NO: 3813284 - RNA, 13 nt, Human
agaucuuucagga

SEQ ID NO: 3813285 - RNA, 16 nt, Human
agaucuuucuccuuga

SEQ ID NO: 3813286 - RNA, 20 nt, Human
agaugaaaaagcauguacag

SEQ ID NO: 3813287 - RNA, 14 nt, Human
agaugaaacacaaa

SEQ ID NO: 3813288 - RNA, 23 nt, Human
agaugaaagcagggaauuucuau

SEQ ID NO: 3813289 - RNA, 20 nt, Human
agaugaaaucuuacagcugg

SEQ ID NO: 3813290 - RNA, 15 nt, Human
agaugaaauuccauu

SEQ ID NO: 3813291 - RNA, 21 nt, Human
agaugaacucugaacuuugga

SEQ ID NO: 3813292 - RNA, 21 nt, Human
agaugaacucuuucuggccug

SEQ ID NO: 3813293 - RNA, 17 nt, Human
agaugaagagugagagg

SEQ ID NO: 3813294 - RNA, 19 nt, Human
agaugaagagugagagggc

SEQ ID NO: 3813295 - RNA, 17 nt, Human
agaugaagcaaacacau

SEQ ID NO: 3813296 - RNA, 11 nt, Human
agaugaauaaa

SEQ ID NO: 3813297 - RNA, 16 nt, Human
agaugaauacaaacaa

SEQ ID NO: 3813298 - RNA, 18 nt, Human
agaugaaucaaugggaaa

SEQ ID NO: 3813299 - RNA, 11 nt, Human
agaugaauguc

SEQ ID NO: 3813300 - RNA, 11 nt, Human
agaugacaaaa

SEQ ID NO: 3813301 - RNA, 12 nt, Human
agaugacaaccu

SEQ ID NO: 3813302 - RNA, 14 nt, Human
agaugaccccuccc

SEQ ID NO: 3813303 - RNA, 23 nt, Human
agaugaccccugcccagaucagc

SEQ ID NO: 3813304 - RNA, 15 nt, Human
agaugaccucauuaa

SEQ ID NO: 3813305 - RNA, 14 nt, Human
agaugacugagucc

SEQ ID NO: 3813306 - RNA, 17 nt, Human
agaugagaauucagcug

SEQ ID NO: 3813307 - RNA, 20 nt, Human
agaugagcuuucuuuuuaaa

SEQ ID NO: 3813308 - RNA, 18 nt, Human
agaugaggaguaaaauuc

SEQ ID NO: 3813309 - RNA, 20 nt, Human
agaugaggaguaaaauucag

SEQ ID NO: 3813310 - RNA, 13 nt, Human
agaugaggccaga

SEQ ID NO: 3813311 - RNA, 19 nt, Human
agaugagggaugggccugg

SEQ ID NO: 3813312 - RNA, 20 nt, Human
agaugagggaugggccuggc

SEQ ID NO: 3813313 - RNA, 22 nt, Human
agaugaguuaucuaagaauaca

SEQ ID NO: 3813314 - RNA, 16 nt, Human
agaugauacauccaaa

SEQ ID NO: 3813315 - RNA, 20 nt, Human
agaugauacauccaaagcag

SEQ ID NO: 3813316 - RNA, 13 nt, Human
agaugaucauuug

SEQ ID NO: 3813317 - RNA, 18 nt, Human
agaugaugagaauuucua

SEQ ID NO: 3813318 - RNA, 20 nt, Human
agaugaugagaauuucuaaa

SEQ ID NO: 3813319 - RNA, 16 nt, Human
agaugauggaugccaa

SEQ ID NO: 3813320 - RNA, 18 nt, Human
agaugauuaaauaagauu

SEQ ID NO: 3813321 - RNA, 19 nt, Human
agaugauuaaauaagauuc

SEQ ID NO: 3813322 - RNA, 21 nt, Human
agaugauuaaauaagauucua

SEQ ID NO: 3813323 - RNA, 21 nt, Human
agaugauucuggcugaaaaag

SEQ ID NO: 3813324 - RNA, 16 nt, Human
agaugauuuccccccu

SEQ ID NO: 3813325 - RNA, 22 nt, Human
agaugauuuccccccuccgccu

SEQ ID NO: 3813326 - RNA, 15 nt, Human
agaugauuuuuugaa

SEQ ID NO: 3813327 - RNA, 17 nt, Human
agaugauuuuuugaaag

SEQ ID NO: 3813328 - RNA, 20 nt, Human
agaugcaaagaggcaagagg

SEQ ID NO: 3813329 - RNA, 13 nt, Human
agaugcaagauau

SEQ ID NO: 3813330 - RNA, 16 nt, Human
agaugcaagucucuug

SEQ ID NO: 3813331 - RNA, 20 nt, Human
agaugcaaugacucaggaca

SEQ ID NO: 3813332 - RNA, 20 nt, Human
agaugcaccaccaagccaag

SEQ ID NO: 3813333 - RNA, 21 nt, Human
agaugcaccaccaagccaagg

SEQ ID NO: 3813334 - RNA, 22 nt, Human
agaugcacuuugcuuuaauaua

SEQ ID NO: 3813335 - RNA, 15 nt, Human
agaugcagagagcca

SEQ ID NO: 3813336 - RNA, 21 nt, Human
agaugcagcaaaaugugaaug

SEQ ID NO: 3813337 - RNA, 13 nt, Human
agaugcagccggu

SEQ ID NO: 3813338 - RNA, 14 nt, Human
agaugcagcucuuc

SEQ ID NO: 3813339 - RNA, 13 nt, Human
agaugcagcugga

SEQ ID NO: 3813340 - RNA, 13 nt, Human
agaugcagggcag

SEQ ID NO: 3813341 - RNA, 15 nt, Human
agaugcagugccagg

SEQ ID NO: 3813342 - RNA, 18 nt, Human
agaugcaguucugaagaa

SEQ ID NO: 3813343 - RNA, 19 nt, Human
agaugcaguucugaagaag

SEQ ID NO: 3813344 - RNA, 20 nt, Human
agaugcaguucugaagaaga

SEQ ID NO: 3813345 - RNA, 21 nt, Human
agaugcaguucugaagaagau

SEQ ID NO: 3813346 - RNA, 15 nt, Human
agaugccacccuagc

SEQ ID NO: 3813347 - RNA, 12 nt, Human
agaugccagagc

SEQ ID NO: 3813348 - RNA, 19 nt, Human
agaugccauccucuuucuc

SEQ ID NO: 3813349 - RNA, 18 nt, Human
agaucaaaagguuaauaa

SEQ ID NO: 3813350 - RNA, 12 nt, Human
agaucaaagaug

SEQ ID NO: 3813351 - RNA, 13 nt, Human
agaucaaagauga

SEQ ID NO: 3813352 - RNA, 13 nt, Human
agaucaaauacuu

SEQ ID NO: 3813353 - RNA, 15 nt, Human
agaucaaauacuuua

SEQ ID NO: 3813354 - RNA, 19 nt, Human
agaucaaccccuucgcucc

SEQ ID NO: 3813355 - RNA, 16 nt, Human
agaucaacgccucacu

SEQ ID NO: 3813356 - RNA, 15 nt, Human
agaucaacucauguu

SEQ ID NO: 3813357 - RNA, 16 nt, Human
agaucaaggagaggag

SEQ ID NO: 3813358 - RNA, 20 nt, Human
agaucacauaacagaaugca

SEQ ID NO: 3813359 - RNA, 15 nt, Human
agaucaccagaauaa

SEQ ID NO: 3813360 - RNA, 22 nt, Human
agaucacgccacugcacuccag

SEQ ID NO: 3813361 - RNA, 15 nt, Human
agaucacgcuccccg

SEQ ID NO: 3813362 - RNA, 23 nt, Human
agaucacgcuccccgccuguucc

SEQ ID NO: 3813363 - RNA, 18 nt, Human
agaucacguuccuucccc

SEQ ID NO: 3813364 - RNA, 22 nt, Human
agaucacugcaaccucugccuc

SEQ ID NO: 3813365 - RNA, 19 nt, Human
agaucacuuucucaguuuu

SEQ ID NO: 3813366 - RNA, 23 nt, Human
agaucacuuucucaguuuucaua

SEQ ID NO: 3813367 - RNA, 14 nt, Human
agaucacuuugcuc

SEQ ID NO: 3813368 - RNA, 18 nt, Human
agaucagaugcuccaaga

SEQ ID NO: 3813369 - RNA, 14 nt, Human
agaucagccagaag

SEQ ID NO: 3813370 - RNA, 15 nt, Human
agaucagccugggca

SEQ ID NO: 3813371 - RNA, 13 nt, Human
agaucaguaaaga

SEQ ID NO: 3813372 - RNA, 21 nt, Human
agaucaguguaccauuugccu

SEQ ID NO: 3813373 - RNA, 18 nt, Human
agaucauagauuucugau

SEQ ID NO: 3813374 - RNA, 21 nt, Human
agaucauagauuucugauuuu

SEQ ID NO: 3813375 - RNA, 23 nt, Human
agaucauagauuucugauuuuau

SEQ ID NO: 3813376 - RNA, 16 nt, Human
agaucauaguuuuauu

SEQ ID NO: 3813377 - RNA, 22 nt, Human
agaugcuuuucugucucugccu

SEQ ID NO: 3813378 - RNA, 22 nt, Human
agauggaaaauucauuuuuuaa

SEQ ID NO: 3813379 - RNA, 22 nt, Human
agauggaacccuuuuggccccc

SEQ ID NO: 3813380 - RNA, 17 nt, Human
agauggaaccgcaggaa

SEQ ID NO: 3813381 - RNA, 21 nt, Human
agauggaaccgcaggaagcug

SEQ ID NO: 3813382 - RNA, 16 nt, Human
agauggaagcuuccag

SEQ ID NO: 3813383 - RNA, 15 nt, Human
agauggaaugcugug

SEQ ID NO: 3813384 - RNA, 23 nt, Human
agauggacaguucacacccugca

SEQ ID NO: 3813385 - RNA, 17 nt, Human
agauggaguucuugugc

SEQ ID NO: 3813386 - RNA, 16 nt, Human
agauggaguuucuaag

SEQ ID NO: 3813387 - RNA, 17 nt, Human
agauggaguuucuaagg

SEQ ID NO: 3813388 - RNA, 18 nt, Human
agauggaguuucuaaggu

SEQ ID NO: 3813389 - RNA, 17 nt, Human
agauggauaugaccagu

SEQ ID NO: 3813390 - RNA, 15 nt, Human
agauggauucucaga

SEQ ID NO: 3813391 - RNA, 18 nt, Human
agauggauucucagauau

SEQ ID NO: 3813392 - RNA, 20 nt, Human
agauggauuugccugugcca

SEQ ID NO: 3813393 - RNA, 16 nt, Human
agauggcaaaugacca

SEQ ID NO: 3813394 - RNA, 21 nt, Human
agauggcagcuuuuaaaagau

SEQ ID NO: 3813395 - RNA, 14 nt, Human
agauggcagucacu

SEQ ID NO: 3813396 - RNA, 15 nt, Human
agauggcccauccug

SEQ ID NO: 3813397 - RNA, 15 nt, Human
agauggccuuugcuu

SEQ ID NO: 3813398 - RNA, 23 nt, Human
agauggccuuugcuuaugaauau

SEQ ID NO: 3813399 - RNA, 13 nt, Human
agauggcucccag

SEQ ID NO: 3813400 - RNA, 14 nt, Human
agauggcucccagg

SEQ ID NO: 3813401 - RNA, 14 nt, Human
agauggcuccucuc

SEQ ID NO: 3813402 - RNA, 15 nt, Human
agauggcuccucuca

SEQ ID NO: 3813403 - RNA, 18 nt, Human
agaugggaaugaagcuug

SEQ ID NO: 3813404 - RNA, 23 nt, Human
agaugggaaugaagcuuguguau

SEQ ID NO: 3813405 - RNA, 16 nt, Human
agaugggacaggauca

SEQ ID NO: 3813406 - RNA, 21 nt, Human
agaugggagaaucacuugaac

SEQ ID NO: 3813407 - RNA, 13 nt, Human
agaugggagcucc

SEQ ID NO: 3813408 - RNA, 19 nt, Human
agaugggaggaaagagagc

SEQ ID NO: 3813409 - RNA, 16 nt, Human
agaugggcaucuuuug

SEQ ID NO: 3813410 - RNA, 17 nt, Human
agaugggcuucccaagg

SEQ ID NO: 3813411 - RNA, 20 nt, Human
agauggggauaaaaugacua

SEQ ID NO: 3813412 - RNA, 21 nt, Human
agaugggggaaagcaaagcac

SEQ ID NO: 3813413 - RNA, 23 nt, Human
agaugggggaaagcaaagcacag

SEQ ID NO: 3813414 - RNA, 24 nt, Human
agaugggggaaagcaaagcacaga

SEQ ID NO: 3813415 - RNA, 18 nt, Human
agaugggggccucuuuca

SEQ ID NO: 3813416 - RNA, 19 nt, Human
agaugggucuggcugagcu

SEQ ID NO: 3813417 - RNA, 21 nt, Human
agaugggucuggcugagcuga

SEQ ID NO: 3813418 - RNA, 22 nt, Human
agaugggucuggcugagcugaa

SEQ ID NO: 3813419 - RNA, 23 nt, Human
agaugggucuggcugagcugaac

SEQ ID NO: 3813420 - RNA, 17 nt, Human
agaugggugaaggcugg

SEQ ID NO: 3813421 - RNA, 13 nt, Human
agaugggugggga

SEQ ID NO: 3813422 - RNA, 22 nt, Human
agaugguacaaccuuuauucuu

SEQ ID NO: 3813423 - RNA, 19 nt, Human
agauggucauauuuaaaca

SEQ ID NO: 3813424 - RNA, 15 nt, Human
agauggugaaauuua

SEQ ID NO: 3813425 - RNA, 22 nt, Human
agauggugaagcauucucccca

SEQ ID NO: 3813426 - RNA, 14 nt, Human
agauggugcugaga

SEQ ID NO: 3813427 - RNA, 21 nt, Human
agaugguguggguguccugcc

SEQ ID NO: 3813428 - RNA, 17 nt, Human
agaugguuaaacauuuu

SEQ ID NO: 3813429 - RNA, 18 nt, Human
agaugguuacacuguuag

SEQ ID NO: 3813430 - RNA, 13 nt, Human
agauguaaaaaga

SEQ ID NO: 3813431 - RNA, 19 nt, Human
agauguaaaguuauucuug

SEQ ID NO: 3813432 - RNA, 21 nt, Human
agauguaagagcuuuacaaaa

SEQ ID NO: 3813433 - RNA, 19 nt, Human
agauguaauuuuguguaag

SEQ ID NO: 3813434 - RNA, 15 nt, Human
agauguacuauaaca

SEQ ID NO: 3813435 - RNA, 14 nt, Human
agauguagaggaga

SEQ ID NO: 3813436 - RNA, 18 nt, Human
agauguagauuuauuuca

SEQ ID NO: 3813437 - RNA, 15 nt, Human
agauguaggagggac

SEQ ID NO: 3813438 - RNA, 20 nt, Human
agauguaugcacacacauau

SEQ ID NO: 3813439 - RNA, 22 nt, Human
agauguauguacuucaugcugu

SEQ ID NO: 3813440 - RNA, 15 nt, Human
agaugucagacuggc

SEQ ID NO: 3813441 - RNA, 15 nt, Human
agaugucaucagagc

SEQ ID NO: 3813442 - RNA, 22 nt, Human
agaugucaucagagcuccucug

SEQ ID NO: 3813443 - RNA, 20 nt, Human
agaugucccuuucuuggcca

SEQ ID NO: 3813444 - RNA, 12 nt, Human
agaugucuauuc

SEQ ID NO: 3813445 - RNA, 15 nt, Human
agaugucuucguaca

SEQ ID NO: 3813446 - RNA, 19 nt, Human
agaugucuucugccuguua

SEQ ID NO: 3813447 - RNA, 13 nt, Human
agaugucuuuagg

SEQ ID NO: 3813448 - RNA, 15 nt, Human
agaugucuuuaggca

SEQ ID NO: 3813449 - RNA, 17 nt, Human
agaugugaacacaucag

SEQ ID NO: 3813450 - RNA, 11 nt, Human
agaugugaauu

SEQ ID NO: 3813451 - RNA, 14 nt, Human
agaugugaauuauu

SEQ ID NO: 3813452 - RNA, 16 nt, Human
agaugugaauuauuga

SEQ ID NO: 3813453 - RNA, 18 nt, Human
agaugugaauuauugaca

SEQ ID NO: 3813454 - RNA, 22 nt, Human
agaugugaauuauugacacuga

SEQ ID NO: 3813455 - RNA, 16 nt, Human
agaugugauauucuaa

SEQ ID NO: 3813456 - RNA, 17 nt, Human
agaugugauauucuaag

SEQ ID NO: 3813457 - RNA, 23 nt, Human
agaugugaugcuugauauuuucu

SEQ ID NO: 3813458 - RNA, 18 nt, Human
agaugugcaaaugcaagc

SEQ ID NO: 3813459 - RNA, 21 nt, Human
agaugugcacccaugggcucu

SEQ ID NO: 3813460 - RNA, 14 nt, Human
agaugugcagcaga

SEQ ID NO: 3813461 - RNA, 17 nt, Human
agaugugcagcagauug

SEQ ID NO: 3813462 - RNA, 21 nt, Human
agauguggccuuccauuuaua

SEQ ID NO: 3813463 - RNA, 20 nt, Human
agaugugggccaccauugca

SEQ ID NO: 3813464 - RNA, 20 nt, Human
agaugugguuaauuuugcau

SEQ ID NO: 3813465 - RNA, 17 nt, Human
agauguguaauuuuucu

SEQ ID NO: 3813466 - RNA, 16 nt, Human
agaugugucuauggcu

SEQ ID NO: 3813467 - RNA, 19 nt, Human
agauguguguugauacugu

SEQ ID NO: 3813468 - RNA, 20 nt, Human
agauguguguugauacuguu

SEQ ID NO: 3813469 - RNA, 15 nt, Human
agauguguucacaau

SEQ ID NO: 3813470 - RNA, 17 nt, Human
agauguuauauuuuucu

SEQ ID NO: 3813471 - RNA, 19 nt, Human
agauguuauauuuuucuua

SEQ ID NO: 3813472 - RNA, 15 nt, Human
agauguucacccaac

SEQ ID NO: 3813473 - RNA, 18 nt, Human
agauguucagucauuuuu

SEQ ID NO: 3813474 - RNA, 17 nt, Human
agauguucuaagucuuu

SEQ ID NO: 3813475 - RNA, 15 nt, Human
agauguucucuauca

SEQ ID NO: 3813476 - RNA, 18 nt, Human
agauguucucuaucauuu

SEQ ID NO: 3813477 - RNA, 21 nt, Human
agauguucucuaucauuuaau

SEQ ID NO: 3813478 - RNA, 20 nt, Human
agauguucucucccaggggc

SEQ ID NO: 3813479 - RNA, 15 nt, Human
agauguugaauucuu

SEQ ID NO: 3813480 - RNA, 14 nt, Human
agauguugccaugu

SEQ ID NO: 3813481 - RNA, 16 nt, Human
agauguuuaaaacacc

SEQ ID NO: 3813482 - RNA, 21 nt, Human
agauguuuauucuucuagagu

SEQ ID NO: 3813483 - RNA, 16 nt, Human
agauguuuauuucagg

SEQ ID NO: 3813484 - RNA, 21 nt, Human
agauguuuugguagauuaaau

SEQ ID NO: 3813485 - RNA, 23 nt, Human
agauguuuuggucaaguaguuug

SEQ ID NO: 3813486 - RNA, 18 nt, Human
agauguuuuuaaaaguuu

SEQ ID NO: 3813487 - RNA, 20 nt, Human
agauguuuuuaaaaguuuca

SEQ ID NO: 3813488 - RNA, 22 nt, Human
agauguuuuuaaaaguuucaau

SEQ ID NO: 3813489 - RNA, 14 nt, Human
agauuaaacagaug

SEQ ID NO: 3813490 - RNA, 17 nt, Human
agauuaaacagaugaug

SEQ ID NO: 3813491 - RNA, 12 nt, Human
agauuaaauaua

SEQ ID NO: 3813492 - RNA, 16 nt, Human
agauuaaauauagauu

SEQ ID NO: 3813493 - RNA, 13 nt, Human
agauuaagaaaua

SEQ ID NO: 3813494 - RNA, 20 nt, Human
agauuaauacucuauuuuua

SEQ ID NO: 3813495 - RNA, 15 nt, Human
agauuaauggcacug

SEQ ID NO: 3813496 - RNA, 15 nt, Human
agauuaauuccuuuc

SEQ ID NO: 3813497 - RNA, 14 nt, Human
agauuaccuccuga

SEQ ID NO: 3813498 - RNA, 13 nt, Human
agauuagaaaaau

SEQ ID NO: 3813499 - RNA, 23 nt, Human
agauuagaauucuguauagauua

SEQ ID NO: 3813500 - RNA, 15 nt, Human
agauuagaucuuuua

SEQ ID NO: 3813501 - RNA, 17 nt, Human
agauuagcucuggacca

SEQ ID NO: 3813502 - RNA, 18 nt, Human
agauuauaacuugucuaa

SEQ ID NO: 3813503 - RNA, 16 nt, Human
agauuauagauucuaa

SEQ ID NO: 3813504 - RNA, 20 nt, Human
agauuauaggcaccuaccac

SEQ ID NO: 3813505 - RNA, 23 nt, Human
agauuauauauauuuuuuucuga

SEQ ID NO: 3813506 - RNA, 18 nt, Human
agauuauaucaaaguauu

SEQ ID NO: 3813507 - RNA, 15 nt, Human
agauuaucuauuugu

SEQ ID NO: 3813508 - RNA, 22 nt, Human
acucuguccugaaggccugagg

SEQ ID NO: 3813509 - RNA, 19 nt, Human
acucugucucaaaaaaaca

SEQ ID NO: 3813510 - RNA, 15 nt, Human
acucugucucagucc

SEQ ID NO: 3813511 - RNA, 18 nt, Human
acucugucuucaccugau

SEQ ID NO: 3813512 - RNA, 17 nt, Human
acucugugccagagccu

SEQ ID NO: 3813513 - RNA, 18 nt, Human
acucugugccagagccug

SEQ ID NO: 3813514 - RNA, 21 nt, Human
acucugugccagagccugggg

SEQ ID NO: 3813515 - RNA, 12 nt, Human
acucugugccca

SEQ ID NO: 3813516 - RNA, 18 nt, Human
acucugugcccaugggca

SEQ ID NO: 3813517 - RNA, 24 nt, Human
acucugugcccaugggcacugcug

SEQ ID NO: 3813518 - RNA, 16 nt, Human
acucugugucugagug

SEQ ID NO: 3813519 - RNA, 22 nt, Human
acucugugucugaguggcuuca

SEQ ID NO: 3813520 - RNA, 15 nt, Human
acucuguuauuuaga

SEQ ID NO: 3813521 - RNA, 15 nt, Human
agauucaaagguucu

SEQ ID NO: 3813522 - RNA, 22 nt, Human
agauucaaugccccugaauuua

SEQ ID NO: 3813523 - RNA, 17 nt, Human
agauucaauuuucuuua

SEQ ID NO: 3813524 - RNA, 22 nt, Human
agauucacaccugacucugaaa

SEQ ID NO: 3813525 - RNA, 20 nt, Human
agauucaccuaagagauucu

SEQ ID NO: 3813526 - RNA, 20 nt, Human
agauucaccuguaaaacuuu

SEQ ID NO: 3813527 - RNA, 15 nt, Human
agauucacuuugaca

SEQ ID NO: 3813528 - RNA, 17 nt, Human
agauucacuuugacacu

SEQ ID NO: 3813529 - RNA, 14 nt, Human
agauucaggcauuu

SEQ ID NO: 3813530 - RNA, 20 nt, Human
agauucagguauguugccuu

SEQ ID NO: 3813531 - RNA, 18 nt, Human
agauucagucuugccuua

SEQ ID NO: 3813532 - RNA, 18 nt, Human
agauucaugauuuauaaa

SEQ ID NO: 3813533 - RNA, 21 nt, Human
agauucauuauuuuuccacuu

SEQ ID NO: 3813534 - RNA, 15 nt, Human
agauucauuuucuag

SEQ ID NO: 3813535 - RNA, 16 nt, Human
agauucauuuucuaga

SEQ ID NO: 3813536 - RNA, 22 nt, Human
agauuccauugguccaagauuc

SEQ ID NO: 3813537 - RNA, 12 nt, Human
agauucccagag

SEQ ID NO: 3813538 - RNA, 14 nt, Human
agauucccagagac

SEQ ID NO: 3813539 - RNA, 13 nt, Human
agauucccagagc

SEQ ID NO: 3813540 - RNA, 19 nt, Human
agauucccaggaguucugc

SEQ ID NO: 3813541 - RNA, 19 nt, Human
agauuccccauugccuccu

SEQ ID NO: 3813542 - RNA, 15 nt, Human
agauuccccuguguc

SEQ ID NO: 3813543 - RNA, 24 nt, Human
agauuccggauccuaagcaucuaa

SEQ ID NO: 3813544 - RNA, 14 nt, Human
agauuccuuucccu

SEQ ID NO: 3813545 - RNA, 16 nt, Human
agauuccuuucccuuu

SEQ ID NO: 3813546 - RNA, 17 nt, Human
agauuccuuuucuuguu

SEQ ID NO: 3813547 - RNA, 11 nt, Human
agauucuaaag

SEQ ID NO: 3813548 - RNA, 14 nt, Human
agauucuaaagauu

SEQ ID NO: 3813549 - RNA, 14 nt, Human
agauucuaaugaug

SEQ ID NO: 3813550 - RNA, 19 nt, Human
agauucuacauauucuuua

SEQ ID NO: 3813551 - RNA, 11 nt, Human
agauucuagau

SEQ ID NO: 3813552 - RNA, 14 nt, Human
agauucuagaugau

SEQ ID NO: 3813553 - RNA, 15 nt, Human
agauucuauaguucu

SEQ ID NO: 3813554 - RNA, 16 nt, Human
agauucuauaguucua

SEQ ID NO: 3813555 - RNA, 18 nt, Human
agauucuauaguucuaga

SEQ ID NO: 3813556 - RNA, 21 nt, Human
agauucuauaguucuagacau

SEQ ID NO: 3813557 - RNA, 18 nt, Human
agauucuauguuaauauu

SEQ ID NO: 3813558 - RNA, 19 nt, Human
agauucucauaacuugaga

SEQ ID NO: 3813559 - RNA, 20 nt, Human
agauucucauaacuugagac

SEQ ID NO: 3813560 - RNA, 19 nt, Human
agauucucugugucuaaga

SEQ ID NO: 3813561 - RNA, 24 nt, Human
agauucugauuugccacugauauu

SEQ ID NO: 3813562 - RNA, 23 nt, Human
agauucuucccauucuccauuug

SEQ ID NO: 3813563 - RNA, 13 nt, Human
agauucuucugug

SEQ ID NO: 3813564 - RNA, 22 nt, Human
agauucuuguauuuauuacaac

SEQ ID NO: 3813565 - RNA, 21 nt, Human
agauucuuucaguucuuugga

SEQ ID NO: 3813566 - RNA, 12 nt, Human
agauucuuuccc

SEQ ID NO: 3813567 - RNA, 15 nt, Human
agauucuuuccugag

SEQ ID NO: 3813568 - RNA, 18 nt, Human
agauucuuuccugaggcu

SEQ ID NO: 3813569 - RNA, 20 nt, Human
agauucuuuuaaauuagaaa

SEQ ID NO: 3813570 - RNA, 15 nt, Human
agauucuuuuucuga

SEQ ID NO: 3813571 - RNA, 20 nt, Human
agauugaaccugaauauugc

SEQ ID NO: 3813572 - RNA, 23 nt, Human
agauugaccuggauggggcaggc

SEQ ID NO: 3813573 - RNA, 17 nt, Human
agauugacgacaagugc

SEQ ID NO: 3813574 - RNA, 12 nt, Human
agauugagaaau

SEQ ID NO: 3813575 - RNA, 14 nt, Human
agauugagaaaugu

SEQ ID NO: 3813576 - RNA, 17 nt, Human
agauugagaaaugugua

SEQ ID NO: 3813577 - RNA, 19 nt, Human
agauugagaaggagagaaa

SEQ ID NO: 3813578 - RNA, 22 nt, Human
agauugagaaguuuuguacaga

SEQ ID NO: 3813579 - RNA, 18 nt, Human
agauugaguaagauuuac

SEQ ID NO: 3813580 - RNA, 15 nt, Human
agauugauuguauug

SEQ ID NO: 3813581 - RNA, 17 nt, Human
agauugcaacaggcugg

SEQ ID NO: 3813582 - RNA, 19 nt, Human
agauugcaacaggcugggc

SEQ ID NO: 3813583 - RNA, 13 nt, Human
agauugcauguga

SEQ ID NO: 3813584 - RNA, 16 nt, Human
agauugcaugugacuc

SEQ ID NO: 3813585 - RNA, 22 nt, Human
agauugcaugugacucugaagc

SEQ ID NO: 3813586 - RNA, 19 nt, Human
agauugcuaauugcuguug

SEQ ID NO: 3813587 - RNA, 14 nt, Human
agauugcugaaauu

SEQ ID NO: 3813588 - RNA, 16 nt, Human
agauugcuuaaaauag

SEQ ID NO: 3813589 - RNA, 12 nt, Human
agauugcuucuc

SEQ ID NO: 3813590 - RNA, 14 nt, Human
agauuggaaggaga

SEQ ID NO: 3813591 - RNA, 15 nt, Human
agauuggaaggagac

SEQ ID NO: 3813592 - RNA, 20 nt, Human
agauuggaaggagacacaga

SEQ ID NO: 3813593 - RNA, 23 nt, Human
agauuggaaggagacacagaugu

SEQ ID NO: 3813594 - RNA, 22 nt, Human
agauuggaucaaguauuacuaa

SEQ ID NO: 3813595 - RNA, 15 nt, Human
agauuggauuuuaug

SEQ ID NO: 3813596 - RNA, 17 nt, Human
agauuggauuuuauguu

SEQ ID NO: 3813597 - RNA, 23 nt, Human
agauuggcauggcuuuauuuguu

SEQ ID NO: 3813598 - RNA, 22 nt, Human
agauuggcucacacugagaaug

SEQ ID NO: 3813599 - RNA, 23 nt, Human
agauuggcucacacugagaaugu

SEQ ID NO: 3813600 - RNA, 12 nt, Human
agauugggucua

SEQ ID NO: 3813601 - RNA, 14 nt, Human
agauugguguuuuu

SEQ ID NO: 3813602 - RNA, 13 nt, Human
agauuguccuuuu

SEQ ID NO: 3813603 - RNA, 14 nt, Human
agauugugaauaau

SEQ ID NO: 3813604 - RNA, 20 nt, Human
agauugugaucccuugagau

SEQ ID NO: 3813605 - RNA, 21 nt, Human
agauugugccccugcacucca

SEQ ID NO: 3813606 - RNA, 16 nt, Human
agauuguggaauguug

SEQ ID NO: 3813607 - RNA, 21 nt, Human
agauuguguaacaauuuuaau

SEQ ID NO: 3813608 - RNA, 14 nt, Human
agauuguuaaaaua

SEQ ID NO: 3813609 - RNA, 15 nt, Human
agauuguuauuaaau

SEQ ID NO: 3813610 - RNA, 16 nt, Human
agauuguuauuaaaug

SEQ ID NO: 3813611 - RNA, 22 nt, Human
agauuguuguuugccauacuuu

SEQ ID NO: 3813612 - RNA, 14 nt, Human
agauuguuuaucua

SEQ ID NO: 3813613 - RNA, 16 nt, Human
agauuguuuaucuaga

SEQ ID NO: 3813614 - RNA, 18 nt, Human
agauuguuuaucuagaug

SEQ ID NO: 3813615 - RNA, 21 nt, Human
agauuguuuaucuagauguaa

SEQ ID NO: 3813616 - RNA, 19 nt, Human
agauuguuuccucuuccaa

SEQ ID NO: 3813617 - RNA, 11 nt, Human
agauuuaagca

SEQ ID NO: 3813618 - RNA, 23 nt, Human
agauuuaauauaaaguuuuauau

SEQ ID NO: 3813619 - RNA, 13 nt, Human
agauuuaauuugc

SEQ ID NO: 3813620 - RNA, 18 nt, Human
agauuuagugaaagcuag

SEQ ID NO: 3813621 - RNA, 15 nt, Human
agauuuauauaaaug

SEQ ID NO: 3813622 - RNA, 17 nt, Human
agauuuauauaaaugua

SEQ ID NO: 3813623 - RNA, 13 nt, Human
agauuuaucaaau

SEQ ID NO: 3813624 - RNA, 15 nt, Human
agauuuaucaaauca

SEQ ID NO: 3813625 - RNA, 17 nt, Human
agauuuauuaaagaaaa

SEQ ID NO: 3813626 - RNA, 18 nt, Human
agauuuauuaaagaaaaa

SEQ ID NO: 3813627 - RNA, 17 nt, Human
agauuuauuccuuuguu

SEQ ID NO: 3813628 - RNA, 13 nt, Human
agauuucacucuc

SEQ ID NO: 3813629 - RNA, 14 nt, Human
agauuucacucucc

SEQ ID NO: 3813630 - RNA, 15 nt, Human
agauuucagucuuuu

SEQ ID NO: 3813631 - RNA, 12 nt, Human
agauuucauagu

SEQ ID NO: 3813632 - RNA, 18 nt, Human
agauuucauaguucagaa

SEQ ID NO: 3813633 - RNA, 15 nt, Human
agauuucaucugcuc

SEQ ID NO: 3813634 - RNA, 21 nt, Human
agauuucaucugcucuccuuc

SEQ ID NO: 3813635 - RNA, 23 nt, Human
agauuucaucugcucuccuuccu

SEQ ID NO: 3813636 - RNA, 18 nt, Human
agauuuccauauaaauau

SEQ ID NO: 3813637 - RNA, 15 nt, Human
agauuucuaaauaaa

SEQ ID NO: 3813638 - RNA, 22 nt, Human
agauuucucagaagucuuucag

SEQ ID NO: 3813639 - RNA, 16 nt, Human
agauuucucauugacu

SEQ ID NO: 3813640 - RNA, 18 nt, Human
agauuucugauuuuaugu

SEQ ID NO: 3813641 - RNA, 19 nt, Human
agauuucugauuuuaugua

SEQ ID NO: 3813642 - RNA, 22 nt, Human
agauuucugauuuuauguaaaa

SEQ ID NO: 3813643 - RNA, 11 nt, Human
agauuucuguu

SEQ ID NO: 3813644 - RNA, 15 nt, Human
agauuugaccuccuc

SEQ ID NO: 3813645 - RNA, 18 nt, Human
agauuugccauagaguac

SEQ ID NO: 3813646 - RNA, 14 nt, Human
agauuugcccauuu

SEQ ID NO: 3813647 - RNA, 16 nt, Human
agauuugcccauuuac

SEQ ID NO: 3813648 - RNA, 12 nt, Human
agauuuggaaua

SEQ ID NO: 3813649 - RNA, 17 nt, Human
agauuuggcuugacaaa

SEQ ID NO: 3813650 - RNA, 14 nt, Human
agauuugggcugga

SEQ ID NO: 3813651 - RNA, 20 nt, Human
agauuuggugaauuugaauc

SEQ ID NO: 3813652 - RNA, 21 nt, Human
agauuuguacuacaguucuuu

SEQ ID NO: 3813653 - RNA, 15 nt, Human
agauuugucuaauug

SEQ ID NO: 3813654 - RNA, 22 nt, Human
agauuugugaacucagccaagc

SEQ ID NO: 3813655 - RNA, 12 nt, Human
agauuuuaaaga

SEQ ID NO: 3813656 - RNA, 19 nt, Human
agauuuuaaucaaguugaa

SEQ ID NO: 3813657 - RNA, 16 nt, Human
agauuuuacaugaagu

SEQ ID NO: 3813658 - RNA, 19 nt, Human
agauuuuacaugaaguauu

SEQ ID NO: 3813659 - RNA, 19 nt, Human
agauuuuaggaaaugaaug

SEQ ID NO: 3813660 - RNA, 20 nt, Human
agauuuuaggaaaugaaugu

SEQ ID NO: 3813661 - RNA, 15 nt, Human
agauuuuaguuuuau

SEQ ID NO: 3813662 - RNA, 20 nt, Human
agauuuuaguuuuauuuucu

SEQ ID NO: 3813663 - RNA, 23 nt, Human
agauuuuaguuuuauuuucuaaa

SEQ ID NO: 3813664 - RNA, 16 nt, Human
agauuuuauuauguaa

SEQ ID NO: 3813665 - RNA, 20 nt, Human
agauuuuauuauguaaaucc

SEQ ID NO: 3813666 - RNA, 22 nt, Human
agcaguggcugguccagggcua

SEQ ID NO: 3813667 - RNA, 14 nt, Human
agcagugggccugg

SEQ ID NO: 3813668 - RNA, 18 nt, Human
agcagugggccuggccag

SEQ ID NO: 3813669 - RNA, 22 nt, Human
agcagugggucaugaugcucuu

SEQ ID NO: 3813670 - RNA, 15 nt, Human
agcagugucaucaga

SEQ ID NO: 3813671 - RNA, 20 nt, Human
agcagugucaucagaagaua

SEQ ID NO: 3813672 - RNA, 16 nt, Human
agcagugucuuccaua

SEQ ID NO: 3813673 - RNA, 19 nt, Human
agcagugugaaguacaaua

SEQ ID NO: 3813674 - RNA, 15 nt, Human
agcagugugaggcca

SEQ ID NO: 3813675 - RNA, 17 nt, Human
agcaguguuagcuuagu

SEQ ID NO: 3813676 - RNA, 18 nt, Human
agcaguucagagcugccc

SEQ ID NO: 3813677 - RNA, 13 nt, Human
agcaguucugcaa

SEQ ID NO: 3813678 - RNA, 23 nt, Human
agcaguugaaaagacuccaaaga

SEQ ID NO: 3813679 - RNA, 17 nt, Human
agcaguugcugguaaaa

SEQ ID NO: 3813680 - RNA, 20 nt, Human
agcaguugcugguaaaauga

SEQ ID NO: 3813681 - RNA, 21 nt, Human
agcaguugcugguaaaaugaa

SEQ ID NO: 3813682 - RNA, 21 nt, Human
agcaguuucaauaaaguuuga

SEQ ID NO: 3813683 - RNA, 14 nt, Human
agcaguuucaggua

SEQ ID NO: 3813684 - RNA, 13 nt, Human
agcauaaaaacau

SEQ ID NO: 3813685 - RNA, 21 nt, Human
agcauaaaaacauuuuaaaaa

SEQ ID NO: 3813686 - RNA, 18 nt, Human
agcauaaguauacaguuc

SEQ ID NO: 3813687 - RNA, 17 nt, Human
agcauaaguuucuggga

SEQ ID NO: 3813688 - RNA, 23 nt, Human
agcauaaguuucugggaccucag

SEQ ID NO: 3813689 - RNA, 21 nt, Human
agcauaauugaaaguucugaa

SEQ ID NO: 3813690 - RNA, 17 nt, Human
agcauaauuuaaaaaua

SEQ ID NO: 3813691 - RNA, 18 nt, Human
agcauaauuuaaaaauau

SEQ ID NO: 3813692 - RNA, 20 nt, Human
agcauaauuuaaaaauauau

SEQ ID NO: 3813693 - RNA, 12 nt, Human
agcauacaacuu

SEQ ID NO: 3813694 - RNA, 19 nt, Human
agcauaccaacacgagcag

SEQ ID NO: 3813695 - RNA, 22 nt, Human
agcauaccaacacgagcaggcu

SEQ ID NO: 3813696 - RNA, 19 nt, Human
agcauaccuuuauugugau

SEQ ID NO: 3813697 - RNA, 18 nt, Human
agcauacguacacauuuu

SEQ ID NO: 3813698 - RNA, 14 nt, Human
agcauacuuuguaa

SEQ ID NO: 3813699 - RNA, 20 nt, Human
agcauagaaaccacuagaaa

SEQ ID NO: 3813700 - RNA, 16 nt, Human
agcauagcuuauuauu

SEQ ID NO: 3813701 - RNA, 14 nt, Human
agcauauaaaaugg

SEQ ID NO: 3813702 - RNA, 16 nt, Human
agcauaucugccuuua

SEQ ID NO: 3813703 - RNA, 20 nt, Human
agcauaucugccuuuauugu

SEQ ID NO: 3813704 - RNA, 22 nt, Human
agcauaucugccuuuauugugu

SEQ ID NO: 3813705 - RNA, 19 nt, Human
agcauaugacaaauguuuc

SEQ ID NO: 3813706 - RNA, 20 nt, Human
agcauaugacaaauguuucu

SEQ ID NO: 3813707 - RNA, 21 nt, Human
agcauaugacaaauguuucua

SEQ ID NO: 3813708 - RNA, 16 nt, Human
agcauaugaguuucau

SEQ ID NO: 3813709 - RNA, 20 nt, Human
agcauauggguuagauguug

SEQ ID NO: 3813710 - RNA, 14 nt, Human
agcauauucaggaa

SEQ ID NO: 3813711 - RNA, 16 nt, Human
agcauauucaggaagc

SEQ ID NO: 3813712 - RNA, 19 nt, Human
agcauauucaggaagcuca

SEQ ID NO: 3813713 - RNA, 17 nt, Human
agcaucaaaauauuuca

SEQ ID NO: 3813714 - RNA, 14 nt, Human
agcaucaaacucuu

SEQ ID NO: 3813715 - RNA, 15 nt, Human
agcaucacaaaugau

SEQ ID NO: 3813716 - RNA, 18 nt, Human
acuggaaaacagaacacu

SEQ ID NO: 3813717 - RNA, 20 nt, Human
acuggaaaggggagagccug

SEQ ID NO: 3813718 - RNA, 16 nt, Human
acuggaacacuagaca

SEQ ID NO: 3813719 - RNA, 16 nt, Human
acuggaaccagggaga

SEQ ID NO: 3813720 - RNA, 13 nt, Human
acuggaacccuuu

SEQ ID NO: 3813721 - RNA, 18 nt, Human
acuggaacggugaaggug

SEQ ID NO: 3813722 - RNA, 21 nt, Human
acuggaacggugaaggugaca

SEQ ID NO: 3813723 - RNA, 18 nt, Human
acuggaacuugaacugau

SEQ ID NO: 3813724 - RNA, 16 nt, Human
acuggaagcacagcuu

SEQ ID NO: 3813725 - RNA, 20 nt, Human
acuggaagcuaauuugcauu

SEQ ID NO: 3813726 - RNA, 20 nt, Human
acuggaaguucauaccuaag

SEQ ID NO: 3813727 - RNA, 23 nt, Human
acuggaauaagaagcaaauaaau

SEQ ID NO: 3813728 - RNA, 21 nt, Human
acuggaaucagcucaggacug

SEQ ID NO: 3813729 - RNA, 16 nt, Human
acuggaauccuuucag

SEQ ID NO: 3813730 - RNA, 17 nt, Human
acuggaauccuuucagc

SEQ ID NO: 3813731 - RNA, 14 nt, Human
acuggaauuuuuau

SEQ ID NO: 3813732 - RNA, 19 nt, Human
acuggaauuuuuauuaugc

SEQ ID NO: 3813733 - RNA, 21 nt, Human
acuggaauuuuuauuaugcau

SEQ ID NO: 3813734 - RNA, 23 nt, Human
acuggaauuuuuauuaugcauaa

SEQ ID NO: 3813735 - RNA, 14 nt, Human
acuggacaaagaau

SEQ ID NO: 3813736 - RNA, 12 nt, Human
acuggacagcuu

SEQ ID NO: 3813737 - RNA, 18 nt, Human
acuggacagucacugcca

SEQ ID NO: 3813738 - RNA, 21 nt, Human
acuggaccacugggcaaugau

SEQ ID NO: 3813739 - RNA, 13 nt, Human
acuggaccccagc

SEQ ID NO: 3813740 - RNA, 16 nt, Human
acuggacccuguugcu

SEQ ID NO: 3813741 - RNA, 20 nt, Human
acuggacccuguugcuaagc

SEQ ID NO: 3813742 - RNA, 14 nt, Human
acuggacucaggau

SEQ ID NO: 3813743 - RNA, 16 nt, Human
acuggacuccggcccu

SEQ ID NO: 3813744 - RNA, 22 nt, Human
acuggacucuucaaaaacuguu

SEQ ID NO: 3813745 - RNA, 13 nt, Human
acuggagacugug

SEQ ID NO: 3813746 - RNA, 15 nt, Human
acuggagccaugggc

SEQ ID NO: 3813747 - RNA, 12 nt, Human
acuggagcccag

SEQ ID NO: 3813748 - RNA, 13 nt, Human
acuggagcccagg

SEQ ID NO: 3813749 - RNA, 18 nt, Human
acuggaggaccacacuca

SEQ ID NO: 3813750 - RNA, 18 nt, Human
acuggaggagagaagaau

SEQ ID NO: 3813751 - RNA, 15 nt, Human
acuggaggagcuggg

SEQ ID NO: 3813752 - RNA, 18 nt, Human
acuggaggccccuggagc

SEQ ID NO: 3813753 - RNA, 22 nt, Human
acuggaggccccuggagccaga

SEQ ID NO: 3813754 - RNA, 22 nt, Human
acuggaggggacgcugguagag

SEQ ID NO: 3813755 - RNA, 16 nt, Human
acuggagguugaagcc

SEQ ID NO: 3813756 - RNA, 17 nt, Human
acuggagguugaagcca

SEQ ID NO: 3813757 - RNA, 13 nt, Human
acuggagugcagg

SEQ ID NO: 3813758 - RNA, 18 nt, Human
acuggagugcagggagga

SEQ ID NO: 3813759 - RNA, 22 nt, Human
acuggagugugcgugguggucc

SEQ ID NO: 3813760 - RNA, 15 nt, Human
acuggaguuacauua

SEQ ID NO: 3813761 - RNA, 13 nt, Human
acuggaguucuau

SEQ ID NO: 3813762 - RNA, 18 nt, Human
acuggauaaauuguuuag

SEQ ID NO: 3813763 - RNA, 19 nt, Human
acuggauaaauuguuuagu

SEQ ID NO: 3813764 - RNA, 17 nt, Human
acuggaugcagaaacag

SEQ ID NO: 3813765 - RNA, 15 nt, Human
acuggauuaaacuua

SEQ ID NO: 3813766 - RNA, 14 nt, Human
acuggauucuuauu

SEQ ID NO: 3813767 - RNA, 16 nt, Human
acuggauuguacuuug

SEQ ID NO: 3813768 - RNA, 12 nt, Human
acuggcaaaagg

SEQ ID NO: 3813769 - RNA, 23 nt, Human
acuggcaaaauaguucugcaggu

SEQ ID NO: 3813770 - RNA, 17 nt, Human
acuggcaaacagggccu

SEQ ID NO: 3813771 - RNA, 19 nt, Human
acuggcaaacagggccucu

SEQ ID NO: 3813772 - RNA, 20 nt, Human
acuggcaaacagggccucug

SEQ ID NO: 3813773 - RNA, 15 nt, Human
acuggcaaagcagaa

SEQ ID NO: 3813774 - RNA, 14 nt, Human
acuggcaagaaaag

SEQ ID NO: 3813775 - RNA, 19 nt, Human
acuggcacaguuuucugag

SEQ ID NO: 3813776 - RNA, 20 nt, Human
acuggcacaguuuucugaga

SEQ ID NO: 3813777 - RNA, 21 nt, Human
acuggcacaguuuucugagaa

SEQ ID NO: 3813778 - RNA, 14 nt, Human
acuggcagcaucuu

SEQ ID NO: 3813779 - RNA, 22 nt, Human
acuggcaguuuuccauugguuu

SEQ ID NO: 3813780 - RNA, 10 nt, Human
acuggcaugc

SEQ ID NO: 3813781 - RNA, 21 nt, Human
acuggcauugucccugugccu

SEQ ID NO: 3813782 - RNA, 13 nt, Human
acuggcauuuuau

SEQ ID NO: 3813783 - RNA, 19 nt, Human
acuggccaccaggcuggcg

SEQ ID NO: 3813784 - RNA, 23 nt, Human
acuggccaccaggcuggcgcagc

SEQ ID NO: 3813785 - RNA, 15 nt, Human
acuggccauggccug

SEQ ID NO: 3813786 - RNA, 22 nt, Human
acuggccauuugccaauuuucc

SEQ ID NO: 3813787 - RNA, 21 nt, Human
acuggccccuacuuuguggca

SEQ ID NO: 3813788 - RNA, 21 nt, Human
acuggccccuagaaucagccu

SEQ ID NO: 3813789 - RNA, 12 nt, Human
acuggccccugg

SEQ ID NO: 3813790 - RNA, 14 nt, Human
acuggccccugggu

SEQ ID NO: 3813791 - RNA, 17 nt, Human
acuggccccugggucag

SEQ ID NO: 3813792 - RNA, 15 nt, Human
acuggcccucuucuu

SEQ ID NO: 3813793 - RNA, 15 nt, Human
acuggccucaaagca

SEQ ID NO: 3813794 - RNA, 13 nt, Human
acuggccugacuu

SEQ ID NO: 3813795 - RNA, 14 nt, Human
acuggccugaggag

SEQ ID NO: 3813796 - RNA, 16 nt, Human
acuggccugaggagca

SEQ ID NO: 3813797 - RNA, 19 nt, Human
acuggccugaggagcagca

SEQ ID NO: 3813798 - RNA, 15 nt, Human
acuggcggggggccc

SEQ ID NO: 3813799 - RNA, 23 nt, Human
acuggcguagaaguuuuuguacu

SEQ ID NO: 3813800 - RNA, 16 nt, Human
acuggcuccucugugg

SEQ ID NO: 3813801 - RNA, 19 nt, Human
acuggcuccucuguggugu

SEQ ID NO: 3813802 - RNA, 15 nt, Human
acuggcucuccaagu

SEQ ID NO: 3813803 - RNA, 21 nt, Human
acuggcucuccaagugccaga

SEQ ID NO: 3813804 - RNA, 22 nt, Human
acuggcugcaaaggguaucagg

SEQ ID NO: 3813805 - RNA, 20 nt, Human
acuggcugccagcuauuuuu

SEQ ID NO: 3813806 - RNA, 16 nt, Human
acuggcuggcugcagu

SEQ ID NO: 3813807 - RNA, 17 nt, Human
acuggcuggcugcagug

SEQ ID NO: 3813808 - RNA, 12 nt, Human
acuggcugguga

SEQ ID NO: 3813809 - RNA, 17 nt, Human
acuggcugucaguauga

SEQ ID NO: 3813810 - RNA, 22 nt, Human
agcagguuaaauguuuuguaaa

SEQ ID NO: 3813811 - RNA, 13 nt, Human
agcagguuagaga

SEQ ID NO: 3813812 - RNA, 18 nt, Human
agcagguucccaagcuca

SEQ ID NO: 3813813 - RNA, 14 nt, Human
agcagguucuuguu

SEQ ID NO: 3813814 - RNA, 21 nt, Human
agcagguugaggggcuccugg

SEQ ID NO: 3813815 - RNA, 15 nt, Human
agcaguaaaaacugu

SEQ ID NO: 3813816 - RNA, 19 nt, Human
agcaguaaauuugcuagca

SEQ ID NO: 3813817 - RNA, 15 nt, Human
agcaguacaauaaaa

SEQ ID NO: 3813818 - RNA, 11 nt, Human
agcaguacaug

SEQ ID NO: 3813819 - RNA, 15 nt, Human
agcaguacaugggaa

SEQ ID NO: 3813820 - RNA, 13 nt, Human
agcaguagacauu

SEQ ID NO: 3813821 - RNA, 20 nt, Human
agcaguagacauuuuaacaa

SEQ ID NO: 3813822 - RNA, 22 nt, Human
agcaguagacauuuuaacaaga

SEQ ID NO: 3813823 - RNA, 15 nt, Human
agcaguccaugcaug

SEQ ID NO: 3813824 - RNA, 15 nt, Human
agcaguccccuuccc

SEQ ID NO: 3813825 - RNA, 15 nt, Human
agcagucccugagac

SEQ ID NO: 3813826 - RNA, 22 nt, Human
agcaguccugccucagccuccg

SEQ ID NO: 3813827 - RNA, 15 nt, Human
agcaguccuuggccu

SEQ ID NO: 3813828 - RNA, 16 nt, Human
agcaguccuuggccug

SEQ ID NO: 3813829 - RNA, 22 nt, Human
agcaguccuuggccugcuaagg

SEQ ID NO: 3813830 - RNA, 14 nt, Human
agcagucucugccu

SEQ ID NO: 3813831 - RNA, 16 nt, Human
agcagucucugccuug

SEQ ID NO: 3813832 - RNA, 17 nt, Human
agcagucucugccuugc

SEQ ID NO: 3813833 - RNA, 15 nt, Human
agcagucugccugga

SEQ ID NO: 3813834 - RNA, 19 nt, Human
agcagucuuaugcuuccag

SEQ ID NO: 3813835 - RNA, 22 nt, Human
agcagucuuaugcuuccagaaa

SEQ ID NO: 3813836 - RNA, 20 nt, Human
agcagugaaugauucagugu

SEQ ID NO: 3813837 - RNA, 21 nt, Human
agcagugaaugauucaguguu

SEQ ID NO: 3813838 - RNA, 22 nt, Human
agcagugaaugauucaguguua

SEQ ID NO: 3813839 - RNA, 23 nt, Human
agcagugaguuacagcgagaggc

SEQ ID NO: 3813840 - RNA, 19 nt, Human
agcagugauugucuuaaua

SEQ ID NO: 3813841 - RNA, 13 nt, Human
agcagugcaugcu

SEQ ID NO: 3813842 - RNA, 16 nt, Human
agcagugcaugcuguc

SEQ ID NO: 3813843 - RNA, 18 nt, Human
agcagugcaugcuguccc

SEQ ID NO: 3813844 - RNA, 19 nt, Human
agcagugcaugcugucccu

SEQ ID NO: 3813845 - RNA, 12 nt, Human
agcagugcccag

SEQ ID NO: 3813846 - RNA, 20 nt, Human
agcagugcccagguggcugu

SEQ ID NO: 3813847 - RNA, 20 nt, Human
agcagugccuuccauaauua

SEQ ID NO: 3813848 - RNA, 15 nt, Human
agcaguggacaccag

SEQ ID NO: 3813849 - RNA, 19 nt, Human
agcaguggccuuauugcau

SEQ ID NO: 3813850 - RNA, 19 nt, Human
agcaguggcugguccaggg

SEQ ID NO: 3813851 - RNA, 15 nt, Human
agcagugucuuccau

SEQ ID NO: 3813852 - RNA, 15 nt, Human
agcagugugucuccu

SEQ ID NO: 3813853 - RNA, 17 nt, Human
agcagugugucuccugc

SEQ ID NO: 3813854 - RNA, 21 nt, Human
agcagugugucuccugcaugc

SEQ ID NO: 3813855 - RNA, 22 nt, Human
agcagugugucuccugcaugca

SEQ ID NO: 3813856 - RNA, 21 nt, Human
agcaguguuccccaucugggu

SEQ ID NO: 3813857 - RNA, 15 nt, Human
agcaguuaacuuuaa

SEQ ID NO: 3813858 - RNA, 21 nt, Human
agcaguuacaaaaaccuuccc

SEQ ID NO: 3813859 - RNA, 21 nt, Human
agcaguuaugugaccucacgu

SEQ ID NO: 3813860 - RNA, 22 nt, Human
agcaguucaauaauccaugaaa

SEQ ID NO: 3813861 - RNA, 15 nt, Human
agcaguucagagcug

SEQ ID NO: 3813862 - RNA, 16 nt, Human
agcaguucagagcugc

SEQ ID NO: 3813863 - RNA, 17 nt, Human
agcaguucugcagagga

SEQ ID NO: 3813864 - RNA, 20 nt, Human
agcaguugagacaagaaaau

SEQ ID NO: 3813865 - RNA, 22 nt, Human
agcaguugagacaagaaaauaa

SEQ ID NO: 3813866 - RNA, 16 nt, Human
agcaguugcugguaaa

SEQ ID NO: 3813867 - RNA, 23 nt, Human
agcaguugcugguaaaaugaaga

SEQ ID NO: 3813868 - RNA, 20 nt, Human
agcaguuucuguccugcugg

SEQ ID NO: 3813869 - RNA, 23 nt, Human
agcaguuugguuucuagcaugaa

SEQ ID NO: 3813870 - RNA, 13 nt, Human
agcaguuuucaag

SEQ ID NO: 3813871 - RNA, 18 nt, Human
agcaguuuucaagucaaa

SEQ ID NO: 3813872 - RNA, 22 nt, Human
agcaguuuucaagucaaauuaa

SEQ ID NO: 3813873 - RNA, 23 nt, Human
agcauaaaaauuagccaagugug

SEQ ID NO: 3813874 - RNA, 14 nt, Human
agcauaaagaauuu

SEQ ID NO: 3813875 - RNA, 21 nt, Human
acugguguuaucaccgugggc

SEQ ID NO: 3813876 - RNA, 14 nt, Human
acugguuauuuaaa

SEQ ID NO: 3813877 - RNA, 18 nt, Human
acugguuccauggccucu

SEQ ID NO: 3813878 - RNA, 16 nt, Human
acugguuccuucuucc

SEQ ID NO: 3813879 - RNA, 14 nt, Human
acugguucucaaug

SEQ ID NO: 3813880 - RNA, 17 nt, Human
acugguugcauggaaau

SEQ ID NO: 3813881 - RNA, 22 nt, Human
acugguuggcucccgcggugcc

SEQ ID NO: 3813882 - RNA, 20 nt, Human
acugguuguugccaaacagc

SEQ ID NO: 3813883 - RNA, 17 nt, Human
acugguuuacaggcccu

SEQ ID NO: 3813884 - RNA, 14 nt, Human
acugguuuucugcc

SEQ ID NO: 3813885 - RNA, 19 nt, Human
acugguuuucugccaauga

SEQ ID NO: 3813886 - RNA, 13 nt, Human
acuguaaaaugca

SEQ ID NO: 3813887 - RNA, 16 nt, Human
acuguaaaauguggga

SEQ ID NO: 3813888 - RNA, 22 nt, Human
acuguaaaaugugggauuaugg

SEQ ID NO: 3813889 - RNA, 16 nt, Human
acuguaaacacagaca

SEQ ID NO: 3813890 - RNA, 16 nt, Human
acuguaaagaaagaga

SEQ ID NO: 3813891 - RNA, 18 nt, Human
acuguaaagaaagagaga

SEQ ID NO: 3813892 - RNA, 21 nt, Human
acuguaaagaaagagagaaaa

SEQ ID NO: 3813893 - RNA, 13 nt, Human
acuguaaagaugu

SEQ ID NO: 3813894 - RNA, 11 nt, Human
acuguaaauca

SEQ ID NO: 3813895 - RNA, 17 nt, Human
acuguaacauauucugu

SEQ ID NO: 3813896 - RNA, 22 nt, Human
acuguaacugugucaugauuca

SEQ ID NO: 3813897 - RNA, 20 nt, Human
acuguaagaaaauaucacuu

SEQ ID NO: 3813898 - RNA, 19 nt, Human
acuguaagaauaauuuaua

SEQ ID NO: 3813899 - RNA, 20 nt, Human
acuguaagaauaauuuauag

SEQ ID NO: 3813900 - RNA, 13 nt, Human
acuguaagacauu

SEQ ID NO: 3813901 - RNA, 16 nt, Human
acuguaaggcaaucau

SEQ ID NO: 3813902 - RNA, 16 nt, Human
acuguaauaauaccuc

SEQ ID NO: 3813903 - RNA, 17 nt, Human
acuguaauaauaccuca

SEQ ID NO: 3813904 - RNA, 19 nt, Human
acuguaauaauaccucaau

SEQ ID NO: 3813905 - RNA, 19 nt, Human
acuguaauuugugauacaa

SEQ ID NO: 3813906 - RNA, 17 nt, Human
acuguacaaaaaaaucu

SEQ ID NO: 3813907 - RNA, 13 nt, Human
acuguacaaagua

SEQ ID NO: 3813908 - RNA, 11 nt, Human
acuguacaaua

SEQ ID NO: 3813909 - RNA, 18 nt, Human
acuguacaauaaaaacau

SEQ ID NO: 3813910 - RNA, 22 nt, Human
acuguacacacuuuauuuacuu

SEQ ID NO: 3813911 - RNA, 18 nt, Human
acuguacagacagaaaaa

SEQ ID NO: 3813912 - RNA, 21 nt, Human
acuguacagauugcugcuucu

SEQ ID NO: 3813913 - RNA, 14 nt, Human
acuguacagcuggc

SEQ ID NO: 3813914 - RNA, 18 nt, Human
acuguacagcuggcucua

SEQ ID NO: 3813915 - RNA, 12 nt, Human
acuguacagugu

SEQ ID NO: 3813916 - RNA, 15 nt, Human
acuguacagugucuu

SEQ ID NO: 3813917 - RNA, 20 nt, Human
acuguacaugaaaacacauu

SEQ ID NO: 3813918 - RNA, 23 nt, Human
acuguacaugaaaacacauuuuu

SEQ ID NO: 3813919 - RNA, 14 nt, Human
acuguacauuuaaa

SEQ ID NO: 3813920 - RNA, 16 nt, Human
acuguacauuuaaaau

SEQ ID NO: 3813921 - RNA, 22 nt, Human
acuguacauuuaaaauugcuau

SEQ ID NO: 3813922 - RNA, 12 nt, Human
acuguacuaauu

SEQ ID NO: 3813923 - RNA, 18 nt, Human
acuguacuaauucuuaca

SEQ ID NO: 3813924 - RNA, 17 nt, Human
acuguacuagucugugu

SEQ ID NO: 3813925 - RNA, 13 nt, Human
acuguacuccucc

SEQ ID NO: 3813926 - RNA, 18 nt, Human
acuguacuuaauaaauuc

SEQ ID NO: 3813927 - RNA, 13 nt, Human
acuguacuucacu

SEQ ID NO: 3813928 - RNA, 15 nt, Human
acuguacuugcucuu

SEQ ID NO: 3813929 - RNA, 23 nt, Human
acuguacuuugauucacauguuu

SEQ ID NO: 3813930 - RNA, 18 nt, Human
acuguagaaugauuucau

SEQ ID NO: 3813931 - RNA, 13 nt, Human
acuguagaugaug

SEQ ID NO: 3813932 - RNA, 15 nt, Human
acuguagauugcuuc

SEQ ID NO: 3813933 - RNA, 19 nt, Human
acuguagcucuaaaaucug

SEQ ID NO: 3813934 - RNA, 19 nt, Human
acuguagcuuuuaggaaua

SEQ ID NO: 3813935 - RNA, 19 nt, Human
acuguaguaaauaaugcuu

SEQ ID NO: 3813936 - RNA, 16 nt, Human
acuguagucucaggac

SEQ ID NO: 3813937 - RNA, 15 nt, Human
acuguaguucuaaga

SEQ ID NO: 3813938 - RNA, 16 nt, Human
acuguaguucuaagac

SEQ ID NO: 3813939 - RNA, 21 nt, Human
acuguaguuuuucuucaacau

SEQ ID NO: 3813940 - RNA, 12 nt, Human
acuguauaaaua

SEQ ID NO: 3813941 - RNA, 14 nt, Human
acuguauaaauagg

SEQ ID NO: 3813942 - RNA, 15 nt, Human
acuguauaaauagga

SEQ ID NO: 3813943 - RNA, 17 nt, Human
acuguauaaauaggaga

SEQ ID NO: 3813944 - RNA, 22 nt, Human
acuguauaaauaggagaggaug

SEQ ID NO: 3813945 - RNA, 21 nt, Human
acuguauaccccgugaagcau

SEQ ID NO: 3813946 - RNA, 21 nt, Human
acuguauagacaguuuguaaa

SEQ ID NO: 3813947 - RNA, 17 nt, Human
acuguauauuuguauga

SEQ ID NO: 3813948 - RNA, 16 nt, Human
acuguaucaugacaaa

SEQ ID NO: 3813949 - RNA, 20 nt, Human
acuguaucaugacaaagacu

SEQ ID NO: 3813950 - RNA, 22 nt, Human
acuguaucuaggcaacauagua

SEQ ID NO: 3813951 - RNA, 23 nt, Human
acuguaucuaggcaacauaguau

SEQ ID NO: 3813952 - RNA, 22 nt, Human
acuguaucucuaauacagugug

SEQ ID NO: 3813953 - RNA, 13 nt, Human
acuguaucugugu

SEQ ID NO: 3813954 - RNA, 14 nt, Human
agcccacguccugu

SEQ ID NO: 3813955 - RNA, 21 nt, Human
agcccacguccugucagugcc

SEQ ID NO: 3813956 - RNA, 22 nt, Human
agcccacguucucucugccugu

SEQ ID NO: 3813957 - RNA, 16 nt, Human
agcccacuccaucugg

SEQ ID NO: 3813958 - RNA, 21 nt, Human
agcccacuccaucugguagaa

SEQ ID NO: 3813959 - RNA, 14 nt, Human
agcccacucugcuc

SEQ ID NO: 3813960 - RNA, 20 nt, Human
agcccacugcccacccccuc

SEQ ID NO: 3813961 - RNA, 12 nt, Human
agcccacuggau

SEQ ID NO: 3813962 - RNA, 20 nt, Human
agcccacuggaucagaaaga

SEQ ID NO: 3813963 - RNA, 16 nt, Human
agcccacuguacuugc

SEQ ID NO: 3813964 - RNA, 14 nt, Human
agcccacuguccug

SEQ ID NO: 3813965 - RNA, 15 nt, Human
agcccacuguccugg

SEQ ID NO: 3813966 - RNA, 18 nt, Human
agcccacuguccugggcc

SEQ ID NO: 3813967 - RNA, 19 nt, Human
agcccacuguccugggccu

SEQ ID NO: 3813968 - RNA, 14 nt, Human
agcccagagaacag

SEQ ID NO: 3813969 - RNA, 21 nt, Human
agcccagagacauacuugaag

SEQ ID NO: 3813970 - RNA, 20 nt, Human
agcccagagacuuuguagau

SEQ ID NO: 3813971 - RNA, 21 nt, Human
agcccagagccuggcugccca

SEQ ID NO: 3813972 - RNA, 20 nt, Human
agcccagaguccccccacuc

SEQ ID NO: 3813973 - RNA, 18 nt, Human
agcccagaucagcuccua

SEQ ID NO: 3813974 - RNA, 22 nt, Human
agcccagauguuuuacgucugg

SEQ ID NO: 3813975 - RNA, 13 nt, Human
agcccagccacgu

SEQ ID NO: 3813976 - RNA, 12 nt, Human
agcccagccagc

SEQ ID NO: 3813977 - RNA, 14 nt, Human
agcccagcccagcu

SEQ ID NO: 3813978 - RNA, 16 nt, Human
agcccagcccagcugg

SEQ ID NO: 3813979 - RNA, 16 nt, Human
agcccagccccacucc

SEQ ID NO: 3813980 - RNA, 19 nt, Human
agcccagccccacuccucu

SEQ ID NO: 3813981 - RNA, 13 nt, Human
agcccagcuccag

SEQ ID NO: 3813982 - RNA, 15 nt, Human
agcccagcuggguca

SEQ ID NO: 3813983 - RNA, 16 nt, Human
agcccagcugguggga

SEQ ID NO: 3813984 - RNA, 23 nt, Human
agcccagcuugaaaccuucacuu

SEQ ID NO: 3813985 - RNA, 23 nt, Human
agcccagcuuggcccuuuccuuc

SEQ ID NO: 3813986 - RNA, 20 nt, Human
agcccaggaaaggcuccagg

SEQ ID NO: 3813987 - RNA, 24 nt, Human
agcccaggaaaggcuccaggagca

SEQ ID NO: 3813988 - RNA, 21 nt, Human
agcccaggaagucucaucugg

SEQ ID NO: 3813989 - RNA, 13 nt, Human
agcccaggagaga

SEQ ID NO: 3813990 - RNA, 16 nt, Human
agcccaggagccucac

SEQ ID NO: 3813991 - RNA, 17 nt, Human
agcccaggagccucacu

SEQ ID NO: 3813992 - RNA, 18 nt, Human
agcccaggagcuccccuc

SEQ ID NO: 3813993 - RNA, 12 nt, Human
agcccaggagga

SEQ ID NO: 3813994 - RNA, 20 nt, Human
agcccaggagggagcagagg

SEQ ID NO: 3813995 - RNA, 11 nt, Human
agcccaggagu

SEQ ID NO: 3813996 - RNA, 19 nt, Human
agcccaggauacuggcaca

SEQ ID NO: 3813997 - RNA, 12 nt, Human
agcccaggccac

SEQ ID NO: 3813998 - RNA, 21 nt, Human
agcccaggccaggacucugca

SEQ ID NO: 3813999 - RNA, 13 nt, Human
agcccaggccccu

SEQ ID NO: 3814000 - RNA, 21 nt, Human
agcccaggcgggagcgguggc

SEQ ID NO: 3814001 - RNA, 19 nt, Human
agcccagggagcggaaagc

SEQ ID NO: 3814002 - RNA, 16 nt, Human
agcccagggaggccga

SEQ ID NO: 3814003 - RNA, 23 nt, Human
agcccagggcaucuugcuggcua

SEQ ID NO: 3814004 - RNA, 14 nt, Human
agcccagggcuccu

SEQ ID NO: 3814005 - RNA, 16 nt, Human
agcccagggcuccugc

SEQ ID NO: 3814006 - RNA, 16 nt, Human
agcccaggguuccccc

SEQ ID NO: 3814007 - RNA, 17 nt, Human
agcccaggguuccccca

SEQ ID NO: 3814008 - RNA, 21 nt, Human
agcccaggguucccccagccc

SEQ ID NO: 3814009 - RNA, 22 nt, Human
agcccaggugccagccugaggc

SEQ ID NO: 3814010 - RNA, 18 nt, Human
agcccaguagaccuuguu

SEQ ID NO: 3814011 - RNA, 18 nt, Human
agcccaguucagcuuggg

SEQ ID NO: 3814012 - RNA, 14 nt, Human
agcccauaaccagu

SEQ ID NO: 3814013 - RNA, 15 nt, Human
agcccauacucagcc

SEQ ID NO: 3814014 - RNA, 18 nt, Human
agcccauacucagccugc

SEQ ID NO: 3814015 - RNA, 14 nt, Human
agcccauaugcuac

SEQ ID NO: 3814016 - RNA, 21 nt, Human
agcccauaugcuaccaccagc

SEQ ID NO: 3814017 - RNA, 22 nt, Human
agcccauccauaguaacugaca

SEQ ID NO: 3814018 - RNA, 21 nt, Human
agcccauccauuaggccagca

SEQ ID NO: 3814019 - RNA, 15 nt, Human
agcccaucccugccu

SEQ ID NO: 3814020 - RNA, 18 nt, Human
agcccaucccugccuggu

SEQ ID NO: 3814021 - RNA, 17 nt, Human
agcccauccugaccagc

SEQ ID NO: 3814022 - RNA, 17 nt, Human
agcccauggacuucaca

SEQ ID NO: 3814023 - RNA, 21 nt, Human
agcccauggagauugaccugg

SEQ ID NO: 3814024 - RNA, 22 nt, Human
agcccauggagauugaccugga

SEQ ID NO: 3814025 - RNA, 16 nt, Human
agcccauguucugccc

SEQ ID NO: 3814026 - RNA, 17 nt, Human
agcccauguucugcccc

SEQ ID NO: 3814027 - RNA, 22 nt, Human
agcccauguucugcccccagcc

SEQ ID NO: 3814028 - RNA, 14 nt, Human
agcccauucauucc

SEQ ID NO: 3814029 - RNA, 16 nt, Human
agcccauucucucucc

SEQ ID NO: 3814030 - RNA, 17 nt, Human
agcccauucucucuccu

SEQ ID NO: 3814031 - RNA, 18 nt, Human
agcccauucucucuccug

SEQ ID NO: 3814032 - RNA, 19 nt, Human
agcccauucucucuccugu

SEQ ID NO: 3814033 - RNA, 17 nt, Human
agcccauuuggagggcc

SEQ ID NO: 3814034 - RNA, 19 nt, Human
agcccauuuggagggccug

SEQ ID NO: 3814035 - RNA, 21 nt, Human
agccccaaaacucuccucugc

SEQ ID NO: 3814036 - RNA, 22 nt, Human
agccccaaaacucuccucugcu

SEQ ID NO: 3814037 - RNA, 19 nt, Human
agccccaaguccugaagag

SEQ ID NO: 3814038 - RNA, 12 nt, Human
agccccacacag

SEQ ID NO: 3814039 - RNA, 11 nt, Human
agccccacagc

SEQ ID NO: 3814040 - RNA, 15 nt, Human
agccccacagcccac

SEQ ID NO: 3814041 - RNA, 18 nt, Human
agccccacagcccacguc

SEQ ID NO: 3814042 - RNA, 20 nt, Human
agccccacagcccacguccu

SEQ ID NO: 3814043 - RNA, 13 nt, Human
agccccacccagg

SEQ ID NO: 3814044 - RNA, 20 nt, Human
agccccacccaggagggagg

SEQ ID NO: 3814045 - RNA, 18 nt, Human
agccccaccccagggcag

SEQ ID NO: 3814046 - RNA, 16 nt, Human
agccccacucucagag

SEQ ID NO: 3814047 - RNA, 21 nt, Human
agccccacucucagaggcccc

SEQ ID NO: 3814048 - RNA, 12 nt, Human
agccccacugcc

SEQ ID NO: 3814049 - RNA, 15 nt, Human
agccccacugccagc

SEQ ID NO: 3814050 - RNA, 16 nt, Human
agccccacugccagca

SEQ ID NO: 3814051 - RNA, 17 nt, Human
agccccacuuaccgcgu

SEQ ID NO: 3814052 - RNA, 16 nt, Human
agccccagagcagggu

SEQ ID NO: 3814053 - RNA, 13 nt, Human
agccccagcacca

SEQ ID NO: 3814054 - RNA, 12 nt, Human
agccccagcacu

SEQ ID NO: 3814055 - RNA, 13 nt, Human
agccccaggcagg

SEQ ID NO: 3814056 - RNA, 16 nt, Human
agccccaggcaggcug

SEQ ID NO: 3814057 - RNA, 12 nt, Human
agccccaggccu

SEQ ID NO: 3814058 - RNA, 10 nt, Human
agccccaggg

SEQ ID NO: 3814059 - RNA, 23 nt, Human
agccccagggucuucccuaccuc

SEQ ID NO: 3814060 - RNA, 18 nt, Human
agccccagggugcccaga

SEQ ID NO: 3814061 - RNA, 17 nt, Human
agccccaucagcuccag

SEQ ID NO: 3814062 - RNA, 20 nt, Human
agccccaucccaaacccuuc

SEQ ID NO: 3814063 - RNA, 13 nt, Human
agccccaucuguc

SEQ ID NO: 3814064 - RNA, 16 nt, Human
agccccaucugugcau

SEQ ID NO: 3814065 - RNA, 23 nt, Human
agccccaucugugcauucuccug

SEQ ID NO: 3814066 - RNA, 20 nt, Human
agccccaugcuggagccugu

SEQ ID NO: 3814067 - RNA, 18 nt, Human
agccccauucugccugcc

SEQ ID NO: 3814068 - RNA, 21 nt, Human
agccccauucugccugcccag

SEQ ID NO: 3814069 - RNA, 19 nt, Human
agcccccacccacuucccu

SEQ ID NO: 3814070 - RNA, 14 nt, Human
agcccccagccugu

SEQ ID NO: 3814071 - RNA, 16 nt, Human
agcccccagccuguca

SEQ ID NO: 3814072 - RNA, 12 nt, Human
agcccccaggaa

SEQ ID NO: 3814073 - RNA, 13 nt, Human
agcccccaggaag

SEQ ID NO: 3814074 - RNA, 18 nt, Human
agcccccaggcugcugga

SEQ ID NO: 3814075 - RNA, 18 nt, Human
agcccccccaacacugug

SEQ ID NO: 3814076 - RNA, 22 nt, Human
agcccccccaacacugugcccu

SEQ ID NO: 3814077 - RNA, 11 nt, Human
agcccccucac

SEQ ID NO: 3814078 - RNA, 21 nt, Human
agccgccaugcuccuggccca

SEQ ID NO: 3814079 - RNA, 18 nt, Human
agccgccauugccaccag

SEQ ID NO: 3814080 - RNA, 16 nt, Human
agccgccuuccuugac

SEQ ID NO: 3814081 - RNA, 17 nt, Human
agccgccuuccuugacc

SEQ ID NO: 3814082 - RNA, 14 nt, Human
agccgcuccugucu

SEQ ID NO: 3814083 - RNA, 17 nt, Human
agccgcuccugucugcc

SEQ ID NO: 3814084 - RNA, 19 nt, Human
agccgcuccugucugccag

SEQ ID NO: 3814085 - RNA, 17 nt, Human
agccgcugcccggcgcc

SEQ ID NO: 3814086 - RNA, 18 nt, Human
agccgcugcccggcgccc

SEQ ID NO: 3814087 - RNA, 22 nt, Human
agccgcugcccggcgcccucug

SEQ ID NO: 3814088 - RNA, 16 nt, Human
agccgcugugagcccc

SEQ ID NO: 3814089 - RNA, 22 nt, Human
agccgcugugagccccuggucc

SEQ ID NO: 3814090 - RNA, 20 nt, Human
agccgcuuggcgaugccagc

SEQ ID NO: 3814091 - RNA, 23 nt, Human
agccggacuuucggaguuggggg

SEQ ID NO: 3814092 - RNA, 18 nt, Human
agccggccaauggaaacc

SEQ ID NO: 3814093 - RNA, 23 nt, Human
agccggccucucuggccucccac

SEQ ID NO: 3814094 - RNA, 21 nt, Human
agccggcguggcaaauauaaa

SEQ ID NO: 3814095 - RNA, 20 nt, Human
agccgggaaagaagagccgg

SEQ ID NO: 3814096 - RNA, 23 nt, Human
agccgggaacagacaacagaagu

SEQ ID NO: 3814097 - RNA, 16 nt, Human
agccgggccccugggc

SEQ ID NO: 3814098 - RNA, 19 nt, Human
agccgggccuggggcuccu

SEQ ID NO: 3814099 - RNA, 22 nt, Human
agccgggcgugguggcgggcac

SEQ ID NO: 3814100 - RNA, 21 nt, Human
agccggggaguuucuuuccug

SEQ ID NO: 3814101 - RNA, 16 nt, Human
agccgggucugccucu

SEQ ID NO: 3814102 - RNA, 21 nt, Human
agccgggucugccucuucugg

SEQ ID NO: 3814103 - RNA, 16 nt, Human
agccgguaacuguccu

SEQ ID NO: 3814104 - RNA, 13 nt, Human
agccgguuccugu

SEQ ID NO: 3814105 - RNA, 14 nt, Human
agccgguuccuguc

SEQ ID NO: 3814106 - RNA, 14 nt, Human
agccgucaccccug

SEQ ID NO: 3814107 - RNA, 19 nt, Human
agccgucagccaaauguaa

SEQ ID NO: 3814108 - RNA, 20 nt, Human
agccgucagccaaauguaau

SEQ ID NO: 3814109 - RNA, 13 nt, Human
agccgugagcaug

SEQ ID NO: 3814110 - RNA, 18 nt, Human
agccgugaugcucaggcu

SEQ ID NO: 3814111 - RNA, 20 nt, Human
agccgugaugcucaggcuug

SEQ ID NO: 3814112 - RNA, 16 nt, Human
agccgugcccugcccc

SEQ ID NO: 3814113 - RNA, 16 nt, Human
agccgugccuucagcu

SEQ ID NO: 3814114 - RNA, 17 nt, Human
agccgugccuucagcuc

SEQ ID NO: 3814115 - RNA, 18 nt, Human
agccgugcucgccccagc

SEQ ID NO: 3814116 - RNA, 14 nt, Human
agccguggcuuccc

SEQ ID NO: 3814117 - RNA, 15 nt, Human
agccguggucccuga

SEQ ID NO: 3814118 - RNA, 16 nt, Human
agccgugguccuuugg

SEQ ID NO: 3814119 - RNA, 13 nt, Human
agccuaaaaauaa

SEQ ID NO: 3814120 - RNA, 14 nt, Human
agccuaaaaauaaa

SEQ ID NO: 3814121 - RNA, 18 nt, Human
agccuaaaaauaaagcac

SEQ ID NO: 3814122 - RNA, 16 nt, Human
agccuaaagauuuuga

SEQ ID NO: 3814123 - RNA, 22 nt, Human
agccuaaaugccuuagaaaugu

SEQ ID NO: 3814124 - RNA, 17 nt, Human
agccuaagauauacuug

SEQ ID NO: 3814125 - RNA, 15 nt, Human
agccuaaucccuggg

SEQ ID NO: 3814126 - RNA, 14 nt, Human
agccuacaggccuc

SEQ ID NO: 3814127 - RNA, 17 nt, Human
agccuaccugcucucca

SEQ ID NO: 3814128 - RNA, 14 nt, Human
agccuaccuguaug

SEQ ID NO: 3814129 - RNA, 16 nt, Human
agccuacgcugaagau

SEQ ID NO: 3814130 - RNA, 14 nt, Human
agccuacucuccuu

SEQ ID NO: 3814131 - RNA, 18 nt, Human
agccuagauaugaauaua

SEQ ID NO: 3814132 - RNA, 19 nt, Human
agccuagauaugaauauau

SEQ ID NO: 3814133 - RNA, 15 nt, Human
agccuagauguuuua

SEQ ID NO: 3814134 - RNA, 16 nt, Human
agccuagauguuuuau

SEQ ID NO: 3814135 - RNA, 17 nt, Human
agccuagcacagcagcu

SEQ ID NO: 3814136 - RNA, 17 nt, Human
agccuagccgaccucag

SEQ ID NO: 3814137 - RNA, 20 nt, Human
agccuaggaccacucagccc

SEQ ID NO: 3814138 - RNA, 14 nt, Human
agccuaggccaggu

SEQ ID NO: 3814139 - RNA, 22 nt, Human
agccuaggccuaguccugcgaa

SEQ ID NO: 3814140 - RNA, 20 nt, Human
agccuaggggucagggacca

SEQ ID NO: 3814141 - RNA, 23 nt, Human
agccuagugaaggcuucucucug

SEQ ID NO: 3814142 - RNA, 18 nt, Human
agccuaguggcuuguccu

SEQ ID NO: 3814143 - RNA, 19 nt, Human
agccuaguggcuuguccuc

SEQ ID NO: 3814144 - RNA, 22 nt, Human
agccuaguucauccaauccuca

SEQ ID NO: 3814145 - RNA, 17 nt, Human
agccuaugagcauccug

SEQ ID NO: 3814146 - RNA, 14 nt, Human
agccuauggcagaa

SEQ ID NO: 3814147 - RNA, 15 nt, Human
agccuauuuaccugc

SEQ ID NO: 3814148 - RNA, 18 nt, Human
agccucaaauccaggacc

SEQ ID NO: 3814149 - RNA, 19 nt, Human
agccucaaauccaggaccc

SEQ ID NO: 3814150 - RNA, 14 nt, Human
agccucaaaugcag

SEQ ID NO: 3814151 - RNA, 20 nt, Human
agccucaaccuccugggcua

SEQ ID NO: 3814152 - RNA, 21 nt, Human
agccucaagguuuuagguucu

SEQ ID NO: 3814153 - RNA, 18 nt, Human
agccucaauaagccuugu

SEQ ID NO: 3814154 - RNA, 23 nt, Human
agccucacgcuccuuucugaucu

SEQ ID NO: 3814155 - RNA, 16 nt, Human
agccucacuugaaugu

SEQ ID NO: 3814156 - RNA, 13 nt, Human
agccucagacugg

SEQ ID NO: 3814157 - RNA, 22 nt, Human
agccucagaugauuuccccccu

SEQ ID NO: 3814158 - RNA, 16 nt, Human
agccucagauuccuuc

SEQ ID NO: 3814159 - RNA, 17 nt, Human
agccucagcccccugcu

SEQ ID NO: 3814160 - RNA, 16 nt, Human
agccucagcuacccac

SEQ ID NO: 3814161 - RNA, 16 nt, Human
agccucaggacuggga

SEQ ID NO: 3814162 - RNA, 18 nt, Human
agccucaggacugggagc

SEQ ID NO: 3814163 - RNA, 20 nt, Human
agccucaggggucugagcuc

SEQ ID NO: 3814164 - RNA, 17 nt, Human
agccucaguccuccccu

SEQ ID NO: 3814165 - RNA, 13 nt, Human
agccucagucucc

SEQ ID NO: 3814166 - RNA, 22 nt, Human
agccucagucucccucccuugg

SEQ ID NO: 3814167 - RNA, 19 nt, Human
agccucauauuuaaagaca

SEQ ID NO: 3814168 - RNA, 15 nt, Human
agccucaucaucaga

SEQ ID NO: 3814169 - RNA, 14 nt, Human
agccucauccgagg

SEQ ID NO: 3814170 - RNA, 19 nt, Human
agccucauccgaggcaggg

SEQ ID NO: 3814171 - RNA, 13 nt, Human
agccuccacagcg

SEQ ID NO: 3814172 - RNA, 15 nt, Human
agccuccacagcgag

SEQ ID NO: 3814173 - RNA, 23 nt, Human
agccuccacagcgagggcagcug

SEQ ID NO: 3814174 - RNA, 22 nt, Human
agccuccaccccacaacccaaa

SEQ ID NO: 3814175 - RNA, 20 nt, Human
agccuccacugccucuggaa

SEQ ID NO: 3814176 - RNA, 12 nt, Human
agccuccagccu

SEQ ID NO: 3814177 - RNA, 16 nt, Human
agccuccagccucugu

SEQ ID NO: 3814178 - RNA, 18 nt, Human
agccuccagccucuguuc

SEQ ID NO: 3814179 - RNA, 16 nt, Human
agccuccaguccaagg

SEQ ID NO: 3814180 - RNA, 20 nt, Human
agccuccaugcugccuccag

SEQ ID NO: 3814181 - RNA, 21 nt, Human
agccuccauuuaguucuuugu

SEQ ID NO: 3814182 - RNA, 16 nt, Human
agccucccaaggagaa

SEQ ID NO: 3814183 - RNA, 22 nt, Human
agccucccacgacugcccggca

SEQ ID NO: 3814184 - RNA, 18 nt, Human
agccucccauccagggcc

SEQ ID NO: 3814185 - RNA, 18 nt, Human
agccuccccugccagggc

SEQ ID NO: 3814186 - RNA, 22 nt, Human
agccucccgaauagcugggacu

SEQ ID NO: 3814187 - RNA, 13 nt, Human
agccucccuccgc

SEQ ID NO: 3814188 - RNA, 11 nt, Human
agccucccuga

SEQ ID NO: 3814189 - RNA, 17 nt, Human
agccucccugaagacca

SEQ ID NO: 3814190 - RNA, 14 nt, Human
agccucccugaagc

SEQ ID NO: 3814191 - RNA, 16 nt, Human
agccucccugaagccu

SEQ ID NO: 3814192 - RNA, 23 nt, Human
agccucccugccucaggccucug

SEQ ID NO: 3814193 - RNA, 17 nt, Human
agccuccgagagggaga

SEQ ID NO: 3814194 - RNA, 17 nt, Human
agccuccgcuucccugg

SEQ ID NO: 3814195 - RNA, 18 nt, Human
agccuccgcuucccuggu

SEQ ID NO: 3814196 - RNA, 15 nt, Human
agccuccggaagcug

SEQ ID NO: 3814197 - RNA, 23 nt, Human
agccuccggaguagcugggacca

SEQ ID NO: 3814198 - RNA, 18 nt, Human
agccuccguauuucagac

SEQ ID NO: 3814199 - RNA, 20 nt, Human
agccuccucaucccguguuc

SEQ ID NO: 3814200 - RNA, 13 nt, Human
agccuccuccuga

SEQ ID NO: 3814201 - RNA, 13 nt, Human
agccuccucucuc

SEQ ID NO: 3814202 - RNA, 12 nt, Human
agccuccucugu

SEQ ID NO: 3814203 - RNA, 15 nt, Human
agccuccucugucug

SEQ ID NO: 3814204 - RNA, 19 nt, Human
agccuccugaguagcugga

SEQ ID NO: 3814205 - RNA, 18 nt, Human
agccuccugcccaguccc

SEQ ID NO: 3814206 - RNA, 13 nt, Human
agccuccugcccu

SEQ ID NO: 3814207 - RNA, 16 nt, Human
agccucgaggugccuu

SEQ ID NO: 3814208 - RNA, 18 nt, Human
agccucgaggugccuucu

SEQ ID NO: 3814209 - RNA, 18 nt, Human
agccucgcaacccgugcc

SEQ ID NO: 3814210 - RNA, 21 nt, Human
agccucgcaacccgugccaag

SEQ ID NO: 3814211 - RNA, 20 nt, Human
agccucgcaggccucccugc

SEQ ID NO: 3814212 - RNA, 16 nt, Human
agccucgccccuggca

SEQ ID NO: 3814213 - RNA, 20 nt, Human
agccucgccccuggcagaga

SEQ ID NO: 3814214 - RNA, 14 nt, Human
agccucucaucccc

SEQ ID NO: 3814215 - RNA, 14 nt, Human
agccucuccaggaa

SEQ ID NO: 3814216 - RNA, 23 nt, Human
agccucuccaggaaugccuccuc

SEQ ID NO: 3814217 - RNA, 13 nt, Human
agccucuccccug

SEQ ID NO: 3814218 - RNA, 14 nt, Human
agccucuccccugc

SEQ ID NO: 3814219 - RNA, 19 nt, Human
agccucuccccugccugcc

SEQ ID NO: 3814220 - RNA, 13 nt, Human
agccucuccugua

SEQ ID NO: 3814221 - RNA, 17 nt, Human
agccucucuuccuaucc

SEQ ID NO: 3814222 - RNA, 21 nt, Human
agccucugacuuaagcugccu

SEQ ID NO: 3814223 - RNA, 18 nt, Human
agccucugagccccuggg

SEQ ID NO: 3814224 - RNA, 18 nt, Human
agccucugcccaggcacu

SEQ ID NO: 3814225 - RNA, 13 nt, Human
agccucugcuccc

SEQ ID NO: 3814226 - RNA, 15 nt, Human
agccucugcucccca

SEQ ID NO: 3814227 - RNA, 14 nt, Human
agccucugcugcca

SEQ ID NO: 3814228 - RNA, 18 nt, Human
acuuccaaacuaauuuuu

SEQ ID NO: 3814229 - RNA, 18 nt, Human
acuuccaaagaaaguucu

SEQ ID NO: 3814230 - RNA, 16 nt, Human
acuuccacaggguccc

SEQ ID NO: 3814231 - RNA, 16 nt, Human
acuuccaccagccugc

SEQ ID NO: 3814232 - RNA, 20 nt, Human
acuuccaggggaaccugcca

SEQ ID NO: 3814233 - RNA, 20 nt, Human
acuuccagguguuacuguaa

SEQ ID NO: 3814234 - RNA, 17 nt, Human
acuuccauaaucuggac

SEQ ID NO: 3814235 - RNA, 16 nt, Human
acuuccauacagcucu

SEQ ID NO: 3814236 - RNA, 17 nt, Human
acuuccauacagcucua

SEQ ID NO: 3814237 - RNA, 12 nt, Human
acuuccauagug

SEQ ID NO: 3814238 - RNA, 14 nt, Human
acuuccaugccuua

SEQ ID NO: 3814239 - RNA, 20 nt, Human
acuuccaugccuuaaaccua

SEQ ID NO: 3814240 - RNA, 14 nt, Human
acuucccacccugc

SEQ ID NO: 3814241 - RNA, 19 nt, Human
acuucccacccugccccuc

SEQ ID NO: 3814242 - RNA, 20 nt, Human
acuucccacucuagggcagu

SEQ ID NO: 3814243 - RNA, 18 nt, Human
acuugagggcccagagca

SEQ ID NO: 3814244 - RNA, 15 nt, Human
acuugaggguaauaa

SEQ ID NO: 3814245 - RNA, 15 nt, Human
acuugagguggccuc

SEQ ID NO: 3814246 - RNA, 21 nt, Human
acuugaguaaaauacucuuuu

SEQ ID NO: 3814247 - RNA, 20 nt, Human
acuugauagcaaacacuggg

SEQ ID NO: 3814248 - RNA, 20 nt, Human
acuugaucauuuuuaccauu

SEQ ID NO: 3814249 - RNA, 17 nt, Human
acuugauccauuucuaa

SEQ ID NO: 3814250 - RNA, 21 nt, Human
acuugaugaguguaacaagaa

SEQ ID NO: 3814251 - RNA, 19 nt, Human
acuugaugugccauuuuaa

SEQ ID NO: 3814252 - RNA, 17 nt, Human
acuugauuaagauuuua

SEQ ID NO: 3814253 - RNA, 19 nt, Human
acuugauuaagauuuuaca

SEQ ID NO: 3814254 - RNA, 17 nt, Human
acuugcaaaaaggguca

SEQ ID NO: 3814255 - RNA, 13 nt, Human
acuugcaccucug

SEQ ID NO: 3814256 - RNA, 12 nt, Human
acuugcaugaag

SEQ ID NO: 3814257 - RNA, 21 nt, Human
acuugcaugaagagaagcaau

SEQ ID NO: 3814258 - RNA, 17 nt, Human
acuugcauuuuugcagg

SEQ ID NO: 3814259 - RNA, 19 nt, Human
acuugcauuuuugcaggag

SEQ ID NO: 3814260 - RNA, 14 nt, Human
acuugccaaauuua

SEQ ID NO: 3814261 - RNA, 19 nt, Human
acuugccaaauuuagauuu

SEQ ID NO: 3814262 - RNA, 21 nt, Human
acuugccauuccaaaauauua

SEQ ID NO: 3814263 - RNA, 12 nt, Human
acuugcccugcu

SEQ ID NO: 3814264 - RNA, 22 nt, Human
acuugccgcgucgcccucccag

SEQ ID NO: 3814265 - RNA, 13 nt, Human
acuugccucuuuu

SEQ ID NO: 3814266 - RNA, 22 nt, Human
acuugccucuuuuaccugcugc

SEQ ID NO: 3814267 - RNA, 12 nt, Human
acuugccugggu

SEQ ID NO: 3814268 - RNA, 14 nt, Human
acuugccuggguca

SEQ ID NO: 3814269 - RNA, 17 nt, Human
acuugcucuugaugccu

SEQ ID NO: 3814270 - RNA, 21 nt, Human
acuugcugaaucggaaucucu

SEQ ID NO: 3814271 - RNA, 13 nt, Human
acuugcugcuguc

SEQ ID NO: 3814272 - RNA, 19 nt, Human
acuugcugucccuuggaac

SEQ ID NO: 3814273 - RNA, 18 nt, Human
acuugcuguuuuguucug

SEQ ID NO: 3814274 - RNA, 16 nt, Human
acuugcuuaaauguga

SEQ ID NO: 3814275 - RNA, 23 nt, Human
acuugcuuaaauuucuuauguga

SEQ ID NO: 3814276 - RNA, 19 nt, Human
acuugcuuaucaacuuccu

SEQ ID NO: 3814277 - RNA, 21 nt, Human
acuugcuuaucaacuuccuaa

SEQ ID NO: 3814278 - RNA, 21 nt, Human
acuugcuuuaccuuuucaggg

SEQ ID NO: 3814279 - RNA, 22 nt, Human
acuugcuuuaccuuuucagggc

SEQ ID NO: 3814280 - RNA, 21 nt, Human
acuuggaaaaauccagaaaga

SEQ ID NO: 3814281 - RNA, 22 nt, Human
acuuggaaaaauccagaaagaa

SEQ ID NO: 3814282 - RNA, 16 nt, Human
acuuggaaauauuaaa

SEQ ID NO: 3814283 - RNA, 16 nt, Human
acuuggaauuuguaac

SEQ ID NO: 3814284 - RNA, 21 nt, Human
acuuggaauuuguaaccucag

SEQ ID NO: 3814285 - RNA, 21 nt, Human
acuuggaugaguuuugggaag

SEQ ID NO: 3814286 - RNA, 15 nt, Human
acuuggauucucuaa

SEQ ID NO: 3814287 - RNA, 20 nt, Human
acuuggauuuaguuucagua

SEQ ID NO: 3814288 - RNA, 15 nt, Human
acuuggcaacagaag

SEQ ID NO: 3814289 - RNA, 18 nt, Human
acuuggcaucagcuggcg

SEQ ID NO: 3814290 - RNA, 10 nt, Human
acuuggccaa

SEQ ID NO: 3814291 - RNA, 15 nt, Human
acuuggccucacccu

SEQ ID NO: 3814292 - RNA, 17 nt, Human
acuuggcuacacaggga

SEQ ID NO: 3814293 - RNA, 20 nt, Human
acuuggcucgaaucucugug

SEQ ID NO: 3814294 - RNA, 22 nt, Human
acuuggcucgaaucucugugcc

SEQ ID NO: 3814295 - RNA, 13 nt, Human
acuuggcuuucau

SEQ ID NO: 3814296 - RNA, 20 nt, Human
acuugggcacccccagccug

SEQ ID NO: 3814297 - RNA, 21 nt, Human
acuugggcacccccagccugg

SEQ ID NO: 3814298 - RNA, 20 nt, Human
acuuggggagauggaguucu

SEQ ID NO: 3814299 - RNA, 16 nt, Human
acuugggggcucagca

SEQ ID NO: 3814300 - RNA, 20 nt, Human
acuugggggcucagcaaggc

SEQ ID NO: 3814301 - RNA, 15 nt, Human
acuuggggggcugag

SEQ ID NO: 3814302 - RNA, 19 nt, Human
acuugguccaacugcaacu

SEQ ID NO: 3814303 - RNA, 15 nt, Human
acuuggucugugaga

SEQ ID NO: 3814304 - RNA, 14 nt, Human
acuugguuauacau

SEQ ID NO: 3814305 - RNA, 15 nt, Human
acuugguuauacaug

SEQ ID NO: 3814306 - RNA, 20 nt, Human
acuugguuauacaugacacu

SEQ ID NO: 3814307 - RNA, 15 nt, Human
acuugguucugcuuc

SEQ ID NO: 3814308 - RNA, 12 nt, Human
acuugguuugug

SEQ ID NO: 3814309 - RNA, 16 nt, Human
acuugguuuuuaaaaa

SEQ ID NO: 3814310 - RNA, 14 nt, Human
acuuguaaauacac

SEQ ID NO: 3814311 - RNA, 16 nt, Human
acuuguaaauacacca

SEQ ID NO: 3814312 - RNA, 13 nt, Human
acuuguaaauaua

SEQ ID NO: 3814313 - RNA, 14 nt, Human
acuuguaaaugcug

SEQ ID NO: 3814314 - RNA, 17 nt, Human
acuuguaauauuuuuau

SEQ ID NO: 3814315 - RNA, 15 nt, Human
acuuguaauuaugga

SEQ ID NO: 3814316 - RNA, 16 nt, Human
acuuguaauuauggag

SEQ ID NO: 3814317 - RNA, 14 nt, Human
acuuguagcuguaa

SEQ ID NO: 3814318 - RNA, 23 nt, Human
acuuguaggauaagugaaaugga

SEQ ID NO: 3814319 - RNA, 22 nt, Human
acuuguauauucuauuuuacaa

SEQ ID NO: 3814320 - RNA, 14 nt, Human
acuuguauauuugu

SEQ ID NO: 3814321 - RNA, 15 nt, Human
acuuguauauuugua

SEQ ID NO: 3814322 - RNA, 16 nt, Human
acuuguauauuuguac

SEQ ID NO: 3814323 - RNA, 17 nt, Human
acuuguauauuuguaca

SEQ ID NO: 3814324 - RNA, 14 nt, Human
acuuguaugaaaga

SEQ ID NO: 3814325 - RNA, 14 nt, Human
acuuguauuaugug

SEQ ID NO: 3814326 - RNA, 18 nt, Human
acuuguauuauguguguu

SEQ ID NO: 3814327 - RNA, 19 nt, Human
acuuguauuauguguguuu

SEQ ID NO: 3814328 - RNA, 18 nt, Human
acuugucaaagaagguuu

SEQ ID NO: 3814329 - RNA, 20 nt, Human
acuugucaagccugugcaaa

SEQ ID NO: 3814330 - RNA, 16 nt, Human
acuugucaauaaaauc

SEQ ID NO: 3814331 - RNA, 24 nt, Human
acuugucauuguuauauaaucauu

SEQ ID NO: 3814332 - RNA, 17 nt, Human
acuuguccuagcacaga

SEQ ID NO: 3814333 - RNA, 20 nt, Human
acuuguccuuagccuggacc

SEQ ID NO: 3814334 - RNA, 15 nt, Human
acuugucuaaauaag

SEQ ID NO: 3814335 - RNA, 19 nt, Human
acuugucuaaauaaguuug

SEQ ID NO: 3814336 - RNA, 16 nt, Human
acuugucuauuaccug

SEQ ID NO: 3814337 - RNA, 15 nt, Human
acuugucucauuuua

SEQ ID NO: 3814338 - RNA, 17 nt, Human
acuugucucauuuuaau

SEQ ID NO: 3814339 - RNA, 12 nt, Human
acuugucuuaaa

SEQ ID NO: 3814340 - RNA, 15 nt, Human
acuugucuuuuucug

SEQ ID NO: 3814341 - RNA, 20 nt, Human
acuugugaaacacagcuguu

SEQ ID NO: 3814342 - RNA, 16 nt, Human
acuugugauuauuuau

SEQ ID NO: 3814343 - RNA, 17 nt, Human
acuugugcacaggcaga

SEQ ID NO: 3814344 - RNA, 13 nt, Human
acuugugccaaca

SEQ ID NO: 3814345 - RNA, 14 nt, Human
acuuguggacacag

SEQ ID NO: 3814346 - RNA, 17 nt, Human
acuuguggacacagcuc

SEQ ID NO: 3814347 - RNA, 18 nt, Human
acuuguggacacagcucu

SEQ ID NO: 3814348 - RNA, 17 nt, Human
acuugugguuuucaaau

SEQ ID NO: 3814349 - RNA, 21 nt, Human
acuuguguaaauacaauuuug

SEQ ID NO: 3814350 - RNA, 22 nt, Human
acuuguguaaauacaauuuugu

SEQ ID NO: 3814351 - RNA, 22 nt, Human
acuugugucccuaauguguuua

SEQ ID NO: 3814352 - RNA, 16 nt, Human
acuugugucucugugc

SEQ ID NO: 3814353 - RNA, 11 nt, Human
acuugugucug

SEQ ID NO: 3814354 - RNA, 23 nt, Human
acuugugugugggcugugagugu

SEQ ID NO: 3814355 - RNA, 16 nt, Human
acuuguuagaaaugca

SEQ ID NO: 3814356 - RNA, 14 nt, Human
acuuguuagaucua

SEQ ID NO: 3814357 - RNA, 15 nt, Human
acuuguuauugugaa

SEQ ID NO: 3814358 - RNA, 19 nt, Human
acuuguucuuccaaagcag

SEQ ID NO: 3814359 - RNA, 16 nt, Human
acuuguugccuauaag

SEQ ID NO: 3814360 - RNA, 21 nt, Human
acuuguugccuauaagccaaa

SEQ ID NO: 3814361 - RNA, 16 nt, Human
acuuguuguuuaaugu

SEQ ID NO: 3814362 - RNA, 16 nt, Human
acuuguuugucuucca

SEQ ID NO: 3814363 - RNA, 17 nt, Human
acuuguuugucuuccau

SEQ ID NO: 3814364 - RNA, 17 nt, Human
acuuguuuuaugcucag

SEQ ID NO: 3814365 - RNA, 13 nt, Human
acuuguuuuggau

SEQ ID NO: 3814366 - RNA, 16 nt, Human
acuuguuuuggaugcc

SEQ ID NO: 3814367 - RNA, 15 nt, Human
acuuguuuuuguaaa

SEQ ID NO: 3814368 - RNA, 23 nt, Human
acuuguuuuuguuuuuguuuugu

SEQ ID NO: 3814369 - RNA, 14 nt, Human
acuuuaaaaaauau

SEQ ID NO: 3814370 - RNA, 21 nt, Human
acuuuaaaaaauauuuauuaa

SEQ ID NO: 3814371 - RNA, 14 nt, Human
acuuuaaaaauuua

SEQ ID NO: 3814372 - RNA, 19 nt, Human
acuuuaaaaauuuacuaca

SEQ ID NO: 3814373 - RNA, 12 nt, Human
acuuuaaaacac

SEQ ID NO: 3814374 - RNA, 16 nt, Human
acuuuaaaaggagcca

SEQ ID NO: 3814375 - RNA, 11 nt, Human
acuuuaaacua

SEQ ID NO: 3814376 - RNA, 12 nt, Human
acuuuaaaggaa

SEQ ID NO: 3814377 - RNA, 23 nt, Human
acuuuaacauaagcuauuuuucu

SEQ ID NO: 3814378 - RNA, 21 nt, Human
acuuuaacuuaguuuugcaua

SEQ ID NO: 3814379 - RNA, 22 nt, Human
acuuuaacuuaguuuugcauag

SEQ ID NO: 3814380 - RNA, 20 nt, Human
acuuuaacuucuguuuuacc

SEQ ID NO: 3814381 - RNA, 17 nt, Human
acuuuaagacugagcac

SEQ ID NO: 3814382 - RNA, 17 nt, Human
acuuuaagagagaaauc

SEQ ID NO: 3814383 - RNA, 14 nt, Human
acuuuaagcacuac

SEQ ID NO: 3814384 - RNA, 15 nt, Human
acuuuaagcacuaca

SEQ ID NO: 3814385 - RNA, 16 nt, Human
acuuuaagcacuacau

SEQ ID NO: 3814386 - RNA, 18 nt, Human
acuuuaaguuucaggaua

SEQ ID NO: 3814387 - RNA, 19 nt, Human
acuuuaauucucaugugau

SEQ ID NO: 3814388 - RNA, 18 nt, Human
agaaagccccacccaggc

SEQ ID NO: 3814389 - RNA, 19 nt, Human
agaaagccugggugacauu

SEQ ID NO: 3814390 - RNA, 19 nt, Human
agaaagccuguuccccuca

SEQ ID NO: 3814391 - RNA, 22 nt, Human
agaaagccuguuccccucacug

SEQ ID NO: 3814392 - RNA, 13 nt, Human
agaaagccuucuu

SEQ ID NO: 3814393 - RNA, 13 nt, Human
agaaagcugacuu

SEQ ID NO: 3814394 - RNA, 17 nt, Human
agaaagcugacuuggcu

SEQ ID NO: 3814395 - RNA, 22 nt, Human
agaaagcugacuuggcuggugu

SEQ ID NO: 3814396 - RNA, 16 nt, Human
agaaagcugguaaacu

SEQ ID NO: 3814397 - RNA, 20 nt, Human
agaaagcugguaaacuauuu

SEQ ID NO: 3814398 - RNA, 18 nt, Human
agaaaggaaaaacaaacu

SEQ ID NO: 3814399 - RNA, 14 nt, Human
agaaaggaacauuu

SEQ ID NO: 3814400 - RNA, 18 nt, Human
agaaaggaagcauuguaa

SEQ ID NO: 3814401 - RNA, 19 nt, Human
agaaaggaagcauuguaaa

SEQ ID NO: 3814402 - RNA, 14 nt, Human
agaaaggacucugg

SEQ ID NO: 3814403 - RNA, 16 nt, Human
agaaaggauauuuaag

SEQ ID NO: 3814404 - RNA, 21 nt, Human
agaaaggauauuuaagaaaau

SEQ ID NO: 3814405 - RNA, 17 nt, Human
agaaaggccugcacaca

SEQ ID NO: 3814406 - RNA, 17 nt, Human
agaaaggccuuuaaaau

SEQ ID NO: 3814407 - RNA, 13 nt, Human
agaaagggagggc

SEQ ID NO: 3814408 - RNA, 15 nt, Human
agaaagggagggcuc

SEQ ID NO: 3814409 - RNA, 22 nt, Human
agaaagggcccugggccugccu

SEQ ID NO: 3814410 - RNA, 14 nt, Human
agaaaggggagccc

SEQ ID NO: 3814411 - RNA, 17 nt, Human
agaaaggggagcccacu

SEQ ID NO: 3814412 - RNA, 19 nt, Human
agaaaggguucuguaaaau

SEQ ID NO: 3814413 - RNA, 20 nt, Human
agaaagguggacuggaaggg

SEQ ID NO: 3814414 - RNA, 16 nt, Human
agaaagguuaguauca

SEQ ID NO: 3814415 - RNA, 21 nt, Human
agaaagguuuugagcaugggu

SEQ ID NO: 3814416 - RNA, 20 nt, Human
agaaagucauuccuucuuuu

SEQ ID NO: 3814417 - RNA, 20 nt, Human
agaaagucgaauuaauagcu

SEQ ID NO: 3814418 - RNA, 22 nt, Human
agaaagucuaucuaaugacaug

SEQ ID NO: 3814419 - RNA, 15 nt, Human
agaaagugaagcaaa

SEQ ID NO: 3814420 - RNA, 23 nt, Human
agaaagugaagcaaaucagaaac

SEQ ID NO: 3814421 - RNA, 21 nt, Human
agaaagugaauaaaaauuaag

SEQ ID NO: 3814422 - RNA, 16 nt, Human
agaaagugagcagugu

SEQ ID NO: 3814423 - RNA, 15 nt, Human
agaaagugauuucua

SEQ ID NO: 3814424 - RNA, 19 nt, Human
agaaagugccugacacacu

SEQ ID NO: 3814425 - RNA, 17 nt, Human
agaaagugccuuucagg

SEQ ID NO: 3814426 - RNA, 22 nt, Human
agaaagugccuuucaggaucua

SEQ ID NO: 3814427 - RNA, 19 nt, Human
agaaaguggaaaacaagga

SEQ ID NO: 3814428 - RNA, 23 nt, Human
agaaaguggaaaacaaggaaguc

SEQ ID NO: 3814429 - RNA, 21 nt, Human
agaaaguggccaugccacccu

SEQ ID NO: 3814430 - RNA, 16 nt, Human
agaaagugggagguca

SEQ ID NO: 3814431 - RNA, 22 nt, Human
agaaagugggaggucaggaaac

SEQ ID NO: 3814432 - RNA, 20 nt, Human
agaaaguggucuuaagaaau

SEQ ID NO: 3814433 - RNA, 21 nt, Human
agaaaguggucuuaagaaaug

SEQ ID NO: 3814434 - RNA, 21 nt, Human
agaaaguggugcucaguugua

SEQ ID NO: 3814435 - RNA, 17 nt, Human
agaaaguguauuuggaa

SEQ ID NO: 3814436 - RNA, 16 nt, Human
agaaagugugagcaaa

SEQ ID NO: 3814437 - RNA, 23 nt, Human
agaaagugugcuuuaugcugaaa

SEQ ID NO: 3814438 - RNA, 23 nt, Human
agaaaguguucuguuacaaaaug

SEQ ID NO: 3814439 - RNA, 23 nt, Human
agccuguggcaguaaagagaaac

SEQ ID NO: 3814440 - RNA, 24 nt, Human
agccuguggcaguaaagagaaacu

SEQ ID NO: 3814441 - RNA, 17 nt, Human
agccuguggcggugccu

SEQ ID NO: 3814442 - RNA, 19 nt, Human
agccuguggcggugccugg

SEQ ID NO: 3814443 - RNA, 20 nt, Human
agccuguggcggugccuggg

SEQ ID NO: 3814444 - RNA, 18 nt, Human
agccuguggcuguggaga

SEQ ID NO: 3814445 - RNA, 22 nt, Human
agccuguggcuguggagacaau

SEQ ID NO: 3814446 - RNA, 13 nt, Human
agccuguguaaca

SEQ ID NO: 3814447 - RNA, 23 nt, Human
agccugugucuuuaaaugcugcu

SEQ ID NO: 3814448 - RNA, 19 nt, Human
agccuguucauggcagaug

SEQ ID NO: 3814449 - RNA, 22 nt, Human
agccuguuccccucacuggaug

SEQ ID NO: 3814450 - RNA, 14 nt, Human
agccuguuggaccc

SEQ ID NO: 3814451 - RNA, 14 nt, Human
agccuguuucuucc

SEQ ID NO: 3814452 - RNA, 23 nt, Human
agccuguuucuuccuguuaaugu

SEQ ID NO: 3814453 - RNA, 19 nt, Human
agccuuaaaacaucauucc

SEQ ID NO: 3814454 - RNA, 16 nt, Human
agccuuaagcugcagg

SEQ ID NO: 3814455 - RNA, 12 nt, Human
agccuuaauuuu

SEQ ID NO: 3814456 - RNA, 14 nt, Human
agccuuacauuugu

SEQ ID NO: 3814457 - RNA, 15 nt, Human
agccuuacauuugug

SEQ ID NO: 3814458 - RNA, 20 nt, Human
agccuuagcucucccaacuc

SEQ ID NO: 3814459 - RNA, 22 nt, Human
agccuuagggaagcuggccuga

SEQ ID NO: 3814460 - RNA, 19 nt, Human
agccuuaucaagugucuuc

SEQ ID NO: 3814461 - RNA, 17 nt, Human
agccuuauccucugauc

SEQ ID NO: 3814462 - RNA, 16 nt, Human
agccuucaagcucuga

SEQ ID NO: 3814463 - RNA, 20 nt, Human
agccuucaagcucugaggga

SEQ ID NO: 3814464 - RNA, 16 nt, Human
agccuucagccuuaau

SEQ ID NO: 3814465 - RNA, 11 nt, Human
agccuuccagg

SEQ ID NO: 3814466 - RNA, 17 nt, Human
agccuuccagggguggg

SEQ ID NO: 3814467 - RNA, 19 nt, Human
agccuucccccucccaggg

SEQ ID NO: 3814468 - RNA, 16 nt, Human
agccuuccccuacccc

SEQ ID NO: 3814469 - RNA, 22 nt, Human
agccuuccccuugcccagggcu

SEQ ID NO: 3814470 - RNA, 21 nt, Human
agccuuccuccacauccuuuc

SEQ ID NO: 3814471 - RNA, 17 nt, Human
agccuuccucugcagcu

SEQ ID NO: 3814472 - RNA, 18 nt, Human
agccuuccucugcagcug

SEQ ID NO: 3814473 - RNA, 18 nt, Human
agccuucucagaagcaca

SEQ ID NO: 3814474 - RNA, 14 nt, Human
agccuucucuguuc

SEQ ID NO: 3814475 - RNA, 15 nt, Human
agccuucucuguuca

SEQ ID NO: 3814476 - RNA, 21 nt, Human
agccuucucuguucauuuccu

SEQ ID NO: 3814477 - RNA, 23 nt, Human
agccuucucuguucauuuccuca

SEQ ID NO: 3814478 - RNA, 18 nt, Human
agccuucuuccaucccag

SEQ ID NO: 3814479 - RNA, 23 nt, Human
agccuucuuugcuugccucucug

SEQ ID NO: 3814480 - RNA, 18 nt, Human
agccuugaacucugggcu

SEQ ID NO: 3814481 - RNA, 16 nt, Human
agccuugaacuuugac

SEQ ID NO: 3814482 - RNA, 23 nt, Human
agccuugaacuuugaccucugca

SEQ ID NO: 3814483 - RNA, 19 nt, Human
agccuugagcccuggcugu

SEQ ID NO: 3814484 - RNA, 20 nt, Human
agccuugauugguguugcca

SEQ ID NO: 3814485 - RNA, 19 nt, Human
agccuugccagagauccaa

SEQ ID NO: 3814486 - RNA, 21 nt, Human
agccuugcccggauucuggga

SEQ ID NO: 3814487 - RNA, 21 nt, Human
agccuugccuaaauuuaaugc

SEQ ID NO: 3814488 - RNA, 22 nt, Human
agccuuggauaaugcuguugcc

SEQ ID NO: 3814489 - RNA, 23 nt, Human
agccuugggaacaugcgugugac

SEQ ID NO: 3814490 - RNA, 20 nt, Human
agccuugguucaucaguguu

SEQ ID NO: 3814491 - RNA, 16 nt, Human
agccuuguaauucuaa

SEQ ID NO: 3814492 - RNA, 15 nt, Human
agccuugucccccuc

SEQ ID NO: 3814493 - RNA, 23 nt, Human
agccuugugaucacuuucugaaa

SEQ ID NO: 3814494 - RNA, 16 nt, Human
agccuugugucuacag

SEQ ID NO: 3814495 - RNA, 23 nt, Human
agccuuuaauggacuuauuucuu

SEQ ID NO: 3814496 - RNA, 20 nt, Human
agccuuuacuguuugauaua

SEQ ID NO: 3814497 - RNA, 16 nt, Human
agccuuucauuuugcu

SEQ ID NO: 3814498 - RNA, 17 nt, Human
agccuuucauuuugcuu

SEQ ID NO: 3814499 - RNA, 21 nt, Human
agccuuugaauaaaaaugcac

SEQ ID NO: 3814500 - RNA, 15 nt, Human
agccuuuggaaacag

SEQ ID NO: 3814501 - RNA, 20 nt, Human
agccuuuggaugaccagaac

SEQ ID NO: 3814502 - RNA, 23 nt, Human
agccuuuggcucuggagacagcc

SEQ ID NO: 3814503 - RNA, 18 nt, Human
agccuuugguucuggcca

SEQ ID NO: 3814504 - RNA, 24 nt, Human
agccuuuguuccccacuggagcag

SEQ ID NO: 3814505 - RNA, 19 nt, Human
agccuuuguugaacuguua

SEQ ID NO: 3814506 - RNA, 17 nt, Human
agccuuuuauacugauu

SEQ ID NO: 3814507 - RNA, 16 nt, Human
agccuuuuuaaaacac

SEQ ID NO: 3814508 - RNA, 17 nt, Human
agccuuuuuaaaacaca

SEQ ID NO: 3814509 - RNA, 14 nt, Human
agccuuuuugaaag

SEQ ID NO: 3814510 - RNA, 21 nt, Human
agccuuuuuguauaaaauaga

SEQ ID NO: 3814511 - RNA, 16 nt, Human
agccuuuuuuccccag

SEQ ID NO: 3814512 - RNA, 20 nt, Human
agccuuuuuuccccagacuu

SEQ ID NO: 3814513 - RNA, 23 nt, Human
agcgaaaaaaucagguggcuuuu

SEQ ID NO: 3814514 - RNA, 15 nt, Human
agcgaacaaccacag

SEQ ID NO: 3814515 - RNA, 17 nt, Human
agcgaaguagcuugcuc

SEQ ID NO: 3814516 - RNA, 14 nt, Human
agcgacaaagauga

SEQ ID NO: 3814517 - RNA, 15 nt, Human
agcgacaaagaugau

SEQ ID NO: 3814518 - RNA, 21 nt, Human
agcgacauagcccaucccugc

SEQ ID NO: 3814519 - RNA, 17 nt, Human
agcgacaucucugacuu

SEQ ID NO: 3814520 - RNA, 21 nt, Human
agcgaccaccccugccuccac

SEQ ID NO: 3814521 - RNA, 22 nt, Human
agcgaccuuccucauccacccc

SEQ ID NO: 3814522 - RNA, 15 nt, Human
agcgagcauccccca

SEQ ID NO: 3814523 - RNA, 15 nt, Human
agcgaggaggcucca

SEQ ID NO: 3814524 - RNA, 19 nt, Human
agcgaggaggcuccagagg

SEQ ID NO: 3814525 - RNA, 17 nt, Human
agcgaggcucuaaccac

SEQ ID NO: 3814526 - RNA, 15 nt, Human
agcgagggcagcugc

SEQ ID NO: 3814527 - RNA, 15 nt, Human
agcgagggcgugucu

SEQ ID NO: 3814528 - RNA, 19 nt, Human
agcgaggucaacagagaag

SEQ ID NO: 3814529 - RNA, 23 nt, Human
agcgaggucaacagagaaggcag

SEQ ID NO: 3814530 - RNA, 17 nt, Human
agcugcucugcccagag

SEQ ID NO: 3814531 - RNA, 20 nt, Human
agcugcucugcccagagcug

SEQ ID NO: 3814532 - RNA, 14 nt, Human
agcugcucugugac

SEQ ID NO: 3814533 - RNA, 14 nt, Human
agcugcugacagug

SEQ ID NO: 3814534 - RNA, 20 nt, Human
agcugcugaccaauugugcu

SEQ ID NO: 3814535 - RNA, 20 nt, Human
agcugcugagauccuggacu

SEQ ID NO: 3814536 - RNA, 13 nt, Human
agcugcugagccg

SEQ ID NO: 3814537 - RNA, 14 nt, Human
agcugcuggcuugc

SEQ ID NO: 3814538 - RNA, 14 nt, Human
agcugcuuccagug

SEQ ID NO: 3814539 - RNA, 22 nt, Human
agcugcuucucccacuuggcca

SEQ ID NO: 3814540 - RNA, 22 nt, Human
agcugcuuggaccucgugcuuu

SEQ ID NO: 3814541 - RNA, 21 nt, Human
agcugcuugggcuucauccuc

SEQ ID NO: 3814542 - RNA, 21 nt, Human
agcugcuugugucccuccugg

SEQ ID NO: 3814543 - RNA, 20 nt, Human
agcugcuuucuguugucauu

SEQ ID NO: 3814544 - RNA, 14 nt, Human
agcugcuuucuucu

SEQ ID NO: 3814545 - RNA, 17 nt, Human
agcugcuuuuuuugaaa

SEQ ID NO: 3814546 - RNA, 22 nt, Human
agcugcuuuuuuugaaacuuug

SEQ ID NO: 3814547 - RNA, 18 nt, Human
agcuggaauuuuuuauuc

SEQ ID NO: 3814548 - RNA, 12 nt, Human
agcuggacagag

SEQ ID NO: 3814549 - RNA, 17 nt, Human
agcuggacagaggggac

SEQ ID NO: 3814550 - RNA, 14 nt, Human
agcuggacccugac

SEQ ID NO: 3814551 - RNA, 15 nt, Human
agcuggacuacccac

SEQ ID NO: 3814552 - RNA, 21 nt, Human
agcuggagaggagcccugccu

SEQ ID NO: 3814553 - RNA, 22 nt, Human
agcuggagaggagcccugccuc

SEQ ID NO: 3814554 - RNA, 19 nt, Human
agcuggagaugaggccaga

SEQ ID NO: 3814555 - RNA, 20 nt, Human
agcuggagaugaggccagac

SEQ ID NO: 3814556 - RNA, 21 nt, Human
agcuggagaugaggccagacc

SEQ ID NO: 3814557 - RNA, 15 nt, Human
agcuggagccuggug

SEQ ID NO: 3814558 - RNA, 22 nt, Human
agcuggaggacuagaaccugga

SEQ ID NO: 3814559 - RNA, 22 nt, Human
agcuggaggcaggggcuuccug

SEQ ID NO: 3814560 - RNA, 14 nt, Human
agcuggagugcagu

SEQ ID NO: 3814561 - RNA, 14 nt, Human
agcuggaugagaau

SEQ ID NO: 3814562 - RNA, 19 nt, Human
agcuggcaaagguggcucu

SEQ ID NO: 3814563 - RNA, 19 nt, Human
agcuggccccgccgccugg

SEQ ID NO: 3814564 - RNA, 18 nt, Human
agcuggcccgugacagac

SEQ ID NO: 3814565 - RNA, 21 nt, Human
agcuggccgaggguccuggcu

SEQ ID NO: 3814566 - RNA, 22 nt, Human
agcuggccgcgccaaauaaugu

SEQ ID NO: 3814567 - RNA, 16 nt, Human
agcuggccucucacug

SEQ ID NO: 3814568 - RNA, 12 nt, Human
agcuggccugag

SEQ ID NO: 3814569 - RNA, 21 nt, Human
agcuggccugagaggggaagc

SEQ ID NO: 3814570 - RNA, 15 nt, Human
agcuggccuggacag

SEQ ID NO: 3814571 - RNA, 22 nt, Human
agcuggcggcuggggucccagc

SEQ ID NO: 3814572 - RNA, 23 nt, Human
agcuggcggcuggggucccagca

SEQ ID NO: 3814573 - RNA, 16 nt, Human
agcuggcuccagccug

SEQ ID NO: 3814574 - RNA, 17 nt, Human
agcuggcuccagccugg

SEQ ID NO: 3814575 - RNA, 18 nt, Human
agcuggcuccagccugga

SEQ ID NO: 3814576 - RNA, 20 nt, Human
agcuggcucugagcgccucc

SEQ ID NO: 3814577 - RNA, 23 nt, Human
agcuggcucugagcgccuccauc

SEQ ID NO: 3814578 - RNA, 15 nt, Human
agcuggcuggggugg

SEQ ID NO: 3814579 - RNA, 15 nt, Human
agcugggaccaguac

SEQ ID NO: 3814580 - RNA, 19 nt, Human
agcugggacuacaggcacc

SEQ ID NO: 3814581 - RNA, 20 nt, Human
agcugggacuacaggcaccc

SEQ ID NO: 3814582 - RNA, 16 nt, Human
agcugggacuacaggu

SEQ ID NO: 3814583 - RNA, 13 nt, Human
agcugggagaagg

SEQ ID NO: 3814584 - RNA, 13 nt, Human
agcugggaggaaa

SEQ ID NO: 3814585 - RNA, 18 nt, Human
agcugggaggaaaagaaa

SEQ ID NO: 3814586 - RNA, 19 nt, Human
agcugggaggcaagagggg

SEQ ID NO: 3814587 - RNA, 19 nt, Human
agcugggaggcauggcccu

SEQ ID NO: 3814588 - RNA, 21 nt, Human
agcugggaggcauggcccugg

SEQ ID NO: 3814589 - RNA, 16 nt, Human
agcugggaucugacug

SEQ ID NO: 3814590 - RNA, 16 nt, Human
agcugggauuuuaaac

SEQ ID NO: 3814591 - RNA, 14 nt, Human
agcugggcagguug

SEQ ID NO: 3814592 - RNA, 17 nt, Human
agcugggcaugguacca

SEQ ID NO: 3814593 - RNA, 20 nt, Human
agcugggcccaacccugucu

SEQ ID NO: 3814594 - RNA, 15 nt, Human
agcugggccccagcc

SEQ ID NO: 3814595 - RNA, 17 nt, Human
agcugggccccagccca

SEQ ID NO: 3814596 - RNA, 18 nt, Human
agcggccccucccacaca

SEQ ID NO: 3814597 - RNA, 11 nt, Human
agcggccggcc

SEQ ID NO: 3814598 - RNA, 22 nt, Human
agcggccggccagccccuggcc

SEQ ID NO: 3814599 - RNA, 19 nt, Human
agcggcucaagcccaggag

SEQ ID NO: 3814600 - RNA, 14 nt, Human
agcgggaccugugg

SEQ ID NO: 3814601 - RNA, 23 nt, Human
agcgggcagguucugccugcuuu

SEQ ID NO: 3814602 - RNA, 13 nt, Human
agcgggcgccugu

SEQ ID NO: 3814603 - RNA, 16 nt, Human
agcggggacagcuccu

SEQ ID NO: 3814604 - RNA, 22 nt, Human
agcggggacagcuccuucuguc

SEQ ID NO: 3814605 - RNA, 13 nt, Human
agcggggggaggg

SEQ ID NO: 3814606 - RNA, 16 nt, Human
agcgggguaugaagag

SEQ ID NO: 3814607 - RNA, 21 nt, Human
agcgguggcccugucccuccc

SEQ ID NO: 3814608 - RNA, 14 nt, Human
agcgguugccagga

SEQ ID NO: 3814609 - RNA, 16 nt, Human
agcguaaaauggugaa

SEQ ID NO: 3814610 - RNA, 14 nt, Human
agcguagccucucc

SEQ ID NO: 3814611 - RNA, 19 nt, Human
agcgucagcugcucccugg

SEQ ID NO: 3814612 - RNA, 21 nt, Human
agcgucagcugcucccuggca

SEQ ID NO: 3814613 - RNA, 21 nt, Human
agcgucaggguuggugugcug

SEQ ID NO: 3814614 - RNA, 14 nt, Human
agcgucccuggcgc

SEQ ID NO: 3814615 - RNA, 15 nt, Human
agcgucccuggcgca

SEQ ID NO: 3814616 - RNA, 15 nt, Human
agcgucggucugugc

SEQ ID NO: 3814617 - RNA, 16 nt, Human
agcgucggucugugcc

SEQ ID NO: 3814618 - RNA, 22 nt, Human
agcgugaaggccgagaagcaag

SEQ ID NO: 3814619 - RNA, 23 nt, Human
agcgugaaggccgagaagcaaga

SEQ ID NO: 3814620 - RNA, 16 nt, Human
agcgugagccacugca

SEQ ID NO: 3814621 - RNA, 19 nt, Human
agcgugagccacugcaccg

SEQ ID NO: 3814622 - RNA, 16 nt, Human
agcgugagcugagcag

SEQ ID NO: 3814623 - RNA, 20 nt, Human
agcgugagcuuaaaauacaa

SEQ ID NO: 3814624 - RNA, 19 nt, Human
agcgugcaccaucccuuuu

SEQ ID NO: 3814625 - RNA, 15 nt, Human
agcgugcauaaguua

SEQ ID NO: 3814626 - RNA, 19 nt, Human
agcgugcuccagccuggcu

SEQ ID NO: 3814627 - RNA, 14 nt, Human
agcguggaggggua

SEQ ID NO: 3814628 - RNA, 22 nt, Human
agcguggcgcaguggcccugag

SEQ ID NO: 3814629 - RNA, 11 nt, Human
agcguucuugu

SEQ ID NO: 3814630 - RNA, 19 nt, Human
agcguuggaauuaaaacaa

SEQ ID NO: 3814631 - RNA, 20 nt, Human
agcguuggaauuaaaacaau

SEQ ID NO: 3814632 - RNA, 13 nt, Human
agcguuuugcaag

SEQ ID NO: 3814633 - RNA, 18 nt, Human
agcguuuuguugagcaug

SEQ ID NO: 3814634 - RNA, 12 nt, Human
agcuaaaauaaa

SEQ ID NO: 3814635 - RNA, 15 nt, Human
agcuaaaaugauuuu

SEQ ID NO: 3814636 - RNA, 20 nt, Human
agcuaaaaugauuuuaucug

SEQ ID NO: 3814637 - RNA, 17 nt, Human
agcuaaaccaaggacug

SEQ ID NO: 3814638 - RNA, 17 nt, Human
agcuaaacggauuccaa

SEQ ID NO: 3814639 - RNA, 18 nt, Human
agcuaaacggauuccaaa

SEQ ID NO: 3814640 - RNA, 16 nt, Human
agcuaaagcccaaccu

SEQ ID NO: 3814641 - RNA, 17 nt, Human
agcuaacacacagcucc

SEQ ID NO: 3814642 - RNA, 19 nt, Human
agcuaacacacagcuccca

SEQ ID NO: 3814643 - RNA, 19 nt, Human
agcuaacacuggccccuag

SEQ ID NO: 3814644 - RNA, 19 nt, Human
agcuaacagggaaggcagg

SEQ ID NO: 3814645 - RNA, 23 nt, Human
agcuaacagggaaggcaggcagg

SEQ ID NO: 3814646 - RNA, 19 nt, Human
agcuaacauggaaguacua

SEQ ID NO: 3814647 - RNA, 23 nt, Human
agcuaacauuuuaaauaaaagaa

SEQ ID NO: 3814648 - RNA, 23 nt, Human
agcuaaccaguuaccacacaucu

SEQ ID NO: 3814649 - RNA, 15 nt, Human
agcuaagaaauaaaa

SEQ ID NO: 3814650 - RNA, 17 nt, Human
agcuaagaaccuggaac

SEQ ID NO: 3814651 - RNA, 18 nt, Human
agcuaagcuaggaaugaa

SEQ ID NO: 3814652 - RNA, 23 nt, Human
agcuaagcucacguccugagaaa

SEQ ID NO: 3814653 - RNA, 17 nt, Human
agcuaagggaagacauu

SEQ ID NO: 3814654 - RNA, 21 nt, Human
agcuaagggugggugcucaga

SEQ ID NO: 3814655 - RNA, 16 nt, Human
agcuaauaaaauauca

SEQ ID NO: 3814656 - RNA, 19 nt, Human
agcuaauaaaauaucauuc

SEQ ID NO: 3814657 - RNA, 15 nt, Human
agcuaauaauguuaa

SEQ ID NO: 3814658 - RNA, 21 nt, Human
agcuaaucagcauucucacuc

SEQ ID NO: 3814659 - RNA, 13 nt, Human
agcuaaucuguag

SEQ ID NO: 3814660 - RNA, 19 nt, Human
agcuaaucuguagggcugg

SEQ ID NO: 3814661 - RNA, 23 nt, Human
agcuaaucuguagggcuggaccu

SEQ ID NO: 3814662 - RNA, 15 nt, Human
agcuaaugggacacu

SEQ ID NO: 3814663 - RNA, 23 nt, Human
agcuaauguaauaacugugaagu

SEQ ID NO: 3814664 - RNA, 21 nt, Human
agcuaauucuacucacagugc

SEQ ID NO: 3814665 - RNA, 19 nt, Human
agcuaauugggaguccagg

SEQ ID NO: 3814666 - RNA, 13 nt, Human
agcuaauuuacug

SEQ ID NO: 3814667 - RNA, 20 nt, Human
agcuaauuugcauuaaauuc

SEQ ID NO: 3814668 - RNA, 13 nt, Human
agcuacaaaugca

SEQ ID NO: 3814669 - RNA, 19 nt, Human
agcuacagagaaaccagcu

SEQ ID NO: 3814670 - RNA, 20 nt, Human
agcuacagagaaaccagcuu

SEQ ID NO: 3814671 - RNA, 13 nt, Human
agcuacagguuac

SEQ ID NO: 3814672 - RNA, 14 nt, Human
agcuacagguuaca

SEQ ID NO: 3814673 - RNA, 20 nt, Human
agcuacagguuacaacagau

SEQ ID NO: 3814674 - RNA, 18 nt, Human
agcugugugcucuccaag

SEQ ID NO: 3814675 - RNA, 14 nt, Human
agcuguguggcagu

SEQ ID NO: 3814676 - RNA, 12 nt, Human
agcuguuaaacu

SEQ ID NO: 3814677 - RNA, 19 nt, Human
agcuguuaccauucacaau

SEQ ID NO: 3814678 - RNA, 19 nt, Human
agcuguuauuucuauuuuu

SEQ ID NO: 3814679 - RNA, 13 nt, Human
agcuguucagcug

SEQ ID NO: 3814680 - RNA, 14 nt, Human
agcuguucagcugg

SEQ ID NO: 3814681 - RNA, 18 nt, Human
agcuguuccuguucagua

SEQ ID NO: 3814682 - RNA, 14 nt, Human
agcuguugaccagg

SEQ ID NO: 3814683 - RNA, 16 nt, Human
agcuguugaccaggca

SEQ ID NO: 3814684 - RNA, 18 nt, Human
agcuguugaccaggcacc

SEQ ID NO: 3814685 - RNA, 23 nt, Human
agcuguugacucuaguacuguga

SEQ ID NO: 3814686 - RNA, 13 nt, Human
agcuguugccuca

SEQ ID NO: 3814687 - RNA, 22 nt, Human
agcuguuggccucugcaaagga

SEQ ID NO: 3814688 - RNA, 15 nt, Human
agcuguuguacauuu

SEQ ID NO: 3814689 - RNA, 16 nt, Human
agcuguuguacauuua

SEQ ID NO: 3814690 - RNA, 17 nt, Human
agcuguugucucuucuc

SEQ ID NO: 3814691 - RNA, 18 nt, Human
agcuguuuauagagaaug

SEQ ID NO: 3814692 - RNA, 16 nt, Human
agcuguuuaugcauag

SEQ ID NO: 3814693 - RNA, 18 nt, Human
agcuguuuauggccucag

SEQ ID NO: 3814694 - RNA, 20 nt, Human
agcuguuuauggccucagcu

SEQ ID NO: 3814695 - RNA, 21 nt, Human
agcuguuuauggccucagcug

SEQ ID NO: 3814696 - RNA, 12 nt, Human
agcuguuuaugu

SEQ ID NO: 3814697 - RNA, 13 nt, Human
agcuguuuauguu

SEQ ID NO: 3814698 - RNA, 18 nt, Human
agcuguuuauguuuuuau

SEQ ID NO: 3814699 - RNA, 23 nt, Human
agcuguuugguuuuaaaauacug

SEQ ID NO: 3814700 - RNA, 18 nt, Human
agcuguuuucccugaccu

SEQ ID NO: 3814701 - RNA, 13 nt, Human
agcuuaacagugu

SEQ ID NO: 3814702 - RNA, 14 nt, Human
agcuuaagaaaaaa

SEQ ID NO: 3814703 - RNA, 19 nt, Human
agcuuaagggucauauguu

SEQ ID NO: 3814704 - RNA, 17 nt, Human
agcuuacaagccagcug

SEQ ID NO: 3814705 - RNA, 14 nt, Human
agcuuacaugagaa

SEQ ID NO: 3814706 - RNA, 13 nt, Human
agcuuaccugaca

SEQ ID NO: 3814707 - RNA, 13 nt, Human
agcuuacguaguu

SEQ ID NO: 3814708 - RNA, 15 nt, Human
agcuuagaccucagc

SEQ ID NO: 3814709 - RNA, 19 nt, Human
agcuuagaccucagccugu

SEQ ID NO: 3814710 - RNA, 16 nt, Human
agcuuagauuucauag

SEQ ID NO: 3814711 - RNA, 14 nt, Human
agcuuagcaggaga

SEQ ID NO: 3814712 - RNA, 21 nt, Human
agcuuagcuuuagaaacagug

SEQ ID NO: 3814713 - RNA, 13 nt, Human
agcuuaggcaggg

SEQ ID NO: 3814714 - RNA, 16 nt, Human
agcuuagggcccugga

SEQ ID NO: 3814715 - RNA, 17 nt, Human
agcuuagggcccuggag

SEQ ID NO: 3814716 - RNA, 19 nt, Human
agcuuagggcccuggaggc

SEQ ID NO: 3814717 - RNA, 17 nt, Human
agcuuagggucucaggg

SEQ ID NO: 3814718 - RNA, 17 nt, Human
agcuuagugaaauuacu

SEQ ID NO: 3814719 - RNA, 15 nt, Human
agcuuauaaugggcu

SEQ ID NO: 3814720 - RNA, 18 nt, Human
agcuuauacgaaauaauu

SEQ ID NO: 3814721 - RNA, 20 nt, Human
agcuuauacgaaauaauugu

SEQ ID NO: 3814722 - RNA, 21 nt, Human
agcuuauacgaaauaauuguu

SEQ ID NO: 3814723 - RNA, 15 nt, Human
agcuuaucaauuugu

SEQ ID NO: 3814724 - RNA, 15 nt, Human
agcuuaucaugcugu

SEQ ID NO: 3814725 - RNA, 14 nt, Human
agcuuaucucuuuu

SEQ ID NO: 3814726 - RNA, 17 nt, Human
agcuuaucucuuuuaua

SEQ ID NO: 3814727 - RNA, 22 nt, Human
agcuuaucucuuuuauauuugu

SEQ ID NO: 3814728 - RNA, 14 nt, Human
agcuuauuaaugcu

SEQ ID NO: 3814729 - RNA, 20 nt, Human
agcuuauuuuggagagauag

SEQ ID NO: 3814730 - RNA, 12 nt, Human
agcuucaaagcu

SEQ ID NO: 3814731 - RNA, 16 nt, Human
agcuucaagucugugc

SEQ ID NO: 3814732 - RNA, 18 nt, Human
agcuucaccccaauccca

SEQ ID NO: 3814733 - RNA, 14 nt, Human
agcuucacuucuga

SEQ ID NO: 3814734 - RNA, 17 nt, Human
agcuucagccaggagcu

SEQ ID NO: 3814735 - RNA, 20 nt, Human
agcuucagccaggagcuggg

SEQ ID NO: 3814736 - RNA, 18 nt, Human
agcuucagcuagcuuuua

SEQ ID NO: 3814737 - RNA, 23 nt, Human
agcuucaggaaccucgaguacug

SEQ ID NO: 3814738 - RNA, 11 nt, Human
agcuucagguu

SEQ ID NO: 3814739 - RNA, 22 nt, Human
agcuucaguaaguuaucuuuga

SEQ ID NO: 3814740 - RNA, 19 nt, Human
agcuucagucauuaaauua

SEQ ID NO: 3814741 - RNA, 17 nt, Human
agcuucagugcugccga

SEQ ID NO: 3814742 - RNA, 17 nt, Human
agcuucauauaccagca

SEQ ID NO: 3814743 - RNA, 21 nt, Human
agcuucaugccuuuguaaguu

SEQ ID NO: 3814744 - RNA, 19 nt, Human
agcuucauuuccugugucu

SEQ ID NO: 3814745 - RNA, 13 nt, Human
agcuucauuugug

SEQ ID NO: 3814746 - RNA, 22 nt, Human
agcuuccaaggggcaaauuuuu

SEQ ID NO: 3814747 - RNA, 17 nt, Human
agcuuccaauuuuccuu

SEQ ID NO: 3814748 - RNA, 13 nt, Human
agcuuccagcagg

SEQ ID NO: 3814749 - RNA, 19 nt, Human
agcuuccagcaggagggac

SEQ ID NO: 3814750 - RNA, 23 nt, Human
agcuuccauuccaagccugacca

SEQ ID NO: 3814751 - RNA, 22 nt, Human
agcuuccccaacacgcaggagc

SEQ ID NO: 3814752 - RNA, 12 nt, Human
agcuucccuccc

SEQ ID NO: 3814753 - RNA, 15 nt, Human
agcuucccucccugc

SEQ ID NO: 3814754 - RNA, 16 nt, Human
agcuucccucccugcu

SEQ ID NO: 3814755 - RNA, 20 nt, Human
agaagagcuguucacagcca

SEQ ID NO: 3814756 - RNA, 15 nt, Human
agaagagucuauugu

SEQ ID NO: 3814757 - RNA, 16 nt, Human
agaagaguugaggaac

SEQ ID NO: 3814758 - RNA, 22 nt, Human
agaagaguugaggaacuguaca

SEQ ID NO: 3814759 - RNA, 23 nt, Human
agaagaguugaggaacuguacag

SEQ ID NO: 3814760 - RNA, 22 nt, Human
agaagauaauuguugaaauuuu

SEQ ID NO: 3814761 - RNA, 23 nt, Human
agaagaucacgcuccccgccugu

SEQ ID NO: 3814762 - RNA, 13 nt, Human
agaagauccccuc

SEQ ID NO: 3814763 - RNA, 17 nt, Human
agaagauccuaaaacaa

SEQ ID NO: 3814764 - RNA, 13 nt, Human
agaagaucuuugg

SEQ ID NO: 3814765 - RNA, 22 nt, Human
agaagaugaaaauggaaguggc

SEQ ID NO: 3814766 - RNA, 18 nt, Human
agaagaugaaugagcaaa

SEQ ID NO: 3814767 - RNA, 23 nt, Human
agaagaugcuccagcaacacagc

SEQ ID NO: 3814768 - RNA, 23 nt, Human
agaagauguugaagaauacaguu

SEQ ID NO: 3814769 - RNA, 21 nt, Human
agaagcaaccucaguaauuua

SEQ ID NO: 3814770 - RNA, 16 nt, Human
agaagcacagaauauu

SEQ ID NO: 3814771 - RNA, 13 nt, Human
agaagcagagaga

SEQ ID NO: 3814772 - RNA, 16 nt, Human
agaagcagaggaagga

SEQ ID NO: 3814773 - RNA, 23 nt, Human
agaagcagugagccgcaucuucu

SEQ ID NO: 3814774 - RNA, 18 nt, Human
agaagcauuaacuucucu

SEQ ID NO: 3814775 - RNA, 21 nt, Human
agaagcauuaacuucucugga

SEQ ID NO: 3814776 - RNA, 14 nt, Human
agaagcauuccuuc

SEQ ID NO: 3814777 - RNA, 23 nt, Human
agaagcauuccuucuuugauaau

SEQ ID NO: 3814778 - RNA, 16 nt, Human
agaagcauuuguauuu

SEQ ID NO: 3814779 - RNA, 23 nt, Human
agaagcauuuguauuuuguguga

SEQ ID NO: 3814780 - RNA, 19 nt, Human
agaagcauuuuguaaguug

SEQ ID NO: 3814781 - RNA, 17 nt, Human
agaagccaaaagauugg

SEQ ID NO: 3814782 - RNA, 18 nt, Human
agaagccaacuaugauua

SEQ ID NO: 3814783 - RNA, 16 nt, Human
agaagccaagggaaag

SEQ ID NO: 3814784 - RNA, 16 nt, Human
agaagccacaggccug

SEQ ID NO: 3814785 - RNA, 18 nt, Human
agaagccacccaaagcag

SEQ ID NO: 3814786 - RNA, 20 nt, Human
agaagccagcuuguuuacau

SEQ ID NO: 3814787 - RNA, 16 nt, Human
agaagccaucaccuca

SEQ ID NO: 3814788 - RNA, 13 nt, Human
agaagcccagaau

SEQ ID NO: 3814789 - RNA, 12 nt, Human
agaagcccccag

SEQ ID NO: 3814790 - RNA, 24 nt, Human
agaagcccccagcuaagaaccugg

SEQ ID NO: 3814791 - RNA, 20 nt, Human
agaagccccuuccccauggg

SEQ ID NO: 3814792 - RNA, 17 nt, Human
agaagcccggcuccugg

SEQ ID NO: 3814793 - RNA, 16 nt, Human
agaagccgggaacaga

SEQ ID NO: 3814794 - RNA, 14 nt, Human
agaagccgugggug

SEQ ID NO: 3814795 - RNA, 16 nt, Human
agaagccucuggcuag

SEQ ID NO: 3814796 - RNA, 23 nt, Human
agaagccucuggcuagaggccag

SEQ ID NO: 3814797 - RNA, 17 nt, Human
agaagccugaggcuggg

SEQ ID NO: 3814798 - RNA, 11 nt, Human
agaagccugca

SEQ ID NO: 3814799 - RNA, 18 nt, Human
agaagccugggggccugg

SEQ ID NO: 3814800 - RNA, 18 nt, Human
agaagccuguaacacucc

SEQ ID NO: 3814801 - RNA, 15 nt, Human
agaagccuucaagcu

SEQ ID NO: 3814802 - RNA, 18 nt, Human
agaagccuucaagcucug

SEQ ID NO: 3814803 - RNA, 19 nt, Human
agaagccuucaagcucuga

SEQ ID NO: 3814804 - RNA, 20 nt, Human
agaagccuucaagcucugag

SEQ ID NO: 3814805 - RNA, 23 nt, Human
agaagccuucaagcucugaggga

SEQ ID NO: 3814806 - RNA, 18 nt, Human
agaagccuucagcuccag

SEQ ID NO: 3814807 - RNA, 19 nt, Human
agaagccuuugggaagggg

SEQ ID NO: 3814808 - RNA, 20 nt, Human
agaagcuauaaauuccucuu

SEQ ID NO: 3814809 - RNA, 18 nt, Human
agaagcucagcugcauuc

SEQ ID NO: 3814810 - RNA, 16 nt, Human
agaagcucccaggaac

SEQ ID NO: 3814811 - RNA, 15 nt, Human
agaagcucccccagc

SEQ ID NO: 3814812 - RNA, 19 nt, Human
agaagcucugaagaacucu

SEQ ID NO: 3814813 - RNA, 21 nt, Human
agaagcugaagugcauccaaa

SEQ ID NO: 3814814 - RNA, 11 nt, Human
agaagcugcag

SEQ ID NO: 3814815 - RNA, 13 nt, Human
agaagcugcaggc

SEQ ID NO: 3814816 - RNA, 15 nt, Human
agaagcugcaggcuu

SEQ ID NO: 3814817 - RNA, 21 nt, Human
agaagcugccaggugagaaac

SEQ ID NO: 3814818 - RNA, 23 nt, Human
agaagcugccaggugagaaacug

SEQ ID NO: 3814819 - RNA, 16 nt, Human
aggaauauuuuccaaa

SEQ ID NO: 3814820 - RNA, 20 nt, Human
aggaauauuuuccaaagagu

SEQ ID NO: 3814821 - RNA, 17 nt, Human
aggaaucaagagcugcc

SEQ ID NO: 3814822 - RNA, 15 nt, Human
aggaaucacucuugu

SEQ ID NO: 3814823 - RNA, 15 nt, Human
aggaaucagacuuca

SEQ ID NO: 3814824 - RNA, 22 nt, Human
aggaaucagcaagaagauccua

SEQ ID NO: 3814825 - RNA, 20 nt, Human
aggaaucaucaggaacguuu

SEQ ID NO: 3814826 - RNA, 22 nt, Human
aggaaucaugucaggccugugu

SEQ ID NO: 3814827 - RNA, 16 nt, Human
aggaauccacucccag

SEQ ID NO: 3814828 - RNA, 17 nt, Human
aggaauccacucccagg

SEQ ID NO: 3814829 - RNA, 17 nt, Human
aggaauccagacccggc

SEQ ID NO: 3814830 - RNA, 20 nt, Human
aggaauccagacccggcugc

SEQ ID NO: 3814831 - RNA, 15 nt, Human
aggaauccaugaaga

SEQ ID NO: 3814832 - RNA, 16 nt, Human
aggaauccuggcagcc

SEQ ID NO: 3814833 - RNA, 20 nt, Human
aggaauccuggcagcccaga

SEQ ID NO: 3814834 - RNA, 19 nt, Human
aggaaucugugggucuggg

SEQ ID NO: 3814835 - RNA, 16 nt, Human
aggaaucuuuaaaaga

SEQ ID NO: 3814836 - RNA, 22 nt, Human
aggaaucuuuaaaagaugcuuu

SEQ ID NO: 3814837 - RNA, 13 nt, Human
aggaaugaagaua

SEQ ID NO: 3814838 - RNA, 19 nt, Human
aggaaugaagauaccauca

SEQ ID NO: 3814839 - RNA, 15 nt, Human
aggaaugcuccccca

SEQ ID NO: 3814840 - RNA, 20 nt, Human
aggaaugcucccccauccuc

SEQ ID NO: 3814841 - RNA, 16 nt, Human
aggaaugcuuggaaua

SEQ ID NO: 3814842 - RNA, 20 nt, Human
aggaaugcuuggaauaucug

SEQ ID NO: 3814843 - RNA, 24 nt, Human
aggaaugcuuggaauaucugcugu

SEQ ID NO: 3814844 - RNA, 12 nt, Human
aggaauggacag

SEQ ID NO: 3814845 - RNA, 20 nt, Human
aggaauggacagacagagga

SEQ ID NO: 3814846 - RNA, 16 nt, Human
aggaauggacauuucu

SEQ ID NO: 3814847 - RNA, 13 nt, Human
aggaaugggcugu

SEQ ID NO: 3814848 - RNA, 20 nt, Human
aggaaugggggccucuucaa

SEQ ID NO: 3814849 - RNA, 16 nt, Human
aggaauguguggccug

SEQ ID NO: 3814850 - RNA, 14 nt, Human
aggaauguuaaagu

SEQ ID NO: 3814851 - RNA, 22 nt, Human
aggaauguuaaagucaguggga

SEQ ID NO: 3814852 - RNA, 23 nt, Human
aggaauuaaguuagggaauggca

SEQ ID NO: 3814853 - RNA, 23 nt, Human
aggaauucccagcccaaagcugu

SEQ ID NO: 3814854 - RNA, 14 nt, Human
aggaauucuguaua

SEQ ID NO: 3814855 - RNA, 22 nt, Human
aggaauugacccacaagaaaug

SEQ ID NO: 3814856 - RNA, 12 nt, Human
aggaauugacuu

SEQ ID NO: 3814857 - RNA, 11 nt, Human
aggaauuuaaa

SEQ ID NO: 3814858 - RNA, 14 nt, Human
aggaauuuauaccu

SEQ ID NO: 3814859 - RNA, 15 nt, Human
aggaauuuauaccuc

SEQ ID NO: 3814860 - RNA, 18 nt, Human
aggaauuucccaggaccc

SEQ ID NO: 3814861 - RNA, 19 nt, Human
aggaauuugaagcugcagu

SEQ ID NO: 3814862 - RNA, 13 nt, Human
aggaauuugggac

SEQ ID NO: 3814863 - RNA, 20 nt, Human
aggaauuugggacccugcuu

SEQ ID NO: 3814864 - RNA, 20 nt, Human
aggaauuuuauuuuuuucug

SEQ ID NO: 3814865 - RNA, 14 nt, Human
aggaauuuucuuug

SEQ ID NO: 3814866 - RNA, 16 nt, Human
aggaauuuucuuugug

SEQ ID NO: 3814867 - RNA, 18 nt, Human
aggacaaaaaugaacuga

SEQ ID NO: 3814868 - RNA, 14 nt, Human
aggacaaaacuucu

SEQ ID NO: 3814869 - RNA, 17 nt, Human
aggacaaaacuucuugu

SEQ ID NO: 3814870 - RNA, 23 nt, Human
aggacaaaacuucuugucagaca

SEQ ID NO: 3814871 - RNA, 18 nt, Human
aggacaaagucuccagcc

SEQ ID NO: 3814872 - RNA, 18 nt, Human
aggacaaagugccaaaga

SEQ ID NO: 3814873 - RNA, 21 nt, Human
aggacaaagugccaaagaaag

SEQ ID NO: 3814874 - RNA, 16 nt, Human
aggacaaauugagaca

SEQ ID NO: 3814875 - RNA, 14 nt, Human
aggacaaccauucc

SEQ ID NO: 3814876 - RNA, 14 nt, Human
aggacaacgaggaa

SEQ ID NO: 3814877 - RNA, 18 nt, Human
aggacaacgaggaagccc

SEQ ID NO: 3814878 - RNA, 13 nt, Human
aggacaagcaugg

SEQ ID NO: 3814879 - RNA, 19 nt, Human
aggacaaggugcaggcagg

SEQ ID NO: 3814880 - RNA, 17 nt, Human
aggacaaucaguccccu

SEQ ID NO: 3814881 - RNA, 21 nt, Human
aggacaaucaguccccuccca

SEQ ID NO: 3814882 - RNA, 14 nt, Human
aggacaauuucaaa

SEQ ID NO: 3814883 - RNA, 11 nt, Human
aggacacaggc

SEQ ID NO: 3814884 - RNA, 14 nt, Human
aggacacaggccug

SEQ ID NO: 3814885 - RNA, 15 nt, Human
aggacacaguuccug

SEQ ID NO: 3814886 - RNA, 16 nt, Human
aggacacaguuccugg

SEQ ID NO: 3814887 - RNA, 21 nt, Human
aggacacaguuccugggaaca

SEQ ID NO: 3814888 - RNA, 12 nt, Human
aggacacauguc

SEQ ID NO: 3814889 - RNA, 15 nt, Human
aggacaccacaccca

SEQ ID NO: 3814890 - RNA, 20 nt, Human
aggacaccacacccagccuc

SEQ ID NO: 3814891 - RNA, 22 nt, Human
aggacaccuguacuggagagca

SEQ ID NO: 3814892 - RNA, 16 nt, Human
aggacacuuccugccu

SEQ ID NO: 3814893 - RNA, 17 nt, Human
aggacagccccuccucc

SEQ ID NO: 3814894 - RNA, 16 nt, Human
aggacagccgccugga

SEQ ID NO: 3814895 - RNA, 23 nt, Human
aggacagccuguggcggugccug

SEQ ID NO: 3814896 - RNA, 15 nt, Human
aggacagcuguccuc

SEQ ID NO: 3814897 - RNA, 22 nt, Human
aggacaggaaaguggcaccugu

SEQ ID NO: 3814898 - RNA, 18 nt, Human
aggacaggaccagauuuu

SEQ ID NO: 3814899 - RNA, 17 nt, Human
aggacaggcagaaagag

SEQ ID NO: 3814900 - RNA, 14 nt, Human
aggacaggcaggug

SEQ ID NO: 3814901 - RNA, 20 nt, Human
aggacaggcgggaggaggug

SEQ ID NO: 3814902 - RNA, 12 nt, Human
aggacaggcugc

SEQ ID NO: 3814903 - RNA, 12 nt, Human
aggacaguauuu

SEQ ID NO: 3814904 - RNA, 19 nt, Human
aggacaguauuugugggga

SEQ ID NO: 3814905 - RNA, 20 nt, Human
aggacauaaauuagaggucu

SEQ ID NO: 3814906 - RNA, 13 nt, Human
aggacauaauggg

SEQ ID NO: 3814907 - RNA, 22 nt, Human
aggacauagagguauauuggaa

SEQ ID NO: 3814908 - RNA, 12 nt, Human
aggacaucagca

SEQ ID NO: 3814909 - RNA, 20 nt, Human
aggacauccccccgccaaaa

SEQ ID NO: 3814910 - RNA, 17 nt, Human
aggacaugaugcuuuua

SEQ ID NO: 3814911 - RNA, 20 nt, Human
aggacaugcgguagccagca

SEQ ID NO: 3814912 - RNA, 14 nt, Human
aggacauggcuucu

SEQ ID NO: 3814913 - RNA, 16 nt, Human
aggacauguucccuuc

SEQ ID NO: 3814914 - RNA, 16 nt, Human
aggacauuccaagaca

SEQ ID NO: 3814915 - RNA, 17 nt, Human
aggacauuccaagacag

SEQ ID NO: 3814916 - RNA, 23 nt, Human
aggaccaauaaaauuucuaagag

SEQ ID NO: 3814917 - RNA, 19 nt, Human
aggaccacaggugugagcc

SEQ ID NO: 3814918 - RNA, 18 nt, Human
aggaccacucagccccua

SEQ ID NO: 3814919 - RNA, 19 nt, Human
aggaccacucagccccuag

SEQ ID NO: 3814920 - RNA, 12 nt, Human
aggaccacuccu

SEQ ID NO: 3814921 - RNA, 16 nt, Human
aggaccacuccuguac

SEQ ID NO: 3814922 - RNA, 18 nt, Human
aggaccagcacacucccg

SEQ ID NO: 3814923 - RNA, 12 nt, Human
aggaccagcuca

SEQ ID NO: 3814924 - RNA, 13 nt, Human
aggaccagcucag

SEQ ID NO: 3814925 - RNA, 14 nt, Human
aggaccagcucagg

SEQ ID NO: 3814926 - RNA, 18 nt, Human
aggaccagcucaggacag

SEQ ID NO: 3814927 - RNA, 12 nt, Human
aggaccaggacu

SEQ ID NO: 3814928 - RNA, 22 nt, Human
aggaccaggacuauagcccagg

SEQ ID NO: 3814929 - RNA, 18 nt, Human
aggaccagggcagggcca

SEQ ID NO: 3814930 - RNA, 18 nt, Human
aggacccaagcagagaag

SEQ ID NO: 3814931 - RNA, 23 nt, Human
aggacccacuuccugaucccuca

SEQ ID NO: 3814932 - RNA, 12 nt, Human
aggacccagacc

SEQ ID NO: 3814933 - RNA, 13 nt, Human
aggacccagaccc

SEQ ID NO: 3814934 - RNA, 18 nt, Human
aggacccagacccagugg

SEQ ID NO: 3814935 - RNA, 13 nt, Human
aggacccagagga

SEQ ID NO: 3814936 - RNA, 18 nt, Human
aggacccaggacaggauc

SEQ ID NO: 3814937 - RNA, 12 nt, Human
aggacccagggc

SEQ ID NO: 3814938 - RNA, 15 nt, Human
aggacccagggcucu

SEQ ID NO: 3814939 - RNA, 17 nt, Human
aggacccggaggggccu

SEQ ID NO: 3814940 - RNA, 20 nt, Human
aggacccggaggggccuggc

SEQ ID NO: 3814941 - RNA, 16 nt, Human
aggacccgucuccagc

SEQ ID NO: 3814942 - RNA, 18 nt, Human
aggacccuaacacaguau

SEQ ID NO: 3814943 - RNA, 19 nt, Human
aggacccucgcuggccccc

SEQ ID NO: 3814944 - RNA, 19 nt, Human
aggacccugccaggcacag

SEQ ID NO: 3814945 - RNA, 14 nt, Human
aggacccuggaccu

SEQ ID NO: 3814946 - RNA, 19 nt, Human
aggaccguggcccugcccu

SEQ ID NO: 3814947 - RNA, 20 nt, Human
aggaccucaggugagaagca

SEQ ID NO: 3814948 - RNA, 23 nt, Human
aggaccucauccaaacaauuuaa

SEQ ID NO: 3814949 - RNA, 21 nt, Human
aggaccuccaagccacugagc

SEQ ID NO: 3814950 - RNA, 19 nt, Human
aggaccuccucuucccccu

SEQ ID NO: 3814951 - RNA, 22 nt, Human
aggaccugacccuacucccuug

SEQ ID NO: 3814952 - RNA, 16 nt, Human
aggaccugagaccuga

SEQ ID NO: 3814953 - RNA, 14 nt, Human
aggaccugagccug

SEQ ID NO: 3814954 - RNA, 16 nt, Human
aggaccugagccugcc

SEQ ID NO: 3814955 - RNA, 18 nt, Human
aggaccugagccugccga

SEQ ID NO: 3814956 - RNA, 12 nt, Human
aggaccugcccc

SEQ ID NO: 3814957 - RNA, 17 nt, Human
aggaccuggcugccaua

SEQ ID NO: 3814958 - RNA, 19 nt, Human
agcuucauggcagaaggca

SEQ ID NO: 3814959 - RNA, 16 nt, Human
agcuucauguggcuuc

SEQ ID NO: 3814960 - RNA, 21 nt, Human
agcuucauucuccuuguuguu

SEQ ID NO: 3814961 - RNA, 19 nt, Human
agcuucauuugugucaaug

SEQ ID NO: 3814962 - RNA, 20 nt, Human
agcuucauuugugucaaugg

SEQ ID NO: 3814963 - RNA, 20 nt, Human
agcuuccaaggggcaaauuu

SEQ ID NO: 3814964 - RNA, 18 nt, Human
aggagcccaggccaggac

SEQ ID NO: 3814965 - RNA, 22 nt, Human
aggagcccauuuggagggccug

SEQ ID NO: 3814966 - RNA, 17 nt, Human
aggagccccaucugucu

SEQ ID NO: 3814967 - RNA, 15 nt, Human
aggagccccauuccu

SEQ ID NO: 3814968 - RNA, 18 nt, Human
aggagccccauuccuggg

SEQ ID NO: 3814969 - RNA, 17 nt, Human
aggagccccgaggccuu

SEQ ID NO: 3814970 - RNA, 22 nt, Human
aggagccccgaggccuucucug

SEQ ID NO: 3814971 - RNA, 13 nt, Human
aggagcccugccu

SEQ ID NO: 3814972 - RNA, 14 nt, Human
aggagccucacugg

SEQ ID NO: 3814973 - RNA, 13 nt, Human
aggagccugcaac

SEQ ID NO: 3814974 - RNA, 21 nt, Human
agcuuuuuaauuguuguuucu

SEQ ID NO: 3814975 - RNA, 22 nt, Human
agcuuuuuauuccuccugcuca

SEQ ID NO: 3814976 - RNA, 17 nt, Human
agcuuuuuccuccugga

SEQ ID NO: 3814977 - RNA, 15 nt, Human
agcuuuuugaaaacc

SEQ ID NO: 3814978 - RNA, 13 nt, Human
agcuuuuuggaau

SEQ ID NO: 3814979 - RNA, 13 nt, Human
agcuuuuugucuu

SEQ ID NO: 3814980 - RNA, 22 nt, Human
agcuuuuuuauuuuuuauacag

SEQ ID NO: 3814981 - RNA, 20 nt, Human
agcuuuuuucucugauacag

SEQ ID NO: 3814982 - RNA, 16 nt, Human
aggaaaaaaacuuuua

SEQ ID NO: 3814983 - RNA, 22 nt, Human
aggaaaaaaaucguccagggag

SEQ ID NO: 3814984 - RNA, 14 nt, Human
aggaaaaacagguc

SEQ ID NO: 3814985 - RNA, 14 nt, Human
aggaaaaagaaaau

SEQ ID NO: 3814986 - RNA, 22 nt, Human
aggaaaaagcaaguucgucugu

SEQ ID NO: 3814987 - RNA, 18 nt, Human
aggaaaaagcacaagaag

SEQ ID NO: 3814988 - RNA, 18 nt, Human
aggaaaaagcuccaugug

SEQ ID NO: 3814989 - RNA, 14 nt, Human
aggaaaaauaugug

SEQ ID NO: 3814990 - RNA, 14 nt, Human
aggaaaaauauuua

SEQ ID NO: 3814991 - RNA, 19 nt, Human
aggaaaaauguguaauuuu

SEQ ID NO: 3814992 - RNA, 13 nt, Human
aggaaaacuaccu

SEQ ID NO: 3814993 - RNA, 14 nt, Human
aggaaaacugcaug

SEQ ID NO: 3814994 - RNA, 16 nt, Human
aggaaaagcaaauuga

SEQ ID NO: 3814995 - RNA, 20 nt, Human
aggaaaagcggacaucagcu

SEQ ID NO: 3814996 - RNA, 17 nt, Human
aggaaaagguugaauaa

SEQ ID NO: 3814997 - RNA, 22 nt, Human
aggaaaagguugaauaauauau

SEQ ID NO: 3814998 - RNA, 21 nt, Human
aggaaaaguuuaauauuaaag

SEQ ID NO: 3814999 - RNA, 23 nt, Human
aggaaaaguuuaauauuaaagcc

SEQ ID NO: 3815000 - RNA, 14 nt, Human
aggaaaauaaugua

SEQ ID NO: 3815001 - RNA, 22 nt, Human
aggaaaauaauguaauuguaau

SEQ ID NO: 3815002 - RNA, 22 nt, Human
aggaaaauauuuugaucuucaa

SEQ ID NO: 3815003 - RNA, 14 nt, Human
aggaaaaugaauaa

SEQ ID NO: 3815004 - RNA, 15 nt, Human
aggaaaaugaucuga

SEQ ID NO: 3815005 - RNA, 21 nt, Human
aggaaaauuauucuauaauuu

SEQ ID NO: 3815006 - RNA, 13 nt, Human
aggaaaccaacac

SEQ ID NO: 3815007 - RNA, 15 nt, Human
aggaaacccagcucu

SEQ ID NO: 3815008 - RNA, 17 nt, Human
aggaaacccagcucugg

SEQ ID NO: 3815009 - RNA, 23 nt, Human
aggaaaccgaguagaaaauguga

SEQ ID NO: 3815010 - RNA, 16 nt, Human
aggaaaccuuuucuug

SEQ ID NO: 3815011 - RNA, 17 nt, Human
aggaaaccuuuucuugu

SEQ ID NO: 3815012 - RNA, 20 nt, Human
aggaaacgagacuuuccauu

SEQ ID NO: 3815013 - RNA, 16 nt, Human
aggaaacgcuaccucu

SEQ ID NO: 3815014 - RNA, 20 nt, Human
aggaaacucaccugcuggcc

SEQ ID NO: 3815015 - RNA, 19 nt, Human
aggaaacuccacaucugcc

SEQ ID NO: 3815016 - RNA, 13 nt, Human
aggaaacucuuau

SEQ ID NO: 3815017 - RNA, 18 nt, Human
aggaaacucuuaucucag

SEQ ID NO: 3815018 - RNA, 15 nt, Human
aggaaacuuuuaacu

SEQ ID NO: 3815019 - RNA, 19 nt, Human
aggaaagagaacuuccaga

SEQ ID NO: 3815020 - RNA, 19 nt, Human
aggaaagcaaaggagauug

SEQ ID NO: 3815021 - RNA, 23 nt, Human
aggaaagcaaaucaguuugguug

SEQ ID NO: 3815022 - RNA, 18 nt, Human
aggaaagcaauaaaugaa

SEQ ID NO: 3815023 - RNA, 19 nt, Human
aggaaagccccagcacuaa

SEQ ID NO: 3815024 - RNA, 24 nt, Human
aggaaagcgccuccaacccuagca

SEQ ID NO: 3815025 - RNA, 21 nt, Human
aggaaagcuugaguaaaauaa

SEQ ID NO: 3815026 - RNA, 17 nt, Human
aggaaaggccagcuggc

SEQ ID NO: 3815027 - RNA, 22 nt, Human
aggaaaggccagcuggcagcag

SEQ ID NO: 3815028 - RNA, 15 nt, Human
aggaaaggcuccagg

SEQ ID NO: 3815029 - RNA, 22 nt, Human
aggaaagggaggaguggaggug

SEQ ID NO: 3815030 - RNA, 19 nt, Human
aggaaagggggucccagug

SEQ ID NO: 3815031 - RNA, 18 nt, Human
aggaaagugauaugcauu

SEQ ID NO: 3815032 - RNA, 20 nt, Human
aggaaauaaaaaagucucua

SEQ ID NO: 3815033 - RNA, 22 nt, Human
aggaaauaaaaaagucucuauu

SEQ ID NO: 3815034 - RNA, 19 nt, Human
aggaaauaaaaccuuucaa

SEQ ID NO: 3815035 - RNA, 16 nt, Human
aggaaauaagaaaaau

SEQ ID NO: 3815036 - RNA, 20 nt, Human
aggaaauauauaugugugug

SEQ ID NO: 3815037 - RNA, 16 nt, Human
aggaaauauugcuggg

SEQ ID NO: 3815038 - RNA, 19 nt, Human
aggaaaucaaauaugcaaa

SEQ ID NO: 3815039 - RNA, 21 nt, Human
aggaaaucaaauaugcaaagc

SEQ ID NO: 3815040 - RNA, 22 nt, Human
aggaaaucaaauaugcaaagca

SEQ ID NO: 3815041 - RNA, 14 nt, Human
aggaaauccagggu

SEQ ID NO: 3815042 - RNA, 14 nt, Human
aggaaaucccuuca

SEQ ID NO: 3815043 - RNA, 18 nt, Human
aggaaaucccuucauacu

SEQ ID NO: 3815044 - RNA, 14 nt, Human
aggaaaucucaccc

SEQ ID NO: 3815045 - RNA, 15 nt, Human
aggaaaugaaugugu

SEQ ID NO: 3815046 - RNA, 18 nt, Human
aggaaauggaauacugaa

SEQ ID NO: 3815047 - RNA, 23 nt, Human
aggaaauguuuuuaauaaaagaa

SEQ ID NO: 3815048 - RNA, 16 nt, Human
aggaaauucuccacug

SEQ ID NO: 3815049 - RNA, 22 nt, Human
aggaaauucuuucccagucugu

SEQ ID NO: 3815050 - RNA, 16 nt, Human
aggaacaaaaaaacca

SEQ ID NO: 3815051 - RNA, 15 nt, Human
aggaacaaaucuucc

SEQ ID NO: 3815052 - RNA, 17 nt, Human
aggaacaaaucuuccug

SEQ ID NO: 3815053 - RNA, 20 nt, Human
aggaacaaggcaaggcuguc

SEQ ID NO: 3815054 - RNA, 13 nt, Human
aggaacagaagga

SEQ ID NO: 3815055 - RNA, 17 nt, Human
aggaacauuuaggggca

SEQ ID NO: 3815056 - RNA, 15 nt, Human
aggaaccacaccaca

SEQ ID NO: 3815057 - RNA, 16 nt, Human
aggaaccauaaucaau

SEQ ID NO: 3815058 - RNA, 19 nt, Human
aggaacccuuacaguagga

SEQ ID NO: 3815059 - RNA, 20 nt, Human
aggaaccgugguaugucugc

SEQ ID NO: 3815060 - RNA, 23 nt, Human
aggaaccgugguaugucugccau

SEQ ID NO: 3815061 - RNA, 13 nt, Human
aggaaccuggacc

SEQ ID NO: 3815062 - RNA, 20 nt, Human
aggaaccuuccuuccugcuu

SEQ ID NO: 3815063 - RNA, 22 nt, Human
aggaacguaaucguguccccua

SEQ ID NO: 3815064 - RNA, 15 nt, Human
aggaacuacugagga

SEQ ID NO: 3815065 - RNA, 14 nt, Human
aggaacuccuuggc

SEQ ID NO: 3815066 - RNA, 18 nt, Human
aggaacuguccagagagc

SEQ ID NO: 3815067 - RNA, 19 nt, Human
aggaacuguccagagagca

SEQ ID NO: 3815068 - RNA, 16 nt, Human
aggaagaaaaaucagu

SEQ ID NO: 3815069 - RNA, 22 nt, Human
aggaagaacggggcucuucuca

SEQ ID NO: 3815070 - RNA, 18 nt, Human
aggaagaagcuuaggcag

SEQ ID NO: 3815071 - RNA, 17 nt, Human
aggaagaauagggccca

SEQ ID NO: 3815072 - RNA, 15 nt, Human
aggaagaauuuuaaa

SEQ ID NO: 3815073 - RNA, 13 nt, Human
aggaagacuuugg

SEQ ID NO: 3815074 - RNA, 14 nt, Human
aggaagagaaaaaa

SEQ ID NO: 3815075 - RNA, 16 nt, Human
aggaagagaaggagca

SEQ ID NO: 3815076 - RNA, 14 nt, Human
aggaagagacacuc

SEQ ID NO: 3815077 - RNA, 18 nt, Human
aggaagaucacuuugcuc

SEQ ID NO: 3815078 - RNA, 21 nt, Human
aggaagaucacuuugcucuga

SEQ ID NO: 3815079 - RNA, 17 nt, Human
aggaagaucccccagaa

SEQ ID NO: 3815080 - RNA, 20 nt, Human
aggaagaucucugcagggcc

SEQ ID NO: 3815081 - RNA, 15 nt, Human
aggaagaugaaagag

SEQ ID NO: 3815082 - RNA, 17 nt, Human
aggaagaugaaagagga

SEQ ID NO: 3815083 - RNA, 18 nt, Human
aggaagaugggggcaaga

SEQ ID NO: 3815084 - RNA, 20 nt, Human
aggaagaugggggcaagaag

SEQ ID NO: 3815085 - RNA, 22 nt, Human
aggaagaugggggcaagaagau

SEQ ID NO: 3815086 - RNA, 17 nt, Human
aggaagauuacucagua

SEQ ID NO: 3815087 - RNA, 19 nt, Human
aggaagcaaauagaagaga

SEQ ID NO: 3815088 - RNA, 13 nt, Human
aggaagcaacgaa

SEQ ID NO: 3815089 - RNA, 19 nt, Human
aggaagcaacgaagggaaa

SEQ ID NO: 3815090 - RNA, 11 nt, Human
aggaagcacau

SEQ ID NO: 3815091 - RNA, 11 nt, Human
aggaagcagaa

SEQ ID NO: 3815092 - RNA, 14 nt, Human
aggaagcagaauaa

SEQ ID NO: 3815093 - RNA, 17 nt, Human
aggaagcagaauaaagc

SEQ ID NO: 3815094 - RNA, 14 nt, Human
aggaagcagccaag

SEQ ID NO: 3815095 - RNA, 16 nt, Human
aggaagcaugagugcu

SEQ ID NO: 3815096 - RNA, 18 nt, Human
aggaagcauucagagagc

SEQ ID NO: 3815097 - RNA, 19 nt, Human
aggaagcauucagagagca

SEQ ID NO: 3815098 - RNA, 15 nt, Human
aggaagcauuguaaa

SEQ ID NO: 3815099 - RNA, 17 nt, Human
aggaagcauuguaaaau

SEQ ID NO: 3815100 - RNA, 21 nt, Human
aggaagcauuguaaaauaauu

SEQ ID NO: 3815101 - RNA, 22 nt, Human
aggaagcauuguaaaauaauuc

SEQ ID NO: 3815102 - RNA, 15 nt, Human
aggaagccacagcug

SEQ ID NO: 3815103 - RNA, 23 nt, Human
aggaagccagcaggcucucaggc

SEQ ID NO: 3815104 - RNA, 20 nt, Human
aggaagccgcuggggccagu

SEQ ID NO: 3815105 - RNA, 19 nt, Human
aggaagccggggaagagau

SEQ ID NO: 3815106 - RNA, 21 nt, Human
aggaagccgugcccugccccc

SEQ ID NO: 3815107 - RNA, 13 nt, Human
aggaagccucaga

SEQ ID NO: 3815108 - RNA, 19 nt, Human
aggaggccacgugaugugg

SEQ ID NO: 3815109 - RNA, 12 nt, Human
aggaggccucca

SEQ ID NO: 3815110 - RNA, 15 nt, Human
aggaggccuccaucu

SEQ ID NO: 3815111 - RNA, 20 nt, Human
aggaggcgcccuuggcuucu

SEQ ID NO: 3815112 - RNA, 21 nt, Human
aggaggcuaugcucaggggcc

SEQ ID NO: 3815113 - RNA, 17 nt, Human
aggaggcuccaggcagc

SEQ ID NO: 3815114 - RNA, 12 nt, Human
aggaggcuggag

SEQ ID NO: 3815115 - RNA, 13 nt, Human
aggaggcuggcag

SEQ ID NO: 3815116 - RNA, 19 nt, Human
aggagggacaaaggagccu

SEQ ID NO: 3815117 - RNA, 20 nt, Human
aggagggacaaaggagccug

SEQ ID NO: 3815118 - RNA, 16 nt, Human
aggagggagacacugg

SEQ ID NO: 3815119 - RNA, 23 nt, Human
aggagggagacacuggccccuca

SEQ ID NO: 3815120 - RNA, 20 nt, Human
aggagggagagucucccagg

SEQ ID NO: 3815121 - RNA, 19 nt, Human
aggagggaugcugccugag

SEQ ID NO: 3815122 - RNA, 20 nt, Human
aggagggcaagggccaugcu

SEQ ID NO: 3815123 - RNA, 13 nt, Human
aggagggcaggca

SEQ ID NO: 3815124 - RNA, 17 nt, Human
aggaggggaaaaaaaug

SEQ ID NO: 3815125 - RNA, 16 nt, Human
aggaggggaacacugc

SEQ ID NO: 3815126 - RNA, 12 nt, Human
aggaggggaaga

SEQ ID NO: 3815127 - RNA, 15 nt, Human
aggaggggaagaggc

SEQ ID NO: 3815128 - RNA, 14 nt, Human
aggaggggaagcug

SEQ ID NO: 3815129 - RNA, 19 nt, Human
aggaggggaagcugcagcu

SEQ ID NO: 3815130 - RNA, 14 nt, Human
aggaggggagggua

SEQ ID NO: 3815131 - RNA, 19 nt, Human
aggaggggccccccugccc

SEQ ID NO: 3815132 - RNA, 21 nt, Human
aggaggggggagggaagggag

SEQ ID NO: 3815133 - RNA, 21 nt, Human
aggagggggucguggagagcu

SEQ ID NO: 3815134 - RNA, 19 nt, Human
aggaggguacagcugggcu

SEQ ID NO: 3815135 - RNA, 16 nt, Human
aggaggguguaaugga

SEQ ID NO: 3815136 - RNA, 18 nt, Human
aggagguccuuaggccuc

SEQ ID NO: 3815137 - RNA, 16 nt, Human
aggaggugccaacagu

SEQ ID NO: 3815138 - RNA, 14 nt, Human
aggaggugccacug

SEQ ID NO: 3815139 - RNA, 20 nt, Human
aggagguggagguugcagug

SEQ ID NO: 3815140 - RNA, 21 nt, Human
aggaggugucucaggcugccu

SEQ ID NO: 3815141 - RNA, 14 nt, Human
aggagguugggagg

SEQ ID NO: 3815142 - RNA, 22 nt, Human
aggagguugggaggggguuggg

SEQ ID NO: 3815143 - RNA, 14 nt, Human
aggaguaaaauuca

SEQ ID NO: 3815144 - RNA, 21 nt, Human
aggaguaaucuguguacaaag

SEQ ID NO: 3815145 - RNA, 13 nt, Human
aggaguagcugag

SEQ ID NO: 3815146 - RNA, 16 nt, Human
aggaguagcugagcuc

SEQ ID NO: 3815147 - RNA, 14 nt, Human
aggagucacugaga

SEQ ID NO: 3815148 - RNA, 21 nt, Human
aggagucccugccaucauguu

SEQ ID NO: 3815149 - RNA, 15 nt, Human
aggagucugaggucc

SEQ ID NO: 3815150 - RNA, 22 nt, Human
aggagugaaaccuuuagggcag

SEQ ID NO: 3815151 - RNA, 17 nt, Human
aggagugagaggggaca

SEQ ID NO: 3815152 - RNA, 21 nt, Human
aggagugaucgucagaugugu

SEQ ID NO: 3815153 - RNA, 20 nt, Human
aggagugggugacaagagcc

SEQ ID NO: 3815154 - RNA, 21 nt, Human
aggagugggugacaagagccu

SEQ ID NO: 3815155 - RNA, 23 nt, Human
aggagugggugacaagagccuga

SEQ ID NO: 3815156 - RNA, 18 nt, Human
aggaguggguugauuuca

SEQ ID NO: 3815157 - RNA, 14 nt, Human
aggaguggugcaga

SEQ ID NO: 3815158 - RNA, 14 nt, Human
aggaguguccucuu

SEQ ID NO: 3815159 - RNA, 16 nt, Human
aggagugugagaauca

SEQ ID NO: 3815160 - RNA, 20 nt, Human
aggagugugugacauuccag

SEQ ID NO: 3815161 - RNA, 22 nt, Human
aggaguuaguggauuacugcca

SEQ ID NO: 3815162 - RNA, 17 nt, Human
aggaguuauuuguaaug

SEQ ID NO: 3815163 - RNA, 21 nt, Human
aggaguucaagaccagccugg

SEQ ID NO: 3815164 - RNA, 14 nt, Human
aggaguucaaugau

SEQ ID NO: 3815165 - RNA, 20 nt, Human
aggaguuccuugaucuguau

SEQ ID NO: 3815166 - RNA, 14 nt, Human
aggaguugcuguuu

SEQ ID NO: 3815167 - RNA, 21 nt, Human
aggaguugcuguuuguuugac

SEQ ID NO: 3815168 - RNA, 19 nt, Human
aggaguuucguuuucaaaa

SEQ ID NO: 3815169 - RNA, 20 nt, Human
aggccaaaggaagcacaugc

SEQ ID NO: 3815170 - RNA, 23 nt, Human
aggccaacacuguggguguguga

SEQ ID NO: 3815171 - RNA, 21 nt, Human
aggccaagaaacgucuucuaa

SEQ ID NO: 3815172 - RNA, 18 nt, Human
aggccaagaauauugcaa

SEQ ID NO: 3815173 - RNA, 18 nt, Human
aggccaagagcagaggca

SEQ ID NO: 3815174 - RNA, 20 nt, Human
aggccaagagcagaggcagc

SEQ ID NO: 3815175 - RNA, 14 nt, Human
aggccaagagguuu

SEQ ID NO: 3815176 - RNA, 16 nt, Human
aggccaagaguggccc

SEQ ID NO: 3815177 - RNA, 21 nt, Human
aggccaagaguggccccaccu

SEQ ID NO: 3815178 - RNA, 20 nt, Human
aggccaagguguccuacaga

SEQ ID NO: 3815179 - RNA, 18 nt, Human
aggccaagucaggcccuu

SEQ ID NO: 3815180 - RNA, 21 nt, Human
aggccaagugcaggcuggcac

SEQ ID NO: 3815181 - RNA, 16 nt, Human
aggccacaagacccuu

SEQ ID NO: 3815182 - RNA, 16 nt, Human
aggccacaugaguccc

SEQ ID NO: 3815183 - RNA, 19 nt, Human
aggccacaugagucccagu

SEQ ID NO: 3815184 - RNA, 23 nt, Human
aggccacauggggcugggcagcu

SEQ ID NO: 3815185 - RNA, 21 nt, Human
aggccacaugucaccguggac

SEQ ID NO: 3815186 - RNA, 24 nt, Human
aggccacauuacuagaguuggcau

SEQ ID NO: 3815187 - RNA, 22 nt, Human
aggccacccugugcagaaggga

SEQ ID NO: 3815188 - RNA, 16 nt, Human
aggccaccuccagaaa

SEQ ID NO: 3815189 - RNA, 21 nt, Human
aggccaccuccuaaaaggccc

SEQ ID NO: 3815190 - RNA, 19 nt, Human
aggccaccucuccaagggc

SEQ ID NO: 3815191 - RNA, 14 nt, Human
aggccaccucuucc

SEQ ID NO: 3815192 - RNA, 23 nt, Human
aggccaccucuuccuggccggug

SEQ ID NO: 3815193 - RNA, 12 nt, Human
aggccaccugca

SEQ ID NO: 3815194 - RNA, 13 nt, Human
aggccaccugccc

SEQ ID NO: 3815195 - RNA, 15 nt, Human
aggccaccugccccc

SEQ ID NO: 3815196 - RNA, 18 nt, Human
aggccaccugcccccuuc

SEQ ID NO: 3815197 - RNA, 21 nt, Human
aggccaccuggcucucaccuc

SEQ ID NO: 3815198 - RNA, 13 nt, Human
aggccacggcagc

SEQ ID NO: 3815199 - RNA, 19 nt, Human
aggccacuccuccaaagga

SEQ ID NO: 3815200 - RNA, 13 nt, Human
aggccacugaaga

SEQ ID NO: 3815201 - RNA, 14 nt, Human
aggccacugaagag

SEQ ID NO: 3815202 - RNA, 17 nt, Human
aggccacugaagaggag

SEQ ID NO: 3815203 - RNA, 18 nt, Human
aggccacugaagaggagg

SEQ ID NO: 3815204 - RNA, 20 nt, Human
aggccacugaagaggaggag

SEQ ID NO: 3815205 - RNA, 20 nt, Human
aggccacuguguuccuuccg

SEQ ID NO: 3815206 - RNA, 14 nt, Human
aggccagaccugca

SEQ ID NO: 3815207 - RNA, 13 nt, Human
aggccagagacac

SEQ ID NO: 3815208 - RNA, 18 nt, Human
aggccagagacacaagcc

SEQ ID NO: 3815209 - RNA, 14 nt, Human
aggccagagccaag

SEQ ID NO: 3815210 - RNA, 22 nt, Human
aggccagaggcccccagcccag

SEQ ID NO: 3815211 - RNA, 14 nt, Human
aggccagagggagu

SEQ ID NO: 3815212 - RNA, 20 nt, Human
aggccagaguggccuggcca

SEQ ID NO: 3815213 - RNA, 22 nt, Human
aggccagaguggccuggccagg

SEQ ID NO: 3815214 - RNA, 22 nt, Human
aggccagcaagguggaguggau

SEQ ID NO: 3815215 - RNA, 24 nt, Human
aggccagcaagguggaguggaugc

SEQ ID NO: 3815216 - RNA, 22 nt, Human
aggccagcacucgcuagcagug

SEQ ID NO: 3815217 - RNA, 15 nt, Human
aggccagccccaccc

SEQ ID NO: 3815218 - RNA, 17 nt, Human
aggccagccccacccag

SEQ ID NO: 3815219 - RNA, 18 nt, Human
aggccagccccacccagg

SEQ ID NO: 3815220 - RNA, 10 nt, Human
aggccagccu

SEQ ID NO: 3815221 - RNA, 13 nt, Human
aggccagccuccg

SEQ ID NO: 3815222 - RNA, 12 nt, Human
aggccagccugg

SEQ ID NO: 3815223 - RNA, 15 nt, Human
aggccagccuugacc

SEQ ID NO: 3815224 - RNA, 18 nt, Human
aggccagcuggcagcaga

SEQ ID NO: 3815225 - RNA, 15 nt, Human
aggccaggacucugc

SEQ ID NO: 3815226 - RNA, 11 nt, Human
aggccaggagu

SEQ ID NO: 3815227 - RNA, 21 nt, Human
aggccaggaguuugagaccag

SEQ ID NO: 3815228 - RNA, 11 nt, Human
aggccaggcau

SEQ ID NO: 3815229 - RNA, 14 nt, Human
aggccaggccacca

SEQ ID NO: 3815230 - RNA, 17 nt, Human
aggccaggccaccagga

SEQ ID NO: 3815231 - RNA, 19 nt, Human
aggccaggccaccaggaug

SEQ ID NO: 3815232 - RNA, 14 nt, Human
aggccaggcccucu

SEQ ID NO: 3815233 - RNA, 16 nt, Human
aggccaggcccucugc

SEQ ID NO: 3815234 - RNA, 17 nt, Human
aggccaggcuccuuccu

SEQ ID NO: 3815235 - RNA, 22 nt, Human
aggccaggcuccuuccugucuu

SEQ ID NO: 3815236 - RNA, 13 nt, Human
aggccagggcaga

SEQ ID NO: 3815237 - RNA, 15 nt, Human
aggccagguccagag

SEQ ID NO: 3815238 - RNA, 12 nt, Human
aggccaggugca

SEQ ID NO: 3815239 - RNA, 18 nt, Human
aggccaggugcaaccagg

SEQ ID NO: 3815240 - RNA, 14 nt, Human
aggccaggugcagu

SEQ ID NO: 3815241 - RNA, 15 nt, Human
aggccauauuuccau

SEQ ID NO: 3815242 - RNA, 16 nt, Human
aggccaucuggagagc

SEQ ID NO: 3815243 - RNA, 20 nt, Human
aggccaucuggagagcccag

SEQ ID NO: 3815244 - RNA, 19 nt, Human
aggccauggacucuguccu

SEQ ID NO: 3815245 - RNA, 20 nt, Human
aggccauggacucuguccug

SEQ ID NO: 3815246 - RNA, 22 nt, Human
aggccauggacucuguccugaa

SEQ ID NO: 3815247 - RNA, 21 nt, Human
aggccauggagagcuggagcc

SEQ ID NO: 3815248 - RNA, 22 nt, Human
aggccaugggacagggaggacg

SEQ ID NO: 3815249 - RNA, 23 nt, Human
aggccaugggcacuguggguaga

SEQ ID NO: 3815250 - RNA, 18 nt, Human
aggccaugggccuccugu

SEQ ID NO: 3815251 - RNA, 14 nt, Human
aggccaugugcaua

SEQ ID NO: 3815252 - RNA, 15 nt, Human
agagcgacagagcag

SEQ ID NO: 3815253 - RNA, 16 nt, Human
agagcgacagagcagu

SEQ ID NO: 3815254 - RNA, 12 nt, Human
agagcgaggcug

SEQ ID NO: 3815255 - RNA, 13 nt, Human
agagcgcagcccg

SEQ ID NO: 3815256 - RNA, 13 nt, Human
agagcgccccucc

SEQ ID NO: 3815257 - RNA, 21 nt, Human
agagcgccugccccucccaga

SEQ ID NO: 3815258 - RNA, 15 nt, Human
agagcgcgccccuag

SEQ ID NO: 3815259 - RNA, 14 nt, Human
agagcggucucagg

SEQ ID NO: 3815260 - RNA, 21 nt, Human
agagcgugcuccagccuggcu

SEQ ID NO: 3815261 - RNA, 21 nt, Human
agagcuacuugggccauagcu

SEQ ID NO: 3815262 - RNA, 18 nt, Human
agagcuagaaccuggaga

SEQ ID NO: 3815263 - RNA, 22 nt, Human
agagcuagaaccuggagggcua

SEQ ID NO: 3815264 - RNA, 16 nt, Human
agagcuagcgcugccg

SEQ ID NO: 3815265 - RNA, 13 nt, Human
agagcuaggagca

SEQ ID NO: 3815266 - RNA, 21 nt, Human
agagcuaggagcaaagccugu

SEQ ID NO: 3815267 - RNA, 23 nt, Human
agagcuauuuaauggccggcugg

SEQ ID NO: 3815268 - RNA, 17 nt, Human
agagcucaagggacaag

SEQ ID NO: 3815269 - RNA, 12 nt, Human
agagcuccuccc

SEQ ID NO: 3815270 - RNA, 17 nt, Human
agagcuccucccucuca

SEQ ID NO: 3815271 - RNA, 23 nt, Human
agagcuccucuguccugcuucug

SEQ ID NO: 3815272 - RNA, 14 nt, Human
agagcucucucuac

SEQ ID NO: 3815273 - RNA, 14 nt, Human
agagcucuggagcc

SEQ ID NO: 3815274 - RNA, 22 nt, Human
agagcucuggagccaccugucc

SEQ ID NO: 3815275 - RNA, 22 nt, Human
agagcucuggugauaaggacau

SEQ ID NO: 3815276 - RNA, 20 nt, Human
agagcugacacaaaccugcc

SEQ ID NO: 3815277 - RNA, 22 nt, Human
agagcugacacaaaccugccug

SEQ ID NO: 3815278 - RNA, 23 nt, Human
agagcugacacaaaccugccugg

SEQ ID NO: 3815279 - RNA, 15 nt, Human
agagcugagugagcu

SEQ ID NO: 3815280 - RNA, 13 nt, Human
agagcugauccag

SEQ ID NO: 3815281 - RNA, 20 nt, Human
agagcugauggagaaggaag

SEQ ID NO: 3815282 - RNA, 13 nt, Human
agagcugcccucc

SEQ ID NO: 3815283 - RNA, 20 nt, Human
agagcugcccuccuugucca

SEQ ID NO: 3815284 - RNA, 18 nt, Human
agagcugcccucuccugg

SEQ ID NO: 3815285 - RNA, 22 nt, Human
agagcugcccucuccugggcag

SEQ ID NO: 3815286 - RNA, 21 nt, Human
agagcugccuaagaggcaaug

SEQ ID NO: 3815287 - RNA, 14 nt, Human
agagcugcucugga

SEQ ID NO: 3815288 - RNA, 22 nt, Human
agagcugcucuggaaaauguga

SEQ ID NO: 3815289 - RNA, 17 nt, Human
agagcugcuuccccguc

SEQ ID NO: 3815290 - RNA, 17 nt, Human
agagcuggaccaguggu

SEQ ID NO: 3815291 - RNA, 23 nt, Human
agagcuggagaugaggccagacc

SEQ ID NO: 3815292 - RNA, 15 nt, Human
agagcuggagccugg

SEQ ID NO: 3815293 - RNA, 17 nt, Human
agagcuggagccuggug

SEQ ID NO: 3815294 - RNA, 18 nt, Human
agagcuggagccuggugc

SEQ ID NO: 3815295 - RNA, 15 nt, Human
agagcuggcucugag

SEQ ID NO: 3815296 - RNA, 16 nt, Human
agagcuggcucugagc

SEQ ID NO: 3815297 - RNA, 21 nt, Human
agagcuggggcugagggaugg

SEQ ID NO: 3815298 - RNA, 12 nt, Human
agagcuggguga

SEQ ID NO: 3815299 - RNA, 16 nt, Human
agagcugggugagugg

SEQ ID NO: 3815300 - RNA, 11 nt, Human
agagcuggugc

SEQ ID NO: 3815301 - RNA, 17 nt, Human
agagcuggugcggcugg

SEQ ID NO: 3815302 - RNA, 17 nt, Human
agagcuggugucugauu

SEQ ID NO: 3815303 - RNA, 16 nt, Human
agagcugguugggaag

SEQ ID NO: 3815304 - RNA, 16 nt, Human
agagcugugcaucagc

SEQ ID NO: 3815305 - RNA, 18 nt, Human
agagcuguucacagccag

SEQ ID NO: 3815306 - RNA, 21 nt, Human
agagcuguucacagccagacu

SEQ ID NO: 3815307 - RNA, 20 nt, Human
agagcuguucccaaauuuuc

SEQ ID NO: 3815308 - RNA, 19 nt, Human
agagcuguuuauggccuca

SEQ ID NO: 3815309 - RNA, 20 nt, Human
agagcuguuuauggccucag

SEQ ID NO: 3815310 - RNA, 21 nt, Human
agagcuguuuauggccucagc

SEQ ID NO: 3815311 - RNA, 18 nt, Human
agagcuuagaaacuggaa

SEQ ID NO: 3815312 - RNA, 15 nt, Human
agagcuuagccugga

SEQ ID NO: 3815313 - RNA, 16 nt, Human
agagcuucccugacuc

SEQ ID NO: 3815314 - RNA, 17 nt, Human
agagcuucccugacuca

SEQ ID NO: 3815315 - RNA, 21 nt, Human
agagcuucuguugcugccuca

SEQ ID NO: 3815316 - RNA, 22 nt, Human
agagcuucuguugcugccucau

SEQ ID NO: 3815317 - RNA, 15 nt, Human
agagcuucuuccagg

SEQ ID NO: 3815318 - RNA, 17 nt, Human
agagcuugaugccagua

SEQ ID NO: 3815319 - RNA, 23 nt, Human
agagcuuggacuggaugcauguu

SEQ ID NO: 3815320 - RNA, 15 nt, Human
agagcuuuacaaaaa

SEQ ID NO: 3815321 - RNA, 17 nt, Human
agagcuuuacaaaaaga

SEQ ID NO: 3815322 - RNA, 22 nt, Human
agagcuuucuguccuuuuggca

SEQ ID NO: 3815323 - RNA, 21 nt, Human
aggaguuugagaccaaccugg

SEQ ID NO: 3815324 - RNA, 19 nt, Human
aggaguuugaggcugcagc

SEQ ID NO: 3815325 - RNA, 24 nt, Human
aggaguuugaggcugcagcgagcu

SEQ ID NO: 3815326 - RNA, 16 nt, Human
aggaguuuggccagaa

SEQ ID NO: 3815327 - RNA, 21 nt, Human
aggauaaacuuuuagaaacuu

SEQ ID NO: 3815328 - RNA, 15 nt, Human
aggauacaggcugga

SEQ ID NO: 3815329 - RNA, 18 nt, Human
aggauacgacaguacacu

SEQ ID NO: 3815330 - RNA, 13 nt, Human
aggauacucuguc

SEQ ID NO: 3815331 - RNA, 16 nt, Human
aggauacucugucaga

SEQ ID NO: 3815332 - RNA, 13 nt, Human
aggauacugcugc

SEQ ID NO: 3815333 - RNA, 22 nt, Human
aggauacuguaacacuuuacaa

SEQ ID NO: 3815334 - RNA, 15 nt, Human
aggauacuuauuuaa

SEQ ID NO: 3815335 - RNA, 19 nt, Human
aggauagaugcuggcccag

SEQ ID NO: 3815336 - RNA, 16 nt, Human
aggauaggaguucacu

SEQ ID NO: 3815337 - RNA, 21 nt, Human
aggauaggaguucacuucauc

SEQ ID NO: 3815338 - RNA, 19 nt, Human
aggauauccuuaucagagc

SEQ ID NO: 3815339 - RNA, 21 nt, Human
aggauauccuuaucagagcua

SEQ ID NO: 3815340 - RNA, 14 nt, Human
aggauaugccugcu

SEQ ID NO: 3815341 - RNA, 23 nt, Human
aggauauguucacaccuagcguc

SEQ ID NO: 3815342 - RNA, 19 nt, Human
aggauauuuaagaaaauac

SEQ ID NO: 3815343 - RNA, 13 nt, Human
aggaucagccagg

SEQ ID NO: 3815344 - RNA, 13 nt, Human
aggaucaguuuuu

SEQ ID NO: 3815345 - RNA, 15 nt, Human
aggaucaugguguaa

SEQ ID NO: 3815346 - RNA, 15 nt, Human
aggauccagccucac

SEQ ID NO: 3815347 - RNA, 11 nt, Human
aggauccaggc

SEQ ID NO: 3815348 - RNA, 16 nt, Human
aggauccccuccaagc

SEQ ID NO: 3815349 - RNA, 18 nt, Human
aggauccccuccaagccu

SEQ ID NO: 3815350 - RNA, 16 nt, Human
aggaucccucucugga

SEQ ID NO: 3815351 - RNA, 17 nt, Human
aggaucccucucuggau

SEQ ID NO: 3815352 - RNA, 14 nt, Human
aggauccggaaaga

SEQ ID NO: 3815353 - RNA, 16 nt, Human
aggaucuaaggcuguu

SEQ ID NO: 3815354 - RNA, 22 nt, Human
aggaucuagaauguguuuucug

SEQ ID NO: 3815355 - RNA, 14 nt, Human
aggaucuagagggg

SEQ ID NO: 3815356 - RNA, 17 nt, Human
aggaucucuaaagagca

SEQ ID NO: 3815357 - RNA, 15 nt, Human
aggaucucucaggag

SEQ ID NO: 3815358 - RNA, 19 nt, Human
aggaucucucaggagcaca

SEQ ID NO: 3815359 - RNA, 21 nt, Human
aggaucucucaggagcacagg

SEQ ID NO: 3815360 - RNA, 23 nt, Human
aggaucuguuuuuaaaaaucaua

SEQ ID NO: 3815361 - RNA, 22 nt, Human
aggaucuuucacccacagaaag

SEQ ID NO: 3815362 - RNA, 23 nt, Human
aggaucuuucacccacagaaaga

SEQ ID NO: 3815363 - RNA, 20 nt, Human
aggaucuuuguggccaagga

SEQ ID NO: 3815364 - RNA, 13 nt, Human
aggaucuuuugaa

SEQ ID NO: 3815365 - RNA, 20 nt, Human
aggaugaaugaggucccagg

SEQ ID NO: 3815366 - RNA, 20 nt, Human
aggaugacgguauuaugcuu

SEQ ID NO: 3815367 - RNA, 15 nt, Human
aggaugagagcccag

SEQ ID NO: 3815368 - RNA, 17 nt, Human
aggaugagagcccagag

SEQ ID NO: 3815369 - RNA, 13 nt, Human
aggaugagcugga

SEQ ID NO: 3815370 - RNA, 21 nt, Human
aggaugaggccgcuagaggcc

SEQ ID NO: 3815371 - RNA, 23 nt, Human
aggaugaggccgcuagaggccug

SEQ ID NO: 3815372 - RNA, 23 nt, Human
aggaugaucuaggaagacuuugg

SEQ ID NO: 3815373 - RNA, 24 nt, Human
aggaugaugccaguuacuugcuuu

SEQ ID NO: 3815374 - RNA, 17 nt, Human
aggaugccccguccccc

SEQ ID NO: 3815375 - RNA, 14 nt, Human
aggaugcucaguug

SEQ ID NO: 3815376 - RNA, 21 nt, Human
aggaugcucaguugcuaaaca

SEQ ID NO: 3815377 - RNA, 13 nt, Human
aggaugcugggug

SEQ ID NO: 3815378 - RNA, 14 nt, Human
aggaugcugggugg

SEQ ID NO: 3815379 - RNA, 18 nt, Human
aggaugcuuguacauaau

SEQ ID NO: 3815380 - RNA, 13 nt, Human
aggauggagagag

SEQ ID NO: 3815381 - RNA, 16 nt, Human
aggauggagagagggg

SEQ ID NO: 3815382 - RNA, 22 nt, Human
aggauggcaggacgugggcugg

SEQ ID NO: 3815383 - RNA, 18 nt, Human
aggauggccagugucugu

SEQ ID NO: 3815384 - RNA, 20 nt, Human
aggauggccagugucugucc

SEQ ID NO: 3815385 - RNA, 17 nt, Human
aggaugggcuucugugc

SEQ ID NO: 3815386 - RNA, 19 nt, Human
aggauggucuuacagcagg

SEQ ID NO: 3815387 - RNA, 15 nt, Human
aggaugguguuacug

SEQ ID NO: 3815388 - RNA, 20 nt, Human
aggauguaaacagugccugc

SEQ ID NO: 3815389 - RNA, 22 nt, Human
aggauguaaacagugccugcug

SEQ ID NO: 3815390 - RNA, 19 nt, Human
aggauguaaagaucaauaa

SEQ ID NO: 3815391 - RNA, 14 nt, Human
aggauguagcuuuu

SEQ ID NO: 3815392 - RNA, 16 nt, Human
aggauguagcuuuuca

SEQ ID NO: 3815393 - RNA, 19 nt, Human
aggauguagcuuuucaccu

SEQ ID NO: 3815394 - RNA, 17 nt, Human
aggaugucacagggcca

SEQ ID NO: 3815395 - RNA, 19 nt, Human
aggaugucacucagaugga

SEQ ID NO: 3815396 - RNA, 21 nt, Human
aggccucuuggaccucugcuc

SEQ ID NO: 3815397 - RNA, 22 nt, Human
aggccucuuggaccucugcucu

SEQ ID NO: 3815398 - RNA, 19 nt, Human
aggccucuuguaaagacug

SEQ ID NO: 3815399 - RNA, 21 nt, Human
aggccugaaagaggcugaggc

SEQ ID NO: 3815400 - RNA, 18 nt, Human
aggccugaaaggagcccu

SEQ ID NO: 3815401 - RNA, 21 nt, Human
aggccugaagccagcugcccu

SEQ ID NO: 3815402 - RNA, 20 nt, Human
aggccugaauccaaaagaaa

SEQ ID NO: 3815403 - RNA, 16 nt, Human
aggccugacucucagc

SEQ ID NO: 3815404 - RNA, 19 nt, Human
aggccugacugccaagcca

SEQ ID NO: 3815405 - RNA, 19 nt, Human
aggccugacuucugcuggc

SEQ ID NO: 3815406 - RNA, 15 nt, Human
aggccugagacccag

SEQ ID NO: 3815407 - RNA, 16 nt, Human
aggccugagacccagg

SEQ ID NO: 3815408 - RNA, 18 nt, Human
aggccugagacccaggac

SEQ ID NO: 3815409 - RNA, 16 nt, Human
aggccugagauuucau

SEQ ID NO: 3815410 - RNA, 20 nt, Human
aggccugagauuucaucugc

SEQ ID NO: 3815411 - RNA, 14 nt, Human
aggccugaggauga

SEQ ID NO: 3815412 - RNA, 13 nt, Human
aggccugcacaca

SEQ ID NO: 3815413 - RNA, 24 nt, Human
aggccugcacacaagcccacagca

SEQ ID NO: 3815414 - RNA, 19 nt, Human
aggccugccuccagggcug

SEQ ID NO: 3815415 - RNA, 18 nt, Human
aggccugccucccacuuc

SEQ ID NO: 3815416 - RNA, 19 nt, Human
aggccugcgacccuggggg

SEQ ID NO: 3815417 - RNA, 12 nt, Human
aggccugcuccc

SEQ ID NO: 3815418 - RNA, 18 nt, Human
aggccuggacuuuccugc

SEQ ID NO: 3815419 - RNA, 19 nt, Human
aggccuggacuuuccugca

SEQ ID NO: 3815420 - RNA, 16 nt, Human
aggccuggcacagugu

SEQ ID NO: 3815421 - RNA, 18 nt, Human
aggccuggcacagugucu

SEQ ID NO: 3815422 - RNA, 12 nt, Human
aggccuggccag

SEQ ID NO: 3815423 - RNA, 17 nt, Human
aggccuggccuuggaga

SEQ ID NO: 3815424 - RNA, 19 nt, Human
aggccugggccgcugccac

SEQ ID NO: 3815425 - RNA, 21 nt, Human
aggccugggccgcugccacgu

SEQ ID NO: 3815426 - RNA, 18 nt, Human
aggccugggggcugggca

SEQ ID NO: 3815427 - RNA, 20 nt, Human
aggccuggggugacccggca

SEQ ID NO: 3815428 - RNA, 21 nt, Human
aggccuggggugacccggcac

SEQ ID NO: 3815429 - RNA, 16 nt, Human
aggccugggucugugu

SEQ ID NO: 3815430 - RNA, 19 nt, Human
aggccugggucugugucuc

SEQ ID NO: 3815431 - RNA, 12 nt, Human
aggccugggugc

SEQ ID NO: 3815432 - RNA, 16 nt, Human
aggccugggugcuggc

SEQ ID NO: 3815433 - RNA, 12 nt, Human
aggccugggugg

SEQ ID NO: 3815434 - RNA, 16 nt, Human
aggccugucccuggcc

SEQ ID NO: 3815435 - RNA, 22 nt, Human
aggccuguccugaccugucuca

SEQ ID NO: 3815436 - RNA, 22 nt, Human
aggccugucugugaccugcauc

SEQ ID NO: 3815437 - RNA, 21 nt, Human
aggccuguguagcugugaccu

SEQ ID NO: 3815438 - RNA, 12 nt, Human
aggccugugugu

SEQ ID NO: 3815439 - RNA, 19 nt, Human
aggccuuaucuccaagacc

SEQ ID NO: 3815440 - RNA, 18 nt, Human
aggccuuaugaggguccu

SEQ ID NO: 3815441 - RNA, 17 nt, Human
aggccuuccccuggcac

SEQ ID NO: 3815442 - RNA, 18 nt, Human
aggccuuccucucuccag

SEQ ID NO: 3815443 - RNA, 15 nt, Human
aggccuugcgcuguu

SEQ ID NO: 3815444 - RNA, 23 nt, Human
aggccuugcggcuccucagggac

SEQ ID NO: 3815445 - RNA, 19 nt, Human
aggccuugggcucugcuga

SEQ ID NO: 3815446 - RNA, 21 nt, Human
aggccuuuagauauuauucau

SEQ ID NO: 3815447 - RNA, 23 nt, Human
aggccuuuaguuauaaaggaauc

SEQ ID NO: 3815448 - RNA, 14 nt, Human
aggccuuucccuaa

SEQ ID NO: 3815449 - RNA, 16 nt, Human
aggccuuuuaacauuu

SEQ ID NO: 3815450 - RNA, 18 nt, Human
aggcgaagcguuguccuc

SEQ ID NO: 3815451 - RNA, 18 nt, Human
aggcgagaagggcugcuu

SEQ ID NO: 3815452 - RNA, 14 nt, Human
aggcgagugccagg

SEQ ID NO: 3815453 - RNA, 17 nt, Human
aggcgagugccaggacu

SEQ ID NO: 3815454 - RNA, 20 nt, Human
aggcgaucacaacgugcauu

SEQ ID NO: 3815455 - RNA, 21 nt, Human
aggcgcacuuuccuccuggca

SEQ ID NO: 3815456 - RNA, 23 nt, Human
aggcgcacuuuccuccuggcaga

SEQ ID NO: 3815457 - RNA, 14 nt, Human
aggcgccggcgggc

SEQ ID NO: 3815458 - RNA, 23 nt, Human
aggcgccucaacucugcugaggg

SEQ ID NO: 3815459 - RNA, 23 nt, Human
aggcgcuaacuugcuuaaaugug

SEQ ID NO: 3815460 - RNA, 15 nt, Human
aggcgcuagcacagc

SEQ ID NO: 3815461 - RNA, 20 nt, Human
aggcggagaguacagugagc

SEQ ID NO: 3815462 - RNA, 23 nt, Human
aggcggcacuccaaccuaaccug

SEQ ID NO: 3815463 - RNA, 20 nt, Human
aggcgggaggaggugugagg

SEQ ID NO: 3815464 - RNA, 13 nt, Human
aggcgggccagcc

SEQ ID NO: 3815465 - RNA, 15 nt, Human
aggcgggccagccag

SEQ ID NO: 3815466 - RNA, 14 nt, Human
aggcggggcuugcc

SEQ ID NO: 3815467 - RNA, 15 nt, Human
aggcggggcuugccu

SEQ ID NO: 3815468 - RNA, 19 nt, Human
aggcggggcuugccuucug

SEQ ID NO: 3815469 - RNA, 10 nt, Human
aggcggugag

SEQ ID NO: 3815470 - RNA, 19 nt, Human
aggcggugcacucacuccu

SEQ ID NO: 3815471 - RNA, 21 nt, Human
aggcggugggcacccacccug

SEQ ID NO: 3815472 - RNA, 17 nt, Human
aggcgucccgcaccugu

SEQ ID NO: 3815473 - RNA, 21 nt, Human
aggcguccgcgcgccagcaca

SEQ ID NO: 3815474 - RNA, 18 nt, Human
aggcgugagccaccaugc

SEQ ID NO: 3815475 - RNA, 17 nt, Human
aggcgugagccaccucg

SEQ ID NO: 3815476 - RNA, 18 nt, Human
aggcgugagccaccucgc

SEQ ID NO: 3815477 - RNA, 17 nt, Human
aggcguggagcugccug

SEQ ID NO: 3815478 - RNA, 18 nt, Human
aggcguucuucgaggugg

SEQ ID NO: 3815479 - RNA, 13 nt, Human
aggcuaaaauguu

SEQ ID NO: 3815480 - RNA, 18 nt, Human
aggcuaaaauguuuucag

SEQ ID NO: 3815481 - RNA, 19 nt, Human
aggcaccagaagaacagua

SEQ ID NO: 3815482 - RNA, 11 nt, Human
aggcaccagga

SEQ ID NO: 3815483 - RNA, 14 nt, Human
aggcaccaggaagc

SEQ ID NO: 3815484 - RNA, 15 nt, Human
aggcaccaggaagcc

SEQ ID NO: 3815485 - RNA, 15 nt, Human
aggcaccagucccug

SEQ ID NO: 3815486 - RNA, 20 nt, Human
aggcacccaccaucaugucu

SEQ ID NO: 3815487 - RNA, 20 nt, Human
aggcacccccuggagagaag

SEQ ID NO: 3815488 - RNA, 20 nt, Human
aggcacccuucuuuccucuu

SEQ ID NO: 3815489 - RNA, 16 nt, Human
aggcaccgagaauguu

SEQ ID NO: 3815490 - RNA, 22 nt, Human
aggcaccucacagaaaugagau

SEQ ID NO: 3815491 - RNA, 14 nt, Human
aggcaccugcauuu

SEQ ID NO: 3815492 - RNA, 19 nt, Human
aggcaccuuaguggcuuuu

SEQ ID NO: 3815493 - RNA, 20 nt, Human
aggcacgaacccaccugcug

SEQ ID NO: 3815494 - RNA, 21 nt, Human
aggcacgaacccaccugcuga

SEQ ID NO: 3815495 - RNA, 19 nt, Human
aggcacucauggguaauaa

SEQ ID NO: 3815496 - RNA, 16 nt, Human
aggcacucuguuauuu

SEQ ID NO: 3815497 - RNA, 19 nt, Human
aggcacucuguuauuuaga

SEQ ID NO: 3815498 - RNA, 20 nt, Human
aggcacucuguuauuuagac

SEQ ID NO: 3815499 - RNA, 22 nt, Human
aggcacugcccugguggcccuc

SEQ ID NO: 3815500 - RNA, 13 nt, Human
aggcacugggcau

SEQ ID NO: 3815501 - RNA, 14 nt, Human
aggcacugggcucc

SEQ ID NO: 3815502 - RNA, 19 nt, Human
aggcacuguaguucuaaga

SEQ ID NO: 3815503 - RNA, 16 nt, Human
aggcacuucugccuga

SEQ ID NO: 3815504 - RNA, 17 nt, Human
aggcacuuggcagccuu

SEQ ID NO: 3815505 - RNA, 22 nt, Human
aggcacuuuggggguuugaggg

SEQ ID NO: 3815506 - RNA, 16 nt, Human
aggcagaaaauugcac

SEQ ID NO: 3815507 - RNA, 13 nt, Human
aggcagaaagagu

SEQ ID NO: 3815508 - RNA, 14 nt, Human
aggcagaaagcaaa

SEQ ID NO: 3815509 - RNA, 19 nt, Human
aggcagaaagcaaaauuau

SEQ ID NO: 3815510 - RNA, 19 nt, Human
aggcagaaagcagaggcug

SEQ ID NO: 3815511 - RNA, 22 nt, Human
aggcagaagaauugaacccagg

SEQ ID NO: 3815512 - RNA, 21 nt, Human
aggcagacacagggacuugaa

SEQ ID NO: 3815513 - RNA, 20 nt, Human
aggcagacacggaucugaga

SEQ ID NO: 3815514 - RNA, 15 nt, Human
aggcagacagcaggc

SEQ ID NO: 3815515 - RNA, 22 nt, Human
aggcagacagcaggcagcgcca

SEQ ID NO: 3815516 - RNA, 20 nt, Human
aggcagacucuuuaugcuug

SEQ ID NO: 3815517 - RNA, 22 nt, Human
aggcagacucuuuaugcuugca

SEQ ID NO: 3815518 - RNA, 22 nt, Human
aggcagacuucccugaauguau

SEQ ID NO: 3815519 - RNA, 13 nt, Human
aggcagagaaaga

SEQ ID NO: 3815520 - RNA, 19 nt, Human
aggcagagaaagaagagac

SEQ ID NO: 3815521 - RNA, 22 nt, Human
aggcagagaaagaagagacagg

SEQ ID NO: 3815522 - RNA, 14 nt, Human
aggcagagaaucau

SEQ ID NO: 3815523 - RNA, 22 nt, Human
aggcagagaaucauacuuagca

SEQ ID NO: 3815524 - RNA, 11 nt, Human
aggcagagagc

SEQ ID NO: 3815525 - RNA, 13 nt, Human
aggcagaggacag

SEQ ID NO: 3815526 - RNA, 18 nt, Human
aggcagagggccuuugcu

SEQ ID NO: 3815527 - RNA, 20 nt, Human
aggcagagguugcagugagc

SEQ ID NO: 3815528 - RNA, 21 nt, Human
aggcagagugccccaccugcc

SEQ ID NO: 3815529 - RNA, 22 nt, Human
aggcagagugccccaccugcca

SEQ ID NO: 3815530 - RNA, 24 nt, Human
aggcagagugccccaccugccacu

SEQ ID NO: 3815531 - RNA, 15 nt, Human
aggcagauccaggac

SEQ ID NO: 3815532 - RNA, 23 nt, Human
aggcagaucugugccccaugccu

SEQ ID NO: 3815533 - RNA, 16 nt, Human
aggcagauucaauuuu

SEQ ID NO: 3815534 - RNA, 16 nt, Human
aggcagauuugagguu

SEQ ID NO: 3815535 - RNA, 20 nt, Human
aggcagauuuuacagagcgc

SEQ ID NO: 3815536 - RNA, 18 nt, Human
aggcagcacgugcacaaa

SEQ ID NO: 3815537 - RNA, 21 nt, Human
aggcagcauguauaguugcuu

SEQ ID NO: 3815538 - RNA, 12 nt, Human
aggcagcauuua

SEQ ID NO: 3815539 - RNA, 20 nt, Human
agaucaaaaaggcuuauaaa

SEQ ID NO: 3815540 - RNA, 16 nt, Human
agaucaaauggaaagg

SEQ ID NO: 3815541 - RNA, 14 nt, Human
agaucaaauuucac

SEQ ID NO: 3815542 - RNA, 14 nt, Human
agaucaaccccuuc

SEQ ID NO: 3815543 - RNA, 14 nt, Human
agaucaauuuguaa

SEQ ID NO: 3815544 - RNA, 21 nt, Human
agaucaccaguguguggcuuu

SEQ ID NO: 3815545 - RNA, 14 nt, Human
agaucacgccacug

SEQ ID NO: 3815546 - RNA, 18 nt, Human
agaucacgccacugcacu

SEQ ID NO: 3815547 - RNA, 16 nt, Human
agaucacgcuccccgc

SEQ ID NO: 3815548 - RNA, 22 nt, Human
agaucacgcuccccgccuguuc

SEQ ID NO: 3815549 - RNA, 15 nt, Human
agaucacuacugcag

SEQ ID NO: 3815550 - RNA, 14 nt, Human
agaucacugccaca

SEQ ID NO: 3815551 - RNA, 16 nt, Human
agaucacuguuuagau

SEQ ID NO: 3815552 - RNA, 17 nt, Human
agaucacuuugcucuga

SEQ ID NO: 3815553 - RNA, 17 nt, Human
agaucagagcagcagug

SEQ ID NO: 3815554 - RNA, 20 nt, Human
agaucagcaaaccggggccu

SEQ ID NO: 3815555 - RNA, 12 nt, Human
agaucagccaga

SEQ ID NO: 3815556 - RNA, 13 nt, Human
agaucaggaagag

SEQ ID NO: 3815557 - RNA, 17 nt, Human
agaucaggaagagaagg

SEQ ID NO: 3815558 - RNA, 13 nt, Human
agaucauaaggcu

SEQ ID NO: 3815559 - RNA, 16 nt, Human
agaucauaaggcuuca

SEQ ID NO: 3815560 - RNA, 17 nt, Human
agaucauaguuuuauuu

SEQ ID NO: 3815561 - RNA, 16 nt, Human
agaucauauacgugaa

SEQ ID NO: 3815562 - RNA, 15 nt, Human
agaucauccuuucca

SEQ ID NO: 3815563 - RNA, 16 nt, Human
agaucauccuuuccag

SEQ ID NO: 3815564 - RNA, 12 nt, Human
agaucaugaaga

SEQ ID NO: 3815565 - RNA, 19 nt, Human
agaucauggaacacaaaca

SEQ ID NO: 3815566 - RNA, 14 nt, Human
agaucauggcaucc

SEQ ID NO: 3815567 - RNA, 16 nt, Human
agaucauucaguguuu

SEQ ID NO: 3815568 - RNA, 12 nt, Human
agaucauuguga

SEQ ID NO: 3815569 - RNA, 23 nt, Human
agauccaaaagaagcccccagcu

SEQ ID NO: 3815570 - RNA, 18 nt, Human
agauccacacacagagga

SEQ ID NO: 3815571 - RNA, 14 nt, Human
agauccaggagcuc

SEQ ID NO: 3815572 - RNA, 16 nt, Human
agauccagggacugaa

SEQ ID NO: 3815573 - RNA, 18 nt, Human
agauccauuuccauugcu

SEQ ID NO: 3815574 - RNA, 22 nt, Human
agaucccaaguagaaucucagu

SEQ ID NO: 3815575 - RNA, 13 nt, Human
agauccuaaaaca

SEQ ID NO: 3815576 - RNA, 23 nt, Human
agauccuaagggucgaaagcucu

SEQ ID NO: 3815577 - RNA, 22 nt, Human
agauccuaccccaauuccuugu

SEQ ID NO: 3815578 - RNA, 18 nt, Human
agauccuagauccuaagg

SEQ ID NO: 3815579 - RNA, 13 nt, Human
agauccucucugg

SEQ ID NO: 3815580 - RNA, 21 nt, Human
agauccugaucuuaagaggcu

SEQ ID NO: 3815581 - RNA, 23 nt, Human
agauccugugaggagccccaucu

SEQ ID NO: 3815582 - RNA, 15 nt, Human
agauccuuguuucaa

SEQ ID NO: 3815583 - RNA, 20 nt, Human
agauccuuguuucaaacaca

SEQ ID NO: 3815584 - RNA, 20 nt, Human
agauccuuuaaauccuucca

SEQ ID NO: 3815585 - RNA, 16 nt, Human
agaucgagaccauccu

SEQ ID NO: 3815586 - RNA, 16 nt, Human
agaucgcaucauugca

SEQ ID NO: 3815587 - RNA, 15 nt, Human
agaucggggccagag

SEQ ID NO: 3815588 - RNA, 19 nt, Human
agaucggggccagaggcag

SEQ ID NO: 3815589 - RNA, 15 nt, Human
agaucgguuaacaaa

SEQ ID NO: 3815590 - RNA, 17 nt, Human
agaucgguuaacaaaua

SEQ ID NO: 3815591 - RNA, 20 nt, Human
agaucuaaaaauaacuguaa

SEQ ID NO: 3815592 - RNA, 19 nt, Human
agaucuaaauaaaaugcua

SEQ ID NO: 3815593 - RNA, 19 nt, Human
agaucuaggugaggauuga

SEQ ID NO: 3815594 - RNA, 14 nt, Human
agaucuccaaagcu

SEQ ID NO: 3815595 - RNA, 21 nt, Human
agaucuccaaagcuuuccugg

SEQ ID NO: 3815596 - RNA, 22 nt, Human
agaucuccaaagcuuuccugga

SEQ ID NO: 3815597 - RNA, 23 nt, Human
agaucugauuuguaacccacuga

SEQ ID NO: 3815598 - RNA, 15 nt, Human
agaucugcaccgccg

SEQ ID NO: 3815599 - RNA, 19 nt, Human
agaucuggaaccucagccu

SEQ ID NO: 3815600 - RNA, 14 nt, Human
agaucuguccucag

SEQ ID NO: 3815601 - RNA, 17 nt, Human
agaucuguccucagccu

SEQ ID NO: 3815602 - RNA, 19 nt, Human
agaucuguccucagccuug

SEQ ID NO: 3815603 - RNA, 18 nt, Human
agaucuguuuugaaggca

SEQ ID NO: 3815604 - RNA, 21 nt, Human
agaucuguuuugaaggcaaaa

SEQ ID NO: 3815605 - RNA, 15 nt, Human
agaucuuagauucuc

SEQ ID NO: 3815606 - RNA, 15 nt, Human
agaucuucugaaaug

SEQ ID NO: 3815607 - RNA, 14 nt, Human
agaucuucuguggg

SEQ ID NO: 3815608 - RNA, 17 nt, Human
agaucuuucagaaauau

SEQ ID NO: 3815609 - RNA, 21 nt, Human
agaucuuucaggaaagacgga

SEQ ID NO: 3815610 - RNA, 19 nt, Human
agaugaaaaagcauguaca

SEQ ID NO: 3815611 - RNA, 17 nt, Human
agaugaaacacaaacaa

SEQ ID NO: 3815612 - RNA, 14 nt, Human
agaugaaagagcag

SEQ ID NO: 3815613 - RNA, 13 nt, Human
agaugaaagagga

SEQ ID NO: 3815614 - RNA, 17 nt, Human
agaugaaagaggagguu

SEQ ID NO: 3815615 - RNA, 22 nt, Human
agaugaaagcagggaauuucua

SEQ ID NO: 3815616 - RNA, 21 nt, Human
agaugaaauaaagacccaggg

SEQ ID NO: 3815617 - RNA, 23 nt, Human
agaugaaaucuuacagcugggug

SEQ ID NO: 3815618 - RNA, 19 nt, Human
agaugaacucugaacuuug

SEQ ID NO: 3815619 - RNA, 22 nt, Human
agaugaacucugaacuuuggag

SEQ ID NO: 3815620 - RNA, 20 nt, Human
agaugaagagugagagggca

SEQ ID NO: 3815621 - RNA, 14 nt, Human
agaugaaggucugu

SEQ ID NO: 3815622 - RNA, 15 nt, Human
agaugaaguuuuaca

SEQ ID NO: 3815623 - RNA, 19 nt, Human
agaugaaguuuuacauugu

SEQ ID NO: 3815624 - RNA, 13 nt, Human
agaugaaucaaug

SEQ ID NO: 3815625 - RNA, 15 nt, Human
agaugacauugcuaa

SEQ ID NO: 3815626 - RNA, 22 nt, Human
agaugacauugcuaagaugcuc

SEQ ID NO: 3815627 - RNA, 14 nt, Human
agaugacugagggu

SEQ ID NO: 3815628 - RNA, 14 nt, Human
agaugacuugaggc

SEQ ID NO: 3815629 - RNA, 16 nt, Human
agaugagaacaaagcu

SEQ ID NO: 3815630 - RNA, 18 nt, Human
agaugagaacaaagcugu

SEQ ID NO: 3815631 - RNA, 21 nt, Human
agaugagaacagauaaagauu

SEQ ID NO: 3815632 - RNA, 14 nt, Human
agaugagcacuucu

SEQ ID NO: 3815633 - RNA, 21 nt, Human
agaugagcccagcccuguucu

SEQ ID NO: 3815634 - RNA, 14 nt, Human
agaugaggccagac

SEQ ID NO: 3815635 - RNA, 22 nt, Human
agaugaggccagaccauggaca

SEQ ID NO: 3815636 - RNA, 21 nt, Human
agaugaguaaaggaguaagaa

SEQ ID NO: 3815637 - RNA, 14 nt, Human
agaugagugagcau

SEQ ID NO: 3815638 - RNA, 16 nt, Human
agaugauaaagagaca

SEQ ID NO: 3815639 - RNA, 18 nt, Human
agaugauaaagagacagu

SEQ ID NO: 3815640 - RNA, 22 nt, Human
agaugaucaguggacagucugc

SEQ ID NO: 3815641 - RNA, 13 nt, Human
agaugauccauga

SEQ ID NO: 3815642 - RNA, 18 nt, Human
agaugaugaaaauauuua

SEQ ID NO: 3815643 - RNA, 19 nt, Human
agaugaugaugaucuuuaa

SEQ ID NO: 3815644 - RNA, 17 nt, Human
agaugaugggggagggg

SEQ ID NO: 3815645 - RNA, 12 nt, Human
agaugauguauu

SEQ ID NO: 3815646 - RNA, 14 nt, Human
agaugauuaaaaug

SEQ ID NO: 3815647 - RNA, 20 nt, Human
agaugauuaaauaagauucu

SEQ ID NO: 3815648 - RNA, 19 nt, Human
agaugauuuaaaagggaag

SEQ ID NO: 3815649 - RNA, 20 nt, Human
agaugauuucaguucuagga

SEQ ID NO: 3815650 - RNA, 23 nt, Human
agaugauuucaguucuaggaaaa

SEQ ID NO: 3815651 - RNA, 20 nt, Human
agaugauuuuuugaaaguua

SEQ ID NO: 3815652 - RNA, 14 nt, Human
agaugcaaagaggc

SEQ ID NO: 3815653 - RNA, 15 nt, Human
agaugcaaagaggca

SEQ ID NO: 3815654 - RNA, 17 nt, Human
agaugcaaggaccagga

SEQ ID NO: 3815655 - RNA, 18 nt, Human
agaugcaaggaccaggac

SEQ ID NO: 3815656 - RNA, 15 nt, Human
agaugcaagucucuu

SEQ ID NO: 3815657 - RNA, 14 nt, Human
agaugcaauuguuu

SEQ ID NO: 3815658 - RNA, 18 nt, Human
agaugcaccaccaagcca

SEQ ID NO: 3815659 - RNA, 15 nt, Human
agaugcacuuugcuu

SEQ ID NO: 3815660 - RNA, 12 nt, Human
agaugcagagag

SEQ ID NO: 3815661 - RNA, 14 nt, Human
agaugcagagagcc

SEQ ID NO: 3815662 - RNA, 14 nt, Human
agaugcagcaaaau

SEQ ID NO: 3815663 - RNA, 16 nt, Human
agaugcagcucuuccu

SEQ ID NO: 3815664 - RNA, 17 nt, Human
agaugcagcucuuccug

SEQ ID NO: 3815665 - RNA, 18 nt, Human
agaugcagcucuuccugg

SEQ ID NO: 3815666 - RNA, 12 nt, Human
agaugcagcugg

SEQ ID NO: 3815667 - RNA, 15 nt, Human
agaugcagcuggaaa

SEQ ID NO: 3815668 - RNA, 16 nt, Human
agaugcagggcaguca

SEQ ID NO: 3815669 - RNA, 15 nt, Human
agaugcaguuuggag

SEQ ID NO: 3815670 - RNA, 22 nt, Human
agaugcauucuugguuggcugg

SEQ ID NO: 3815671 - RNA, 20 nt, Human
agaugcauuuggguccagga

SEQ ID NO: 3815672 - RNA, 22 nt, Human
agaugcauuuggguccaggagg

SEQ ID NO: 3815673 - RNA, 17 nt, Human
agaugccacuucuaaga

SEQ ID NO: 3815674 - RNA, 20 nt, Human
agaugccacuucuaagaaaa

SEQ ID NO: 3815675 - RNA, 16 nt, Human
agaugccaucuguguc

SEQ ID NO: 3815676 - RNA, 22 nt, Human
agaugcccagagggcccaggca

SEQ ID NO: 3815677 - RNA, 12 nt, Human
agaugccccaga

SEQ ID NO: 3815678 - RNA, 16 nt, Human
agaugccgcauuugga

SEQ ID NO: 3815679 - RNA, 17 nt, Human
agaugccuccaccgcug

SEQ ID NO: 3815680 - RNA, 22 nt, Human
agggauggaaaaggaagacuag

SEQ ID NO: 3815681 - RNA, 15 nt, Human
agggauggacaucuu

SEQ ID NO: 3815682 - RNA, 16 nt, Human
agggauggauuccaac

SEQ ID NO: 3815683 - RNA, 17 nt, Human
agggauggauuccaacc

SEQ ID NO: 3815684 - RNA, 14 nt, Human
agggccuggcucag

SEQ ID NO: 3815685 - RNA, 16 nt, Human
agggccugggccuggc

SEQ ID NO: 3815686 - RNA, 20 nt, Human
agggccugggccuggcuccc

SEQ ID NO: 3815687 - RNA, 16 nt, Human
agggccuggggccuga

SEQ ID NO: 3815688 - RNA, 22 nt, Human
agggccuggggccugagagaau

SEQ ID NO: 3815689 - RNA, 21 nt, Human
agggccuggucccugggagga

SEQ ID NO: 3815690 - RNA, 18 nt, Human
agggccugugggagccug

SEQ ID NO: 3815691 - RNA, 23 nt, Human
agggccuuaaaagccaucaugua

SEQ ID NO: 3815692 - RNA, 12 nt, Human
agggccuugcua

SEQ ID NO: 3815693 - RNA, 21 nt, Human
agggccuuggaaauuccugua

SEQ ID NO: 3815694 - RNA, 13 nt, Human
agggcgaggggag

SEQ ID NO: 3815695 - RNA, 14 nt, Human
agggcgcaggccgu

SEQ ID NO: 3815696 - RNA, 13 nt, Human
agggcggcacuca

SEQ ID NO: 3815697 - RNA, 15 nt, Human
agggcggcaggggcc

SEQ ID NO: 3815698 - RNA, 20 nt, Human
agggcgggcagagggcugga

SEQ ID NO: 3815699 - RNA, 13 nt, Human
agggcuaagagcu

SEQ ID NO: 3815700 - RNA, 21 nt, Human
agggcuaagagcuagcgcugc

SEQ ID NO: 3815701 - RNA, 15 nt, Human
agggcuacccugagc

SEQ ID NO: 3815702 - RNA, 17 nt, Human
agggcuacccugagcug

SEQ ID NO: 3815703 - RNA, 18 nt, Human
agggcuacccugagcuga

SEQ ID NO: 3815704 - RNA, 20 nt, Human
agggcuacccugagcugagg

SEQ ID NO: 3815705 - RNA, 21 nt, Human
agggcuacccugagcugaggc

SEQ ID NO: 3815706 - RNA, 21 nt, Human
agggcuacugcagcuuuacau

SEQ ID NO: 3815707 - RNA, 17 nt, Human
agggcuagaaccuagaa

SEQ ID NO: 3815708 - RNA, 19 nt, Human
agggcuagaaccuggagaa

SEQ ID NO: 3815709 - RNA, 20 nt, Human
agggcuagaaccuggagagc

SEQ ID NO: 3815710 - RNA, 22 nt, Human
agggcuagaaccuggagggcug

SEQ ID NO: 3815711 - RNA, 21 nt, Human
agggcuagaaccuggaggggc

SEQ ID NO: 3815712 - RNA, 20 nt, Human
agggcuagaaucuggagagc

SEQ ID NO: 3815713 - RNA, 24 nt, Human
agggcuagugacuugugucccaug

SEQ ID NO: 3815714 - RNA, 19 nt, Human
agggcuauagcucaggacc

SEQ ID NO: 3815715 - RNA, 14 nt, Human
agggcucaacacug

SEQ ID NO: 3815716 - RNA, 24 nt, Human
agggcucaaucucugggggcugag

SEQ ID NO: 3815717 - RNA, 13 nt, Human
agggcucacucag

SEQ ID NO: 3815718 - RNA, 13 nt, Human
agggcucagccug

SEQ ID NO: 3815719 - RNA, 22 nt, Human
agggcucagcggggacagcucc

SEQ ID NO: 3815720 - RNA, 20 nt, Human
agggcuccagacacaugucc

SEQ ID NO: 3815721 - RNA, 22 nt, Human
agggcucccaggggucucccug

SEQ ID NO: 3815722 - RNA, 13 nt, Human
agggcuccuccca

SEQ ID NO: 3815723 - RNA, 15 nt, Human
agggcuccucccagc

SEQ ID NO: 3815724 - RNA, 14 nt, Human
agggcuccugcagg

SEQ ID NO: 3815725 - RNA, 14 nt, Human
agggcuccugccuu

SEQ ID NO: 3815726 - RNA, 12 nt, Human
agggcuccuggg

SEQ ID NO: 3815727 - RNA, 21 nt, Human
agggcuccuugugggccuggg

SEQ ID NO: 3815728 - RNA, 18 nt, Human
agggcucgaggggugggc

SEQ ID NO: 3815729 - RNA, 20 nt, Human
agggcucgaggggugggcug

SEQ ID NO: 3815730 - RNA, 16 nt, Human
agggcucuccuggcuu

SEQ ID NO: 3815731 - RNA, 14 nt, Human
agggcucugaccag

SEQ ID NO: 3815732 - RNA, 13 nt, Human
agggcucugaggc

SEQ ID NO: 3815733 - RNA, 17 nt, Human
agggcucugauauucca

SEQ ID NO: 3815734 - RNA, 15 nt, Human
agggcucuuuagcca

SEQ ID NO: 3815735 - RNA, 16 nt, Human
agggcugagcugggga

SEQ ID NO: 3815736 - RNA, 15 nt, Human
agggcugcaugaugu

SEQ ID NO: 3815737 - RNA, 22 nt, Human
agggcugcaugauguuugccca

SEQ ID NO: 3815738 - RNA, 21 nt, Human
agggcugccccuaaucucugu

SEQ ID NO: 3815739 - RNA, 13 nt, Human
agggcugcccuga

SEQ ID NO: 3815740 - RNA, 21 nt, Human
agggcugcggcguacaggcug

SEQ ID NO: 3815741 - RNA, 23 nt, Human
agggcugcugggggcaacuggcc

SEQ ID NO: 3815742 - RNA, 20 nt, Human
agggcugcuucccugaagcu

SEQ ID NO: 3815743 - RNA, 22 nt, Human
agggcuggaaucuggagagcua

SEQ ID NO: 3815744 - RNA, 13 nt, Human
agggcuggaccua

SEQ ID NO: 3815745 - RNA, 16 nt, Human
agggcuggacugaggc

SEQ ID NO: 3815746 - RNA, 18 nt, Human
agggcuggacugaggccu

SEQ ID NO: 3815747 - RNA, 15 nt, Human
agggcuggaggccca

SEQ ID NO: 3815748 - RNA, 21 nt, Human
agggcuggaggcccaggcugg

SEQ ID NO: 3815749 - RNA, 13 nt, Human
agggcuggcccag

SEQ ID NO: 3815750 - RNA, 20 nt, Human
agggcuggcccagcccugcu

SEQ ID NO: 3815751 - RNA, 23 nt, Human
agggcuggcccagcccugcuggc

SEQ ID NO: 3815752 - RNA, 14 nt, Human
agggcuggccccag

SEQ ID NO: 3815753 - RNA, 19 nt, Human
agggcuggccccagggcac

SEQ ID NO: 3815754 - RNA, 12 nt, Human
agggcugggagg

SEQ ID NO: 3815755 - RNA, 22 nt, Human
agggcugggcaaggaaaaagaa

SEQ ID NO: 3815756 - RNA, 11 nt, Human
agggcugggug

SEQ ID NO: 3815757 - RNA, 18 nt, Human
agggcuguaacugccagg

SEQ ID NO: 3815758 - RNA, 20 nt, Human
agggcugucaucugugcacu

SEQ ID NO: 3815759 - RNA, 22 nt, Human
agggcugugcuugaaggcccug

SEQ ID NO: 3815760 - RNA, 15 nt, Human
agggcuuacggcccu

SEQ ID NO: 3815761 - RNA, 15 nt, Human
agggcuuacuauuuc

SEQ ID NO: 3815762 - RNA, 14 nt, Human
agggcuucugcacc

SEQ ID NO: 3815763 - RNA, 15 nt, Human
agggcuucugcaccc

SEQ ID NO: 3815764 - RNA, 17 nt, Human
agggcuucugcacccuc

SEQ ID NO: 3815765 - RNA, 19 nt, Human
agggcuucugcacccucca

SEQ ID NO: 3815766 - RNA, 22 nt, Human
agggcuucugcacccuccaccc

SEQ ID NO: 3815767 - RNA, 15 nt, Human
agggcuuguaguucu

SEQ ID NO: 3815768 - RNA, 17 nt, Human
agggcuuguaguucuuu

SEQ ID NO: 3815769 - RNA, 19 nt, Human
agggcuuguaguucuuuaa

SEQ ID NO: 3815770 - RNA, 17 nt, Human
agggcuuuaaaauucuc

SEQ ID NO: 3815771 - RNA, 17 nt, Human
aggggaaaaaaauguug

SEQ ID NO: 3815772 - RNA, 13 nt, Human
aggggaaaagagg

SEQ ID NO: 3815773 - RNA, 22 nt, Human
aggggaaaaucagccugcucca

SEQ ID NO: 3815774 - RNA, 20 nt, Human
aggggaaaccaguguagccu

SEQ ID NO: 3815775 - RNA, 21 nt, Human
aggggaaaccaguguagccuu

SEQ ID NO: 3815776 - RNA, 18 nt, Human
aggggaagaguguacugg

SEQ ID NO: 3815777 - RNA, 12 nt, Human
aggggaagcugc

SEQ ID NO: 3815778 - RNA, 13 nt, Human
aggggaagcugca

SEQ ID NO: 3815779 - RNA, 14 nt, Human
aggggaagcugcag

SEQ ID NO: 3815780 - RNA, 21 nt, Human
aggggaauaaacuguugaguc

SEQ ID NO: 3815781 - RNA, 23 nt, Human
aggggaauauuuuauucaaggua

SEQ ID NO: 3815782 - RNA, 20 nt, Human
aggggaaucuggagguagcc

SEQ ID NO: 3815783 - RNA, 17 nt, Human
aggggaaugagggggcu

SEQ ID NO: 3815784 - RNA, 20 nt, Human
aggggaaugagggggcucag

SEQ ID NO: 3815785 - RNA, 16 nt, Human
aggggaauugaggaca

SEQ ID NO: 3815786 - RNA, 22 nt, Human
aggggacaagggauuugaggug

SEQ ID NO: 3815787 - RNA, 18 nt, Human
aggggacaggccucaccu

SEQ ID NO: 3815788 - RNA, 19 nt, Human
aggggacaggccucaccuc

SEQ ID NO: 3815789 - RNA, 12 nt, Human
aggggaccagga

SEQ ID NO: 3815790 - RNA, 18 nt, Human
aggggacccccgcccccu

SEQ ID NO: 3815791 - RNA, 19 nt, Human
aggggacccccgcccccug

SEQ ID NO: 3815792 - RNA, 14 nt, Human
aggggacucagccc

SEQ ID NO: 3815793 - RNA, 22 nt, Human
aggggacucagcccugagguga

SEQ ID NO: 3815794 - RNA, 16 nt, Human
aggggagacagagcaa

SEQ ID NO: 3815795 - RNA, 19 nt, Human
aggggagaccucagaagua

SEQ ID NO: 3815796 - RNA, 21 nt, Human
aggggagaccucagaaguaaa

SEQ ID NO: 3815797 - RNA, 22 nt, Human
aggggagagccugcuggcaccc

SEQ ID NO: 3815798 - RNA, 13 nt, Human
aggggagccagga

SEQ ID NO: 3815799 - RNA, 12 nt, Human
aggggagcccac

SEQ ID NO: 3815800 - RNA, 13 nt, Human
aggggagcccacu

SEQ ID NO: 3815801 - RNA, 17 nt, Human
aggggaggaccucuggg

SEQ ID NO: 3815802 - RNA, 16 nt, Human
aggggaggccaucugg

SEQ ID NO: 3815803 - RNA, 15 nt, Human
aggggaggccuucca

SEQ ID NO: 3815804 - RNA, 17 nt, Human
aggggaggggcuccuuu

SEQ ID NO: 3815805 - RNA, 17 nt, Human
aggggagggggcaaagg

SEQ ID NO: 3815806 - RNA, 18 nt, Human
aggggagggucagccagg

SEQ ID NO: 3815807 - RNA, 16 nt, Human
aggggagucaccuucc

SEQ ID NO: 3815808 - RNA, 17 nt, Human
aggggauauaggagagg

SEQ ID NO: 3815809 - RNA, 19 nt, Human
aggggaucuggaagggcca

SEQ ID NO: 3815810 - RNA, 14 nt, Human
aggggaugggaggu

SEQ ID NO: 3815811 - RNA, 19 nt, Human
aggggauguauccaugggg

SEQ ID NO: 3815812 - RNA, 22 nt, Human
aggggauguauccaugggggca

SEQ ID NO: 3815813 - RNA, 17 nt, Human
aggggaugugugugugc

SEQ ID NO: 3815814 - RNA, 19 nt, Human
aggggcaacgaagaaaaaa

SEQ ID NO: 3815815 - RNA, 15 nt, Human
aggggcacagggucu

SEQ ID NO: 3815816 - RNA, 19 nt, Human
aggggcacuucauugagag

SEQ ID NO: 3815817 - RNA, 16 nt, Human
aggggcagagccagga

SEQ ID NO: 3815818 - RNA, 15 nt, Human
aggggcagaggaggc

SEQ ID NO: 3815819 - RNA, 15 nt, Human
aggggcagauggaaa

SEQ ID NO: 3815820 - RNA, 12 nt, Human
aggggcagcccc

SEQ ID NO: 3815821 - RNA, 16 nt, Human
aggggcagcccuugcu

SEQ ID NO: 3815822 - RNA, 14 nt, Human
aggggcagcuucua

SEQ ID NO: 3815823 - RNA, 12 nt, Human
aggggcaggagc

SEQ ID NO: 3815824 - RNA, 14 nt, Human
aggggcaggcacag

SEQ ID NO: 3815825 - RNA, 23 nt, Human
aggggcagguaaacuccuguccu

SEQ ID NO: 3815826 - RNA, 15 nt, Human
aggggcagucuggag

SEQ ID NO: 3815827 - RNA, 16 nt, Human
aggggcagucuggagg

SEQ ID NO: 3815828 - RNA, 17 nt, Human
aggggcagucuggaggg

SEQ ID NO: 3815829 - RNA, 10 nt, Human
agggaaaagg

SEQ ID NO: 3815830 - RNA, 17 nt, Human
agggaaaaugcagcagg

SEQ ID NO: 3815831 - RNA, 22 nt, Human
agggaaaaugcagcagggaugc

SEQ ID NO: 3815832 - RNA, 18 nt, Human
agggaaaauuauuugcau

SEQ ID NO: 3815833 - RNA, 15 nt, Human
agggaaacuaagauu

SEQ ID NO: 3815834 - RNA, 19 nt, Human
agggaaacuaagauucuuu

SEQ ID NO: 3815835 - RNA, 16 nt, Human
agggaaacuauugucc

SEQ ID NO: 3815836 - RNA, 14 nt, Human
agggaaacugccag

SEQ ID NO: 3815837 - RNA, 19 nt, Human
agggaaacugccagcaacg

SEQ ID NO: 3815838 - RNA, 21 nt, Human
agggaaacugccagcaacgca

SEQ ID NO: 3815839 - RNA, 12 nt, Human
agggaaagacug

SEQ ID NO: 3815840 - RNA, 19 nt, Human
agaugcgcagccccaucug

SEQ ID NO: 3815841 - RNA, 23 nt, Human
agaugcgcagccccaucugugca

SEQ ID NO: 3815842 - RNA, 23 nt, Human
agaugcgcauucuaaccuggagg

SEQ ID NO: 3815843 - RNA, 23 nt, Human
agaugcgucccaagauguugauu

SEQ ID NO: 3815844 - RNA, 22 nt, Human
agaugcuagaacucccuuucaa

SEQ ID NO: 3815845 - RNA, 21 nt, Human
agaugcuagcgcguugccugu

SEQ ID NO: 3815846 - RNA, 15 nt, Human
agaugcucaaaguug

SEQ ID NO: 3815847 - RNA, 15 nt, Human
agaugcuccaagauu

SEQ ID NO: 3815848 - RNA, 20 nt, Human
agaugcuccaagauucuaga

SEQ ID NO: 3815849 - RNA, 22 nt, Human
agaugcuccaagauucuagaug

SEQ ID NO: 3815850 - RNA, 23 nt, Human
agaugcuccaagauucuagauga

SEQ ID NO: 3815851 - RNA, 15 nt, Human
agaugcuccuugggc

SEQ ID NO: 3815852 - RNA, 18 nt, Human
agaugcucuaucuugcuc

SEQ ID NO: 3815853 - RNA, 15 nt, Human
agaugcucuucugug

SEQ ID NO: 3815854 - RNA, 18 nt, Human
agaugcugaaacaggaga

SEQ ID NO: 3815855 - RNA, 20 nt, Human
agaugcugauggagccuucc

SEQ ID NO: 3815856 - RNA, 13 nt, Human
agaugcugauguu

SEQ ID NO: 3815857 - RNA, 19 nt, Human
agaugcugauguucagugu

SEQ ID NO: 3815858 - RNA, 19 nt, Human
agaugcugcagagucacaa

SEQ ID NO: 3815859 - RNA, 13 nt, Human
agaugcuggagaa

SEQ ID NO: 3815860 - RNA, 22 nt, Human
agaugcuggagaagagaggaga

SEQ ID NO: 3815861 - RNA, 16 nt, Human
agaugcuggcccaggg

SEQ ID NO: 3815862 - RNA, 17 nt, Human
agaugcuggcccagggc

SEQ ID NO: 3815863 - RNA, 18 nt, Human
agaugcuggcccagggcc

SEQ ID NO: 3815864 - RNA, 20 nt, Human
agaugcuggcccagggccca

SEQ ID NO: 3815865 - RNA, 21 nt, Human
agaugcuggcccagggcccag

SEQ ID NO: 3815866 - RNA, 22 nt, Human
agaugcuggcccagggcccaga

SEQ ID NO: 3815867 - RNA, 19 nt, Human
agaugcuggcuugggcagc

SEQ ID NO: 3815868 - RNA, 18 nt, Human
agaugcuggguuggugca

SEQ ID NO: 3815869 - RNA, 15 nt, Human
agaugcugugccccu

SEQ ID NO: 3815870 - RNA, 15 nt, Human
agaugcuucucacug

SEQ ID NO: 3815871 - RNA, 16 nt, Human
agaugcuucucacugc

SEQ ID NO: 3815872 - RNA, 17 nt, Human
agaugcuuuucugucuc

SEQ ID NO: 3815873 - RNA, 20 nt, Human
agauggaaccgcaggaagcu

SEQ ID NO: 3815874 - RNA, 22 nt, Human
agauggaaguugcagugagcug

SEQ ID NO: 3815875 - RNA, 18 nt, Human
agauggaaugcuguguua

SEQ ID NO: 3815876 - RNA, 19 nt, Human
agauggaguucuugugcca

SEQ ID NO: 3815877 - RNA, 15 nt, Human
agauggaguuucuaa

SEQ ID NO: 3815878 - RNA, 11 nt, Human
agauggauucu

SEQ ID NO: 3815879 - RNA, 13 nt, Human
agauggauucucc

SEQ ID NO: 3815880 - RNA, 18 nt, Human
agauggauugguguaaaa

SEQ ID NO: 3815881 - RNA, 22 nt, Human
agauggcaagagggugacagcu

SEQ ID NO: 3815882 - RNA, 14 nt, Human
agauggcagcuuuu

SEQ ID NO: 3815883 - RNA, 19 nt, Human
agauggcauccugugaagu

SEQ ID NO: 3815884 - RNA, 19 nt, Human
agauggcccagcuccccaa

SEQ ID NO: 3815885 - RNA, 14 nt, Human
agauggccuuugcu

SEQ ID NO: 3815886 - RNA, 16 nt, Human
agauggcucagagggg

SEQ ID NO: 3815887 - RNA, 21 nt, Human
agauggcucagagggggacug

SEQ ID NO: 3815888 - RNA, 13 nt, Human
agaugggaaugag

SEQ ID NO: 3815889 - RNA, 16 nt, Human
agaugggacaauuaga

SEQ ID NO: 3815890 - RNA, 15 nt, Human
agaugggacugggag

SEQ ID NO: 3815891 - RNA, 22 nt, Human
agaugggaggggaaaggggaga

SEQ ID NO: 3815892 - RNA, 22 nt, Human
agaugggcauaugugucagugg

SEQ ID NO: 3815893 - RNA, 20 nt, Human
agaugggcaucuuuuguauu

SEQ ID NO: 3815894 - RNA, 22 nt, Human
agaugggcuucccaagggcugc

SEQ ID NO: 3815895 - RNA, 19 nt, Human
agaugggcuuguuuucuug

SEQ ID NO: 3815896 - RNA, 14 nt, Human
agauggggccucug

SEQ ID NO: 3815897 - RNA, 18 nt, Human
agaugggggaaagcacag

SEQ ID NO: 3815898 - RNA, 17 nt, Human
agaugggggcaagaaga

SEQ ID NO: 3815899 - RNA, 18 nt, Human
agaugggggcaagaagau

SEQ ID NO: 3815900 - RNA, 16 nt, Human
agaugggggcagggcu

SEQ ID NO: 3815901 - RNA, 17 nt, Human
agaugggggcagggcug

SEQ ID NO: 3815902 - RNA, 16 nt, Human
agauggggucuguaaa

SEQ ID NO: 3815903 - RNA, 22 nt, Human
agaugggugcuuggaggaagga

SEQ ID NO: 3815904 - RNA, 20 nt, Human
agauggugaagcauucuccc

SEQ ID NO: 3815905 - RNA, 17 nt, Human
agauggugcugagaagc

SEQ ID NO: 3815906 - RNA, 16 nt, Human
agaugguuacacuguu

SEQ ID NO: 3815907 - RNA, 14 nt, Human
agaugguugccaag

SEQ ID NO: 3815908 - RNA, 22 nt, Human
agaugguuuuauaaucugauuu

SEQ ID NO: 3815909 - RNA, 14 nt, Human
agauguaauguuuu

SEQ ID NO: 3815910 - RNA, 17 nt, Human
agauguaauguuuucuu

SEQ ID NO: 3815911 - RNA, 13 nt, Human
agauguaauuuug

SEQ ID NO: 3815912 - RNA, 16 nt, Human
agauguaccuggugga

SEQ ID NO: 3815913 - RNA, 22 nt, Human
agauguacuauaacauagaauu

SEQ ID NO: 3815914 - RNA, 19 nt, Human
agauguagaggagaaacug

SEQ ID NO: 3815915 - RNA, 21 nt, Human
agauguagccccucuccugga

SEQ ID NO: 3815916 - RNA, 14 nt, Human
agauguaggaggga

SEQ ID NO: 3815917 - RNA, 16 nt, Human
agauguaggagggacu

SEQ ID NO: 3815918 - RNA, 14 nt, Human
agauguaguauuuu

SEQ ID NO: 3815919 - RNA, 12 nt, Human
agauguauccuu

SEQ ID NO: 3815920 - RNA, 18 nt, Human
agaugucagacuggcugg

SEQ ID NO: 3815921 - RNA, 12 nt, Human
agaugucccuug

SEQ ID NO: 3815922 - RNA, 22 nt, Human
agaugucccuugaugcacagag

SEQ ID NO: 3815923 - RNA, 24 nt, Human
agaugucccuugaugcacagagaa

SEQ ID NO: 3815924 - RNA, 21 nt, Human
agaugucccuuucuuggccag

SEQ ID NO: 3815925 - RNA, 22 nt, Human
agaugucucuggcgugugggua

SEQ ID NO: 3815926 - RNA, 15 nt, Human
agaugucugucucug

SEQ ID NO: 3815927 - RNA, 11 nt, Human
agaugucuguu

SEQ ID NO: 3815928 - RNA, 13 nt, Human
agaugucuucgua

SEQ ID NO: 3815929 - RNA, 20 nt, Human
agaugucuucguacaguucu

SEQ ID NO: 3815930 - RNA, 16 nt, Human
agaugucuucugccug

SEQ ID NO: 3815931 - RNA, 17 nt, Human
agaugucuucugccugu

SEQ ID NO: 3815932 - RNA, 14 nt, Human
agaugucuuggaac

SEQ ID NO: 3815933 - RNA, 18 nt, Human
agaugucuuggaacauug

SEQ ID NO: 3815934 - RNA, 23 nt, Human
agaugucuuuaggcagcagcuuu

SEQ ID NO: 3815935 - RNA, 22 nt, Human
agaugucuuuucccauuuaucu

SEQ ID NO: 3815936 - RNA, 22 nt, Human
agaugugaacacaucagcuugc

SEQ ID NO: 3815937 - RNA, 23 nt, Human
agaugugaauuauugacacugaa

SEQ ID NO: 3815938 - RNA, 20 nt, Human
agaugugauauucuaagacu

SEQ ID NO: 3815939 - RNA, 21 nt, Human
agaugugauuaaagcuaagga

SEQ ID NO: 3815940 - RNA, 12 nt, Human
agaugugauuua

SEQ ID NO: 3815941 - RNA, 16 nt, Human
agaugugcaaaugcaa

SEQ ID NO: 3815942 - RNA, 15 nt, Human
agaugugcacccaug

SEQ ID NO: 3815943 - RNA, 15 nt, Human
agaugugcugacaag

SEQ ID NO: 3815944 - RNA, 14 nt, Human
agaugugcugcuuu

SEQ ID NO: 3815945 - RNA, 16 nt, Human
agaugugcugcuuuga

SEQ ID NO: 3815946 - RNA, 13 nt, Human
agauguggagcca

SEQ ID NO: 3815947 - RNA, 16 nt, Human
agauguguaauuuuuc

SEQ ID NO: 3815948 - RNA, 22 nt, Human
agauguguaucaguguuuaugu

SEQ ID NO: 3815949 - RNA, 17 nt, Human
agaugugucuucaauuu

SEQ ID NO: 3815950 - RNA, 19 nt, Human
agauguguggacuguggca

SEQ ID NO: 3815951 - RNA, 17 nt, Human
agauguguguugauacu

SEQ ID NO: 3815952 - RNA, 21 nt, Human
agauguguguugauacuguug

SEQ ID NO: 3815953 - RNA, 24 nt, Human
agauguguguugauacuguugcac

SEQ ID NO: 3815954 - RNA, 16 nt, Human
agauguguucuuauuu

SEQ ID NO: 3815955 - RNA, 12 nt, Human
agauguuaaaaa

SEQ ID NO: 3815956 - RNA, 15 nt, Human
agauguuaaaauaaa

SEQ ID NO: 3815957 - RNA, 17 nt, Human
agauguuaaaauaaaug

SEQ ID NO: 3815958 - RNA, 18 nt, Human
agauguuaaaauaaaugg

SEQ ID NO: 3815959 - RNA, 15 nt, Human
agauguuagacucau

SEQ ID NO: 3815960 - RNA, 15 nt, Human
agauguuagauauuu

SEQ ID NO: 3815961 - RNA, 17 nt, Human
agauguucagucauuuu

SEQ ID NO: 3815962 - RNA, 20 nt, Human
agauguucuaagucuuucca

SEQ ID NO: 3815963 - RNA, 23 nt, Human
agauguugaauucuuuugccaag

SEQ ID NO: 3815964 - RNA, 14 nt, Human
agauguuuaaaaca

SEQ ID NO: 3815965 - RNA, 18 nt, Human
agauguuuauucuucuag

SEQ ID NO: 3815966 - RNA, 14 nt, Human
agauguuucacacc

SEQ ID NO: 3815967 - RNA, 23 nt, Human
agauguuucacaccggaagguuu

SEQ ID NO: 3815968 - RNA, 14 nt, Human
agauguuucacgaa

SEQ ID NO: 3815969 - RNA, 14 nt, Human
agauguuuccagac

SEQ ID NO: 3815970 - RNA, 23 nt, Human
agauguuuccagacuuccuugag

SEQ ID NO: 3815971 - RNA, 18 nt, Human
agauguuucuuuuguaug

SEQ ID NO: 3815972 - RNA, 21 nt, Human
agauguuucuuuuguauguaa

SEQ ID NO: 3815973 - RNA, 20 nt, Human
agauuucucauuugccaaua

SEQ ID NO: 3815974 - RNA, 14 nt, Human
agauuucugaggaa

SEQ ID NO: 3815975 - RNA, 14 nt, Human
agauuucuguucag

SEQ ID NO: 3815976 - RNA, 19 nt, Human
agauuucuugaguuuuguu

SEQ ID NO: 3815977 - RNA, 17 nt, Human
agauuugaacucuucaa

SEQ ID NO: 3815978 - RNA, 20 nt, Human
agauuugaagacaaaaauac

SEQ ID NO: 3815979 - RNA, 16 nt, Human
agauuugaaggucugc

SEQ ID NO: 3815980 - RNA, 12 nt, Human
agauuugaccua

SEQ ID NO: 3815981 - RNA, 19 nt, Human
agauuugaccuccucccug

SEQ ID NO: 3815982 - RNA, 22 nt, Human
agauuugaccuccucccuguua

SEQ ID NO: 3815983 - RNA, 12 nt, Human
agauuugcacaa

SEQ ID NO: 3815984 - RNA, 14 nt, Human
agauuugcacaaaa

SEQ ID NO: 3815985 - RNA, 17 nt, Human
agauuugcacaaaaaga

SEQ ID NO: 3815986 - RNA, 19 nt, Human
agauuugccauagaguaca

SEQ ID NO: 3815987 - RNA, 21 nt, Human
agauuugccauagaguacacu

SEQ ID NO: 3815988 - RNA, 13 nt, Human
agauuuggaagcu

SEQ ID NO: 3815989 - RNA, 21 nt, Human
agauuuggugaauuugaaucu

SEQ ID NO: 3815990 - RNA, 22 nt, Human
agauuuguaggaaggucucauu

SEQ ID NO: 3815991 - RNA, 23 nt, Human
agauuuguaggaaggucucauuc

SEQ ID NO: 3815992 - RNA, 11 nt, Human
agauuugugaa

SEQ ID NO: 3815993 - RNA, 15 nt, Human
agauuugugaacuca

SEQ ID NO: 3815994 - RNA, 19 nt, Human
agauuugugaacucagcca

SEQ ID NO: 3815995 - RNA, 21 nt, Human
agauuugugaacucagccaag

SEQ ID NO: 3815996 - RNA, 14 nt, Human
agauuuguuuugug

SEQ ID NO: 3815997 - RNA, 15 nt, Human
agauuuguuuuuaaa

SEQ ID NO: 3815998 - RNA, 21 nt, Human
agauuuguuuuuaaacuguac

SEQ ID NO: 3815999 - RNA, 22 nt, Human
agggaaaggcucugaaagccag

SEQ ID NO: 3816000 - RNA, 15 nt, Human
agggaaaggggugcu

SEQ ID NO: 3816001 - RNA, 23 nt, Human
agggaaauagaaaaacccugccc

SEQ ID NO: 3816002 - RNA, 14 nt, Human
agggaaaugaaaga

SEQ ID NO: 3816003 - RNA, 19 nt, Human
agggaacagacaggagaaa

SEQ ID NO: 3816004 - RNA, 20 nt, Human
agggaacagacaggagaaau

SEQ ID NO: 3816005 - RNA, 15 nt, Human
agggaacagggcgga

SEQ ID NO: 3816006 - RNA, 14 nt, Human
agggaacagugagg

SEQ ID NO: 3816007 - RNA, 14 nt, Human
agggaacucugggg

SEQ ID NO: 3816008 - RNA, 13 nt, Human
agggaacugggga

SEQ ID NO: 3816009 - RNA, 15 nt, Human
agggaagaacuauug

SEQ ID NO: 3816010 - RNA, 16 nt, Human
agggaagacauuucuu

SEQ ID NO: 3816011 - RNA, 14 nt, Human
agggaagagaaaca

SEQ ID NO: 3816012 - RNA, 14 nt, Human
agggaagagugcau

SEQ ID NO: 3816013 - RNA, 19 nt, Human
agggaagaguggaggugga

SEQ ID NO: 3816014 - RNA, 19 nt, Human
agggaagauaaguuggaaa

SEQ ID NO: 3816015 - RNA, 21 nt, Human
agggaagauaaguuggaaaca

SEQ ID NO: 3816016 - RNA, 17 nt, Human
agggaagcagcagccuc

SEQ ID NO: 3816017 - RNA, 18 nt, Human
agggaagcagcagccucg

SEQ ID NO: 3816018 - RNA, 13 nt, Human
agggaagcccagc

SEQ ID NO: 3816019 - RNA, 16 nt, Human
agggaagcuacagguu

SEQ ID NO: 3816020 - RNA, 13 nt, Human
agggaagcuggcc

SEQ ID NO: 3816021 - RNA, 18 nt, Human
agggaaggaacucuggcu

SEQ ID NO: 3816022 - RNA, 23 nt, Human
agggaaggaacucuggcuuccag

SEQ ID NO: 3816023 - RNA, 15 nt, Human
agggaaggaucccau

SEQ ID NO: 3816024 - RNA, 16 nt, Human
agggaaggauuuagga

SEQ ID NO: 3816025 - RNA, 14 nt, Human
agggaaggcaggca

SEQ ID NO: 3816026 - RNA, 16 nt, Human
agggaaggccccacag

SEQ ID NO: 3816027 - RNA, 12 nt, Human
agggaaggccug

SEQ ID NO: 3816028 - RNA, 16 nt, Human
agggaagggagccaag

SEQ ID NO: 3816029 - RNA, 13 nt, Human
agggaagggccug

SEQ ID NO: 3816030 - RNA, 22 nt, Human
agggaaggggacaaggacuagg

SEQ ID NO: 3816031 - RNA, 22 nt, Human
agggaaguaacaguaacgcagg

SEQ ID NO: 3816032 - RNA, 19 nt, Human
agggaauccaagccuccac

SEQ ID NO: 3816033 - RNA, 20 nt, Human
agggaauccccgaaggugcu

SEQ ID NO: 3816034 - RNA, 15 nt, Human
agggaauccuccucc

SEQ ID NO: 3816035 - RNA, 16 nt, Human
agggaauccuccucca

SEQ ID NO: 3816036 - RNA, 18 nt, Human
agggaauccuccuccagg

SEQ ID NO: 3816037 - RNA, 15 nt, Human
agggaauggcacagc

SEQ ID NO: 3816038 - RNA, 14 nt, Human
agggacaaaggagc

SEQ ID NO: 3816039 - RNA, 16 nt, Human
agggacaaaggagccu

SEQ ID NO: 3816040 - RNA, 20 nt, Human
agggacaaaggagccuguga

SEQ ID NO: 3816041 - RNA, 21 nt, Human
agggacaaaggagccugugaa

SEQ ID NO: 3816042 - RNA, 14 nt, Human
agggacaccagcca

SEQ ID NO: 3816043 - RNA, 21 nt, Human
agggacaccagccaggcucug

SEQ ID NO: 3816044 - RNA, 14 nt, Human
agggacaccuggga

SEQ ID NO: 3816045 - RNA, 21 nt, Human
agggacaccugggagaaaucu

SEQ ID NO: 3816046 - RNA, 10 nt, Human
agggacagag

SEQ ID NO: 3816047 - RNA, 20 nt, Human
agggacagaggccccagccu

SEQ ID NO: 3816048 - RNA, 23 nt, Human
agggacagaggggguggccuccc

SEQ ID NO: 3816049 - RNA, 20 nt, Human
agggacagcccacugagaag

SEQ ID NO: 3816050 - RNA, 13 nt, Human
agggacaggaccc

SEQ ID NO: 3816051 - RNA, 18 nt, Human
agggacaggaccccagcu

SEQ ID NO: 3816052 - RNA, 21 nt, Human
agggaccaaggaccccucacc

SEQ ID NO: 3816053 - RNA, 17 nt, Human
agggaccaaggcaaggc

SEQ ID NO: 3816054 - RNA, 18 nt, Human
agggaccacacccuguac

SEQ ID NO: 3816055 - RNA, 14 nt, Human
agggaccagccaag

SEQ ID NO: 3816056 - RNA, 13 nt, Human
agggacccagcua

SEQ ID NO: 3816057 - RNA, 17 nt, Human
agggacccuuugggggu

SEQ ID NO: 3816058 - RNA, 22 nt, Human
agggaccggcggaccccagcca

SEQ ID NO: 3816059 - RNA, 16 nt, Human
agggaccuggggaagc

SEQ ID NO: 3816060 - RNA, 15 nt, Human
agggaccuugaaggg

SEQ ID NO: 3816061 - RNA, 21 nt, Human
agggacgaagaagagccacag

SEQ ID NO: 3816062 - RNA, 22 nt, Human
agggacgcggcucccggggcag

SEQ ID NO: 3816063 - RNA, 17 nt, Human
agggacgcuacccggga

SEQ ID NO: 3816064 - RNA, 21 nt, Human
agggacgcuacccgggaaggg

SEQ ID NO: 3816065 - RNA, 20 nt, Human
agggacuaugaaugggcaaa

SEQ ID NO: 3816066 - RNA, 21 nt, Human
agggacucaucuuucccuccu

SEQ ID NO: 3816067 - RNA, 20 nt, Human
agggacucugaagccucugg

SEQ ID NO: 3816068 - RNA, 22 nt, Human
agggacucugaagccucuggga

SEQ ID NO: 3816069 - RNA, 14 nt, Human
agggacugaagcca

SEQ ID NO: 3816070 - RNA, 13 nt, Human
agggacugagaaa

SEQ ID NO: 3816071 - RNA, 15 nt, Human
agggacugccucugc

SEQ ID NO: 3816072 - RNA, 17 nt, Human
agggacugccucugcca

SEQ ID NO: 3816073 - RNA, 18 nt, Human
agggacugccucugccac

SEQ ID NO: 3816074 - RNA, 18 nt, Human
agggacuggaaccaggga

SEQ ID NO: 3816075 - RNA, 20 nt, Human
agggacuguaaacacagaca

SEQ ID NO: 3816076 - RNA, 16 nt, Human
agggacugucgcugcu

SEQ ID NO: 3816077 - RNA, 17 nt, Human
agggacuuaaaaaacuu

SEQ ID NO: 3816078 - RNA, 23 nt, Human
agggacuucugucuucacaacag

SEQ ID NO: 3816079 - RNA, 13 nt, Human
agggagaaauguu

SEQ ID NO: 3816080 - RNA, 15 nt, Human
agggagaagaaguca

SEQ ID NO: 3816081 - RNA, 21 nt, Human
agggagaagacuauauuguac

SEQ ID NO: 3816082 - RNA, 12 nt, Human
agggagacagag

SEQ ID NO: 3816083 - RNA, 19 nt, Human
agggagacccguccauuug

SEQ ID NO: 3816084 - RNA, 22 nt, Human
agggagagagagagagagagga

SEQ ID NO: 3816085 - RNA, 23 nt, Human
agggagagagagagagagaggac

SEQ ID NO: 3816086 - RNA, 13 nt, Human
agggagagcccag

SEQ ID NO: 3816087 - RNA, 18 nt, Human
agggagagcccaggagcu

SEQ ID NO: 3816088 - RNA, 19 nt, Human
agggagagcccaggagcuc

SEQ ID NO: 3816089 - RNA, 21 nt, Human
agggagagcccaggagcuccc

SEQ ID NO: 3816090 - RNA, 13 nt, Human
agggagagggggc

SEQ ID NO: 3816091 - RNA, 16 nt, Human
agggagagguggagca

SEQ ID NO: 3816092 - RNA, 19 nt, Human
agggagagucauauuuuga

SEQ ID NO: 3816093 - RNA, 19 nt, Human
agggagagucucccaggga

SEQ ID NO: 3816094 - RNA, 22 nt, Human
agggagagucucccagggagca

SEQ ID NO: 3816095 - RNA, 22 nt, Human
agggagauauuuaaguauaaaa

SEQ ID NO: 3816096 - RNA, 13 nt, Human
agggagcacuggg

SEQ ID NO: 3816097 - RNA, 20 nt, Human
agggagcagagaaggccagg

SEQ ID NO: 3816098 - RNA, 20 nt, Human
agggagcauagaaggcaggu

SEQ ID NO: 3816099 - RNA, 20 nt, Human
agggagccaagggauggaca

SEQ ID NO: 3816100 - RNA, 21 nt, Human
agggagccaagggauggacau

SEQ ID NO: 3816101 - RNA, 16 nt, Human
agggagccauguuuca

SEQ ID NO: 3816102 - RNA, 15 nt, Human
agggagccauuugag

SEQ ID NO: 3816103 - RNA, 17 nt, Human
agggagccccuuugaug

SEQ ID NO: 3816104 - RNA, 22 nt, Human
agggagcggccggccagccccu

SEQ ID NO: 3816105 - RNA, 16 nt, Human
agggagcuagccagag

SEQ ID NO: 3816106 - RNA, 23 nt, Human
agggagcuagccagaggacugug

SEQ ID NO: 3816107 - RNA, 15 nt, Human
agggagcuggcucca

SEQ ID NO: 3816108 - RNA, 16 nt, Human
agggagcuggcuccag

SEQ ID NO: 3816109 - RNA, 14 nt, Human
agggagcugggccc

SEQ ID NO: 3816110 - RNA, 21 nt, Human
agggaggaagaagcuuaggca

SEQ ID NO: 3816111 - RNA, 21 nt, Human
agggaggaaucgaggaaccag

SEQ ID NO: 3816112 - RNA, 22 nt, Human
agggaggaaucgaggaaccaga

SEQ ID NO: 3816113 - RNA, 23 nt, Human
agggaggacgcucucuggccuuc

SEQ ID NO: 3816114 - RNA, 17 nt, Human
agggaggaggccaccuc

SEQ ID NO: 3816115 - RNA, 19 nt, Human
agggaggaggccaccucuc

SEQ ID NO: 3816116 - RNA, 14 nt, Human
agggaggaguggag

SEQ ID NO: 3816117 - RNA, 10 nt, Human
agggggccac

SEQ ID NO: 3816118 - RNA, 15 nt, Human
agggggccaggugca

SEQ ID NO: 3816119 - RNA, 23 nt, Human
agggggccccuuugcugacccuc

SEQ ID NO: 3816120 - RNA, 17 nt, Human
agggggccuggaugccc

SEQ ID NO: 3816121 - RNA, 19 nt, Human
agggggcugcugcugggcu

SEQ ID NO: 3816122 - RNA, 13 nt, Human
agggggcugggac

SEQ ID NO: 3816123 - RNA, 17 nt, Human
agggggcuggugggugc

SEQ ID NO: 3816124 - RNA, 16 nt, Human
agggggcuugaagcca

SEQ ID NO: 3816125 - RNA, 17 nt, Human
aggggggaagaucaggu

SEQ ID NO: 3816126 - RNA, 23 nt, Human
aggggggcacaugcugagucucc

SEQ ID NO: 3816127 - RNA, 17 nt, Human
aggggggcugccuggcc

SEQ ID NO: 3816128 - RNA, 23 nt, Human
agggggggguauuucaauuaccu

SEQ ID NO: 3816129 - RNA, 13 nt, Human
aggggguaaggcc

SEQ ID NO: 3816130 - RNA, 16 nt, Human
aggggguccacccagc

SEQ ID NO: 3816131 - RNA, 20 nt, Human
agggggucccagugggaggg

SEQ ID NO: 3816132 - RNA, 15 nt, Human
aggggguccguggaa

SEQ ID NO: 3816133 - RNA, 16 nt, Human
agggggucuggcuggu

SEQ ID NO: 3816134 - RNA, 17 nt, Human
agggggucuggcuggug

SEQ ID NO: 3816135 - RNA, 23 nt, Human
agggggugauuagagggaggaga

SEQ ID NO: 3816136 - RNA, 12 nt, Human
aggggguuacaa

SEQ ID NO: 3816137 - RNA, 20 nt, Human
aggggguuugcuggggaacu

SEQ ID NO: 3816138 - RNA, 22 nt, Human
agggguacauuucccugugcug

SEQ ID NO: 3816139 - RNA, 16 nt, Human
agggguaggggcuggg

SEQ ID NO: 3816140 - RNA, 19 nt, Human
agggguaggggcugggaac

SEQ ID NO: 3816141 - RNA, 13 nt, Human
aggggucaggcuc

SEQ ID NO: 3816142 - RNA, 16 nt, Human
aggggucaggcuccau

SEQ ID NO: 3816143 - RNA, 21 nt, Human
aggggucgacuucgggcuggc

SEQ ID NO: 3816144 - RNA, 15 nt, Human
aggggucucccugga

SEQ ID NO: 3816145 - RNA, 16 nt, Human
aggggucucccuggag

SEQ ID NO: 3816146 - RNA, 19 nt, Human
aggggucucccuggagugc

SEQ ID NO: 3816147 - RNA, 16 nt, Human
aggggucucccuggcu

SEQ ID NO: 3816148 - RNA, 18 nt, Human
aggggucucccuggcucc

SEQ ID NO: 3816149 - RNA, 11 nt, Human
aggggugcccc

SEQ ID NO: 3816150 - RNA, 13 nt, Human
aggggugcccccu

SEQ ID NO: 3816151 - RNA, 20 nt, Human
aggggugcccccuccucucc

SEQ ID NO: 3816152 - RNA, 17 nt, Human
agggguggagacugcuu

SEQ ID NO: 3816153 - RNA, 20 nt, Human
agggguggagacugcuuccc

SEQ ID NO: 3816154 - RNA, 13 nt, Human
aggggugguccug

SEQ ID NO: 3816155 - RNA, 15 nt, Human
aggggugguccugac

SEQ ID NO: 3816156 - RNA, 14 nt, Human
aggggugucuuggg

SEQ ID NO: 3816157 - RNA, 22 nt, Human
aggggugucuugggcagagcug

SEQ ID NO: 3816158 - RNA, 15 nt, Human
agggguuagagcagg

SEQ ID NO: 3816159 - RNA, 23 nt, Human
agggguucccuugagggcugcag

SEQ ID NO: 3816160 - RNA, 14 nt, Human
agggguuccucaaa

SEQ ID NO: 3816161 - RNA, 14 nt, Human
agggguuccucccc

SEQ ID NO: 3816162 - RNA, 15 nt, Human
agggguuccuccccu

SEQ ID NO: 3816163 - RNA, 17 nt, Human
agggguuccuccccucc

SEQ ID NO: 3816164 - RNA, 21 nt, Human
agggguuccuccccuccagcu

SEQ ID NO: 3816165 - RNA, 22 nt, Human
agggguuccuccccuccagcuc

SEQ ID NO: 3816166 - RNA, 20 nt, Human
agggguucgagaccagucug

SEQ ID NO: 3816167 - RNA, 18 nt, Human
agggguugcagugagcgg

SEQ ID NO: 3816168 - RNA, 11 nt, Human
agggguuuaca

SEQ ID NO: 3816169 - RNA, 21 nt, Human
agggguuuucgaagcucagcc

SEQ ID NO: 3816170 - RNA, 21 nt, Human
agggguuuucuugauaauuuu

SEQ ID NO: 3816171 - RNA, 15 nt, Human
aggguaaauuauuca

SEQ ID NO: 3816172 - RNA, 18 nt, Human
aggguaacuaacuaaaac

SEQ ID NO: 3816173 - RNA, 22 nt, Human
aggguaauaaacuuagaauaaa

SEQ ID NO: 3816174 - RNA, 14 nt, Human
aggguacagcuggg

SEQ ID NO: 3816175 - RNA, 18 nt, Human
aggguacauggugcuggg

SEQ ID NO: 3816176 - RNA, 18 nt, Human
aggguacauuuauaauug

SEQ ID NO: 3816177 - RNA, 15 nt, Human
aggguacuaaauuua

SEQ ID NO: 3816178 - RNA, 17 nt, Human
aggguacuaaauuuaaa

SEQ ID NO: 3816179 - RNA, 19 nt, Human
aggguacuaaggaaucuuu

SEQ ID NO: 3816180 - RNA, 23 nt, Human
aggguagaauucuggcugguaga

SEQ ID NO: 3816181 - RNA, 23 nt, Human
aggguagcccgccugccaguccu

SEQ ID NO: 3816182 - RNA, 13 nt, Human
aggguaggcagga

SEQ ID NO: 3816183 - RNA, 17 nt, Human
aggguauauuuuccuau

SEQ ID NO: 3816184 - RNA, 19 nt, Human
aggguaucaggugcugcca

SEQ ID NO: 3816185 - RNA, 21 nt, Human
aggguaucaggugcugccauc

SEQ ID NO: 3816186 - RNA, 15 nt, Human
aggguaucuggugac

SEQ ID NO: 3816187 - RNA, 21 nt, Human
aggguaucuggugacuuuccu

SEQ ID NO: 3816188 - RNA, 13 nt, Human
aggguauuccaga

SEQ ID NO: 3816189 - RNA, 14 nt, Human
agggucaaugcuau

SEQ ID NO: 3816190 - RNA, 15 nt, Human
agggucagaaacagg

SEQ ID NO: 3816191 - RNA, 19 nt, Human
agggucagaaacaggaccg

SEQ ID NO: 3816192 - RNA, 21 nt, Human
agggucagacgccugaggaac

SEQ ID NO: 3816193 - RNA, 15 nt, Human
agggucagccagggc

SEQ ID NO: 3816194 - RNA, 23 nt, Human
agggucagccagggccugcgagg

SEQ ID NO: 3816195 - RNA, 22 nt, Human
agggucauaucacucaggcccu

SEQ ID NO: 3816196 - RNA, 18 nt, Human
aggguccagaaggagaca

SEQ ID NO: 3816197 - RNA, 11 nt, Human
aguaacuguuu

SEQ ID NO: 3816198 - RNA, 17 nt, Human
aguaacuguuuuuuaag

SEQ ID NO: 3816199 - RNA, 19 nt, Human
aguaacuucuuauggaauu

SEQ ID NO: 3816200 - RNA, 18 nt, Human
aguaacuugguuauacau

SEQ ID NO: 3816201 - RNA, 19 nt, Human
aguaacuugguuauacaug

SEQ ID NO: 3816202 - RNA, 22 nt, Human
aguaacuugguuauacaugaca

SEQ ID NO: 3816203 - RNA, 15 nt, Human
aguaacuugucuuaa

SEQ ID NO: 3816204 - RNA, 14 nt, Human
aguaacuuuaugug

SEQ ID NO: 3816205 - RNA, 16 nt, Human
aguaagaaaauauuuu

SEQ ID NO: 3816206 - RNA, 20 nt, Human
aguaagaaagugaagcaaau

SEQ ID NO: 3816207 - RNA, 17 nt, Human
aguaagaaauuucaggu

SEQ ID NO: 3816208 - RNA, 14 nt, Human
aguaagaagacaug

SEQ ID NO: 3816209 - RNA, 16 nt, Human
aguaagaccggaagcu

SEQ ID NO: 3816210 - RNA, 11 nt, Human
aguaagagacu

SEQ ID NO: 3816211 - RNA, 19 nt, Human
aguaagagcuggugucuga

SEQ ID NO: 3816212 - RNA, 20 nt, Human
aguaagaucacuguuuagau

SEQ ID NO: 3816213 - RNA, 21 nt, Human
aguaagaucacuguuuagauu

SEQ ID NO: 3816214 - RNA, 20 nt, Human
aguaagccgugauuuucauu

SEQ ID NO: 3816215 - RNA, 21 nt, Human
aguaagcggcucaagcccagg

SEQ ID NO: 3816216 - RNA, 18 nt, Human
aguaaggaaugauauugc

SEQ ID NO: 3816217 - RNA, 23 nt, Human
aguaaggaauuuuauuuuuuucu

SEQ ID NO: 3816218 - RNA, 15 nt, Human
aguaagggaagcaga

SEQ ID NO: 3816219 - RNA, 22 nt, Human
aguaagggcacugacggacuca

SEQ ID NO: 3816220 - RNA, 14 nt, Human
aguaaggugcaguu

SEQ ID NO: 3816221 - RNA, 19 nt, Human
aguaaggugcuuggaguuu

SEQ ID NO: 3816222 - RNA, 19 nt, Human
aguaaguaccacucaggcc

SEQ ID NO: 3816223 - RNA, 19 nt, Human
aguaaguuaauguauauaa

SEQ ID NO: 3816224 - RNA, 13 nt, Human
aguaauaaaacau

SEQ ID NO: 3816225 - RNA, 15 nt, Human
aguaauaaaauucaa

SEQ ID NO: 3816226 - RNA, 16 nt, Human
aguaauaaacuguguu

SEQ ID NO: 3816227 - RNA, 17 nt, Human
aguaauaaacuguguuu

SEQ ID NO: 3816228 - RNA, 16 nt, Human
aguaauaaaugaaugu

SEQ ID NO: 3816229 - RNA, 21 nt, Human
aguaauaccucuaauaguaua

SEQ ID NO: 3816230 - RNA, 22 nt, Human
aguaauaccucuaauaguauaa

SEQ ID NO: 3816231 - RNA, 11 nt, Human
aguaauauaau

SEQ ID NO: 3816232 - RNA, 20 nt, Human
aguaauauaauacacaaaau

SEQ ID NO: 3816233 - RNA, 16 nt, Human
aguaauauauuuaaag

SEQ ID NO: 3816234 - RNA, 13 nt, Human
aguaauauuuauu

SEQ ID NO: 3816235 - RNA, 19 nt, Human
aguaauauuuauuaaauuu

SEQ ID NO: 3816236 - RNA, 22 nt, Human
aguaauauuuauuaaauuuuuu

SEQ ID NO: 3816237 - RNA, 14 nt, Human
aguaauccaccugc

SEQ ID NO: 3816238 - RNA, 19 nt, Human
aguaaucugaucguucuuu

SEQ ID NO: 3816239 - RNA, 23 nt, Human
aguaaucugcauuauuggaauau

SEQ ID NO: 3816240 - RNA, 14 nt, Human
aguaaucuguacau

SEQ ID NO: 3816241 - RNA, 18 nt, Human
aguaaucuguacauuuug

SEQ ID NO: 3816242 - RNA, 21 nt, Human
aguaaucuguacauuuuguug

SEQ ID NO: 3816243 - RNA, 12 nt, Human
aguaaugaauuu

SEQ ID NO: 3816244 - RNA, 20 nt, Human
aguaaugcuacgugugauuu

SEQ ID NO: 3816245 - RNA, 21 nt, Human
aguaaugcuacgugugauuuu

SEQ ID NO: 3816246 - RNA, 21 nt, Human
aguaauggguuucauauuucu

SEQ ID NO: 3816247 - RNA, 18 nt, Human
aguaaugguguagaacac

SEQ ID NO: 3816248 - RNA, 23 nt, Human
aguaaugucauaaagugagaaaa

SEQ ID NO: 3816249 - RNA, 23 nt, Human
aguaauguggaagaaaaugguuu

SEQ ID NO: 3816250 - RNA, 20 nt, Human
aguaauuaucgggaacagug

SEQ ID NO: 3816251 - RNA, 15 nt, Human
aguaauuaugcacua

SEQ ID NO: 3816252 - RNA, 19 nt, Human
aguaauuaugcacuaaaua

SEQ ID NO: 3816253 - RNA, 18 nt, Human
aguaauugcauuugcuuu

SEQ ID NO: 3816254 - RNA, 22 nt, Human
aguaauugcauuugcuuuugua

SEQ ID NO: 3816255 - RNA, 23 nt, Human
aguaauugguuaucaugggaaag

SEQ ID NO: 3816256 - RNA, 21 nt, Human
aguaauuguguuuacauuuua

SEQ ID NO: 3816257 - RNA, 16 nt, Human
aguaauuguuccagag

SEQ ID NO: 3816258 - RNA, 13 nt, Human
aguaauuuauugu

SEQ ID NO: 3816259 - RNA, 22 nt, Human
aguaauuuauuguuuuuccuug

SEQ ID NO: 3816260 - RNA, 23 nt, Human
aguaauuuauuguuuuuccuugu

SEQ ID NO: 3816261 - RNA, 21 nt, Human
agggugucugcccccuccuga

SEQ ID NO: 3816262 - RNA, 15 nt, Human
agggugugcccucac

SEQ ID NO: 3816263 - RNA, 18 nt, Human
aggguguggcccugccau

SEQ ID NO: 3816264 - RNA, 22 nt, Human
aggguguggcccugccaucuuc

SEQ ID NO: 3816265 - RNA, 22 nt, Human
aggguguggggccaugccuccu

SEQ ID NO: 3816266 - RNA, 12 nt, Human
agggugugugcu

SEQ ID NO: 3816267 - RNA, 13 nt, Human
aggguuaagaaaa

SEQ ID NO: 3816268 - RNA, 16 nt, Human
aggguuaaggccugaa

SEQ ID NO: 3816269 - RNA, 13 nt, Human
aggguuagggagg

SEQ ID NO: 3816270 - RNA, 15 nt, Human
aggguuagggagggg

SEQ ID NO: 3816271 - RNA, 17 nt, Human
aggguucccccagcccu

SEQ ID NO: 3816272 - RNA, 19 nt, Human
aggguucccccagcccugu

SEQ ID NO: 3816273 - RNA, 17 nt, Human
aggguucuccucucccc

SEQ ID NO: 3816274 - RNA, 20 nt, Human
aggguucuccucuccccucu

SEQ ID NO: 3816275 - RNA, 15 nt, Human
aggguugauuaaggc

SEQ ID NO: 3816276 - RNA, 15 nt, Human
aggguugcuggagcc

SEQ ID NO: 3816277 - RNA, 14 nt, Human
aggguuggagcagu

SEQ ID NO: 3816278 - RNA, 17 nt, Human
aggguuggcaccuuccc

SEQ ID NO: 3816279 - RNA, 17 nt, Human
aggguugggcugguguc

SEQ ID NO: 3816280 - RNA, 17 nt, Human
aggguuggggaggggcg

SEQ ID NO: 3816281 - RNA, 20 nt, Human
aggguugguccucuugccuc

SEQ ID NO: 3816282 - RNA, 22 nt, Human
aggguuuaauccccaguaaaau

SEQ ID NO: 3816283 - RNA, 22 nt, Human
aggguuucccuacugaagcccu

SEQ ID NO: 3816284 - RNA, 17 nt, Human
aggguuucgagaagcug

SEQ ID NO: 3816285 - RNA, 22 nt, Human
aggguuugagagagcagccagg

SEQ ID NO: 3816286 - RNA, 15 nt, Human
aggguuugugacagg

SEQ ID NO: 3816287 - RNA, 16 nt, Human
aggguuuuaacuuugu

SEQ ID NO: 3816288 - RNA, 16 nt, Human
aggguuuuaauguaga

SEQ ID NO: 3816289 - RNA, 17 nt, Human
aggguuuuaucucuguc

SEQ ID NO: 3816290 - RNA, 18 nt, Human
aggguuuuccacccugga

SEQ ID NO: 3816291 - RNA, 12 nt, Human
agguaaaaaguu

SEQ ID NO: 3816292 - RNA, 13 nt, Human
agguaaaacaaaa

SEQ ID NO: 3816293 - RNA, 17 nt, Human
agguaaaagugugagca

SEQ ID NO: 3816294 - RNA, 14 nt, Human
agguaaaaugccau

SEQ ID NO: 3816295 - RNA, 15 nt, Human
agguaaaaugccaug

SEQ ID NO: 3816296 - RNA, 17 nt, Human
agguaaaauguauuuuu

SEQ ID NO: 3816297 - RNA, 19 nt, Human
agguaaaauguauuuuucu

SEQ ID NO: 3816298 - RNA, 13 nt, Human
agguaaaauucua

SEQ ID NO: 3816299 - RNA, 16 nt, Human
agguaaaauucuaaau

SEQ ID NO: 3816300 - RNA, 13 nt, Human
agguaaacaguuc

SEQ ID NO: 3816301 - RNA, 19 nt, Human
agguaaagggcaaauaaug

SEQ ID NO: 3816302 - RNA, 18 nt, Human
agguaaaucagacuauga

SEQ ID NO: 3816303 - RNA, 15 nt, Human
agguaacagaacagc

SEQ ID NO: 3816304 - RNA, 22 nt, Human
agguaacagaacagcuucaggu

SEQ ID NO: 3816305 - RNA, 16 nt, Human
agguaacaggcagaua

SEQ ID NO: 3816306 - RNA, 18 nt, Human
agguaacuaacugcauac

SEQ ID NO: 3816307 - RNA, 22 nt, Human
agguaagaaguuuuaaaaagcc

SEQ ID NO: 3816308 - RNA, 18 nt, Human
agguaauauaaaaagcuu

SEQ ID NO: 3816309 - RNA, 21 nt, Human
agguaauccaagauauuuuaa

SEQ ID NO: 3816310 - RNA, 18 nt, Human
agguaaucgaccugccuc

SEQ ID NO: 3816311 - RNA, 17 nt, Human
agguaaugagggacugg

SEQ ID NO: 3816312 - RNA, 16 nt, Human
agguaaugugaauaaa

SEQ ID NO: 3816313 - RNA, 16 nt, Human
agguaauuucuugugc

SEQ ID NO: 3816314 - RNA, 16 nt, Human
agguacacagcucuag

SEQ ID NO: 3816315 - RNA, 17 nt, Human
agguacacuugugaaua

SEQ ID NO: 3816316 - RNA, 11 nt, Human
agguacagggu

SEQ ID NO: 3816317 - RNA, 19 nt, Human
agguacaggguuuuuaccu

SEQ ID NO: 3816318 - RNA, 13 nt, Human
agguaccagcugc

SEQ ID NO: 3816319 - RNA, 12 nt, Human
agguacccuggg

SEQ ID NO: 3816320 - RNA, 13 nt, Human
agguacccugggu

SEQ ID NO: 3816321 - RNA, 20 nt, Human
agguacccuggguguccccg

SEQ ID NO: 3816322 - RNA, 21 nt, Human
agguaccuugaccuuuguaca

SEQ ID NO: 3816323 - RNA, 13 nt, Human
agguacucuccug

SEQ ID NO: 3816324 - RNA, 23 nt, Human
agguacuucaaauccuugaagau

SEQ ID NO: 3816325 - RNA, 11 nt, Human
agguacuuuug

SEQ ID NO: 3816326 - RNA, 16 nt, Human
agguacuuuuggaauc

SEQ ID NO: 3816327 - RNA, 17 nt, Human
agguacuuuuggaaucu

SEQ ID NO: 3816328 - RNA, 14 nt, Human
agguagaaaaaggg

SEQ ID NO: 3816329 - RNA, 16 nt, Human
agguagaaaaaggguc

SEQ ID NO: 3816330 - RNA, 18 nt, Human
agguagaaaaagggucaa

SEQ ID NO: 3816331 - RNA, 12 nt, Human
agguagaaacuu

SEQ ID NO: 3816332 - RNA, 15 nt, Human
agguagaacgccagg

SEQ ID NO: 3816333 - RNA, 17 nt, Human
agguagaaugaccuugu

SEQ ID NO: 3816334 - RNA, 18 nt, Human
agguagaaugaccuugua

SEQ ID NO: 3816335 - RNA, 14 nt, Human
agguagaauguaaa

SEQ ID NO: 3816336 - RNA, 21 nt, Human
agguagaguuugaaggaggug

SEQ ID NO: 3816337 - RNA, 23 nt, Human
agguagaguuugaaggaggugag

SEQ ID NO: 3816338 - RNA, 18 nt, Human
agguagcccccucuuccc

SEQ ID NO: 3816339 - RNA, 23 nt, Human
agguagcugcagauaaguggccu

SEQ ID NO: 3816340 - RNA, 14 nt, Human
agguagcugccccu

SEQ ID NO: 3816341 - RNA, 23 nt, Human
agguagcuuugagguggaagagg

SEQ ID NO: 3816342 - RNA, 20 nt, Human
agguaggaauauuauauuug

SEQ ID NO: 3816343 - RNA, 19 nt, Human
agguaggagaauugcuuga

SEQ ID NO: 3816344 - RNA, 17 nt, Human
agguaguucaagaaaug

SEQ ID NO: 3816345 - RNA, 19 nt, Human
agguaguucaagaaaugaa

SEQ ID NO: 3816346 - RNA, 19 nt, Human
agguauaaguggugugugu

SEQ ID NO: 3816347 - RNA, 20 nt, Human
agguauaaguggugugugua

SEQ ID NO: 3816348 - RNA, 15 nt, Human
agguauaauugugug

SEQ ID NO: 3816349 - RNA, 19 nt, Human
agguauaucauucuaaaga

SEQ ID NO: 3816350 - RNA, 19 nt, Human
agguauaucuagguuuaug

SEQ ID NO: 3816351 - RNA, 21 nt, Human
agguaucauuuucugcauuua

SEQ ID NO: 3816352 - RNA, 13 nt, Human
agguaucuccagg

SEQ ID NO: 3816353 - RNA, 13 nt, Human
agguaugaauaag

SEQ ID NO: 3816354 - RNA, 23 nt, Human
agguaugaccuucuaggaagcuc

SEQ ID NO: 3816355 - RNA, 22 nt, Human
agguauggaaggguuuguggcu

SEQ ID NO: 3816356 - RNA, 19 nt, Human
aguagaacagauaaucagu

SEQ ID NO: 3816357 - RNA, 18 nt, Human
aguagaacuuuguauagu

SEQ ID NO: 3816358 - RNA, 21 nt, Human
aguagaacuuuguauaguuau

SEQ ID NO: 3816359 - RNA, 16 nt, Human
aguagaaggucggagg

SEQ ID NO: 3816360 - RNA, 19 nt, Human
aguagaagucucuuccagu

SEQ ID NO: 3816361 - RNA, 14 nt, Human
aguagaaucucagu

SEQ ID NO: 3816362 - RNA, 21 nt, Human
aguagaaucucaguugauuuu

SEQ ID NO: 3816363 - RNA, 13 nt, Human
aguagaauguagu

SEQ ID NO: 3816364 - RNA, 22 nt, Human
aguagacauuuuaacaagaaga

SEQ ID NO: 3816365 - RNA, 13 nt, Human
aguagaccccugg

SEQ ID NO: 3816366 - RNA, 15 nt, Human
aguagacuacuguuc

SEQ ID NO: 3816367 - RNA, 13 nt, Human
aguagagacaggg

SEQ ID NO: 3816368 - RNA, 12 nt, Human
aguagagccagc

SEQ ID NO: 3816369 - RNA, 14 nt, Human
aguagagguacacu

SEQ ID NO: 3816370 - RNA, 21 nt, Human
aguagagguacacuugugaau

SEQ ID NO: 3816371 - RNA, 22 nt, Human
aguagagguacacuugugaaua

SEQ ID NO: 3816372 - RNA, 17 nt, Human
aguagagguauaauugu

SEQ ID NO: 3816373 - RNA, 14 nt, Human
aguagagucaucuc

SEQ ID NO: 3816374 - RNA, 23 nt, Human
aguagagucaucuccaucagcug

SEQ ID NO: 3816375 - RNA, 14 nt, Human
aguagauaagcaga

SEQ ID NO: 3816376 - RNA, 18 nt, Human
aguagauaauuucagggu

SEQ ID NO: 3816377 - RNA, 19 nt, Human
aguagauaauuucagggug

SEQ ID NO: 3816378 - RNA, 15 nt, Human
aguagauauuacuuu

SEQ ID NO: 3816379 - RNA, 17 nt, Human
aguagauauuacuuuau

SEQ ID NO: 3816380 - RNA, 15 nt, Human
aguagaucuauauua

SEQ ID NO: 3816381 - RNA, 16 nt, Human
aguagauggugaaauu

SEQ ID NO: 3816382 - RNA, 21 nt, Human
aguagauggugaaauuuauua

SEQ ID NO: 3816383 - RNA, 18 nt, Human
aguagauguggccuuuga

SEQ ID NO: 3816384 - RNA, 17 nt, Human
aguagauuaaaaauuau

SEQ ID NO: 3816385 - RNA, 18 nt, Human
aguagauuaaaaauuaua

SEQ ID NO: 3816386 - RNA, 19 nt, Human
aguagauuaaaaauuauag

SEQ ID NO: 3816387 - RNA, 13 nt, Human
aguagauuucaug

SEQ ID NO: 3816388 - RNA, 20 nt, Human
aguagcaaaugagacagcag

SEQ ID NO: 3816389 - RNA, 16 nt, Human
aguagcaaguucuaga

SEQ ID NO: 3816390 - RNA, 14 nt, Human
aguagcagugauug

SEQ ID NO: 3816391 - RNA, 22 nt, Human
aguagcauuuacugugucuuug

SEQ ID NO: 3816392 - RNA, 23 nt, Human
aguagccccaacccaaaccugga

SEQ ID NO: 3816393 - RNA, 16 nt, Human
aguagccgagagccug

SEQ ID NO: 3816394 - RNA, 22 nt, Human
aguagccucuccuguauuuaac

SEQ ID NO: 3816395 - RNA, 21 nt, Human
aguagcgcuauaguuacuguc

SEQ ID NO: 3816396 - RNA, 19 nt, Human
aguagcguuuuuuaaaugu

SEQ ID NO: 3816397 - RNA, 22 nt, Human
aguagcguuuuuuaaauguaua

SEQ ID NO: 3816398 - RNA, 14 nt, Human
aguagcucugccuu

SEQ ID NO: 3816399 - RNA, 13 nt, Human
aguagcugagcuc

SEQ ID NO: 3816400 - RNA, 17 nt, Human
aguagcuggauuacagg

SEQ ID NO: 3816401 - RNA, 13 nt, Human
aguagcugggacu

SEQ ID NO: 3816402 - RNA, 22 nt, Human
aguagcugggacuacaggcacc

SEQ ID NO: 3816403 - RNA, 18 nt, Human
aguagcugggauuuuaaa

SEQ ID NO: 3816404 - RNA, 21 nt, Human
aguagcugggauuuuaaacua

SEQ ID NO: 3816405 - RNA, 22 nt, Human
aguagcugggauuuuaaacuag

SEQ ID NO: 3816406 - RNA, 14 nt, Human
aguagaauugcauu

SEQ ID NO: 3816407 - RNA, 15 nt, Human
aguagaauugcauug

SEQ ID NO: 3816408 - RNA, 19 nt, Human
aguagacaaucauuguuuu

SEQ ID NO: 3816409 - RNA, 18 nt, Human
aguagacacauuuaagga

SEQ ID NO: 3816410 - RNA, 23 nt, Human
aguagacauuuuaacaagaagau

SEQ ID NO: 3816411 - RNA, 20 nt, Human
aguagaccuuguuacuucug

SEQ ID NO: 3816412 - RNA, 23 nt, Human
aguagaccuuguuacuucugagg

SEQ ID NO: 3816413 - RNA, 14 nt, Human
aguagacuccaaca

SEQ ID NO: 3816414 - RNA, 19 nt, Human
aguagagauggggaaagaa

SEQ ID NO: 3816415 - RNA, 15 nt, Human
aguagagccagcuug

SEQ ID NO: 3816416 - RNA, 20 nt, Human
aguagagguacacuugugaa

SEQ ID NO: 3816417 - RNA, 19 nt, Human
aguagauaggccaugggca

SEQ ID NO: 3816418 - RNA, 23 nt, Human
aguagaucuauauuagaucaaau

SEQ ID NO: 3816419 - RNA, 21 nt, Human
aguagaugcauuuggguccag

SEQ ID NO: 3816420 - RNA, 21 nt, Human
aguagaugcgcagccccaucu

SEQ ID NO: 3816421 - RNA, 17 nt, Human
aguagauggugaaauuu

SEQ ID NO: 3816422 - RNA, 18 nt, Human
aguagauuagaucuuuua

SEQ ID NO: 3816423 - RNA, 15 nt, Human
aguagauuuuccaaa

SEQ ID NO: 3816424 - RNA, 13 nt, Human
aguagauuuucuu

SEQ ID NO: 3816425 - RNA, 21 nt, Human
aguagauuuucuuuaaaagaa

SEQ ID NO: 3816426 - RNA, 20 nt, Human
aguagcaaguucuagagaag

SEQ ID NO: 3816427 - RNA, 23 nt, Human
aguagcacaaguuauuuaaaucu

SEQ ID NO: 3816428 - RNA, 15 nt, Human
aguagcacaggcuga

SEQ ID NO: 3816429 - RNA, 16 nt, Human
aguagcacaggcugag

SEQ ID NO: 3816430 - RNA, 14 nt, Human
aguagcauuuacug

SEQ ID NO: 3816431 - RNA, 13 nt, Human
aguagcauuucau

SEQ ID NO: 3816432 - RNA, 22 nt, Human
aguagccaggguguggcccugc

SEQ ID NO: 3816433 - RNA, 22 nt, Human
aguagccccaacccaaaccugg

SEQ ID NO: 3816434 - RNA, 16 nt, Human
aguagcccuuucugug

SEQ ID NO: 3816435 - RNA, 19 nt, Human
aguagccgagagccugcuc

SEQ ID NO: 3816436 - RNA, 19 nt, Human
aguagcgguaccaaugcag

SEQ ID NO: 3816437 - RNA, 18 nt, Human
aguagcguuuuuuaaaug

SEQ ID NO: 3816438 - RNA, 22 nt, Human
aguagcucugccuuugcucugg

SEQ ID NO: 3816439 - RNA, 16 nt, Human
aguagcugaaaugcaa

SEQ ID NO: 3816440 - RNA, 11 nt, Human
aguagcugagc

SEQ ID NO: 3816441 - RNA, 23 nt, Human
aguagcugagcucacaaggcagc

SEQ ID NO: 3816442 - RNA, 14 nt, Human
aguagcugggacua

SEQ ID NO: 3816443 - RNA, 16 nt, Human
aguagcuugcucccug

SEQ ID NO: 3816444 - RNA, 23 nt, Human
aguagcuugcucccuguguccac

SEQ ID NO: 3816445 - RNA, 15 nt, Human
aguaggcaagauggc

SEQ ID NO: 3816446 - RNA, 22 nt, Human
aguaggcauuuuuaccaucacu

SEQ ID NO: 3816447 - RNA, 23 nt, Human
aguaggggaggagcacaguuugu

SEQ ID NO: 3816448 - RNA, 20 nt, Human
aguagggguaccacugaauc

SEQ ID NO: 3816449 - RNA, 18 nt, Human
aguaguaccaaaugcuuu

SEQ ID NO: 3816450 - RNA, 23 nt, Human
aguaguacuucuucuguaauauu

SEQ ID NO: 3816451 - RNA, 13 nt, Human
aguagucagacug

SEQ ID NO: 3816452 - RNA, 21 nt, Human
aguagucccugcacagugacu

SEQ ID NO: 3816453 - RNA, 14 nt, Human
aguaguccugugaa

SEQ ID NO: 3816454 - RNA, 21 nt, Human
aguagucucugugaggccuua

SEQ ID NO: 3816455 - RNA, 18 nt, Human
aguagugaagacuccaga

SEQ ID NO: 3816456 - RNA, 18 nt, Human
aguagugccuuuacuuca

SEQ ID NO: 3816457 - RNA, 17 nt, Human
aguaguguuacauguau

SEQ ID NO: 3816458 - RNA, 23 nt, Human
aguaguuaaaaaaaaaaaaagga

SEQ ID NO: 3816459 - RNA, 14 nt, Human
aguaguuaauucug

SEQ ID NO: 3816460 - RNA, 18 nt, Human
aguaguuauauaauuguu

SEQ ID NO: 3816461 - RNA, 17 nt, Human
aguaguuaucauguuag

SEQ ID NO: 3816462 - RNA, 13 nt, Human
aguaguucuguau

SEQ ID NO: 3816463 - RNA, 21 nt, Human
aguaguucuguauuugaaagu

SEQ ID NO: 3816464 - RNA, 17 nt, Human
aguaguuuguauaacuu

SEQ ID NO: 3816465 - RNA, 21 nt, Human
aguaguuuuuacagcuguguu

SEQ ID NO: 3816466 - RNA, 18 nt, Human
aguauaaaugguugucug

SEQ ID NO: 3816467 - RNA, 17 nt, Human
aguauaaauuuguguaa

SEQ ID NO: 3816468 - RNA, 18 nt, Human
aguauaauguuuauuaaa

SEQ ID NO: 3816469 - RNA, 15 nt, Human
aguauacaaacauuu

SEQ ID NO: 3816470 - RNA, 15 nt, Human
aguauacaagauaag

SEQ ID NO: 3816471 - RNA, 16 nt, Human
aguauacaauauauaa

SEQ ID NO: 3816472 - RNA, 19 nt, Human
aguauacaauauauaaaaa

SEQ ID NO: 3816473 - RNA, 15 nt, Human
aguauaccugauuuu

SEQ ID NO: 3816474 - RNA, 16 nt, Human
aguauagagagaaguu

SEQ ID NO: 3816475 - RNA, 17 nt, Human
aguauaucauguaaaga

SEQ ID NO: 3816476 - RNA, 15 nt, Human
aguauaucucaguuu

SEQ ID NO: 3816477 - RNA, 16 nt, Human
aguauaucuggacaag

SEQ ID NO: 3816478 - RNA, 17 nt, Human
aguauauuaaaaauggu

SEQ ID NO: 3816479 - RNA, 19 nt, Human
aguauauuaaaaaugguaa

SEQ ID NO: 3816480 - RNA, 21 nt, Human
aguauauugauaaccuugaaa

SEQ ID NO: 3816481 - RNA, 22 nt, Human
aguauauugauccagaaagaaa

SEQ ID NO: 3816482 - RNA, 14 nt, Human
aguauauuguugaa

SEQ ID NO: 3816483 - RNA, 20 nt, Human
aguauauuguugaagagaca

SEQ ID NO: 3816484 - RNA, 15 nt, Human
aguauauuuaaacuc

SEQ ID NO: 3816485 - RNA, 11 nt, Human
aguauauuuau

SEQ ID NO: 3816486 - RNA, 16 nt, Human
aguauauuuauauaau

SEQ ID NO: 3816487 - RNA, 20 nt, Human
aguauauuuauauaauuaug

SEQ ID NO: 3816488 - RNA, 22 nt, Human
aguauauuucuucguucuuuuu

SEQ ID NO: 3816489 - RNA, 13 nt, Human
aguauauuuucuu

SEQ ID NO: 3816490 - RNA, 18 nt, Human
aguauauuuucuuuuccu

SEQ ID NO: 3816491 - RNA, 19 nt, Human
aguauauuuucuuuuccuc

SEQ ID NO: 3816492 - RNA, 15 nt, Human
aguaucaaauauuag

SEQ ID NO: 3816493 - RNA, 21 nt, Human
aguaucaaauauuagauguga

SEQ ID NO: 3816494 - RNA, 22 nt, Human
aguaucaaauauuagaugugau

SEQ ID NO: 3816495 - RNA, 17 nt, Human
aguaucacugucuuucc

SEQ ID NO: 3816496 - RNA, 15 nt, Human
aguaucaggucuccc

SEQ ID NO: 3816497 - RNA, 13 nt, Human
aguaucaguguuu

SEQ ID NO: 3816498 - RNA, 18 nt, Human
aguaucaguguuuuaaau

SEQ ID NO: 3816499 - RNA, 22 nt, Human
aguaucaguguuuuaaauucug

SEQ ID NO: 3816500 - RNA, 12 nt, Human
aguaucccacau

SEQ ID NO: 3816501 - RNA, 14 nt, Human
aguauccuccaggu

SEQ ID NO: 3816502 - RNA, 16 nt, Human
aguaucggcacuguac

SEQ ID NO: 3816503 - RNA, 17 nt, Human
aguaucuauauaugugu

SEQ ID NO: 3816504 - RNA, 18 nt, Human
aguaucuauauaugugua

SEQ ID NO: 3816505 - RNA, 22 nt, Human
aguaucuauauauguguaugua

SEQ ID NO: 3816506 - RNA, 10 nt, Human
aguaucucau

SEQ ID NO: 3816507 - RNA, 21 nt, Human
aguaucucaucaacaaagaaa

SEQ ID NO: 3816508 - RNA, 18 nt, Human
aguaucuguaucucucuc

SEQ ID NO: 3816509 - RNA, 14 nt, Human
aguaucugugaacu

SEQ ID NO: 3816510 - RNA, 11 nt, Human
aguaucuugaa

SEQ ID NO: 3816511 - RNA, 16 nt, Human
aguaugaaauuauaua

SEQ ID NO: 3816512 - RNA, 16 nt, Human
aguaugaauaaagaca

SEQ ID NO: 3816513 - RNA, 18 nt, Human
aguaugaaucuaugccaa

SEQ ID NO: 3816514 - RNA, 22 nt, Human
aguaugacgcugauacauaacu

SEQ ID NO: 3816515 - RNA, 21 nt, Human
aguaugaggcauuuguuugaa

SEQ ID NO: 3816516 - RNA, 18 nt, Human
aguaugcacuauauacau

SEQ ID NO: 3816517 - RNA, 19 nt, Human
aguauggagcucagagagg

SEQ ID NO: 3816518 - RNA, 15 nt, Human
aguauggaugggugg

SEQ ID NO: 3816519 - RNA, 17 nt, Human
aguaugggacuggccuc

SEQ ID NO: 3816520 - RNA, 19 nt, Human
aguaugguacauuuuucaa

SEQ ID NO: 3816521 - RNA, 22 nt, Human
aguauggugagagaagccugug

SEQ ID NO: 3816522 - RNA, 14 nt, Human
aguaugguggcugg

SEQ ID NO: 3816523 - RNA, 16 nt, Human
aguauguaaaguaugu

SEQ ID NO: 3816524 - RNA, 21 nt, Human
aguauguaaaguauguaaaca

SEQ ID NO: 3816525 - RNA, 18 nt, Human
aguauguauauuaaaaaa

SEQ ID NO: 3816526 - RNA, 20 nt, Human
aguauguauauuaaaaaaga

SEQ ID NO: 3816527 - RNA, 22 nt, Human
aguauguauauuaaaaaagaga

SEQ ID NO: 3816528 - RNA, 23 nt, Human
aguauguauauuaaaaaagagac

SEQ ID NO: 3816529 - RNA, 13 nt, Human
aguauguauuauu

SEQ ID NO: 3816530 - RNA, 21 nt, Human
aguaugugccaggaaacucuu

SEQ ID NO: 3816531 - RNA, 15 nt, Human
aguauguggaagugu

SEQ ID NO: 3816532 - RNA, 21 nt, Human
aguaugugguuuuguaauuug

SEQ ID NO: 3816533 - RNA, 18 nt, Human
aguauguguuugugugug

SEQ ID NO: 3816534 - RNA, 19 nt, Human
aguauguguuugugugugu

SEQ ID NO: 3816535 - RNA, 19 nt, Human
aguauguuaagcucuuuau

SEQ ID NO: 3816536 - RNA, 18 nt, Human
aguauguuagugcaaauu

SEQ ID NO: 3816537 - RNA, 21 nt, Human
aguauguuagugcaaauuguc

SEQ ID NO: 3816538 - RNA, 14 nt, Human
aguauguugucaaa

SEQ ID NO: 3816539 - RNA, 15 nt, Human
aguauguugucaaag

SEQ ID NO: 3816540 - RNA, 18 nt, Human
aguauguugucaaagaga

SEQ ID NO: 3816541 - RNA, 14 nt, Human
aguauguuuuacac

SEQ ID NO: 3816542 - RNA, 19 nt, Human
aguauguuuuagcaugugu

SEQ ID NO: 3816543 - RNA, 12 nt, Human
aguauuaagcau

SEQ ID NO: 3816544 - RNA, 14 nt, Human
aguauuaagcauau

SEQ ID NO: 3816545 - RNA, 15 nt, Human
aguauuacuucugcu

SEQ ID NO: 3816546 - RNA, 18 nt, Human
aguauuacuucugcuaca

SEQ ID NO: 3816547 - RNA, 13 nt, Human
aguauuauaaaca

SEQ ID NO: 3816548 - RNA, 19 nt, Human
aguauuauaaauuauguuu

SEQ ID NO: 3816549 - RNA, 20 nt, Human
aguauuauaggccaaacugg

SEQ ID NO: 3816550 - RNA, 22 nt, Human
agugagaugagggaugggccug

SEQ ID NO: 3816551 - RNA, 23 nt, Human
agugagaugagggaugggccugg

SEQ ID NO: 3816552 - RNA, 12 nt, Human
agugagaugcau

SEQ ID NO: 3816553 - RNA, 18 nt, Human
agugagcaaaccugcccc

SEQ ID NO: 3816554 - RNA, 16 nt, Human
agugagcacucccaag

SEQ ID NO: 3816555 - RNA, 19 nt, Human
agugagcagccuggagccc

SEQ ID NO: 3816556 - RNA, 19 nt, Human
agugagcccagauugugcc

SEQ ID NO: 3816557 - RNA, 21 nt, Human
agugagcccagauugugccac

SEQ ID NO: 3816558 - RNA, 16 nt, Human
agugagccgagauugu

SEQ ID NO: 3816559 - RNA, 19 nt, Human
agugagccgcaucuucucc

SEQ ID NO: 3816560 - RNA, 20 nt, Human
agugagccgcaucuucucca

SEQ ID NO: 3816561 - RNA, 24 nt, Human
agugagccgcaucuucuccaucug

SEQ ID NO: 3816562 - RNA, 22 nt, Human
agugagcggugcuguccucagg

SEQ ID NO: 3816563 - RNA, 20 nt, Human
agugaggaaaucaaagugcu

SEQ ID NO: 3816564 - RNA, 20 nt, Human
agugaggaaggcaggaagag

SEQ ID NO: 3816565 - RNA, 17 nt, Human
agugaggaauggcagug

SEQ ID NO: 3816566 - RNA, 19 nt, Human
agccauguuuaagauuuaa

SEQ ID NO: 3816567 - RNA, 13 nt, Human
agccauguuuauu

SEQ ID NO: 3816568 - RNA, 16 nt, Human
agccauguuuauuaca

SEQ ID NO: 3816569 - RNA, 17 nt, Human
agccauguuuauuacag

SEQ ID NO: 3816570 - RNA, 21 nt, Human
agccauuaaaugaauauuuug

SEQ ID NO: 3816571 - RNA, 17 nt, Human
agccauucugacucaua

SEQ ID NO: 3816572 - RNA, 20 nt, Human
agccauugcacccagcccag

SEQ ID NO: 3816573 - RNA, 12 nt, Human
agccauugucuu

SEQ ID NO: 3816574 - RNA, 12 nt, Human
agccauuugaga

SEQ ID NO: 3816575 - RNA, 14 nt, Human
agccauuuguccca

SEQ ID NO: 3816576 - RNA, 22 nt, Human
agccauuuguuggggcaguggu

SEQ ID NO: 3816577 - RNA, 17 nt, Human
agccauuuugugaaugg

SEQ ID NO: 3816578 - RNA, 19 nt, Human
agccauuuuucaaagcaau

SEQ ID NO: 3816579 - RNA, 21 nt, Human
agcccaaaggggacaggccuc

SEQ ID NO: 3816580 - RNA, 15 nt, Human
agcccaaccucuucc

SEQ ID NO: 3816581 - RNA, 16 nt, Human
agcccaagcuucccuc

SEQ ID NO: 3816582 - RNA, 16 nt, Human
agcccaagggaucugg

SEQ ID NO: 3816583 - RNA, 22 nt, Human
agcccaagggaucugguccuac

SEQ ID NO: 3816584 - RNA, 10 nt, Human
agcccaaguc

SEQ ID NO: 3816585 - RNA, 15 nt, Human
agcccaauauuauaa

SEQ ID NO: 3816586 - RNA, 20 nt, Human
agcccaauauuauaauuuuu

SEQ ID NO: 3816587 - RNA, 15 nt, Human
agcccacacuugaga

SEQ ID NO: 3816588 - RNA, 17 nt, Human
agcccacacuugagagg

SEQ ID NO: 3816589 - RNA, 23 nt, Human
agcccacagcacagcucccugcc

SEQ ID NO: 3816590 - RNA, 19 nt, Human
agcccacagguguccccag

SEQ ID NO: 3816591 - RNA, 16 nt, Human
agcccacaguauauuu

SEQ ID NO: 3816592 - RNA, 19 nt, Human
agcccacaguauauuuuau

SEQ ID NO: 3816593 - RNA, 20 nt, Human
agcccacaguauauuuuauu

SEQ ID NO: 3816594 - RNA, 15 nt, Human
agcccaccccucaac

SEQ ID NO: 3816595 - RNA, 13 nt, Human
agcccaccccucu

SEQ ID NO: 3816596 - RNA, 13 nt, Human
agcccacccuccu

SEQ ID NO: 3816597 - RNA, 19 nt, Human
agcccacgcccccacuggu

SEQ ID NO: 3816598 - RNA, 18 nt, Human
agcccacgcucacccccu

SEQ ID NO: 3816599 - RNA, 23 nt, Human
agcccacgcugacuacagggccg

SEQ ID NO: 3816600 - RNA, 21 nt, Human
agcccacggcuaagaggcugc

SEQ ID NO: 3816601 - RNA, 19 nt, Human
agcccacguccugucagug

SEQ ID NO: 3816602 - RNA, 20 nt, Human
agcccacuguccugggccug

SEQ ID NO: 3816603 - RNA, 22 nt, Human
agcccacuucugccauauucug

SEQ ID NO: 3816604 - RNA, 12 nt, Human
agcccagaagaa

SEQ ID NO: 3816605 - RNA, 12 nt, Human
agcccagacaaa

SEQ ID NO: 3816606 - RNA, 15 nt, Human
agcccagacacagaa

SEQ ID NO: 3816607 - RNA, 10 nt, Human
agcccagaga

SEQ ID NO: 3816608 - RNA, 15 nt, Human
agcccagagaacagc

SEQ ID NO: 3816609 - RNA, 22 nt, Human
agcccagagacauacuugaagg

SEQ ID NO: 3816610 - RNA, 14 nt, Human
agcccagagccugg

SEQ ID NO: 3816611 - RNA, 15 nt, Human
agcccagaggagggc

SEQ ID NO: 3816612 - RNA, 21 nt, Human
agcccagagggucugggggca

SEQ ID NO: 3816613 - RNA, 15 nt, Human
agcccagagguaaca

SEQ ID NO: 3816614 - RNA, 20 nt, Human
agcccagagguaacagaaca

SEQ ID NO: 3816615 - RNA, 16 nt, Human
agcccagaucagcucc

SEQ ID NO: 3816616 - RNA, 17 nt, Human
agcccagaucagcuccu

SEQ ID NO: 3816617 - RNA, 21 nt, Human
agcccagcacugcuugaggaa

SEQ ID NO: 3816618 - RNA, 15 nt, Human
agcccagcagggccu

SEQ ID NO: 3816619 - RNA, 20 nt, Human
agcccagcagggccucaaag

SEQ ID NO: 3816620 - RNA, 11 nt, Human
agcccagccac

SEQ ID NO: 3816621 - RNA, 15 nt, Human
agcccagccacggac

SEQ ID NO: 3816622 - RNA, 23 nt, Human
agcccagccauuaccauggagac

SEQ ID NO: 3816623 - RNA, 17 nt, Human
agcccagcccagcugcu

SEQ ID NO: 3816624 - RNA, 12 nt, Human
agcccagccccu

SEQ ID NO: 3816625 - RNA, 17 nt, Human
agcccagccccuacugc

SEQ ID NO: 3816626 - RNA, 13 nt, Human
agcccagcccucc

SEQ ID NO: 3816627 - RNA, 15 nt, Human
agcccagcccuguuc

SEQ ID NO: 3816628 - RNA, 16 nt, Human
agcccagcccuguucu

SEQ ID NO: 3816629 - RNA, 17 nt, Human
agcccagcccuguucug

SEQ ID NO: 3816630 - RNA, 12 nt, Human
agcccagcucca

SEQ ID NO: 3816631 - RNA, 17 nt, Human
agcccagcuccagggcc

SEQ ID NO: 3816632 - RNA, 14 nt, Human
agcccagcugcucu

SEQ ID NO: 3816633 - RNA, 16 nt, Human
agcccagcugcucugc

SEQ ID NO: 3816634 - RNA, 20 nt, Human
agcccagcugcucugcccag

SEQ ID NO: 3816635 - RNA, 21 nt, Human
agcccagcugcucugcccaga

SEQ ID NO: 3816636 - RNA, 13 nt, Human
agcccagcuggug

SEQ ID NO: 3816637 - RNA, 20 nt, Human
agcccagcuggugggaagcg

SEQ ID NO: 3816638 - RNA, 21 nt, Human
agcccagcuuggcccuuuccu

SEQ ID NO: 3816639 - RNA, 22 nt, Human
agcccaggaaaggcuccaggag

SEQ ID NO: 3816640 - RNA, 16 nt, Human
agcccaggagagagaa

SEQ ID NO: 3816641 - RNA, 18 nt, Human
agcccaggagagagaaag

SEQ ID NO: 3816642 - RNA, 22 nt, Human
agcccaggagagagaaagccag

SEQ ID NO: 3816643 - RNA, 12 nt, Human
agcccaggagcu

SEQ ID NO: 3816644 - RNA, 19 nt, Human
agcccaggagcuccccucc

SEQ ID NO: 3816645 - RNA, 22 nt, Human
agcccaggagggcauccauacc

SEQ ID NO: 3816646 - RNA, 21 nt, Human
agcccaggauacuggcacaga

SEQ ID NO: 3816647 - RNA, 18 nt, Human
agcccaggauauauuuua

SEQ ID NO: 3816648 - RNA, 13 nt, Human
agcccaggccagg

SEQ ID NO: 3816649 - RNA, 19 nt, Human
agcccaggccaggacucug

SEQ ID NO: 3816650 - RNA, 20 nt, Human
agcccaggccaggacucugc

SEQ ID NO: 3816651 - RNA, 22 nt, Human
agcccaggccaggacucugcag

SEQ ID NO: 3816652 - RNA, 23 nt, Human
agcccaggccaggacucugcagc

SEQ ID NO: 3816653 - RNA, 12 nt, Human
agcccaggccuc

SEQ ID NO: 3816654 - RNA, 21 nt, Human
agcccaggccuccuacagcuu

SEQ ID NO: 3816655 - RNA, 13 nt, Human
agcccaggcugga

SEQ ID NO: 3816656 - RNA, 13 nt, Human
agcccaggggccg

SEQ ID NO: 3816657 - RNA, 19 nt, Human
agcccaggguucccccagc

SEQ ID NO: 3816658 - RNA, 23 nt, Human
agcccagguccucugauacccag

SEQ ID NO: 3816659 - RNA, 17 nt, Human
agcccaggugccagccu

SEQ ID NO: 3816660 - RNA, 19 nt, Human
agcccauacucagccugcu

SEQ ID NO: 3816661 - RNA, 20 nt, Human
agcccauacucagccugcug

SEQ ID NO: 3816662 - RNA, 13 nt, Human
agcccaucaauua

SEQ ID NO: 3816663 - RNA, 19 nt, Human
agcccauccauaguaacug

SEQ ID NO: 3816664 - RNA, 17 nt, Human
agcccaucccugccugg

SEQ ID NO: 3816665 - RNA, 20 nt, Human
agcccaucccugccugguca

SEQ ID NO: 3816666 - RNA, 14 nt, Human
agcccauccugacc

SEQ ID NO: 3816667 - RNA, 15 nt, Human
agcccauccugacca

SEQ ID NO: 3816668 - RNA, 16 nt, Human
agcccauccugaccag

SEQ ID NO: 3816669 - RNA, 23 nt, Human
agcccauccugaccagcugcucc

SEQ ID NO: 3816670 - RNA, 16 nt, Human
agcccaugcccaccug

SEQ ID NO: 3816671 - RNA, 20 nt, Human
agcccaugcccaccugccca

SEQ ID NO: 3816672 - RNA, 17 nt, Human
agcccauggagauugac

SEQ ID NO: 3816673 - RNA, 18 nt, Human
agcccauggcacucuaug

SEQ ID NO: 3816674 - RNA, 16 nt, Human
agcccauggcccugug

SEQ ID NO: 3816675 - RNA, 19 nt, Human
agcccauguucugccccca

SEQ ID NO: 3816676 - RNA, 23 nt, Human
agcccauguucugcccccagccc

SEQ ID NO: 3816677 - RNA, 17 nt, Human
agcccauucauuccauu

SEQ ID NO: 3816678 - RNA, 20 nt, Human
agcccauucucucuccuguc

SEQ ID NO: 3816679 - RNA, 19 nt, Human
agcccauuguggccuaaga

SEQ ID NO: 3816680 - RNA, 13 nt, Human
agcccauuucaau

SEQ ID NO: 3816681 - RNA, 14 nt, Human
agcccauuucucca

SEQ ID NO: 3816682 - RNA, 15 nt, Human
agcccauuucuccag

SEQ ID NO: 3816683 - RNA, 22 nt, Human
agcccauuugggcagagaggcu

SEQ ID NO: 3816684 - RNA, 16 nt, Human
agccccaaaacucucc

SEQ ID NO: 3816685 - RNA, 20 nt, Human
agccccaacccaaaccugga

SEQ ID NO: 3816686 - RNA, 21 nt, Human
agccccaacccaaaccuggag

SEQ ID NO: 3816687 - RNA, 23 nt, Human
agccccaacccaaaccuggagau

SEQ ID NO: 3816688 - RNA, 18 nt, Human
agccccaagaaggcuggg

SEQ ID NO: 3816689 - RNA, 15 nt, Human
agccccaaguccuga

SEQ ID NO: 3816690 - RNA, 12 nt, Human
agccccacagcc

SEQ ID NO: 3816691 - RNA, 13 nt, Human
agccccacagccc

SEQ ID NO: 3816692 - RNA, 15 nt, Human
agccccacccaggag

SEQ ID NO: 3816693 - RNA, 22 nt, Human
agccccaccccagggcagccag

SEQ ID NO: 3816694 - RNA, 21 nt, Human
agugcccucucccacccucuu

SEQ ID NO: 3816695 - RNA, 23 nt, Human
agugcccucucccacccucuucc

SEQ ID NO: 3816696 - RNA, 15 nt, Human
agugcccucuccccu

SEQ ID NO: 3816697 - RNA, 20 nt, Human
agugcccuuccugcugcgca

SEQ ID NO: 3816698 - RNA, 17 nt, Human
agugccgcaaauuguac

SEQ ID NO: 3816699 - RNA, 16 nt, Human
agugccgcaucucaca

SEQ ID NO: 3816700 - RNA, 23 nt, Human
agugccgcaucucacagcuaugc

SEQ ID NO: 3816701 - RNA, 16 nt, Human
agugccgccgccucgc

SEQ ID NO: 3816702 - RNA, 20 nt, Human
agugccucucccugcugcuc

SEQ ID NO: 3816703 - RNA, 22 nt, Human
agugccuggauccccucugucu

SEQ ID NO: 3816704 - RNA, 23 nt, Human
agugccuggauccccucugucua

SEQ ID NO: 3816705 - RNA, 17 nt, Human
agugccugggaauguau

SEQ ID NO: 3816706 - RNA, 18 nt, Human
agugccuuacacaauggu

SEQ ID NO: 3816707 - RNA, 20 nt, Human
agugccuuaccuccugccca

SEQ ID NO: 3816708 - RNA, 21 nt, Human
agugccuuaccuccugcccag

SEQ ID NO: 3816709 - RNA, 10 nt, Human
agugccuuau

SEQ ID NO: 3816710 - RNA, 14 nt, Human
agugccuuauggaa

SEQ ID NO: 3816711 - RNA, 18 nt, Human
agugccuucaauaaaugg

SEQ ID NO: 3816712 - RNA, 13 nt, Human
agugccuuccaua

SEQ ID NO: 3816713 - RNA, 15 nt, Human
agugccuuccauaau

SEQ ID NO: 3816714 - RNA, 13 nt, Human
agugccuuucagg

SEQ ID NO: 3816715 - RNA, 19 nt, Human
agugccuuucaggaucuau

SEQ ID NO: 3816716 - RNA, 21 nt, Human
agugccuuucaggaucuauuu

SEQ ID NO: 3816717 - RNA, 22 nt, Human
agugccuuuugcagaagagggu

SEQ ID NO: 3816718 - RNA, 13 nt, Human
agugcgugaaugu

SEQ ID NO: 3816719 - RNA, 17 nt, Human
agugcguggcccaccag

SEQ ID NO: 3816720 - RNA, 22 nt, Human
agugcguguguagaguuaagaa

SEQ ID NO: 3816721 - RNA, 14 nt, Human
agugcuaaaaaugg

SEQ ID NO: 3816722 - RNA, 16 nt, Human
agugcuaacaugaaga

SEQ ID NO: 3816723 - RNA, 19 nt, Human
agugcuaacaugaagaccu

SEQ ID NO: 3816724 - RNA, 22 nt, Human
agugcuaacaugaagaccuuuu

SEQ ID NO: 3816725 - RNA, 15 nt, Human
agugcuaagguucua

SEQ ID NO: 3816726 - RNA, 17 nt, Human
agccccaugcuggagcc

SEQ ID NO: 3816727 - RNA, 18 nt, Human
agccccaugcuggagccu

SEQ ID NO: 3816728 - RNA, 13 nt, Human
agccccauucugc

SEQ ID NO: 3816729 - RNA, 19 nt, Human
agccccauucugccugccc

SEQ ID NO: 3816730 - RNA, 23 nt, Human
agccccauucugccugcccaggc

SEQ ID NO: 3816731 - RNA, 17 nt, Human
agcccccacccuguucc

SEQ ID NO: 3816732 - RNA, 13 nt, Human
agcccccagagcc

SEQ ID NO: 3816733 - RNA, 14 nt, Human
agcccccagagccc

SEQ ID NO: 3816734 - RNA, 15 nt, Human
agcccccagccccuc

SEQ ID NO: 3816735 - RNA, 17 nt, Human
agcccccagccccuccc

SEQ ID NO: 3816736 - RNA, 15 nt, Human
agcccccagccuguc

SEQ ID NO: 3816737 - RNA, 22 nt, Human
agcccccagcuaagaaccugga

SEQ ID NO: 3816738 - RNA, 17 nt, Human
agcccccagcucccacc

SEQ ID NO: 3816739 - RNA, 22 nt, Human
agcccccagcucccaccucccc

SEQ ID NO: 3816740 - RNA, 21 nt, Human
agcccccagcuuccagcagga

SEQ ID NO: 3816741 - RNA, 22 nt, Human
agcccccagcuuccagcaggag

SEQ ID NO: 3816742 - RNA, 19 nt, Human
agcccccccaacacugugc

SEQ ID NO: 3816743 - RNA, 21 nt, Human
agcccccccaacacugugccc

SEQ ID NO: 3816744 - RNA, 23 nt, Human
agcccccccaacacugugcccug

SEQ ID NO: 3816745 - RNA, 15 nt, Human
agcccccccuuccac

SEQ ID NO: 3816746 - RNA, 22 nt, Human
agcccccgccccgccccacauu

SEQ ID NO: 3816747 - RNA, 23 nt, Human
agcccccgccccgccccacauuc

SEQ ID NO: 3816748 - RNA, 19 nt, Human
agcccccuaagagagcacc

SEQ ID NO: 3816749 - RNA, 22 nt, Human
agcccccucacaguauugcuca

SEQ ID NO: 3816750 - RNA, 23 nt, Human
agcccccucacaguauugcucac

SEQ ID NO: 3816751 - RNA, 21 nt, Human
agcccccuccuggugccaccu

SEQ ID NO: 3816752 - RNA, 15 nt, Human
agcccccucuucccu

SEQ ID NO: 3816753 - RNA, 22 nt, Human
agcccccugaccacucagagac

SEQ ID NO: 3816754 - RNA, 19 nt, Human
agcccccuggccucugugc

SEQ ID NO: 3816755 - RNA, 18 nt, Human
agcccccuggucuuugag

SEQ ID NO: 3816756 - RNA, 21 nt, Human
agcccccuuugggcccaggga

SEQ ID NO: 3816757 - RNA, 16 nt, Human
agccccgagcuguccc

SEQ ID NO: 3816758 - RNA, 16 nt, Human
agccccgaggccuucu

SEQ ID NO: 3816759 - RNA, 18 nt, Human
agccccgcagaccucccc

SEQ ID NO: 3816760 - RNA, 14 nt, Human
agccccgcccucuu

SEQ ID NO: 3816761 - RNA, 17 nt, Human
agccccgcccucuuccu

SEQ ID NO: 3816762 - RNA, 23 nt, Human
agccccgcgaccauguggccaca

SEQ ID NO: 3816763 - RNA, 18 nt, Human
agccccgcgccuccuucc

SEQ ID NO: 3816764 - RNA, 23 nt, Human
agccccgcguggaacucgugucu

SEQ ID NO: 3816765 - RNA, 14 nt, Human
agccccggcccugg

SEQ ID NO: 3816766 - RNA, 16 nt, Human
agccccggcccugggc

SEQ ID NO: 3816767 - RNA, 16 nt, Human
agccccuacugcugug

SEQ ID NO: 3816768 - RNA, 16 nt, Human
agccccuagaaaccca

SEQ ID NO: 3816769 - RNA, 12 nt, Human
agccccuagccc

SEQ ID NO: 3816770 - RNA, 18 nt, Human
agccccuagcccaggaga

SEQ ID NO: 3816771 - RNA, 21 nt, Human
agccccuagcccaggagagag

SEQ ID NO: 3816772 - RNA, 22 nt, Human
agccccuagcccaggagagaga

SEQ ID NO: 3816773 - RNA, 11 nt, Human
agccccuagga

SEQ ID NO: 3816774 - RNA, 10 nt, Human
agccccuccc

SEQ ID NO: 3816775 - RNA, 16 nt, Human
agccccucccaccaca

SEQ ID NO: 3816776 - RNA, 18 nt, Human
agccccucccaccacagc

SEQ ID NO: 3816777 - RNA, 23 nt, Human
agccccuccuccagccccugucc

SEQ ID NO: 3816778 - RNA, 13 nt, Human
agccccuccucug

SEQ ID NO: 3816779 - RNA, 15 nt, Human
agccccuccucugcc

SEQ ID NO: 3816780 - RNA, 17 nt, Human
agccccuccucugccac

SEQ ID NO: 3816781 - RNA, 22 nt, Human
agccccuccucugccaccuccc

SEQ ID NO: 3816782 - RNA, 20 nt, Human
agccccucuggucgcuccug

SEQ ID NO: 3816783 - RNA, 10 nt, Human
agccccucuu

SEQ ID NO: 3816784 - RNA, 12 nt, Human
agccccucuucc

SEQ ID NO: 3816785 - RNA, 13 nt, Human
agccccucuuccc

SEQ ID NO: 3816786 - RNA, 17 nt, Human
agccccucuuccccaau

SEQ ID NO: 3816787 - RNA, 17 nt, Human
agccccucuugcccccc

SEQ ID NO: 3816788 - RNA, 21 nt, Human
agccccucuugccccccaccc

SEQ ID NO: 3816789 - RNA, 22 nt, Human
agccccucuugccccccacccc

SEQ ID NO: 3816790 - RNA, 15 nt, Human
agccccucuuggaga

SEQ ID NO: 3816791 - RNA, 20 nt, Human
agccccucuuggagaagucu

SEQ ID NO: 3816792 - RNA, 13 nt, Human
agccccugcccca

SEQ ID NO: 3816793 - RNA, 23 nt, Human
agccccugccccagcccaagucc

SEQ ID NO: 3816794 - RNA, 17 nt, Human
agccccuggaugcagcc

SEQ ID NO: 3816795 - RNA, 19 nt, Human
agccccuggaugcagccuc

SEQ ID NO: 3816796 - RNA, 18 nt, Human
agccccuguauggcacug

SEQ ID NO: 3816797 - RNA, 12 nt, Human
agccccuguccc

SEQ ID NO: 3816798 - RNA, 13 nt, Human
agccccuguccca

SEQ ID NO: 3816799 - RNA, 23 nt, Human
agccccugucuagagagggaggc

SEQ ID NO: 3816800 - RNA, 15 nt, Human
agccccuguggagac

SEQ ID NO: 3816801 - RNA, 18 nt, Human
agccccuguggagacugg

SEQ ID NO: 3816802 - RNA, 16 nt, Human
agccccuuagacagag

SEQ ID NO: 3816803 - RNA, 17 nt, Human
agccccuuccccauggg

SEQ ID NO: 3816804 - RNA, 23 nt, Human
agccccuuccuugcucugcaccc

SEQ ID NO: 3816805 - RNA, 19 nt, Human
agccccuucucagaaucua

SEQ ID NO: 3816806 - RNA, 14 nt, Human
agccccuucugacc

SEQ ID NO: 3816807 - RNA, 19 nt, Human
agccccuucugacccaugc

SEQ ID NO: 3816808 - RNA, 20 nt, Human
agccccuucugacccaugcu

SEQ ID NO: 3816809 - RNA, 22 nt, Human
agccccuucugcucagcucugg

SEQ ID NO: 3816810 - RNA, 12 nt, Human
agccccuuucca

SEQ ID NO: 3816811 - RNA, 14 nt, Human
agccccuuucccuu

SEQ ID NO: 3816812 - RNA, 21 nt, Human
agccccuuucccuuguagcuc

SEQ ID NO: 3816813 - RNA, 22 nt, Human
agccccuuuuucauauguugcu

SEQ ID NO: 3816814 - RNA, 16 nt, Human
agcccgcacccccacc

SEQ ID NO: 3816815 - RNA, 18 nt, Human
agcccgcacccccacccu

SEQ ID NO: 3816816 - RNA, 20 nt, Human
agcccgcaucagcugcucag

SEQ ID NO: 3816817 - RNA, 12 nt, Human
agcccgcaugca

SEQ ID NO: 3816818 - RNA, 16 nt, Human
agcccgcaugcagcag

SEQ ID NO: 3816819 - RNA, 17 nt, Human
agcccgcaugcagcagc

SEQ ID NO: 3816820 - RNA, 13 nt, Human
agcccgccugaca

SEQ ID NO: 3816821 - RNA, 12 nt, Human
agcccgccugcc

SEQ ID NO: 3816822 - RNA, 15 nt, Human
agcccgccugccagu

SEQ ID NO: 3816823 - RNA, 21 nt, Human
agcccgcuaggcucgccuucc

SEQ ID NO: 3816824 - RNA, 19 nt, Human
agcccgcugaguggacugg

SEQ ID NO: 3816825 - RNA, 19 nt, Human
agcccggccugcucccagc

SEQ ID NO: 3816826 - RNA, 22 nt, Human
agcccggccugcucccagcagc

SEQ ID NO: 3816827 - RNA, 20 nt, Human
agcccggcgccaccauccug

SEQ ID NO: 3816828 - RNA, 12 nt, Human
agcccggcuccu

SEQ ID NO: 3816829 - RNA, 16 nt, Human
agcccgggagccuagg

SEQ ID NO: 3816830 - RNA, 18 nt, Human
agcccgggagccuaggac

SEQ ID NO: 3816831 - RNA, 16 nt, Human
agcccgggcucugccu

SEQ ID NO: 3816832 - RNA, 19 nt, Human
agcccgggcugccugggcu

SEQ ID NO: 3816833 - RNA, 21 nt, Human
agcccgggcugccugggcugu

SEQ ID NO: 3816834 - RNA, 21 nt, Human
agcccgguaagagcaaaagaa

SEQ ID NO: 3816835 - RNA, 18 nt, Human
agcccguguggccccuuc

SEQ ID NO: 3816836 - RNA, 15 nt, Human
agcccuaaacaucau

SEQ ID NO: 3816837 - RNA, 21 nt, Human
agcccuaaacaucauucuuga

SEQ ID NO: 3816838 - RNA, 17 nt, Human
agccugugccucuggga

SEQ ID NO: 3816839 - RNA, 13 nt, Human
agccuguggcccu

SEQ ID NO: 3816840 - RNA, 14 nt, Human
agccuguggcccug

SEQ ID NO: 3816841 - RNA, 22 nt, Human
agccuguggcggugccugggug

SEQ ID NO: 3816842 - RNA, 11 nt, Human
agccuguggcu

SEQ ID NO: 3816843 - RNA, 14 nt, Human
agccuguggcugug

SEQ ID NO: 3816844 - RNA, 23 nt, Human
agccuguggcuguggagacaaug

SEQ ID NO: 3816845 - RNA, 18 nt, Human
agccuguguaacagcucc

SEQ ID NO: 3816846 - RNA, 11 nt, Human
agccuguguca

SEQ ID NO: 3816847 - RNA, 16 nt, Human
agccugugucuuuaaa

SEQ ID NO: 3816848 - RNA, 16 nt, Human
agccuguucauggcag

SEQ ID NO: 3816849 - RNA, 18 nt, Human
agccuguucauggcagau

SEQ ID NO: 3816850 - RNA, 20 nt, Human
agccuguuccccucacugga

SEQ ID NO: 3816851 - RNA, 13 nt, Human
agccuguuuaaga

SEQ ID NO: 3816852 - RNA, 22 nt, Human
agccuuaaaacaucauuccuuu

SEQ ID NO: 3816853 - RNA, 14 nt, Human
agccuuaagcugca

SEQ ID NO: 3816854 - RNA, 18 nt, Human
agccuuaaucagguccuc

SEQ ID NO: 3816855 - RNA, 20 nt, Human
agccuuaauuuuuuuuucau

SEQ ID NO: 3816856 - RNA, 20 nt, Human
agccuuagaagucacacagu

SEQ ID NO: 3816857 - RNA, 22 nt, Human
agccuuagaagucacacaguau

SEQ ID NO: 3816858 - RNA, 20 nt, Human
agccuuagggaagcuggccu

SEQ ID NO: 3816859 - RNA, 18 nt, Human
agccuuaucaagugucuu

SEQ ID NO: 3816860 - RNA, 14 nt, Human
agccuuauccucug

SEQ ID NO: 3816861 - RNA, 15 nt, Human
agccuuauccucuga

SEQ ID NO: 3816862 - RNA, 18 nt, Human
agccuuauccucugaucu

SEQ ID NO: 3816863 - RNA, 15 nt, Human
agccuucaagcucug

SEQ ID NO: 3816864 - RNA, 23 nt, Human
agccuucagucuugaauuucuaa

SEQ ID NO: 3816865 - RNA, 16 nt, Human
agccuuccacacucac

SEQ ID NO: 3816866 - RNA, 20 nt, Human
agccuuccccuugcccaggg

SEQ ID NO: 3816867 - RNA, 19 nt, Human
agccuuccuccacauccuu

SEQ ID NO: 3816868 - RNA, 23 nt, Human
agccuuccuccacauccuuucua

SEQ ID NO: 3816869 - RNA, 14 nt, Human
agccuuccucugca

SEQ ID NO: 3816870 - RNA, 22 nt, Human
agccuuccucugcagcugaccu

SEQ ID NO: 3816871 - RNA, 20 nt, Human
agccuucucccuagcuccuc

SEQ ID NO: 3816872 - RNA, 19 nt, Human
agccuucucuguucauuuc

SEQ ID NO: 3816873 - RNA, 22 nt, Human
agccuucucuguucauuuccuc

SEQ ID NO: 3816874 - RNA, 13 nt, Human
agccuucugagcu

SEQ ID NO: 3816875 - RNA, 20 nt, Human
agccuucugaggacauucca

SEQ ID NO: 3816876 - RNA, 22 nt, Human
agccuucuuccaucccaggaca

SEQ ID NO: 3816877 - RNA, 14 nt, Human
agccuugaacucug

SEQ ID NO: 3816878 - RNA, 15 nt, Human
agccuugaacuuuga

SEQ ID NO: 3816879 - RNA, 23 nt, Human
agccuugaccauucuccaccugc

SEQ ID NO: 3816880 - RNA, 21 nt, Human
agccuugauucccuuguuauu

SEQ ID NO: 3816881 - RNA, 19 nt, Human
agccuugauugguguugcc

SEQ ID NO: 3816882 - RNA, 20 nt, Human
agccuuggauaaugcuguug

SEQ ID NO: 3816883 - RNA, 17 nt, Human
agccuuggccucagagg

SEQ ID NO: 3816884 - RNA, 16 nt, Human
agccuugggaccccug

SEQ ID NO: 3816885 - RNA, 16 nt, Human
agccuuggggauucuu

SEQ ID NO: 3816886 - RNA, 17 nt, Human
agccuugguguccaccu

SEQ ID NO: 3816887 - RNA, 21 nt, Human
agccuugguguccaccuggcc

SEQ ID NO: 3816888 - RNA, 22 nt, Human
agccuugugaugucauacagag

SEQ ID NO: 3816889 - RNA, 23 nt, Human
agccuugugaugucauacagaga

SEQ ID NO: 3816890 - RNA, 13 nt, Human
agccuuguguaua

SEQ ID NO: 3816891 - RNA, 14 nt, Human
agccuuguguauau

SEQ ID NO: 3816892 - RNA, 22 nt, Human
agccuuguguauauuuguauau

SEQ ID NO: 3816893 - RNA, 24 nt, Human
agccuuguguauauuuguauauua

SEQ ID NO: 3816894 - RNA, 20 nt, Human
agccuugugucuacagagaa

SEQ ID NO: 3816895 - RNA, 13 nt, Human
agccuuuaaugca

SEQ ID NO: 3816896 - RNA, 15 nt, Human
agccuuuaaugcauc

SEQ ID NO: 3816897 - RNA, 19 nt, Human
agccuuuaguaucaguguu

SEQ ID NO: 3816898 - RNA, 13 nt, Human
agccuuucauuuu

SEQ ID NO: 3816899 - RNA, 20 nt, Human
agccuuucauuuugcuuuaa

SEQ ID NO: 3816900 - RNA, 23 nt, Human
agccuuuccauaaggaauguagc

SEQ ID NO: 3816901 - RNA, 16 nt, Human
agccuuucucccaggc

SEQ ID NO: 3816902 - RNA, 15 nt, Human
agccuuucucucuuu

SEQ ID NO: 3816903 - RNA, 15 nt, Human
agccuuucuuuucuu

SEQ ID NO: 3816904 - RNA, 18 nt, Human
agccuuuggaugaccaga

SEQ ID NO: 3816905 - RNA, 17 nt, Human
agccuuuggccuuggcu

SEQ ID NO: 3816906 - RNA, 16 nt, Human
agccuuuggcucugga

SEQ ID NO: 3816907 - RNA, 17 nt, Human
agccuuuggcucuggag

SEQ ID NO: 3816908 - RNA, 14 nt, Human
agccuuuguucccc

SEQ ID NO: 3816909 - RNA, 20 nt, Human
agccuuuguuccccacugga

SEQ ID NO: 3816910 - RNA, 22 nt, Human
agccuuuguuccccacuggagc

SEQ ID NO: 3816911 - RNA, 15 nt, Human
agccuuuguugaacu

SEQ ID NO: 3816912 - RNA, 21 nt, Human
agccuuuguugaacuguuaga

SEQ ID NO: 3816913 - RNA, 17 nt, Human
agccuuuucacccuucu

SEQ ID NO: 3816914 - RNA, 23 nt, Human
agccuuuucccucuuuggcuccc

SEQ ID NO: 3816915 - RNA, 13 nt, Human
agccuuuugaaag

SEQ ID NO: 3816916 - RNA, 18 nt, Human
agccuuuuuaaaacacau

SEQ ID NO: 3816917 - RNA, 22 nt, Human
agccuuuuuaaaacacauguuu

SEQ ID NO: 3816918 - RNA, 16 nt, Human
agccuuuuucuaggcc

SEQ ID NO: 3816919 - RNA, 18 nt, Human
agccuuuuuguuucaaug

SEQ ID NO: 3816920 - RNA, 17 nt, Human
agccuuuuuuccccaga

SEQ ID NO: 3816921 - RNA, 21 nt, Human
agccuuuuuuccccagacuug

SEQ ID NO: 3816922 - RNA, 23 nt, Human
agccuuuuuuccccagacuuguu

SEQ ID NO: 3816923 - RNA, 18 nt, Human
agcgaaccaauauuugua

SEQ ID NO: 3816924 - RNA, 13 nt, Human
agcgacagagcag

SEQ ID NO: 3816925 - RNA, 15 nt, Human
aguucugaagaagau

SEQ ID NO: 3816926 - RNA, 16 nt, Human
aguucugaagaagaug

SEQ ID NO: 3816927 - RNA, 16 nt, Human
aguucugcaaauagaa

SEQ ID NO: 3816928 - RNA, 12 nt, Human
aguucugcaggu

SEQ ID NO: 3816929 - RNA, 12 nt, Human
aguucugccagg

SEQ ID NO: 3816930 - RNA, 13 nt, Human
aguucugccagga

SEQ ID NO: 3816931 - RNA, 14 nt, Human
aguucugcuccucu

SEQ ID NO: 3816932 - RNA, 15 nt, Human
aguucugcuccucuc

SEQ ID NO: 3816933 - RNA, 19 nt, Human
aguucugcuccucuccagg

SEQ ID NO: 3816934 - RNA, 21 nt, Human
aguucugcuccucuccaggca

SEQ ID NO: 3816935 - RNA, 16 nt, Human
aguucugcucugguug

SEQ ID NO: 3816936 - RNA, 14 nt, Human
aguucugguuccua

SEQ ID NO: 3816937 - RNA, 13 nt, Human
aguucuguagaaa

SEQ ID NO: 3816938 - RNA, 18 nt, Human
aguucuguagaaaugguu

SEQ ID NO: 3816939 - RNA, 15 nt, Human
aguucuguauuugaa

SEQ ID NO: 3816940 - RNA, 17 nt, Human
aguucuguauuugaaag

SEQ ID NO: 3816941 - RNA, 18 nt, Human
aguucuguauuugaaagu

SEQ ID NO: 3816942 - RNA, 11 nt, Human
aguucugugac

SEQ ID NO: 3816943 - RNA, 19 nt, Human
aguucugugacuaggaaaa

SEQ ID NO: 3816944 - RNA, 13 nt, Human
aguucuguguauu

SEQ ID NO: 3816945 - RNA, 21 nt, Human
aguucuguguauuuaauugua

SEQ ID NO: 3816946 - RNA, 18 nt, Human
aguucuguguauuuucag

SEQ ID NO: 3816947 - RNA, 13 nt, Human
aguucuguguuua

SEQ ID NO: 3816948 - RNA, 19 nt, Human
aguucuguguuuaauuucu

SEQ ID NO: 3816949 - RNA, 16 nt, Human
aguucuuaguugcugu

SEQ ID NO: 3816950 - RNA, 14 nt, Human
aguucuuccuguaa

SEQ ID NO: 3816951 - RNA, 15 nt, Human
aguucuucgacuguu

SEQ ID NO: 3816952 - RNA, 19 nt, Human
aguucuucgacuguuguua

SEQ ID NO: 3816953 - RNA, 20 nt, Human
aguucuucgggaagagagga

SEQ ID NO: 3816954 - RNA, 13 nt, Human
aguucuucuccaa

SEQ ID NO: 3816955 - RNA, 22 nt, Human
aguucuugccuuggcugcaguu

SEQ ID NO: 3816956 - RNA, 13 nt, Human
aguucuugugcca

SEQ ID NO: 3816957 - RNA, 14 nt, Human
aguucuugugccau

SEQ ID NO: 3816958 - RNA, 17 nt, Human
aguucuuugggccagac

SEQ ID NO: 3816959 - RNA, 21 nt, Human
aguucuuugggccagacaugc

SEQ ID NO: 3816960 - RNA, 19 nt, Human
aguucuuuguucauagccc

SEQ ID NO: 3816961 - RNA, 19 nt, Human
aguucuuuuugaaguauuu

SEQ ID NO: 3816962 - RNA, 14 nt, Human
aguugaaaagacuc

SEQ ID NO: 3816963 - RNA, 19 nt, Human
aguugaaaagacuccaaag

SEQ ID NO: 3816964 - RNA, 21 nt, Human
aguugaaaagacuccaaagaa

SEQ ID NO: 3816965 - RNA, 18 nt, Human
aguugaaaauaaagugua

SEQ ID NO: 3816966 - RNA, 19 nt, Human
aguugaaaauaaaguguau

SEQ ID NO: 3816967 - RNA, 13 nt, Human
aguugaacugaua

SEQ ID NO: 3816968 - RNA, 16 nt, Human
aguugaagacagagcu

SEQ ID NO: 3816969 - RNA, 15 nt, Human
aguugaagucaugcu

SEQ ID NO: 3816970 - RNA, 17 nt, Human
aguugaaguuaguggaa

SEQ ID NO: 3816971 - RNA, 17 nt, Human
aguugaauacuugaacc

SEQ ID NO: 3816972 - RNA, 21 nt, Human
aguugaaugacaacagaagcu

SEQ ID NO: 3816973 - RNA, 20 nt, Human
aguugaauggccugccuuga

SEQ ID NO: 3816974 - RNA, 20 nt, Human
aguugaauuuauuggcuuuu

SEQ ID NO: 3816975 - RNA, 17 nt, Human
aguugacaugagauuua

SEQ ID NO: 3816976 - RNA, 19 nt, Human
aguugagccagcagacauu

SEQ ID NO: 3816977 - RNA, 21 nt, Human
aguugagccagcagacauugu

SEQ ID NO: 3816978 - RNA, 16 nt, Human
aguugagccccaaguc

SEQ ID NO: 3816979 - RNA, 17 nt, Human
aguugaggaguuuccua

SEQ ID NO: 3816980 - RNA, 19 nt, Human
aguugaguauauuauaaua

SEQ ID NO: 3816981 - RNA, 20 nt, Human
aguugagucgucaucacuuu

SEQ ID NO: 3816982 - RNA, 17 nt, Human
agcgcuaucuucacaua

SEQ ID NO: 3816983 - RNA, 17 nt, Human
agcgcuccugccgcaga

SEQ ID NO: 3816984 - RNA, 21 nt, Human
agcgcuccugccgcagagcug

SEQ ID NO: 3816985 - RNA, 12 nt, Human
agcgcucugccu

SEQ ID NO: 3816986 - RNA, 16 nt, Human
agcgcuggccgggacc

SEQ ID NO: 3816987 - RNA, 16 nt, Human
agcgcugucaggauug

SEQ ID NO: 3816988 - RNA, 21 nt, Human
agcgcugucaggauugcgaga

SEQ ID NO: 3816989 - RNA, 17 nt, Human
agcgcuuucuggaaaag

SEQ ID NO: 3816990 - RNA, 21 nt, Human
agcgcuuugggaggccgaggc

SEQ ID NO: 3816991 - RNA, 23 nt, Human
agcggaaagcagcucaaaggcac

SEQ ID NO: 3816992 - RNA, 17 nt, Human
agcggaacaaggaguca

SEQ ID NO: 3816993 - RNA, 22 nt, Human
agcggaacaaggagucagacau

SEQ ID NO: 3816994 - RNA, 20 nt, Human
agcggacuccuccuuucucc

SEQ ID NO: 3816995 - RNA, 14 nt, Human
agcggaggugugga

SEQ ID NO: 3816996 - RNA, 23 nt, Human
agcggagguugcagggagccgag

SEQ ID NO: 3816997 - RNA, 22 nt, Human
agcggagguugcagugagcuga

SEQ ID NO: 3816998 - RNA, 13 nt, Human
agcggauuuccag

SEQ ID NO: 3816999 - RNA, 13 nt, Human
agcggcaucaggc

SEQ ID NO: 3817000 - RNA, 13 nt, Human
agcggccccuccc

SEQ ID NO: 3817001 - RNA, 20 nt, Human
agcggccccuugacucuggg

SEQ ID NO: 3817002 - RNA, 17 nt, Human
agcggcccuaagggagu

SEQ ID NO: 3817003 - RNA, 14 nt, Human
agcggcccugucau

SEQ ID NO: 3817004 - RNA, 18 nt, Human
agcggccggccagccccu

SEQ ID NO: 3817005 - RNA, 18 nt, Human
agcggcucaagcccagga

SEQ ID NO: 3817006 - RNA, 16 nt, Human
agcggcugagucauga

SEQ ID NO: 3817007 - RNA, 17 nt, Human
agcggcuggacuuggag

SEQ ID NO: 3817008 - RNA, 21 nt, Human
agcggcuggacuuggagguag

SEQ ID NO: 3817009 - RNA, 20 nt, Human
agcggcuugccugccugcuc

SEQ ID NO: 3817010 - RNA, 14 nt, Human
agcgggaaaaggag

SEQ ID NO: 3817011 - RNA, 15 nt, Human
agcgggaccuguggc

SEQ ID NO: 3817012 - RNA, 16 nt, Human
agcgggaccuguggcu

SEQ ID NO: 3817013 - RNA, 17 nt, Human
agcgggagccucccugc

SEQ ID NO: 3817014 - RNA, 12 nt, Human
agcgggaggcag

SEQ ID NO: 3817015 - RNA, 17 nt, Human
agcggggacagcuccuu

SEQ ID NO: 3817016 - RNA, 19 nt, Human
agcggggacagcuccuucu

SEQ ID NO: 3817017 - RNA, 20 nt, Human
agcgggggaggcccgcagag

SEQ ID NO: 3817018 - RNA, 21 nt, Human
agcgggggaggguaggcagga

SEQ ID NO: 3817019 - RNA, 16 nt, Human
agcgggggccagggaa

SEQ ID NO: 3817020 - RNA, 18 nt, Human
agcgggggccuaaaaaaa

SEQ ID NO: 3817021 - RNA, 21 nt, Human
agcgguaccaaugcagaacuc

SEQ ID NO: 3817022 - RNA, 14 nt, Human
agcgguuuggggag

SEQ ID NO: 3817023 - RNA, 20 nt, Human
agcguagugcagcagggcag

SEQ ID NO: 3817024 - RNA, 21 nt, Human
agcguauauauaagaaagaca

SEQ ID NO: 3817025 - RNA, 16 nt, Human
agcguauggcuuuauu

SEQ ID NO: 3817026 - RNA, 16 nt, Human
agcgucccuagcagug

SEQ ID NO: 3817027 - RNA, 18 nt, Human
agcgucccuagcagugaa

SEQ ID NO: 3817028 - RNA, 16 nt, Human
agcguccuccucugug

SEQ ID NO: 3817029 - RNA, 18 nt, Human
agcgucuuucuuuuuugg

SEQ ID NO: 3817030 - RNA, 13 nt, Human
agcgugagccacu

SEQ ID NO: 3817031 - RNA, 17 nt, Human
agcgugagccacugcac

SEQ ID NO: 3817032 - RNA, 15 nt, Human
agcgugagcugagca

SEQ ID NO: 3817033 - RNA, 12 nt, Human
agcgugagcuua

SEQ ID NO: 3817034 - RNA, 15 nt, Human
agcguggacaggugu

SEQ ID NO: 3817035 - RNA, 20 nt, Human
agcguggagggguaggggcu

SEQ ID NO: 3817036 - RNA, 23 nt, Human
agcgugucuguauuuauguguga

SEQ ID NO: 3817037 - RNA, 16 nt, Human
agcguuggauguagca

SEQ ID NO: 3817038 - RNA, 14 nt, Human
agcguuuuuuaaau

SEQ ID NO: 3817039 - RNA, 18 nt, Human
agcguuuuuuaaauguau

SEQ ID NO: 3817040 - RNA, 19 nt, Human
agcuaaaauaaagaaauag

SEQ ID NO: 3817041 - RNA, 21 nt, Human
agcuaaagaggcugaaagagg

SEQ ID NO: 3817042 - RNA, 18 nt, Human
agcuaaauuacaauuguc

SEQ ID NO: 3817043 - RNA, 18 nt, Human
agcuaacacuggccccua

SEQ ID NO: 3817044 - RNA, 13 nt, Human
agcuaacagggaa

SEQ ID NO: 3817045 - RNA, 21 nt, Human
agcuaacagggaaggcaggca

SEQ ID NO: 3817046 - RNA, 20 nt, Human
agcuaacauggaaguacuau

SEQ ID NO: 3817047 - RNA, 17 nt, Human
agcuaacauuuuaaaua

SEQ ID NO: 3817048 - RNA, 18 nt, Human
agcuaacauuuuaaauaa

SEQ ID NO: 3817049 - RNA, 20 nt, Human
agcuaacauuuuaaauaaaa

SEQ ID NO: 3817050 - RNA, 23 nt, Human
agcuaacccccuucuacugagcc

SEQ ID NO: 3817051 - RNA, 22 nt, Human
agcuaaccuuauccugcauugu

SEQ ID NO: 3817052 - RNA, 15 nt, Human
agcuaacuguaaauc

SEQ ID NO: 3817053 - RNA, 14 nt, Human
agcuaagaaaagau

SEQ ID NO: 3817054 - RNA, 13 nt, Human
agcuaagaaauaa

SEQ ID NO: 3817055 - RNA, 19 nt, Human
agcuaagaaauaaaacugu

SEQ ID NO: 3817056 - RNA, 16 nt, Human
agcuaagaaccuggaa

SEQ ID NO: 3817057 - RNA, 16 nt, Human
agcuaaggacauuucc

SEQ ID NO: 3817058 - RNA, 18 nt, Human
agcuaagggaagacauuu

SEQ ID NO: 3817059 - RNA, 20 nt, Human
agcuaagggaagacauuucu

SEQ ID NO: 3817060 - RNA, 16 nt, Human
agcuaagggugggugc

SEQ ID NO: 3817061 - RNA, 22 nt, Human
agcuaagggugggugcucagaa

SEQ ID NO: 3817062 - RNA, 18 nt, Human
agcuaauaaaaagcuuuu

SEQ ID NO: 3817063 - RNA, 23 nt, Human
agcuaauaaaaagcuuuugucua

SEQ ID NO: 3817064 - RNA, 17 nt, Human
agcuaauaaaauaucau

SEQ ID NO: 3817065 - RNA, 18 nt, Human
agcuaauaaaauaucauu

SEQ ID NO: 3817066 - RNA, 20 nt, Human
agcuaauaaaauaucauuca

SEQ ID NO: 3817067 - RNA, 21 nt, Human
agcuaauaaaauaucauucag

SEQ ID NO: 3817068 - RNA, 16 nt, Human
agcuaauaacugaucu

SEQ ID NO: 3817069 - RNA, 12 nt, Human
agcuaauaauga

SEQ ID NO: 3817070 - RNA, 16 nt, Human
agcuaauaauucuuca

SEQ ID NO: 3817071 - RNA, 22 nt, Human
agcuaauaauucuucaccuaag

SEQ ID NO: 3817072 - RNA, 17 nt, Human
agcuaaucuguagggcu

SEQ ID NO: 3817073 - RNA, 16 nt, Human
agcuaauggaaaauga

SEQ ID NO: 3817074 - RNA, 13 nt, Human
agcuaaugggaca

SEQ ID NO: 3817075 - RNA, 14 nt, Human
agcuaaugggacac

SEQ ID NO: 3817076 - RNA, 15 nt, Human
agcuaauuauuuuaa

SEQ ID NO: 3817077 - RNA, 16 nt, Human
agcuaauuauuuuaau

SEQ ID NO: 3817078 - RNA, 18 nt, Human
agcuaauuauuuuaauua

SEQ ID NO: 3817079 - RNA, 15 nt, Human
agcuaauugggaguc

SEQ ID NO: 3817080 - RNA, 22 nt, Human
agcuaauuugcauuaaauucac

SEQ ID NO: 3817081 - RNA, 20 nt, Human
agcuacaacagccucacuug

SEQ ID NO: 3817082 - RNA, 22 nt, Human
agcuacaccuuucuccuuugua

SEQ ID NO: 3817083 - RNA, 15 nt, Human
agcuacagagaaacc

SEQ ID NO: 3817084 - RNA, 23 nt, Human
agcuacagagaaaccagcuuccu

SEQ ID NO: 3817085 - RNA, 17 nt, Human
agugcaguuauuugcuu

SEQ ID NO: 3817086 - RNA, 23 nt, Human
agugcauagcuacuaaaaucagu

SEQ ID NO: 3817087 - RNA, 22 nt, Human
agugcauaguuguagacaaagu

SEQ ID NO: 3817088 - RNA, 17 nt, Human
agugcaucucagcccac

SEQ ID NO: 3817089 - RNA, 18 nt, Human
agugcaucuuugccucuc

SEQ ID NO: 3817090 - RNA, 16 nt, Human
agugcaugcugucccu

SEQ ID NO: 3817091 - RNA, 21 nt, Human
agugcauuucugaauagaaau

SEQ ID NO: 3817092 - RNA, 22 nt, Human
agugcauuucugaauagaaaug

SEQ ID NO: 3817093 - RNA, 17 nt, Human
agugcauuuucccagau

SEQ ID NO: 3817094 - RNA, 14 nt, Human
agugcauuuuugua

SEQ ID NO: 3817095 - RNA, 20 nt, Human
agugcauuuuuguaaaugug

SEQ ID NO: 3817096 - RNA, 13 nt, Human
agugccaacugug

SEQ ID NO: 3817097 - RNA, 15 nt, Human
agugccaaguuuguu

SEQ ID NO: 3817098 - RNA, 21 nt, Human
agugccacugcccgagcuggu

SEQ ID NO: 3817099 - RNA, 17 nt, Human
agugccacuuaauguau

SEQ ID NO: 3817100 - RNA, 20 nt, Human
agugccagaggugggcaggu

SEQ ID NO: 3817101 - RNA, 18 nt, Human
agugccagcaccugccca

SEQ ID NO: 3817102 - RNA, 24 nt, Human
agugccaggacuccccaggccagg

SEQ ID NO: 3817103 - RNA, 18 nt, Human
agugccaggauggaauga

SEQ ID NO: 3817104 - RNA, 15 nt, Human
agugccauguaaauc

SEQ ID NO: 3817105 - RNA, 16 nt, Human
agugccauugucuuua

SEQ ID NO: 3817106 - RNA, 14 nt, Human
agugcccaacuguu

SEQ ID NO: 3817107 - RNA, 17 nt, Human
agugcccaacuguuaua

SEQ ID NO: 3817108 - RNA, 16 nt, Human
agugcccaccaacauc

SEQ ID NO: 3817109 - RNA, 16 nt, Human
agugcccacccuggga

SEQ ID NO: 3817110 - RNA, 22 nt, Human
agugcccacccugggagacaga

SEQ ID NO: 3817111 - RNA, 16 nt, Human
agugccccaccugcca

SEQ ID NO: 3817112 - RNA, 23 nt, Human
agugccccaccugccacuaggcu

SEQ ID NO: 3817113 - RNA, 14 nt, Human
agugcccccacuga

SEQ ID NO: 3817114 - RNA, 16 nt, Human
agugcccccacugacc

SEQ ID NO: 3817115 - RNA, 18 nt, Human
agugcccccacugaccag

SEQ ID NO: 3817116 - RNA, 21 nt, Human
agugccccgucuacagcuccc

SEQ ID NO: 3817117 - RNA, 11 nt, Human
agugccccugc

SEQ ID NO: 3817118 - RNA, 13 nt, Human
agugccccugcug

SEQ ID NO: 3817119 - RNA, 19 nt, Human
agugccccugcugccuccc

SEQ ID NO: 3817120 - RNA, 21 nt, Human
agugccccugcugccucccca

SEQ ID NO: 3817121 - RNA, 22 nt, Human
agugccccugcugccuccccaa

SEQ ID NO: 3817122 - RNA, 16 nt, Human
agugcccuccacagcc

SEQ ID NO: 3817123 - RNA, 17 nt, Human
agugcccuccacagccg

SEQ ID NO: 3817124 - RNA, 13 nt, Human
agugcccucuccc

SEQ ID NO: 3817125 - RNA, 15 nt, Human
agugcccucucccac

SEQ ID NO: 3817126 - RNA, 13 nt, Human
agcuacuuuguuu

SEQ ID NO: 3817127 - RNA, 16 nt, Human
agcuagaacccggcag

SEQ ID NO: 3817128 - RNA, 15 nt, Human
agcuagaacccucug

SEQ ID NO: 3817129 - RNA, 16 nt, Human
agcuagaaccuggaga

SEQ ID NO: 3817130 - RNA, 19 nt, Human
agcuagaacuuugaaggac

SEQ ID NO: 3817131 - RNA, 15 nt, Human
agcuagaagugggcc

SEQ ID NO: 3817132 - RNA, 19 nt, Human
agcuagaagugggccagga

SEQ ID NO: 3817133 - RNA, 21 nt, Human
agcuagaagugggccaggaca

SEQ ID NO: 3817134 - RNA, 22 nt, Human
agcuagaauucccucucucuga

SEQ ID NO: 3817135 - RNA, 16 nt, Human
agcuagaauuugauau

SEQ ID NO: 3817136 - RNA, 15 nt, Human
agcuagagaaauucu

SEQ ID NO: 3817137 - RNA, 15 nt, Human
agcuagagcuucaag

SEQ ID NO: 3817138 - RNA, 17 nt, Human
agcuagaugcuuuccua

SEQ ID NO: 3817139 - RNA, 17 nt, Human
agcuagccagaggacug

SEQ ID NO: 3817140 - RNA, 18 nt, Human
agcuagcgcugccgcacc

SEQ ID NO: 3817141 - RNA, 15 nt, Human
agcuagcucaacuag

SEQ ID NO: 3817142 - RNA, 16 nt, Human
agcuagcucaacuagu

SEQ ID NO: 3817143 - RNA, 16 nt, Human
agcuagcuccccuccu

SEQ ID NO: 3817144 - RNA, 20 nt, Human
agcuagcuccccuccucucc

SEQ ID NO: 3817145 - RNA, 23 nt, Human
agcuagcuccccuccucuccccu

SEQ ID NO: 3817146 - RNA, 17 nt, Human
agcuagcugcagagcca

SEQ ID NO: 3817147 - RNA, 20 nt, Human
agcuaggaaaagaaaucuau

SEQ ID NO: 3817148 - RNA, 21 nt, Human
agcuaggaacaaaucuuccug

SEQ ID NO: 3817149 - RNA, 18 nt, Human
agcuaggaagagcaggac

SEQ ID NO: 3817150 - RNA, 21 nt, Human
agcuaggaagagcaggacucc

SEQ ID NO: 3817151 - RNA, 13 nt, Human
agcuaggaaugaa

SEQ ID NO: 3817152 - RNA, 15 nt, Human
agcuaggagcaaagc

SEQ ID NO: 3817153 - RNA, 16 nt, Human
agcuaggagcaaagcc

SEQ ID NO: 3817154 - RNA, 18 nt, Human
agcuaggagcaaagccug

SEQ ID NO: 3817155 - RNA, 23 nt, Human
agcuaggauuugaacacuuggug

SEQ ID NO: 3817156 - RNA, 12 nt, Human
agcuaggcaggg

SEQ ID NO: 3817157 - RNA, 14 nt, Human
agcuaggccuggcc

SEQ ID NO: 3817158 - RNA, 15 nt, Human
agcuaggccuggcca

SEQ ID NO: 3817159 - RNA, 21 nt, Human
agcuaggugcuaauuaauaaa

SEQ ID NO: 3817160 - RNA, 18 nt, Human
agcuaguccuagugaacc

SEQ ID NO: 3817161 - RNA, 23 nt, Human
agcuagucuuuugcuuuugccca

SEQ ID NO: 3817162 - RNA, 18 nt, Human
agcuagugacccacaugc

SEQ ID NO: 3817163 - RNA, 21 nt, Human
agcuagugacccacaugccau

SEQ ID NO: 3817164 - RNA, 21 nt, Human
agcuaguguaccuccucucag

SEQ ID NO: 3817165 - RNA, 17 nt, Human
agcuaguucguagcuuu

SEQ ID NO: 3817166 - RNA, 16 nt, Human
agcuaguugaauacuu

SEQ ID NO: 3817167 - RNA, 24 nt, Human
agcuaguugaauacuugaaccaua

SEQ ID NO: 3817168 - RNA, 22 nt, Human
agcuaguuuuauucuugguuuu

SEQ ID NO: 3817169 - RNA, 22 nt, Human
agcuauauccauguacuguagu

SEQ ID NO: 3817170 - RNA, 17 nt, Human
agcuauaucuauauaua

SEQ ID NO: 3817171 - RNA, 18 nt, Human
agcuauauuuaaguauuc

SEQ ID NO: 3817172 - RNA, 15 nt, Human
agcuaucaagaggcu

SEQ ID NO: 3817173 - RNA, 17 nt, Human
agcuaucaagugugcuu

SEQ ID NO: 3817174 - RNA, 22 nt, Human
agcuaucaagugugcuuuagcu

SEQ ID NO: 3817175 - RNA, 16 nt, Human
agcuaucuucauguaa

SEQ ID NO: 3817176 - RNA, 13 nt, Human
agcuaugaagaaa

SEQ ID NO: 3817177 - RNA, 17 nt, Human
agcuaugcuguaucugu

SEQ ID NO: 3817178 - RNA, 22 nt, Human
agcuaugcuguaucugugcuuu

SEQ ID NO: 3817179 - RNA, 18 nt, Human
agcuaugggagccccagg

SEQ ID NO: 3817180 - RNA, 22 nt, Human
agcuaugggagccccagggucu

SEQ ID NO: 3817181 - RNA, 17 nt, Human
agcuauggugagaugca

SEQ ID NO: 3817182 - RNA, 18 nt, Human
agcuauguuauauugaaa

SEQ ID NO: 3817183 - RNA, 20 nt, Human
agcuauuacuggaucucuua

SEQ ID NO: 3817184 - RNA, 21 nt, Human
agcuauuacugucugguuuua

SEQ ID NO: 3817185 - RNA, 18 nt, Human
agcuauuagccaggauca

SEQ ID NO: 3817186 - RNA, 20 nt, Human
agcuauuagccaggaucaug

SEQ ID NO: 3817187 - RNA, 22 nt, Human
agcuauuagccaggaucauggu

SEQ ID NO: 3817188 - RNA, 13 nt, Human
agcuauuccuuuc

SEQ ID NO: 3817189 - RNA, 19 nt, Human
agcuauuccuuucccuucc

SEQ ID NO: 3817190 - RNA, 20 nt, Human
agcuauuccuuucccuuccu

SEQ ID NO: 3817191 - RNA, 17 nt, Human
agcuauugccaaccagu

SEQ ID NO: 3817192 - RNA, 17 nt, Human
agcuauuuaugggcccc

SEQ ID NO: 3817193 - RNA, 15 nt, Human
agcuauuuuucuaac

SEQ ID NO: 3817194 - RNA, 17 nt, Human
agcuauuuuucuaacua

SEQ ID NO: 3817195 - RNA, 17 nt, Human
agcucaaauaaaaauaa

SEQ ID NO: 3817196 - RNA, 23 nt, Human
agcucaaaugaaauguaugcauu

SEQ ID NO: 3817197 - RNA, 23 nt, Human
agcucaacuagugggguuuccug

SEQ ID NO: 3817198 - RNA, 22 nt, Human
agcucaacucucuuauugccuc

SEQ ID NO: 3817199 - RNA, 15 nt, Human
agcucaacuuucugu

SEQ ID NO: 3817200 - RNA, 19 nt, Human
agcucaacuuucuguugga

SEQ ID NO: 3817201 - RNA, 13 nt, Human
agcucaaugagca

SEQ ID NO: 3817202 - RNA, 14 nt, Human
agcucaauggacug

SEQ ID NO: 3817203 - RNA, 20 nt, Human
agcucacaaggcagcaaggc

SEQ ID NO: 3817204 - RNA, 20 nt, Human
agcucaccagccccagugcc

SEQ ID NO: 3817205 - RNA, 21 nt, Human
agcucaccagccccagugccc

SEQ ID NO: 3817206 - RNA, 15 nt, Human
agcucaccccccaca

SEQ ID NO: 3817207 - RNA, 18 nt, Human
agcucaccuguugcuuac

SEQ ID NO: 3817208 - RNA, 19 nt, Human
agcucaccuguugcuuaca

SEQ ID NO: 3817209 - RNA, 13 nt, Human
agcucacgucaca

SEQ ID NO: 3817210 - RNA, 21 nt, Human
agcucacguccugagaaagcu

SEQ ID NO: 3817211 - RNA, 19 nt, Human
agcucacuccccaaccccc

SEQ ID NO: 3817212 - RNA, 15 nt, Human
agcucagaaccacag

SEQ ID NO: 3817213 - RNA, 17 nt, Human
agcucagaacccagggc

SEQ ID NO: 3817214 - RNA, 15 nt, Human
agcucagaaggcucu

SEQ ID NO: 3817215 - RNA, 16 nt, Human
agcucagaaggcucuu

SEQ ID NO: 3817216 - RNA, 17 nt, Human
agcucagagagggcagg

SEQ ID NO: 3817217 - RNA, 18 nt, Human
agcucagagaggguggga

SEQ ID NO: 3817218 - RNA, 19 nt, Human
agcucagaggcgcacugug

SEQ ID NO: 3817219 - RNA, 22 nt, Human
agcucagaggcgcacugugacc

SEQ ID NO: 3817220 - RNA, 16 nt, Human
agcucagcccaccccc

SEQ ID NO: 3817221 - RNA, 20 nt, Human
agcucagcccaccccccuca

SEQ ID NO: 3817222 - RNA, 17 nt, Human
agcucagccccagccca

SEQ ID NO: 3817223 - RNA, 20 nt, Human
agcucagccccagcccagcc

SEQ ID NO: 3817224 - RNA, 23 nt, Human
agcucagccccgagcuguccccg

SEQ ID NO: 3817225 - RNA, 12 nt, Human
agcucagcgcca

SEQ ID NO: 3817226 - RNA, 15 nt, Human
agcucagcuuuuugu

SEQ ID NO: 3817227 - RNA, 20 nt, Human
agcucagcuuuuugucuuuu

SEQ ID NO: 3817228 - RNA, 21 nt, Human
agcucaggaaccgaggcaggg

SEQ ID NO: 3817229 - RNA, 17 nt, Human
agcucaggaggcuugga

SEQ ID NO: 3817230 - RNA, 16 nt, Human
agcucagggccuggcu

SEQ ID NO: 3817231 - RNA, 17 nt, Human
agcucaggugucccugc

SEQ ID NO: 3817232 - RNA, 20 nt, Human
agcucaggugucccugcacu

SEQ ID NO: 3817233 - RNA, 21 nt, Human
agcucaggugucccugcacuu

SEQ ID NO: 3817234 - RNA, 22 nt, Human
agcucaggugucccugcacuug

SEQ ID NO: 3817235 - RNA, 23 nt, Human
agcucaguucuagucucucuggg

SEQ ID NO: 3817236 - RNA, 19 nt, Human
agcucaguuuauccaaggu

SEQ ID NO: 3817237 - RNA, 15 nt, Human
agcucaguuuucaac

SEQ ID NO: 3817238 - RNA, 16 nt, Human
agcucaucugcaaaag

SEQ ID NO: 3817239 - RNA, 16 nt, Human
agcucauuaaacuuuu

SEQ ID NO: 3817240 - RNA, 14 nt, Human
agcucauucauuuu

SEQ ID NO: 3817241 - RNA, 20 nt, Human
agcucauucuccuuguguua

SEQ ID NO: 3817242 - RNA, 12 nt, Human
agcucauuucac

SEQ ID NO: 3817243 - RNA, 15 nt, Human
aguggauagaugccc

SEQ ID NO: 3817244 - RNA, 16 nt, Human
aguggaucacaaagug

SEQ ID NO: 3817245 - RNA, 16 nt, Human
aguggaugcugggucc

SEQ ID NO: 3817246 - RNA, 14 nt, Human
aguggauugcauuu

SEQ ID NO: 3817247 - RNA, 19 nt, Human
aguggauugcucaucucag

SEQ ID NO: 3817248 - RNA, 14 nt, Human
aguggauuguuuau

SEQ ID NO: 3817249 - RNA, 20 nt, Human
aguggcagcccagccagcgu

SEQ ID NO: 3817250 - RNA, 16 nt, Human
aguggcaggacaggaa

SEQ ID NO: 3817251 - RNA, 17 nt, Human
aguggcaggacaggaaa

SEQ ID NO: 3817252 - RNA, 13 nt, Human
aguggcagggcac

SEQ ID NO: 3817253 - RNA, 16 nt, Human
aguggcagggcacagg

SEQ ID NO: 3817254 - RNA, 11 nt, Human
aguggcagggg

SEQ ID NO: 3817255 - RNA, 15 nt, Human
aguggcauggcucca

SEQ ID NO: 3817256 - RNA, 18 nt, Human
aguggcauggcuccaguc

SEQ ID NO: 3817257 - RNA, 21 nt, Human
aguggccaagagaugcagugc

SEQ ID NO: 3817258 - RNA, 14 nt, Human
aguggccacuaagc

SEQ ID NO: 3817259 - RNA, 14 nt, Human
aguggccagaccag

SEQ ID NO: 3817260 - RNA, 22 nt, Human
aguggccagaccagagcucugg

SEQ ID NO: 3817261 - RNA, 12 nt, Human
aguggccccacc

SEQ ID NO: 3817262 - RNA, 14 nt, Human
aguggccccaccug

SEQ ID NO: 3817263 - RNA, 16 nt, Human
aguggccccaccuggc

SEQ ID NO: 3817264 - RNA, 18 nt, Human
aguggccccaccuggccc

SEQ ID NO: 3817265 - RNA, 19 nt, Human
aguggccccuuaggccagu

SEQ ID NO: 3817266 - RNA, 21 nt, Human
aguggccuacaaaucaguaau

SEQ ID NO: 3817267 - RNA, 21 nt, Human
aguggccucaacccucccuca

SEQ ID NO: 3817268 - RNA, 22 nt, Human
aguggccucaacccucccucag

SEQ ID NO: 3817269 - RNA, 14 nt, Human
aguggccucuuugu

SEQ ID NO: 3817270 - RNA, 23 nt, Human
aguuuaaccaaaaagaccagacu

SEQ ID NO: 3817271 - RNA, 15 nt, Human
aguuuaauauuaaag

SEQ ID NO: 3817272 - RNA, 20 nt, Human
aguuuaauauuaaagccaug

SEQ ID NO: 3817273 - RNA, 23 nt, Human
aguuuacaaguguauaucagaaa

SEQ ID NO: 3817274 - RNA, 23 nt, Human
aguuuacagcucugacuuuacac

SEQ ID NO: 3817275 - RNA, 18 nt, Human
aguuuacaguaaauaaau

SEQ ID NO: 3817276 - RNA, 22 nt, Human
aguuuacaguaaauaaauuguu

SEQ ID NO: 3817277 - RNA, 14 nt, Human
aguuuaccauuugu

SEQ ID NO: 3817278 - RNA, 17 nt, Human
aguuuaccauuuguaau

SEQ ID NO: 3817279 - RNA, 19 nt, Human
aguuuaccauuuguaauaa

SEQ ID NO: 3817280 - RNA, 17 nt, Human
aguuuacccaugaagau

SEQ ID NO: 3817281 - RNA, 18 nt, Human
aguuuaccuggcuuauuu

SEQ ID NO: 3817282 - RNA, 12 nt, Human
aguuuagaacag

SEQ ID NO: 3817283 - RNA, 17 nt, Human
aguuuagaacagguuuu

SEQ ID NO: 3817284 - RNA, 19 nt, Human
aguuuagaggaaaaaaaug

SEQ ID NO: 3817285 - RNA, 18 nt, Human
aguuuagcccugaacauu

SEQ ID NO: 3817286 - RNA, 22 nt, Human
aguuuagcccugaacauuucau

SEQ ID NO: 3817287 - RNA, 14 nt, Human
aguuuagcucugag

SEQ ID NO: 3817288 - RNA, 15 nt, Human
aguuuagcuggaaaa

SEQ ID NO: 3817289 - RNA, 16 nt, Human
aguuuaggauaaaaua

SEQ ID NO: 3817290 - RNA, 23 nt, Human
aguuuagggaacaauuuggcaau

SEQ ID NO: 3817291 - RNA, 12 nt, Human
aguuuagggugg

SEQ ID NO: 3817292 - RNA, 14 nt, Human
aguuuagugcaucu

SEQ ID NO: 3817293 - RNA, 14 nt, Human
aguuuauacaguuu

SEQ ID NO: 3817294 - RNA, 14 nt, Human
aguuuaucaugaag

SEQ ID NO: 3817295 - RNA, 16 nt, Human
aguuuaucaugaagcc

SEQ ID NO: 3817296 - RNA, 14 nt, Human
aguuuaucauucaa

SEQ ID NO: 3817297 - RNA, 15 nt, Human
aguuuaucauucaag

SEQ ID NO: 3817298 - RNA, 17 nt, Human
aguuuaucauucaagug

SEQ ID NO: 3817299 - RNA, 23 nt, Human
aguuuaucgaccaguuugaaucu

SEQ ID NO: 3817300 - RNA, 18 nt, Human
aguuuaugcagugcugcu

SEQ ID NO: 3817301 - RNA, 16 nt, Human
aguuuauguuuugguc

SEQ ID NO: 3817302 - RNA, 22 nt, Human
aguuuauuccagagcugccagu

SEQ ID NO: 3817303 - RNA, 22 nt, Human
auaauacuauauuuauacugua

SEQ ID NO: 3817304 - RNA, 19 nt, Human
auaauacuugcuuuggaaa

SEQ ID NO: 3817305 - RNA, 15 nt, Human
auaauacuuuguaua

SEQ ID NO: 3817306 - RNA, 18 nt, Human
auaauagauugugaauaa

SEQ ID NO: 3817307 - RNA, 19 nt, Human
auaauagucaccugcuguu

SEQ ID NO: 3817308 - RNA, 14 nt, Human
auaauaguuuuuuc

SEQ ID NO: 3817309 - RNA, 18 nt, Human
auaauauaccaaugcuuu

SEQ ID NO: 3817310 - RNA, 10 nt, Human
auaauauaua

SEQ ID NO: 3817311 - RNA, 15 nt, Human
auaauauauauauau

SEQ ID NO: 3817312 - RNA, 15 nt, Human
auaauauauuuucug

SEQ ID NO: 3817313 - RNA, 20 nt, Human
auaauauccaggucaacaga

SEQ ID NO: 3817314 - RNA, 22 nt, Human
auaauaucuuugugauaauuua

SEQ ID NO: 3817315 - RNA, 13 nt, Human
auaauaugauuuu

SEQ ID NO: 3817316 - RNA, 17 nt, Human
auaauauggcuaugcuu

SEQ ID NO: 3817317 - RNA, 19 nt, Human
auaauauguuuccuucccu

SEQ ID NO: 3817318 - RNA, 12 nt, Human
auaauauugaaa

SEQ ID NO: 3817319 - RNA, 16 nt, Human
auaauauugaaaauug

SEQ ID NO: 3817320 - RNA, 14 nt, Human
auaauauuguuugg

SEQ ID NO: 3817321 - RNA, 17 nt, Human
auaaucaaauacauuuu

SEQ ID NO: 3817322 - RNA, 20 nt, Human
auaaucaagagccuuaaaac

SEQ ID NO: 3817323 - RNA, 22 nt, Human
auaaucaagagccuuaaaacau

SEQ ID NO: 3817324 - RNA, 18 nt, Human
auaaucacaacccuucag

SEQ ID NO: 3817325 - RNA, 13 nt, Human
auaaucagccucu

SEQ ID NO: 3817326 - RNA, 16 nt, Human
auaaucagccucuuaa

SEQ ID NO: 3817327 - RNA, 22 nt, Human
auaaucauuauuacuuuugcug

SEQ ID NO: 3817328 - RNA, 17 nt, Human
auaauccaguaaaauaa

SEQ ID NO: 3817329 - RNA, 21 nt, Human
auaaucccuggaugauauuuu

SEQ ID NO: 3817330 - RNA, 18 nt, Human
auaauccuaaacauauga

SEQ ID NO: 3817331 - RNA, 19 nt, Human
auaauccuugauaauauau

SEQ ID NO: 3817332 - RNA, 22 nt, Human
auaaucggcccacagcucccac

SEQ ID NO: 3817333 - RNA, 14 nt, Human
auaaucuauuucua

SEQ ID NO: 3817334 - RNA, 14 nt, Human
auaaucuguacaau

SEQ ID NO: 3817335 - RNA, 13 nt, Human
auaaucugucaaa

SEQ ID NO: 3817336 - RNA, 19 nt, Human
auaaucugucaaaacacug

SEQ ID NO: 3817337 - RNA, 17 nt, Human
auaaugaacagaacaua

SEQ ID NO: 3817338 - RNA, 14 nt, Human
auaaugaauaaauc

SEQ ID NO: 3817339 - RNA, 15 nt, Human
auaaugaaugaaaca

SEQ ID NO: 3817340 - RNA, 17 nt, Human
auaaugaauggacucaa

SEQ ID NO: 3817341 - RNA, 19 nt, Human
auaaugagcuauuaaaacu

SEQ ID NO: 3817342 - RNA, 17 nt, Human
auaaugaggaguuuaug

SEQ ID NO: 3817343 - RNA, 22 nt, Human
auaaugaggaugauuauuuuca

SEQ ID NO: 3817344 - RNA, 15 nt, Human
auaaugauaaaacac

SEQ ID NO: 3817345 - RNA, 19 nt, Human
auaaugaucgaaaaaauaa

SEQ ID NO: 3817346 - RNA, 22 nt, Human
auaaugaugaugggaauugugu

SEQ ID NO: 3817347 - RNA, 14 nt, Human
auaaugcaaagaau

SEQ ID NO: 3817348 - RNA, 11 nt, Human
auaaugcagua

SEQ ID NO: 3817349 - RNA, 15 nt, Human
auaaugcaguauggu

SEQ ID NO: 3817350 - RNA, 18 nt, Human
auaaugcaguaugguaca

SEQ ID NO: 3817351 - RNA, 18 nt, Human
auaaugccggugagaaua

SEQ ID NO: 3817352 - RNA, 15 nt, Human
auaaugcgugcauac

SEQ ID NO: 3817353 - RNA, 17 nt, Human
auaaugcuaauuuaaag

SEQ ID NO: 3817354 - RNA, 15 nt, Human
auaaugcuacugucu

SEQ ID NO: 3817355 - RNA, 18 nt, Human
auaaugcuguugccucau

SEQ ID NO: 3817356 - RNA, 13 nt, Human
auaauggaaaaaa

SEQ ID NO: 3817357 - RNA, 22 nt, Human
auaauggaaaaaaaaaaaagag

SEQ ID NO: 3817358 - RNA, 22 nt, Human
auaauggaaaaugccaugaauu

SEQ ID NO: 3817359 - RNA, 18 nt, Human
auaauggaagagaaaucu

SEQ ID NO: 3817360 - RNA, 21 nt, Human
auaaugggccacugaaaucug

SEQ ID NO: 3817361 - RNA, 22 nt, Human
auaaugggccacugaaaucugu

SEQ ID NO: 3817362 - RNA, 18 nt, Human
auaaugggcuuagagcag

SEQ ID NO: 3817363 - RNA, 19 nt, Human
auaaugguaccagauaaaa

SEQ ID NO: 3817364 - RNA, 22 nt, Human
auaauggucccauccaggcagu

SEQ ID NO: 3817365 - RNA, 14 nt, Human
auaaugguugacug

SEQ ID NO: 3817366 - RNA, 14 nt, Human
auaauguaagcucu

SEQ ID NO: 3817367 - RNA, 15 nt, Human
auaauguaauuguaa

SEQ ID NO: 3817368 - RNA, 17 nt, Human
auaauguaauuguaauu

SEQ ID NO: 3817369 - RNA, 19 nt, Human
auaauguacugauuucagu

SEQ ID NO: 3817370 - RNA, 20 nt, Human
auaauguacugauuucagua

SEQ ID NO: 3817371 - RNA, 19 nt, Human
auaauguauucauauuugu

SEQ ID NO: 3817372 - RNA, 17 nt, Human
auaauguccauaugcua

SEQ ID NO: 3817373 - RNA, 15 nt, Human
auaaugucccuucac

SEQ ID NO: 3817374 - RNA, 11 nt, Human
auaaugucucu

SEQ ID NO: 3817375 - RNA, 10 nt, Human
auaaugucuu

SEQ ID NO: 3817376 - RNA, 17 nt, Human
auaaugucuuguuaaua

SEQ ID NO: 3817377 - RNA, 13 nt, Human
auaaugugaaaau

SEQ ID NO: 3817378 - RNA, 16 nt, Human
auaaugugaaaauggu

SEQ ID NO: 3817379 - RNA, 18 nt, Human
auaaugugaaacuggauu

SEQ ID NO: 3817380 - RNA, 21 nt, Human
auaaugugaaacuggauuaaa

SEQ ID NO: 3817381 - RNA, 18 nt, Human
auaauguguaguucaugu

SEQ ID NO: 3817382 - RNA, 23 nt, Human
auaauguguaguucauguaaaua

SEQ ID NO: 3817383 - RNA, 14 nt, Human
auaauguguguaug

SEQ ID NO: 3817384 - RNA, 18 nt, Human
auaauguguguaugugua

SEQ ID NO: 3817385 - RNA, 19 nt, Human
auaauguguguauguguau

SEQ ID NO: 3817386 - RNA, 12 nt, Human
auaauguuaaca

SEQ ID NO: 3817387 - RNA, 20 nt, Human
auaauguuaaccaaggaaau

SEQ ID NO: 3817388 - RNA, 21 nt, Human
auaauguugugguuuguugcc

SEQ ID NO: 3817389 - RNA, 14 nt, Human
auaauguuguuauu

SEQ ID NO: 3817390 - RNA, 19 nt, Human
auaauguuguuauuuaaag

SEQ ID NO: 3817391 - RNA, 22 nt, Human
auaauguuuaauauugagaaag

SEQ ID NO: 3817392 - RNA, 17 nt, Human
auaauguuuauuaaaug

SEQ ID NO: 3817393 - RNA, 23 nt, Human
auaauguuucaaacauauauaac

SEQ ID NO: 3817394 - RNA, 17 nt, Human
auaauguuuuuaauauu

SEQ ID NO: 3817395 - RNA, 12 nt, Human
auaauuaaagug

SEQ ID NO: 3817396 - RNA, 20 nt, Human
auaauuaaauuuugaguucu

SEQ ID NO: 3817397 - RNA, 21 nt, Human
auaauuaaccaagguagaaug

SEQ ID NO: 3817398 - RNA, 22 nt, Human
auaauuacagugccuaaaauaa

SEQ ID NO: 3817399 - RNA, 21 nt, Human
auaauuagauccauuaauuua

SEQ ID NO: 3817400 - RNA, 16 nt, Human
auaauuagguuaacau

SEQ ID NO: 3817401 - RNA, 19 nt, Human
auaauuauauaacuguauu

SEQ ID NO: 3817402 - RNA, 21 nt, Human
auaauuaucggaagcagugcc

SEQ ID NO: 3817403 - RNA, 14 nt, Human
auaauuaugacagu

SEQ ID NO: 3817404 - RNA, 18 nt, Human
auaauuaugacaguuaua

SEQ ID NO: 3817405 - RNA, 21 nt, Human
auaauuauuuauuuaauaaca

SEQ ID NO: 3817406 - RNA, 18 nt, Human
auaauucaauuuuaaaga

SEQ ID NO: 3817407 - RNA, 23 nt, Human
auaauucacauuguauucagagu

SEQ ID NO: 3817408 - RNA, 17 nt, Human
auaauucaguauguuuu

SEQ ID NO: 3817409 - RNA, 13 nt, Human
auaauucauauuc

SEQ ID NO: 3817410 - RNA, 12 nt, Human
auaauucccuau

SEQ ID NO: 3817411 - RNA, 17 nt, Human
auaauucccuaucuuuu

SEQ ID NO: 3817412 - RNA, 19 nt, Human
auaauucccuaucuuuuag

SEQ ID NO: 3817413 - RNA, 19 nt, Human
auaauuccuacagcacuac

SEQ ID NO: 3817414 - RNA, 20 nt, Human
aguuuguagguaaaauguau

SEQ ID NO: 3817415 - RNA, 17 nt, Human
aguuuguauaacuucuu

SEQ ID NO: 3817416 - RNA, 21 nt, Human
aguuuguauagaguucauccc

SEQ ID NO: 3817417 - RNA, 14 nt, Human
aguuugucagacuu

SEQ ID NO: 3817418 - RNA, 21 nt, Human
aguuugucgcucaugugugca

SEQ ID NO: 3817419 - RNA, 14 nt, Human
aguuuguguguugu

SEQ ID NO: 3817420 - RNA, 19 nt, Human
aguuuguguguugucuuga

SEQ ID NO: 3817421 - RNA, 22 nt, Human
aguuuguuaguaugaggcauuu

SEQ ID NO: 3817422 - RNA, 14 nt, Human
aguuuguuuacaca

SEQ ID NO: 3817423 - RNA, 22 nt, Human
aguuuguuucuuugaauuuuca

SEQ ID NO: 3817424 - RNA, 23 nt, Human
aguuuuaaaaaaauaaaacauuu

SEQ ID NO: 3817425 - RNA, 22 nt, Human
aguuuuaaaaagccaguuuggg

SEQ ID NO: 3817426 - RNA, 23 nt, Human
aguuuuaaacucauuuuugccau

SEQ ID NO: 3817427 - RNA, 11 nt, Human
aguuuuaaagu

SEQ ID NO: 3817428 - RNA, 18 nt, Human
aguuuuaacuagaauuua

SEQ ID NO: 3817429 - RNA, 15 nt, Human
aguuuuacaguguuu

SEQ ID NO: 3817430 - RNA, 23 nt, Human
aguuuuacugucuauuaauauuc

SEQ ID NO: 3817431 - RNA, 19 nt, Human
aguuuuacuuuuaaacugu

SEQ ID NO: 3817432 - RNA, 18 nt, Human
aguuuuaggguacaugug

SEQ ID NO: 3817433 - RNA, 21 nt, Human
aguuuuaguugcagaaacauu

SEQ ID NO: 3817434 - RNA, 24 nt, Human
aguuuuauaauccuuaaaucuuaa

SEQ ID NO: 3817435 - RNA, 14 nt, Human
aguuuuauauauua

SEQ ID NO: 3817436 - RNA, 16 nt, Human
aguuuuauauauuaua

SEQ ID NO: 3817437 - RNA, 21 nt, Human
aguuuuauauauuauauggaa

SEQ ID NO: 3817438 - RNA, 14 nt, Human
aguuuuauaugcuu

SEQ ID NO: 3817439 - RNA, 15 nt, Human
aguuuuauaugcuuu

SEQ ID NO: 3817440 - RNA, 16 nt, Human
aguuuuauaugcuuua

SEQ ID NO: 3817441 - RNA, 17 nt, Human
aguuuuauaugcuuuau

SEQ ID NO: 3817442 - RNA, 14 nt, Human
aguuuuaucauuuu

SEQ ID NO: 3817443 - RNA, 14 nt, Human
aguuuuaugcucuu

SEQ ID NO: 3817444 - RNA, 21 nt, Human
aguuuuaugcucuuuuuuacu

SEQ ID NO: 3817445 - RNA, 24 nt, Human
aguuuuaugcucuuuuuuacucau

SEQ ID NO: 3817446 - RNA, 23 nt, Human
aguuuuauuaauaaacauucuau

SEQ ID NO: 3817447 - RNA, 18 nt, Human
aguuuuauuuauauuuau

SEQ ID NO: 3817448 - RNA, 23 nt, Human
aguuuuauuuauauuuauugacu

SEQ ID NO: 3817449 - RNA, 13 nt, Human
aguuuuauuuucu

SEQ ID NO: 3817450 - RNA, 21 nt, Human
aguuuucaagucaaauuaaua

SEQ ID NO: 3817451 - RNA, 16 nt, Human
aguuuucagaaccucu

SEQ ID NO: 3817452 - RNA, 21 nt, Human
aguuuucagaaccucuucccc

SEQ ID NO: 3817453 - RNA, 22 nt, Human
aguuuucagaaccucuucccca

SEQ ID NO: 3817454 - RNA, 17 nt, Human
aguuuucaguuuguaua

SEQ ID NO: 3817455 - RNA, 14 nt, Human
aguuuucaugugcu

SEQ ID NO: 3817456 - RNA, 15 nt, Human
aguuuucauuaaauc

SEQ ID NO: 3817457 - RNA, 21 nt, Human
aguuuuccaugaaaacguuuu

SEQ ID NO: 3817458 - RNA, 22 nt, Human
aguuuuccauggcaggaaggcu

SEQ ID NO: 3817459 - RNA, 21 nt, Human
aguuuuccauggucacagaga

SEQ ID NO: 3817460 - RNA, 16 nt, Human
aguuuucccugaaguu

SEQ ID NO: 3817461 - RNA, 18 nt, Human
aguuuucccuugaggaaa

SEQ ID NO: 3817462 - RNA, 23 nt, Human
auaauuuccauuuacuuaagacu

SEQ ID NO: 3817463 - RNA, 18 nt, Human
auaauuucccaauuagga

SEQ ID NO: 3817464 - RNA, 21 nt, Human
auaauuucccaauuaggaagu

SEQ ID NO: 3817465 - RNA, 13 nt, Human
auaauuucgagau

SEQ ID NO: 3817466 - RNA, 22 nt, Human
auaauuuguacauauguaaaau

SEQ ID NO: 3817467 - RNA, 15 nt, Human
auaauuuuaagaaau

SEQ ID NO: 3817468 - RNA, 21 nt, Human
auaauuuuaagaaaucaaaga

SEQ ID NO: 3817469 - RNA, 21 nt, Human
auaauuuuagugucauuucca

SEQ ID NO: 3817470 - RNA, 13 nt, Human
auaauuuuaugaa

SEQ ID NO: 3817471 - RNA, 12 nt, Human
auaauuuuguaa

SEQ ID NO: 3817472 - RNA, 13 nt, Human
auaauuuuguaau

SEQ ID NO: 3817473 - RNA, 23 nt, Human
auaauuuuuaaaguauauauuua

SEQ ID NO: 3817474 - RNA, 14 nt, Human
auaauuuuuauaug

SEQ ID NO: 3817475 - RNA, 16 nt, Human
auaauuuuuauauuug

SEQ ID NO: 3817476 - RNA, 19 nt, Human
auaauuuuuauauuugaaa

SEQ ID NO: 3817477 - RNA, 22 nt, Human
auaauuuuuuuuaaaauagaaa

SEQ ID NO: 3817478 - RNA, 22 nt, Human
auacaaaaaaaaaaaaaaauua

SEQ ID NO: 3817479 - RNA, 15 nt, Human
auacaaaagcaugug

SEQ ID NO: 3817480 - RNA, 22 nt, Human
auacaaacaauggaaacugaau

SEQ ID NO: 3817481 - RNA, 14 nt, Human
auacaaauauauug

SEQ ID NO: 3817482 - RNA, 20 nt, Human
auacaaauggauuuugggag

SEQ ID NO: 3817483 - RNA, 16 nt, Human
auacaaauuaaaaaga

SEQ ID NO: 3817484 - RNA, 14 nt, Human
auacaaauuagaaa

SEQ ID NO: 3817485 - RNA, 15 nt, Human
auacaaauuagaaaa

SEQ ID NO: 3817486 - RNA, 19 nt, Human
auacaacaaaggcaaguua

SEQ ID NO: 3817487 - RNA, 12 nt, Human
auacaacagugc

SEQ ID NO: 3817488 - RNA, 16 nt, Human
auacaacagugcuaaa

SEQ ID NO: 3817489 - RNA, 21 nt, Human
auacaacagugcuaaaaaugg

SEQ ID NO: 3817490 - RNA, 16 nt, Human
auacaaccucccucuu

SEQ ID NO: 3817491 - RNA, 18 nt, Human
auacaaccucccucuugu

SEQ ID NO: 3817492 - RNA, 21 nt, Human
auacaaccucccucuuguuuu

SEQ ID NO: 3817493 - RNA, 16 nt, Human
auacaacuuaaauaau

SEQ ID NO: 3817494 - RNA, 12 nt, Human
auacaagacugc

SEQ ID NO: 3817495 - RNA, 12 nt, Human
auacaagauaag

SEQ ID NO: 3817496 - RNA, 17 nt, Human
auacaagauugaaaauc

SEQ ID NO: 3817497 - RNA, 22 nt, Human
auacaagccauucuaaggaaau

SEQ ID NO: 3817498 - RNA, 12 nt, Human
auacaagguaua

SEQ ID NO: 3817499 - RNA, 17 nt, Human
auacaaguucuauuuaa

SEQ ID NO: 3817500 - RNA, 15 nt, Human
auacaaguuuucaua

SEQ ID NO: 3817501 - RNA, 20 nt, Human
auacaauaaacuauuggaaa

SEQ ID NO: 3817502 - RNA, 17 nt, Human
auacaauaaauugcuaa

SEQ ID NO: 3817503 - RNA, 14 nt, Human
auacaauaacauaa

SEQ ID NO: 3817504 - RNA, 18 nt, Human
auacaauaauggaaaaaa

SEQ ID NO: 3817505 - RNA, 13 nt, Human
auacaauauauaa

SEQ ID NO: 3817506 - RNA, 20 nt, Human
auacaauauauaaaaauaua

SEQ ID NO: 3817507 - RNA, 12 nt, Human
auacaaucagcu

SEQ ID NO: 3817508 - RNA, 14 nt, Human
auacaaucagcugc

SEQ ID NO: 3817509 - RNA, 15 nt, Human
auacaaucagcugcu

SEQ ID NO: 3817510 - RNA, 16 nt, Human
auacaaucagcugcuu

SEQ ID NO: 3817511 - RNA, 17 nt, Human
auacaaugaacacuuau

SEQ ID NO: 3817512 - RNA, 16 nt, Human
auacaaugacaaguau

SEQ ID NO: 3817513 - RNA, 23 nt, Human
auacaaugcugugcccuaaagug

SEQ ID NO: 3817514 - RNA, 20 nt, Human
auacaauguauuuauuuaaa

SEQ ID NO: 3817515 - RNA, 17 nt, Human
auacaauuuuuuuuauu

SEQ ID NO: 3817516 - RNA, 18 nt, Human
auacacaaaaucaaauaa

SEQ ID NO: 3817517 - RNA, 11 nt, Human
auacacaaauu

SEQ ID NO: 3817518 - RNA, 15 nt, Human
auacacaaguaaaca

SEQ ID NO: 3817519 - RNA, 19 nt, Human
auacacacacaaagagagu

SEQ ID NO: 3817520 - RNA, 15 nt, Human
auacacacacacaca

SEQ ID NO: 3817521 - RNA, 16 nt, Human
auacacacacacacac

SEQ ID NO: 3817522 - RNA, 11 nt, Human
auacacacgcu

SEQ ID NO: 3817523 - RNA, 15 nt, Human
auacacacgcugccu

SEQ ID NO: 3817524 - RNA, 14 nt, Human
auacacauauaccu

SEQ ID NO: 3817525 - RNA, 20 nt, Human
auacaccacuacauucuguu

SEQ ID NO: 3817526 - RNA, 23 nt, Human
auacacccccucuucugagcaca

SEQ ID NO: 3817527 - RNA, 19 nt, Human
auacacgaauagacaucaa

SEQ ID NO: 3817528 - RNA, 19 nt, Human
auacacuaaccaaaucucu

SEQ ID NO: 3817529 - RNA, 21 nt, Human
auacacugaaguuaacagaga

SEQ ID NO: 3817530 - RNA, 17 nt, Human
auacacuguguaaauac

SEQ ID NO: 3817531 - RNA, 22 nt, Human
auacacuuacacuuuaugcaca

SEQ ID NO: 3817532 - RNA, 22 nt, Human
auacacuuauuggaacucugcu

SEQ ID NO: 3817533 - RNA, 15 nt, Human
auacacuuguauaaa

SEQ ID NO: 3817534 - RNA, 22 nt, Human
auacacuuguauaaauguauau

SEQ ID NO: 3817535 - RNA, 14 nt, Human
auacagagaaguca

SEQ ID NO: 3817536 - RNA, 14 nt, Human
auacagauaacauu

SEQ ID NO: 3817537 - RNA, 23 nt, Human
auacagauagauauaugcucugc

SEQ ID NO: 3817538 - RNA, 13 nt, Human
auacagauauauu

SEQ ID NO: 3817539 - RNA, 14 nt, Human
auacagaugaaaau

SEQ ID NO: 3817540 - RNA, 15 nt, Human
auacagaugaaaauu

SEQ ID NO: 3817541 - RNA, 20 nt, Human
auacagaugaaaauuugaga

SEQ ID NO: 3817542 - RNA, 16 nt, Human
auacagauuuugauag

SEQ ID NO: 3817543 - RNA, 14 nt, Human
auacagcagcaaga

SEQ ID NO: 3817544 - RNA, 15 nt, Human
auacagcagcaagaa

SEQ ID NO: 3817545 - RNA, 15 nt, Human
auacagcaguagaca

SEQ ID NO: 3817546 - RNA, 17 nt, Human
auacagcaguagacauu

SEQ ID NO: 3817547 - RNA, 19 nt, Human
auacagcuuucugaccuuc

SEQ ID NO: 3817548 - RNA, 14 nt, Human
auacaggaaaagcu

SEQ ID NO: 3817549 - RNA, 21 nt, Human
auacaggauuugaacucagau

SEQ ID NO: 3817550 - RNA, 16 nt, Human
auacaggggaauauuu

SEQ ID NO: 3817551 - RNA, 19 nt, Human
auacaggggaauauuuuau

SEQ ID NO: 3817552 - RNA, 18 nt, Human
auacaguaacuuuaugug

SEQ ID NO: 3817553 - RNA, 19 nt, Human
auacaguaacuuuaugugu

SEQ ID NO: 3817554 - RNA, 20 nt, Human
auacaguaacuuuaugugua

SEQ ID NO: 3817555 - RNA, 18 nt, Human
auacaguauaaaaauaga

SEQ ID NO: 3817556 - RNA, 15 nt, Human
auacaguauucugua

SEQ ID NO: 3817557 - RNA, 15 nt, Human
auacagucaacaagc

SEQ ID NO: 3817558 - RNA, 12 nt, Human
auagugacuuuu

SEQ ID NO: 3817559 - RNA, 17 nt, Human
auagugacuuuucaagu

SEQ ID NO: 3817560 - RNA, 21 nt, Human
auagugacuuuucaaguauuu

SEQ ID NO: 3817561 - RNA, 13 nt, Human
auagugcaauaua

SEQ ID NO: 3817562 - RNA, 17 nt, Human
auagugcacaaaaugaa

SEQ ID NO: 3817563 - RNA, 22 nt, Human
auagugcauuguuucugugggc

SEQ ID NO: 3817564 - RNA, 22 nt, Human
auagugcuaacaugaagaccuu

SEQ ID NO: 3817565 - RNA, 14 nt, Human
auagugcuauauau

SEQ ID NO: 3817566 - RNA, 20 nt, Human
auagugcuauauauauaaau

SEQ ID NO: 3817567 - RNA, 22 nt, Human
auagugcuauauauauaaauau

SEQ ID NO: 3817568 - RNA, 15 nt, Human
auaguggaaaaacac

SEQ ID NO: 3817569 - RNA, 21 nt, Human
auaguggccagaccagagcuc

SEQ ID NO: 3817570 - RNA, 22 nt, Human
auagugggcccuccgacagccc

SEQ ID NO: 3817571 - RNA, 14 nt, Human
auaguguaaaauaa

SEQ ID NO: 3817572 - RNA, 14 nt, Human
auaguguaacuugc

SEQ ID NO: 3817573 - RNA, 14 nt, Human
auagugugaaauau

SEQ ID NO: 3817574 - RNA, 15 nt, Human
auagugugaaauaua

SEQ ID NO: 3817575 - RNA, 13 nt, Human
auaguguguucug

SEQ ID NO: 3817576 - RNA, 14 nt, Human
auaguguguucuga

SEQ ID NO: 3817577 - RNA, 21 nt, Human
auaguguguucugauuagaaa

SEQ ID NO: 3817578 - RNA, 12 nt, Human
auaguguuaauc

SEQ ID NO: 3817579 - RNA, 18 nt, Human
auaguguuaaucaauuua

SEQ ID NO: 3817580 - RNA, 15 nt, Human
auaguuaacacacua

SEQ ID NO: 3817581 - RNA, 22 nt, Human
auaguuaagcgugcauaaguua

SEQ ID NO: 3817582 - RNA, 14 nt, Human
auaguuaauauagu

SEQ ID NO: 3817583 - RNA, 13 nt, Human
auaguuacuguaa

SEQ ID NO: 3817584 - RNA, 20 nt, Human
auaguuacuguguaaacuca

SEQ ID NO: 3817585 - RNA, 20 nt, Human
auaguuacuguguaauuagu

SEQ ID NO: 3817586 - RNA, 15 nt, Human
auaguuagaaccugg

SEQ ID NO: 3817587 - RNA, 15 nt, Human
auaguucaaggaacu

SEQ ID NO: 3817588 - RNA, 14 nt, Human
auaguucacccccu

SEQ ID NO: 3817589 - RNA, 18 nt, Human
auaguucuagugcagcug

SEQ ID NO: 3817590 - RNA, 21 nt, Human
auaguugaaccuauuucucuu

SEQ ID NO: 3817591 - RNA, 23 nt, Human
auaguugagccagcagacauugu

SEQ ID NO: 3817592 - RNA, 16 nt, Human
auaguuggucaucuag

SEQ ID NO: 3817593 - RNA, 20 nt, Human
auaguuguaccgcaauguga

SEQ ID NO: 3817594 - RNA, 17 nt, Human
auaguuguggacauuua

SEQ ID NO: 3817595 - RNA, 13 nt, Human
auaguuuaaaaca

SEQ ID NO: 3817596 - RNA, 17 nt, Human
auaguuuaccugaauaa

SEQ ID NO: 3817597 - RNA, 22 nt, Human
auaguuuacuauuuuacuucua

SEQ ID NO: 3817598 - RNA, 14 nt, Human
auaguuuauugaca

SEQ ID NO: 3817599 - RNA, 14 nt, Human
auaguuucagauau

SEQ ID NO: 3817600 - RNA, 19 nt, Human
auaguuuggauauguaaaa

SEQ ID NO: 3817601 - RNA, 12 nt, Human
auaguuuggcau

SEQ ID NO: 3817602 - RNA, 17 nt, Human
auaguuuuaaacucauu

SEQ ID NO: 3817603 - RNA, 24 nt, Human
auaguuuuauuuauauuuauugac

SEQ ID NO: 3817604 - RNA, 13 nt, Human
auaguuuucaucc

SEQ ID NO: 3817605 - RNA, 22 nt, Human
auaguuuucauccauaacugaa

SEQ ID NO: 3817606 - RNA, 14 nt, Human
auauaaaaacaaaa

SEQ ID NO: 3817607 - RNA, 23 nt, Human
auauaaaaaccccaaacuguuga

SEQ ID NO: 3817608 - RNA, 17 nt, Human
auauaaaaagaaaagau

SEQ ID NO: 3817609 - RNA, 14 nt, Human
auauaaaaauauau

SEQ ID NO: 3817610 - RNA, 17 nt, Human
auauaaaacaaauaaaa

SEQ ID NO: 3817611 - RNA, 22 nt, Human
auauaaaacugcguuaaaggcu

SEQ ID NO: 3817612 - RNA, 22 nt, Human
auauaaaacuguacuucacugu

SEQ ID NO: 3817613 - RNA, 21 nt, Human
auauaaaaggcaaauguguac

SEQ ID NO: 3817614 - RNA, 23 nt, Human
auauaaaaggcaaauguguacau

SEQ ID NO: 3817615 - RNA, 16 nt, Human
auauaaaauaaauaua

SEQ ID NO: 3817616 - RNA, 14 nt, Human
auauaaaauaguug

SEQ ID NO: 3817617 - RNA, 13 nt, Human
auauaaaauauuu

SEQ ID NO: 3817618 - RNA, 12 nt, Human
auauaaaaugcc

SEQ ID NO: 3817619 - RNA, 15 nt, Human
auauaaaaugccaag

SEQ ID NO: 3817620 - RNA, 13 nt, Human
auauaaaaugugc

SEQ ID NO: 3817621 - RNA, 19 nt, Human
auauaaaccuaaaaaagau

SEQ ID NO: 3817622 - RNA, 18 nt, Human
auauaaagaauauauaua

SEQ ID NO: 3817623 - RNA, 18 nt, Human
auauaaagaccuauaaau

SEQ ID NO: 3817624 - RNA, 20 nt, Human
auauaaagacguuuuauaag

SEQ ID NO: 3817625 - RNA, 22 nt, Human
auauaaagacguuuuauaagca

SEQ ID NO: 3817626 - RNA, 18 nt, Human
auauaaagagaaaauuga

SEQ ID NO: 3817627 - RNA, 19 nt, Human
auauaaagagaaaauugaa

SEQ ID NO: 3817628 - RNA, 20 nt, Human
auauaaagggggagggaaau

SEQ ID NO: 3817629 - RNA, 21 nt, Human
auauaaagggggagggaaaua

SEQ ID NO: 3817630 - RNA, 14 nt, Human
auauaaaguauaga

SEQ ID NO: 3817631 - RNA, 24 nt, Human
auauaaaguaucaucaguguagaa

SEQ ID NO: 3817632 - RNA, 15 nt, Human
auauaaauaaaacau

SEQ ID NO: 3817633 - RNA, 14 nt, Human
auauaaauaaauau

SEQ ID NO: 3817634 - RNA, 15 nt, Human
auauaaauaaauaua

SEQ ID NO: 3817635 - RNA, 22 nt, Human
auauaaauaaauauauauaucc

SEQ ID NO: 3817636 - RNA, 11 nt, Human
auauaaauaua

SEQ ID NO: 3817637 - RNA, 15 nt, Human
auauaaauauauaua

SEQ ID NO: 3817638 - RNA, 20 nt, Human
auauaaauauauauaaauau

SEQ ID NO: 3817639 - RNA, 21 nt, Human
auauaaauauauauaaauaua

SEQ ID NO: 3817640 - RNA, 23 nt, Human
auauaaauauauauauauauaaa

SEQ ID NO: 3817641 - RNA, 18 nt, Human
auauaaaugcaaauaaca

SEQ ID NO: 3817642 - RNA, 22 nt, Human
auauaaaugcaauauuaaugcc

SEQ ID NO: 3817643 - RNA, 23 nt, Human
auauaaauggcugguuuuuagaa

SEQ ID NO: 3817644 - RNA, 14 nt, Human
auauaaaugugugu

SEQ ID NO: 3817645 - RNA, 22 nt, Human
auauaaauucacuuucauuuuu

SEQ ID NO: 3817646 - RNA, 15 nt, Human
auauaaauucugugg

SEQ ID NO: 3817647 - RNA, 13 nt, Human
auauaacauauau

SEQ ID NO: 3817648 - RNA, 18 nt, Human
auauaacaugaaaugaua

SEQ ID NO: 3817649 - RNA, 20 nt, Human
auauaacaugaaaugauaga

SEQ ID NO: 3817650 - RNA, 16 nt, Human
auauaacuuauauugu

SEQ ID NO: 3817651 - RNA, 21 nt, Human
auauaacuuauauuguaagaa

SEQ ID NO: 3817652 - RNA, 22 nt, Human
auauaacuuauauuguaagaaa

SEQ ID NO: 3817653 - RNA, 14 nt, Human
auauaacuuuagaa

SEQ ID NO: 3817654 - RNA, 18 nt, Human
auauaagaaagacaucuu

SEQ ID NO: 3817655 - RNA, 14 nt, Human
auauaagauuuucu

SEQ ID NO: 3817656 - RNA, 12 nt, Human
auauaagcuuuu

SEQ ID NO: 3817657 - RNA, 14 nt, Human
auauaagggaagua

SEQ ID NO: 3817658 - RNA, 13 nt, Human
auauaagguuuuu

SEQ ID NO: 3817659 - RNA, 17 nt, Human
auauaaguauucuaaau

SEQ ID NO: 3817660 - RNA, 13 nt, Human
auauaagugcugu

SEQ ID NO: 3817661 - RNA, 14 nt, Human
auauaaguguacau

SEQ ID NO: 3817662 - RNA, 13 nt, Human
aggaaagucauug

SEQ ID NO: 3817663 - RNA, 19 nt, Human
aggaaagucauuggcuuua

SEQ ID NO: 3817664 - RNA, 22 nt, Human
aggaaagucauuggcuuuaucc

SEQ ID NO: 3817665 - RNA, 22 nt, Human
aggaaaguggcaccugucugcu

SEQ ID NO: 3817666 - RNA, 22 nt, Human
aggaaaguucagaguuuucugg

SEQ ID NO: 3817667 - RNA, 20 nt, Human
aggaaaguuucuuugaaaau

SEQ ID NO: 3817668 - RNA, 17 nt, Human
aggaaauaaaaccuuuc

SEQ ID NO: 3817669 - RNA, 22 nt, Human
aggaaauaaaaccuuucaaauu

SEQ ID NO: 3817670 - RNA, 20 nt, Human
aggaaauaagaaaaaucaug

SEQ ID NO: 3817671 - RNA, 15 nt, Human
aggaaauauacuuuu

SEQ ID NO: 3817672 - RNA, 18 nt, Human
aggaaauauuuauuuuaa

SEQ ID NO: 3817673 - RNA, 15 nt, Human
aggaaaucaccgaaa

SEQ ID NO: 3817674 - RNA, 19 nt, Human
aggaaaucaccgaaaacgu

SEQ ID NO: 3817675 - RNA, 16 nt, Human
aggaaaucucacccca

SEQ ID NO: 3817676 - RNA, 13 nt, Human
aggaaaugaaugu

SEQ ID NO: 3817677 - RNA, 14 nt, Human
aggaaaugaaugug

SEQ ID NO: 3817678 - RNA, 23 nt, Human
aggaaaugguauccagaauggaa

SEQ ID NO: 3817679 - RNA, 23 nt, Human
aggaaaugugguagccucacuuu

SEQ ID NO: 3817680 - RNA, 22 nt, Human
aggaaauguuuuuaauaaaaga

SEQ ID NO: 3817681 - RNA, 23 nt, Human
aggaaauugagauuagagggagg

SEQ ID NO: 3817682 - RNA, 14 nt, Human
aggaaauuugcagc

SEQ ID NO: 3817683 - RNA, 15 nt, Human
aggaacaaaaaaacc

SEQ ID NO: 3817684 - RNA, 18 nt, Human
aggaacaaaaaaaccaca

SEQ ID NO: 3817685 - RNA, 13 nt, Human
aggaacaaacagg

SEQ ID NO: 3817686 - RNA, 14 nt, Human
aggaacaaacaggg

SEQ ID NO: 3817687 - RNA, 14 nt, Human
aggaacaaaucuuc

SEQ ID NO: 3817688 - RNA, 16 nt, Human
aggaacaaaucuuccu

SEQ ID NO: 3817689 - RNA, 12 nt, Human
aggaacaaggca

SEQ ID NO: 3817690 - RNA, 19 nt, Human
aggaacaaggcaaggcugu

SEQ ID NO: 3817691 - RNA, 17 nt, Human
aggaacaaucggcugca

SEQ ID NO: 3817692 - RNA, 12 nt, Human
aggaacacuccu

SEQ ID NO: 3817693 - RNA, 15 nt, Human
aggaacacuccuuca

SEQ ID NO: 3817694 - RNA, 16 nt, Human
aggaacauaugaaaau

SEQ ID NO: 3817695 - RNA, 15 nt, Human
aggaaccaaagcgaa

SEQ ID NO: 3817696 - RNA, 21 nt, Human
aggaaccaacaaucuuccugu

SEQ ID NO: 3817697 - RNA, 17 nt, Human
aggaaccacaccacauc

SEQ ID NO: 3817698 - RNA, 16 nt, Human
aggaaccgaggcaggg

SEQ ID NO: 3817699 - RNA, 19 nt, Human
aggaaccuccuccacacca

SEQ ID NO: 3817700 - RNA, 16 nt, Human
aggaaccucgaguacu

SEQ ID NO: 3817701 - RNA, 18 nt, Human
aggaaccucugauuuauu

SEQ ID NO: 3817702 - RNA, 22 nt, Human
aggaaccucugauuuauuuugu

SEQ ID NO: 3817703 - RNA, 22 nt, Human
auacacacacacacacagccac

SEQ ID NO: 3817704 - RNA, 14 nt, Human
auacacacauaugu

SEQ ID NO: 3817705 - RNA, 16 nt, Human
auacacacgcugccuu

SEQ ID NO: 3817706 - RNA, 10 nt, Human
auacacauaa

SEQ ID NO: 3817707 - RNA, 12 nt, Human
auacacauaauu

SEQ ID NO: 3817708 - RNA, 22 nt, Human
auacacauaauuaaagugucca

SEQ ID NO: 3817709 - RNA, 23 nt, Human
auacacauaauuaaaguguccau

SEQ ID NO: 3817710 - RNA, 22 nt, Human
auacacauuugcuacuguugua

SEQ ID NO: 3817711 - RNA, 16 nt, Human
auacaccaauugauuu

SEQ ID NO: 3817712 - RNA, 15 nt, Human
auacaccacuacauu

SEQ ID NO: 3817713 - RNA, 17 nt, Human
auacaccacuacauucu

SEQ ID NO: 3817714 - RNA, 18 nt, Human
auacaccacuacauucug

SEQ ID NO: 3817715 - RNA, 24 nt, Human
auacacccaagaugggcaucuuuu

SEQ ID NO: 3817716 - RNA, 14 nt, Human
auacaccgggccug

SEQ ID NO: 3817717 - RNA, 21 nt, Human
auacaccucaacuaaauccaa

SEQ ID NO: 3817718 - RNA, 15 nt, Human
auacacgaaagagag

SEQ ID NO: 3817719 - RNA, 20 nt, Human
auacacgaauagacaucaaa

SEQ ID NO: 3817720 - RNA, 18 nt, Human
auacacuguguaaauacc

SEQ ID NO: 3817721 - RNA, 16 nt, Human
auacacuugcccugcu

SEQ ID NO: 3817722 - RNA, 21 nt, Human
auacacuuggaguuugcauuc

SEQ ID NO: 3817723 - RNA, 22 nt, Human
auacacuuggggagauuugcca

SEQ ID NO: 3817724 - RNA, 15 nt, Human
auacacuuuguugca

SEQ ID NO: 3817725 - RNA, 21 nt, Human
auacacuuuguugcaagaugu

SEQ ID NO: 3817726 - RNA, 23 nt, Human
auacacuuuguugcaagauguga

SEQ ID NO: 3817727 - RNA, 23 nt, Human
auacacuuuuucucuuuccauga

SEQ ID NO: 3817728 - RNA, 14 nt, Human
auacagaacucuuu

SEQ ID NO: 3817729 - RNA, 16 nt, Human
auacagaacucuuuca

SEQ ID NO: 3817730 - RNA, 18 nt, Human
auacagaaucuuguuuug

SEQ ID NO: 3817731 - RNA, 20 nt, Human
auacagaauuacuguaacug

SEQ ID NO: 3817732 - RNA, 12 nt, Human
auacagacacua

SEQ ID NO: 3817733 - RNA, 15 nt, Human
auacagacacuaagu

SEQ ID NO: 3817734 - RNA, 18 nt, Human
auacagacacuaaguuau

SEQ ID NO: 3817735 - RNA, 18 nt, Human
auacagaccgaacuguug

SEQ ID NO: 3817736 - RNA, 15 nt, Human
auacagagaagucac

SEQ ID NO: 3817737 - RNA, 16 nt, Human
auacagaggcaacugc

SEQ ID NO: 3817738 - RNA, 18 nt, Human
auacagauaaaugauuca

SEQ ID NO: 3817739 - RNA, 15 nt, Human
auacagauaacauua

SEQ ID NO: 3817740 - RNA, 14 nt, Human
auacagauauauuu

SEQ ID NO: 3817741 - RNA, 17 nt, Human
auacagaucaucuugga

SEQ ID NO: 3817742 - RNA, 14 nt, Human
auacagauuuugau

SEQ ID NO: 3817743 - RNA, 18 nt, Human
auacagauuuugauagca

SEQ ID NO: 3817744 - RNA, 23 nt, Human
auacagcaaaccuaauugcacaa

SEQ ID NO: 3817745 - RNA, 16 nt, Human
auacagcaacaauuua

SEQ ID NO: 3817746 - RNA, 22 nt, Human
auacagcagagcuagguggaaa

SEQ ID NO: 3817747 - RNA, 17 nt, Human
auacagcagcaagaaaa

SEQ ID NO: 3817748 - RNA, 19 nt, Human
auacagcagcaagaaaaaa

SEQ ID NO: 3817749 - RNA, 20 nt, Human
auacagcccucccccagcag

SEQ ID NO: 3817750 - RNA, 12 nt, Human
auacagcuguau

SEQ ID NO: 3817751 - RNA, 20 nt, Human
auacaggaaaagcugcugac

SEQ ID NO: 3817752 - RNA, 17 nt, Human
auacaggagauucucuu

SEQ ID NO: 3817753 - RNA, 18 nt, Human
auacagggaugguguuca

SEQ ID NO: 3817754 - RNA, 21 nt, Human
auacagggcaugcauuuugca

SEQ ID NO: 3817755 - RNA, 20 nt, Human
auacaggggaauauuuuauu

SEQ ID NO: 3817756 - RNA, 19 nt, Human
auacaguacaggcagcaca

SEQ ID NO: 3817757 - RNA, 16 nt, Human
auacaguacagugguu

SEQ ID NO: 3817758 - RNA, 10 nt, Human
auacaguagu

SEQ ID NO: 3817759 - RNA, 17 nt, Human
auacaguagugagaaga

SEQ ID NO: 3817760 - RNA, 17 nt, Human
auacagucuuccacaaa

SEQ ID NO: 3817761 - RNA, 18 nt, Human
auacagucuuccacaaag

SEQ ID NO: 3817762 - RNA, 21 nt, Human
auacagucuuccacaaagaaa

SEQ ID NO: 3817763 - RNA, 19 nt, Human
auacagucuuccauuugca

SEQ ID NO: 3817764 - RNA, 15 nt, Human
auacaguguuauuuu

SEQ ID NO: 3817765 - RNA, 15 nt, Human
auacaguuauaaaau

SEQ ID NO: 3817766 - RNA, 18 nt, Human
auacaguuauaaaauuaa

SEQ ID NO: 3817767 - RNA, 19 nt, Human
auacaguucaauaaacuua

SEQ ID NO: 3817768 - RNA, 21 nt, Human
auacaguucugcucugguugu

SEQ ID NO: 3817769 - RNA, 16 nt, Human
auacaguuguuggccu

SEQ ID NO: 3817770 - RNA, 16 nt, Human
auacaguuuuaaagaa

SEQ ID NO: 3817771 - RNA, 13 nt, Human
auacaguuuuaug

SEQ ID NO: 3817772 - RNA, 14 nt, Human
auacaguuuuaugc

SEQ ID NO: 3817773 - RNA, 21 nt, Human
auacaguuuuccuaaauguau

SEQ ID NO: 3817774 - RNA, 14 nt, Human
auacauaaaagaaa

SEQ ID NO: 3817775 - RNA, 16 nt, Human
auacauaaaagaaaua

SEQ ID NO: 3817776 - RNA, 18 nt, Human
auacauaaaagaaauaaa

SEQ ID NO: 3817777 - RNA, 20 nt, Human
auacauaaacaagaccacgu

SEQ ID NO: 3817778 - RNA, 14 nt, Human
auacauaaagacua

SEQ ID NO: 3817779 - RNA, 12 nt, Human
auacauaacagg

SEQ ID NO: 3817780 - RNA, 15 nt, Human
auacauaacuaaauu

SEQ ID NO: 3817781 - RNA, 13 nt, Human
auacauaauaaaa

SEQ ID NO: 3817782 - RNA, 14 nt, Human
auacauacacuugu

SEQ ID NO: 3817783 - RNA, 22 nt, Human
auacauacggucagguuuaaca

SEQ ID NO: 3817784 - RNA, 20 nt, Human
auacauacuuacaugugugu

SEQ ID NO: 3817785 - RNA, 15 nt, Human
auacauagugaaaau

SEQ ID NO: 3817786 - RNA, 16 nt, Human
auacauagugaaaauu

SEQ ID NO: 3817787 - RNA, 18 nt, Human
auacauagugaaaauugu

SEQ ID NO: 3817788 - RNA, 13 nt, Human
auacauauauaua

SEQ ID NO: 3817789 - RNA, 20 nt, Human
auacauauauauauauaaca

SEQ ID NO: 3817790 - RNA, 21 nt, Human
auacauaucgcugacuucaug

SEQ ID NO: 3817791 - RNA, 17 nt, Human
auacauaucuuuauuaa

SEQ ID NO: 3817792 - RNA, 20 nt, Human
auacauaucuuuauuaauca

SEQ ID NO: 3817793 - RNA, 19 nt, Human
auacauauuuuuguagcac

SEQ ID NO: 3817794 - RNA, 15 nt, Human
auacaucacugcuug

SEQ ID NO: 3817795 - RNA, 19 nt, Human
auacaucacugcuugauga

SEQ ID NO: 3817796 - RNA, 14 nt, Human
auacauccugggua

SEQ ID NO: 3817797 - RNA, 22 nt, Human
auacaugaagaauagaaacaag

SEQ ID NO: 3817798 - RNA, 13 nt, Human
auacaugaagcuu

SEQ ID NO: 3817799 - RNA, 14 nt, Human
auacaugacacuga

SEQ ID NO: 3817800 - RNA, 19 nt, Human
auacaugacacugaaaugc

SEQ ID NO: 3817801 - RNA, 16 nt, Human
auacaugaugauuuca

SEQ ID NO: 3817802 - RNA, 13 nt, Human
auacaugcauaua

SEQ ID NO: 3817803 - RNA, 21 nt, Human
auacaugcauauaaugaauaa

SEQ ID NO: 3817804 - RNA, 10 nt, Human
auacaugcca

SEQ ID NO: 3817805 - RNA, 21 nt, Human
auacaugccacaucaaaccuu

SEQ ID NO: 3817806 - RNA, 22 nt, Human
auacaugcuaagagaaguagaa

SEQ ID NO: 3817807 - RNA, 15 nt, Human
auacaugcucuuaga

SEQ ID NO: 3817808 - RNA, 14 nt, Human
auacaugguuguga

SEQ ID NO: 3817809 - RNA, 22 nt, Human
auacauguuuauguaaacaaau

SEQ ID NO: 3817810 - RNA, 14 nt, Human
auacauuaguaaau

SEQ ID NO: 3817811 - RNA, 17 nt, Human
auacauuaguaaauguc

SEQ ID NO: 3817812 - RNA, 19 nt, Human
auacauuaguaaaugucuu

SEQ ID NO: 3817813 - RNA, 23 nt, Human
auacauuaguaaaugucuuugua

SEQ ID NO: 3817814 - RNA, 15 nt, Human
auacauuauauuucu

SEQ ID NO: 3817815 - RNA, 16 nt, Human
auacauucaaauuugu

SEQ ID NO: 3817816 - RNA, 17 nt, Human
auacauucuguaauaca

SEQ ID NO: 3817817 - RNA, 15 nt, Human
auacauugaauuaga

SEQ ID NO: 3817818 - RNA, 16 nt, Human
auacauugucucuaaa

SEQ ID NO: 3817819 - RNA, 16 nt, Human
auacauuuaaaacauu

SEQ ID NO: 3817820 - RNA, 14 nt, Human
auacauuuaaaacu

SEQ ID NO: 3817821 - RNA, 15 nt, Human
auacauuuauaaugu

SEQ ID NO: 3817822 - RNA, 21 nt, Human
auacauuucuccuuugauaaa

SEQ ID NO: 3817823 - RNA, 16 nt, Human
auacauuugauaaagu

SEQ ID NO: 3817824 - RNA, 16 nt, Human
auacauuuuguaccaa

SEQ ID NO: 3817825 - RNA, 15 nt, Human
auaccaaaauguugc

SEQ ID NO: 3817826 - RNA, 20 nt, Human
auaccaaaauuauuucagaa

SEQ ID NO: 3817827 - RNA, 16 nt, Human
aggaauagaagcaaau

SEQ ID NO: 3817828 - RNA, 15 nt, Human
aggaauauuuuccaa

SEQ ID NO: 3817829 - RNA, 17 nt, Human
aggaaucaaaaauugaa

SEQ ID NO: 3817830 - RNA, 20 nt, Human
aggaaucaagagcugcccuc

SEQ ID NO: 3817831 - RNA, 23 nt, Human
aggaaucaugucaggccugugug

SEQ ID NO: 3817832 - RNA, 17 nt, Human
aggaaucauucagaaau

SEQ ID NO: 3817833 - RNA, 19 nt, Human
aggaauccuggcagcccag

SEQ ID NO: 3817834 - RNA, 20 nt, Human
aggaaucgaggaaccagagc

SEQ ID NO: 3817835 - RNA, 15 nt, Human
aggaaugauauugcu

SEQ ID NO: 3817836 - RNA, 19 nt, Human
aggaaugcacauggaauau

SEQ ID NO: 3817837 - RNA, 13 nt, Human
aggaaugcuaaca

SEQ ID NO: 3817838 - RNA, 20 nt, Human
aggaaugcuaacaguucacu

SEQ ID NO: 3817839 - RNA, 13 nt, Human
aggaaugcucccc

SEQ ID NO: 3817840 - RNA, 14 nt, Human
aggaauggaagucc

SEQ ID NO: 3817841 - RNA, 23 nt, Human
aggaauggagccugcacggugaa

SEQ ID NO: 3817842 - RNA, 22 nt, Human
aggaauggaggccauauuucca

SEQ ID NO: 3817843 - RNA, 18 nt, Human
aggaauggaggcucuaau

SEQ ID NO: 3817844 - RNA, 20 nt, Human
aggaauggaggcucuaauug

SEQ ID NO: 3817845 - RNA, 21 nt, Human
aggaauuaccaagaauauccu

SEQ ID NO: 3817846 - RNA, 15 nt, Human
aggaauucuguauag

SEQ ID NO: 3817847 - RNA, 16 nt, Human
aggaauucuguauaga

SEQ ID NO: 3817848 - RNA, 17 nt, Human
auauaugccuuuuuccu

SEQ ID NO: 3817849 - RNA, 13 nt, Human
auauauguacagu

SEQ ID NO: 3817850 - RNA, 14 nt, Human
auauauguacaguu

SEQ ID NO: 3817851 - RNA, 15 nt, Human
auauauguauauaca

SEQ ID NO: 3817852 - RNA, 12 nt, Human
auauauguaugu

SEQ ID NO: 3817853 - RNA, 19 nt, Human
auauauguauuauuuauaa

SEQ ID NO: 3817854 - RNA, 18 nt, Human
auauauguguauauauac

SEQ ID NO: 3817855 - RNA, 21 nt, Human
auauauguguauauauacaua

SEQ ID NO: 3817856 - RNA, 19 nt, Human
auauauguguguguauguu

SEQ ID NO: 3817857 - RNA, 20 nt, Human
auauauguguguuuaaauaa

SEQ ID NO: 3817858 - RNA, 13 nt, Human
auauauguguuuu

SEQ ID NO: 3817859 - RNA, 15 nt, Human
auauauguguuuuuc

SEQ ID NO: 3817860 - RNA, 20 nt, Human
auauauguugauuucuugua

SEQ ID NO: 3817861 - RNA, 20 nt, Human
auauauguuuaccuuuuaau

SEQ ID NO: 3817862 - RNA, 13 nt, Human
auauauguuuuaa

SEQ ID NO: 3817863 - RNA, 17 nt, Human
auauauguuuuugaagg

SEQ ID NO: 3817864 - RNA, 16 nt, Human
auauauuaaaaauaua

SEQ ID NO: 3817865 - RNA, 22 nt, Human
auauauuaaaaauauaaaacug

SEQ ID NO: 3817866 - RNA, 16 nt, Human
auauauuaaaauucca

SEQ ID NO: 3817867 - RNA, 17 nt, Human
auauauuacaagggaua

SEQ ID NO: 3817868 - RNA, 19 nt, Human
auauauuauacuuguaauu

SEQ ID NO: 3817869 - RNA, 16 nt, Human
auauauuauauggaaa

SEQ ID NO: 3817870 - RNA, 15 nt, Human
auauauuaucuuuuc

SEQ ID NO: 3817871 - RNA, 16 nt, Human
auauauuaucuuuuca

SEQ ID NO: 3817872 - RNA, 18 nt, Human
auauauucagccuggcuu

SEQ ID NO: 3817873 - RNA, 12 nt, Human
auauauucucuu

SEQ ID NO: 3817874 - RNA, 14 nt, Human
auauauucucuuug

SEQ ID NO: 3817875 - RNA, 22 nt, Human
auauauucuggcugauaaaaga

SEQ ID NO: 3817876 - RNA, 17 nt, Human
auauauugaacuuuugu

SEQ ID NO: 3817877 - RNA, 13 nt, Human
auauauugaauua

SEQ ID NO: 3817878 - RNA, 12 nt, Human
auauauugcugc

SEQ ID NO: 3817879 - RNA, 21 nt, Human
auauauuggguuccauucuca

SEQ ID NO: 3817880 - RNA, 21 nt, Human
auauauugguaacauccuuuc

SEQ ID NO: 3817881 - RNA, 16 nt, Human
auauauuuaaaaauaa

SEQ ID NO: 3817882 - RNA, 13 nt, Human
auauauuuauaac

SEQ ID NO: 3817883 - RNA, 14 nt, Human
auauauuuauaacu

SEQ ID NO: 3817884 - RNA, 23 nt, Human
auauauuuauaacucaucauaaa

SEQ ID NO: 3817885 - RNA, 16 nt, Human
aucaaacauuuucugg

SEQ ID NO: 3817886 - RNA, 15 nt, Human
aucaaacauuuugaa

SEQ ID NO: 3817887 - RNA, 22 nt, Human
aucaaacccggcgguccccucc

SEQ ID NO: 3817888 - RNA, 17 nt, Human
aucaaacccuagccuug

SEQ ID NO: 3817889 - RNA, 14 nt, Human
aucaaacugaagcc

SEQ ID NO: 3817890 - RNA, 12 nt, Human
aucaaagcaaug

SEQ ID NO: 3817891 - RNA, 17 nt, Human
aucaaagcaaugcauuu

SEQ ID NO: 3817892 - RNA, 23 nt, Human
aucaaagcacuuggacucuugcu

SEQ ID NO: 3817893 - RNA, 14 nt, Human
aucaaagccacacu

SEQ ID NO: 3817894 - RNA, 16 nt, Human
aucaaaguagcaaaug

SEQ ID NO: 3817895 - RNA, 19 nt, Human
aucaaagucauuaaagaca

SEQ ID NO: 3817896 - RNA, 16 nt, Human
aucaaaguucugcuuu

SEQ ID NO: 3817897 - RNA, 23 nt, Human
aucaaaguucugcuuucucccca

SEQ ID NO: 3817898 - RNA, 19 nt, Human
aucaaauaaaaauucuaga

SEQ ID NO: 3817899 - RNA, 20 nt, Human
aucaaauaaguauuuauaau

SEQ ID NO: 3817900 - RNA, 17 nt, Human
aucaaauaauaccuuag

SEQ ID NO: 3817901 - RNA, 20 nt, Human
aucaaauaauaccuuagaag

SEQ ID NO: 3817902 - RNA, 13 nt, Human
aucaaauacauuu

SEQ ID NO: 3817903 - RNA, 14 nt, Human
aucaaauacauuua

SEQ ID NO: 3817904 - RNA, 20 nt, Human
aucaaauacuuuaaaggaaa

SEQ ID NO: 3817905 - RNA, 21 nt, Human
aucaaauacuuuaaaggaaaa

SEQ ID NO: 3817906 - RNA, 14 nt, Human
aucaaauauauuca

SEQ ID NO: 3817907 - RNA, 14 nt, Human
aucaaauaugcaaa

SEQ ID NO: 3817908 - RNA, 16 nt, Human
aucaaauaugcaaagc

SEQ ID NO: 3817909 - RNA, 15 nt, Human
aucaaauauuagaug

SEQ ID NO: 3817910 - RNA, 17 nt, Human
aucaaauggaagacaca

SEQ ID NO: 3817911 - RNA, 18 nt, Human
aucaaauguaacuuacug

SEQ ID NO: 3817912 - RNA, 15 nt, Human
aucaacaaagaaaua

SEQ ID NO: 3817913 - RNA, 16 nt, Human
aucaacacacauuuua

SEQ ID NO: 3817914 - RNA, 17 nt, Human
aucaacagaagcauuug

SEQ ID NO: 3817915 - RNA, 13 nt, Human
aucaacaucuuuu

SEQ ID NO: 3817916 - RNA, 14 nt, Human
aucaacauuucuca

SEQ ID NO: 3817917 - RNA, 13 nt, Human
aucaacugaauga

SEQ ID NO: 3817918 - RNA, 14 nt, Human
aucaacuuuaauca

SEQ ID NO: 3817919 - RNA, 16 nt, Human
aucaacuuuuuauugc

SEQ ID NO: 3817920 - RNA, 19 nt, Human
aucaacuuuuuauugccuu

SEQ ID NO: 3817921 - RNA, 20 nt, Human
aucaacuuuuuauugccuuc

SEQ ID NO: 3817922 - RNA, 21 nt, Human
aucaacuuuuuauugccuucu

SEQ ID NO: 3817923 - RNA, 17 nt, Human
aucaagaagacuuuagg

SEQ ID NO: 3817924 - RNA, 21 nt, Human
aucaagaagacuuuaggaaug

SEQ ID NO: 3817925 - RNA, 14 nt, Human
aucaagaagggcug

SEQ ID NO: 3817926 - RNA, 16 nt, Human
aucaagaagggcugca

SEQ ID NO: 3817927 - RNA, 13 nt, Human
aucaagagacuga

SEQ ID NO: 3817928 - RNA, 16 nt, Human
aucaagagcugcccuc

SEQ ID NO: 3817929 - RNA, 16 nt, Human
aucaagaggcugagac

SEQ ID NO: 3817930 - RNA, 21 nt, Human
aucaagaguugugacaacuuc

SEQ ID NO: 3817931 - RNA, 15 nt, Human
aucaagauaaaggac

SEQ ID NO: 3817932 - RNA, 17 nt, Human
aucaagauaaaggacag

SEQ ID NO: 3817933 - RNA, 18 nt, Human
aucaagaugucagacugg

SEQ ID NO: 3817934 - RNA, 21 nt, Human
aucaagccauguauaaaugug

SEQ ID NO: 3817935 - RNA, 16 nt, Human
aucaagcuagaaggcc

SEQ ID NO: 3817936 - RNA, 20 nt, Human
aucaagcuagaaggccacau

SEQ ID NO: 3817937 - RNA, 16 nt, Human
aucaaggcacugccug

SEQ ID NO: 3817938 - RNA, 22 nt, Human
aucaaggccuuauuggaaagca

SEQ ID NO: 3817939 - RNA, 23 nt, Human
aucaagggaauguaacugcugaa

SEQ ID NO: 3817940 - RNA, 16 nt, Human
aucaaggguacacugc

SEQ ID NO: 3817941 - RNA, 14 nt, Human
aucaaggucguuuu

SEQ ID NO: 3817942 - RNA, 14 nt, Human
aucaaguaauacaa

SEQ ID NO: 3817943 - RNA, 16 nt, Human
aucaaguaauacaaac

SEQ ID NO: 3817944 - RNA, 17 nt, Human
aucaaguaauacaaacu

SEQ ID NO: 3817945 - RNA, 18 nt, Human
aucaaguagacuacuguu

SEQ ID NO: 3817946 - RNA, 17 nt, Human
aucaaguauagaaaauc

SEQ ID NO: 3817947 - RNA, 12 nt, Human
aucaaguauuac

SEQ ID NO: 3817948 - RNA, 21 nt, Human
aucaaguauuacuaaauugac

SEQ ID NO: 3817949 - RNA, 14 nt, Human
aucaaguauuauac

SEQ ID NO: 3817950 - RNA, 20 nt, Human
aucaaguauuugggaaguga

SEQ ID NO: 3817951 - RNA, 21 nt, Human
aucaaguauuugggaagugaa

SEQ ID NO: 3817952 - RNA, 17 nt, Human
aucaagucaaucauuuc

SEQ ID NO: 3817953 - RNA, 18 nt, Human
aucaagucaaucauuucu

SEQ ID NO: 3817954 - RNA, 12 nt, Human
aucaagucaccg

SEQ ID NO: 3817955 - RNA, 14 nt, Human
aucaaguuauuuuu

SEQ ID NO: 3817956 - RNA, 20 nt, Human
aucaaguuuccaagcaaaug

SEQ ID NO: 3817957 - RNA, 17 nt, Human
aucaauaaaaaauuaug

SEQ ID NO: 3817958 - RNA, 18 nt, Human
aucaauaaaaaauuauga

SEQ ID NO: 3817959 - RNA, 16 nt, Human
aucaauaaaaugugau

SEQ ID NO: 3817960 - RNA, 22 nt, Human
aucaauaacagccgcuccagag

SEQ ID NO: 3817961 - RNA, 18 nt, Human
aucaauaauauauuuucu

SEQ ID NO: 3817962 - RNA, 21 nt, Human
aucaauaauauauuuucuguu

SEQ ID NO: 3817963 - RNA, 23 nt, Human
aucaauaugcagaauggcauuug

SEQ ID NO: 3817964 - RNA, 20 nt, Human
aucaauauugucauuccugu

SEQ ID NO: 3817965 - RNA, 13 nt, Human
aucaaucaaaccc

SEQ ID NO: 3817966 - RNA, 15 nt, Human
aucaaucaaauaagu

SEQ ID NO: 3817967 - RNA, 19 nt, Human
aucaaucaaauaaguauuu

SEQ ID NO: 3817968 - RNA, 14 nt, Human
aucaaucacagcuu

SEQ ID NO: 3817969 - RNA, 19 nt, Human
aucaaucaucugugugaaa

SEQ ID NO: 3817970 - RNA, 22 nt, Human
aucaaucaucugugugaaaaug

SEQ ID NO: 3817971 - RNA, 19 nt, Human
aucaaucauuguacaguuu

SEQ ID NO: 3817972 - RNA, 23 nt, Human
aucaauccugugugguuuagugu

SEQ ID NO: 3817973 - RNA, 16 nt, Human
aucaauccuuguucag

SEQ ID NO: 3817974 - RNA, 21 nt, Human
aucaaucuguaaaacuaagaa

SEQ ID NO: 3817975 - RNA, 17 nt, Human
aucaaucuugcauguaa

SEQ ID NO: 3817976 - RNA, 18 nt, Human
aucaaucuugcauguaac

SEQ ID NO: 3817977 - RNA, 15 nt, Human
aucaaucuuuagaaa

SEQ ID NO: 3817978 - RNA, 14 nt, Human
aucaaugaguaaca

SEQ ID NO: 3817979 - RNA, 21 nt, Human
aucaauggcgcagugccucug

SEQ ID NO: 3817980 - RNA, 23 nt, Human
aucaauggcgcagugccucuggu

SEQ ID NO: 3817981 - RNA, 22 nt, Human
aucaaugugucuuucuaagaaa

SEQ ID NO: 3817982 - RNA, 22 nt, Human
aucaauguucacgcaacuugaa

SEQ ID NO: 3817983 - RNA, 19 nt, Human
aucaauguuucuucuaggu

SEQ ID NO: 3817984 - RNA, 15 nt, Human
aucaauuaaauguag

SEQ ID NO: 3817985 - RNA, 20 nt, Human
aucaauuaacugaguagcuc

SEQ ID NO: 3817986 - RNA, 15 nt, Human
aucaauuaauuuuuu

SEQ ID NO: 3817987 - RNA, 22 nt, Human
aucaauuaauuuuuuuauuguu

SEQ ID NO: 3817988 - RNA, 18 nt, Human
aucaauuauaguuucuga

SEQ ID NO: 3817989 - RNA, 15 nt, Human
aucaauuuaaaccca

SEQ ID NO: 3817990 - RNA, 17 nt, Human
aucaauuuaaacccauu

SEQ ID NO: 3817991 - RNA, 14 nt, Human
aucaauuugucauu

SEQ ID NO: 3817992 - RNA, 18 nt, Human
aucaauuugucauuuuga

SEQ ID NO: 3817993 - RNA, 23 nt, Human
aucagaugacuagaaagugaaua

SEQ ID NO: 3817994 - RNA, 21 nt, Human
aucagaugcuccaagauucua

SEQ ID NO: 3817995 - RNA, 23 nt, Human
aucagaugcuccaagauucuaga

SEQ ID NO: 3817996 - RNA, 21 nt, Human
aucagauggaaauauuuugau

SEQ ID NO: 3817997 - RNA, 22 nt, Human
aucagauggaaauauuuugaua

SEQ ID NO: 3817998 - RNA, 23 nt, Human
aucagauggaaauauuuugauaa

SEQ ID NO: 3817999 - RNA, 21 nt, Human
aucagauugcaugugacucug

SEQ ID NO: 3818000 - RNA, 13 nt, Human
aucagauugcuuu

SEQ ID NO: 3818001 - RNA, 19 nt, Human
aucagauugcuuuugugca

SEQ ID NO: 3818002 - RNA, 13 nt, Human
aucagcaaaaaag

SEQ ID NO: 3818003 - RNA, 13 nt, Human
aucagcaaagaaa

SEQ ID NO: 3818004 - RNA, 23 nt, Human
aucagcaacaaccagcaucccuu

SEQ ID NO: 3818005 - RNA, 22 nt, Human
aucagcacagauaaaaagugga

SEQ ID NO: 3818006 - RNA, 20 nt, Human
aucagcacgauuucuguuua

SEQ ID NO: 3818007 - RNA, 23 nt, Human
aucagcacgauuucuguuuagau

SEQ ID NO: 3818008 - RNA, 12 nt, Human
aucagcacugaa

SEQ ID NO: 3818009 - RNA, 18 nt, Human
aucagcaucugugauggg

SEQ ID NO: 3818010 - RNA, 15 nt, Human
aucagcaugaaaaug

SEQ ID NO: 3818011 - RNA, 15 nt, Human
aucagccaauuaugu

SEQ ID NO: 3818012 - RNA, 18 nt, Human
aucagccaauuauguuaa

SEQ ID NO: 3818013 - RNA, 23 nt, Human
aucagcccugcccuucagcaucc

SEQ ID NO: 3818014 - RNA, 20 nt, Human
aucagccuaggggucaggga

SEQ ID NO: 3818015 - RNA, 11 nt, Human
aucagccucuu

SEQ ID NO: 3818016 - RNA, 15 nt, Human
aucagccucuuaaag

SEQ ID NO: 3818017 - RNA, 20 nt, Human
aucagccugcuccagcuguu

SEQ ID NO: 3818018 - RNA, 19 nt, Human
aucagccugucucuuccau

SEQ ID NO: 3818019 - RNA, 21 nt, Human
aucagccugucucuuccauau

SEQ ID NO: 3818020 - RNA, 23 nt, Human
aucagcgccggccuccagaacuu

SEQ ID NO: 3818021 - RNA, 21 nt, Human
aucagcuagcaaaagaaguaa

SEQ ID NO: 3818022 - RNA, 18 nt, Human
aucagcuccacuuucagu

SEQ ID NO: 3818023 - RNA, 13 nt, Human
aucagcuccuucc

SEQ ID NO: 3818024 - RNA, 17 nt, Human
aucagcuccuuccugga

SEQ ID NO: 3818025 - RNA, 12 nt, Human
aucagcugcuac

SEQ ID NO: 3818026 - RNA, 23 nt, Human
aucagcugcuacuacuccuguag

SEQ ID NO: 3818027 - RNA, 17 nt, Human
aucagcugcugaaacaa

SEQ ID NO: 3818028 - RNA, 21 nt, Human
aucagcugcugaaacaacaaa

SEQ ID NO: 3818029 - RNA, 23 nt, Human
aucagcugcugaaacaacaaaua

SEQ ID NO: 3818030 - RNA, 19 nt, Human
aucagcugcuuuguuaccu

SEQ ID NO: 3818031 - RNA, 21 nt, Human
aucagcuucuauccuugacuu

SEQ ID NO: 3818032 - RNA, 22 nt, Human
aucagcuugcccuguuaaaaga

SEQ ID NO: 3818033 - RNA, 19 nt, Human
aucaggaauauuuuccaaa

SEQ ID NO: 3818034 - RNA, 22 nt, Human
aucaggaauauuuuccaaagag

SEQ ID NO: 3818035 - RNA, 12 nt, Human
aucaggaugaac

SEQ ID NO: 3818036 - RNA, 17 nt, Human
aucaggcacaggucagg

SEQ ID NO: 3818037 - RNA, 18 nt, Human
aucaggccuaaucucaua

SEQ ID NO: 3818038 - RNA, 14 nt, Human
aucaggccuagagg

SEQ ID NO: 3818039 - RNA, 15 nt, Human
aucaggcuauguaug

SEQ ID NO: 3818040 - RNA, 16 nt, Human
aucaggcucugccuca

SEQ ID NO: 3818041 - RNA, 13 nt, Human
aucaggcugaggu

SEQ ID NO: 3818042 - RNA, 14 nt, Human
aucaggcuuucuua

SEQ ID NO: 3818043 - RNA, 22 nt, Human
aucaggcuuucuuaaagugaga

SEQ ID NO: 3818044 - RNA, 22 nt, Human
aucaggcuuucuuuuuuuucuu

SEQ ID NO: 3818045 - RNA, 16 nt, Human
aucaggcuuuuguuuc

SEQ ID NO: 3818046 - RNA, 18 nt, Human
aucagggaccaccagagg

SEQ ID NO: 3818047 - RNA, 23 nt, Human
aucagggaggaaaguuucuuuga

SEQ ID NO: 3818048 - RNA, 11 nt, Human
aucagggccug

SEQ ID NO: 3818049 - RNA, 20 nt, Human
auaugauuuaaaacauguaa

SEQ ID NO: 3818050 - RNA, 20 nt, Human
auaugauuuaaaucagccgu

SEQ ID NO: 3818051 - RNA, 12 nt, Human
auaugauuuaua

SEQ ID NO: 3818052 - RNA, 14 nt, Human
auaugauuuauagu

SEQ ID NO: 3818053 - RNA, 18 nt, Human
auaugauuucacuagaaa

SEQ ID NO: 3818054 - RNA, 19 nt, Human
auaugauuuuauuugacaa

SEQ ID NO: 3818055 - RNA, 18 nt, Human
auaugauuuuuuaaaaga

SEQ ID NO: 3818056 - RNA, 18 nt, Human
auaugcaaacauaacaaa

SEQ ID NO: 3818057 - RNA, 21 nt, Human
auaugcaaacauaacaaaauc

SEQ ID NO: 3818058 - RNA, 14 nt, Human
auaugcaaagcacu

SEQ ID NO: 3818059 - RNA, 15 nt, Human
auaugcaaagcacug

SEQ ID NO: 3818060 - RNA, 15 nt, Human
auaugcacacauuuu

SEQ ID NO: 3818061 - RNA, 22 nt, Human
auaugcacacauuuuuuaaaug

SEQ ID NO: 3818062 - RNA, 21 nt, Human
auaugcaccuugugucuguac

SEQ ID NO: 3818063 - RNA, 18 nt, Human
auaugcauauauauaugu

SEQ ID NO: 3818064 - RNA, 19 nt, Human
auaugccucuccuuuguau

SEQ ID NO: 3818065 - RNA, 22 nt, Human
auaugccucuccuuuguauauu

SEQ ID NO: 3818066 - RNA, 14 nt, Human
auaugccugcucuu

SEQ ID NO: 3818067 - RNA, 21 nt, Human
auaugccuguaauucagugua

SEQ ID NO: 3818068 - RNA, 17 nt, Human
auaugcuaccaccagcu

SEQ ID NO: 3818069 - RNA, 15 nt, Human
auaugcuauuucuau

SEQ ID NO: 3818070 - RNA, 19 nt, Human
auaugcuauuucuauauuu

SEQ ID NO: 3818071 - RNA, 22 nt, Human
auaugcuauuucuauauuuuca

SEQ ID NO: 3818072 - RNA, 20 nt, Human
auaugcucugcauguuacau

SEQ ID NO: 3818073 - RNA, 18 nt, Human
auaugcugccaaauuuug

SEQ ID NO: 3818074 - RNA, 22 nt, Human
auaugcugccaaauuuuggcca

SEQ ID NO: 3818075 - RNA, 18 nt, Human
auaugcuuaaaauaagca

SEQ ID NO: 3818076 - RNA, 15 nt, Human
auaugcuuaguaaug

SEQ ID NO: 3818077 - RNA, 16 nt, Human
auaugcuuauacacuu

SEQ ID NO: 3818078 - RNA, 23 nt, Human
auauggaaauauauauuauacuu

SEQ ID NO: 3818079 - RNA, 15 nt, Human
auauggaauuuugca

SEQ ID NO: 3818080 - RNA, 15 nt, Human
auauggacucugcac

SEQ ID NO: 3818081 - RNA, 23 nt, Human
auauggauguuacucucuugcac

SEQ ID NO: 3818082 - RNA, 19 nt, Human
auauggcaagaaagcuggu

SEQ ID NO: 3818083 - RNA, 15 nt, Human
auauggcagaagaca

SEQ ID NO: 3818084 - RNA, 16 nt, Human
auauggcagaguugua

SEQ ID NO: 3818085 - RNA, 17 nt, Human
auauggcagaguuguaa

SEQ ID NO: 3818086 - RNA, 16 nt, Human
auauggcauuugcaga

SEQ ID NO: 3818087 - RNA, 15 nt, Human
auaugggacauuuuu

SEQ ID NO: 3818088 - RNA, 15 nt, Human
auaugggagaaauag

SEQ ID NO: 3818089 - RNA, 18 nt, Human
auauggggggccaacacc

SEQ ID NO: 3818090 - RNA, 20 nt, Human
auauggguuuauaauuuucu

SEQ ID NO: 3818091 - RNA, 15 nt, Human
auauggucuaauguu

SEQ ID NO: 3818092 - RNA, 17 nt, Human
auauggucuaauguuua

SEQ ID NO: 3818093 - RNA, 12 nt, Human
auauguaaaaca

SEQ ID NO: 3818094 - RNA, 18 nt, Human
auauguaaaacauuuauu

SEQ ID NO: 3818095 - RNA, 12 nt, Human
auauguaaaaua

SEQ ID NO: 3818096 - RNA, 20 nt, Human
auauguaaacauaaguguac

SEQ ID NO: 3818097 - RNA, 16 nt, Human
auauguaacaagccac

SEQ ID NO: 3818098 - RNA, 12 nt, Human
auauguacauuu

SEQ ID NO: 3818099 - RNA, 15 nt, Human
auauguacauuucua

SEQ ID NO: 3818100 - RNA, 19 nt, Human
auauguaccauguacauga

SEQ ID NO: 3818101 - RNA, 23 nt, Human
auauguaccuaacgaaguauccu

SEQ ID NO: 3818102 - RNA, 19 nt, Human
auauguacuugucaaagaa

SEQ ID NO: 3818103 - RNA, 16 nt, Human
auauguagaaggcaca

SEQ ID NO: 3818104 - RNA, 16 nt, Human
auauguagacuauaua

SEQ ID NO: 3818105 - RNA, 18 nt, Human
auauguagacuauauaca

SEQ ID NO: 3818106 - RNA, 21 nt, Human
auauguagacuauauacaugu

SEQ ID NO: 3818107 - RNA, 16 nt, Human
auauguagauguaugc

SEQ ID NO: 3818108 - RNA, 15 nt, Human
auauguauaacuuua

SEQ ID NO: 3818109 - RNA, 16 nt, Human
auauguauaacuuuaa

SEQ ID NO: 3818110 - RNA, 18 nt, Human
auauguauauuuuuuuaa

SEQ ID NO: 3818111 - RNA, 23 nt, Human
auauguauggguaggguaaauca

SEQ ID NO: 3818112 - RNA, 15 nt, Human
auauguaugugugua

SEQ ID NO: 3818113 - RNA, 16 nt, Human
auauguauguguguau

SEQ ID NO: 3818114 - RNA, 14 nt, Human
auauguauguguuu

SEQ ID NO: 3818115 - RNA, 18 nt, Human
auauguauguguuuagaa

SEQ ID NO: 3818116 - RNA, 23 nt, Human
auauguauuaauaaauagagcaa

SEQ ID NO: 3818117 - RNA, 16 nt, Human
auauguauuauuuaua

SEQ ID NO: 3818118 - RNA, 18 nt, Human
auauguauucuuuucuca

SEQ ID NO: 3818119 - RNA, 20 nt, Human
auauguauucuuuucucagu

SEQ ID NO: 3818120 - RNA, 14 nt, Human
auauguauuguaaa

SEQ ID NO: 3818121 - RNA, 21 nt, Human
auaugucucgcuagugauguu

SEQ ID NO: 3818122 - RNA, 16 nt, Human
auaugugaacauuuau

SEQ ID NO: 3818123 - RNA, 15 nt, Human
auaugugaucugucu

SEQ ID NO: 3818124 - RNA, 18 nt, Human
auaugugccacauuuucu

SEQ ID NO: 3818125 - RNA, 19 nt, Human
auaugugcuggaauucuaa

SEQ ID NO: 3818126 - RNA, 15 nt, Human
auauguggaguucau

SEQ ID NO: 3818127 - RNA, 16 nt, Human
auauguggaguucauc

SEQ ID NO: 3818128 - RNA, 13 nt, Human
auauguguauaua

SEQ ID NO: 3818129 - RNA, 22 nt, Human
auauguguaugcacaguaaaaa

SEQ ID NO: 3818130 - RNA, 12 nt, Human
auauguguaugu

SEQ ID NO: 3818131 - RNA, 22 nt, Human
auauguguauguacguuuguau

SEQ ID NO: 3818132 - RNA, 14 nt, Human
auauguguugaaaa

SEQ ID NO: 3818133 - RNA, 18 nt, Human
auauguguugaaaaccaa

SEQ ID NO: 3818134 - RNA, 20 nt, Human
auauguguugaaaaccaaaa

SEQ ID NO: 3818135 - RNA, 16 nt, Human
auauguucaacuggag

SEQ ID NO: 3818136 - RNA, 20 nt, Human
auccuuuccucauuaaauua

SEQ ID NO: 3818137 - RNA, 15 nt, Human
auccuuucuaaacaa

SEQ ID NO: 3818138 - RNA, 15 nt, Human
auccuuucugccgac

SEQ ID NO: 3818139 - RNA, 16 nt, Human
auccuuucugccgacc

SEQ ID NO: 3818140 - RNA, 15 nt, Human
auccuuugcagggca

SEQ ID NO: 3818141 - RNA, 20 nt, Human
auccuuugcagggcagcccc

SEQ ID NO: 3818142 - RNA, 19 nt, Human
auccuuuguuuucugacua

SEQ ID NO: 3818143 - RNA, 16 nt, Human
auccuuuuauguuauu

SEQ ID NO: 3818144 - RNA, 18 nt, Human
auccuuuuauguuauuua

SEQ ID NO: 3818145 - RNA, 16 nt, Human
auccuuuucuccuauc

SEQ ID NO: 3818146 - RNA, 12 nt, Human
auccuuuucugu

SEQ ID NO: 3818147 - RNA, 15 nt, Human
auccuuuucuucuau

SEQ ID NO: 3818148 - RNA, 16 nt, Human
auccuuuucuucuaug

SEQ ID NO: 3818149 - RNA, 18 nt, Human
auccuuuucuucuaugua

SEQ ID NO: 3818150 - RNA, 11 nt, Human
auccuuuugua

SEQ ID NO: 3818151 - RNA, 16 nt, Human
auccuuuuuuaaaagu

SEQ ID NO: 3818152 - RNA, 22 nt, Human
auccuuuuuuaaaaguaaaugu

SEQ ID NO: 3818153 - RNA, 17 nt, Human
aucgaaaauucauuuca

SEQ ID NO: 3818154 - RNA, 19 nt, Human
aucgaaauaacaauguuaa

SEQ ID NO: 3818155 - RNA, 22 nt, Human
aucgaaauaacaauguuaagga

SEQ ID NO: 3818156 - RNA, 17 nt, Human
aucgacuuguucuugau

SEQ ID NO: 3818157 - RNA, 22 nt, Human
aucgcaucauugcacucuagcc

SEQ ID NO: 3818158 - RNA, 14 nt, Human
aucgcauugcauac

SEQ ID NO: 3818159 - RNA, 16 nt, Human
aucgccacaaacucua

SEQ ID NO: 3818160 - RNA, 20 nt, Human
aucgccagaggugcuucacc

SEQ ID NO: 3818161 - RNA, 19 nt, Human
aucgccagcugaugacuca

SEQ ID NO: 3818162 - RNA, 23 nt, Human
aucgccagcugaugacucaagau

SEQ ID NO: 3818163 - RNA, 20 nt, Human
aucgcggcggagcuggcccc

SEQ ID NO: 3818164 - RNA, 16 nt, Human
aucgcucguguguucu

SEQ ID NO: 3818165 - RNA, 14 nt, Human
aucgcuggccccuu

SEQ ID NO: 3818166 - RNA, 14 nt, Human
aucggaagcagugc

SEQ ID NO: 3818167 - RNA, 22 nt, Human
aucggaagcagugccuuccaua

SEQ ID NO: 3818168 - RNA, 16 nt, Human
aucggagccuccucuc

SEQ ID NO: 3818169 - RNA, 21 nt, Human
aucggaggcuugucagagcug

SEQ ID NO: 3818170 - RNA, 21 nt, Human
aucggaucuggggcucuggga

SEQ ID NO: 3818171 - RNA, 21 nt, Human
aucggccaucaagggaagaac

SEQ ID NO: 3818172 - RNA, 20 nt, Human
aucggcccacagcucccacc

SEQ ID NO: 3818173 - RNA, 17 nt, Human
aucgggaacaguguuuc

SEQ ID NO: 3818174 - RNA, 18 nt, Human
aucgggagcagugucuuc

SEQ ID NO: 3818175 - RNA, 17 nt, Human
aucggggcacugcaggg

SEQ ID NO: 3818176 - RNA, 14 nt, Human
aucgguccugucuc

SEQ ID NO: 3818177 - RNA, 19 nt, Human
aucggugaaacuaacagau

SEQ ID NO: 3818178 - RNA, 21 nt, Human
aucggugaaacuaacagauaa

SEQ ID NO: 3818179 - RNA, 15 nt, Human
aucgguguccauuua

SEQ ID NO: 3818180 - RNA, 17 nt, Human
aucgguguccauuuaua

SEQ ID NO: 3818181 - RNA, 23 nt, Human
aucgguguccauuuauagaauaa

SEQ ID NO: 3818182 - RNA, 16 nt, Human
aucguaauguacagau

SEQ ID NO: 3818183 - RNA, 18 nt, Human
aucguauagcuguauuga

SEQ ID NO: 3818184 - RNA, 22 nt, Human
aucguauagcuguauugaauca

SEQ ID NO: 3818185 - RNA, 19 nt, Human
aucguccagcgaccuuccu

SEQ ID NO: 3818186 - RNA, 20 nt, Human
aucguccccucccccacccc

SEQ ID NO: 3818187 - RNA, 15 nt, Human
aucgugaagaagccu

SEQ ID NO: 3818188 - RNA, 14 nt, Human
aucgugcuacugca

SEQ ID NO: 3818189 - RNA, 15 nt, Human
aucguuccaguuccc

SEQ ID NO: 3818190 - RNA, 18 nt, Human
aucguucucucuuugcau

SEQ ID NO: 3818191 - RNA, 16 nt, Human
aucguucuuucuagcu

SEQ ID NO: 3818192 - RNA, 17 nt, Human
aucguuuucuuaaagug

SEQ ID NO: 3818193 - RNA, 19 nt, Human
aucuaaaagaaaugucuau

SEQ ID NO: 3818194 - RNA, 17 nt, Human
aucuaaaguguguuguu

SEQ ID NO: 3818195 - RNA, 20 nt, Human
aucuaaaguguguuguugcu

SEQ ID NO: 3818196 - RNA, 23 nt, Human
aucuaaaguguguuguugcuuua

SEQ ID NO: 3818197 - RNA, 13 nt, Human
aucuaaaguuaua

SEQ ID NO: 3818198 - RNA, 14 nt, Human
aucuaaaguuauau

SEQ ID NO: 3818199 - RNA, 17 nt, Human
aucuaaaguuauauuuc

SEQ ID NO: 3818200 - RNA, 18 nt, Human
aucuaaaguuauauuuca

SEQ ID NO: 3818201 - RNA, 20 nt, Human
aucuaaaucuauuuauuaau

SEQ ID NO: 3818202 - RNA, 16 nt, Human
aucuaaaucuguccaa

SEQ ID NO: 3818203 - RNA, 13 nt, Human
aucuaaauggaac

SEQ ID NO: 3818204 - RNA, 19 nt, Human
aucuaacauuauuacuuuu

SEQ ID NO: 3818205 - RNA, 15 nt, Human
aucuaacccucccau

SEQ ID NO: 3818206 - RNA, 22 nt, Human
aucuaacccucccauggcaccu

SEQ ID NO: 3818207 - RNA, 12 nt, Human
aucuaagaauaa

SEQ ID NO: 3818208 - RNA, 18 nt, Human
aucuaagcagcauuucug

SEQ ID NO: 3818209 - RNA, 21 nt, Human
aucuaagcccaugggacaaau

SEQ ID NO: 3818210 - RNA, 17 nt, Human
aucuaagccuuuccaua

SEQ ID NO: 3818211 - RNA, 18 nt, Human
aucuaagccuuuccauaa

SEQ ID NO: 3818212 - RNA, 16 nt, Human
aucuaagcugcagcuu

SEQ ID NO: 3818213 - RNA, 17 nt, Human
aucuaagugauauaaau

SEQ ID NO: 3818214 - RNA, 18 nt, Human
aucuaaguuaauuuaaag

SEQ ID NO: 3818215 - RNA, 13 nt, Human
aucuaaguuauaa

SEQ ID NO: 3818216 - RNA, 19 nt, Human
aucuaaguuauaagacucu

SEQ ID NO: 3818217 - RNA, 15 nt, Human
aucuaauaccucugu

SEQ ID NO: 3818218 - RNA, 19 nt, Human
aucuaauaccucugugugc

SEQ ID NO: 3818219 - RNA, 22 nt, Human
aucuaauagcggguuacuuuca

SEQ ID NO: 3818220 - RNA, 15 nt, Human
aucuaauauauauga

SEQ ID NO: 3818221 - RNA, 17 nt, Human
aucuaauauauaugaau

SEQ ID NO: 3818222 - RNA, 23 nt, Human
aucuaauauggccacaguagucu

SEQ ID NO: 3818223 - RNA, 23 nt, Human
aucuaauauguaacaagccaccc

SEQ ID NO: 3818224 - RNA, 14 nt, Human
aucuaauauuaaaa

SEQ ID NO: 3818225 - RNA, 18 nt, Human
aucuaaugacauucaaua

SEQ ID NO: 3818226 - RNA, 16 nt, Human
aucuaauuauuuugca

SEQ ID NO: 3818227 - RNA, 13 nt, Human
aucuaauucuuua

SEQ ID NO: 3818228 - RNA, 14 nt, Human
aucuaauucuuuaa

SEQ ID NO: 3818229 - RNA, 15 nt, Human
aucuaauuuauaaaa

SEQ ID NO: 3818230 - RNA, 19 nt, Human
aucuaauuuauaaaaaggu

SEQ ID NO: 3818231 - RNA, 15 nt, Human
aucuaauuucugaaa

SEQ ID NO: 3818232 - RNA, 19 nt, Human
aucuacaaucucuuuuugu

SEQ ID NO: 3818233 - RNA, 17 nt, Human
aucuacaucuuuuuuca

SEQ ID NO: 3818234 - RNA, 16 nt, Human
aucuaccaacuuucaa

SEQ ID NO: 3818235 - RNA, 18 nt, Human
aucuaccaacuuucaaga

SEQ ID NO: 3818236 - RNA, 19 nt, Human
aucuaccaacuuucaagaa

SEQ ID NO: 3818237 - RNA, 21 nt, Human
aucuacccaagggcagaaagu

SEQ ID NO: 3818238 - RNA, 21 nt, Human
aucuaccccagacuagaugua

SEQ ID NO: 3818239 - RNA, 21 nt, Human
aucuaccucacuauucaagua

SEQ ID NO: 3818240 - RNA, 13 nt, Human
aucuaccuggagg

SEQ ID NO: 3818241 - RNA, 12 nt, Human
aucuacugcauu

SEQ ID NO: 3818242 - RNA, 20 nt, Human
aucuacuucuguaauugugu

SEQ ID NO: 3818243 - RNA, 19 nt, Human
aucuacuuuuacucauaag

SEQ ID NO: 3818244 - RNA, 12 nt, Human
aucuagaagacu

SEQ ID NO: 3818245 - RNA, 20 nt, Human
aucuagagcuugaugccagu

SEQ ID NO: 3818246 - RNA, 21 nt, Human
aucuagaucuuugugccaaac

SEQ ID NO: 3818247 - RNA, 13 nt, Human
aucuagauguaaa

SEQ ID NO: 3818248 - RNA, 19 nt, Human
aucuagauuauggagcuuu

SEQ ID NO: 3818249 - RNA, 14 nt, Human
aucuagcaaauguu

SEQ ID NO: 3818250 - RNA, 18 nt, Human
aucuagcaaauguuaugc

SEQ ID NO: 3818251 - RNA, 12 nt, Human
aucuagccagcc

SEQ ID NO: 3818252 - RNA, 20 nt, Human
aucuaggaaaauauuuugau

SEQ ID NO: 3818253 - RNA, 22 nt, Human
aucuaggaagacuuuggaaaga

SEQ ID NO: 3818254 - RNA, 17 nt, Human
aucuaggggagccuuga

SEQ ID NO: 3818255 - RNA, 14 nt, Human
aucuagguuuaacu

SEQ ID NO: 3818256 - RNA, 19 nt, Human
aucuagguuuaacucagau

SEQ ID NO: 3818257 - RNA, 22 nt, Human
aucuagguuuaacucagaucac

SEQ ID NO: 3818258 - RNA, 22 nt, Human
aucuagguuuaugacaguaauu

SEQ ID NO: 3818259 - RNA, 22 nt, Human
aucuaguaagacguaaggggaa

SEQ ID NO: 3818260 - RNA, 14 nt, Human
aucuaguaauauau

SEQ ID NO: 3818261 - RNA, 16 nt, Human
aucuaguaauauauuu

SEQ ID NO: 3818262 - RNA, 19 nt, Human
aucuaguaauauauuuaaa

SEQ ID NO: 3818263 - RNA, 22 nt, Human
aucuaguaauauauuuaaaggg

SEQ ID NO: 3818264 - RNA, 16 nt, Human
aucuaguaugaaauua

SEQ ID NO: 3818265 - RNA, 14 nt, Human
aucuagugcagcug

SEQ ID NO: 3818266 - RNA, 22 nt, Human
aucuagugcagcugauuuuaac

SEQ ID NO: 3818267 - RNA, 12 nt, Human
aucuaguguuug

SEQ ID NO: 3818268 - RNA, 17 nt, Human
aucuaguuccccuguuu

SEQ ID NO: 3818269 - RNA, 12 nt, Human
aucuauaaaaua

SEQ ID NO: 3818270 - RNA, 13 nt, Human
aucuauaaagaag

SEQ ID NO: 3818271 - RNA, 16 nt, Human
aucuauaauuuaccua

SEQ ID NO: 3818272 - RNA, 16 nt, Human
aucuauacauaucuuu

SEQ ID NO: 3818273 - RNA, 17 nt, Human
aucuauagaaagcuaua

SEQ ID NO: 3818274 - RNA, 13 nt, Human
aucuauagaaagu

SEQ ID NO: 3818275 - RNA, 16 nt, Human
aucuauagaaaguguu

SEQ ID NO: 3818276 - RNA, 23 nt, Human
aucuauagaaaguguucuguuac

SEQ ID NO: 3818277 - RNA, 14 nt, Human
aucuauauaaaaua

SEQ ID NO: 3818278 - RNA, 13 nt, Human
aucuauauauaau

SEQ ID NO: 3818279 - RNA, 20 nt, Human
aucuauauauaauucuguac

SEQ ID NO: 3818280 - RNA, 17 nt, Human
aucuauauuuuacauaa

SEQ ID NO: 3818281 - RNA, 18 nt, Human
aucucuguuauguacugu

SEQ ID NO: 3818282 - RNA, 20 nt, Human
aucucuuaagacagcaugug

SEQ ID NO: 3818283 - RNA, 23 nt, Human
aucucuuaagacagcauguguua

SEQ ID NO: 3818284 - RNA, 16 nt, Human
aucucuuagcuccccu

SEQ ID NO: 3818285 - RNA, 22 nt, Human
aucucuuccuacccaaccacuc

SEQ ID NO: 3818286 - RNA, 12 nt, Human
aucucuuccuug

SEQ ID NO: 3818287 - RNA, 19 nt, Human
aucucuucuggguuccuuc

SEQ ID NO: 3818288 - RNA, 22 nt, Human
aucucuucuuaauguacauagu

SEQ ID NO: 3818289 - RNA, 20 nt, Human
aucucuucuuuuggcuucca

SEQ ID NO: 3818290 - RNA, 15 nt, Human
aucucuugagccugg

SEQ ID NO: 3818291 - RNA, 15 nt, Human
aucucuugaggccag

SEQ ID NO: 3818292 - RNA, 19 nt, Human
aucucuuucacauuguuug

SEQ ID NO: 3818293 - RNA, 21 nt, Human
aucucuuugaauuuucugugu

SEQ ID NO: 3818294 - RNA, 22 nt, Human
aucucuuuguucuaaagaugga

SEQ ID NO: 3818295 - RNA, 11 nt, Human
aucucuuuuau

SEQ ID NO: 3818296 - RNA, 12 nt, Human
aucucuuuuaua

SEQ ID NO: 3818297 - RNA, 22 nt, Human
aucucuuuugaauccaugcuug

SEQ ID NO: 3818298 - RNA, 15 nt, Human
aucucuuuuuguuug

SEQ ID NO: 3818299 - RNA, 16 nt, Human
aucucuuuuuguuugc

SEQ ID NO: 3818300 - RNA, 20 nt, Human
aucugaaaauguauguguaa

SEQ ID NO: 3818301 - RNA, 15 nt, Human
aucugaagauuguuu

SEQ ID NO: 3818302 - RNA, 20 nt, Human
aucugaagauuguuuaucua

SEQ ID NO: 3818303 - RNA, 23 nt, Human
aucugaagcuucacucacuguca

SEQ ID NO: 3818304 - RNA, 22 nt, Human
aucugaauaccucuuugaaaga

SEQ ID NO: 3818305 - RNA, 20 nt, Human
aucugacaucucugcaaucu

SEQ ID NO: 3818306 - RNA, 20 nt, Human
aucugacaugauuccuuccu

SEQ ID NO: 3818307 - RNA, 16 nt, Human
aucugaccagcagcgc

SEQ ID NO: 3818308 - RNA, 13 nt, Human
aucugacccagug

SEQ ID NO: 3818309 - RNA, 18 nt, Human
aucugacccagugccccc

SEQ ID NO: 3818310 - RNA, 21 nt, Human
aucugacccagugcccccacu

SEQ ID NO: 3818311 - RNA, 18 nt, Human
aucugacucacaagaaga

SEQ ID NO: 3818312 - RNA, 22 nt, Human
aucugagaaaagcuuugaaccc

SEQ ID NO: 3818313 - RNA, 21 nt, Human
aucugagaaacaaugacuaau

SEQ ID NO: 3818314 - RNA, 22 nt, Human
aucugagagaggcuaaaauguu

SEQ ID NO: 3818315 - RNA, 19 nt, Human
aucugagcagguugcucca

SEQ ID NO: 3818316 - RNA, 19 nt, Human
aucugagcucuuugcacua

SEQ ID NO: 3818317 - RNA, 16 nt, Human
aucugagcugagccag

SEQ ID NO: 3818318 - RNA, 19 nt, Human
aucugagcugagccaggcu

SEQ ID NO: 3818319 - RNA, 16 nt, Human
aucugaggaauucugu

SEQ ID NO: 3818320 - RNA, 20 nt, Human
aucugaggaauucuguauag

SEQ ID NO: 3818321 - RNA, 18 nt, Human
aucugaggaugaccagaa

SEQ ID NO: 3818322 - RNA, 21 nt, Human
aucugagggaaauguuuugua

SEQ ID NO: 3818323 - RNA, 16 nt, Human
aucugagggaggaggc

SEQ ID NO: 3818324 - RNA, 22 nt, Human
aucugagggaggaggccaccuc

SEQ ID NO: 3818325 - RNA, 23 nt, Human
aucugagggaggaggccaccucu

SEQ ID NO: 3818326 - RNA, 13 nt, Human
aucugaguccugg

SEQ ID NO: 3818327 - RNA, 16 nt, Human
aucugaguugccaaga

SEQ ID NO: 3818328 - RNA, 18 nt, Human
aucugaguugccaagaca

SEQ ID NO: 3818329 - RNA, 20 nt, Human
aucugaguugccaagacaaa

SEQ ID NO: 3818330 - RNA, 23 nt, Human
aucugaguugccaagacaaauca

SEQ ID NO: 3818331 - RNA, 12 nt, Human
aucugauagggu

SEQ ID NO: 3818332 - RNA, 22 nt, Human
aucugauaggguuugugacagg

SEQ ID NO: 3818333 - RNA, 19 nt, Human
aucugaucagaacaaaugu

SEQ ID NO: 3818334 - RNA, 18 nt, Human
aucugaucguucuuucua

SEQ ID NO: 3818335 - RNA, 20 nt, Human
aucugaucguucuuucuagc

SEQ ID NO: 3818336 - RNA, 18 nt, Human
aucugaugcaagcaagaa

SEQ ID NO: 3818337 - RNA, 14 nt, Human
aucugauggcuucu

SEQ ID NO: 3818338 - RNA, 17 nt, Human
aucugauugugauguga

SEQ ID NO: 3818339 - RNA, 22 nt, Human
aucugauuguugucaggccaua

SEQ ID NO: 3818340 - RNA, 13 nt, Human
aucugauuugcau

SEQ ID NO: 3818341 - RNA, 19 nt, Human
aucugauuugcauauucau

SEQ ID NO: 3818342 - RNA, 21 nt, Human
aucugcaauucaaaaguucca

SEQ ID NO: 3818343 - RNA, 15 nt, Human
aucugcaccccccug

SEQ ID NO: 3818344 - RNA, 17 nt, Human
aucugcaccccccuggg

SEQ ID NO: 3818345 - RNA, 21 nt, Human
aucugcaccccccugggcuga

SEQ ID NO: 3818346 - RNA, 22 nt, Human
aucugcaccccuucucuccucc

SEQ ID NO: 3818347 - RNA, 20 nt, Human
aucugcacccuucuuuucuc

SEQ ID NO: 3818348 - RNA, 22 nt, Human
aucugcacccuucuuuucucau

SEQ ID NO: 3818349 - RNA, 11 nt, Human
aucugcagaag

SEQ ID NO: 3818350 - RNA, 14 nt, Human
aucugcagaaggaa

SEQ ID NO: 3818351 - RNA, 20 nt, Human
aucugcagaaggaaaaaugu

SEQ ID NO: 3818352 - RNA, 16 nt, Human
aucugcaggcagacac

SEQ ID NO: 3818353 - RNA, 17 nt, Human
aucugcaggcagacacg

SEQ ID NO: 3818354 - RNA, 13 nt, Human
aucugcagucacu

SEQ ID NO: 3818355 - RNA, 17 nt, Human
aucugcauugcccaguc

SEQ ID NO: 3818356 - RNA, 23 nt, Human
aucugcccaccucagccucccaa

SEQ ID NO: 3818357 - RNA, 19 nt, Human
aucugcccaggggugcccc

SEQ ID NO: 3818358 - RNA, 21 nt, Human
aucugcccaggggugcccccu

SEQ ID NO: 3818359 - RNA, 22 nt, Human
aucugcccaggggugcccccuc

SEQ ID NO: 3818360 - RNA, 23 nt, Human
aucugcccaggggugcccccucc

SEQ ID NO: 3818361 - RNA, 18 nt, Human
aucugccccacagucucc

SEQ ID NO: 3818362 - RNA, 12 nt, Human
aucugccccucc

SEQ ID NO: 3818363 - RNA, 23 nt, Human
aucugcccgccugcccaccugcc

SEQ ID NO: 3818364 - RNA, 15 nt, Human
aucugccuaaggacu

SEQ ID NO: 3818365 - RNA, 21 nt, Human
aucugccuaaggacuucuuua

SEQ ID NO: 3818366 - RNA, 22 nt, Human
aucugccuaaggacuucuuuaa

SEQ ID NO: 3818367 - RNA, 15 nt, Human
aucugccucucuugu

SEQ ID NO: 3818368 - RNA, 17 nt, Human
aucugccuuaaaaccaa

SEQ ID NO: 3818369 - RNA, 16 nt, Human
aucugccuuuauugug

SEQ ID NO: 3818370 - RNA, 19 nt, Human
aucugccuuuauuguguuu

SEQ ID NO: 3818371 - RNA, 15 nt, Human
aucugcgaucaucgu

SEQ ID NO: 3818372 - RNA, 22 nt, Human
aucugcggaucucagcuuugag

SEQ ID NO: 3818373 - RNA, 21 nt, Human
aucugcgggggcagugcucac

SEQ ID NO: 3818374 - RNA, 17 nt, Human
aucugcgugacaauaaa

SEQ ID NO: 3818375 - RNA, 15 nt, Human
aucugcgugugugca

SEQ ID NO: 3818376 - RNA, 13 nt, Human
aucugcuaugcuu

SEQ ID NO: 3818377 - RNA, 16 nt, Human
aucugcuaugcuugaa

SEQ ID NO: 3818378 - RNA, 18 nt, Human
aucugcucacuuuaaacc

SEQ ID NO: 3818379 - RNA, 16 nt, Human
aucugcucagcccugg

SEQ ID NO: 3818380 - RNA, 17 nt, Human
aucugcugcagagcagu

SEQ ID NO: 3818381 - RNA, 17 nt, Human
aucugcuguccagacag

SEQ ID NO: 3818382 - RNA, 21 nt, Human
aucugcuguccagacagccug

SEQ ID NO: 3818383 - RNA, 13 nt, Human
aucugcugucuuu

SEQ ID NO: 3818384 - RNA, 21 nt, Human
aucugcugucuuuucuuugcc

SEQ ID NO: 3818385 - RNA, 22 nt, Human
aucugcugucuuuucuuugcca

SEQ ID NO: 3818386 - RNA, 15 nt, Human
aucugcuuaugcagu

SEQ ID NO: 3818387 - RNA, 12 nt, Human
aucugcuucagu

SEQ ID NO: 3818388 - RNA, 15 nt, Human
aucuggaacccagac

SEQ ID NO: 3818389 - RNA, 18 nt, Human
aucuggaacccagacuca

SEQ ID NO: 3818390 - RNA, 19 nt, Human
aucuggaacccagacucag

SEQ ID NO: 3818391 - RNA, 16 nt, Human
aucuggaaccucagcc

SEQ ID NO: 3818392 - RNA, 17 nt, Human
aucuggaaccucagccu

SEQ ID NO: 3818393 - RNA, 18 nt, Human
aucuggaaccucagccug

SEQ ID NO: 3818394 - RNA, 20 nt, Human
aucuggaaccucagccuggc

SEQ ID NO: 3818395 - RNA, 22 nt, Human
aucuggaaccucagccuggcca

SEQ ID NO: 3818396 - RNA, 21 nt, Human
aucuggaagagcuaggcaggg

SEQ ID NO: 3818397 - RNA, 21 nt, Human
aucuggaagccaaaauguagg

SEQ ID NO: 3818398 - RNA, 21 nt, Human
aucuggaagggccaaggucug

SEQ ID NO: 3818399 - RNA, 21 nt, Human
aucuggaccccaucugugaau

SEQ ID NO: 3818400 - RNA, 22 nt, Human
aucuggagaccagggagccuuu

SEQ ID NO: 3818401 - RNA, 14 nt, Human
aucuggagagaaca

SEQ ID NO: 3818402 - RNA, 20 nt, Human
aucuggagagcuagaaccug

SEQ ID NO: 3818403 - RNA, 22 nt, Human
aucuggaggccuuccagcugcu

SEQ ID NO: 3818404 - RNA, 18 nt, Human
aucuggaguucucaaaga

SEQ ID NO: 3818405 - RNA, 15 nt, Human
aucuggauucaaauu

SEQ ID NO: 3818406 - RNA, 15 nt, Human
aucuggauuccagag

SEQ ID NO: 3818407 - RNA, 21 nt, Human
aucuggcccucgacacucacc

SEQ ID NO: 3818408 - RNA, 19 nt, Human
aucuggccuaaaaucuugg

SEQ ID NO: 3818409 - RNA, 21 nt, Human
aucuggccuaaaaucuuggaa

SEQ ID NO: 3818410 - RNA, 21 nt, Human
aggccccacugaugcuguucu

SEQ ID NO: 3818411 - RNA, 17 nt, Human
aggccccacuggggaaa

SEQ ID NO: 3818412 - RNA, 14 nt, Human
aggccccagagacu

SEQ ID NO: 3818413 - RNA, 15 nt, Human
aggccccaggaagcc

SEQ ID NO: 3818414 - RNA, 17 nt, Human
aggccccaugaccucca

SEQ ID NO: 3818415 - RNA, 15 nt, Human
aggcccccaccacac

SEQ ID NO: 3818416 - RNA, 17 nt, Human
aggcccccaccacacau

SEQ ID NO: 3818417 - RNA, 22 nt, Human
aggcccccaccacacaucccag

SEQ ID NO: 3818418 - RNA, 18 nt, Human
aggcccccacuugccucu

SEQ ID NO: 3818419 - RNA, 18 nt, Human
aggcccccaucauccucu

SEQ ID NO: 3818420 - RNA, 19 nt, Human
aggcccccgccuuggccug

SEQ ID NO: 3818421 - RNA, 21 nt, Human
aggcccccucucaggagccau

SEQ ID NO: 3818422 - RNA, 18 nt, Human
aggcccccugccugcccu

SEQ ID NO: 3818423 - RNA, 17 nt, Human
agggagggcucugaggc

SEQ ID NO: 3818424 - RNA, 12 nt, Human
agggaggggacu

SEQ ID NO: 3818425 - RNA, 23 nt, Human
agggaggggccggcccugugugc

SEQ ID NO: 3818426 - RNA, 20 nt, Human
agggaggucacuggaaaggg

SEQ ID NO: 3818427 - RNA, 17 nt, Human
agggaggugaccccagg

SEQ ID NO: 3818428 - RNA, 23 nt, Human
agggagguguuuaaagagagguu

SEQ ID NO: 3818429 - RNA, 14 nt, Human
agggaguccccucc

SEQ ID NO: 3818430 - RNA, 16 nt, Human
agggaguccccucccc

SEQ ID NO: 3818431 - RNA, 22 nt, Human
agggaguccccuccccggcccu

SEQ ID NO: 3818432 - RNA, 13 nt, Human
agggagucugcca

SEQ ID NO: 3818433 - RNA, 15 nt, Human
agggagucugccagg

SEQ ID NO: 3818434 - RNA, 17 nt, Human
agggagugacagaggca

SEQ ID NO: 3818435 - RNA, 19 nt, Human
agggagugacagaggcagc

SEQ ID NO: 3818436 - RNA, 17 nt, Human
agggagugcuggcucac

SEQ ID NO: 3818437 - RNA, 20 nt, Human
agggagugcuggcucacagu

SEQ ID NO: 3818438 - RNA, 23 nt, Human
agggagugcuggcucacaguaca

SEQ ID NO: 3818439 - RNA, 24 nt, Human
agggagugcuggcucacaguacag

SEQ ID NO: 3818440 - RNA, 17 nt, Human
agggaguguacucccag

SEQ ID NO: 3818441 - RNA, 18 nt, Human
agggaguguacucccagg

SEQ ID NO: 3818442 - RNA, 20 nt, Human
agggaguuacugaagucuua

SEQ ID NO: 3818443 - RNA, 23 nt, Human
agggauaaagaaaaaaauacuau

SEQ ID NO: 3818444 - RNA, 15 nt, Human
agggauaagguaccu

SEQ ID NO: 3818445 - RNA, 16 nt, Human
agggauacccauccca

SEQ ID NO: 3818446 - RNA, 22 nt, Human
agggauacgagcggaguccccu

SEQ ID NO: 3818447 - RNA, 13 nt, Human
agggauagagggg

SEQ ID NO: 3818448 - RNA, 17 nt, Human
agggauagcacugagca

SEQ ID NO: 3818449 - RNA, 22 nt, Human
agggauagcacugagcaaagca

SEQ ID NO: 3818450 - RNA, 18 nt, Human
agggauauauaagaugga

SEQ ID NO: 3818451 - RNA, 21 nt, Human
agggaucaaccagcuaagaaa

SEQ ID NO: 3818452 - RNA, 13 nt, Human
agggaucacaggg

SEQ ID NO: 3818453 - RNA, 15 nt, Human
agggaucacagggcc

SEQ ID NO: 3818454 - RNA, 19 nt, Human
agggaucaucaugcagcuc

SEQ ID NO: 3818455 - RNA, 15 nt, Human
agggaucccucaucu

SEQ ID NO: 3818456 - RNA, 19 nt, Human
agggaucccucaucugucc

SEQ ID NO: 3818457 - RNA, 22 nt, Human
agggaucuugcauucccagugg

SEQ ID NO: 3818458 - RNA, 22 nt, Human
agggaugacuaaaauauuuauu

SEQ ID NO: 3818459 - RNA, 20 nt, Human
agggaugagcauggagcugg

SEQ ID NO: 3818460 - RNA, 21 nt, Human
agggaugagcauggagcuggc

SEQ ID NO: 3818461 - RNA, 16 nt, Human
agggaugaggugcugg

SEQ ID NO: 3818462 - RNA, 18 nt, Human
agggaugccaucuguggg

SEQ ID NO: 3818463 - RNA, 17 nt, Human
agggaugcccuggaggu

SEQ ID NO: 3818464 - RNA, 20 nt, Human
agggaugcccuggagguggc

SEQ ID NO: 3818465 - RNA, 19 nt, Human
agggaugcugccugaguca

SEQ ID NO: 3818466 - RNA, 17 nt, Human
agggauggacaucuugu

SEQ ID NO: 3818467 - RNA, 13 nt, Human
agggauggacuga

SEQ ID NO: 3818468 - RNA, 17 nt, Human
agggauggacugaugcu

SEQ ID NO: 3818469 - RNA, 17 nt, Human
aucuaccaacuuucaag

SEQ ID NO: 3818470 - RNA, 15 nt, Human
aucuacccaaaggau

SEQ ID NO: 3818471 - RNA, 22 nt, Human
aucuaccccagacuagauguag

SEQ ID NO: 3818472 - RNA, 19 nt, Human
aucuaccuggagggaagag

SEQ ID NO: 3818473 - RNA, 22 nt, Human
aucuaccuuccagucaggauga

SEQ ID NO: 3818474 - RNA, 15 nt, Human
aucuaccuucuguag

SEQ ID NO: 3818475 - RNA, 15 nt, Human
aucuacuaauuccac

SEQ ID NO: 3818476 - RNA, 16 nt, Human
aucuacucagaaauuu

SEQ ID NO: 3818477 - RNA, 10 nt, Human
aucuacugca

SEQ ID NO: 3818478 - RNA, 13 nt, Human
aucuacugcauuu

SEQ ID NO: 3818479 - RNA, 21 nt, Human
aucuagaacacaggcaaaauc

SEQ ID NO: 3818480 - RNA, 16 nt, Human
aucuagaagaaaugaa

SEQ ID NO: 3818481 - RNA, 18 nt, Human
aucuagaagaaaugaaau

SEQ ID NO: 3818482 - RNA, 21 nt, Human
aucuagaagagucuauugucu

SEQ ID NO: 3818483 - RNA, 21 nt, Human
aucuagaauguguuuucugaa

SEQ ID NO: 3818484 - RNA, 19 nt, Human
aucuagaggcuuccuucau

SEQ ID NO: 3818485 - RNA, 15 nt, Human
aucuagcaaucacaa

SEQ ID NO: 3818486 - RNA, 17 nt, Human
aucuaggaaaauauuuu

SEQ ID NO: 3818487 - RNA, 19 nt, Human
aucuaggaaaauauuuuga

SEQ ID NO: 3818488 - RNA, 14 nt, Human
aucuaggaaaauua

SEQ ID NO: 3818489 - RNA, 17 nt, Human
aucuaggaagacuuugg

SEQ ID NO: 3818490 - RNA, 19 nt, Human
aucuaggaagacuuuggaa

SEQ ID NO: 3818491 - RNA, 23 nt, Human
aucuaggaagacuuuggaaagag

SEQ ID NO: 3818492 - RNA, 14 nt, Human
aucuaggagaggag

SEQ ID NO: 3818493 - RNA, 19 nt, Human
aucuaggauuuuaagggaa

SEQ ID NO: 3818494 - RNA, 14 nt, Human
aucuaggcaugaag

SEQ ID NO: 3818495 - RNA, 20 nt, Human
aucuaggcaugaagagcaaa

SEQ ID NO: 3818496 - RNA, 16 nt, Human
aucuagguaauuuuua

SEQ ID NO: 3818497 - RNA, 21 nt, Human
aucuagguggaguugaaagag

SEQ ID NO: 3818498 - RNA, 16 nt, Human
aucuagguuuaacuca

SEQ ID NO: 3818499 - RNA, 18 nt, Human
aucuagguuuaacucaga

SEQ ID NO: 3818500 - RNA, 21 nt, Human
aucuagguuuaugacaguaau

SEQ ID NO: 3818501 - RNA, 23 nt, Human
aucuagguuuaugacaguaauug

SEQ ID NO: 3818502 - RNA, 12 nt, Human
aucuaguaguug

SEQ ID NO: 3818503 - RNA, 21 nt, Human
aucuaguaguuguucugaaau

SEQ ID NO: 3818504 - RNA, 18 nt, Human
aucuaguaugaaauuaua

SEQ ID NO: 3818505 - RNA, 19 nt, Human
aucuagugcagcugauuuu

SEQ ID NO: 3818506 - RNA, 19 nt, Human
aucuaguuccccuguuuau

SEQ ID NO: 3818507 - RNA, 22 nt, Human
aucuaguuccccuguuuauuca

SEQ ID NO: 3818508 - RNA, 23 nt, Human
aucuaguuccccuguuuauucau

SEQ ID NO: 3818509 - RNA, 22 nt, Human
aucuaguuuacagaaaaaucuu

SEQ ID NO: 3818510 - RNA, 14 nt, Human
aucuauaaaauaga

SEQ ID NO: 3818511 - RNA, 15 nt, Human
aucuauaaacuauaa

SEQ ID NO: 3818512 - RNA, 23 nt, Human
aucuauaaggugcucucuuucug

SEQ ID NO: 3818513 - RNA, 11 nt, Human
aucuauaauuu

SEQ ID NO: 3818514 - RNA, 16 nt, Human
aucuauagaaagcuau

SEQ ID NO: 3818515 - RNA, 21 nt, Human
aucuauaguugauauguuuua

SEQ ID NO: 3818516 - RNA, 16 nt, Human
aucuauauaaaauaac

SEQ ID NO: 3818517 - RNA, 14 nt, Human
aucuauauauaauu

SEQ ID NO: 3818518 - RNA, 15 nt, Human
aucuauauauaauuc

SEQ ID NO: 3818519 - RNA, 19 nt, Human
aucuauauauaauucugua

SEQ ID NO: 3818520 - RNA, 15 nt, Human
aucuauauaugugua

SEQ ID NO: 3818521 - RNA, 16 nt, Human
aucuauauauguguau

SEQ ID NO: 3818522 - RNA, 18 nt, Human
aucuauauauguguaugu

SEQ ID NO: 3818523 - RNA, 19 nt, Human
aucuauauauguguaugua

SEQ ID NO: 3818524 - RNA, 14 nt, Human
aucuauauuuuaca

SEQ ID NO: 3818525 - RNA, 22 nt, Human
aucuaucaauagucaagaaaaa

SEQ ID NO: 3818526 - RNA, 19 nt, Human
aucuaucucaucuaucuca

SEQ ID NO: 3818527 - RNA, 19 nt, Human
aucuaucuggugauuucua

SEQ ID NO: 3818528 - RNA, 22 nt, Human
aucuaucuuaauacuaaggaac

SEQ ID NO: 3818529 - RNA, 16 nt, Human
aucuaugcauuuucug

SEQ ID NO: 3818530 - RNA, 19 nt, Human
aucuaugccaaagaucacu

SEQ ID NO: 3818531 - RNA, 23 nt, Human
aucuaugggagagugucaaccag

SEQ ID NO: 3818532 - RNA, 16 nt, Human
aucuauguuucaucuu

SEQ ID NO: 3818533 - RNA, 15 nt, Human
aucuauuaauauaug

SEQ ID NO: 3818534 - RNA, 18 nt, Human
aucuauuauacuguauua

SEQ ID NO: 3818535 - RNA, 15 nt, Human
aucuauucagacaag

SEQ ID NO: 3818536 - RNA, 23 nt, Human
aucuauucucuccaaaaaugcac

SEQ ID NO: 3818537 - RNA, 17 nt, Human
aucuauucugagaaaac

SEQ ID NO: 3818538 - RNA, 17 nt, Human
aucuauugggauuuucu

SEQ ID NO: 3818539 - RNA, 17 nt, Human
aucuauuggguucauua

SEQ ID NO: 3818540 - RNA, 19 nt, Human
aucuauuggguucauuauu

SEQ ID NO: 3818541 - RNA, 22 nt, Human
aucuauuggguucauuauugga

SEQ ID NO: 3818542 - RNA, 12 nt, Human
aucuauuguaag

SEQ ID NO: 3818543 - RNA, 13 nt, Human
aucuauuguaaga

SEQ ID NO: 3818544 - RNA, 17 nt, Human
aucuauuguaagauaaa

SEQ ID NO: 3818545 - RNA, 21 nt, Human
aucuauuguaagauaaaaaag

SEQ ID NO: 3818546 - RNA, 15 nt, Human
aucuauuuauuaaua

SEQ ID NO: 3818547 - RNA, 19 nt, Human
aucuauuuauuaauauuua

SEQ ID NO: 3818548 - RNA, 12 nt, Human
aucuauuugagg

SEQ ID NO: 3818549 - RNA, 12 nt, Human
aucuauuuguau

SEQ ID NO: 3818550 - RNA, 22 nt, Human
aucuauuuguauauauacauaa

SEQ ID NO: 3818551 - RNA, 16 nt, Human
aucuauuuucuaugua

SEQ ID NO: 3818552 - RNA, 18 nt, Human
aucuauuuugaugcagca

SEQ ID NO: 3818553 - RNA, 21 nt, Human
aucuauuuuuggagguuuauu

SEQ ID NO: 3818554 - RNA, 19 nt, Human
aucuauuuuuggcagucug

SEQ ID NO: 3818555 - RNA, 23 nt, Human
aucucaaauaacuaaaagguaug

SEQ ID NO: 3818556 - RNA, 20 nt, Human
aucucaaauaggcuauuaaa

SEQ ID NO: 3818557 - RNA, 20 nt, Human
aucucaacaggccucagggc

SEQ ID NO: 3818558 - RNA, 22 nt, Human
aucucaacaggccucagggcuc

SEQ ID NO: 3818559 - RNA, 22 nt, Human
aucucaagaugggggcagggcu

SEQ ID NO: 3818560 - RNA, 13 nt, Human
aucucaauauuuc

SEQ ID NO: 3818561 - RNA, 15 nt, Human
aucucacacaugagc

SEQ ID NO: 3818562 - RNA, 23 nt, Human
aucucacacaugagcaucaggcc

SEQ ID NO: 3818563 - RNA, 11 nt, Human
aucucacacuc

SEQ ID NO: 3818564 - RNA, 15 nt, Human
aucucacagcacacu

SEQ ID NO: 3818565 - RNA, 12 nt, Human
aucucacagcua

SEQ ID NO: 3818566 - RNA, 19 nt, Human
agggccaaaagcuucccuc

SEQ ID NO: 3818567 - RNA, 21 nt, Human
agggccaacccuucuccucuu

SEQ ID NO: 3818568 - RNA, 18 nt, Human
agggccacacuauuacca

SEQ ID NO: 3818569 - RNA, 23 nt, Human
agggccaccuacaauacaucuga

SEQ ID NO: 3818570 - RNA, 14 nt, Human
agggccacucugcc

SEQ ID NO: 3818571 - RNA, 16 nt, Human
agggccagaucuguua

SEQ ID NO: 3818572 - RNA, 18 nt, Human
agggccagccucuagagc

SEQ ID NO: 3818573 - RNA, 16 nt, Human
agggccaggagaugga

SEQ ID NO: 3818574 - RNA, 13 nt, Human
agggccaggcagg

SEQ ID NO: 3818575 - RNA, 20 nt, Human
agggccaggggucucccugg

SEQ ID NO: 3818576 - RNA, 13 nt, Human
agggccaguccug

SEQ ID NO: 3818577 - RNA, 17 nt, Human
agggccaguggggccug

SEQ ID NO: 3818578 - RNA, 19 nt, Human
agggccaguggggccugug

SEQ ID NO: 3818579 - RNA, 20 nt, Human
agggccaguggggccugugg

SEQ ID NO: 3818580 - RNA, 19 nt, Human
agggccaugcugaagggac

SEQ ID NO: 3818581 - RNA, 16 nt, Human
agggcccaagucccug

SEQ ID NO: 3818582 - RNA, 22 nt, Human
agggcccaagucccuguuuucu

SEQ ID NO: 3818583 - RNA, 15 nt, Human
agggcccacuuguau

SEQ ID NO: 3818584 - RNA, 12 nt, Human
agggcccagaga

SEQ ID NO: 3818585 - RNA, 13 nt, Human
agggcccagagag

SEQ ID NO: 3818586 - RNA, 18 nt, Human
agggcccagagagggugg

SEQ ID NO: 3818587 - RNA, 15 nt, Human
agggcccagagcagg

SEQ ID NO: 3818588 - RNA, 14 nt, Human
agggcccagagccc

SEQ ID NO: 3818589 - RNA, 15 nt, Human
agggcccagagccca

SEQ ID NO: 3818590 - RNA, 16 nt, Human
agggcccagagcccag

SEQ ID NO: 3818591 - RNA, 18 nt, Human
agggcccagagcccagcu

SEQ ID NO: 3818592 - RNA, 15 nt, Human
agggcccagaggcug

SEQ ID NO: 3818593 - RNA, 14 nt, Human
agggccccagcacu

SEQ ID NO: 3818594 - RNA, 17 nt, Human
agggccccucugcccag

SEQ ID NO: 3818595 - RNA, 20 nt, Human
agggccccucugcccagcuu

SEQ ID NO: 3818596 - RNA, 23 nt, Human
agggccccucugcccagcuuggg

SEQ ID NO: 3818597 - RNA, 19 nt, Human
agggcccugagcugagggc

SEQ ID NO: 3818598 - RNA, 12 nt, Human
agggcccugcag

SEQ ID NO: 3818599 - RNA, 13 nt, Human
agggcccuggagg

SEQ ID NO: 3818600 - RNA, 15 nt, Human
agggcccuggaggcg

SEQ ID NO: 3818601 - RNA, 16 nt, Human
agggcccugggccugc

SEQ ID NO: 3818602 - RNA, 18 nt, Human
agggcccugggccugccu

SEQ ID NO: 3818603 - RNA, 17 nt, Human
agggcccuuuuucaaua

SEQ ID NO: 3818604 - RNA, 20 nt, Human
agggccgaggaggugccugg

SEQ ID NO: 3818605 - RNA, 15 nt, Human
agggccgagugagag

SEQ ID NO: 3818606 - RNA, 20 nt, Human
agggccgccagggagaccug

SEQ ID NO: 3818607 - RNA, 16 nt, Human
agggccgggcagaggg

SEQ ID NO: 3818608 - RNA, 21 nt, Human
agggccggggaacuggccaag

SEQ ID NO: 3818609 - RNA, 19 nt, Human
agggccguaccccacccuc

SEQ ID NO: 3818610 - RNA, 20 nt, Human
agggccguaccccacccuca

SEQ ID NO: 3818611 - RNA, 19 nt, Human
agggccuagcugcuacaaa

SEQ ID NO: 3818612 - RNA, 23 nt, Human
agggccugcaggaccugccugua

SEQ ID NO: 3818613 - RNA, 17 nt, Human
agggccugcgagggcag

SEQ ID NO: 3818614 - RNA, 18 nt, Human
agggccugcuggaggccu

SEQ ID NO: 3818615 - RNA, 13 nt, Human
agggccuggccca

SEQ ID NO: 3818616 - RNA, 16 nt, Human
agggccuggccugagc

SEQ ID NO: 3818617 - RNA, 13 nt, Human
agggccuggcuca

SEQ ID NO: 3818618 - RNA, 18 nt, Human
agggccuggcucaggugg

SEQ ID NO: 3818619 - RNA, 15 nt, Human
agggccuggggccug

SEQ ID NO: 3818620 - RNA, 19 nt, Human
agggccuggggccugagag

SEQ ID NO: 3818621 - RNA, 22 nt, Human
agggccuggguuuucauguuuu

SEQ ID NO: 3818622 - RNA, 19 nt, Human
agggccugugggagccugc

SEQ ID NO: 3818623 - RNA, 16 nt, Human
agggccuuaaaagcca

SEQ ID NO: 3818624 - RNA, 14 nt, Human
agggccuugcccag

SEQ ID NO: 3818625 - RNA, 15 nt, Human
agggccuugcccaga

SEQ ID NO: 3818626 - RNA, 15 nt, Human
agggccuuuucuggc

SEQ ID NO: 3818627 - RNA, 20 nt, Human
agggccuuuucuggcaccgc

SEQ ID NO: 3818628 - RNA, 13 nt, Human
agggcggcagggg

SEQ ID NO: 3818629 - RNA, 16 nt, Human
agggcggcaggggccu

SEQ ID NO: 3818630 - RNA, 18 nt, Human
agggcggcaggggccugg

SEQ ID NO: 3818631 - RNA, 19 nt, Human
agggcggcaggggccugga

SEQ ID NO: 3818632 - RNA, 18 nt, Human
agggcgggcagagggcug

SEQ ID NO: 3818633 - RNA, 19 nt, Human
agggcgggcagagggcugg

SEQ ID NO: 3818634 - RNA, 15 nt, Human
aucugcaggcagaca

SEQ ID NO: 3818635 - RNA, 20 nt, Human
aucugcagggggugugucug

SEQ ID NO: 3818636 - RNA, 14 nt, Human
aucugcauucccag

SEQ ID NO: 3818637 - RNA, 20 nt, Human
aucugcauugcccagucuuu

SEQ ID NO: 3818638 - RNA, 22 nt, Human
aucugcauuuucaccccacccu

SEQ ID NO: 3818639 - RNA, 14 nt, Human
aucugcccaacugu

SEQ ID NO: 3818640 - RNA, 12 nt, Human
aucugcccagga

SEQ ID NO: 3818641 - RNA, 13 nt, Human
aucugcccaggac

SEQ ID NO: 3818642 - RNA, 15 nt, Human
aucugcccaggggug

SEQ ID NO: 3818643 - RNA, 15 nt, Human
aucugccccuccccc

SEQ ID NO: 3818644 - RNA, 16 nt, Human
aucugccccucccugc

SEQ ID NO: 3818645 - RNA, 20 nt, Human
aucugcccgccugcccaccu

SEQ ID NO: 3818646 - RNA, 21 nt, Human
aucugcccgccugcccaccug

SEQ ID NO: 3818647 - RNA, 14 nt, Human
aucugccuaaggac

SEQ ID NO: 3818648 - RNA, 17 nt, Human
aucugccuaaggacuuc

SEQ ID NO: 3818649 - RNA, 21 nt, Human
aucugccuuaaaaccaaagag

SEQ ID NO: 3818650 - RNA, 22 nt, Human
aucugccuuuauuguguuuguc

SEQ ID NO: 3818651 - RNA, 16 nt, Human
aucugcgugacaauaa

SEQ ID NO: 3818652 - RNA, 21 nt, Human
aucugcgugacaauaaaacau

SEQ ID NO: 3818653 - RNA, 23 nt, Human
aucugcgugacaauaaaacauua

SEQ ID NO: 3818654 - RNA, 18 nt, Human
aucugcuaccaaaacagu

SEQ ID NO: 3818655 - RNA, 14 nt, Human
aucugcucagcagc

SEQ ID NO: 3818656 - RNA, 15 nt, Human
aucugcucagcagcu

SEQ ID NO: 3818657 - RNA, 14 nt, Human
aucugcucagcccu

SEQ ID NO: 3818658 - RNA, 13 nt, Human
aucugcuccuccc

SEQ ID NO: 3818659 - RNA, 14 nt, Human
aucugcucuccuuc

SEQ ID NO: 3818660 - RNA, 17 nt, Human
aucugcucuccuuccug

SEQ ID NO: 3818661 - RNA, 21 nt, Human
aucugcucuccuuccuggagc

SEQ ID NO: 3818662 - RNA, 16 nt, Human
aucugcugcagagcag

SEQ ID NO: 3818663 - RNA, 15 nt, Human
aucugcuguauaugg

SEQ ID NO: 3818664 - RNA, 18 nt, Human
aucugcuguccagacagc

SEQ ID NO: 3818665 - RNA, 23 nt, Human
aucugcuguccagacagccugua

SEQ ID NO: 3818666 - RNA, 12 nt, Human
aucugcugucuu

SEQ ID NO: 3818667 - RNA, 21 nt, Human
aucugcuuaggaguuuaggga

SEQ ID NO: 3818668 - RNA, 21 nt, Human
aucugcuuaguagagcuuuuu

SEQ ID NO: 3818669 - RNA, 14 nt, Human
aucugcuucagugg

SEQ ID NO: 3818670 - RNA, 14 nt, Human
aucugcuuuuauua

SEQ ID NO: 3818671 - RNA, 22 nt, Human
aucugcuuuuuaaagaaugcuc

SEQ ID NO: 3818672 - RNA, 23 nt, Human
aucuggaaaccucuacauauuua

SEQ ID NO: 3818673 - RNA, 11 nt, Human
aucuggaaccc

SEQ ID NO: 3818674 - RNA, 14 nt, Human
aucuggaacccaga

SEQ ID NO: 3818675 - RNA, 17 nt, Human
aucuggaacccagacuc

SEQ ID NO: 3818676 - RNA, 23 nt, Human
aucuggaacccagacucagacau

SEQ ID NO: 3818677 - RNA, 11 nt, Human
aucuggaaccu

SEQ ID NO: 3818678 - RNA, 14 nt, Human
aucuggaagaaaaa

SEQ ID NO: 3818679 - RNA, 21 nt, Human
aucuggaaucuggagaccagg

SEQ ID NO: 3818680 - RNA, 18 nt, Human
aucuggacuccucugucc

SEQ ID NO: 3818681 - RNA, 19 nt, Human
aucuggacuccucugucca

SEQ ID NO: 3818682 - RNA, 22 nt, Human
aucuggacuccucuguccaggc

SEQ ID NO: 3818683 - RNA, 20 nt, Human
aucuggagaccagggagccu

SEQ ID NO: 3818684 - RNA, 16 nt, Human
aucuggagagaacagg

SEQ ID NO: 3818685 - RNA, 19 nt, Human
aucuggaggccuuccagcu

SEQ ID NO: 3818686 - RNA, 21 nt, Human
aucuggauaggagccugcugg

SEQ ID NO: 3818687 - RNA, 17 nt, Human
aucuggcaacaucuuua

SEQ ID NO: 3818688 - RNA, 21 nt, Human
aucuggccccagguagaaacu

SEQ ID NO: 3818689 - RNA, 17 nt, Human
aucuggccuaaaaucuu

SEQ ID NO: 3818690 - RNA, 20 nt, Human
aucuggccuaaaaucuugga

SEQ ID NO: 3818691 - RNA, 12 nt, Human
aucuggccuggc

SEQ ID NO: 3818692 - RNA, 16 nt, Human
aucuggccuggccugg

SEQ ID NO: 3818693 - RNA, 16 nt, Human
aucuggcugccuuugc

SEQ ID NO: 3818694 - RNA, 18 nt, Human
aucuggcuuauuuuaaug

SEQ ID NO: 3818695 - RNA, 22 nt, Human
aucuggcuuauuuuaaugugau

SEQ ID NO: 3818696 - RNA, 11 nt, Human
aucugggaaag

SEQ ID NO: 3818697 - RNA, 17 nt, Human
aucugggacccuuuccu

SEQ ID NO: 3818698 - RNA, 20 nt, Human
aucugggacccuuuccuucc

SEQ ID NO: 3818699 - RNA, 23 nt, Human
aucugggacccuuuccuuccuuc

SEQ ID NO: 3818700 - RNA, 22 nt, Human
aucugggauucccaccaagguc

SEQ ID NO: 3818701 - RNA, 18 nt, Human
aucugggcauagaugcag

SEQ ID NO: 3818702 - RNA, 17 nt, Human
aucugggccagaauuuc

SEQ ID NO: 3818703 - RNA, 13 nt, Human
aucugggccuggg

SEQ ID NO: 3818704 - RNA, 19 nt, Human
aucugggccuuggccugga

SEQ ID NO: 3818705 - RNA, 21 nt, Human
aucugggccuuggccuggagc

SEQ ID NO: 3818706 - RNA, 17 nt, Human
aucugggcugugggcaa

SEQ ID NO: 3818707 - RNA, 13 nt, Human
aucugggcuuccu

SEQ ID NO: 3818708 - RNA, 14 nt, Human
aucugggcuuccug

SEQ ID NO: 3818709 - RNA, 16 nt, Human
aucugggcuuccugga

SEQ ID NO: 3818710 - RNA, 15 nt, Human
aucugggggagugga

SEQ ID NO: 3818711 - RNA, 21 nt, Human
agguccagcccuggcugaagg

SEQ ID NO: 3818712 - RNA, 23 nt, Human
agguccagcccuggcugaaggac

SEQ ID NO: 3818713 - RNA, 16 nt, Human
agguccagcucuggag

SEQ ID NO: 3818714 - RNA, 12 nt, Human
aggucccaaggc

SEQ ID NO: 3818715 - RNA, 17 nt, Human
aggucccaccuccagcc

SEQ ID NO: 3818716 - RNA, 18 nt, Human
aggucccaccuccagccc

SEQ ID NO: 3818717 - RNA, 19 nt, Human
aggucccaccuccagcccg

SEQ ID NO: 3818718 - RNA, 14 nt, Human
aggucccaggcaga

SEQ ID NO: 3818719 - RNA, 15 nt, Human
aggucccccugcagc

SEQ ID NO: 3818720 - RNA, 16 nt, Human
aggucccccugcagcu

SEQ ID NO: 3818721 - RNA, 12 nt, Human
aggucccuaaua

SEQ ID NO: 3818722 - RNA, 13 nt, Human
aggucccuaauaa

SEQ ID NO: 3818723 - RNA, 19 nt, Human
agguccgguguucuaagau

SEQ ID NO: 3818724 - RNA, 16 nt, Human
agguccucagaaagug

SEQ ID NO: 3818725 - RNA, 17 nt, Human
agguccuccccucucuu

SEQ ID NO: 3818726 - RNA, 21 nt, Human
agguccucuacuuaaugagau

SEQ ID NO: 3818727 - RNA, 19 nt, Human
agguccucugucagucaca

SEQ ID NO: 3818728 - RNA, 23 nt, Human
agguccucugucagucacagcca

SEQ ID NO: 3818729 - RNA, 21 nt, Human
agguccugaaaguaacucaua

SEQ ID NO: 3818730 - RNA, 12 nt, Human
agguccugagca

SEQ ID NO: 3818731 - RNA, 13 nt, Human
agguccugagcac

SEQ ID NO: 3818732 - RNA, 15 nt, Human
agguccugagcacug

SEQ ID NO: 3818733 - RNA, 20 nt, Human
agguccugagcacugccagg

SEQ ID NO: 3818734 - RNA, 19 nt, Human
agguccugggggccugacc

SEQ ID NO: 3818735 - RNA, 14 nt, Human
agguccuggugggg

SEQ ID NO: 3818736 - RNA, 19 nt, Human
agguccugguggggcagcu

SEQ ID NO: 3818737 - RNA, 14 nt, Human
aggucgggcucagc

SEQ ID NO: 3818738 - RNA, 22 nt, Human
aggucuauuuggauuauucuuu

SEQ ID NO: 3818739 - RNA, 19 nt, Human
aggucucagaaucuuuccu

SEQ ID NO: 3818740 - RNA, 20 nt, Human
aggucucauagguugagcaa

SEQ ID NO: 3818741 - RNA, 23 nt, Human
aggucucccgggaagccacccuc

SEQ ID NO: 3818742 - RNA, 13 nt, Human
aggucuccuccac

SEQ ID NO: 3818743 - RNA, 11 nt, Human
aggucuccucu

SEQ ID NO: 3818744 - RNA, 19 nt, Human
aggucucgcugaugcuggg

SEQ ID NO: 3818745 - RNA, 22 nt, Human
aggucucgcugaugcugggcug

SEQ ID NO: 3818746 - RNA, 16 nt, Human
aggucucucuuuggac

SEQ ID NO: 3818747 - RNA, 23 nt, Human
aggucucucuuuggacucucccc

SEQ ID NO: 3818748 - RNA, 12 nt, Human
aggucucuuccc

SEQ ID NO: 3818749 - RNA, 15 nt, Human
aggucucuugaggga

SEQ ID NO: 3818750 - RNA, 23 nt, Human
aggucugaaauuuuucuucuuga

SEQ ID NO: 3818751 - RNA, 23 nt, Human
aggucugagccacagcagcauuu

SEQ ID NO: 3818752 - RNA, 23 nt, Human
aggucugaguuguuaccccaagc

SEQ ID NO: 3818753 - RNA, 14 nt, Human
aggucugcucggcc

SEQ ID NO: 3818754 - RNA, 22 nt, Human
aggucugggagaggcagagugc

SEQ ID NO: 3818755 - RNA, 16 nt, Human
aggucuguuugcuguu

SEQ ID NO: 3818756 - RNA, 20 nt, Human
aggucuucaucgaaucuacu

SEQ ID NO: 3818757 - RNA, 21 nt, Human
aggucuucaucgaaucuacua

SEQ ID NO: 3818758 - RNA, 19 nt, Human
aggucuucuuaauauguuc

SEQ ID NO: 3818759 - RNA, 17 nt, Human
aggucuugaacuccugg

SEQ ID NO: 3818760 - RNA, 11 nt, Human
aggucuugcua

SEQ ID NO: 3818761 - RNA, 15 nt, Human
aggucuugcucuccu

SEQ ID NO: 3818762 - RNA, 19 nt, Human
aggucuuggaacuugccug

SEQ ID NO: 3818763 - RNA, 21 nt, Human
aggucuuggagcugagccucu

SEQ ID NO: 3818764 - RNA, 18 nt, Human
aggucuuggugccucugc

SEQ ID NO: 3818765 - RNA, 18 nt, Human
aggucuuucaguacuuuu

SEQ ID NO: 3818766 - RNA, 23 nt, Human
aggucuuuguaagaacuaaagaa

SEQ ID NO: 3818767 - RNA, 19 nt, Human
aggucuuuugacaugugga

SEQ ID NO: 3818768 - RNA, 20 nt, Human
aggugaaacuccagaugcca

SEQ ID NO: 3818769 - RNA, 22 nt, Human
aggugaaacuccagaugccaca

SEQ ID NO: 3818770 - RNA, 14 nt, Human
aggugaaagggagc

SEQ ID NO: 3818771 - RNA, 16 nt, Human
aggugaaggaauauau

SEQ ID NO: 3818772 - RNA, 13 nt, Human
aggugaaggaggc

SEQ ID NO: 3818773 - RNA, 19 nt, Human
aggugaaggaggcuccagg

SEQ ID NO: 3818774 - RNA, 23 nt, Human
aggugaaggaggcuccaggcagc

SEQ ID NO: 3818775 - RNA, 19 nt, Human
aggugaauagccauauuug

SEQ ID NO: 3818776 - RNA, 21 nt, Human
aggugaauagccauauuugua

SEQ ID NO: 3818777 - RNA, 22 nt, Human
aggugaauagccauauuuguaa

SEQ ID NO: 3818778 - RNA, 15 nt, Human
aggugacacuauagu

SEQ ID NO: 3818779 - RNA, 18 nt, Human
aggugacagaaggaccag

SEQ ID NO: 3818780 - RNA, 13 nt, Human
aggugacagagug

SEQ ID NO: 3818781 - RNA, 20 nt, Human
aggugacaugugaaaccuuu

SEQ ID NO: 3818782 - RNA, 22 nt, Human
aggugaccaaaauccccuucuc

SEQ ID NO: 3818783 - RNA, 14 nt, Human
aggugaccccaggg

SEQ ID NO: 3818784 - RNA, 15 nt, Human
aggugaccccagggc

SEQ ID NO: 3818785 - RNA, 16 nt, Human
aggugaccccagggca

SEQ ID NO: 3818786 - RNA, 18 nt, Human
aggugaccccagggcaca

SEQ ID NO: 3818787 - RNA, 14 nt, Human
aggugacugucugg

SEQ ID NO: 3818788 - RNA, 17 nt, Human
aggugacugucugggga

SEQ ID NO: 3818789 - RNA, 18 nt, Human
aggugacugucuggggag

SEQ ID NO: 3818790 - RNA, 13 nt, Human
aggugagaaaaaa

SEQ ID NO: 3818791 - RNA, 23 nt, Human
aggugagaagcagaggaaggaga

SEQ ID NO: 3818792 - RNA, 14 nt, Human
aggugagaccaccu

SEQ ID NO: 3818793 - RNA, 22 nt, Human
aggugagcaaccaguuggcuag

SEQ ID NO: 3818794 - RNA, 22 nt, Human
aggugagcacggccaacaaagc

SEQ ID NO: 3818795 - RNA, 20 nt, Human
aggugagcccauggcccucc

SEQ ID NO: 3818796 - RNA, 14 nt, Human
aggugaggccuguc

SEQ ID NO: 3818797 - RNA, 20 nt, Human
aggugaggccugucugugac

SEQ ID NO: 3818798 - RNA, 17 nt, Human
aggugaggucagcacau

SEQ ID NO: 3818799 - RNA, 21 nt, Human
aggugauaagggaaaagauaa

SEQ ID NO: 3818800 - RNA, 21 nt, Human
aggugauccacccaccucagc

SEQ ID NO: 3818801 - RNA, 18 nt, Human
aggugauccauguaacug

SEQ ID NO: 3818802 - RNA, 16 nt, Human
aggugaugaagacagc

SEQ ID NO: 3818803 - RNA, 21 nt, Human
aggugcaacagacuugaaugc

SEQ ID NO: 3818804 - RNA, 15 nt, Human
aggugcaauuucaag

SEQ ID NO: 3818805 - RNA, 18 nt, Human
aggugcaauuucaagguu

SEQ ID NO: 3818806 - RNA, 15 nt, Human
aggugcacaagcucc

SEQ ID NO: 3818807 - RNA, 18 nt, Human
aggugcacaagcuccaag

SEQ ID NO: 3818808 - RNA, 17 nt, Human
aggugcagagugcccag

SEQ ID NO: 3818809 - RNA, 14 nt, Human
aggugcagccagag

SEQ ID NO: 3818810 - RNA, 13 nt, Human
aggugcaggcagg

SEQ ID NO: 3818811 - RNA, 16 nt, Human
aggugccagcaaagcc

SEQ ID NO: 3818812 - RNA, 18 nt, Human
aggugcccagaaugaggc

SEQ ID NO: 3818813 - RNA, 12 nt, Human
aggugcccagga

SEQ ID NO: 3818814 - RNA, 15 nt, Human
aggugcccaggagaa

SEQ ID NO: 3818815 - RNA, 17 nt, Human
aggugcccaucccugga

SEQ ID NO: 3818816 - RNA, 17 nt, Human
aggugccccucucucca

SEQ ID NO: 3818817 - RNA, 15 nt, Human
aggugcccgccacca

SEQ ID NO: 3818818 - RNA, 18 nt, Human
aggugccucaagagaagg

SEQ ID NO: 3818819 - RNA, 15 nt, Human
aggugccuccaggug

SEQ ID NO: 3818820 - RNA, 17 nt, Human
aggugccugugaggcag

SEQ ID NO: 3818821 - RNA, 19 nt, Human
aggugccugugaggcaggg

SEQ ID NO: 3818822 - RNA, 20 nt, Human
aggugccugugaggcagggg

SEQ ID NO: 3818823 - RNA, 21 nt, Human
aggugccugugaggcaggggc

SEQ ID NO: 3818824 - RNA, 13 nt, Human
aggugccuucuuc

SEQ ID NO: 3818825 - RNA, 17 nt, Human
aggugccuucuucaggg

SEQ ID NO: 3818826 - RNA, 21 nt, Human
aggugccuucuucagggccug

SEQ ID NO: 3818827 - RNA, 18 nt, Human
aggugccuuucaaauuua

SEQ ID NO: 3818828 - RNA, 23 nt, Human
aggugcuaaauggucgcccagga

SEQ ID NO: 3818829 - RNA, 16 nt, Human
aggugcuacaaaaaca

SEQ ID NO: 3818830 - RNA, 22 nt, Human
aggugcuacaaaaacacagcaa

SEQ ID NO: 3818831 - RNA, 20 nt, Human
aggugcuacacccuuuucca

SEQ ID NO: 3818832 - RNA, 22 nt, Human
aggugcuaggaacacuccuuca

SEQ ID NO: 3818833 - RNA, 17 nt, Human
aggugcuauuguuacuc

SEQ ID NO: 3818834 - RNA, 21 nt, Human
aggugcugagcaaagggaaca

SEQ ID NO: 3818835 - RNA, 17 nt, Human
aggugcugccauccagg

SEQ ID NO: 3818836 - RNA, 21 nt, Human
aggugcugcuacccucccugc

SEQ ID NO: 3818837 - RNA, 23 nt, Human
aggugcugcuacccucccugcug

SEQ ID NO: 3818838 - RNA, 16 nt, Human
aggugcuggagcacug

SEQ ID NO: 3818839 - RNA, 23 nt, Human
aggugcuggaggugggagcagga

SEQ ID NO: 3818840 - RNA, 19 nt, Human
aggugcuguugucauugcu

SEQ ID NO: 3818841 - RNA, 23 nt, Human
aggugcuuauucucaaagcagga

SEQ ID NO: 3818842 - RNA, 21 nt, Human
aggugcuucaggauaccauau

SEQ ID NO: 3818843 - RNA, 18 nt, Human
augagucuguuguguguc

SEQ ID NO: 3818844 - RNA, 17 nt, Human
augagugaauaaauguc

SEQ ID NO: 3818845 - RNA, 13 nt, Human
augagugagaaua

SEQ ID NO: 3818846 - RNA, 17 nt, Human
augagugcgugcucagu

SEQ ID NO: 3818847 - RNA, 19 nt, Human
augagugcguggugcgagu

SEQ ID NO: 3818848 - RNA, 22 nt, Human
augagugcguggugcgagugcg

SEQ ID NO: 3818849 - RNA, 15 nt, Human
augaguggaaaaagc

SEQ ID NO: 3818850 - RNA, 20 nt, Human
augaguguaacaagaaagga

SEQ ID NO: 3818851 - RNA, 13 nt, Human
augagugugaagg

SEQ ID NO: 3818852 - RNA, 12 nt, Human
augagugugcau

SEQ ID NO: 3818853 - RNA, 22 nt, Human
augaguuguuuucagacucaga

SEQ ID NO: 3818854 - RNA, 22 nt, Human
auggaaacaaaguggaaggaaa

SEQ ID NO: 3818855 - RNA, 22 nt, Human
auggaaacccauaggcccacac

SEQ ID NO: 3818856 - RNA, 13 nt, Human
auggaaacgguga

SEQ ID NO: 3818857 - RNA, 16 nt, Human
auggaaacugaaugcu

SEQ ID NO: 3818858 - RNA, 15 nt, Human
auggaaaggagagga

SEQ ID NO: 3818859 - RNA, 16 nt, Human
auggaaaguaacucau

SEQ ID NO: 3818860 - RNA, 19 nt, Human
auggaaaugggcagagcag

SEQ ID NO: 3818861 - RNA, 20 nt, Human
auggaaauucccuucaucug

SEQ ID NO: 3818862 - RNA, 17 nt, Human
auggaaauuuaaagcag

SEQ ID NO: 3818863 - RNA, 14 nt, Human
auggaacacucuga

SEQ ID NO: 3818864 - RNA, 15 nt, Human
auggaacaggcucag

SEQ ID NO: 3818865 - RNA, 17 nt, Human
auggaaccaggcuugga

SEQ ID NO: 3818866 - RNA, 23 nt, Human
auggaacccuuuuggcccccgag

SEQ ID NO: 3818867 - RNA, 13 nt, Human
auggaaccuccuu

SEQ ID NO: 3818868 - RNA, 16 nt, Human
auggaacgcguugaaa

SEQ ID NO: 3818869 - RNA, 17 nt, Human
auggaacgcguugaaau

SEQ ID NO: 3818870 - RNA, 19 nt, Human
auggaacgcguugaaauug

SEQ ID NO: 3818871 - RNA, 22 nt, Human
auggaacucauuccugccuguc

SEQ ID NO: 3818872 - RNA, 12 nt, Human
auggaagaaagu

SEQ ID NO: 3818873 - RNA, 14 nt, Human
auggaagaaaguaa

SEQ ID NO: 3818874 - RNA, 14 nt, Human
auggaagacacauu

SEQ ID NO: 3818875 - RNA, 15 nt, Human
auggaagacagcucu

SEQ ID NO: 3818876 - RNA, 18 nt, Human
auggaagacagcucuuau

SEQ ID NO: 3818877 - RNA, 12 nt, Human
auggaagagaaa

SEQ ID NO: 3818878 - RNA, 13 nt, Human
auggaagagaaau

SEQ ID NO: 3818879 - RNA, 14 nt, Human
auggaagagaaauc

SEQ ID NO: 3818880 - RNA, 20 nt, Human
auggaagaggaaaaggcugg

SEQ ID NO: 3818881 - RNA, 14 nt, Human
auggaagccaacac

SEQ ID NO: 3818882 - RNA, 15 nt, Human
auggaagcuuccagu

SEQ ID NO: 3818883 - RNA, 14 nt, Human
auggaaggggcuga

SEQ ID NO: 3818884 - RNA, 22 nt, Human
auggaagguuuguauauuguca

SEQ ID NO: 3818885 - RNA, 21 nt, Human
auggaaguacuauaauuuacc

SEQ ID NO: 3818886 - RNA, 17 nt, Human
auggaauacaguguuau

SEQ ID NO: 3818887 - RNA, 21 nt, Human
auggaaucccacuguaugauu

SEQ ID NO: 3818888 - RNA, 14 nt, Human
auggaaugaggguu

SEQ ID NO: 3818889 - RNA, 15 nt, Human
auggaaugcuugaaa

SEQ ID NO: 3818890 - RNA, 16 nt, Human
auggaaugcuugaaaa

SEQ ID NO: 3818891 - RNA, 20 nt, Human
auggaaugcuugaaaaaugu

SEQ ID NO: 3818892 - RNA, 17 nt, Human
auggaauucacaaagua

SEQ ID NO: 3818893 - RNA, 13 nt, Human
auggaauugauuu

SEQ ID NO: 3818894 - RNA, 17 nt, Human
auggaauugauuugcau

SEQ ID NO: 3818895 - RNA, 17 nt, Human
auggaauugcuuaccaa

SEQ ID NO: 3818896 - RNA, 13 nt, Human
auggaauuucaua

SEQ ID NO: 3818897 - RNA, 17 nt, Human
auggaauuuguaaguuu

SEQ ID NO: 3818898 - RNA, 21 nt, Human
auggaauuuguaaguuuaugu

SEQ ID NO: 3818899 - RNA, 17 nt, Human
auggaauuuugcaaaga

SEQ ID NO: 3818900 - RNA, 19 nt, Human
auggaauuuugcaaagauu

SEQ ID NO: 3818901 - RNA, 16 nt, Human
auggaauuuuuuugua

SEQ ID NO: 3818902 - RNA, 18 nt, Human
auggaauuuuuuuguacg

SEQ ID NO: 3818903 - RNA, 23 nt, Human
auggacaccccuuauccaggacu

SEQ ID NO: 3818904 - RNA, 16 nt, Human
auggacacuacaccca

SEQ ID NO: 3818905 - RNA, 17 nt, Human
auggacacuacacccag

SEQ ID NO: 3818906 - RNA, 18 nt, Human
auggacacuacacccagc

SEQ ID NO: 3818907 - RNA, 11 nt, Human
auggacacucc

SEQ ID NO: 3818908 - RNA, 15 nt, Human
auggacacuccaggg

SEQ ID NO: 3818909 - RNA, 19 nt, Human
auggacacuccagugccag

SEQ ID NO: 3818910 - RNA, 15 nt, Human
auggacacuuugaaa

SEQ ID NO: 3818911 - RNA, 23 nt, Human
auggacacuuugaaauguguuuc

SEQ ID NO: 3818912 - RNA, 20 nt, Human
auggacagaagaaggcagca

SEQ ID NO: 3818913 - RNA, 16 nt, Human
auggacagauuaauau

SEQ ID NO: 3818914 - RNA, 18 nt, Human
auggacaguucacacccu

SEQ ID NO: 3818915 - RNA, 19 nt, Human
auggacaguucacacccug

SEQ ID NO: 3818916 - RNA, 19 nt, Human
auggacaucuugucauuuu

SEQ ID NO: 3818917 - RNA, 18 nt, Human
auggacauuuagaagaaa

SEQ ID NO: 3818918 - RNA, 22 nt, Human
auggaccacuguuucuugcuug

SEQ ID NO: 3818919 - RNA, 16 nt, Human
auggaccggagagugg

SEQ ID NO: 3818920 - RNA, 15 nt, Human
auggaccuaacauuc

SEQ ID NO: 3818921 - RNA, 14 nt, Human
auggaccugucacg

SEQ ID NO: 3818922 - RNA, 22 nt, Human
auggacggugcuccaggcaggc

SEQ ID NO: 3818923 - RNA, 17 nt, Human
auggacuaucugucugg

SEQ ID NO: 3818924 - RNA, 22 nt, Human
auggacuaucugucugguggcc

SEQ ID NO: 3818925 - RNA, 21 nt, Human
auggacuccagccugccuggc

SEQ ID NO: 3818926 - RNA, 19 nt, Human
auggacuccuguuguugaa

SEQ ID NO: 3818927 - RNA, 14 nt, Human
auggacucuacacu

SEQ ID NO: 3818928 - RNA, 16 nt, Human
auggacucuacacugu

SEQ ID NO: 3818929 - RNA, 13 nt, Human
auggacucugucc

SEQ ID NO: 3818930 - RNA, 14 nt, Human
auggacucuguccu

SEQ ID NO: 3818931 - RNA, 16 nt, Human
auggacucuguccuga

SEQ ID NO: 3818932 - RNA, 16 nt, Human
auggacuuguauauuu

SEQ ID NO: 3818933 - RNA, 18 nt, Human
auggacuuuggaagcagg

SEQ ID NO: 3818934 - RNA, 13 nt, Human
auggagaaagcug

SEQ ID NO: 3818935 - RNA, 14 nt, Human
auggagaagcugca

SEQ ID NO: 3818936 - RNA, 17 nt, Human
auggagaauugcugaag

SEQ ID NO: 3818937 - RNA, 20 nt, Human
auggagacuccaugagaagc

SEQ ID NO: 3818938 - RNA, 13 nt, Human
auggagagaaaac

SEQ ID NO: 3818939 - RNA, 18 nt, Human
auggagagaaaacagacc

SEQ ID NO: 3818940 - RNA, 13 nt, Human
auggagagagggg

SEQ ID NO: 3818941 - RNA, 17 nt, Human
auggagagaggggaaua

SEQ ID NO: 3818942 - RNA, 15 nt, Human
auggagagcccuggg

SEQ ID NO: 3818943 - RNA, 18 nt, Human
auggagagcccugggacc

SEQ ID NO: 3818944 - RNA, 13 nt, Human
auggagagcugga

SEQ ID NO: 3818945 - RNA, 17 nt, Human
auggagauugaccugga

SEQ ID NO: 3818946 - RNA, 13 nt, Human
auggagcaagaga

SEQ ID NO: 3818947 - RNA, 19 nt, Human
auggagcaguacaugggaa

SEQ ID NO: 3818948 - RNA, 18 nt, Human
auggagcaucaagccacu

SEQ ID NO: 3818949 - RNA, 11 nt, Human
auggagccagc

SEQ ID NO: 3818950 - RNA, 12 nt, Human
auggagccccag

SEQ ID NO: 3818951 - RNA, 21 nt, Human
auggagccuggcacaggacug

SEQ ID NO: 3818952 - RNA, 22 nt, Human
auggagccuggcacaggacuga

SEQ ID NO: 3818953 - RNA, 23 nt, Human
auggagcgcaccugcccccuggu

SEQ ID NO: 3818954 - RNA, 18 nt, Human
auggagcuauuuuaaacc

SEQ ID NO: 3818955 - RNA, 14 nt, Human
auggagcugggcua

SEQ ID NO: 3818956 - RNA, 22 nt, Human
auggaggaaaaccaagccgugg

SEQ ID NO: 3818957 - RNA, 18 nt, Human
auggaggaagaacugaaa

SEQ ID NO: 3818958 - RNA, 11 nt, Human
auggaggagaa

SEQ ID NO: 3818959 - RNA, 14 nt, Human
auggaggaggaggc

SEQ ID NO: 3818960 - RNA, 16 nt, Human
auggaggauggagaga

SEQ ID NO: 3818961 - RNA, 14 nt, Human
auggaggggcagag

SEQ ID NO: 3818962 - RNA, 19 nt, Human
auggaggggcagagccagg

SEQ ID NO: 3818963 - RNA, 18 nt, Human
auggaggggugguccuga

SEQ ID NO: 3818964 - RNA, 17 nt, Human
auggaguagaccccugg

SEQ ID NO: 3818965 - RNA, 17 nt, Human
auggagugcaccaaaga

SEQ ID NO: 3818966 - RNA, 19 nt, Human
auggagugcaccaaagaga

SEQ ID NO: 3818967 - RNA, 20 nt, Human
auggagugcaccaaagagaa

SEQ ID NO: 3818968 - RNA, 12 nt, Human
auggagugcugu

SEQ ID NO: 3818969 - RNA, 13 nt, Human
auggagugcuguu

SEQ ID NO: 3818970 - RNA, 19 nt, Human
auggaguggcaauauagaa

SEQ ID NO: 3818971 - RNA, 21 nt, Human
auggaguguguauuguuccca

SEQ ID NO: 3818972 - RNA, 15 nt, Human
auggaguucuugugc

SEQ ID NO: 3818973 - RNA, 16 nt, Human
auggaguuucuaaggu

SEQ ID NO: 3818974 - RNA, 21 nt, Human
auggauaaugccggugagaau

SEQ ID NO: 3818975 - RNA, 13 nt, Human
auggauacauaaa

SEQ ID NO: 3818976 - RNA, 19 nt, Human
auggauacuacaucuuuaa

SEQ ID NO: 3818977 - RNA, 16 nt, Human
auggauagagaagaaa

SEQ ID NO: 3818978 - RNA, 16 nt, Human
auggauagaguauuga

SEQ ID NO: 3818979 - RNA, 17 nt, Human
auggauaggcacaggaa

SEQ ID NO: 3818980 - RNA, 22 nt, Human
auggauauaguuuuacuuuuaa

SEQ ID NO: 3818981 - RNA, 14 nt, Human
auggaucagaucug

SEQ ID NO: 3818982 - RNA, 22 nt, Human
auggauccacuggcuggacaaa

SEQ ID NO: 3818983 - RNA, 16 nt, Human
auggaugaacugaaag

SEQ ID NO: 3818984 - RNA, 20 nt, Human
auggaugaaucucccacucc

SEQ ID NO: 3818985 - RNA, 21 nt, Human
auggaugaaucucccacucca

SEQ ID NO: 3818986 - RNA, 22 nt, Human
auggaugaaucucccacuccag

SEQ ID NO: 3818987 - RNA, 21 nt, Human
auggaugauucagaaauugga

SEQ ID NO: 3818988 - RNA, 13 nt, Human
auggaugcaaagu

SEQ ID NO: 3818989 - RNA, 17 nt, Human
auggauguccccagcag

SEQ ID NO: 3818990 - RNA, 12 nt, Human
auggauguuacu

SEQ ID NO: 3818991 - RNA, 16 nt, Human
auggauucuauuuauu

SEQ ID NO: 3818992 - RNA, 17 nt, Human
auggauucucagauauu

SEQ ID NO: 3818993 - RNA, 19 nt, Human
auggauucuccacucaguu

SEQ ID NO: 3818994 - RNA, 20 nt, Human
auggauugauaauugcauuc

SEQ ID NO: 3818995 - RNA, 15 nt, Human
auggauuggauuauu

SEQ ID NO: 3818996 - RNA, 16 nt, Human
auggauuguuaauuuc

SEQ ID NO: 3818997 - RNA, 17 nt, Human
auggauuucagaagccu

SEQ ID NO: 3818998 - RNA, 18 nt, Human
auggauuuccagccaaag

SEQ ID NO: 3818999 - RNA, 23 nt, Human
aggugcuucuaguucugccagga

SEQ ID NO: 3819000 - RNA, 19 nt, Human
auggacaggcuggcuccag

SEQ ID NO: 3819001 - RNA, 15 nt, Human
auggacauccuguau

SEQ ID NO: 3819002 - RNA, 12 nt, Human
auggacaucuug

SEQ ID NO: 3819003 - RNA, 20 nt, Human
auggacaucuugucauuuuu

SEQ ID NO: 3819004 - RNA, 19 nt, Human
auggacaugaucuucuuua

SEQ ID NO: 3819005 - RNA, 14 nt, Human
auggacaugguggc

SEQ ID NO: 3819006 - RNA, 15 nt, Human
auggaccacuguuuc

SEQ ID NO: 3819007 - RNA, 16 nt, Human
auggaccacuguuucu

SEQ ID NO: 3819008 - RNA, 13 nt, Human
auggacccaaugc

SEQ ID NO: 3819009 - RNA, 12 nt, Human
auggaccuaaca

SEQ ID NO: 3819010 - RNA, 17 nt, Human
auggacggugcuccagg

SEQ ID NO: 3819011 - RNA, 20 nt, Human
auggacggugcuccaggcag

SEQ ID NO: 3819012 - RNA, 19 nt, Human
auggacguguuaugacucc

SEQ ID NO: 3819013 - RNA, 23 nt, Human
auggacguguuaugacuccagaa

SEQ ID NO: 3819014 - RNA, 19 nt, Human
auggacuaacuugucuuug

SEQ ID NO: 3819015 - RNA, 15 nt, Human
auggacucuguccug

SEQ ID NO: 3819016 - RNA, 14 nt, Human
auggacugcucagg

SEQ ID NO: 3819017 - RNA, 18 nt, Human
auggacuuauuucuucaa

SEQ ID NO: 3819018 - RNA, 19 nt, Human
auggacuuauuucuucaaa

SEQ ID NO: 3819019 - RNA, 20 nt, Human
auggacuuauuucuucaaau

SEQ ID NO: 3819020 - RNA, 22 nt, Human
auggacuuguauauuuguacaa

SEQ ID NO: 3819021 - RNA, 15 nt, Human
auggagaaagcugac

SEQ ID NO: 3819022 - RNA, 12 nt, Human
auggagaaggaa

SEQ ID NO: 3819023 - RNA, 18 nt, Human
auggagacuccugcccug

SEQ ID NO: 3819024 - RNA, 16 nt, Human
auggagagcccuggga

SEQ ID NO: 3819025 - RNA, 20 nt, Human
auggagagcuagaacccggc

SEQ ID NO: 3819026 - RNA, 23 nt, Human
auggagagcuggagccuggugcc

SEQ ID NO: 3819027 - RNA, 23 nt, Human
auggagauagccccacaggaggu

SEQ ID NO: 3819028 - RNA, 20 nt, Human
auggagauucaguuuucauu

SEQ ID NO: 3819029 - RNA, 12 nt, Human
auggagcccagg

SEQ ID NO: 3819030 - RNA, 18 nt, Human
auggagccugcacgguga

SEQ ID NO: 3819031 - RNA, 22 nt, Human
auggagccugcacggugaaugg

SEQ ID NO: 3819032 - RNA, 23 nt, Human
auggagccuggcacaggacugau

SEQ ID NO: 3819033 - RNA, 14 nt, Human
auggagcucagaga

SEQ ID NO: 3819034 - RNA, 13 nt, Human
auggagcuggccg

SEQ ID NO: 3819035 - RNA, 13 nt, Human
auggaggaauaug

SEQ ID NO: 3819036 - RNA, 22 nt, Human
auggaggaccacgucuauuuca

SEQ ID NO: 3819037 - RNA, 17 nt, Human
auggaggacuccaggca

SEQ ID NO: 3819038 - RNA, 21 nt, Human
auggaggacuccaggcagcag

SEQ ID NO: 3819039 - RNA, 13 nt, Human
auggaggagaaga

SEQ ID NO: 3819040 - RNA, 17 nt, Human
auggaggagaguguuua

SEQ ID NO: 3819041 - RNA, 15 nt, Human
auggaggaggaggca

SEQ ID NO: 3819042 - RNA, 19 nt, Human
auggaggaucucuaaagag

SEQ ID NO: 3819043 - RNA, 21 nt, Human
auggaggaucucuaaagagca

SEQ ID NO: 3819044 - RNA, 18 nt, Human
auggaggauggagagagg

SEQ ID NO: 3819045 - RNA, 15 nt, Human
auggaggccuguccu

SEQ ID NO: 3819046 - RNA, 18 nt, Human
auggaggcuauguggagu

SEQ ID NO: 3819047 - RNA, 22 nt, Human
auggaggggugguccugacuca

SEQ ID NO: 3819048 - RNA, 13 nt, Human
auggagguucuaa

SEQ ID NO: 3819049 - RNA, 15 nt, Human
auggagguucuaagg

SEQ ID NO: 3819050 - RNA, 22 nt, Human
auggaguagaccccuggcuggu

SEQ ID NO: 3819051 - RNA, 21 nt, Human
auggaguagagguacuagaau

SEQ ID NO: 3819052 - RNA, 22 nt, Human
auggaguagagguacuagaaug

SEQ ID NO: 3819053 - RNA, 13 nt, Human
auguaguaacacu

SEQ ID NO: 3819054 - RNA, 15 nt, Human
auguaguaacacuaa

SEQ ID NO: 3819055 - RNA, 19 nt, Human
auguaguauaaagaaaagu

SEQ ID NO: 3819056 - RNA, 14 nt, Human
auguaguaucuaua

SEQ ID NO: 3819057 - RNA, 12 nt, Human
auguaguauuuu

SEQ ID NO: 3819058 - RNA, 23 nt, Human
auguaguauuuuuuguauaauug

SEQ ID NO: 3819059 - RNA, 21 nt, Human
auguagucagaauuagcugcu

SEQ ID NO: 3819060 - RNA, 16 nt, Human
auguagugccucuuuc

SEQ ID NO: 3819061 - RNA, 22 nt, Human
auguagugugggaggcuccugu

SEQ ID NO: 3819062 - RNA, 18 nt, Human
auguaguucugcuccaga

SEQ ID NO: 3819063 - RNA, 17 nt, Human
auguaguugauguaucc

SEQ ID NO: 3819064 - RNA, 22 nt, Human
auguaguugauguauccaacaa

SEQ ID NO: 3819065 - RNA, 23 nt, Human
auguaguuugaggaaauuugcag

SEQ ID NO: 3819066 - RNA, 21 nt, Human
auguaguuuuuauauguugua

SEQ ID NO: 3819067 - RNA, 17 nt, Human
auguauaaaauaaauau

SEQ ID NO: 3819068 - RNA, 21 nt, Human
auguauaaacuuuagaguaga

SEQ ID NO: 3819069 - RNA, 14 nt, Human
auguauaaauguga

SEQ ID NO: 3819070 - RNA, 23 nt, Human
auguauaacuaggagcuuugacu

SEQ ID NO: 3819071 - RNA, 14 nt, Human
auguauacaugugc

SEQ ID NO: 3819072 - RNA, 15 nt, Human
auguauaguaaauca

SEQ ID NO: 3819073 - RNA, 16 nt, Human
auguauaguaaaucac

SEQ ID NO: 3819074 - RNA, 14 nt, Human
auguauaguauuug

SEQ ID NO: 3819075 - RNA, 17 nt, Human
auguauaguauuugaaa

SEQ ID NO: 3819076 - RNA, 18 nt, Human
auguauaguauuugaaaa

SEQ ID NO: 3819077 - RNA, 15 nt, Human
auguauaguugcuuu

SEQ ID NO: 3819078 - RNA, 14 nt, Human
auguauauaaaaau

SEQ ID NO: 3819079 - RNA, 17 nt, Human
auguauauaaacaugcu

SEQ ID NO: 3819080 - RNA, 15 nt, Human
auguauauacacaua

SEQ ID NO: 3819081 - RNA, 16 nt, Human
auguauauacacauau

SEQ ID NO: 3819082 - RNA, 20 nt, Human
auguauauacccacacacau

SEQ ID NO: 3819083 - RNA, 22 nt, Human
auguauaugaacuuaacaugcu

SEQ ID NO: 3819084 - RNA, 16 nt, Human
auguauauguguucau

SEQ ID NO: 3819085 - RNA, 16 nt, Human
auguauauuaaaaaag

SEQ ID NO: 3819086 - RNA, 17 nt, Human
auguauauuaaaaaaga

SEQ ID NO: 3819087 - RNA, 22 nt, Human
auguauauuaaaaaagagacau

SEQ ID NO: 3819088 - RNA, 15 nt, Human
auguauauuccuuug

SEQ ID NO: 3819089 - RNA, 21 nt, Human
auguauauuuuuuuaauuuaa

SEQ ID NO: 3819090 - RNA, 17 nt, Human
auguaucaaauacauuu

SEQ ID NO: 3819091 - RNA, 12 nt, Human
auguaucaauga

SEQ ID NO: 3819092 - RNA, 17 nt, Human
auguaucauaauuacca

SEQ ID NO: 3819093 - RNA, 16 nt, Human
auguaucauagaaaug

SEQ ID NO: 3819094 - RNA, 15 nt, Human
auguauccaguacau

SEQ ID NO: 3819095 - RNA, 17 nt, Human
auguauccaguacauuu

SEQ ID NO: 3819096 - RNA, 17 nt, Human
auguaugaauacagcag

SEQ ID NO: 3819097 - RNA, 19 nt, Human
auguaugaggaauuucugu

SEQ ID NO: 3819098 - RNA, 16 nt, Human
auguaugcacacacau

SEQ ID NO: 3819099 - RNA, 15 nt, Human
auguaugcauguugu

SEQ ID NO: 3819100 - RNA, 15 nt, Human
auguaugcuucauac

SEQ ID NO: 3819101 - RNA, 22 nt, Human
auguauggaaucccacuguaug

SEQ ID NO: 3819102 - RNA, 19 nt, Human
auguauggguaggguaaau

SEQ ID NO: 3819103 - RNA, 12 nt, Human
auguauggugca

SEQ ID NO: 3819104 - RNA, 20 nt, Human
auguaugugcacugucacuu

SEQ ID NO: 3819105 - RNA, 17 nt, Human
auguauguguaauaaau

SEQ ID NO: 3819106 - RNA, 16 nt, Human
auguauguguuuagaa

SEQ ID NO: 3819107 - RNA, 17 nt, Human
auguauguguuuagaau

SEQ ID NO: 3819108 - RNA, 13 nt, Human
auguauguuacca

SEQ ID NO: 3819109 - RNA, 12 nt, Human
auguauguuuac

SEQ ID NO: 3819110 - RNA, 14 nt, Human
auguauguuuacau

SEQ ID NO: 3819111 - RNA, 16 nt, Human
auguauguuuacauau

SEQ ID NO: 3819112 - RNA, 21 nt, Human
auguauuaaauuacauuugua

SEQ ID NO: 3819113 - RNA, 14 nt, Human
auguauuauucugc

SEQ ID NO: 3819114 - RNA, 17 nt, Human
auguauuauucugcagc

SEQ ID NO: 3819115 - RNA, 15 nt, Human
auguauuauuuauaa

SEQ ID NO: 3819116 - RNA, 20 nt, Human
auguauucuagcuaauguaa

SEQ ID NO: 3819117 - RNA, 14 nt, Human
auguauugagauau

SEQ ID NO: 3819118 - RNA, 16 nt, Human
auguauugcacauugu

SEQ ID NO: 3819119 - RNA, 22 nt, Human
auguauugcacauuguaaaaag

SEQ ID NO: 3819120 - RNA, 11 nt, Human
auguauuguaa

SEQ ID NO: 3819121 - RNA, 22 nt, Human
auguauugugcaauguguauaa

SEQ ID NO: 3819122 - RNA, 24 nt, Human
auguauugugcaauguguauaaac

SEQ ID NO: 3819123 - RNA, 23 nt, Human
auguauuguuugggauccuauug

SEQ ID NO: 3819124 - RNA, 14 nt, Human
auguauuuauauuu

SEQ ID NO: 3819125 - RNA, 18 nt, Human
auguauuuauuuaaaaga

SEQ ID NO: 3819126 - RNA, 12 nt, Human
auguauuuguuc

SEQ ID NO: 3819127 - RNA, 14 nt, Human
auguauuuguucau

SEQ ID NO: 3819128 - RNA, 16 nt, Human
auguauuuuauguuau

SEQ ID NO: 3819129 - RNA, 16 nt, Human
auguauuuuauuguaa

SEQ ID NO: 3819130 - RNA, 20 nt, Human
auguauuuuauuguaacaga

SEQ ID NO: 3819131 - RNA, 16 nt, Human
auguauuuugugaguu

SEQ ID NO: 3819132 - RNA, 23 nt, Human
auguauuuugugaguuuguuucu

SEQ ID NO: 3819133 - RNA, 17 nt, Human
auguauuuuugucaauu

SEQ ID NO: 3819134 - RNA, 20 nt, Human
augucaaaaguagaacuuug

SEQ ID NO: 3819135 - RNA, 23 nt, Human
augucaaccagguccagaugugc

SEQ ID NO: 3819136 - RNA, 17 nt, Human
augucaacugaccuaaa

SEQ ID NO: 3819137 - RNA, 19 nt, Human
augucaacuucuggcuccu

SEQ ID NO: 3819138 - RNA, 18 nt, Human
augucaagauucagcuag

SEQ ID NO: 3819139 - RNA, 21 nt, Human
augucaagggcagcuuugcuc

SEQ ID NO: 3819140 - RNA, 16 nt, Human
augucaaguaccaaaa

SEQ ID NO: 3819141 - RNA, 16 nt, Human
augucaaucagccuag

SEQ ID NO: 3819142 - RNA, 16 nt, Human
augucaauuucugugu

SEQ ID NO: 3819143 - RNA, 13 nt, Human
augucacaggcag

SEQ ID NO: 3819144 - RNA, 19 nt, Human
augucacaggcagguccag

SEQ ID NO: 3819145 - RNA, 17 nt, Human
augugaacuuuauuaaa

SEQ ID NO: 3819146 - RNA, 14 nt, Human
augugaagaugcau

SEQ ID NO: 3819147 - RNA, 21 nt, Human
augugaagaugcauuguaguu

SEQ ID NO: 3819148 - RNA, 23 nt, Human
augugaagaugcauuguaguuua

SEQ ID NO: 3819149 - RNA, 12 nt, Human
augugaagccaa

SEQ ID NO: 3819150 - RNA, 20 nt, Human
augugaaggaccuucacucu

SEQ ID NO: 3819151 - RNA, 23 nt, Human
augugaagggaaggaagaggaag

SEQ ID NO: 3819152 - RNA, 15 nt, Human
augugaaucagaccc

SEQ ID NO: 3819153 - RNA, 16 nt, Human
augugaaucagacccu

SEQ ID NO: 3819154 - RNA, 13 nt, Human
augugaauuacua

SEQ ID NO: 3819155 - RNA, 14 nt, Human
augugaauuacuaa

SEQ ID NO: 3819156 - RNA, 17 nt, Human
augugaauuacuaacuu

SEQ ID NO: 3819157 - RNA, 18 nt, Human
augugaauuacuaacuuc

SEQ ID NO: 3819158 - RNA, 20 nt, Human
augugaauuacuaacuucua

SEQ ID NO: 3819159 - RNA, 14 nt, Human
augugaauuauuga

SEQ ID NO: 3819160 - RNA, 16 nt, Human
augugaauuauugaca

SEQ ID NO: 3819161 - RNA, 10 nt, Human
augugaauuu

SEQ ID NO: 3819162 - RNA, 11 nt, Human
augugaauuuu

SEQ ID NO: 3819163 - RNA, 13 nt, Human
augugaauuuuua

SEQ ID NO: 3819164 - RNA, 21 nt, Human
augugaauuuuuaagcugcaa

SEQ ID NO: 3819165 - RNA, 17 nt, Human
augugaauuuuuauugu

SEQ ID NO: 3819166 - RNA, 16 nt, Human
augugacaauaauauu

SEQ ID NO: 3819167 - RNA, 18 nt, Human
augugacaauuuuguaca

SEQ ID NO: 3819168 - RNA, 20 nt, Human
augugacaauuuuguacaaa

SEQ ID NO: 3819169 - RNA, 11 nt, Human
augugacacau

SEQ ID NO: 3819170 - RNA, 15 nt, Human
augugacauuaacaa

SEQ ID NO: 3819171 - RNA, 19 nt, Human
augugacauuuauauauug

SEQ ID NO: 3819172 - RNA, 19 nt, Human
augugacauuugucauuuu

SEQ ID NO: 3819173 - RNA, 18 nt, Human
augugacauuuuacauua

SEQ ID NO: 3819174 - RNA, 20 nt, Human
augugacccagauccucaca

SEQ ID NO: 3819175 - RNA, 15 nt, Human
augugacucuggcuu

SEQ ID NO: 3819176 - RNA, 22 nt, Human
augugacucuggcuuggccuau

SEQ ID NO: 3819177 - RNA, 16 nt, Human
augugacucuuuccaa

SEQ ID NO: 3819178 - RNA, 23 nt, Human
augugacuugcaucguggagaca

SEQ ID NO: 3819179 - RNA, 18 nt, Human
augugacuuugcaucagc

SEQ ID NO: 3819180 - RNA, 15 nt, Human
augugagaagccagc

SEQ ID NO: 3819181 - RNA, 14 nt, Human
augugagacugguu

SEQ ID NO: 3819182 - RNA, 14 nt, Human
augugagagaaagu

SEQ ID NO: 3819183 - RNA, 16 nt, Human
augugagagguuugac

SEQ ID NO: 3819184 - RNA, 15 nt, Human
augugagcugcugcc

SEQ ID NO: 3819185 - RNA, 16 nt, Human
augugagcugcugcca

SEQ ID NO: 3819186 - RNA, 19 nt, Human
augugagcugcugccauga

SEQ ID NO: 3819187 - RNA, 19 nt, Human
augugaggggucccuagca

SEQ ID NO: 3819188 - RNA, 14 nt, Human
augugaguauucuc

SEQ ID NO: 3819189 - RNA, 18 nt, Human
augugagugccuuuugca

SEQ ID NO: 3819190 - RNA, 22 nt, Human
augugagugccuuuugcagaag

SEQ ID NO: 3819191 - RNA, 15 nt, Human
augugagugguugaa

SEQ ID NO: 3819192 - RNA, 19 nt, Human
augugagugguugaauaug

SEQ ID NO: 3819193 - RNA, 22 nt, Human
augugaguguguguuugugcug

SEQ ID NO: 3819194 - RNA, 20 nt, Human
augugaguuuggucuggacu

SEQ ID NO: 3819195 - RNA, 21 nt, Human
augugaguuuggucuggacug

SEQ ID NO: 3819196 - RNA, 18 nt, Human
augugauaaggaaaucaa

SEQ ID NO: 3819197 - RNA, 18 nt, Human
augugauauaaacagcuu

SEQ ID NO: 3819198 - RNA, 13 nt, Human
augugauauauaa

SEQ ID NO: 3819199 - RNA, 19 nt, Human
augugauauauaaguguac

SEQ ID NO: 3819200 - RNA, 21 nt, Human
augugauauauaaguguacau

SEQ ID NO: 3819201 - RNA, 15 nt, Human
augugauauucuaag

SEQ ID NO: 3819202 - RNA, 18 nt, Human
augugauauucuaagacu

SEQ ID NO: 3819203 - RNA, 23 nt, Human
augugaucagcuuucaaagcauu

SEQ ID NO: 3819204 - RNA, 15 nt, Human
augugaugagaggaa

SEQ ID NO: 3819205 - RNA, 19 nt, Human
augugaugagaggaaauca

SEQ ID NO: 3819206 - RNA, 16 nt, Human
augugaugauguaauu

SEQ ID NO: 3819207 - RNA, 14 nt, Human
augugaugcuggaa

SEQ ID NO: 3819208 - RNA, 14 nt, Human
augugauguucuaa

SEQ ID NO: 3819209 - RNA, 19 nt, Human
augugauguucuaaggcuc

SEQ ID NO: 3819210 - RNA, 15 nt, Human
augugauuguggaau

SEQ ID NO: 3819211 - RNA, 18 nt, Human
augugauuuaauaguguu

SEQ ID NO: 3819212 - RNA, 14 nt, Human
augugauuuuaacu

SEQ ID NO: 3819213 - RNA, 20 nt, Human
augugauuuuaacucugucu

SEQ ID NO: 3819214 - RNA, 15 nt, Human
augugcaaaaauuuu

SEQ ID NO: 3819215 - RNA, 16 nt, Human
augugcaaaaauuuuu

SEQ ID NO: 3819216 - RNA, 14 nt, Human
augugcaaaacagc

SEQ ID NO: 3819217 - RNA, 18 nt, Human
augugcaaaaccuuuuac

SEQ ID NO: 3819218 - RNA, 21 nt, Human
augugcaaaaccuuuuacugg

SEQ ID NO: 3819219 - RNA, 22 nt, Human
agucaugauguuuuuaaaaucu

SEQ ID NO: 3819220 - RNA, 20 nt, Human
agucaugcaaaggcugggac

SEQ ID NO: 3819221 - RNA, 14 nt, Human
agucaugcauaaau

SEQ ID NO: 3819222 - RNA, 16 nt, Human
agucaugcauaaauau

SEQ ID NO: 3819223 - RNA, 17 nt, Human
agucaugcauaaauaug

SEQ ID NO: 3819224 - RNA, 19 nt, Human
agucaugcguuuaaucaca

SEQ ID NO: 3819225 - RNA, 18 nt, Human
agucauggagaaccaccu

SEQ ID NO: 3819226 - RNA, 12 nt, Human
agucauggcugu

SEQ ID NO: 3819227 - RNA, 16 nt, Human
agucauguaaauacug

SEQ ID NO: 3819228 - RNA, 17 nt, Human
agucauguauguuucuc

SEQ ID NO: 3819229 - RNA, 12 nt, Human
agucaugugacc

SEQ ID NO: 3819230 - RNA, 19 nt, Human
agucauguuccuucaagau

SEQ ID NO: 3819231 - RNA, 14 nt, Human
agucauguuuaucu

SEQ ID NO: 3819232 - RNA, 22 nt, Human
agucauguuuuaaauguacagu

SEQ ID NO: 3819233 - RNA, 14 nt, Human
agucauuaaacugg

SEQ ID NO: 3819234 - RNA, 23 nt, Human
agucauuaaagacaggagacaaa

SEQ ID NO: 3819235 - RNA, 15 nt, Human
agucauuagacuccu

SEQ ID NO: 3819236 - RNA, 19 nt, Human
agucauuagacuccuccuc

SEQ ID NO: 3819237 - RNA, 21 nt, Human
agucauuauagaucccccaga

SEQ ID NO: 3819238 - RNA, 18 nt, Human
agucauuauccuugcuau

SEQ ID NO: 3819239 - RNA, 22 nt, Human
agucauuaugagaggcaaugau

SEQ ID NO: 3819240 - RNA, 18 nt, Human
agucauuauguuaauauu

SEQ ID NO: 3819241 - RNA, 13 nt, Human
agucauucagcag

SEQ ID NO: 3819242 - RNA, 13 nt, Human
agucauugcugua

SEQ ID NO: 3819243 - RNA, 14 nt, Human
agucauuggcuuua

SEQ ID NO: 3819244 - RNA, 18 nt, Human
agucauuggcuuuauccu

SEQ ID NO: 3819245 - RNA, 16 nt, Human
agucauuguaauguug

SEQ ID NO: 3819246 - RNA, 18 nt, Human
agucauuguauguuauua

SEQ ID NO: 3819247 - RNA, 22 nt, Human
agucauuuaacugaagauguug

SEQ ID NO: 3819248 - RNA, 13 nt, Human
agucauuuacuaa

SEQ ID NO: 3819249 - RNA, 14 nt, Human
agucauuuacuaaa

SEQ ID NO: 3819250 - RNA, 17 nt, Human
agucauuuacuaaacau

SEQ ID NO: 3819251 - RNA, 23 nt, Human
agucauuuacuaaacauaugauu

SEQ ID NO: 3819252 - RNA, 15 nt, Human
agucauuuauuuuaa

SEQ ID NO: 3819253 - RNA, 20 nt, Human
agucauuuauuuuaaaaaau

SEQ ID NO: 3819254 - RNA, 22 nt, Human
agucauuuauuuuaaaaaauga

SEQ ID NO: 3819255 - RNA, 15 nt, Human
agucauuucugauuu

SEQ ID NO: 3819256 - RNA, 15 nt, Human
agucauuugugaauu

SEQ ID NO: 3819257 - RNA, 19 nt, Human
agucauuuuaacuuuauca

SEQ ID NO: 3819258 - RNA, 13 nt, Human
agucauuuucaag

SEQ ID NO: 3819259 - RNA, 21 nt, Human
agucauuuuguguugaagagc

SEQ ID NO: 3819260 - RNA, 21 nt, Human
agucauuuuuacaauguaauu

SEQ ID NO: 3819261 - RNA, 19 nt, Human
aguccaaauguccuccaga

SEQ ID NO: 3819262 - RNA, 19 nt, Human
aguccaagaggguccuuua

SEQ ID NO: 3819263 - RNA, 21 nt, Human
aguccaagcauuuagauguau

SEQ ID NO: 3819264 - RNA, 16 nt, Human
aguccaagcugggaga

SEQ ID NO: 3819265 - RNA, 21 nt, Human
aguccaaggaaaccacagcug

SEQ ID NO: 3819266 - RNA, 23 nt, Human
aguccaaggaaaccacagcugcu

SEQ ID NO: 3819267 - RNA, 13 nt, Human
aguccaagguuua

SEQ ID NO: 3819268 - RNA, 14 nt, Human
aguccaauuuuaau

SEQ ID NO: 3819269 - RNA, 17 nt, Human
aguccaauuuuaauuua

SEQ ID NO: 3819270 - RNA, 21 nt, Human
aguccaauuuuaauuuaguaa

SEQ ID NO: 3819271 - RNA, 14 nt, Human
aguccacccugccu

SEQ ID NO: 3819272 - RNA, 12 nt, Human
aguccaccugag

SEQ ID NO: 3819273 - RNA, 17 nt, Human
aguccaccugagcugcc

SEQ ID NO: 3819274 - RNA, 16 nt, Human
aguccacucccagugc

SEQ ID NO: 3819275 - RNA, 14 nt, Human
aguccacuuuguuu

SEQ ID NO: 3819276 - RNA, 13 nt, Human
aguccaggaacaa

SEQ ID NO: 3819277 - RNA, 23 nt, Human
aguccaggacaggagaugcugug

SEQ ID NO: 3819278 - RNA, 12 nt, Human
aguccaggcccc

SEQ ID NO: 3819279 - RNA, 14 nt, Human
aguccaggcugccg

SEQ ID NO: 3819280 - RNA, 17 nt, Human
aguccaggcugccgugg

SEQ ID NO: 3819281 - RNA, 13 nt, Human
aguccagguccug

SEQ ID NO: 3819282 - RNA, 21 nt, Human
aguccaguccuaucugggcuu

SEQ ID NO: 3819283 - RNA, 12 nt, Human
aguccauuuaua

SEQ ID NO: 3819284 - RNA, 17 nt, Human
aguccauuuauauauga

SEQ ID NO: 3819285 - RNA, 19 nt, Human
aguccauuuauauaugaaa

SEQ ID NO: 3819286 - RNA, 22 nt, Human
aguccauuuauauaugaaaacu

SEQ ID NO: 3819287 - RNA, 21 nt, Human
agucccaaggaaagccccagc

SEQ ID NO: 3819288 - RNA, 20 nt, Human
agucccaccgguugcuucug

SEQ ID NO: 3819289 - RNA, 23 nt, Human
agucccaccgguugcuucuggga

SEQ ID NO: 3819290 - RNA, 17 nt, Human
agugaggccacugaaga

SEQ ID NO: 3819291 - RNA, 15 nt, Human
agugaggcccaggga

SEQ ID NO: 3819292 - RNA, 14 nt, Human
agugaggcucugcc

SEQ ID NO: 3819293 - RNA, 19 nt, Human
agugaggcucugcccuugg

SEQ ID NO: 3819294 - RNA, 16 nt, Human
agugagggagauccca

SEQ ID NO: 3819295 - RNA, 14 nt, Human
agugagggauuauc

SEQ ID NO: 3819296 - RNA, 18 nt, Human
agugaggggaaaccaggg

SEQ ID NO: 3819297 - RNA, 22 nt, Human
agugagggguaaaagcugaucu

SEQ ID NO: 3819298 - RNA, 23 nt, Human
agugagggucagagaggagucag

SEQ ID NO: 3819299 - RNA, 22 nt, Human
agugaggguuucugagcugcuc

SEQ ID NO: 3819300 - RNA, 18 nt, Human
agugagguccugggggcc

SEQ ID NO: 3819301 - RNA, 17 nt, Human
agugaguaauuuuggau

SEQ ID NO: 3819302 - RNA, 22 nt, Human
agugaguacaugcacacucaug

SEQ ID NO: 3819303 - RNA, 13 nt, Human
agugagucucucu

SEQ ID NO: 3819304 - RNA, 16 nt, Human
agugagucucuucaga

SEQ ID NO: 3819305 - RNA, 16 nt, Human
agugagugagccuggc

SEQ ID NO: 3819306 - RNA, 21 nt, Human
agugaguguggcuccccucua

SEQ ID NO: 3819307 - RNA, 21 nt, Human
agugaguugauagcacagacc

SEQ ID NO: 3819308 - RNA, 22 nt, Human
agugaguugauagcacagaccc

SEQ ID NO: 3819309 - RNA, 18 nt, Human
agugaguuguugcccugg

SEQ ID NO: 3819310 - RNA, 19 nt, Human
agugaguuguugcccuggg

SEQ ID NO: 3819311 - RNA, 20 nt, Human
agugaguuguugcccugggu

SEQ ID NO: 3819312 - RNA, 15 nt, Human
agugaguuuuuuagu

SEQ ID NO: 3819313 - RNA, 23 nt, Human
agugauacaacuucaagugcaug

SEQ ID NO: 3819314 - RNA, 21 nt, Human
agugauagucuuuugcuuuug

SEQ ID NO: 3819315 - RNA, 19 nt, Human
agugauauggcagaagaca

SEQ ID NO: 3819316 - RNA, 21 nt, Human
agugauauggcagaagacacc

SEQ ID NO: 3819317 - RNA, 24 nt, Human
agugauauggcagaagacaccaga

SEQ ID NO: 3819318 - RNA, 12 nt, Human
agugauauucuu

SEQ ID NO: 3819319 - RNA, 13 nt, Human
agugauauuucuc

SEQ ID NO: 3819320 - RNA, 16 nt, Human
agugauauuucucuag

SEQ ID NO: 3819321 - RNA, 15 nt, Human
agugaucacagcagc

SEQ ID NO: 3819322 - RNA, 15 nt, Human
agugauccucccacc

SEQ ID NO: 3819323 - RNA, 22 nt, Human
agugaucuacaugaggaacugu

SEQ ID NO: 3819324 - RNA, 21 nt, Human
agugaucuccauauguuacac

SEQ ID NO: 3819325 - RNA, 17 nt, Human
agugaucugcccgccuc

SEQ ID NO: 3819326 - RNA, 17 nt, Human
agugaugggcuuucucu

SEQ ID NO: 3819327 - RNA, 23 nt, Human
agugauguuuuuaugauaucccu

SEQ ID NO: 3819328 - RNA, 21 nt, Human
agugauuaaggucucucuuug

SEQ ID NO: 3819329 - RNA, 22 nt, Human
agugauuaaggucucucuuugg

SEQ ID NO: 3819330 - RNA, 14 nt, Human
agugauucuccugc

SEQ ID NO: 3819331 - RNA, 15 nt, Human
agugauucuccugcc

SEQ ID NO: 3819332 - RNA, 17 nt, Human
agugauucuccugccuc

SEQ ID NO: 3819333 - RNA, 22 nt, Human
agugauucuccugccucagccu

SEQ ID NO: 3819334 - RNA, 24 nt, Human
agugauucuccugccucagccucc

SEQ ID NO: 3819335 - RNA, 20 nt, Human
agugauuuucaagucugugu

SEQ ID NO: 3819336 - RNA, 22 nt, Human
agugauuuuuauccaaucuugu

SEQ ID NO: 3819337 - RNA, 16 nt, Human
agugauuuuuaugcca

SEQ ID NO: 3819338 - RNA, 20 nt, Human
agugauuuuuaugccaccug

SEQ ID NO: 3819339 - RNA, 23 nt, Human
agugcaaaaggcuugcagaacuu

SEQ ID NO: 3819340 - RNA, 18 nt, Human
agugcaaacuucagaguu

SEQ ID NO: 3819341 - RNA, 18 nt, Human
agugcaaaucauagcugg

SEQ ID NO: 3819342 - RNA, 14 nt, Human
agugcaaauuguca

SEQ ID NO: 3819343 - RNA, 22 nt, Human
agugcaaauugucacaggacag

SEQ ID NO: 3819344 - RNA, 13 nt, Human
agugcaacacugg

SEQ ID NO: 3819345 - RNA, 21 nt, Human
agugcaacacuggucugcugu

SEQ ID NO: 3819346 - RNA, 16 nt, Human
agugcaaccacacacc

SEQ ID NO: 3819347 - RNA, 22 nt, Human
agugcaauaaaucugacccagu

SEQ ID NO: 3819348 - RNA, 18 nt, Human
agugcaaugacacagucu

SEQ ID NO: 3819349 - RNA, 23 nt, Human
agugcaauggcgugaucucggcu

SEQ ID NO: 3819350 - RNA, 22 nt, Human
agugcaaugguauaaauuucaa

SEQ ID NO: 3819351 - RNA, 13 nt, Human
agugcacaugaac

SEQ ID NO: 3819352 - RNA, 13 nt, Human
agugcaccaaaga

SEQ ID NO: 3819353 - RNA, 20 nt, Human
agugcaccugggacagggag

SEQ ID NO: 3819354 - RNA, 14 nt, Human
agugcacuaaugug

SEQ ID NO: 3819355 - RNA, 17 nt, Human
agugcacuaauguguaa

SEQ ID NO: 3819356 - RNA, 20 nt, Human
agugcacuugcuggaagacg

SEQ ID NO: 3819357 - RNA, 13 nt, Human
agugcagaaugua

SEQ ID NO: 3819358 - RNA, 20 nt, Human
agugcagaauguaagugggc

SEQ ID NO: 3819359 - RNA, 21 nt, Human
agugcagagccuucucagaag

SEQ ID NO: 3819360 - RNA, 15 nt, Human
agugcagcaaccaga

SEQ ID NO: 3819361 - RNA, 19 nt, Human
agugcagcaaccagagcac

SEQ ID NO: 3819362 - RNA, 20 nt, Human
agugcagcaaccagagcacu

SEQ ID NO: 3819363 - RNA, 22 nt, Human
agugcagcaaccagagcacugu

SEQ ID NO: 3819364 - RNA, 13 nt, Human
agugcagccaagu

SEQ ID NO: 3819365 - RNA, 22 nt, Human
agugcagccaaguagccucucc

SEQ ID NO: 3819366 - RNA, 16 nt, Human
agugcagcugaaauug

SEQ ID NO: 3819367 - RNA, 17 nt, Human
agugcagcugauuuuaa

SEQ ID NO: 3819368 - RNA, 13 nt, Human
agugcaggcccac

SEQ ID NO: 3819369 - RNA, 15 nt, Human
agugcaggcccaccc

SEQ ID NO: 3819370 - RNA, 18 nt, Human
agugcaggcccacccugc

SEQ ID NO: 3819371 - RNA, 11 nt, Human
agugcaggcug

SEQ ID NO: 3819372 - RNA, 15 nt, Human
agugcaggcuggcca

SEQ ID NO: 3819373 - RNA, 21 nt, Human
agugcaggcuggccagccgcu

SEQ ID NO: 3819374 - RNA, 16 nt, Human
agugcagggcaaaaua

SEQ ID NO: 3819375 - RNA, 17 nt, Human
agugcagugagccgaga

SEQ ID NO: 3819376 - RNA, 19 nt, Human
agugcaguggcacaaucuu

SEQ ID NO: 3819377 - RNA, 23 nt, Human
agugcaguggcgugaucucagcu

SEQ ID NO: 3819378 - RNA, 20 nt, Human
agugcauauuccuuucuauc

SEQ ID NO: 3819379 - RNA, 14 nt, Human
agugcauccaaagg

SEQ ID NO: 3819380 - RNA, 21 nt, Human
agugcauccaaaggugcucag

SEQ ID NO: 3819381 - RNA, 13 nt, Human
agugcaucuacuu

SEQ ID NO: 3819382 - RNA, 14 nt, Human
agugcaucucagcc

SEQ ID NO: 3819383 - RNA, 15 nt, Human
agugcaucucagccc

SEQ ID NO: 3819384 - RNA, 19 nt, Human
agugcaucuggagagaaca

SEQ ID NO: 3819385 - RNA, 17 nt, Human
agugcaugcucucugca

SEQ ID NO: 3819386 - RNA, 20 nt, Human
agugcaugcucucugcagcc

SEQ ID NO: 3819387 - RNA, 14 nt, Human
agugcaugcugucc

SEQ ID NO: 3819388 - RNA, 17 nt, Human
agugcaugguggccaga

SEQ ID NO: 3819389 - RNA, 18 nt, Human
agugcauguacuaucuua

SEQ ID NO: 3819390 - RNA, 21 nt, Human
agugcauuguuucugugggcg

SEQ ID NO: 3819391 - RNA, 22 nt, Human
agugcauuuaugagcucuucau

SEQ ID NO: 3819392 - RNA, 15 nt, Human
agugcauuucugaau

SEQ ID NO: 3819393 - RNA, 14 nt, Human
agugccaaaaacaa

SEQ ID NO: 3819394 - RNA, 21 nt, Human
agugccaacaauccuagugcu

SEQ ID NO: 3819395 - RNA, 16 nt, Human
agugccaacuccucac

SEQ ID NO: 3819396 - RNA, 14 nt, Human
agugccaagcacag

SEQ ID NO: 3819397 - RNA, 12 nt, Human
agugccaaggac

SEQ ID NO: 3819398 - RNA, 13 nt, Human
agugccaaggacc

SEQ ID NO: 3819399 - RNA, 20 nt, Human
agugccacugcccgagcugg

SEQ ID NO: 3819400 - RNA, 22 nt, Human
agugccacugcccgagcuggug

SEQ ID NO: 3819401 - RNA, 20 nt, Human
agugccacuuaauguauguu

SEQ ID NO: 3819402 - RNA, 16 nt, Human
agugccagaggugggc

SEQ ID NO: 3819403 - RNA, 22 nt, Human
agugccagaggugggcaggugg

SEQ ID NO: 3819404 - RNA, 13 nt, Human
agugccaggacuc

SEQ ID NO: 3819405 - RNA, 17 nt, Human
agugccauugucuuuau

SEQ ID NO: 3819406 - RNA, 15 nt, Human
agugcccaacuguua

SEQ ID NO: 3819407 - RNA, 14 nt, Human
agugcccacaggau

SEQ ID NO: 3819408 - RNA, 20 nt, Human
agugcccacccugggagaca

SEQ ID NO: 3819409 - RNA, 23 nt, Human
agugcccacccugggagacagac

SEQ ID NO: 3819410 - RNA, 23 nt, Human
agugcccagaacuggacucagga

SEQ ID NO: 3819411 - RNA, 17 nt, Human
agugcccauuccucacc

SEQ ID NO: 3819412 - RNA, 15 nt, Human
agugccccaccugcc

SEQ ID NO: 3819413 - RNA, 23 nt, Human
agugccccgucuacagcuccccc

SEQ ID NO: 3819414 - RNA, 21 nt, Human
agugcccuccacagccgcagc

SEQ ID NO: 3819415 - RNA, 13 nt, Human
agugcccuccagc

SEQ ID NO: 3819416 - RNA, 18 nt, Human
agugcccuccagccccgc

SEQ ID NO: 3819417 - RNA, 12 nt, Human
agugcccucucc

SEQ ID NO: 3819418 - RNA, 16 nt, Human
agugcccugagccagg

SEQ ID NO: 3819419 - RNA, 21 nt, Human
agugcccugagccagggucuc

SEQ ID NO: 3819420 - RNA, 23 nt, Human
agugcccugagccagggucucca

SEQ ID NO: 3819421 - RNA, 23 nt, Human
agugcccuggggcugaucucagg

SEQ ID NO: 3819422 - RNA, 18 nt, Human
agugccgcaucucacagc

SEQ ID NO: 3819423 - RNA, 23 nt, Human
augugauauauaaguguacauau

SEQ ID NO: 3819424 - RNA, 16 nt, Human
augugaucugucuugu

SEQ ID NO: 3819425 - RNA, 19 nt, Human
augugaugaauacuguauu

SEQ ID NO: 3819426 - RNA, 15 nt, Human
augugauguucuaag

SEQ ID NO: 3819427 - RNA, 15 nt, Human
augugauuacaaggc

SEQ ID NO: 3819428 - RNA, 20 nt, Human
augugauuccuuugaagagg

SEQ ID NO: 3819429 - RNA, 16 nt, Human
augugauuuaauagug

SEQ ID NO: 3819430 - RNA, 20 nt, Human
augugauuuaauaguguuaa

SEQ ID NO: 3819431 - RNA, 21 nt, Human
augugauuuaauaguguuaau

SEQ ID NO: 3819432 - RNA, 16 nt, Human
augugauuuuaacucu

SEQ ID NO: 3819433 - RNA, 16 nt, Human
auguuuaugagccaga

SEQ ID NO: 3819434 - RNA, 12 nt, Human
auguuuauguaa

SEQ ID NO: 3819435 - RNA, 21 nt, Human
auguuuauguaaacaaaucuu

SEQ ID NO: 3819436 - RNA, 19 nt, Human
auguuuauuaaaugcuuca

SEQ ID NO: 3819437 - RNA, 12 nt, Human
auguuuauuaca

SEQ ID NO: 3819438 - RNA, 19 nt, Human
agugccgcaucucacagcu

SEQ ID NO: 3819439 - RNA, 19 nt, Human
agugccuaaaauaagaaua

SEQ ID NO: 3819440 - RNA, 21 nt, Human
agugccucaagaggaaugaaa

SEQ ID NO: 3819441 - RNA, 23 nt, Human
agugccucucccugcugcuccua

SEQ ID NO: 3819442 - RNA, 18 nt, Human
agugccucuuucauccac

SEQ ID NO: 3819443 - RNA, 18 nt, Human
agugccugacacacuaac

SEQ ID NO: 3819444 - RNA, 15 nt, Human
agugccuuacacaau

SEQ ID NO: 3819445 - RNA, 16 nt, Human
agugccuuaccuccug

SEQ ID NO: 3819446 - RNA, 22 nt, Human
agugccuuaccuccugcccagg

SEQ ID NO: 3819447 - RNA, 13 nt, Human
agugccuuaugga

SEQ ID NO: 3819448 - RNA, 18 nt, Human
agugccuuauggaacacu

SEQ ID NO: 3819449 - RNA, 15 nt, Human
agugccuucuguggg

SEQ ID NO: 3819450 - RNA, 17 nt, Human
agugccuucugugggga

SEQ ID NO: 3819451 - RNA, 22 nt, Human
agugccuuggggaauuuccucu

SEQ ID NO: 3819452 - RNA, 17 nt, Human
agugccuuucaggaucu

SEQ ID NO: 3819453 - RNA, 21 nt, Human
agugccuuugcagcucagaac

SEQ ID NO: 3819454 - RNA, 17 nt, Human
agugcgaguauguguuu

SEQ ID NO: 3819455 - RNA, 17 nt, Human
agugcgauucuggauaa

SEQ ID NO: 3819456 - RNA, 17 nt, Human
agugcgugaauguaugu

SEQ ID NO: 3819457 - RNA, 13 nt, Human
agugcguggccca

SEQ ID NO: 3819458 - RNA, 18 nt, Human
agugcguguguagaguua

SEQ ID NO: 3819459 - RNA, 16 nt, Human
agugcuaaaaauggga

SEQ ID NO: 3819460 - RNA, 17 nt, Human
agugcuaacaugaagac

SEQ ID NO: 3819461 - RNA, 13 nt, Human
agugcuaagguuc

SEQ ID NO: 3819462 - RNA, 18 nt, Human
agugcuaagguucuaagg

SEQ ID NO: 3819463 - RNA, 14 nt, Human
agugcuaaguguga

SEQ ID NO: 3819464 - RNA, 18 nt, Human
agugcuaagugugaacug

SEQ ID NO: 3819465 - RNA, 22 nt, Human
agugcuaagugugaacuggacc

SEQ ID NO: 3819466 - RNA, 15 nt, Human
agugcuaauuuugaa

SEQ ID NO: 3819467 - RNA, 18 nt, Human
agugcuaauuuugaaaaa

SEQ ID NO: 3819468 - RNA, 20 nt, Human
agugcuaauuuugaaaaacu

SEQ ID NO: 3819469 - RNA, 22 nt, Human
agugcuauauauauaaauauuu

SEQ ID NO: 3819470 - RNA, 15 nt, Human
agugcuaugaagaca

SEQ ID NO: 3819471 - RNA, 19 nt, Human
agugcuauuacgaaguuca

SEQ ID NO: 3819472 - RNA, 16 nt, Human
agugcucaaggccagc

SEQ ID NO: 3819473 - RNA, 17 nt, Human
agugcucacccacacca

SEQ ID NO: 3819474 - RNA, 18 nt, Human
agugcuccccucugaaag

SEQ ID NO: 3819475 - RNA, 17 nt, Human
agugcucccucacaugu

SEQ ID NO: 3819476 - RNA, 17 nt, Human
agugcucgcuguugcug

SEQ ID NO: 3819477 - RNA, 11 nt, Human
agugcucugau

SEQ ID NO: 3819478 - RNA, 21 nt, Human
agugcucugaucccucuacag

SEQ ID NO: 3819479 - RNA, 14 nt, Human
agugcucuuuucuc

SEQ ID NO: 3819480 - RNA, 12 nt, Human
agugcugaagcu

SEQ ID NO: 3819481 - RNA, 15 nt, Human
agugcugaagcuuau

SEQ ID NO: 3819482 - RNA, 23 nt, Human
agugcugaagcuuauuaaugcua

SEQ ID NO: 3819483 - RNA, 12 nt, Human
agugcugcauuu

SEQ ID NO: 3819484 - RNA, 16 nt, Human
agugcugcauuuaaaa

SEQ ID NO: 3819485 - RNA, 17 nt, Human
agugcugcauuuaaaag

SEQ ID NO: 3819486 - RNA, 19 nt, Human
agugcugcauuuaaaagau

SEQ ID NO: 3819487 - RNA, 20 nt, Human
agugcugcauuuaaaagaua

SEQ ID NO: 3819488 - RNA, 21 nt, Human
agugcugccuguccccaugcu

SEQ ID NO: 3819489 - RNA, 22 nt, Human
agugcuggagucuccugaggac

SEQ ID NO: 3819490 - RNA, 20 nt, Human
agugcuggcauuacaggugu

SEQ ID NO: 3819491 - RNA, 14 nt, Human
agugcuggcucaca

SEQ ID NO: 3819492 - RNA, 17 nt, Human
agugcuggcucacagua

SEQ ID NO: 3819493 - RNA, 18 nt, Human
agugcuggcucacaguac

SEQ ID NO: 3819494 - RNA, 20 nt, Human
agugcuggcucacaguacag

SEQ ID NO: 3819495 - RNA, 12 nt, Human
agugcuguaaaa

SEQ ID NO: 3819496 - RNA, 17 nt, Human
agugcuguauaaaauca

SEQ ID NO: 3819497 - RNA, 19 nt, Human
agugcugucugaucugugc

SEQ ID NO: 3819498 - RNA, 13 nt, Human
agugcugugaaaa

SEQ ID NO: 3819499 - RNA, 16 nt, Human
agugcugugaaaaaaa

SEQ ID NO: 3819500 - RNA, 12 nt, Human
agugcugugcug

SEQ ID NO: 3819501 - RNA, 14 nt, Human
agugcuguggccug

SEQ ID NO: 3819502 - RNA, 16 nt, Human
agugcuguggccuggg

SEQ ID NO: 3819503 - RNA, 17 nt, Human
agugcuguggccugggc

SEQ ID NO: 3819504 - RNA, 18 nt, Human
agugcuguggccugggca

SEQ ID NO: 3819505 - RNA, 16 nt, Human
agugcuguuuuguuau

SEQ ID NO: 3819506 - RNA, 19 nt, Human
agugcuguuuuguuauaua

SEQ ID NO: 3819507 - RNA, 14 nt, Human
agugcuucagccug

SEQ ID NO: 3819508 - RNA, 16 nt, Human
agugcuuccaaggaug

SEQ ID NO: 3819509 - RNA, 16 nt, Human
agugcuuccaaggcag

SEQ ID NO: 3819510 - RNA, 17 nt, Human
agugcuugcuuuucaug

SEQ ID NO: 3819511 - RNA, 22 nt, Human
agugcuugcuuuucaugcaaac

SEQ ID NO: 3819512 - RNA, 22 nt, Human
agugcuuggaacauacuguuca

SEQ ID NO: 3819513 - RNA, 19 nt, Human
agugcuuguccccuaagag

SEQ ID NO: 3819514 - RNA, 13 nt, Human
agugcuuucuugu

SEQ ID NO: 3819515 - RNA, 14 nt, Human
agugcuuugagaga

SEQ ID NO: 3819516 - RNA, 13 nt, Human
agugcuuuguaau

SEQ ID NO: 3819517 - RNA, 19 nt, Human
agugcuuuuaagugaaaau

SEQ ID NO: 3819518 - RNA, 18 nt, Human
agugcuuuuggcggggag

SEQ ID NO: 3819519 - RNA, 14 nt, Human
aguggaaaaacaca

SEQ ID NO: 3819520 - RNA, 11 nt, Human
aguggaaaaag

SEQ ID NO: 3819521 - RNA, 21 nt, Human
aguggaaaauaggcuuuuuaa

SEQ ID NO: 3819522 - RNA, 22 nt, Human
aguggaaagacagcuucucauc

SEQ ID NO: 3819523 - RNA, 22 nt, Human
aguggaaccguugccaaccgag

SEQ ID NO: 3819524 - RNA, 13 nt, Human
aguggaaggaaag

SEQ ID NO: 3819525 - RNA, 14 nt, Human
aguggaauaagaca

SEQ ID NO: 3819526 - RNA, 19 nt, Human
aguggaauaguauccucca

SEQ ID NO: 3819527 - RNA, 17 nt, Human
aguggaauuucuuguuu

SEQ ID NO: 3819528 - RNA, 20 nt, Human
aguggacaccaggagucccu

SEQ ID NO: 3819529 - RNA, 22 nt, Human
aguggacaccaggagucccugg

SEQ ID NO: 3819530 - RNA, 13 nt, Human
aguggacaggagu

SEQ ID NO: 3819531 - RNA, 20 nt, Human
aguggacauuguuggcagca

SEQ ID NO: 3819532 - RNA, 13 nt, Human
aguggaccaggac

SEQ ID NO: 3819533 - RNA, 14 nt, Human
aguggaccaggaca

SEQ ID NO: 3819534 - RNA, 17 nt, Human
aguggacccugaaaugu

SEQ ID NO: 3819535 - RNA, 18 nt, Human
aguggacccugaaaugug

SEQ ID NO: 3819536 - RNA, 19 nt, Human
aguggaccuuaggccuucc

SEQ ID NO: 3819537 - RNA, 23 nt, Human
aguggaccuuaggccuuccucuc

SEQ ID NO: 3819538 - RNA, 18 nt, Human
aguggaccuugagaccac

SEQ ID NO: 3819539 - RNA, 15 nt, Human
aguggacuggccccu

SEQ ID NO: 3819540 - RNA, 16 nt, Human
aguggacuggccccug

SEQ ID NO: 3819541 - RNA, 17 nt, Human
aguggacuggccccugg

SEQ ID NO: 3819542 - RNA, 18 nt, Human
aguggacuggccccuggg

SEQ ID NO: 3819543 - RNA, 17 nt, Human
aguggacuuuccacccc

SEQ ID NO: 3819544 - RNA, 18 nt, Human
aguggacuuuccaccccc

SEQ ID NO: 3819545 - RNA, 22 nt, Human
aguggacuuuccacccccuccc

SEQ ID NO: 3819546 - RNA, 14 nt, Human
aguggaggcacuuu

SEQ ID NO: 3819547 - RNA, 15 nt, Human
aguggaguuacugaa

SEQ ID NO: 3819548 - RNA, 21 nt, Human
aguggauagaugcccugcuag

SEQ ID NO: 3819549 - RNA, 15 nt, Human
aguggaucacaaagu

SEQ ID NO: 3819550 - RNA, 14 nt, Human
aguggaucuccaag

SEQ ID NO: 3819551 - RNA, 13 nt, Human
aguggaugauguu

SEQ ID NO: 3819552 - RNA, 15 nt, Human
aguggaugccacagc

SEQ ID NO: 3819553 - RNA, 21 nt, Human
aguggcaagaccaaaaugaca

SEQ ID NO: 3819554 - RNA, 17 nt, Human
aguggcaauauagaaac

SEQ ID NO: 3819555 - RNA, 18 nt, Human
aguggcaccgccucccca

SEQ ID NO: 3819556 - RNA, 16 nt, Human
aguggcaccugucugc

SEQ ID NO: 3819557 - RNA, 17 nt, Human
aguggcaccugucugcu

SEQ ID NO: 3819558 - RNA, 13 nt, Human
aguggcagcccag

SEQ ID NO: 3819559 - RNA, 11 nt, Human
aguggcagcug

SEQ ID NO: 3819560 - RNA, 14 nt, Human
aguggcagcugcuu

SEQ ID NO: 3819561 - RNA, 20 nt, Human
aguggcaggcagaggcccag

SEQ ID NO: 3819562 - RNA, 14 nt, Human
aguggcagggcuca

SEQ ID NO: 3819563 - RNA, 18 nt, Human
aguggcaggggacaggag

SEQ ID NO: 3819564 - RNA, 20 nt, Human
aguggcaucaucucagcuca

SEQ ID NO: 3819565 - RNA, 18 nt, Human
aguggcauuggcagcagg

SEQ ID NO: 3819566 - RNA, 18 nt, Human
aguggccaagaagcagug

SEQ ID NO: 3819567 - RNA, 19 nt, Human
aguggccacuaagcagagg

SEQ ID NO: 3819568 - RNA, 19 nt, Human
aguggccagaccagagcuc

SEQ ID NO: 3819569 - RNA, 21 nt, Human
aguggcccaacaggggcucca

SEQ ID NO: 3819570 - RNA, 19 nt, Human
aguggcccauggcauuuua

SEQ ID NO: 3819571 - RNA, 16 nt, Human
aguggcccccacagaa

SEQ ID NO: 3819572 - RNA, 20 nt, Human
aguggccucaacccucccuc

SEQ ID NO: 3819573 - RNA, 22 nt, Human
aguggccuccgucacuaccugg

SEQ ID NO: 3819574 - RNA, 14 nt, Human
aguggccuggccag

SEQ ID NO: 3819575 - RNA, 19 nt, Human
aguggccuggccaggagcu

SEQ ID NO: 3819576 - RNA, 17 nt, Human
aguggccuggcuccgcu

SEQ ID NO: 3819577 - RNA, 18 nt, Human
aguggcgaaaucccugcu

SEQ ID NO: 3819578 - RNA, 23 nt, Human
aguugaauugaggggauuaauau

SEQ ID NO: 3819579 - RNA, 13 nt, Human
aguugaauuuauu

SEQ ID NO: 3819580 - RNA, 17 nt, Human
aguugaauuuauuggcu

SEQ ID NO: 3819581 - RNA, 19 nt, Human
aguugaauuuauuggcuuu

SEQ ID NO: 3819582 - RNA, 18 nt, Human
aguugaauuuuuuuuaac

SEQ ID NO: 3819583 - RNA, 22 nt, Human
aguugacaaaaagcucuuacac

SEQ ID NO: 3819584 - RNA, 15 nt, Human
aguugacuuauagua

SEQ ID NO: 3819585 - RNA, 17 nt, Human
aguugacuuauaguaca

SEQ ID NO: 3819586 - RNA, 18 nt, Human
aguugacuuauaguacau

SEQ ID NO: 3819587 - RNA, 21 nt, Human
aguugacuuauaguacaugau

SEQ ID NO: 3819588 - RNA, 22 nt, Human
aguugacuugacagaacacugu

SEQ ID NO: 3819589 - RNA, 17 nt, Human
aguugagacaagaaaau

SEQ ID NO: 3819590 - RNA, 18 nt, Human
aguugagauaguuuucau

SEQ ID NO: 3819591 - RNA, 15 nt, Human
aguugagcuaugacu

SEQ ID NO: 3819592 - RNA, 18 nt, Human
aguugagcuaugacuuaa

SEQ ID NO: 3819593 - RNA, 15 nt, Human
aguugaggacuucuu

SEQ ID NO: 3819594 - RNA, 15 nt, Human
aguugaggaguuucc

SEQ ID NO: 3819595 - RNA, 16 nt, Human
aguugaggaguuuccu

SEQ ID NO: 3819596 - RNA, 16 nt, Human
aguugaggccaggagu

SEQ ID NO: 3819597 - RNA, 23 nt, Human
aguugaguauauuauaauagauu

SEQ ID NO: 3819598 - RNA, 17 nt, Human
aguugagugauagagcu

SEQ ID NO: 3819599 - RNA, 17 nt, Human
aguugauaaagauuuuu

SEQ ID NO: 3819600 - RNA, 14 nt, Human
aguugauagcacag

SEQ ID NO: 3819601 - RNA, 22 nt, Human
aguugauauguuuuauuucauu

SEQ ID NO: 3819602 - RNA, 21 nt, Human
aguugaucgccuuucccaggu

SEQ ID NO: 3819603 - RNA, 23 nt, Human
aguugaucuggaacccagacuca

SEQ ID NO: 3819604 - RNA, 15 nt, Human
aguugauguugcauu

SEQ ID NO: 3819605 - RNA, 14 nt, Human
aguugauucagcuc

SEQ ID NO: 3819606 - RNA, 18 nt, Human
aguugauucagcucugca

SEQ ID NO: 3819607 - RNA, 18 nt, Human
aguugauuuaguguuuuu

SEQ ID NO: 3819608 - RNA, 23 nt, Human
aguugauuuuacaauugaaauga

SEQ ID NO: 3819609 - RNA, 20 nt, Human
aguugcaaggcaaauguuua

SEQ ID NO: 3819610 - RNA, 13 nt, Human
aguugcaauaaua

SEQ ID NO: 3819611 - RNA, 14 nt, Human
aguugcaauaauac

SEQ ID NO: 3819612 - RNA, 22 nt, Human
aguugcaauaauacuucucaaa

SEQ ID NO: 3819613 - RNA, 19 nt, Human
aguugcaaucguaauguac

SEQ ID NO: 3819614 - RNA, 18 nt, Human
aguugcaauugaauuaaa

SEQ ID NO: 3819615 - RNA, 11 nt, Human
aguugcacagc

SEQ ID NO: 3819616 - RNA, 15 nt, Human
aguugcacggcugcu

SEQ ID NO: 3819617 - RNA, 20 nt, Human
aguugcacggcugcugaggc

SEQ ID NO: 3819618 - RNA, 23 nt, Human
aguugcacuuauugaccauuuuu

SEQ ID NO: 3819619 - RNA, 20 nt, Human
aguugcacuuggccucugga

SEQ ID NO: 3819620 - RNA, 11 nt, Human
aguugcagaaa

SEQ ID NO: 3819621 - RNA, 16 nt, Human
aguugcagauucauuu

SEQ ID NO: 3819622 - RNA, 17 nt, Human
aguugcagcuguuuugu

SEQ ID NO: 3819623 - RNA, 22 nt, Human
aguugcagcuguuuuguugaca

SEQ ID NO: 3819624 - RNA, 17 nt, Human
aguugcauagcaguaua

SEQ ID NO: 3819625 - RNA, 18 nt, Human
aguugcauguaguaacac

SEQ ID NO: 3819626 - RNA, 14 nt, Human
aguugcauuuuaac

SEQ ID NO: 3819627 - RNA, 16 nt, Human
aguugccaagacaaau

SEQ ID NO: 3819628 - RNA, 20 nt, Human
aguugccaccaccucugugg

SEQ ID NO: 3819629 - RNA, 21 nt, Human
aguugccaccaccucuguggc

SEQ ID NO: 3819630 - RNA, 14 nt, Human
aguugcccagccuc

SEQ ID NO: 3819631 - RNA, 17 nt, Human
aguugccccgucucugu

SEQ ID NO: 3819632 - RNA, 18 nt, Human
aguugccccgucucuguu

SEQ ID NO: 3819633 - RNA, 22 nt, Human
aguugccgcauauuauaucaga

SEQ ID NO: 3819634 - RNA, 13 nt, Human
aguugccuuuuau

SEQ ID NO: 3819635 - RNA, 19 nt, Human
aguugcuauuuuuguaaag

SEQ ID NO: 3819636 - RNA, 15 nt, Human
aguugcucaaaaaga

SEQ ID NO: 3819637 - RNA, 14 nt, Human
aguugcucuaugcu

SEQ ID NO: 3819638 - RNA, 17 nt, Human
aguugcugcaaaccuga

SEQ ID NO: 3819639 - RNA, 23 nt, Human
aguugcugcuucaauuuauaccu

SEQ ID NO: 3819640 - RNA, 19 nt, Human
aguugcuugucuucuggua

SEQ ID NO: 3819641 - RNA, 13 nt, Human
aguuggaaacacu

SEQ ID NO: 3819642 - RNA, 19 nt, Human
aguuggaaacacuaaaugu

SEQ ID NO: 3819643 - RNA, 16 nt, Human
auucaaaaguuccaag

SEQ ID NO: 3819644 - RNA, 18 nt, Human
auucaaaauaggguauau

SEQ ID NO: 3819645 - RNA, 12 nt, Human
auucaaaauauu

SEQ ID NO: 3819646 - RNA, 18 nt, Human
auucaaacagucucagga

SEQ ID NO: 3819647 - RNA, 19 nt, Human
auucaaacagucucaggaa

SEQ ID NO: 3819648 - RNA, 20 nt, Human
auucaaacagucucaggaaa

SEQ ID NO: 3819649 - RNA, 14 nt, Human
auucaaagaaucac

SEQ ID NO: 3819650 - RNA, 14 nt, Human
auucaaagagaaaa

SEQ ID NO: 3819651 - RNA, 19 nt, Human
auucaaagcaccaaaauaa

SEQ ID NO: 3819652 - RNA, 12 nt, Human
auucaaagcaug

SEQ ID NO: 3819653 - RNA, 17 nt, Human
auucaaagguucuaggu

SEQ ID NO: 3819654 - RNA, 21 nt, Human
auucaaaguugccuaaaucca

SEQ ID NO: 3819655 - RNA, 22 nt, Human
auucaaaguugccuaaauccau

SEQ ID NO: 3819656 - RNA, 20 nt, Human
auucaaaugggugauauccu

SEQ ID NO: 3819657 - RNA, 13 nt, Human
auucaacaaacau

SEQ ID NO: 3819658 - RNA, 22 nt, Human
auucaacacucccuucccauga

SEQ ID NO: 3819659 - RNA, 18 nt, Human
auucaacagguuuuccug

SEQ ID NO: 3819660 - RNA, 19 nt, Human
auucaaccacuguaaaaug

SEQ ID NO: 3819661 - RNA, 19 nt, Human
auucaaccauggacuuuau

SEQ ID NO: 3819662 - RNA, 21 nt, Human
auucaacuuuccaaauaaaag

SEQ ID NO: 3819663 - RNA, 22 nt, Human
auucaagaaaacaacuucaaua

SEQ ID NO: 3819664 - RNA, 16 nt, Human
auucaagaaagccagu

SEQ ID NO: 3819665 - RNA, 12 nt, Human
auucaagauucc

SEQ ID NO: 3819666 - RNA, 21 nt, Human
auucaagccauuccaaaguuc

SEQ ID NO: 3819667 - RNA, 17 nt, Human
auucaaggaauuucuua

SEQ ID NO: 3819668 - RNA, 18 nt, Human
auucaaggaauuucuuaa

SEQ ID NO: 3819669 - RNA, 20 nt, Human
auucaaggaauuucuuaacu

SEQ ID NO: 3819670 - RNA, 17 nt, Human
auucaagguaaaauucu

SEQ ID NO: 3819671 - RNA, 15 nt, Human
auucaagguggccaa

SEQ ID NO: 3819672 - RNA, 12 nt, Human
auucaaguauua

SEQ ID NO: 3819673 - RNA, 16 nt, Human
auucaaguguacagug

SEQ ID NO: 3819674 - RNA, 12 nt, Human
auucaauaaaaa

SEQ ID NO: 3819675 - RNA, 18 nt, Human
auucaauaaaaaaaagaa

SEQ ID NO: 3819676 - RNA, 22 nt, Human
auucaauaaaaaaaagaaauga

SEQ ID NO: 3819677 - RNA, 17 nt, Human
auucaauaaaguauuua

SEQ ID NO: 3819678 - RNA, 18 nt, Human
auucaauaaaguauuuaa

SEQ ID NO: 3819679 - RNA, 20 nt, Human
auucaauaaaguauuuaauu

SEQ ID NO: 3819680 - RNA, 17 nt, Human
auucaauaguaauauaa

SEQ ID NO: 3819681 - RNA, 21 nt, Human
auucaauaguaauauaauaca

SEQ ID NO: 3819682 - RNA, 19 nt, Human
auucaauauugacauuugu

SEQ ID NO: 3819683 - RNA, 21 nt, Human
auucaauauugacauuuguag

SEQ ID NO: 3819684 - RNA, 22 nt, Human
auucaaucgacuggguuuaugu

SEQ ID NO: 3819685 - RNA, 15 nt, Human
auucaaucuguaaac

SEQ ID NO: 3819686 - RNA, 17 nt, Human
auucaaucuguaaacug

SEQ ID NO: 3819687 - RNA, 22 nt, Human
auucaaucuguaaacuguguau

SEQ ID NO: 3819688 - RNA, 20 nt, Human
auucaaugccccugaauuua

SEQ ID NO: 3819689 - RNA, 12 nt, Human
auucaauuaaag

SEQ ID NO: 3819690 - RNA, 18 nt, Human
auucaauuaaagaaauaa

SEQ ID NO: 3819691 - RNA, 21 nt, Human
auucaauuguaaauugaauca

SEQ ID NO: 3819692 - RNA, 22 nt, Human
auucaauuguaaauugaaucag

SEQ ID NO: 3819693 - RNA, 21 nt, Human
auucaauuugauguggugaaa

SEQ ID NO: 3819694 - RNA, 15 nt, Human
auucacaaaaauuga

SEQ ID NO: 3819695 - RNA, 14 nt, Human
auucacaaacuuuu

SEQ ID NO: 3819696 - RNA, 22 nt, Human
auucacaaacuuuuauacucuu

SEQ ID NO: 3819697 - RNA, 21 nt, Human
auucacaaaguaauuuggaaa

SEQ ID NO: 3819698 - RNA, 13 nt, Human
auucacaagcugc

SEQ ID NO: 3819699 - RNA, 19 nt, Human
auucacaaguuaagauucu

SEQ ID NO: 3819700 - RNA, 14 nt, Human
auucacaccccacc

SEQ ID NO: 3819701 - RNA, 17 nt, Human
auucacaucuaaccuca

SEQ ID NO: 3819702 - RNA, 15 nt, Human
auucacauguuuuca

SEQ ID NO: 3819703 - RNA, 21 nt, Human
auucacauguuuucaaaugga

SEQ ID NO: 3819704 - RNA, 20 nt, Human
auucacauuguauucagagu

SEQ ID NO: 3819705 - RNA, 15 nt, Human
auucacauuuagaaa

SEQ ID NO: 3819706 - RNA, 21 nt, Human
auucaccaaaauagucuucuc

SEQ ID NO: 3819707 - RNA, 22 nt, Human
auucacccccuuuccuggacac

SEQ ID NO: 3819708 - RNA, 21 nt, Human
auucaccuaagagauucugau

SEQ ID NO: 3819709 - RNA, 23 nt, Human
auucaccuaagagauucugauuu

SEQ ID NO: 3819710 - RNA, 21 nt, Human
auucaccuccuaaaacaacag

SEQ ID NO: 3819711 - RNA, 19 nt, Human
auucaccuguaaaacuuua

SEQ ID NO: 3819712 - RNA, 13 nt, Human
auucaccuucagu

SEQ ID NO: 3819713 - RNA, 20 nt, Human
auucacggagauaugaagag

SEQ ID NO: 3819714 - RNA, 21 nt, Human
auucacucaagcacugauauc

SEQ ID NO: 3819715 - RNA, 19 nt, Human
auucacucuuccagaaucc

SEQ ID NO: 3819716 - RNA, 12 nt, Human
auucacugauuu

SEQ ID NO: 3819717 - RNA, 14 nt, Human
auucacugggccaa

SEQ ID NO: 3819718 - RNA, 16 nt, Human
auucacuucacugugc

SEQ ID NO: 3819719 - RNA, 18 nt, Human
auucacuucacugugcug

SEQ ID NO: 3819720 - RNA, 18 nt, Human
auucacuuucauuuuuga

SEQ ID NO: 3819721 - RNA, 12 nt, Human
aguuuaaaaaaa

SEQ ID NO: 3819722 - RNA, 14 nt, Human
aguuuaaaaaaauu

SEQ ID NO: 3819723 - RNA, 15 nt, Human
aguuuaaaaaaauug

SEQ ID NO: 3819724 - RNA, 16 nt, Human
aguuuaaaaaucaacu

SEQ ID NO: 3819725 - RNA, 18 nt, Human
aguuuaaaaaucaacuuu

SEQ ID NO: 3819726 - RNA, 20 nt, Human
aguuuaaaaaucaacuuuuu

SEQ ID NO: 3819727 - RNA, 17 nt, Human
aguuuaaaacaguauuu

SEQ ID NO: 3819728 - RNA, 22 nt, Human
aguuuaaaaguucuuaguuaua

SEQ ID NO: 3819729 - RNA, 15 nt, Human
aguuuaaaaucauca

SEQ ID NO: 3819730 - RNA, 12 nt, Human
aguuuaaagcaa

SEQ ID NO: 3819731 - RNA, 20 nt, Human
aguuuaaauauuaagcauga

SEQ ID NO: 3819732 - RNA, 20 nt, Human
aguuuaaauuguaauaggcg

SEQ ID NO: 3819733 - RNA, 14 nt, Human
aguuuaaccauaug

SEQ ID NO: 3819734 - RNA, 17 nt, Human
aguuuaagaccagccug

SEQ ID NO: 3819735 - RNA, 22 nt, Human
aguuuaauccuucuaguuuccc

SEQ ID NO: 3819736 - RNA, 20 nt, Human
aguuuaauggugccuucauu

SEQ ID NO: 3819737 - RNA, 18 nt, Human
aguuuaauugacuuauuu

SEQ ID NO: 3819738 - RNA, 15 nt, Human
aguuuacaaguguau

SEQ ID NO: 3819739 - RNA, 16 nt, Human
aguuuacaaguguaua

SEQ ID NO: 3819740 - RNA, 19 nt, Human
aguuuacaaguguauauca

SEQ ID NO: 3819741 - RNA, 20 nt, Human
aguuuacaguaaauaaauug

SEQ ID NO: 3819742 - RNA, 14 nt, Human
aguuuacauuuuua

SEQ ID NO: 3819743 - RNA, 20 nt, Human
aguuuaccaguugccuuuua

SEQ ID NO: 3819744 - RNA, 12 nt, Human
aguuuaccaucu

SEQ ID NO: 3819745 - RNA, 18 nt, Human
aguuuaccauuuguaaua

SEQ ID NO: 3819746 - RNA, 21 nt, Human
aguuuaccauuuguaauaaag

SEQ ID NO: 3819747 - RNA, 22 nt, Human
aguuuaccauuuguaauaaagu

SEQ ID NO: 3819748 - RNA, 16 nt, Human
aguuuacccgguuucu

SEQ ID NO: 3819749 - RNA, 14 nt, Human
aguuuacuauuuua

SEQ ID NO: 3819750 - RNA, 16 nt, Human
aguuuacuauuuuacu

SEQ ID NO: 3819751 - RNA, 21 nt, Human
aguuuagaggaaaaaaaugac

SEQ ID NO: 3819752 - RNA, 21 nt, Human
aguuuagauuucaagaaaaaa

SEQ ID NO: 3819753 - RNA, 17 nt, Human
aguuuaguaaggcugug

SEQ ID NO: 3819754 - RNA, 17 nt, Human
aguuuagugcaucuuug

SEQ ID NO: 3819755 - RNA, 20 nt, Human
aguuuagugugauaaaggca

SEQ ID NO: 3819756 - RNA, 22 nt, Human
aguuuauacaguuuuaaagaau

SEQ ID NO: 3819757 - RNA, 16 nt, Human
aguuuauauuuaacuc

SEQ ID NO: 3819758 - RNA, 18 nt, Human
aguuuaucaguaaauaac

SEQ ID NO: 3819759 - RNA, 17 nt, Human
aguuuaucaugaagccu

SEQ ID NO: 3819760 - RNA, 21 nt, Human
aguuuaugucuaaagagcuuu

SEQ ID NO: 3819761 - RNA, 22 nt, Human
aguuuauuuccaaauaaaauga

SEQ ID NO: 3819762 - RNA, 19 nt, Human
aguuuauuuguugagagug

SEQ ID NO: 3819763 - RNA, 16 nt, Human
aguuuauuuuaaaaca

SEQ ID NO: 3819764 - RNA, 15 nt, Human
aguuucaaaaacugu

SEQ ID NO: 3819765 - RNA, 18 nt, Human
aguuucaaaaaucugaag

SEQ ID NO: 3819766 - RNA, 23 nt, Human
aguuucaaaaaucugaagauugu

SEQ ID NO: 3819767 - RNA, 19 nt, Human
aguuucaaacuuacuauuu

SEQ ID NO: 3819768 - RNA, 15 nt, Human
aguuucaaguuuuaa

SEQ ID NO: 3819769 - RNA, 20 nt, Human
aguuucaaguuuuaaaguuc

SEQ ID NO: 3819770 - RNA, 17 nt, Human
aguuucaauaaaguuug

SEQ ID NO: 3819771 - RNA, 14 nt, Human
aguuucaaugugau

SEQ ID NO: 3819772 - RNA, 15 nt, Human
aguuucaaugugauu

SEQ ID NO: 3819773 - RNA, 17 nt, Human
aguuucaauucagugcu

SEQ ID NO: 3819774 - RNA, 14 nt, Human
aguuucaauuuguu

SEQ ID NO: 3819775 - RNA, 22 nt, Human
aguuucacagaaaauaaggcac

SEQ ID NO: 3819776 - RNA, 15 nt, Human
aguuucacugacuua

SEQ ID NO: 3819777 - RNA, 17 nt, Human
aguuucacugccauaua

SEQ ID NO: 3819778 - RNA, 21 nt, Human
aguuucagcuuaaaauaaaca

SEQ ID NO: 3819779 - RNA, 22 nt, Human
aguuucagcuuaaaauaaacag

SEQ ID NO: 3819780 - RNA, 16 nt, Human
aguuucaggugacaug

SEQ ID NO: 3819781 - RNA, 17 nt, Human
aguuucaggugacaugu

SEQ ID NO: 3819782 - RNA, 20 nt, Human
aguuucaguagauugcagaa

SEQ ID NO: 3819783 - RNA, 22 nt, Human
aguuucaguauuagaugcacuu

SEQ ID NO: 3819784 - RNA, 19 nt, Human
aguuucaguuuguuggaaa

SEQ ID NO: 3819785 - RNA, 18 nt, Human
aguuucauguacaagaug

SEQ ID NO: 3819786 - RNA, 17 nt, Human
aguuucauucuccugcc

SEQ ID NO: 3819787 - RNA, 21 nt, Human
aguuucauuuaugauacaaaa

SEQ ID NO: 3819788 - RNA, 20 nt, Human
aguuuccaagcaaauguuac

SEQ ID NO: 3819789 - RNA, 17 nt, Human
aguuuccgugcguggca

SEQ ID NO: 3819790 - RNA, 22 nt, Human
aguuuccguuuccagguguuua

SEQ ID NO: 3819791 - RNA, 17 nt, Human
aguuuccuaaaaguuca

SEQ ID NO: 3819792 - RNA, 12 nt, Human
aguuuccugaaa

SEQ ID NO: 3819793 - RNA, 19 nt, Human
aguuuccuuccagcccaga

SEQ ID NO: 3819794 - RNA, 17 nt, Human
aguuuccuuggcuggug

SEQ ID NO: 3819795 - RNA, 20 nt, Human
aguuucuaaaauugaguucu

SEQ ID NO: 3819796 - RNA, 14 nt, Human
auucaugccuggcu

SEQ ID NO: 3819797 - RNA, 12 nt, Human
auucauguaaac

SEQ ID NO: 3819798 - RNA, 13 nt, Human
auucauguuucuu

SEQ ID NO: 3819799 - RNA, 14 nt, Human
auucauuacagcuu

SEQ ID NO: 3819800 - RNA, 15 nt, Human
auucauuagucaugu

SEQ ID NO: 3819801 - RNA, 20 nt, Human
auucauucucauaauuccua

SEQ ID NO: 3819802 - RNA, 19 nt, Human
auucauucugugaucauuu

SEQ ID NO: 3819803 - RNA, 15 nt, Human
auucauugaagucag

SEQ ID NO: 3819804 - RNA, 20 nt, Human
auucauugaagucagaugug

SEQ ID NO: 3819805 - RNA, 22 nt, Human
auucauugugguuauuuuuaua

SEQ ID NO: 3819806 - RNA, 19 nt, Human
auucauuuauaagaagaga

SEQ ID NO: 3819807 - RNA, 13 nt, Human
auucauuucacug

SEQ ID NO: 3819808 - RNA, 15 nt, Human
auucauuucacugua

SEQ ID NO: 3819809 - RNA, 13 nt, Human
auucauuuccugc

SEQ ID NO: 3819810 - RNA, 14 nt, Human
auucauuuccugcc

SEQ ID NO: 3819811 - RNA, 12 nt, Human
auucauuucuaa

SEQ ID NO: 3819812 - RNA, 19 nt, Human
auucauuugaguuauuuua

SEQ ID NO: 3819813 - RNA, 14 nt, Human
auucauuuuauauu

SEQ ID NO: 3819814 - RNA, 22 nt, Human
auucauuuucuagauacaauaa

SEQ ID NO: 3819815 - RNA, 16 nt, Human
auucauuuucucuuua

SEQ ID NO: 3819816 - RNA, 13 nt, Human
auucauuuuuaau

SEQ ID NO: 3819817 - RNA, 16 nt, Human
auuccaaaaagcacau

SEQ ID NO: 3819818 - RNA, 12 nt, Human
auuccaaaauau

SEQ ID NO: 3819819 - RNA, 13 nt, Human
auuccaaaauauu

SEQ ID NO: 3819820 - RNA, 14 nt, Human
auuccaaaccaaau

SEQ ID NO: 3819821 - RNA, 21 nt, Human
auuccaaaccaaauuuuaauu

SEQ ID NO: 3819822 - RNA, 13 nt, Human
auuccaaauucau

SEQ ID NO: 3819823 - RNA, 16 nt, Human
auuccaacacugauuu

SEQ ID NO: 3819824 - RNA, 14 nt, Human
auuccaacaguuua

SEQ ID NO: 3819825 - RNA, 18 nt, Human
auuccaacaguuuaauga

SEQ ID NO: 3819826 - RNA, 19 nt, Human
auuccaacaguuuaaugaa

SEQ ID NO: 3819827 - RNA, 16 nt, Human
auuccaaccccaacuc

SEQ ID NO: 3819828 - RNA, 11 nt, Human
auuccaaccuu

SEQ ID NO: 3819829 - RNA, 13 nt, Human
auuccaagacagu

SEQ ID NO: 3819830 - RNA, 13 nt, Human
auuccaagcuucc

SEQ ID NO: 3819831 - RNA, 23 nt, Human
auuccaagucagaaacuguuucu

SEQ ID NO: 3819832 - RNA, 17 nt, Human
auuccaauaugaugacu

SEQ ID NO: 3819833 - RNA, 14 nt, Human
auuccaccuuaaau

SEQ ID NO: 3819834 - RNA, 22 nt, Human
auuccaccuuaaauuaaacaau

SEQ ID NO: 3819835 - RNA, 18 nt, Human
auuccacugcguugucca

SEQ ID NO: 3819836 - RNA, 19 nt, Human
auuccagaagaagagaagc

SEQ ID NO: 3819837 - RNA, 16 nt, Human
auuccagaauaucugg

SEQ ID NO: 3819838 - RNA, 14 nt, Human
auuccagaaugcug

SEQ ID NO: 3819839 - RNA, 19 nt, Human
auuccagaaugcuguacau

SEQ ID NO: 3819840 - RNA, 23 nt, Human
auuccagaaugcuguacaucuau

SEQ ID NO: 3819841 - RNA, 17 nt, Human
auuccagaccugaagaa

SEQ ID NO: 3819842 - RNA, 18 nt, Human
auuccagagacaucagca

SEQ ID NO: 3819843 - RNA, 21 nt, Human
auuccagagaguggcuccucc

SEQ ID NO: 3819844 - RNA, 12 nt, Human
auuccagaggaa

SEQ ID NO: 3819845 - RNA, 20 nt, Human
auuccagcacuucaggaggc

SEQ ID NO: 3819846 - RNA, 17 nt, Human
auuccagccccucuggu

SEQ ID NO: 3819847 - RNA, 13 nt, Human
auuccagcucauu

SEQ ID NO: 3819848 - RNA, 15 nt, Human
auuccagcuccuccg

SEQ ID NO: 3819849 - RNA, 23 nt, Human
auuccaguuuguuuauuacuuau

SEQ ID NO: 3819850 - RNA, 20 nt, Human
auuccauaauuccauaugcu

SEQ ID NO: 3819851 - RNA, 19 nt, Human
auuccauaguauauuaaaa

SEQ ID NO: 3819852 - RNA, 23 nt, Human
auuccauaguauauuaaaaaugg

SEQ ID NO: 3819853 - RNA, 22 nt, Human
auuccauaucuugcgaauccaa

SEQ ID NO: 3819854 - RNA, 23 nt, Human
auuccauauuagaaaacuuuguu

SEQ ID NO: 3819855 - RNA, 17 nt, Human
auuccauauucauguaa

SEQ ID NO: 3819856 - RNA, 18 nt, Human
auuccauauucauguaaa

SEQ ID NO: 3819857 - RNA, 11 nt, Human
auuccaucucc

SEQ ID NO: 3819858 - RNA, 12 nt, Human
auuccaucuccu

SEQ ID NO: 3819859 - RNA, 15 nt, Human
auuccaugaaucgcu

SEQ ID NO: 3819860 - RNA, 21 nt, Human
auuccaugaaucgcuucucuu

SEQ ID NO: 3819861 - RNA, 18 nt, Human
auuccaugaauguaucag

SEQ ID NO: 3819862 - RNA, 15 nt, Human
auuccaugaauguuc

SEQ ID NO: 3819863 - RNA, 12 nt, Human
auuccaugcuaa

SEQ ID NO: 3819864 - RNA, 22 nt, Human
auuccaugcuaagcaagcuaac

SEQ ID NO: 3819865 - RNA, 21 nt, Human
auuccauucuggaagugacuu

SEQ ID NO: 3819866 - RNA, 13 nt, Human
auucuaggcaucc

SEQ ID NO: 3819867 - RNA, 20 nt, Human
auucuaggcaucccagggga

SEQ ID NO: 3819868 - RNA, 22 nt, Human
auucuaguacuagaaacugaag

SEQ ID NO: 3819869 - RNA, 17 nt, Human
auucuagugcugcugaa

SEQ ID NO: 3819870 - RNA, 17 nt, Human
auucuaguuuugucaaa

SEQ ID NO: 3819871 - RNA, 13 nt, Human
auucuauaaaacu

SEQ ID NO: 3819872 - RNA, 14 nt, Human
auucuauaaaacuc

SEQ ID NO: 3819873 - RNA, 18 nt, Human
auucuauaaguuuuaugu

SEQ ID NO: 3819874 - RNA, 17 nt, Human
auucuauaguucuagac

SEQ ID NO: 3819875 - RNA, 13 nt, Human
auucuauaugaau

SEQ ID NO: 3819876 - RNA, 14 nt, Human
auucuauaugaauu

SEQ ID NO: 3819877 - RNA, 23 nt, Human
auucuaugugucaucaauagugu

SEQ ID NO: 3819878 - RNA, 22 nt, Human
auucuauuuauauguacaugag

SEQ ID NO: 3819879 - RNA, 15 nt, Human
auucuauuugcuggg

SEQ ID NO: 3819880 - RNA, 13 nt, Human
auucuauuuuaca

SEQ ID NO: 3819881 - RNA, 21 nt, Human
auucucaaccuaccaccccuu

SEQ ID NO: 3819882 - RNA, 23 nt, Human
auucucaagccgcaucccagacu

SEQ ID NO: 3819883 - RNA, 15 nt, Human
auucucaccagcugu

SEQ ID NO: 3819884 - RNA, 13 nt, Human
auucucaccagga

SEQ ID NO: 3819885 - RNA, 15 nt, Human
auucucagcagagug

SEQ ID NO: 3819886 - RNA, 17 nt, Human
auucucagcagagugcu

SEQ ID NO: 3819887 - RNA, 13 nt, Human
auucucaggcacc

SEQ ID NO: 3819888 - RNA, 17 nt, Human
auucucagggucucugc

SEQ ID NO: 3819889 - RNA, 19 nt, Human
auucucagugccaacugug

SEQ ID NO: 3819890 - RNA, 22 nt, Human
auucucagugccaacuguggcu

SEQ ID NO: 3819891 - RNA, 18 nt, Human
auucucaguuuuucuuaa

SEQ ID NO: 3819892 - RNA, 14 nt, Human
auucucaugccuca

SEQ ID NO: 3819893 - RNA, 15 nt, Human
auucucaugugaucc

SEQ ID NO: 3819894 - RNA, 18 nt, Human
auucucauugcagaauaa

SEQ ID NO: 3819895 - RNA, 11 nt, Human
auucucauugg

SEQ ID NO: 3819896 - RNA, 22 nt, Human
auucucauuggaaauuuagcau

SEQ ID NO: 3819897 - RNA, 23 nt, Human
auucucauuggaaauuuagcauu

SEQ ID NO: 3819898 - RNA, 17 nt, Human
auucucauuugucacac

SEQ ID NO: 3819899 - RNA, 14 nt, Human
auucuccacagcaa

SEQ ID NO: 3819900 - RNA, 15 nt, Human
auucuccaccugcca

SEQ ID NO: 3819901 - RNA, 19 nt, Human
auucuccaccugccaggga

SEQ ID NO: 3819902 - RNA, 20 nt, Human
auucuccaccugccagggac

SEQ ID NO: 3819903 - RNA, 21 nt, Human
auucuccagggguuuacagug

SEQ ID NO: 3819904 - RNA, 14 nt, Human
auucuccauuuguu

SEQ ID NO: 3819905 - RNA, 18 nt, Human
auucuccauuuguuaucu

SEQ ID NO: 3819906 - RNA, 19 nt, Human
auucuccauuuguuaucug

SEQ ID NO: 3819907 - RNA, 20 nt, Human
auucucccagguaccagcug

SEQ ID NO: 3819908 - RNA, 24 nt, Human
auucucccagguaccagcugcgcu

SEQ ID NO: 3819909 - RNA, 17 nt, Human
auucucccgggacucug

SEQ ID NO: 3819910 - RNA, 21 nt, Human
auucuccuaucaccugucuug

SEQ ID NO: 3819911 - RNA, 12 nt, Human
auucuccuccuc

SEQ ID NO: 3819912 - RNA, 13 nt, Human
auucuccugccuu

SEQ ID NO: 3819913 - RNA, 14 nt, Human
auucuccugugcua

SEQ ID NO: 3819914 - RNA, 22 nt, Human
auucuccuucagcccucacccc

SEQ ID NO: 3819915 - RNA, 18 nt, Human
auucuccuuguguuacua

SEQ ID NO: 3819916 - RNA, 18 nt, Human
auucuccuuguuguuggu

SEQ ID NO: 3819917 - RNA, 17 nt, Human
auucucgcuucccugaa

SEQ ID NO: 3819918 - RNA, 17 nt, Human
auucucuauuugaauua

SEQ ID NO: 3819919 - RNA, 21 nt, Human
auucucuccauuucacuggcu

SEQ ID NO: 3819920 - RNA, 19 nt, Human
auucucuccuguaccucuu

SEQ ID NO: 3819921 - RNA, 15 nt, Human
auucucucuccugua

SEQ ID NO: 3819922 - RNA, 17 nt, Human
auucucugagcugugca

SEQ ID NO: 3819923 - RNA, 18 nt, Human
auucucugagcugugcag

SEQ ID NO: 3819924 - RNA, 17 nt, Human
auucucuggcuguaagg

SEQ ID NO: 3819925 - RNA, 19 nt, Human
auucucuggcuguaaggcu

SEQ ID NO: 3819926 - RNA, 20 nt, Human
auucucuggcuguaaggcuc

SEQ ID NO: 3819927 - RNA, 14 nt, Human
auucucuguacaua

SEQ ID NO: 3819928 - RNA, 12 nt, Human
auucucugucuc

SEQ ID NO: 3819929 - RNA, 16 nt, Human
auucucugucucaucc

SEQ ID NO: 3819930 - RNA, 17 nt, Human
auucucugucucaucca

SEQ ID NO: 3819931 - RNA, 17 nt, Human
auucucugugucuaaga

SEQ ID NO: 3819932 - RNA, 18 nt, Human
auucucugugucuaagau

SEQ ID NO: 3819933 - RNA, 20 nt, Human
auucucugugucuaagauuc

SEQ ID NO: 3819934 - RNA, 14 nt, Human
auucucuuauccaa

SEQ ID NO: 3819935 - RNA, 15 nt, Human
auucucuugccucag

SEQ ID NO: 3819936 - RNA, 17 nt, Human
auucucuuggcuggcuu

SEQ ID NO: 3819937 - RNA, 20 nt, Human
auucucuuguauaagauccu

SEQ ID NO: 3819938 - RNA, 16 nt, Human
auucucuuuuaucugu

SEQ ID NO: 3819939 - RNA, 17 nt, Human
auucucuuuuaucuguu

SEQ ID NO: 3819940 - RNA, 15 nt, Human
auucugaaggagccc

SEQ ID NO: 3819941 - RNA, 12 nt, Human
auucugaaguua

SEQ ID NO: 3819942 - RNA, 14 nt, Human
auucugaaguuaua

SEQ ID NO: 3819943 - RNA, 13 nt, Human
auucugaauauuu

SEQ ID NO: 3819944 - RNA, 15 nt, Human
auucugaaugcuucu

SEQ ID NO: 3819945 - RNA, 15 nt, Human
auucugaauuugcaa

SEQ ID NO: 3819946 - RNA, 18 nt, Human
auucugaauuugcaaagu

SEQ ID NO: 3819947 - RNA, 19 nt, Human
auucugaauuugcaaagua

SEQ ID NO: 3819948 - RNA, 23 nt, Human
auucugaauuugcaaaguacugu

SEQ ID NO: 3819949 - RNA, 15 nt, Human
auucugagaaaacaa

SEQ ID NO: 3819950 - RNA, 19 nt, Human
auucugagacaugugucaa

SEQ ID NO: 3819951 - RNA, 13 nt, Human
auucugagagcug

SEQ ID NO: 3819952 - RNA, 19 nt, Human
auucugagaugacuauuca

SEQ ID NO: 3819953 - RNA, 17 nt, Human
auucugaggcccugccc

SEQ ID NO: 3819954 - RNA, 16 nt, Human
auucugauguacucua

SEQ ID NO: 3819955 - RNA, 18 nt, Human
auucugauguacucuaaa

SEQ ID NO: 3819956 - RNA, 23 nt, Human
auucugauguacucuaaauacug

SEQ ID NO: 3819957 - RNA, 15 nt, Human
auucugauuacacaa

SEQ ID NO: 3819958 - RNA, 14 nt, Human
auucugauuucuuu

SEQ ID NO: 3819959 - RNA, 19 nt, Human
auucugauuuggaaaaaga

SEQ ID NO: 3819960 - RNA, 19 nt, Human
auucugcaagcacaucugc

SEQ ID NO: 3819961 - RNA, 22 nt, Human
auucugcaagcacaucugcauu

SEQ ID NO: 3819962 - RNA, 13 nt, Human
auucugcagcaug

SEQ ID NO: 3819963 - RNA, 18 nt, Human
auucacaagacccaaaag

SEQ ID NO: 3819964 - RNA, 14 nt, Human
auucacaagcugcc

SEQ ID NO: 3819965 - RNA, 15 nt, Human
auucacaagcugccu

SEQ ID NO: 3819966 - RNA, 14 nt, Human
auucacaauagaaa

SEQ ID NO: 3819967 - RNA, 16 nt, Human
auucacaccccaccug

SEQ ID NO: 3819968 - RNA, 15 nt, Human
auucacaccugacuc

SEQ ID NO: 3819969 - RNA, 20 nt, Human
auucacagugcucuuuucuc

SEQ ID NO: 3819970 - RNA, 23 nt, Human
auucacaguucuuugggccagac

SEQ ID NO: 3819971 - RNA, 18 nt, Human
auucacaucgcagauucu

SEQ ID NO: 3819972 - RNA, 15 nt, Human
auucacaucucauuu

SEQ ID NO: 3819973 - RNA, 18 nt, Human
auucacauguuuucaaau

SEQ ID NO: 3819974 - RNA, 19 nt, Human
auucacauguuuucaaaug

SEQ ID NO: 3819975 - RNA, 13 nt, Human
auucacauuguau

SEQ ID NO: 3819976 - RNA, 14 nt, Human
auucacauuuagaa

SEQ ID NO: 3819977 - RNA, 19 nt, Human
auucaccauguaaaacaaa

SEQ ID NO: 3819978 - RNA, 21 nt, Human
auucaccauguaaaacaaaaa

SEQ ID NO: 3819979 - RNA, 22 nt, Human
auucaccauguaaaacaaaaaa

SEQ ID NO: 3819980 - RNA, 19 nt, Human
auucacccagacagcuccc

SEQ ID NO: 3819981 - RNA, 16 nt, Human
auucacccccaaacag

SEQ ID NO: 3819982 - RNA, 17 nt, Human
auucaccuaagagauuc

SEQ ID NO: 3819983 - RNA, 14 nt, Human
auucaccuguaaaa

SEQ ID NO: 3819984 - RNA, 14 nt, Human
auucacuauuggcu

SEQ ID NO: 3819985 - RNA, 17 nt, Human
auucacucaagcacuga

SEQ ID NO: 3819986 - RNA, 21 nt, Human
auucacucugaguguuuuaug

SEQ ID NO: 3819987 - RNA, 17 nt, Human
auucacugauuugacau

SEQ ID NO: 3819988 - RNA, 20 nt, Human
auucacuucacugugcuguu

SEQ ID NO: 3819989 - RNA, 23 nt, Human
auucacuucacugugcuguuguu

SEQ ID NO: 3819990 - RNA, 15 nt, Human
auucacuuucauuuu

SEQ ID NO: 3819991 - RNA, 12 nt, Human
auucagaaaaaa

SEQ ID NO: 3819992 - RNA, 13 nt, Human
auucagaaauguu

SEQ ID NO: 3819993 - RNA, 13 nt, Human
auucagaaauugg

SEQ ID NO: 3819994 - RNA, 19 nt, Human
auucagaacaccaagacuu

SEQ ID NO: 3819995 - RNA, 14 nt, Human
auucagaagaaaaa

SEQ ID NO: 3819996 - RNA, 17 nt, Human
auucagaagaaaaagaa

SEQ ID NO: 3819997 - RNA, 18 nt, Human
auucagaaggaucuucau

SEQ ID NO: 3819998 - RNA, 15 nt, Human
auucagaauauucau

SEQ ID NO: 3819999 - RNA, 13 nt, Human
auucagacaaaau

SEQ ID NO: 3820000 - RNA, 14 nt, Human
auucagacaaaaug

SEQ ID NO: 3820001 - RNA, 13 nt, Human
auucagacagaug

SEQ ID NO: 3820002 - RNA, 11 nt, Human
auucagacagc

SEQ ID NO: 3820003 - RNA, 15 nt, Human
auucagacagcugcc

SEQ ID NO: 3820004 - RNA, 16 nt, Human
auucagacagcugccu

SEQ ID NO: 3820005 - RNA, 18 nt, Human
auucagacagcugccugg

SEQ ID NO: 3820006 - RNA, 14 nt, Human
auucagacaggcaa

SEQ ID NO: 3820007 - RNA, 15 nt, Human
auucagacaucugag

SEQ ID NO: 3820008 - RNA, 18 nt, Human
auucagagaaaggcaagg

SEQ ID NO: 3820009 - RNA, 14 nt, Human
auucagagagcagc

SEQ ID NO: 3820010 - RNA, 17 nt, Human
auucagaguugaugguu

SEQ ID NO: 3820011 - RNA, 18 nt, Human
auucagauaugauucaaa

SEQ ID NO: 3820012 - RNA, 19 nt, Human
auaauguuuauuaaaugcu

SEQ ID NO: 3820013 - RNA, 18 nt, Human
auaauguuucaaacauau

SEQ ID NO: 3820014 - RNA, 14 nt, Human
auaauguuugcuau

SEQ ID NO: 3820015 - RNA, 13 nt, Human
auaauuaaagugu

SEQ ID NO: 3820016 - RNA, 19 nt, Human
auaauuaacacuuaagguu

SEQ ID NO: 3820017 - RNA, 22 nt, Human
auaauuagauccauuaauuuaa

SEQ ID NO: 3820018 - RNA, 16 nt, Human
auaauuauaauauacu

SEQ ID NO: 3820019 - RNA, 15 nt, Human
auaauuauauaacug

SEQ ID NO: 3820020 - RNA, 17 nt, Human
auaauuauauaacugua

SEQ ID NO: 3820021 - RNA, 17 nt, Human
auaauuauaugcuauuu

SEQ ID NO: 3820022 - RNA, 21 nt, Human
auaauuauaugcuauuucuau

SEQ ID NO: 3820023 - RNA, 15 nt, Human
auucuguacugauuu

SEQ ID NO: 3820024 - RNA, 17 nt, Human
auucuguagauucugug

SEQ ID NO: 3820025 - RNA, 20 nt, Human
auucuguaucuuucauccuu

SEQ ID NO: 3820026 - RNA, 17 nt, Human
auucugucauagaaagu

SEQ ID NO: 3820027 - RNA, 18 nt, Human
auucugucauagaaagug

SEQ ID NO: 3820028 - RNA, 18 nt, Human
auucugucgccuuagcau

SEQ ID NO: 3820029 - RNA, 21 nt, Human
auucuguguguuuucauaaua

SEQ ID NO: 3820030 - RNA, 20 nt, Human
auucuguuaaaaucuauucu

SEQ ID NO: 3820031 - RNA, 19 nt, Human
auucuguuggccaguguga

SEQ ID NO: 3820032 - RNA, 19 nt, Human
auucuguuuuuaaugcuau

SEQ ID NO: 3820033 - RNA, 23 nt, Human
auucuuaaaaggcccauagcagc

SEQ ID NO: 3820034 - RNA, 20 nt, Human
auucuuaaaauauauuucag

SEQ ID NO: 3820035 - RNA, 13 nt, Human
auucuuaaaguug

SEQ ID NO: 3820036 - RNA, 15 nt, Human
auucuuaaaguugaa

SEQ ID NO: 3820037 - RNA, 15 nt, Human
auucuuaaccaugga

SEQ ID NO: 3820038 - RNA, 22 nt, Human
auucuuaagggaacuuccacau

SEQ ID NO: 3820039 - RNA, 19 nt, Human
auucuuacacugccuguau

SEQ ID NO: 3820040 - RNA, 17 nt, Human
auucuuacauguuuucu

SEQ ID NO: 3820041 - RNA, 22 nt, Human
auucuuacuaaaaaguauaaaa

SEQ ID NO: 3820042 - RNA, 17 nt, Human
auucuuagccuguggca

SEQ ID NO: 3820043 - RNA, 14 nt, Human
auucuuauaaauau

SEQ ID NO: 3820044 - RNA, 10 nt, Human
auucuucaaa

SEQ ID NO: 3820045 - RNA, 20 nt, Human
auucuucaguugguuguguc

SEQ ID NO: 3820046 - RNA, 14 nt, Human
auucuuccaucuga

SEQ ID NO: 3820047 - RNA, 15 nt, Human
auucuuccaucugau

SEQ ID NO: 3820048 - RNA, 22 nt, Human
auucuucccauucuccauuugu

SEQ ID NO: 3820049 - RNA, 21 nt, Human
auucuucccuaucuuugccac

SEQ ID NO: 3820050 - RNA, 12 nt, Human
auucuuccuagu

SEQ ID NO: 3820051 - RNA, 17 nt, Human
auucuuccuaguuuucu

SEQ ID NO: 3820052 - RNA, 15 nt, Human
auucuucucuguugu

SEQ ID NO: 3820053 - RNA, 12 nt, Human
auucuucugauc

SEQ ID NO: 3820054 - RNA, 15 nt, Human
auucuucugaucacu

SEQ ID NO: 3820055 - RNA, 14 nt, Human
auucuucugcuuca

SEQ ID NO: 3820056 - RNA, 22 nt, Human
auucuucuguacgucugacagg

SEQ ID NO: 3820057 - RNA, 22 nt, Human
auucuucuuccaacguggccca

SEQ ID NO: 3820058 - RNA, 16 nt, Human
auucuugaaagcugug

SEQ ID NO: 3820059 - RNA, 21 nt, Human
auucuugaucaguaguuugca

SEQ ID NO: 3820060 - RNA, 22 nt, Human
auucuugaucaguaguuugcau

SEQ ID NO: 3820061 - RNA, 10 nt, Human
auucuugaug

SEQ ID NO: 3820062 - RNA, 21 nt, Human
auucuugaugaaaagcuuugu

SEQ ID NO: 3820063 - RNA, 12 nt, Human
auucuugaugua

SEQ ID NO: 3820064 - RNA, 17 nt, Human
auucuugauguaaaauc

SEQ ID NO: 3820065 - RNA, 14 nt, Human
auucuugcaaagua

SEQ ID NO: 3820066 - RNA, 17 nt, Human
auucuugccaaauauaa

SEQ ID NO: 3820067 - RNA, 17 nt, Human
auucuugguugaggaaa

SEQ ID NO: 3820068 - RNA, 20 nt, Human
auucuugguuggcuggccuu

SEQ ID NO: 3820069 - RNA, 18 nt, Human
auucuuguaaggcuuuga

SEQ ID NO: 3820070 - RNA, 12 nt, Human
auucuuguauau

SEQ ID NO: 3820071 - RNA, 18 nt, Human
auucuugucacaauaaau

SEQ ID NO: 3820072 - RNA, 13 nt, Human
auucuugugaaua

SEQ ID NO: 3820073 - RNA, 19 nt, Human
auucuugugaauauguaca

SEQ ID NO: 3820074 - RNA, 21 nt, Human
auucuuguugcuguacaaaag

SEQ ID NO: 3820075 - RNA, 22 nt, Human
auucuuguugcuguacaaaagc

SEQ ID NO: 3820076 - RNA, 23 nt, Human
auucuuguuuucuuucuuuaaau

SEQ ID NO: 3820077 - RNA, 15 nt, Human
auucuuguuuugcuu

SEQ ID NO: 3820078 - RNA, 17 nt, Human
auucuuuaaauuucauc

SEQ ID NO: 3820079 - RNA, 15 nt, Human
auucuuuagagaaga

SEQ ID NO: 3820080 - RNA, 19 nt, Human
auucuuucaauaacgaagu

SEQ ID NO: 3820081 - RNA, 19 nt, Human
auucuuucaauacagauau

SEQ ID NO: 3820082 - RNA, 17 nt, Human
auucuuucaguucuuug

SEQ ID NO: 3820083 - RNA, 17 nt, Human
auucuuuccauuaugau

SEQ ID NO: 3820084 - RNA, 21 nt, Human
auucuuuccauuaugauucuu

SEQ ID NO: 3820085 - RNA, 22 nt, Human
auucuuuccauuaugauucuuu

SEQ ID NO: 3820086 - RNA, 13 nt, Human
auucuuucccaac

SEQ ID NO: 3820087 - RNA, 19 nt, Human
auucuuucccaacaccucu

SEQ ID NO: 3820088 - RNA, 21 nt, Human
auucuuucccaauucacaucu

SEQ ID NO: 3820089 - RNA, 19 nt, Human
auucuuucccagucugucg

SEQ ID NO: 3820090 - RNA, 20 nt, Human
auucuuucccagucugucga

SEQ ID NO: 3820091 - RNA, 15 nt, Human
auucuuucccaguga

SEQ ID NO: 3820092 - RNA, 13 nt, Human
auucuuuccugag

SEQ ID NO: 3820093 - RNA, 15 nt, Human
auucuuucugauaac

SEQ ID NO: 3820094 - RNA, 15 nt, Human
auucuuucuguauug

SEQ ID NO: 3820095 - RNA, 13 nt, Human
auucuuugauguu

SEQ ID NO: 3820096 - RNA, 14 nt, Human
auucuuugauguua

SEQ ID NO: 3820097 - RNA, 16 nt, Human
auucuuugauguuaac

SEQ ID NO: 3820098 - RNA, 23 nt, Human
auucuuugcuugaacacaguauu

SEQ ID NO: 3820099 - RNA, 22 nt, Human
auucuuuuaaaagacaagacuu

SEQ ID NO: 3820100 - RNA, 18 nt, Human
auucuuuucugaaguugu

SEQ ID NO: 3820101 - RNA, 13 nt, Human
auucuuuuguaau

SEQ ID NO: 3820102 - RNA, 16 nt, Human
auucuuuuguaauuua

SEQ ID NO: 3820103 - RNA, 16 nt, Human
auucuuuuucuuuuuu

SEQ ID NO: 3820104 - RNA, 22 nt, Human
auucuuuuuuauuaaucacugu

SEQ ID NO: 3820105 - RNA, 18 nt, Human
auucuuuuuuucucuaga

SEQ ID NO: 3820106 - RNA, 13 nt, Human
auugaaaaaaaua

SEQ ID NO: 3820107 - RNA, 14 nt, Human
auugaaaaaaauug

SEQ ID NO: 3820108 - RNA, 20 nt, Human
auugaaaagaaguagugucu

SEQ ID NO: 3820109 - RNA, 15 nt, Human
auugaaaaggaagau

SEQ ID NO: 3820110 - RNA, 20 nt, Human
auugaaaaguuuuuguuugg

SEQ ID NO: 3820111 - RNA, 15 nt, Human
auugaaaaucuugug

SEQ ID NO: 3820112 - RNA, 20 nt, Human
auugaaaauguaaguaaaug

SEQ ID NO: 3820113 - RNA, 12 nt, Human
auugaaacacuu

SEQ ID NO: 3820114 - RNA, 13 nt, Human
auugaaagaaugu

SEQ ID NO: 3820115 - RNA, 17 nt, Human
auugaaaucuaggaaaa

SEQ ID NO: 3820116 - RNA, 16 nt, Human
auugaaauuguacaua

SEQ ID NO: 3820117 - RNA, 16 nt, Human
auugaaauuuauacac

SEQ ID NO: 3820118 - RNA, 15 nt, Human
auugaacucuuugaa

SEQ ID NO: 3820119 - RNA, 19 nt, Human
auugaacuuacuguagccu

SEQ ID NO: 3820120 - RNA, 14 nt, Human
auugaacuuuugua

SEQ ID NO: 3820121 - RNA, 19 nt, Human
auugaacuuuuguacugaa

SEQ ID NO: 3820122 - RNA, 20 nt, Human
auugaacuuuuguacugaau

SEQ ID NO: 3820123 - RNA, 23 nt, Human
auugaacuuuuguacugaauuuu

SEQ ID NO: 3820124 - RNA, 17 nt, Human
auugaagaaacagauac

SEQ ID NO: 3820125 - RNA, 22 nt, Human
auugaagacaauuugauacaua

SEQ ID NO: 3820126 - RNA, 13 nt, Human
auugaagcagagu

SEQ ID NO: 3820127 - RNA, 15 nt, Human
auugaagcagagugg

SEQ ID NO: 3820128 - RNA, 17 nt, Human
auugaaggaagccaaau

SEQ ID NO: 3820129 - RNA, 21 nt, Human
auugaaggaagccaaauuuau

SEQ ID NO: 3820130 - RNA, 17 nt, Human
auugaaggaugcugucu

SEQ ID NO: 3820131 - RNA, 12 nt, Human
auugaaggccug

SEQ ID NO: 3820132 - RNA, 20 nt, Human
auugaaggugauaagggaaa

SEQ ID NO: 3820133 - RNA, 17 nt, Human
auugaagguuuuugaua

SEQ ID NO: 3820134 - RNA, 18 nt, Human
auugaagguuuuugauag

SEQ ID NO: 3820135 - RNA, 20 nt, Human
auugaagguuuuugauagca

SEQ ID NO: 3820136 - RNA, 15 nt, Human
auugaaguaaaaugu

SEQ ID NO: 3820137 - RNA, 20 nt, Human
auugaagucaauuacucuau

SEQ ID NO: 3820138 - RNA, 16 nt, Human
auugaagucagaugug

SEQ ID NO: 3820139 - RNA, 22 nt, Human
auugaaguguauaauauaaaaa

SEQ ID NO: 3820140 - RNA, 20 nt, Human
auugaaguuucaaguuuuaa

SEQ ID NO: 3820141 - RNA, 15 nt, Human
auugaauacuuacau

SEQ ID NO: 3820142 - RNA, 14 nt, Human
auugaauacuuuga

SEQ ID NO: 3820143 - RNA, 20 nt, Human
auugaaucaguauaaacaaa

SEQ ID NO: 3820144 - RNA, 13 nt, Human
auugaaucaugua

SEQ ID NO: 3820145 - RNA, 10 nt, Human
auugaaucua

SEQ ID NO: 3820146 - RNA, 14 nt, Human
auugaaucuauuua

SEQ ID NO: 3820147 - RNA, 17 nt, Human
auugaauucauuucacu

SEQ ID NO: 3820148 - RNA, 20 nt, Human
auugaauucuugguugagga

SEQ ID NO: 3820149 - RNA, 22 nt, Human
auugaauucuugguugaggaaa

SEQ ID NO: 3820150 - RNA, 15 nt, Human
auugaauuuaacaau

SEQ ID NO: 3820151 - RNA, 17 nt, Human
auugaauuuuuccuaug

SEQ ID NO: 3820152 - RNA, 13 nt, Human
auugacaaaaugu

SEQ ID NO: 3820153 - RNA, 14 nt, Human
auugacaaaauguu

SEQ ID NO: 3820154 - RNA, 15 nt, Human
auugacaaaauguua

SEQ ID NO: 3820155 - RNA, 19 nt, Human
auugacaaaauguuauuuc

SEQ ID NO: 3820156 - RNA, 15 nt, Human
auugacaaaucugug

SEQ ID NO: 3820157 - RNA, 13 nt, Human
auuuaaaugauuu

SEQ ID NO: 3820158 - RNA, 19 nt, Human
auuuaaauguaaagacaaa

SEQ ID NO: 3820159 - RNA, 24 nt, Human
auuuaaauguguacaauguacaca

SEQ ID NO: 3820160 - RNA, 14 nt, Human
auuuaaauucuuuu

SEQ ID NO: 3820161 - RNA, 17 nt, Human
auuuaaauuuaaagaua

SEQ ID NO: 3820162 - RNA, 18 nt, Human
auuuaaauuuaaagauau

SEQ ID NO: 3820163 - RNA, 17 nt, Human
auuuaaauuuuuuuccu

SEQ ID NO: 3820164 - RNA, 13 nt, Human
auuuaacaagauc

SEQ ID NO: 3820165 - RNA, 21 nt, Human
auuuaacaaugcgaaugguag

SEQ ID NO: 3820166 - RNA, 12 nt, Human
auuuaacagaaa

SEQ ID NO: 3820167 - RNA, 19 nt, Human
auuuaacagaaauguacag

SEQ ID NO: 3820168 - RNA, 14 nt, Human
auuuaacagaaauu

SEQ ID NO: 3820169 - RNA, 17 nt, Human
auuuaacagggagggga

SEQ ID NO: 3820170 - RNA, 22 nt, Human
auuuaacagggucucuagugcu

SEQ ID NO: 3820171 - RNA, 16 nt, Human
auuuaacagucauuua

SEQ ID NO: 3820172 - RNA, 17 nt, Human
auuuaacagucauuuaa

SEQ ID NO: 3820173 - RNA, 18 nt, Human
auuuaacagucauuuaaa

SEQ ID NO: 3820174 - RNA, 18 nt, Human
auuuaaccccccuguaca

SEQ ID NO: 3820175 - RNA, 21 nt, Human
auuuaaccccccuguacacaa

SEQ ID NO: 3820176 - RNA, 23 nt, Human
auuuaacuacccuuaauuacuua

SEQ ID NO: 3820177 - RNA, 13 nt, Human
auuuaacucucuu

SEQ ID NO: 3820178 - RNA, 13 nt, Human
auuuaacugccuu

SEQ ID NO: 3820179 - RNA, 21 nt, Human
auuuaacuuaacauucuguaa

SEQ ID NO: 3820180 - RNA, 13 nt, Human
auuuaacuugagc

SEQ ID NO: 3820181 - RNA, 18 nt, Human
auuuaacuugaggguaau

SEQ ID NO: 3820182 - RNA, 20 nt, Human
auuuaacuugaggguaauaa

SEQ ID NO: 3820183 - RNA, 17 nt, Human
auuuaagaaaauacaau

SEQ ID NO: 3820184 - RNA, 22 nt, Human
auuuaagaauugccagucuuuu

SEQ ID NO: 3820185 - RNA, 15 nt, Human
auuuaagacacugaa

SEQ ID NO: 3820186 - RNA, 15 nt, Human
auuuaagauaguuuu

SEQ ID NO: 3820187 - RNA, 14 nt, Human
auuuaagaugugaa

SEQ ID NO: 3820188 - RNA, 13 nt, Human
auuuaagcaaaua

SEQ ID NO: 3820189 - RNA, 16 nt, Human
auuuaagcaaauacuu

SEQ ID NO: 3820190 - RNA, 15 nt, Human
auuuaagcacaaacu

SEQ ID NO: 3820191 - RNA, 15 nt, Human
auuuaagccucaaau

SEQ ID NO: 3820192 - RNA, 19 nt, Human
auuuaaggagauguaagag

SEQ ID NO: 3820193 - RNA, 12 nt, Human
auuuaagguauu

SEQ ID NO: 3820194 - RNA, 16 nt, Human
auuuaaguaacuuuaa

SEQ ID NO: 3820195 - RNA, 18 nt, Human
auuuaaguauucaagaaa

SEQ ID NO: 3820196 - RNA, 14 nt, Human
auuuaagugcgugu

SEQ ID NO: 3820197 - RNA, 19 nt, Human
auuuaagugcguguguaga

SEQ ID NO: 3820198 - RNA, 20 nt, Human
auuuaagugcguguguagag

SEQ ID NO: 3820199 - RNA, 20 nt, Human
auuuaaguuucaaacuuacu

SEQ ID NO: 3820200 - RNA, 21 nt, Human
auuuaauaaaauaauucuaaa

SEQ ID NO: 3820201 - RNA, 11 nt, Human
auuuaauaaag

SEQ ID NO: 3820202 - RNA, 14 nt, Human
auuuaauaacauua

SEQ ID NO: 3820203 - RNA, 15 nt, Human
auuuaauaacauuac

SEQ ID NO: 3820204 - RNA, 13 nt, Human
auuuaauaauaua

SEQ ID NO: 3820205 - RNA, 15 nt, Human
auuuaauaauauacu

SEQ ID NO: 3820206 - RNA, 15 nt, Human
auuuaauaaucugua

SEQ ID NO: 3820207 - RNA, 18 nt, Human
auuuaauaauuauaugcu

SEQ ID NO: 3820208 - RNA, 19 nt, Human
auuuaauaguguuaaucaa

SEQ ID NO: 3820209 - RNA, 20 nt, Human
auuuaauaguguuaaucaau

SEQ ID NO: 3820210 - RNA, 21 nt, Human
auuuaauaguguuaaucaauu

SEQ ID NO: 3820211 - RNA, 23 nt, Human
auuuaauaguguuaaucaauuua

SEQ ID NO: 3820212 - RNA, 16 nt, Human
auuuaauaugcaaagu

SEQ ID NO: 3820213 - RNA, 21 nt, Human
auuuaauauggauuuguuaca

SEQ ID NO: 3820214 - RNA, 17 nt, Human
auuuaauauuacagaua

SEQ ID NO: 3820215 - RNA, 14 nt, Human
auuuaauauuuacu

SEQ ID NO: 3820216 - RNA, 18 nt, Human
auuuaaucuuuuuuaugu

SEQ ID NO: 3820217 - RNA, 14 nt, Human
auuuaaugaaagac

SEQ ID NO: 3820218 - RNA, 15 nt, Human
auuuaaugaaagacu

SEQ ID NO: 3820219 - RNA, 13 nt, Human
auuuaaugcauua

SEQ ID NO: 3820220 - RNA, 18 nt, Human
auuuaaugcauuaaaccu

SEQ ID NO: 3820221 - RNA, 19 nt, Human
auuuaaugcauuaaaccug

SEQ ID NO: 3820222 - RNA, 22 nt, Human
auuuaauggaaguguauuuauu

SEQ ID NO: 3820223 - RNA, 14 nt, Human
auuuaauguagcca

SEQ ID NO: 3820224 - RNA, 16 nt, Human
auuuaaugugaguuug

SEQ ID NO: 3820225 - RNA, 14 nt, Human
auuuaauguugaac

SEQ ID NO: 3820226 - RNA, 15 nt, Human
auuuaauguugaaca

SEQ ID NO: 3820227 - RNA, 12 nt, Human
auuuaauguuuu

SEQ ID NO: 3820228 - RNA, 14 nt, Human
auuuaauguuuuca

SEQ ID NO: 3820229 - RNA, 18 nt, Human
auuuaauuagugcuaagu

SEQ ID NO: 3820230 - RNA, 13 nt, Human
auuuaauucucuu

SEQ ID NO: 3820231 - RNA, 14 nt, Human
auuuaauuguaaac

SEQ ID NO: 3820232 - RNA, 15 nt, Human
auuuaauuguaaacu

SEQ ID NO: 3820233 - RNA, 13 nt, Human
auuuaauuuccag

SEQ ID NO: 3820234 - RNA, 18 nt, Human
auuuaauuugauaucaca

SEQ ID NO: 3820235 - RNA, 16 nt, Human
auuuaauuuugacacu

SEQ ID NO: 3820236 - RNA, 19 nt, Human
auuuaauuuuuuugagaca

SEQ ID NO: 3820237 - RNA, 16 nt, Human
auuuacaaagugugua

SEQ ID NO: 3820238 - RNA, 19 nt, Human
auuuacaaaguguguauua

SEQ ID NO: 3820239 - RNA, 20 nt, Human
auuuacaaaguguguauuaa

SEQ ID NO: 3820240 - RNA, 16 nt, Human
auuuacaaaugggaaa

SEQ ID NO: 3820241 - RNA, 20 nt, Human
auuuacaacacuuuaauggg

SEQ ID NO: 3820242 - RNA, 19 nt, Human
auuuacaagacaacauugu

SEQ ID NO: 3820243 - RNA, 17 nt, Human
auuuacaauguauuaag

SEQ ID NO: 3820244 - RNA, 16 nt, Human
auuuacaggaacuuca

SEQ ID NO: 3820245 - RNA, 18 nt, Human
auuuacaguccuucaaaa

SEQ ID NO: 3820246 - RNA, 22 nt, Human
auuuacagugaaaauguaagcu

SEQ ID NO: 3820247 - RNA, 23 nt, Human
auuuacagugaaaauguaagcug

SEQ ID NO: 3820248 - RNA, 19 nt, Human
auuuacauguuuuaaagaa

SEQ ID NO: 3820249 - RNA, 15 nt, Human
auuuaccacagcagc

SEQ ID NO: 3820250 - RNA, 21 nt, Human
auuuaccacagcagcugaaca

SEQ ID NO: 3820251 - RNA, 15 nt, Human
auuuaccacuugugu

SEQ ID NO: 3820252 - RNA, 19 nt, Human
auuuaccagggauguagau

SEQ ID NO: 3820253 - RNA, 19 nt, Human
auuuacccaacucuguaca

SEQ ID NO: 3820254 - RNA, 19 nt, Human
auuuacccagaaugucaga

SEQ ID NO: 3820255 - RNA, 18 nt, Human
auuuaccuaagauuacaa

SEQ ID NO: 3820256 - RNA, 11 nt, Human
auuuaccucag

SEQ ID NO: 3820257 - RNA, 14 nt, Human
auuuaccucagccu

SEQ ID NO: 3820258 - RNA, 16 nt, Human
auuuaccucagccugg

SEQ ID NO: 3820259 - RNA, 13 nt, Human
auuuaccugcagg

SEQ ID NO: 3820260 - RNA, 17 nt, Human
auuuacgcuuugauuca

SEQ ID NO: 3820261 - RNA, 17 nt, Human
auuuacggaacucaaau

SEQ ID NO: 3820262 - RNA, 15 nt, Human
auuuacuaaaaugga

SEQ ID NO: 3820263 - RNA, 19 nt, Human
auuuacuaaaauggacugu

SEQ ID NO: 3820264 - RNA, 16 nt, Human
auuuacuaaacauaug

SEQ ID NO: 3820265 - RNA, 21 nt, Human
auuuacuaagccacaagaaau

SEQ ID NO: 3820266 - RNA, 14 nt, Human
auuuacuacaguuu

SEQ ID NO: 3820267 - RNA, 14 nt, Human
auuuacuauauaua

SEQ ID NO: 3820268 - RNA, 13 nt, Human
auuuacugagcuu

SEQ ID NO: 3820269 - RNA, 17 nt, Human
auuuacugcauucuucu

SEQ ID NO: 3820270 - RNA, 21 nt, Human
auuuacugcuagucuuaagaa

SEQ ID NO: 3820271 - RNA, 20 nt, Human
auuuacuggacauaacauuu

SEQ ID NO: 3820272 - RNA, 20 nt, Human
auuuacuucuuauacauuug

SEQ ID NO: 3820273 - RNA, 16 nt, Human
auuuacuuguuuugga

SEQ ID NO: 3820274 - RNA, 23 nt, Human
auuuacuuguuuuggauggcuug

SEQ ID NO: 3820275 - RNA, 15 nt, Human
auuuacuuuaaacua

SEQ ID NO: 3820276 - RNA, 22 nt, Human
auuuagaaaaagaacaugcagu

SEQ ID NO: 3820277 - RNA, 23 nt, Human
auuuagaaaaagaacaugcaguu

SEQ ID NO: 3820278 - RNA, 13 nt, Human
auuuagaaaacuu

SEQ ID NO: 3820279 - RNA, 14 nt, Human
auuuagaaaacuuu

SEQ ID NO: 3820280 - RNA, 22 nt, Human
auuuagaaaauagagcuuuuaa

SEQ ID NO: 3820281 - RNA, 13 nt, Human
auuuagaagccaa

SEQ ID NO: 3820282 - RNA, 21 nt, Human
auuuagaagccaacuaugauu

SEQ ID NO: 3820283 - RNA, 22 nt, Human
auuuagaagccaacuaugauua

SEQ ID NO: 3820284 - RNA, 17 nt, Human
auuuagaauggugauuu

SEQ ID NO: 3820285 - RNA, 16 nt, Human
auuuagacaagagaug

SEQ ID NO: 3820286 - RNA, 19 nt, Human
auuuagaccccauacaagu

SEQ ID NO: 3820287 - RNA, 13 nt, Human
auuuagauaugca

SEQ ID NO: 3820288 - RNA, 17 nt, Human
auuuagaugauaaagag

SEQ ID NO: 3820289 - RNA, 15 nt, Human
auuuagauuguaaac

SEQ ID NO: 3820290 - RNA, 18 nt, Human
auuuagauuguuaaaaua

SEQ ID NO: 3820291 - RNA, 14 nt, Human
auuuagauuugugu

SEQ ID NO: 3820292 - RNA, 16 nt, Human
auuuagccuguccugu

SEQ ID NO: 3820293 - RNA, 22 nt, Human
auuuagccuguccugucaucau

SEQ ID NO: 3820294 - RNA, 21 nt, Human
auuuagcuaaacggauuccaa

SEQ ID NO: 3820295 - RNA, 19 nt, Human
auuuagcuguaucaaacua

SEQ ID NO: 3820296 - RNA, 16 nt, Human
auuuaggaaguugacu

SEQ ID NO: 3820297 - RNA, 14 nt, Human
auuuaggagaagcc

SEQ ID NO: 3820298 - RNA, 17 nt, Human
auuuaggagaagccagg

SEQ ID NO: 3820299 - RNA, 21 nt, Human
auuuaggagugugugacauuc

SEQ ID NO: 3820300 - RNA, 21 nt, Human
auuuagggaaagguaguguau

SEQ ID NO: 3820301 - RNA, 18 nt, Human
auuuagggaacugcuuga

SEQ ID NO: 3820302 - RNA, 11 nt, Human
auuuggagacu

SEQ ID NO: 3820303 - RNA, 14 nt, Human
auuuggagagaaau

SEQ ID NO: 3820304 - RNA, 18 nt, Human
auuuggagagaaauauuu

SEQ ID NO: 3820305 - RNA, 20 nt, Human
auuuggagcacaaaauucaa

SEQ ID NO: 3820306 - RNA, 21 nt, Human
auuuggaguguuccccuucca

SEQ ID NO: 3820307 - RNA, 17 nt, Human
auuuggauaucuguuag

SEQ ID NO: 3820308 - RNA, 19 nt, Human
auuuggauuauucuuucuc

SEQ ID NO: 3820309 - RNA, 18 nt, Human
auuuggauuuaaaagccu

SEQ ID NO: 3820310 - RNA, 19 nt, Human
auuuggcaaugccaucauc

SEQ ID NO: 3820311 - RNA, 14 nt, Human
auuuggcaucccug

SEQ ID NO: 3820312 - RNA, 20 nt, Human
auuuggcaucccugggccuu

SEQ ID NO: 3820313 - RNA, 17 nt, Human
auuuggcuucuguuguc

SEQ ID NO: 3820314 - RNA, 17 nt, Human
auuugggagggaaaagg

SEQ ID NO: 3820315 - RNA, 22 nt, Human
auuugggccugcuccagaccug

SEQ ID NO: 3820316 - RNA, 20 nt, Human
auuugggcugaauguaugua

SEQ ID NO: 3820317 - RNA, 21 nt, Human
auuugggcugaauguauguaa

SEQ ID NO: 3820318 - RNA, 21 nt, Human
auuugggcuuggaccagaucu

SEQ ID NO: 3820319 - RNA, 19 nt, Human
auuuggggacagauucagu

SEQ ID NO: 3820320 - RNA, 22 nt, Human
auuuggggauucagauuucucu

SEQ ID NO: 3820321 - RNA, 14 nt, Human
auuuggguccagga

SEQ ID NO: 3820322 - RNA, 21 nt, Human
auuugguaaauuaguauuuau

SEQ ID NO: 3820323 - RNA, 12 nt, Human
auuugguacuuu

SEQ ID NO: 3820324 - RNA, 23 nt, Human
auuugguacuuuugagugugugu

SEQ ID NO: 3820325 - RNA, 15 nt, Human
auuugguauccuuau

SEQ ID NO: 3820326 - RNA, 14 nt, Human
auuuggucucuauu

SEQ ID NO: 3820327 - RNA, 18 nt, Human
auuuggugguuucagaaa

SEQ ID NO: 3820328 - RNA, 22 nt, Human
auuugguuuggccaucucugga

SEQ ID NO: 3820329 - RNA, 22 nt, Human
auuugguuuucacauuggaaac

SEQ ID NO: 3820330 - RNA, 16 nt, Human
auuugguuuuccugua

SEQ ID NO: 3820331 - RNA, 22 nt, Human
auuuguaaaguugguuggauaa

SEQ ID NO: 3820332 - RNA, 16 nt, Human
auuuguaaaucugcca

SEQ ID NO: 3820333 - RNA, 17 nt, Human
auuuguaaaucugccac

SEQ ID NO: 3820334 - RNA, 18 nt, Human
auuuguaaauuuauguga

SEQ ID NO: 3820335 - RNA, 17 nt, Human
auuuguaaccucagcuc

SEQ ID NO: 3820336 - RNA, 19 nt, Human
auuuguaaccucagcucug

SEQ ID NO: 3820337 - RNA, 16 nt, Human
auuuguaaggcuuguu

SEQ ID NO: 3820338 - RNA, 15 nt, Human
auuuguaaguuucag

SEQ ID NO: 3820339 - RNA, 21 nt, Human
auuuguaaguuucaggugaca

SEQ ID NO: 3820340 - RNA, 14 nt, Human
auuuguaauaaagu

SEQ ID NO: 3820341 - RNA, 19 nt, Human
auuuguaaugucuugagcu

SEQ ID NO: 3820342 - RNA, 20 nt, Human
auuuguaaugucuugagcuc

SEQ ID NO: 3820343 - RNA, 23 nt, Human
auuuguaauuaaaagcaaaucau

SEQ ID NO: 3820344 - RNA, 21 nt, Human
auuuguacagauucuuuauua

SEQ ID NO: 3820345 - RNA, 21 nt, Human
auuuguacauaguuauuuauu

SEQ ID NO: 3820346 - RNA, 19 nt, Human
auuuguacauauguaaaau

SEQ ID NO: 3820347 - RNA, 22 nt, Human
auuuguacuauuuaacugacua

SEQ ID NO: 3820348 - RNA, 18 nt, Human
auuuguacuuucuguuaa

SEQ ID NO: 3820349 - RNA, 19 nt, Human
auuuguacuuucuguuaaa

SEQ ID NO: 3820350 - RNA, 23 nt, Human
auuuguaggaaggucucauucuu

SEQ ID NO: 3820351 - RNA, 14 nt, Human
auuuguaggagaaa

SEQ ID NO: 3820352 - RNA, 19 nt, Human
auuuguaguggaaacauuu

SEQ ID NO: 3820353 - RNA, 18 nt, Human
auuuguauaaaauaauuu

SEQ ID NO: 3820354 - RNA, 16 nt, Human
auuuguauaguugcuu

SEQ ID NO: 3820355 - RNA, 18 nt, Human
auuuguauaguugcuugc

SEQ ID NO: 3820356 - RNA, 21 nt, Human
auuuguauaguugcuugccug

SEQ ID NO: 3820357 - RNA, 16 nt, Human
auuuguauauauacau

SEQ ID NO: 3820358 - RNA, 20 nt, Human
auuuguaucucugaagcaug

SEQ ID NO: 3820359 - RNA, 14 nt, Human
auuuguaucugaag

SEQ ID NO: 3820360 - RNA, 17 nt, Human
auuuguaucugaaggag

SEQ ID NO: 3820361 - RNA, 16 nt, Human
auuuguauguugugaa

SEQ ID NO: 3820362 - RNA, 20 nt, Human
auuuguauuaauuuguaaga

SEQ ID NO: 3820363 - RNA, 17 nt, Human
auuuguauuuauucuuu

SEQ ID NO: 3820364 - RNA, 17 nt, Human
auuuguauuuuguguga

SEQ ID NO: 3820365 - RNA, 15 nt, Human
auuugucaacaaagu

SEQ ID NO: 3820366 - RNA, 14 nt, Human
auuugucaaugaca

SEQ ID NO: 3820367 - RNA, 16 nt, Human
auuugucacugcuuca

SEQ ID NO: 3820368 - RNA, 22 nt, Human
auuugucaguguagaucaacuc

SEQ ID NO: 3820369 - RNA, 15 nt, Human
auuugucauuuugaa

SEQ ID NO: 3820370 - RNA, 16 nt, Human
auuugucauuuugaag

SEQ ID NO: 3820371 - RNA, 21 nt, Human
auuugucauuuugaagcuaau

SEQ ID NO: 3820372 - RNA, 15 nt, Human
auuugucuuucagga

SEQ ID NO: 3820373 - RNA, 23 nt, Human
auuugucuuuuuguuguaaaaca

SEQ ID NO: 3820374 - RNA, 21 nt, Human
auuugugaacucagccaagca

SEQ ID NO: 3820375 - RNA, 21 nt, Human
auuugugaagguggaaauaaa

SEQ ID NO: 3820376 - RNA, 16 nt, Human
auuugugacuaauugu

SEQ ID NO: 3820377 - RNA, 18 nt, Human
auuugugacuaauuguau

SEQ ID NO: 3820378 - RNA, 20 nt, Human
auuugugauacaaugcugug

SEQ ID NO: 3820379 - RNA, 22 nt, Human
auuuguggggagggauuugggg

SEQ ID NO: 3820380 - RNA, 17 nt, Human
auuuguguaauaaagug

SEQ ID NO: 3820381 - RNA, 21 nt, Human
auuuguguaauagaaaacuga

SEQ ID NO: 3820382 - RNA, 21 nt, Human
auuugugucacaaagaauuua

SEQ ID NO: 3820383 - RNA, 16 nt, Human
auuguugagcuauugc

SEQ ID NO: 3820384 - RNA, 21 nt, Human
auuguugaugggcacuugaga

SEQ ID NO: 3820385 - RNA, 20 nt, Human
auuguugcauagguuagaua

SEQ ID NO: 3820386 - RNA, 14 nt, Human
auuguugcucccug

SEQ ID NO: 3820387 - RNA, 18 nt, Human
auuguuggcacauccuau

SEQ ID NO: 3820388 - RNA, 22 nt, Human
auuguuguccgguuuacuuuaa

SEQ ID NO: 3820389 - RNA, 15 nt, Human
auuguuguccuuuuc

SEQ ID NO: 3820390 - RNA, 17 nt, Human
auuguuguccuuuucau

SEQ ID NO: 3820391 - RNA, 18 nt, Human
auuguuguccuuuucaua

SEQ ID NO: 3820392 - RNA, 19 nt, Human
auuguuguucuguuaacug

SEQ ID NO: 3820393 - RNA, 17 nt, Human
auuguuguuuuuuuaau

SEQ ID NO: 3820394 - RNA, 14 nt, Human
auuguuuaaaaugu

SEQ ID NO: 3820395 - RNA, 21 nt, Human
auuguuuaaguguuguaaaua

SEQ ID NO: 3820396 - RNA, 13 nt, Human
auuguuuagauuu

SEQ ID NO: 3820397 - RNA, 16 nt, Human
auuguuuagauuuugu

SEQ ID NO: 3820398 - RNA, 16 nt, Human
auuguuuaguggaaaa

SEQ ID NO: 3820399 - RNA, 21 nt, Human
auuguuuaucuagauguaaau

SEQ ID NO: 3820400 - RNA, 15 nt, Human
auuguuucuauacaa

SEQ ID NO: 3820401 - RNA, 17 nt, Human
auuguuucucaaaucuu

SEQ ID NO: 3820402 - RNA, 21 nt, Human
auuguuucuuuaucaccuggc

SEQ ID NO: 3820403 - RNA, 21 nt, Human
auuguuucuuucaauaucccc

SEQ ID NO: 3820404 - RNA, 12 nt, Human
auuguuugaacc

SEQ ID NO: 3820405 - RNA, 13 nt, Human
auuguuugcuuau

SEQ ID NO: 3820406 - RNA, 21 nt, Human
auuguuuggggaugagaaagg

SEQ ID NO: 3820407 - RNA, 18 nt, Human
auuguuugguaaauguuu

SEQ ID NO: 3820408 - RNA, 20 nt, Human
auuguuugucugucuucaua

SEQ ID NO: 3820409 - RNA, 22 nt, Human
auuguuuuaaaaagaaacaaga

SEQ ID NO: 3820410 - RNA, 23 nt, Human
auuguuuuaaaaagaaacaagau

SEQ ID NO: 3820411 - RNA, 17 nt, Human
auuguuuuaaucugaaa

SEQ ID NO: 3820412 - RNA, 15 nt, Human
auuguuuuagagacu

SEQ ID NO: 3820413 - RNA, 19 nt, Human
auuguuuuaucugaauuuu

SEQ ID NO: 3820414 - RNA, 14 nt, Human
auuguuuugaauau

SEQ ID NO: 3820415 - RNA, 20 nt, Human
auuguuuuucugauauguuu

SEQ ID NO: 3820416 - RNA, 23 nt, Human
auuguuuuuuaucuuuucuacag

SEQ ID NO: 3820417 - RNA, 21 nt, Human
auuuaaaaaaaucacaaaaau

SEQ ID NO: 3820418 - RNA, 15 nt, Human
auuuaaaaaauaacu

SEQ ID NO: 3820419 - RNA, 22 nt, Human
auuuaaaaacaggcagcucaua

SEQ ID NO: 3820420 - RNA, 15 nt, Human
auuuaaaaacuggaa

SEQ ID NO: 3820421 - RNA, 16 nt, Human
auuuaaaaagcccaac

SEQ ID NO: 3820422 - RNA, 19 nt, Human
auuuaaaaagcccaaccuc

SEQ ID NO: 3820423 - RNA, 16 nt, Human
auuuaaaaauaagaaa

SEQ ID NO: 3820424 - RNA, 22 nt, Human
auuuaaaaauaagucaacagua

SEQ ID NO: 3820425 - RNA, 23 nt, Human
auuuaaaaauaagucaacaguaa

SEQ ID NO: 3820426 - RNA, 15 nt, Human
auuuaaaaauagaaa

SEQ ID NO: 3820427 - RNA, 15 nt, Human
auuuaaaaaugucuu

SEQ ID NO: 3820428 - RNA, 18 nt, Human
auuuaaaaaugucuugcu

SEQ ID NO: 3820429 - RNA, 17 nt, Human
auuuaaaacagacacug

SEQ ID NO: 3820430 - RNA, 20 nt, Human
auuuaaaacauuaaaauaua

SEQ ID NO: 3820431 - RNA, 13 nt, Human
auuuaaaacuguu

SEQ ID NO: 3820432 - RNA, 11 nt, Human
auuuaaaacuu

SEQ ID NO: 3820433 - RNA, 15 nt, Human
auuuaaaagacacug

SEQ ID NO: 3820434 - RNA, 13 nt, Human
auuuaaaagauuc

SEQ ID NO: 3820435 - RNA, 23 nt, Human
auuuaaaaggauggcaaguugca

SEQ ID NO: 3820436 - RNA, 16 nt, Human
auuuaaaauaauuaua

SEQ ID NO: 3820437 - RNA, 21 nt, Human
auuuaaaauagcaaaagaaga

SEQ ID NO: 3820438 - RNA, 23 nt, Human
auuuaaaauagcaaaagaagaag

SEQ ID NO: 3820439 - RNA, 13 nt, Human
auuuaaaaugauu

SEQ ID NO: 3820440 - RNA, 12 nt, Human
auuuaaaaugua

SEQ ID NO: 3820441 - RNA, 15 nt, Human
auuuaaaauugugau

SEQ ID NO: 3820442 - RNA, 19 nt, Human
auuuaaaauugugaugugu

SEQ ID NO: 3820443 - RNA, 17 nt, Human
auuuaaacacauuaaag

SEQ ID NO: 3820444 - RNA, 14 nt, Human
auuuaaacagcagu

SEQ ID NO: 3820445 - RNA, 22 nt, Human
auuuagagaugaauuaaauuua

SEQ ID NO: 3820446 - RNA, 16 nt, Human
auuuagagaugcugua

SEQ ID NO: 3820447 - RNA, 17 nt, Human
auuuagauugaaaacuu

SEQ ID NO: 3820448 - RNA, 15 nt, Human
auuuagcauguuguu

SEQ ID NO: 3820449 - RNA, 13 nt, Human
auuuagcauugua

SEQ ID NO: 3820450 - RNA, 19 nt, Human
auuuagcauuguagugcuu

SEQ ID NO: 3820451 - RNA, 20 nt, Human
auuuagcauuguagugcuuu

SEQ ID NO: 3820452 - RNA, 22 nt, Human
auuuagcauuguagugcuuuga

SEQ ID NO: 3820453 - RNA, 14 nt, Human
auuuagccuguccu

SEQ ID NO: 3820454 - RNA, 22 nt, Human
auuuagcuaaacggauuccaaa

SEQ ID NO: 3820455 - RNA, 23 nt, Human
auuuagcuaaacggauuccaaag

SEQ ID NO: 3820456 - RNA, 16 nt, Human
auuuagggaacugcuu

SEQ ID NO: 3820457 - RNA, 15 nt, Human
auuuagggcaaggag

SEQ ID NO: 3820458 - RNA, 20 nt, Human
auuuaggguacuaaauuuaa

SEQ ID NO: 3820459 - RNA, 18 nt, Human
auuuagguuuuuauuagu

SEQ ID NO: 3820460 - RNA, 14 nt, Human
auuuaguaaauguu

SEQ ID NO: 3820461 - RNA, 16 nt, Human
auuuaguauuaucaaa

SEQ ID NO: 3820462 - RNA, 21 nt, Human
auuuaguauugaauacuuaca

SEQ ID NO: 3820463 - RNA, 14 nt, Human
auuuagucauguga

SEQ ID NO: 3820464 - RNA, 21 nt, Human
auuuagucucuuuauuccuag

SEQ ID NO: 3820465 - RNA, 21 nt, Human
auuuagugaucaaauugugca

SEQ ID NO: 3820466 - RNA, 22 nt, Human
auuuaguguuuuuuuauuucua

SEQ ID NO: 3820467 - RNA, 18 nt, Human
auuuaguuguuguagaga

SEQ ID NO: 3820468 - RNA, 23 nt, Human
auuuaguuucaguagauugcaga

SEQ ID NO: 3820469 - RNA, 22 nt, Human
auuuaguuugauuauucagugu

SEQ ID NO: 3820470 - RNA, 20 nt, Human
auuuaguuuuuguaauuuau

SEQ ID NO: 3820471 - RNA, 16 nt, Human
auuuaguuuuuguucu

SEQ ID NO: 3820472 - RNA, 16 nt, Human
auuuauaaaaaggugu

SEQ ID NO: 3820473 - RNA, 14 nt, Human
auuuauaaaacuuc

SEQ ID NO: 3820474 - RNA, 21 nt, Human
auuuauaaaacuucucaagau

SEQ ID NO: 3820475 - RNA, 15 nt, Human
auuuauaaaauuaga

SEQ ID NO: 3820476 - RNA, 21 nt, Human
auuuauaaaauuagaaagcaa

SEQ ID NO: 3820477 - RNA, 17 nt, Human
auuuauaaaugcuauuu

SEQ ID NO: 3820478 - RNA, 14 nt, Human
auuuauaacucauc

SEQ ID NO: 3820479 - RNA, 18 nt, Human
auuuauaacucaucauaa

SEQ ID NO: 3820480 - RNA, 22 nt, Human
auuuauaacucaucauaaaaua

SEQ ID NO: 3820481 - RNA, 23 nt, Human
auuuauaacucaucauaaaauaa

SEQ ID NO: 3820482 - RNA, 19 nt, Human
auuuauaagaaaaauguga

SEQ ID NO: 3820483 - RNA, 14 nt, Human
auuuauaagcagau

SEQ ID NO: 3820484 - RNA, 22 nt, Human
auuuauaagcagauuuaacaau

SEQ ID NO: 3820485 - RNA, 16 nt, Human
auuuauaaggaaauuu

SEQ ID NO: 3820486 - RNA, 16 nt, Human
auuuauaagguuuuaa

SEQ ID NO: 3820487 - RNA, 15 nt, Human
auuuauaaucacuuu

SEQ ID NO: 3820488 - RNA, 16 nt, Human
auuuauaauguuagua

SEQ ID NO: 3820489 - RNA, 17 nt, Human
auuuauaauucaguaug

SEQ ID NO: 3820490 - RNA, 19 nt, Human
auuuauaauucaguauguu

SEQ ID NO: 3820491 - RNA, 14 nt, Human
auuuauaauuccua

SEQ ID NO: 3820492 - RNA, 19 nt, Human
auuuauaauuuuaagauuc

SEQ ID NO: 3820493 - RNA, 18 nt, Human
auuuauacaaauuagaaa

SEQ ID NO: 3820494 - RNA, 13 nt, Human
auuuauacaagau

SEQ ID NO: 3820495 - RNA, 13 nt, Human
auuuauaccucaa

SEQ ID NO: 3820496 - RNA, 18 nt, Human
auuuauaccucaaacuau

SEQ ID NO: 3820497 - RNA, 18 nt, Human
auuuauaguuuauacagu

SEQ ID NO: 3820498 - RNA, 16 nt, Human
auuuauaguuuguaca

SEQ ID NO: 3820499 - RNA, 12 nt, Human
auuuauauaaau

SEQ ID NO: 3820500 - RNA, 18 nt, Human
auuuauauaaauguaaaa

SEQ ID NO: 3820501 - RNA, 14 nt, Human
auuuauauaauuau

SEQ ID NO: 3820502 - RNA, 19 nt, Human
auuuauauacaaccugcuu

SEQ ID NO: 3820503 - RNA, 14 nt, Human
auuuauauaugaaa

SEQ ID NO: 3820504 - RNA, 17 nt, Human
auuuauauaugaaaacu

SEQ ID NO: 3820505 - RNA, 20 nt, Human
auuuauauaugaaaacuaua

SEQ ID NO: 3820506 - RNA, 17 nt, Human
auuuauauauuuauaac

SEQ ID NO: 3820507 - RNA, 18 nt, Human
auuuauauauuuauaacu

SEQ ID NO: 3820508 - RNA, 11 nt, Human
auuuauaugaa

SEQ ID NO: 3820509 - RNA, 20 nt, Human
auuuauauggggaauauauu

SEQ ID NO: 3820510 - RNA, 15 nt, Human
auuuauauguacaug

SEQ ID NO: 3820511 - RNA, 22 nt, Human
auuuauauguauccaguacauu

SEQ ID NO: 3820512 - RNA, 14 nt, Human
auuuauauguaugu

SEQ ID NO: 3820513 - RNA, 17 nt, Human
auuuauauguauguguu

SEQ ID NO: 3820514 - RNA, 18 nt, Human
auuuauauguauguguuu

SEQ ID NO: 3820515 - RNA, 21 nt, Human
auuuauauugauaagaucuuu

SEQ ID NO: 3820516 - RNA, 15 nt, Human
auuuauauuuauuga

SEQ ID NO: 3820517 - RNA, 19 nt, Human
auuuauauuuuuaaaauau

SEQ ID NO: 3820518 - RNA, 14 nt, Human
auuuaucaaagcau

SEQ ID NO: 3820519 - RNA, 17 nt, Human
auuuaucaaaucaguca

SEQ ID NO: 3820520 - RNA, 19 nt, Human
auuuaucacacaaagcaga

SEQ ID NO: 3820521 - RNA, 15 nt, Human
auuuaucagauugcu

SEQ ID NO: 3820522 - RNA, 17 nt, Human
auuuaucagugacagag

SEQ ID NO: 3820523 - RNA, 17 nt, Human
auuuauccaaaaugugu

SEQ ID NO: 3820524 - RNA, 18 nt, Human
auuuauccaaaaugugua

SEQ ID NO: 3820525 - RNA, 19 nt, Human
auuuauccaaaauguguau

SEQ ID NO: 3820526 - RNA, 21 nt, Human
auuuauccacaggaaaguguu

SEQ ID NO: 3820527 - RNA, 20 nt, Human
auuuauccagaaaacuguga

SEQ ID NO: 3820528 - RNA, 16 nt, Human
auuuauccauuuguaa

SEQ ID NO: 3820529 - RNA, 16 nt, Human
auuuauccucuguuga

SEQ ID NO: 3820530 - RNA, 18 nt, Human
auuuauccugaaauuuca

SEQ ID NO: 3820531 - RNA, 19 nt, Human
auuuauccugaaauuucag

SEQ ID NO: 3820532 - RNA, 17 nt, Human
auuuaucgcagaccuuu

SEQ ID NO: 3820533 - RNA, 19 nt, Human
auuuaucgcugggaaauga

SEQ ID NO: 3820534 - RNA, 21 nt, Human
auuuaucgcugggaaaugaga

SEQ ID NO: 3820535 - RNA, 15 nt, Human
auuuaucuaaauaug

SEQ ID NO: 3820536 - RNA, 18 nt, Human
auuuaucuauuguaagau

SEQ ID NO: 3820537 - RNA, 14 nt, Human
auuuaucucuauuu

SEQ ID NO: 3820538 - RNA, 16 nt, Human
auuuaucucuauuuaa

SEQ ID NO: 3820539 - RNA, 19 nt, Human
auuuaucucuauuuaauau

SEQ ID NO: 3820540 - RNA, 22 nt, Human
auuuaucucuauuuaauauuua

SEQ ID NO: 3820541 - RNA, 16 nt, Human
auuuaucugugcaaau

SEQ ID NO: 3820542 - RNA, 12 nt, Human
auuuaucuugaa

SEQ ID NO: 3820543 - RNA, 23 nt, Human
auuuaucuugaaggaaaaauuca

SEQ ID NO: 3820544 - RNA, 16 nt, Human
auuuaucuuugauaac

SEQ ID NO: 3820545 - RNA, 21 nt, Human
auuuaugaaaguauuaaaaug

SEQ ID NO: 3820546 - RNA, 21 nt, Human
auuuuacuuuaaaaggagcca

SEQ ID NO: 3820547 - RNA, 17 nt, Human
auuuuacuuuuuccugg

SEQ ID NO: 3820548 - RNA, 13 nt, Human
auuuuagaaauau

SEQ ID NO: 3820549 - RNA, 19 nt, Human
auuuuagaagacucuacca

SEQ ID NO: 3820550 - RNA, 21 nt, Human
auuuuagcaguucugcaaaua

SEQ ID NO: 3820551 - RNA, 18 nt, Human
auuuuagccuucucuguu

SEQ ID NO: 3820552 - RNA, 21 nt, Human
auuuuagccuucucuguucau

SEQ ID NO: 3820553 - RNA, 19 nt, Human
auuuuagcuaggauuugaa

SEQ ID NO: 3820554 - RNA, 16 nt, Human
auuuuaggaaaugaau

SEQ ID NO: 3820555 - RNA, 18 nt, Human
auuuuaggaacuucagag

SEQ ID NO: 3820556 - RNA, 15 nt, Human
auuuuaggcaaguuu

SEQ ID NO: 3820557 - RNA, 17 nt, Human
auuuuaggcagggauuu

SEQ ID NO: 3820558 - RNA, 21 nt, Human
auuuuaggcagggauuugagg

SEQ ID NO: 3820559 - RNA, 22 nt, Human
auuuuaguauauuuauauaauu

SEQ ID NO: 3820560 - RNA, 15 nt, Human
auuuuagucacuuuu

SEQ ID NO: 3820561 - RNA, 20 nt, Human
auuuuaguggacccugaaau

SEQ ID NO: 3820562 - RNA, 21 nt, Human
auuuuaguggacccugaaaug

SEQ ID NO: 3820563 - RNA, 22 nt, Human
auuuuaguggacccugaaaugu

SEQ ID NO: 3820564 - RNA, 23 nt, Human
auuuuaguggacccugaaaugug

SEQ ID NO: 3820565 - RNA, 14 nt, Human
auuuuaguuucugu

SEQ ID NO: 3820566 - RNA, 22 nt, Human
auuuuaguuuugugcuuaguua

SEQ ID NO: 3820567 - RNA, 13 nt, Human
auuuuauaaaauu

SEQ ID NO: 3820568 - RNA, 17 nt, Human
auuuuauaaaucgcuuu

SEQ ID NO: 3820569 - RNA, 23 nt, Human
auuuuauaaaucgcuuuugauaa

SEQ ID NO: 3820570 - RNA, 14 nt, Human
auuuuauaauucug

SEQ ID NO: 3820571 - RNA, 19 nt, Human
auuuuauagcucaguuuau

SEQ ID NO: 3820572 - RNA, 22 nt, Human
auuuuauagcucaguuuaucca

SEQ ID NO: 3820573 - RNA, 19 nt, Human
auuuuauaggaaaaaauaa

SEQ ID NO: 3820574 - RNA, 15 nt, Human
auuuuauauaaagua

SEQ ID NO: 3820575 - RNA, 19 nt, Human
auuuuauauaauaaaguau

SEQ ID NO: 3820576 - RNA, 22 nt, Human
auuuuauauaauaaaguauucc

SEQ ID NO: 3820577 - RNA, 16 nt, Human
auuuuauaucuuguag

SEQ ID NO: 3820578 - RNA, 20 nt, Human
auuuuauauuagaaguguua

SEQ ID NO: 3820579 - RNA, 22 nt, Human
auuuuauauugaaaaaaauaau

SEQ ID NO: 3820580 - RNA, 20 nt, Human
auuuuaucccucaccuguag

SEQ ID NO: 3820581 - RNA, 15 nt, Human
auuuuaucucuuauu

SEQ ID NO: 3820582 - RNA, 22 nt, Human
auuuuaucuuugauucuccuuc

SEQ ID NO: 3820583 - RNA, 20 nt, Human
auuuuaugagaaauguaaug

SEQ ID NO: 3820584 - RNA, 18 nt, Human
auuuuaugaucaguguug

SEQ ID NO: 3820585 - RNA, 16 nt, Human
auuuuaugcaaauauu

SEQ ID NO: 3820586 - RNA, 20 nt, Human
auuuuaugccuuuuauuucu

SEQ ID NO: 3820587 - RNA, 14 nt, Human
auuuuaugguuaug

SEQ ID NO: 3820588 - RNA, 20 nt, Human
auauaauuuuuuagagagcu

SEQ ID NO: 3820589 - RNA, 23 nt, Human
auauaauuuuuuuauguuuuguu

SEQ ID NO: 3820590 - RNA, 21 nt, Human
auauacaaccugcuugggugg

SEQ ID NO: 3820591 - RNA, 18 nt, Human
auauacaauaacauaauu

SEQ ID NO: 3820592 - RNA, 13 nt, Human
auauacaauaaug

SEQ ID NO: 3820593 - RNA, 16 nt, Human
auauacaauaauggaa

SEQ ID NO: 3820594 - RNA, 17 nt, Human
auauacaauaauggaaa

SEQ ID NO: 3820595 - RNA, 21 nt, Human
auauacacacacaaagagagu

SEQ ID NO: 3820596 - RNA, 15 nt, Human
auauacacacacaca

SEQ ID NO: 3820597 - RNA, 21 nt, Human
auauacacgaauagacaucaa

SEQ ID NO: 3820598 - RNA, 13 nt, Human
auauacagaugaa

SEQ ID NO: 3820599 - RNA, 16 nt, Human
auauacagaugaaaau

SEQ ID NO: 3820600 - RNA, 22 nt, Human
auauacaguaacuuuaugugua

SEQ ID NO: 3820601 - RNA, 17 nt, Human
auauacaguauagauuu

SEQ ID NO: 3820602 - RNA, 12 nt, Human
auauacauacac

SEQ ID NO: 3820603 - RNA, 14 nt, Human
auauacauauguag

SEQ ID NO: 3820604 - RNA, 22 nt, Human
auauacauguguguauauaugu

SEQ ID NO: 3820605 - RNA, 23 nt, Human
auauacauguguguauauaugug

SEQ ID NO: 3820606 - RNA, 18 nt, Human
auauacauucaaacuuaa

SEQ ID NO: 3820607 - RNA, 12 nt, Human
auauaccaaagc

SEQ ID NO: 3820608 - RNA, 19 nt, Human
auauaccaaauuaaaaaaa

SEQ ID NO: 3820609 - RNA, 14 nt, Human
auauaccauuuauc

SEQ ID NO: 3820610 - RNA, 14 nt, Human
auauaccuauaaug

SEQ ID NO: 3820611 - RNA, 22 nt, Human
auauacuauuaaaaagguuuac

SEQ ID NO: 3820612 - RNA, 15 nt, Human
auauacucauuagaa

SEQ ID NO: 3820613 - RNA, 18 nt, Human
auauacuguaaagaaaga

SEQ ID NO: 3820614 - RNA, 22 nt, Human
auauacuguaaagaaagagaga

SEQ ID NO: 3820615 - RNA, 13 nt, Human
auauacugugugc

SEQ ID NO: 3820616 - RNA, 19 nt, Human
auauacuuguuguuuaaug

SEQ ID NO: 3820617 - RNA, 18 nt, Human
auauacuuguuuuuguaa

SEQ ID NO: 3820618 - RNA, 20 nt, Human
auauacuuguuuuuguaaag

SEQ ID NO: 3820619 - RNA, 21 nt, Human
auauacuuguuuuuguaaaga

SEQ ID NO: 3820620 - RNA, 21 nt, Human
auauacuuuguggaccaauua

SEQ ID NO: 3820621 - RNA, 20 nt, Human
auauacuuuuuuuucuuuaa

SEQ ID NO: 3820622 - RNA, 14 nt, Human
auauagaaauauau

SEQ ID NO: 3820623 - RNA, 15 nt, Human
auauagaaugcugca

SEQ ID NO: 3820624 - RNA, 20 nt, Human
auauagacaguccuuaaaaa

SEQ ID NO: 3820625 - RNA, 14 nt, Human
auauagaucacaua

SEQ ID NO: 3820626 - RNA, 15 nt, Human
auauagauuagaaaa

SEQ ID NO: 3820627 - RNA, 21 nt, Human
auauagcaaaacuuuuaaacu

SEQ ID NO: 3820628 - RNA, 17 nt, Human
auauagcagcaaaaaua

SEQ ID NO: 3820629 - RNA, 21 nt, Human
auauagcguucccaacaacau

SEQ ID NO: 3820630 - RNA, 16 nt, Human
auauagcuggcaagaa

SEQ ID NO: 3820631 - RNA, 15 nt, Human
auauaggaauuaaga

SEQ ID NO: 3820632 - RNA, 14 nt, Human
auauaggacauuga

SEQ ID NO: 3820633 - RNA, 13 nt, Human
auauaggcuauuu

SEQ ID NO: 3820634 - RNA, 18 nt, Human
auauaggugauguuugcu

SEQ ID NO: 3820635 - RNA, 17 nt, Human
auauaguaccuuugcuc

SEQ ID NO: 3820636 - RNA, 22 nt, Human
auauaguuagcuaauaaaaagc

SEQ ID NO: 3820637 - RNA, 13 nt, Human
auauaguuuuacu

SEQ ID NO: 3820638 - RNA, 15 nt, Human
auauauaaaaauaua

SEQ ID NO: 3820639 - RNA, 17 nt, Human
auauauaaaacggugcu

SEQ ID NO: 3820640 - RNA, 13 nt, Human
auauauaaaauaa

SEQ ID NO: 3820641 - RNA, 16 nt, Human
auauauaaaauaaaua

SEQ ID NO: 3820642 - RNA, 16 nt, Human
auauauaaagaauaua

SEQ ID NO: 3820643 - RNA, 13 nt, Human
auauauaaaguau

SEQ ID NO: 3820644 - RNA, 10 nt, Human
auauauaaau

SEQ ID NO: 3820645 - RNA, 12 nt, Human
auauauaaaugu

SEQ ID NO: 3820646 - RNA, 13 nt, Human
auauauaaaugua

SEQ ID NO: 3820647 - RNA, 18 nt, Human
auauauaacaaugcugua

SEQ ID NO: 3820648 - RNA, 17 nt, Human
auauauaacagauacau

SEQ ID NO: 3820649 - RNA, 18 nt, Human
auauauaacagauacauu

SEQ ID NO: 3820650 - RNA, 22 nt, Human
auauauaagaaagacaucuuuc

SEQ ID NO: 3820651 - RNA, 22 nt, Human
auauauaagauggaagcuucca

SEQ ID NO: 3820652 - RNA, 17 nt, Human
auauauaauguugccag

SEQ ID NO: 3820653 - RNA, 15 nt, Human
auauauaauucugua

SEQ ID NO: 3820654 - RNA, 14 nt, Human
auauauacacacac

SEQ ID NO: 3820655 - RNA, 21 nt, Human
auauauacacacacaaagaga

SEQ ID NO: 3820656 - RNA, 18 nt, Human
auauauacaguaacuuua

SEQ ID NO: 3820657 - RNA, 20 nt, Human
auauauacaguaacuuuaug

SEQ ID NO: 3820658 - RNA, 11 nt, Human
auauauacaua

SEQ ID NO: 3820659 - RNA, 16 nt, Human
auauauacauacacuu

SEQ ID NO: 3820660 - RNA, 22 nt, Human
auauauacauagcaugacauuu

SEQ ID NO: 3820661 - RNA, 12 nt, Human
auauauacuugu

SEQ ID NO: 3820662 - RNA, 13 nt, Human
auauauagaaucu

SEQ ID NO: 3820663 - RNA, 16 nt, Human
auauauagcauuuaug

SEQ ID NO: 3820664 - RNA, 12 nt, Human
auauauauaaac

SEQ ID NO: 3820665 - RNA, 13 nt, Human
auauauauaaacc

SEQ ID NO: 3820666 - RNA, 12 nt, Human
auauauauaaau

SEQ ID NO: 3820667 - RNA, 16 nt, Human
auauauauaaauguau

SEQ ID NO: 3820668 - RNA, 11 nt, Human
auauauauaau

SEQ ID NO: 3820669 - RNA, 14 nt, Human
auauauauacauau

SEQ ID NO: 3820670 - RNA, 16 nt, Human
auauauauacauaugu

SEQ ID NO: 3820671 - RNA, 11 nt, Human
auauauauaua

SEQ ID NO: 3820672 - RNA, 13 nt, Human
auauauauauaaa

SEQ ID NO: 3820673 - RNA, 15 nt, Human
auauauauauauaca

SEQ ID NO: 3820674 - RNA, 16 nt, Human
auauauauaucaguuu

SEQ ID NO: 3820675 - RNA, 16 nt, Human
auauauauaucuguau

SEQ ID NO: 3820676 - RNA, 15 nt, Human
auauauauauguaca

SEQ ID NO: 3820677 - RNA, 15 nt, Human
auauauaucaguuug

SEQ ID NO: 3820678 - RNA, 21 nt, Human
auauauaucuauauauauaau

SEQ ID NO: 3820679 - RNA, 21 nt, Human
auauauaucuaucuauuugag

SEQ ID NO: 3820680 - RNA, 16 nt, Human
auauauaugccaugau

SEQ ID NO: 3820681 - RNA, 15 nt, Human
auauauauguacagu

SEQ ID NO: 3820682 - RNA, 12 nt, Human
auauauauuaua

SEQ ID NO: 3820683 - RNA, 17 nt, Human
auauauauuauaaauau

SEQ ID NO: 3820684 - RNA, 20 nt, Human
auauauauuaucuuuucaua

SEQ ID NO: 3820685 - RNA, 21 nt, Human
auauauauuuuuuucugaaau

SEQ ID NO: 3820686 - RNA, 21 nt, Human
auauaucacccagacauaaag

SEQ ID NO: 3820687 - RNA, 18 nt, Human
auauauccacacauuugu

SEQ ID NO: 3820688 - RNA, 20 nt, Human
auauaucccugauaaauauu

SEQ ID NO: 3820689 - RNA, 22 nt, Human
auauaucccugauaaauauuca

SEQ ID NO: 3820690 - RNA, 21 nt, Human
auauauccuuuucuucuaugu

SEQ ID NO: 3820691 - RNA, 21 nt, Human
auauaucguucauuguaaaaa

SEQ ID NO: 3820692 - RNA, 19 nt, Human
auauaucuaaauugaauaa

SEQ ID NO: 3820693 - RNA, 20 nt, Human
auauaucuaucuauuugagg

SEQ ID NO: 3820694 - RNA, 16 nt, Human
auauaucucaaauugu

SEQ ID NO: 3820695 - RNA, 17 nt, Human
auauaucucuauuugag

SEQ ID NO: 3820696 - RNA, 19 nt, Human
auauaucugcuguccagac

SEQ ID NO: 3820697 - RNA, 19 nt, Human
auauaugaaaacuaaguuc

SEQ ID NO: 3820698 - RNA, 17 nt, Human
auauaugaaaacuauac

SEQ ID NO: 3820699 - RNA, 20 nt, Human
auauaugaaaacuauacaac

SEQ ID NO: 3820700 - RNA, 12 nt, Human
auauaugaauaa

SEQ ID NO: 3820701 - RNA, 15 nt, Human
auuuaugaagaaaau

SEQ ID NO: 3820702 - RNA, 19 nt, Human
auuuaugaagaaaauacuu

SEQ ID NO: 3820703 - RNA, 13 nt, Human
auuuaugaaguuu

SEQ ID NO: 3820704 - RNA, 14 nt, Human
auuuaugaauauaa

SEQ ID NO: 3820705 - RNA, 17 nt, Human
auuuaugagcucuucau

SEQ ID NO: 3820706 - RNA, 15 nt, Human
auuuaugauuuaaua

SEQ ID NO: 3820707 - RNA, 17 nt, Human
auuuaugcacauucacg

SEQ ID NO: 3820708 - RNA, 20 nt, Human
auuuaugccucuguauuuaa

SEQ ID NO: 3820709 - RNA, 21 nt, Human
auuuaugccuugaugauuuaa

SEQ ID NO: 3820710 - RNA, 12 nt, Human
auuuauggagga

SEQ ID NO: 3820711 - RNA, 13 nt, Human
auuuaugggcccc

SEQ ID NO: 3820712 - RNA, 18 nt, Human
auuuaugggccccuggca

SEQ ID NO: 3820713 - RNA, 15 nt, Human
auuuaugguuguuaa

SEQ ID NO: 3820714 - RNA, 23 nt, Human
auuuaugguuguuaaaaauguca

SEQ ID NO: 3820715 - RNA, 12 nt, Human
auuuauguaaac

SEQ ID NO: 3820716 - RNA, 18 nt, Human
auuuauguaaugaaguaa

SEQ ID NO: 3820717 - RNA, 19 nt, Human
auuuauguaaugaaguaaa

SEQ ID NO: 3820718 - RNA, 20 nt, Human
auuuauguagaugugcauuu

SEQ ID NO: 3820719 - RNA, 14 nt, Human
auuuauguauugug

SEQ ID NO: 3820720 - RNA, 18 nt, Human
auuuauguauugugcaau

SEQ ID NO: 3820721 - RNA, 16 nt, Human
auuuauguguauaugg

SEQ ID NO: 3820722 - RNA, 19 nt, Human
auuuaugugugaggagcug

SEQ ID NO: 3820723 - RNA, 22 nt, Human
auuuauguuugcacuugugauu

SEQ ID NO: 3820724 - RNA, 19 nt, Human
auuuauuaaaaugauugua

SEQ ID NO: 3820725 - RNA, 22 nt, Human
auuuauuaaacagauuuuuaca

SEQ ID NO: 3820726 - RNA, 15 nt, Human
auuuauuaaagaaaa

SEQ ID NO: 3820727 - RNA, 20 nt, Human
auuuauuaaagaaaaaaaug

SEQ ID NO: 3820728 - RNA, 22 nt, Human
auuuauuaaagaaaaaaaugua

SEQ ID NO: 3820729 - RNA, 13 nt, Human
auuuauuaaauaa

SEQ ID NO: 3820730 - RNA, 16 nt, Human
auuuauuaaauaaaau

SEQ ID NO: 3820731 - RNA, 22 nt, Human
auuuauuaaaugcccagccccu

SEQ ID NO: 3820732 - RNA, 14 nt, Human
auuuauuaaauuuu

SEQ ID NO: 3820733 - RNA, 24 nt, Human
auuuauuaaauuuuuuuguaugaa

SEQ ID NO: 3820734 - RNA, 14 nt, Human
auuuuaaaaaugaa

SEQ ID NO: 3820735 - RNA, 17 nt, Human
auuuuaaaaaugaaauu

SEQ ID NO: 3820736 - RNA, 22 nt, Human
auuuuaaaagaaugauuaugaa

SEQ ID NO: 3820737 - RNA, 19 nt, Human
auuuuaaaauaaauuaguu

SEQ ID NO: 3820738 - RNA, 18 nt, Human
auuuuaaaauagcguucu

SEQ ID NO: 3820739 - RNA, 22 nt, Human
auuuuaaaauagcguucuugua

SEQ ID NO: 3820740 - RNA, 13 nt, Human
auuuuaaaaucag

SEQ ID NO: 3820741 - RNA, 13 nt, Human
auuuuaaaauuug

SEQ ID NO: 3820742 - RNA, 14 nt, Human
auuuuaaaauuugu

SEQ ID NO: 3820743 - RNA, 17 nt, Human
auuuuaaaauuuuaucu

SEQ ID NO: 3820744 - RNA, 18 nt, Human
auuuuaaaauuuuaucuc

SEQ ID NO: 3820745 - RNA, 22 nt, Human
auuuuaaacaaagguugagaug

SEQ ID NO: 3820746 - RNA, 23 nt, Human
auuuuaaacacauuaggaaaagu

SEQ ID NO: 3820747 - RNA, 21 nt, Human
auuuuaaacauauccaaguuu

SEQ ID NO: 3820748 - RNA, 21 nt, Human
auuuuaaaccauaaaaagcug

SEQ ID NO: 3820749 - RNA, 17 nt, Human
auuuuaaacuagaugac

SEQ ID NO: 3820750 - RNA, 13 nt, Human
auuuuaaagaauu

SEQ ID NO: 3820751 - RNA, 14 nt, Human
auuuuaaagacaug

SEQ ID NO: 3820752 - RNA, 17 nt, Human
auuuuaaaguaugcauu

SEQ ID NO: 3820753 - RNA, 13 nt, Human
auuuuaaaguuag

SEQ ID NO: 3820754 - RNA, 21 nt, Human
auuuuaaaguuaguaucuuuu

SEQ ID NO: 3820755 - RNA, 20 nt, Human
auuuuaaauaaaagugauca

SEQ ID NO: 3820756 - RNA, 23 nt, Human
caaacccccuccuuacgcuuugu

SEQ ID NO: 3820757 - RNA, 15 nt, Human
caaacccuagccuug

SEQ ID NO: 3820758 - RNA, 18 nt, Human
caaacccuagccuugcuu

SEQ ID NO: 3820759 - RNA, 21 nt, Human
caaacccuagguucccggucc

SEQ ID NO: 3820760 - RNA, 13 nt, Human
caaacccugucaa

SEQ ID NO: 3820761 - RNA, 20 nt, Human
caaacccuucagugccaaaa

SEQ ID NO: 3820762 - RNA, 17 nt, Human
caaaccuaccaaaaugg

SEQ ID NO: 3820763 - RNA, 12 nt, Human
caaaccucuguu

SEQ ID NO: 3820764 - RNA, 13 nt, Human
caaaccucuguuc

SEQ ID NO: 3820765 - RNA, 19 nt, Human
caaaccucuguucagugua

SEQ ID NO: 3820766 - RNA, 19 nt, Human
caaaccugcaagggcuccc

SEQ ID NO: 3820767 - RNA, 21 nt, Human
caaaccugcaagggcucccca

SEQ ID NO: 3820768 - RNA, 13 nt, Human
caaaccugcccca

SEQ ID NO: 3820769 - RNA, 16 nt, Human
caaaccugccccaucc

SEQ ID NO: 3820770 - RNA, 12 nt, Human
caaaccuggaga

SEQ ID NO: 3820771 - RNA, 21 nt, Human
caaaccuguuuaaauauuuca

SEQ ID NO: 3820772 - RNA, 15 nt, Human
caaaccuuaucucca

SEQ ID NO: 3820773 - RNA, 12 nt, Human
caaaccuucaca

SEQ ID NO: 3820774 - RNA, 19 nt, Human
caaaccuuucuauaauuuu

SEQ ID NO: 3820775 - RNA, 17 nt, Human
caaacgccuagauugcu

SEQ ID NO: 3820776 - RNA, 17 nt, Human
caaacgccuccccugcc

SEQ ID NO: 3820777 - RNA, 15 nt, Human
caaacgcugccugcc

SEQ ID NO: 3820778 - RNA, 18 nt, Human
caaacgcugccugcccac

SEQ ID NO: 3820779 - RNA, 16 nt, Human
caaacuaaaggugcac

SEQ ID NO: 3820780 - RNA, 20 nt, Human
caaacuaaggugcuaaaucu

SEQ ID NO: 3820781 - RNA, 21 nt, Human
caaacuacugaaugaagcagu

SEQ ID NO: 3820782 - RNA, 20 nt, Human
caaacuacuuugcugcuaau

SEQ ID NO: 3820783 - RNA, 20 nt, Human
caaacuaggggacaaagcaa

SEQ ID NO: 3820784 - RNA, 18 nt, Human
caaacuauuucuuauaua

SEQ ID NO: 3820785 - RNA, 19 nt, Human
caaacuccugaccucaggc

SEQ ID NO: 3820786 - RNA, 18 nt, Human
caaacucuaucggagaac

SEQ ID NO: 3820787 - RNA, 16 nt, Human
caaacucugccagcca

SEQ ID NO: 3820788 - RNA, 15 nt, Human
caaacucuuaaaacc

SEQ ID NO: 3820789 - RNA, 20 nt, Human
caaacucuugaccucaggug

SEQ ID NO: 3820790 - RNA, 19 nt, Human
caaacucuuuggucguuuu

SEQ ID NO: 3820791 - RNA, 15 nt, Human
caaacugaagccaga

SEQ ID NO: 3820792 - RNA, 17 nt, Human
caaacugacucaacagu

SEQ ID NO: 3820793 - RNA, 17 nt, Human
caaacugaggaauuuca

SEQ ID NO: 3820794 - RNA, 22 nt, Human
caaacugaggaauuucaccugu

SEQ ID NO: 3820795 - RNA, 18 nt, Human
caaacugcacaugauuuc

SEQ ID NO: 3820796 - RNA, 21 nt, Human
caaacugcacaugauuucaca

SEQ ID NO: 3820797 - RNA, 22 nt, Human
caaacugcacaugauuucacaa

SEQ ID NO: 3820798 - RNA, 19 nt, Human
caaacugcaugcccagaga

SEQ ID NO: 3820799 - RNA, 20 nt, Human
caaacugcaugcccagagac

SEQ ID NO: 3820800 - RNA, 19 nt, Human
caaacugccuuggcuucag

SEQ ID NO: 3820801 - RNA, 20 nt, Human
caaacuggaaugagcagcuu

SEQ ID NO: 3820802 - RNA, 19 nt, Human
caaacuggcaaacuucaga

SEQ ID NO: 3820803 - RNA, 20 nt, Human
caaacuggccgcgggggcag

SEQ ID NO: 3820804 - RNA, 19 nt, Human
caaacuggggccuccagaa

SEQ ID NO: 3820805 - RNA, 17 nt, Human
caaacugguuauuuaaa

SEQ ID NO: 3820806 - RNA, 21 nt, Human
caaacuguaaaaaaugugugu

SEQ ID NO: 3820807 - RNA, 21 nt, Human
caaacuguaaauaaaaagaaa

SEQ ID NO: 3820808 - RNA, 20 nt, Human
caaacuguguaacugcccaa

SEQ ID NO: 3820809 - RNA, 20 nt, Human
caaacuguucaagaaauaau

SEQ ID NO: 3820810 - RNA, 13 nt, Human
caaacuuacuauu

SEQ ID NO: 3820811 - RNA, 17 nt, Human
caaacuucacucugggc

SEQ ID NO: 3820812 - RNA, 15 nt, Human
caaacuucagacuga

SEQ ID NO: 3820813 - RNA, 22 nt, Human
caaacuuggaauuuguaaccuc

SEQ ID NO: 3820814 - RNA, 22 nt, Human
caaacuuuauugacaagugauu

SEQ ID NO: 3820815 - RNA, 19 nt, Human
caaacuuuucaaggcuuau

SEQ ID NO: 3820816 - RNA, 16 nt, Human
caaagaaaaugaaaug

SEQ ID NO: 3820817 - RNA, 13 nt, Human
caaagaaacccaa

SEQ ID NO: 3820818 - RNA, 16 nt, Human
caaagaaaugaacauu

SEQ ID NO: 3820819 - RNA, 19 nt, Human
caaagaaaugaacauucca

SEQ ID NO: 3820820 - RNA, 18 nt, Human
caaagaaauuuccacuca

SEQ ID NO: 3820821 - RNA, 17 nt, Human
caaagaaccaaagaaga

SEQ ID NO: 3820822 - RNA, 11 nt, Human
caaagaagaaa

SEQ ID NO: 3820823 - RNA, 20 nt, Human
caaagaagacauguuuuaga

SEQ ID NO: 3820824 - RNA, 17 nt, Human
caaagaaggaauucuag

SEQ ID NO: 3820825 - RNA, 21 nt, Human
caaagaaggcauuugcagggu

SEQ ID NO: 3820826 - RNA, 15 nt, Human
caaagaauaagaaaa

SEQ ID NO: 3820827 - RNA, 19 nt, Human
caaagaaucccuagacuuu

SEQ ID NO: 3820828 - RNA, 20 nt, Human
caaagaaucccuagacuuua

SEQ ID NO: 3820829 - RNA, 23 nt, Human
caaagaaucccuagacuuuaggc

SEQ ID NO: 3820830 - RNA, 15 nt, Human
caaagaaugccuuga

SEQ ID NO: 3820831 - RNA, 15 nt, Human
caaagaauguuuaua

SEQ ID NO: 3820832 - RNA, 17 nt, Human
caaagaauuccaaagca

SEQ ID NO: 3820833 - RNA, 14 nt, Human
caaagacaaauagu

SEQ ID NO: 3820834 - RNA, 14 nt, Human
caaagacccuggcu

SEQ ID NO: 3820835 - RNA, 18 nt, Human
caaagaccuuguguguau

SEQ ID NO: 3820836 - RNA, 17 nt, Human
caaagacgaccuuuacc

SEQ ID NO: 3820837 - RNA, 22 nt, Human
caaagacuuaagcccagugcac

SEQ ID NO: 3820838 - RNA, 21 nt, Human
caaagagaaaaagaaaugcaa

SEQ ID NO: 3820839 - RNA, 16 nt, Human
caaagagaaugccauu

SEQ ID NO: 3820840 - RNA, 18 nt, Human
caaagagaaugcccuucu

SEQ ID NO: 3820841 - RNA, 14 nt, Human
caaagagaguuuuu

SEQ ID NO: 3820842 - RNA, 17 nt, Human
caaagagcacaaacauu

SEQ ID NO: 3820843 - RNA, 16 nt, Human
caaagagccuggagaa

SEQ ID NO: 3820844 - RNA, 18 nt, Human
caaagagccuggagaagc

SEQ ID NO: 3820845 - RNA, 22 nt, Human
caaagaggacucgcuuguaaau

SEQ ID NO: 3820846 - RNA, 14 nt, Human
caaagaggcaagag

SEQ ID NO: 3820847 - RNA, 15 nt, Human
caaagaggcaagagg

SEQ ID NO: 3820848 - RNA, 23 nt, Human
caaagaggcaguugcccagccuc

SEQ ID NO: 3820849 - RNA, 22 nt, Human
caaagaggcugaggcuggcaca

SEQ ID NO: 3820850 - RNA, 12 nt, Human
caaagaggcugc

SEQ ID NO: 3820851 - RNA, 16 nt, Human
caaagaggcugccccu

SEQ ID NO: 3820852 - RNA, 21 nt, Human
caaagaggcugccccucucac

SEQ ID NO: 3820853 - RNA, 23 nt, Human
caaagaggcugccccucucacca

SEQ ID NO: 3820854 - RNA, 18 nt, Human
caaagagggcuuccucua

SEQ ID NO: 3820855 - RNA, 13 nt, Human
caaagagguauuu

SEQ ID NO: 3820856 - RNA, 16 nt, Human
caaagagguauuuauc

SEQ ID NO: 3820857 - RNA, 18 nt, Human
caaagaggugacugggcc

SEQ ID NO: 3820858 - RNA, 22 nt, Human
caaagagugggcugcaucuggg

SEQ ID NO: 3820859 - RNA, 17 nt, Human
caaagaguguagaucag

SEQ ID NO: 3820860 - RNA, 15 nt, Human
caaagaguucaagaa

SEQ ID NO: 3820861 - RNA, 18 nt, Human
caaagaguuugaugaggc

SEQ ID NO: 3820862 - RNA, 16 nt, Human
caaagauaaucucuca

SEQ ID NO: 3820863 - RNA, 20 nt, Human
caaagauaaucucucagcuu

SEQ ID NO: 3820864 - RNA, 19 nt, Human
caaagauagacagguccug

SEQ ID NO: 3820865 - RNA, 22 nt, Human
caaagauagacagguccugauu

SEQ ID NO: 3820866 - RNA, 12 nt, Human
caaagauaucuu

SEQ ID NO: 3820867 - RNA, 14 nt, Human
caaagauaucuuuu

SEQ ID NO: 3820868 - RNA, 20 nt, Human
caaagauauuuugcuuugug

SEQ ID NO: 3820869 - RNA, 18 nt, Human
caaagaucaaaauaaaaa

SEQ ID NO: 3820870 - RNA, 12 nt, Human
caaagaucacuu

SEQ ID NO: 3820871 - RNA, 20 nt, Human
caaagaucuguccucagccu

SEQ ID NO: 3820872 - RNA, 18 nt, Human
caaagaugaaugaagcaa

SEQ ID NO: 3820873 - RNA, 19 nt, Human
caaagaugaccauaaccac

SEQ ID NO: 3820874 - RNA, 22 nt, Human
caaagaugggugaaggcuggca

SEQ ID NO: 3820875 - RNA, 16 nt, Human
caaagauguuugucag

SEQ ID NO: 3820876 - RNA, 22 nt, Human
caaagauguuugucagauauga

SEQ ID NO: 3820877 - RNA, 17 nt, Human
caaagauucaaaauuga

SEQ ID NO: 3820878 - RNA, 16 nt, Human
caaagugccaaagaaa

SEQ ID NO: 3820879 - RNA, 16 nt, Human
caaagugcugagauua

SEQ ID NO: 3820880 - RNA, 13 nt, Human
caaagugcuggga

SEQ ID NO: 3820881 - RNA, 19 nt, Human
caaagugcugggauuacaa

SEQ ID NO: 3820882 - RNA, 23 nt, Human
caaagugcugggauuacaggugu

SEQ ID NO: 3820883 - RNA, 16 nt, Human
caaaguggaaggaaag

SEQ ID NO: 3820884 - RNA, 18 nt, Human
caaagugguauagaaaug

SEQ ID NO: 3820885 - RNA, 22 nt, Human
caaaguguauuuuauaaaauua

SEQ ID NO: 3820886 - RNA, 13 nt, Human
caaaguguguauu

SEQ ID NO: 3820887 - RNA, 15 nt, Human
caaaguguuuucucu

SEQ ID NO: 3820888 - RNA, 17 nt, Human
caaaguguuuuguacca

SEQ ID NO: 3820889 - RNA, 19 nt, Human
caaaguguuuuguaccagu

SEQ ID NO: 3820890 - RNA, 23 nt, Human
caaaguguuuuguaccagugaau

SEQ ID NO: 3820891 - RNA, 15 nt, Human
caaaguuaacagauu

SEQ ID NO: 3820892 - RNA, 16 nt, Human
caaaguuacuagguaa

SEQ ID NO: 3820893 - RNA, 14 nt, Human
caaaguucaacuug

SEQ ID NO: 3820894 - RNA, 21 nt, Human
caaaguucuaauaauuucuaa

SEQ ID NO: 3820895 - RNA, 23 nt, Human
caaaguucuaauaauuucuaaug

SEQ ID NO: 3820896 - RNA, 17 nt, Human
caaaguucucuguggca

SEQ ID NO: 3820897 - RNA, 14 nt, Human
caaaguugccuaaa

SEQ ID NO: 3820898 - RNA, 19 nt, Human
caaaguugccuaaauccau

SEQ ID NO: 3820899 - RNA, 15 nt, Human
caaaguuguuguaac

SEQ ID NO: 3820900 - RNA, 12 nt, Human
caaaguuucaau

SEQ ID NO: 3820901 - RNA, 17 nt, Human
caaaguuucagaguaua

SEQ ID NO: 3820902 - RNA, 18 nt, Human
caaaguuucagaguauau

SEQ ID NO: 3820903 - RNA, 22 nt, Human
caaaguuuccuaaucagaaauu

SEQ ID NO: 3820904 - RNA, 16 nt, Human
caaaguuugacaggaa

SEQ ID NO: 3820905 - RNA, 19 nt, Human
caaaguuugacaggaaccu

SEQ ID NO: 3820906 - RNA, 20 nt, Human
caaaguuugacaggaaccuu

SEQ ID NO: 3820907 - RNA, 14 nt, Human
caaaguuuuaucaa

SEQ ID NO: 3820908 - RNA, 19 nt, Human
caaaguuuugaaaagcuau

SEQ ID NO: 3820909 - RNA, 22 nt, Human
caaaguuuuguuguacuuaaau

SEQ ID NO: 3820910 - RNA, 23 nt, Human
caaauaaaauaaaaauaaaaaca

SEQ ID NO: 3820911 - RNA, 14 nt, Human
caaauaaacacugu

SEQ ID NO: 3820912 - RNA, 18 nt, Human
caaauaaacucuaaacau

SEQ ID NO: 3820913 - RNA, 19 nt, Human
caaauaaaguaguaaaaga

SEQ ID NO: 3820914 - RNA, 15 nt, Human
caaauaacuucaguc

SEQ ID NO: 3820915 - RNA, 14 nt, Human
caaauaagaaauuu

SEQ ID NO: 3820916 - RNA, 18 nt, Human
caaauaaguguauuuuga

SEQ ID NO: 3820917 - RNA, 19 nt, Human
caaauaaguguauuuugaa

SEQ ID NO: 3820918 - RNA, 17 nt, Human
auuuucagaaucugaau

SEQ ID NO: 3820919 - RNA, 23 nt, Human
auuuucagagccggcccgccucu

SEQ ID NO: 3820920 - RNA, 17 nt, Human
auuuucagauuugcaca

SEQ ID NO: 3820921 - RNA, 20 nt, Human
auuuucagauuugcacaaaa

SEQ ID NO: 3820922 - RNA, 19 nt, Human
auuuucagcaaacucuuuu

SEQ ID NO: 3820923 - RNA, 19 nt, Human
auuuucagcauuaagcugu

SEQ ID NO: 3820924 - RNA, 22 nt, Human
auuuucaguaauguuauuuucu

SEQ ID NO: 3820925 - RNA, 21 nt, Human
auuuucaguagggcuacaaaa

SEQ ID NO: 3820926 - RNA, 19 nt, Human
auuuucaguauaauuuaac

SEQ ID NO: 3820927 - RNA, 12 nt, Human
auuuucaguauu

SEQ ID NO: 3820928 - RNA, 22 nt, Human
auuuucaguuauuauauuuaca

SEQ ID NO: 3820929 - RNA, 20 nt, Human
auuuucauaaguauuucaaa

SEQ ID NO: 3820930 - RNA, 22 nt, Human
auuuucauaaguauuucaaauu

SEQ ID NO: 3820931 - RNA, 14 nt, Human
auuuucaugaaaau

SEQ ID NO: 3820932 - RNA, 17 nt, Human
auuuucaugaaaauacc

SEQ ID NO: 3820933 - RNA, 21 nt, Human
auuuucaugaaaauaccauuu

SEQ ID NO: 3820934 - RNA, 20 nt, Human
auuuucaugacuuuuccaug

SEQ ID NO: 3820935 - RNA, 14 nt, Human
auuuucauuagcaa

SEQ ID NO: 3820936 - RNA, 15 nt, Human
auuuucauuagcaaa

SEQ ID NO: 3820937 - RNA, 16 nt, Human
auuuucauuagcaaaa

SEQ ID NO: 3820938 - RNA, 17 nt, Human
auuuucauuagcaaaaa

SEQ ID NO: 3820939 - RNA, 22 nt, Human
auuuucauuagcaaaaaaaguu

SEQ ID NO: 3820940 - RNA, 15 nt, Human
auuuucauuauuccu

SEQ ID NO: 3820941 - RNA, 14 nt, Human
auuuucauuguaaa

SEQ ID NO: 3820942 - RNA, 17 nt, Human
auuuucauuuuacaguu

SEQ ID NO: 3820943 - RNA, 21 nt, Human
auuuuccacaagauucccaga

SEQ ID NO: 3820944 - RNA, 21 nt, Human
auuuuccauuuuuauuucaaa

SEQ ID NO: 3820945 - RNA, 22 nt, Human
auuuucccacucauucugaauu

SEQ ID NO: 3820946 - RNA, 20 nt, Human
auuuuccccccacucucccc

SEQ ID NO: 3820947 - RNA, 22 nt, Human
auuuuccccccacucuccccac

SEQ ID NO: 3820948 - RNA, 16 nt, Human
auuuuccuacaggcag

SEQ ID NO: 3820949 - RNA, 13 nt, Human
auuuuccucccca

SEQ ID NO: 3820950 - RNA, 15 nt, Human
auuuuccucugcuuu

SEQ ID NO: 3820951 - RNA, 16 nt, Human
auuuuccugccaggca

SEQ ID NO: 3820952 - RNA, 19 nt, Human
auuuuccuguccucuuuca

SEQ ID NO: 3820953 - RNA, 13 nt, Human
auuuuccuugaag

SEQ ID NO: 3820954 - RNA, 23 nt, Human
auuuuccuuuaauaugaaauuuu

SEQ ID NO: 3820955 - RNA, 13 nt, Human
auuuuccuuuuuu

SEQ ID NO: 3820956 - RNA, 20 nt, Human
auuuuccuuuuuuauacaca

SEQ ID NO: 3820957 - RNA, 17 nt, Human
auuuucguaugaaaaug

SEQ ID NO: 3820958 - RNA, 15 nt, Human
auuuucuaaaagcuu

SEQ ID NO: 3820959 - RNA, 16 nt, Human
auuuucuaaaguacug

SEQ ID NO: 3820960 - RNA, 14 nt, Human
auuuucuacaagua

SEQ ID NO: 3820961 - RNA, 16 nt, Human
auuuucuacguuucuu

SEQ ID NO: 3820962 - RNA, 16 nt, Human
auuuucuacucuuuuu

SEQ ID NO: 3820963 - RNA, 16 nt, Human
auuuucuagacuuucu

SEQ ID NO: 3820964 - RNA, 14 nt, Human
auuuucuagauaca

SEQ ID NO: 3820965 - RNA, 18 nt, Human
auuuucuauaauuuaaau

SEQ ID NO: 3820966 - RNA, 15 nt, Human
auuuucuauguacua

SEQ ID NO: 3820967 - RNA, 21 nt, Human
auuuucuauguacuaguacug

SEQ ID NO: 3820968 - RNA, 22 nt, Human
auuuucuauguacuaguacugu

SEQ ID NO: 3820969 - RNA, 23 nt, Human
auuuucuauguacuaguacugug

SEQ ID NO: 3820970 - RNA, 16 nt, Human
auuuucuauuguuacu

SEQ ID NO: 3820971 - RNA, 20 nt, Human
auuuucuauuguuacucugg

SEQ ID NO: 3820972 - RNA, 17 nt, Human
auuuucucaaaagcauu

SEQ ID NO: 3820973 - RNA, 23 nt, Human
auuuucucaaaagcauuuaucau

SEQ ID NO: 3820974 - RNA, 15 nt, Human
auuuucucccaggaa

SEQ ID NO: 3820975 - RNA, 23 nt, Human
auuuucucccuggauuuuuacca

SEQ ID NO: 3820976 - RNA, 17 nt, Human
auuuucucucaggugaa

SEQ ID NO: 3820977 - RNA, 19 nt, Human
auuuucucugauacuuuuu

SEQ ID NO: 3820978 - RNA, 17 nt, Human
auuuucucuguacuuuu

SEQ ID NO: 3820979 - RNA, 14 nt, Human
auuuucucuuagaa

SEQ ID NO: 3820980 - RNA, 15 nt, Human
auuuucugaaacuaa

SEQ ID NO: 3820981 - RNA, 20 nt, Human
auuuucugaaacuaaugaaa

SEQ ID NO: 3820982 - RNA, 12 nt, Human
auuuucugaaag

SEQ ID NO: 3820983 - RNA, 18 nt, Human
auuuucugaaaguuaccc

SEQ ID NO: 3820984 - RNA, 15 nt, Human
auuuucugcaucucc

SEQ ID NO: 3820985 - RNA, 18 nt, Human
auuuucuggaauacauga

SEQ ID NO: 3820986 - RNA, 22 nt, Human
auuuucuggaauacaugaaaua

SEQ ID NO: 3820987 - RNA, 22 nt, Human
auuuucuggauuccccaucuca

SEQ ID NO: 3820988 - RNA, 23 nt, Human
auuuucuggggcuccucacauag

SEQ ID NO: 3820989 - RNA, 16 nt, Human
auuuucugguaaaaag

SEQ ID NO: 3820990 - RNA, 21 nt, Human
auuuucugguagauagaaaua

SEQ ID NO: 3820991 - RNA, 17 nt, Human
auuuucugguucuaaca

SEQ ID NO: 3820992 - RNA, 13 nt, Human
auuuucugucaga

SEQ ID NO: 3820993 - RNA, 14 nt, Human
auuuucugucagau

SEQ ID NO: 3820994 - RNA, 22 nt, Human
auuuucugucagaugagaacaa

SEQ ID NO: 3820995 - RNA, 11 nt, Human
auuuucugugg

SEQ ID NO: 3820996 - RNA, 13 nt, Human
auuuucugugugu

SEQ ID NO: 3820997 - RNA, 16 nt, Human
auuuucuguguguucc

SEQ ID NO: 3820998 - RNA, 18 nt, Human
auuuucuguguguuccug

SEQ ID NO: 3820999 - RNA, 20 nt, Human
auuuucuguguguuccuggc

SEQ ID NO: 3821000 - RNA, 17 nt, Human
auuuucuuaaccaguug

SEQ ID NO: 3821001 - RNA, 19 nt, Human
auuuucuugaugacuggaa

SEQ ID NO: 3821002 - RNA, 15 nt, Human
auuuucuuuaaaaga

SEQ ID NO: 3821003 - RNA, 22 nt, Human
auuuucuuuaaccagucugaag

SEQ ID NO: 3821004 - RNA, 15 nt, Human
auuuucuuuaaugcu

SEQ ID NO: 3821005 - RNA, 15 nt, Human
auuuucuuugaaauu

SEQ ID NO: 3821006 - RNA, 23 nt, Human
auuuucuuuguguagcuuugcuc

SEQ ID NO: 3821007 - RNA, 13 nt, Human
auuuucuuuucuu

SEQ ID NO: 3821008 - RNA, 20 nt, Human
auuuucuuuucuuucaacuu

SEQ ID NO: 3821009 - RNA, 16 nt, Human
auuuucuuuuguaaau

SEQ ID NO: 3821010 - RNA, 17 nt, Human
auuuucuuuuguaaaug

SEQ ID NO: 3821011 - RNA, 19 nt, Human
auuuucuuuuguaaauguu

SEQ ID NO: 3821012 - RNA, 22 nt, Human
auuuucuuuuuauuuuuuaauu

SEQ ID NO: 3821013 - RNA, 13 nt, Human
auuuugaaaaacu

SEQ ID NO: 3821014 - RNA, 15 nt, Human
auuuugaaaaacugc

SEQ ID NO: 3821015 - RNA, 18 nt, Human
auuuugaaaaauuccuau

SEQ ID NO: 3821016 - RNA, 22 nt, Human
auuuugaaaaauuccuauugug

SEQ ID NO: 3821017 - RNA, 18 nt, Human
auuuugaaaacuacauuu

SEQ ID NO: 3821018 - RNA, 22 nt, Human
auuuugaaaacuacauuuuaac

SEQ ID NO: 3821019 - RNA, 13 nt, Human
auuuugaaaagcu

SEQ ID NO: 3821020 - RNA, 18 nt, Human
auuuugaaaagcuucuua

SEQ ID NO: 3821021 - RNA, 12 nt, Human
auuuugaaaagu

SEQ ID NO: 3821022 - RNA, 15 nt, Human
caacuauuuuuccaa

SEQ ID NO: 3821023 - RNA, 15 nt, Human
caacucaccccagcc

SEQ ID NO: 3821024 - RNA, 16 nt, Human
caacucaccccagccc

SEQ ID NO: 3821025 - RNA, 16 nt, Human
caacucacuccuuuua

SEQ ID NO: 3821026 - RNA, 17 nt, Human
caacucacuccuuuuaa

SEQ ID NO: 3821027 - RNA, 20 nt, Human
caacucacuccuuuuaaaga

SEQ ID NO: 3821028 - RNA, 21 nt, Human
caacucacuccuuuuaaagaa

SEQ ID NO: 3821029 - RNA, 12 nt, Human
caacucauucca

SEQ ID NO: 3821030 - RNA, 15 nt, Human
caacucauuccagau

SEQ ID NO: 3821031 - RNA, 13 nt, Human
caacuccaaaacc

SEQ ID NO: 3821032 - RNA, 18 nt, Human
caacuccaacauccacuc

SEQ ID NO: 3821033 - RNA, 20 nt, Human
caacuccagcaacuucuucu

SEQ ID NO: 3821034 - RNA, 22 nt, Human
caacuccaguacuggagcuucu

SEQ ID NO: 3821035 - RNA, 20 nt, Human
caacucccugccccccagcc

SEQ ID NO: 3821036 - RNA, 19 nt, Human
caacuccuagggccacuga

SEQ ID NO: 3821037 - RNA, 12 nt, Human
caacuccuccca

SEQ ID NO: 3821038 - RNA, 21 nt, Human
caacuccucgacaucacuguu

SEQ ID NO: 3821039 - RNA, 18 nt, Human
caacucuccccugaccug

SEQ ID NO: 3821040 - RNA, 24 nt, Human
caacucuccccugaccugugagcc

SEQ ID NO: 3821041 - RNA, 16 nt, Human
caacucucuuauugcc

SEQ ID NO: 3821042 - RNA, 21 nt, Human
caacucucuuauugccucacu

SEQ ID NO: 3821043 - RNA, 22 nt, Human
caacucucuuauugccucacuu

SEQ ID NO: 3821044 - RNA, 21 nt, Human
caacucugaaggguaauuaua

SEQ ID NO: 3821045 - RNA, 15 nt, Human
caacucugcugaggg

SEQ ID NO: 3821046 - RNA, 16 nt, Human
caacucugcugagggu

SEQ ID NO: 3821047 - RNA, 13 nt, Human
caacucugucccc

SEQ ID NO: 3821048 - RNA, 14 nt, Human
caacucuuugagaa

SEQ ID NO: 3821049 - RNA, 18 nt, Human
caacucuuuguuauuuga

SEQ ID NO: 3821050 - RNA, 14 nt, Human
caacugaaaguguu

SEQ ID NO: 3821051 - RNA, 22 nt, Human
caacugaaggcuaaaaagcaac

SEQ ID NO: 3821052 - RNA, 13 nt, Human
caacugacacagg

SEQ ID NO: 3821053 - RNA, 16 nt, Human
caacugacacaggaaa

SEQ ID NO: 3821054 - RNA, 17 nt, Human
caacugacacucccacc

SEQ ID NO: 3821055 - RNA, 15 nt, Human
caacugaccagccuc

SEQ ID NO: 3821056 - RNA, 17 nt, Human
caacugaggcagacagc

SEQ ID NO: 3821057 - RNA, 22 nt, Human
caacugaggcagacagcagcuc

SEQ ID NO: 3821058 - RNA, 17 nt, Human
caacugcaucaagaugu

SEQ ID NO: 3821059 - RNA, 20 nt, Human
caacugcaucaagaugugac

SEQ ID NO: 3821060 - RNA, 23 nt, Human
caacugcaucaagaugugacaug

SEQ ID NO: 3821061 - RNA, 16 nt, Human
caacugcauuggcuuu

SEQ ID NO: 3821062 - RNA, 22 nt, Human
caacugccuacuccaaaauguu

SEQ ID NO: 3821063 - RNA, 15 nt, Human
caacugcucccaccu

SEQ ID NO: 3821064 - RNA, 17 nt, Human
caacugcucccaccucc

SEQ ID NO: 3821065 - RNA, 12 nt, Human
caacugcugcuu

SEQ ID NO: 3821066 - RNA, 21 nt, Human
caacuggcccucuucuuacuu

SEQ ID NO: 3821067 - RNA, 13 nt, Human
caacugggcccaa

SEQ ID NO: 3821068 - RNA, 15 nt, Human
caacuguauauauuc

SEQ ID NO: 3821069 - RNA, 12 nt, Human
caacugugacug

SEQ ID NO: 3821070 - RNA, 13 nt, Human
caacuguggcugg

SEQ ID NO: 3821071 - RNA, 22 nt, Human
caacugugugauuaaaagguau

SEQ ID NO: 3821072 - RNA, 16 nt, Human
caacuguguucauuag

SEQ ID NO: 3821073 - RNA, 21 nt, Human
caacuguguuguauuaacaaa

SEQ ID NO: 3821074 - RNA, 22 nt, Human
caacuguguuguauuaacaaaa

SEQ ID NO: 3821075 - RNA, 19 nt, Human
caacuguuaugaaauaaag

SEQ ID NO: 3821076 - RNA, 15 nt, Human
caacuuaaaaagucu

SEQ ID NO: 3821077 - RNA, 19 nt, Human
caacuuaaaaagucugcau

SEQ ID NO: 3821078 - RNA, 15 nt, Human
caacuuaacaugaaa

SEQ ID NO: 3821079 - RNA, 16 nt, Human
caacuuaacaugggcu

SEQ ID NO: 3821080 - RNA, 21 nt, Human
caacuuaauguucugaauaau

SEQ ID NO: 3821081 - RNA, 18 nt, Human
caacuuagaucuccagga

SEQ ID NO: 3821082 - RNA, 14 nt, Human
caacuucaguccug

SEQ ID NO: 3821083 - RNA, 17 nt, Human
caacuucuacuucugcc

SEQ ID NO: 3821084 - RNA, 23 nt, Human
caacuucuccauccuuucugccu

SEQ ID NO: 3821085 - RNA, 14 nt, Human
caacuucuucagag

SEQ ID NO: 3821086 - RNA, 20 nt, Human
caacuucuuuuuauuuucuu

SEQ ID NO: 3821087 - RNA, 21 nt, Human
caacuugagauguaugaaggc

SEQ ID NO: 3821088 - RNA, 19 nt, Human
caacuugagcauguuacug

SEQ ID NO: 3821089 - RNA, 16 nt, Human
caacuugagggcccag

SEQ ID NO: 3821090 - RNA, 16 nt, Human
caacuugccuuugaag

SEQ ID NO: 3821091 - RNA, 17 nt, Human
caacuuggcuuucccgg

SEQ ID NO: 3821092 - RNA, 17 nt, Human
caacuugguucugcuuc

SEQ ID NO: 3821093 - RNA, 19 nt, Human
caacuugguucugcuucaa

SEQ ID NO: 3821094 - RNA, 13 nt, Human
caacuuguccuag

SEQ ID NO: 3821095 - RNA, 18 nt, Human
caacuuuaagcagcucuu

SEQ ID NO: 3821096 - RNA, 21 nt, Human
caacuuuaagcagcucuugcu

SEQ ID NO: 3821097 - RNA, 12 nt, Human
caacuuuacugu

SEQ ID NO: 3821098 - RNA, 12 nt, Human
caacuuuauacc

SEQ ID NO: 3821099 - RNA, 24 nt, Human
caacuuucacuauaaugugaaaug

SEQ ID NO: 3821100 - RNA, 12 nt, Human
caacuuucugua

SEQ ID NO: 3821101 - RNA, 17 nt, Human
caacuuugaauaaagaa

SEQ ID NO: 3821102 - RNA, 19 nt, Human
caacuuuguaaaaaucuuu

SEQ ID NO: 3821103 - RNA, 16 nt, Human
caacuuuuuauugccu

SEQ ID NO: 3821104 - RNA, 23 nt, Human
caacuuuuuauugccuucucacc

SEQ ID NO: 3821105 - RNA, 19 nt, Human
caacuuuuucccucacuaa

SEQ ID NO: 3821106 - RNA, 17 nt, Human
caacuuuuuuuucuuuu

SEQ ID NO: 3821107 - RNA, 16 nt, Human
caacuuuuuuuuuccc

SEQ ID NO: 3821108 - RNA, 17 nt, Human
caagaaaaaaaaaugcc

SEQ ID NO: 3821109 - RNA, 18 nt, Human
caagaaaaaaaaaugcca

SEQ ID NO: 3821110 - RNA, 15 nt, Human
caagaaaaaauaaau

SEQ ID NO: 3821111 - RNA, 17 nt, Human
caagaaaaaauaaaugg

SEQ ID NO: 3821112 - RNA, 18 nt, Human
caagaaaaauaaagaaaa

SEQ ID NO: 3821113 - RNA, 19 nt, Human
caagaaaaauaaagaaaag

SEQ ID NO: 3821114 - RNA, 17 nt, Human
caaaauguuggucauuu

SEQ ID NO: 3821115 - RNA, 18 nt, Human
caaaauguuggucauuuu

SEQ ID NO: 3821116 - RNA, 16 nt, Human
caaaauuaagguguuu

SEQ ID NO: 3821117 - RNA, 21 nt, Human
caaaauuagauccuaagaugu

SEQ ID NO: 3821118 - RNA, 20 nt, Human
caaaauuagccaguaauccu

SEQ ID NO: 3821119 - RNA, 22 nt, Human
caaaauuagccaguaauccugu

SEQ ID NO: 3821120 - RNA, 16 nt, Human
caaaauuauuucagaa

SEQ ID NO: 3821121 - RNA, 17 nt, Human
caaaauuauuucagaaa

SEQ ID NO: 3821122 - RNA, 13 nt, Human
caaaauuauuugu

SEQ ID NO: 3821123 - RNA, 15 nt, Human
caaaauucauuucua

SEQ ID NO: 3821124 - RNA, 18 nt, Human
caaaauucauuucuaauu

SEQ ID NO: 3821125 - RNA, 11 nt, Human
caaaauuccca

SEQ ID NO: 3821126 - RNA, 23 nt, Human
caaaauucgaccugauuuacagu

SEQ ID NO: 3821127 - RNA, 16 nt, Human
caaaauucuaaaugua

SEQ ID NO: 3821128 - RNA, 20 nt, Human
caaaauucuuauuuuuccua

SEQ ID NO: 3821129 - RNA, 17 nt, Human
caaaauugacauugcuu

SEQ ID NO: 3821130 - RNA, 15 nt, Human
caaaauugauguguu

SEQ ID NO: 3821131 - RNA, 16 nt, Human
caaaauugauguguuu

SEQ ID NO: 3821132 - RNA, 22 nt, Human
caaaauuguuuugagcuuucca

SEQ ID NO: 3821133 - RNA, 23 nt, Human
caaaauuguuuugagcuuuccau

SEQ ID NO: 3821134 - RNA, 22 nt, Human
caaaauuuauuuuauaagaaaa

SEQ ID NO: 3821135 - RNA, 14 nt, Human
caaaauuuccagua

SEQ ID NO: 3821136 - RNA, 15 nt, Human
caaaauuuccaguac

SEQ ID NO: 3821137 - RNA, 18 nt, Human
caaaauuuccaguaccuu

SEQ ID NO: 3821138 - RNA, 11 nt, Human
caaaauuuguu

SEQ ID NO: 3821139 - RNA, 16 nt, Human
caaaauuuuaaaaaag

SEQ ID NO: 3821140 - RNA, 20 nt, Human
caaaauuuuaguccaaauaa

SEQ ID NO: 3821141 - RNA, 21 nt, Human
caaaauuuuauagcucaguuu

SEQ ID NO: 3821142 - RNA, 14 nt, Human
caaaauuuuauuuu

SEQ ID NO: 3821143 - RNA, 17 nt, Human
caaaauuuucucauuuu

SEQ ID NO: 3821144 - RNA, 21 nt, Human
caaaauuuuuucucuaggaaa

SEQ ID NO: 3821145 - RNA, 20 nt, Human
caaacaaaaagguucucagg

SEQ ID NO: 3821146 - RNA, 13 nt, Human
caaacaaagccag

SEQ ID NO: 3821147 - RNA, 14 nt, Human
caaacaaauaugca

SEQ ID NO: 3821148 - RNA, 18 nt, Human
caaacaacagaaagucau

SEQ ID NO: 3821149 - RNA, 21 nt, Human
caaacaaggggcuguuacaua

SEQ ID NO: 3821150 - RNA, 15 nt, Human
caaacaauaccugaa

SEQ ID NO: 3821151 - RNA, 20 nt, Human
caaacaaucucuuaaauugg

SEQ ID NO: 3821152 - RNA, 19 nt, Human
caaacaauggaaacugaau

SEQ ID NO: 3821153 - RNA, 23 nt, Human
caaacacaaggucauggccacac

SEQ ID NO: 3821154 - RNA, 15 nt, Human
caaacacauacagga

SEQ ID NO: 3821155 - RNA, 23 nt, Human
caaacacauuaagccuuccacac

SEQ ID NO: 3821156 - RNA, 18 nt, Human
caaacaccaacauaaaaa

SEQ ID NO: 3821157 - RNA, 22 nt, Human
caaacaccuucuuauuauauau

SEQ ID NO: 3821158 - RNA, 21 nt, Human
caaacacuugugacuuuugcu

SEQ ID NO: 3821159 - RNA, 16 nt, Human
caaacagaacaggguc

SEQ ID NO: 3821160 - RNA, 15 nt, Human
caaacagaggccgcc

SEQ ID NO: 3821161 - RNA, 16 nt, Human
caaacagaugcucuga

SEQ ID NO: 3821162 - RNA, 17 nt, Human
caaacagcaaaccaaga

SEQ ID NO: 3821163 - RNA, 19 nt, Human
caaacagcaaaccaagaga

SEQ ID NO: 3821164 - RNA, 15 nt, Human
caaacaggaacaauc

SEQ ID NO: 3821165 - RNA, 14 nt, Human
caaacagggccucu

SEQ ID NO: 3821166 - RNA, 19 nt, Human
caagaauagcauuguaaaa

SEQ ID NO: 3821167 - RNA, 18 nt, Human
caagaauauugcaaaaua

SEQ ID NO: 3821168 - RNA, 21 nt, Human
caagaauauugcaaaauacau

SEQ ID NO: 3821169 - RNA, 15 nt, Human
caagaaucagagaag

SEQ ID NO: 3821170 - RNA, 23 nt, Human
caagaaucagucuauccacagag

SEQ ID NO: 3821171 - RNA, 21 nt, Human
caagaauccacauuucuaaaa

SEQ ID NO: 3821172 - RNA, 21 nt, Human
caagaaugaagguuuuuguaa

SEQ ID NO: 3821173 - RNA, 22 nt, Human
caagaaugaagguuuuuguaaa

SEQ ID NO: 3821174 - RNA, 22 nt, Human
caagaaugcauugauauuguga

SEQ ID NO: 3821175 - RNA, 13 nt, Human
caagaaugcugaa

SEQ ID NO: 3821176 - RNA, 14 nt, Human
caagaauggaucac

SEQ ID NO: 3821177 - RNA, 22 nt, Human
caagaauggaucacaagaugga

SEQ ID NO: 3821178 - RNA, 11 nt, Human
caagaauguac

SEQ ID NO: 3821179 - RNA, 13 nt, Human
caagacaaaucaa

SEQ ID NO: 3821180 - RNA, 18 nt, Human
caagacaaaucaacagaa

SEQ ID NO: 3821181 - RNA, 13 nt, Human
caagacacugugg

SEQ ID NO: 3821182 - RNA, 21 nt, Human
caagacagaugccccagagcu

SEQ ID NO: 3821183 - RNA, 13 nt, Human
caagacauuguca

SEQ ID NO: 3821184 - RNA, 11 nt, Human
caagaccaaaa

SEQ ID NO: 3821185 - RNA, 14 nt, Human
caagaccacguuuc

SEQ ID NO: 3821186 - RNA, 19 nt, Human
caagacccaaaaggcagaa

SEQ ID NO: 3821187 - RNA, 23 nt, Human
caagaccccaagaggaaguucag

SEQ ID NO: 3821188 - RNA, 16 nt, Human
caagacccccagcacu

SEQ ID NO: 3821189 - RNA, 14 nt, Human
caagacccugucuc

SEQ ID NO: 3821190 - RNA, 22 nt, Human
caagacccuuguggucccaccc

SEQ ID NO: 3821191 - RNA, 21 nt, Human
caagacccuuuuggguuucug

SEQ ID NO: 3821192 - RNA, 16 nt, Human
caagaccgaucggcgg

SEQ ID NO: 3821193 - RNA, 16 nt, Human
caagaccucagggcac

SEQ ID NO: 3821194 - RNA, 14 nt, Human
caagaccugacuca

SEQ ID NO: 3821195 - RNA, 14 nt, Human
caagaccuucuccu

SEQ ID NO: 3821196 - RNA, 16 nt, Human
caagacgcugugcugc

SEQ ID NO: 3821197 - RNA, 17 nt, Human
caagacgcugugcugcc

SEQ ID NO: 3821198 - RNA, 18 nt, Human
caagacgcugugcugccc

SEQ ID NO: 3821199 - RNA, 19 nt, Human
caagacgcugugcugcccu

SEQ ID NO: 3821200 - RNA, 15 nt, Human
caagacucugucuca

SEQ ID NO: 3821201 - RNA, 22 nt, Human
caagacucuuuaugaucuggcc

SEQ ID NO: 3821202 - RNA, 16 nt, Human
caagacugacgccagg

SEQ ID NO: 3821203 - RNA, 12 nt, Human
caagacugcugu

SEQ ID NO: 3821204 - RNA, 21 nt, Human
caagacugcuguggccaggag

SEQ ID NO: 3821205 - RNA, 14 nt, Human
caagacuguugcuc

SEQ ID NO: 3821206 - RNA, 16 nt, Human
caagacuucaguaugu

SEQ ID NO: 3821207 - RNA, 21 nt, Human
caagacuucaguauguuguca

SEQ ID NO: 3821208 - RNA, 21 nt, Human
caagacuugguguccuuuccc

SEQ ID NO: 3821209 - RNA, 16 nt, Human
caagagaaacuuccua

SEQ ID NO: 3821210 - RNA, 22 nt, Human
caagagaaaggccugcacacaa

SEQ ID NO: 3821211 - RNA, 14 nt, Human
caagagaagcauuc

SEQ ID NO: 3821212 - RNA, 18 nt, Human
caagagaagcauucucau

SEQ ID NO: 3821213 - RNA, 22 nt, Human
caagagaagcauucucauugga

SEQ ID NO: 3821214 - RNA, 15 nt, Human
caagagacugaguca

SEQ ID NO: 3821215 - RNA, 17 nt, Human
caagagagaaagaagua

SEQ ID NO: 3821216 - RNA, 12 nt, Human
caagagagaacc

SEQ ID NO: 3821217 - RNA, 15 nt, Human
caagagagcagcaag

SEQ ID NO: 3821218 - RNA, 13 nt, Human
caagagaggauga

SEQ ID NO: 3821219 - RNA, 13 nt, Human
caagagauaacug

SEQ ID NO: 3821220 - RNA, 23 nt, Human
caagagaugaagagugagagggc

SEQ ID NO: 3821221 - RNA, 19 nt, Human
caagagauugcuaauugcu

SEQ ID NO: 3821222 - RNA, 15 nt, Human
caagagauuuaauua

SEQ ID NO: 3821223 - RNA, 14 nt, Human
caagagcaaaguag

SEQ ID NO: 3821224 - RNA, 15 nt, Human
caagagcagaggcag

SEQ ID NO: 3821225 - RNA, 16 nt, Human
caagagcagaggcagc

SEQ ID NO: 3821226 - RNA, 15 nt, Human
caagagcagccugug

SEQ ID NO: 3821227 - RNA, 19 nt, Human
caagagcaucaugccucug

SEQ ID NO: 3821228 - RNA, 22 nt, Human
caagagcaucaugccucugagg

SEQ ID NO: 3821229 - RNA, 23 nt, Human
caagagcaucaugccucugaggc

SEQ ID NO: 3821230 - RNA, 17 nt, Human
caagagcccaggccucc

SEQ ID NO: 3821231 - RNA, 11 nt, Human
caagagccuga

SEQ ID NO: 3821232 - RNA, 23 nt, Human
caagagccugagagugaggugga

SEQ ID NO: 3821233 - RNA, 16 nt, Human
caagagccuuaaaaca

SEQ ID NO: 3821234 - RNA, 18 nt, Human
caagagcgaaacuccguc

SEQ ID NO: 3821235 - RNA, 22 nt, Human
caagagcuacguauuuaauagc

SEQ ID NO: 3821236 - RNA, 22 nt, Human
caagaggaauaagaauggagca

SEQ ID NO: 3821237 - RNA, 14 nt, Human
caagaggagaucca

SEQ ID NO: 3821238 - RNA, 14 nt, Human
caagaggcaaagga

SEQ ID NO: 3821239 - RNA, 17 nt, Human
caagaggcugagacagg

SEQ ID NO: 3821240 - RNA, 15 nt, Human
caagaggcugaggca

SEQ ID NO: 3821241 - RNA, 11 nt, Human
caagaggcugg

SEQ ID NO: 3821242 - RNA, 20 nt, Human
caagaggcuguucccaccag

SEQ ID NO: 3821243 - RNA, 16 nt, Human
caagagggaauccccg

SEQ ID NO: 3821244 - RNA, 18 nt, Human
caagagggcacugguggc

SEQ ID NO: 3821245 - RNA, 20 nt, Human
caagagggcacugguggccc

SEQ ID NO: 3821246 - RNA, 17 nt, Human
caagaggggguggaggg

SEQ ID NO: 3821247 - RNA, 16 nt, Human
caagagggguggagac

SEQ ID NO: 3821248 - RNA, 12 nt, Human
caagagggucug

SEQ ID NO: 3821249 - RNA, 15 nt, Human
caagaggugggaggg

SEQ ID NO: 3821250 - RNA, 16 nt, Human
caagaggugggagggc

SEQ ID NO: 3821251 - RNA, 20 nt, Human
caagagguuuggcuccugcc

SEQ ID NO: 3821252 - RNA, 16 nt, Human
caagagugauucuugc

SEQ ID NO: 3821253 - RNA, 14 nt, Human
caagaguggcccca

SEQ ID NO: 3821254 - RNA, 20 nt, Human
caagaguggccccaccuggc

SEQ ID NO: 3821255 - RNA, 18 nt, Human
caagaguuuucuuccuug

SEQ ID NO: 3821256 - RNA, 15 nt, Human
caagauaacugagaa

SEQ ID NO: 3821257 - RNA, 17 nt, Human
caagauagauuuggaau

SEQ ID NO: 3821258 - RNA, 15 nt, Human
caagauaggaccuug

SEQ ID NO: 3821259 - RNA, 16 nt, Human
caagauauuguacaua

SEQ ID NO: 3821260 - RNA, 17 nt, Human
caagauauuguacauaa

SEQ ID NO: 3821261 - RNA, 23 nt, Human
caagauauuuuaaaaucugucac

SEQ ID NO: 3821262 - RNA, 16 nt, Human
caagaucaaaaaggcu

SEQ ID NO: 3821263 - RNA, 21 nt, Human
caagaucaaaaaggcuuauaa

SEQ ID NO: 3821264 - RNA, 22 nt, Human
caagauccugucuuuaaggaaa

SEQ ID NO: 3821265 - RNA, 16 nt, Human
caagaucgcgccacug

SEQ ID NO: 3821266 - RNA, 13 nt, Human
caagaucuuucag

SEQ ID NO: 3821267 - RNA, 14 nt, Human
caagaucuuucagg

SEQ ID NO: 3821268 - RNA, 15 nt, Human
caagaugacuggggu

SEQ ID NO: 3821269 - RNA, 22 nt, Human
caagaugcuggaugucugccaa

SEQ ID NO: 3821270 - RNA, 16 nt, Human
caagauggaaaggauu

SEQ ID NO: 3821271 - RNA, 23 nt, Human
caagauggcacagggcaugaaau

SEQ ID NO: 3821272 - RNA, 16 nt, Human
caagaugggcaucuuu

SEQ ID NO: 3821273 - RNA, 14 nt, Human
caaacuguaauaca

SEQ ID NO: 3821274 - RNA, 22 nt, Human
caaacugugaagcauuuacaga

SEQ ID NO: 3821275 - RNA, 15 nt, Human
caaacuguguaacug

SEQ ID NO: 3821276 - RNA, 17 nt, Human
caaacuuaagaaacacu

SEQ ID NO: 3821277 - RNA, 19 nt, Human
caaacuuaagaaacacuga

SEQ ID NO: 3821278 - RNA, 18 nt, Human
caaacuuacuauuuugac

SEQ ID NO: 3821279 - RNA, 23 nt, Human
caaacuuccagugcaacacugaa

SEQ ID NO: 3821280 - RNA, 17 nt, Human
caaacuuggauuuuuga

SEQ ID NO: 3821281 - RNA, 23 nt, Human
caaacuuggguagaguuuacagc

SEQ ID NO: 3821282 - RNA, 23 nt, Human
caaacuuuagguuuuuuuaauga

SEQ ID NO: 3821283 - RNA, 12 nt, Human
caaacuuugcau

SEQ ID NO: 3821284 - RNA, 20 nt, Human
caaacuuugcaucucaguau

SEQ ID NO: 3821285 - RNA, 18 nt, Human
caaacuuuuauacucuuu

SEQ ID NO: 3821286 - RNA, 21 nt, Human
caaacuuuucaaggcuuauau

SEQ ID NO: 3821287 - RNA, 21 nt, Human
caaagaaaaaaaaaaaagcca

SEQ ID NO: 3821288 - RNA, 18 nt, Human
caaagaaaaugaaaugca

SEQ ID NO: 3821289 - RNA, 16 nt, Human
caaagaaacaaagaug

SEQ ID NO: 3821290 - RNA, 12 nt, Human
caaagaaauauu

SEQ ID NO: 3821291 - RNA, 20 nt, Human
caaagaaauccggagaagcu

SEQ ID NO: 3821292 - RNA, 14 nt, Human
caaagaaaugaaca

SEQ ID NO: 3821293 - RNA, 17 nt, Human
caaagaaaugaacauuc

SEQ ID NO: 3821294 - RNA, 20 nt, Human
caaagaaaugaacauuccaa

SEQ ID NO: 3821295 - RNA, 12 nt, Human
caaagaaauuau

SEQ ID NO: 3821296 - RNA, 15 nt, Human
caaagaaauuaugug

SEQ ID NO: 3821297 - RNA, 12 nt, Human
caaagaaauuuc

SEQ ID NO: 3821298 - RNA, 21 nt, Human
caaagaacauguagaaaacaa

SEQ ID NO: 3821299 - RNA, 16 nt, Human
caaagaagacauguuu

SEQ ID NO: 3821300 - RNA, 19 nt, Human
caaagaaggaaaaggcagg

SEQ ID NO: 3821301 - RNA, 23 nt, Human
caaagaaugaauuucaacgccug

SEQ ID NO: 3821302 - RNA, 14 nt, Human
caaagaaugccuug

SEQ ID NO: 3821303 - RNA, 19 nt, Human
caaagaauuccaaagcaaa

SEQ ID NO: 3821304 - RNA, 20 nt, Human
caaagacaaauucuguuucu

SEQ ID NO: 3821305 - RNA, 14 nt, Human
caaagacagaagcc

SEQ ID NO: 3821306 - RNA, 18 nt, Human
caaagaccaaauuccuug

SEQ ID NO: 3821307 - RNA, 21 nt, Human
caaagaccacacauuugugua

SEQ ID NO: 3821308 - RNA, 23 nt, Human
caaagaccuuguguguaugugua

SEQ ID NO: 3821309 - RNA, 19 nt, Human
caaagacuuaguauauuuu

SEQ ID NO: 3821310 - RNA, 20 nt, Human
caaagacuuaguauauuuuc

SEQ ID NO: 3821311 - RNA, 12 nt, Human
caacuguauaua

SEQ ID NO: 3821312 - RNA, 13 nt, Human
caacuguauauau

SEQ ID NO: 3821313 - RNA, 18 nt, Human
caacugucuauuucugcu

SEQ ID NO: 3821314 - RNA, 21 nt, Human
caacugucucgaugcaaugaa

SEQ ID NO: 3821315 - RNA, 20 nt, Human
caacugucucucuucucaga

SEQ ID NO: 3821316 - RNA, 12 nt, Human
caacugugugau

SEQ ID NO: 3821317 - RNA, 19 nt, Human
caacuguugauugcaggaa

SEQ ID NO: 3821318 - RNA, 15 nt, Human
caacuuaacaugggc

SEQ ID NO: 3821319 - RNA, 22 nt, Human
caacuuaauacucaaaugagua

SEQ ID NO: 3821320 - RNA, 15 nt, Human
caacuuaauguucug

SEQ ID NO: 3821321 - RNA, 14 nt, Human
caacuuacuacuga

SEQ ID NO: 3821322 - RNA, 19 nt, Human
caacuuagucaauaagaaa

SEQ ID NO: 3821323 - RNA, 11 nt, Human
caacuuauuaa

SEQ ID NO: 3821324 - RNA, 16 nt, Human
caacuucaagugcaug

SEQ ID NO: 3821325 - RNA, 22 nt, Human
caacuucaagugcaugcucucu

SEQ ID NO: 3821326 - RNA, 18 nt, Human
caacuucagcaguaccua

SEQ ID NO: 3821327 - RNA, 19 nt, Human
aucucaaauucucaaccua

SEQ ID NO: 3821328 - RNA, 17 nt, Human
aucucaaauuguaauua

SEQ ID NO: 3821329 - RNA, 19 nt, Human
aucucaaauuguaauuaau

SEQ ID NO: 3821330 - RNA, 15 nt, Human
aucucaacaggccuc

SEQ ID NO: 3821331 - RNA, 18 nt, Human
aucucaaggaaucuuuaa

SEQ ID NO: 3821332 - RNA, 13 nt, Human
aucucaauccugc

SEQ ID NO: 3821333 - RNA, 18 nt, Human
aucucaaugaagccagcu

SEQ ID NO: 3821334 - RNA, 14 nt, Human
aucucaauucuucc

SEQ ID NO: 3821335 - RNA, 13 nt, Human
aucucaccccauc

SEQ ID NO: 3821336 - RNA, 16 nt, Human
aucucaccccauccca

SEQ ID NO: 3821337 - RNA, 12 nt, Human
aucucacucugc

SEQ ID NO: 3821338 - RNA, 18 nt, Human
aucucacuugugccaaca

SEQ ID NO: 3821339 - RNA, 16 nt, Human
aucucagaaagugccu

SEQ ID NO: 3821340 - RNA, 18 nt, Human
aucucagaaagugccuga

SEQ ID NO: 3821341 - RNA, 17 nt, Human
aucucagauauuugcac

SEQ ID NO: 3821342 - RNA, 19 nt, Human
aucucagaucacugcaacc

SEQ ID NO: 3821343 - RNA, 18 nt, Human
aucucagauguuaaaaua

SEQ ID NO: 3821344 - RNA, 11 nt, Human
aucucagccca

SEQ ID NO: 3821345 - RNA, 17 nt, Human
aucucagcccugcaacu

SEQ ID NO: 3821346 - RNA, 13 nt, Human
aucucagcucacu

SEQ ID NO: 3821347 - RNA, 17 nt, Human
aucucaggccaccugcc

SEQ ID NO: 3821348 - RNA, 20 nt, Human
aucucaggccaccugccccc

SEQ ID NO: 3821349 - RNA, 14 nt, Human
aucucaggccagag

SEQ ID NO: 3821350 - RNA, 17 nt, Human
aucucaggccagagcca

SEQ ID NO: 3821351 - RNA, 18 nt, Human
aucucagggaagcccagc

SEQ ID NO: 3821352 - RNA, 23 nt, Human
aucucagggaagcccagcuccag

SEQ ID NO: 3821353 - RNA, 16 nt, Human
aucucagggccugguc

SEQ ID NO: 3821354 - RNA, 20 nt, Human
aucucaggggcuguuugagg

SEQ ID NO: 3821355 - RNA, 14 nt, Human
aucucaguccucaa

SEQ ID NO: 3821356 - RNA, 14 nt, Human
aucucagugaagaa

SEQ ID NO: 3821357 - RNA, 17 nt, Human
aucucagugaagaauac

SEQ ID NO: 3821358 - RNA, 20 nt, Human
aucucagugaagaauacuuc

SEQ ID NO: 3821359 - RNA, 14 nt, Human
aucucagugcuuuc

SEQ ID NO: 3821360 - RNA, 15 nt, Human
aucucagugcuuucc

SEQ ID NO: 3821361 - RNA, 15 nt, Human
aucucauaccucuga

SEQ ID NO: 3821362 - RNA, 17 nt, Human
aucucauagguugccaa

SEQ ID NO: 3821363 - RNA, 23 nt, Human
aucucauagguugccaauaauac

SEQ ID NO: 3821364 - RNA, 16 nt, Human
aucucaucaacaaaga

SEQ ID NO: 3821365 - RNA, 19 nt, Human
aucucaucaugucuauugu

SEQ ID NO: 3821366 - RNA, 15 nt, Human
aucucaucuaucuca

SEQ ID NO: 3821367 - RNA, 23 nt, Human
aucucaugccccuggcugggacg

SEQ ID NO: 3821368 - RNA, 22 nt, Human
aucucauggagaagcagaaaua

SEQ ID NO: 3821369 - RNA, 24 nt, Human
aucucauggagaagcagaaauaca

SEQ ID NO: 3821370 - RNA, 16 nt, Human
aucucauguaucaucu

SEQ ID NO: 3821371 - RNA, 16 nt, Human
aucucauugcuuacaa

SEQ ID NO: 3821372 - RNA, 17 nt, Human
aucucauugcuuacaag

SEQ ID NO: 3821373 - RNA, 15 nt, Human
aucucauuggacccu

SEQ ID NO: 3821374 - RNA, 19 nt, Human
aucucauuggacccuucca

SEQ ID NO: 3821375 - RNA, 20 nt, Human
aucuccaaaauaaaacuuuu

SEQ ID NO: 3821376 - RNA, 14 nt, Human
aucuccaagaaugc

SEQ ID NO: 3821377 - RNA, 15 nt, Human
aucuccaagcagcuu

SEQ ID NO: 3821378 - RNA, 17 nt, Human
aucuccaagcagcuuag

SEQ ID NO: 3821379 - RNA, 16 nt, Human
aucuccaaggaccagg

SEQ ID NO: 3821380 - RNA, 15 nt, Human
aucuccacccccagc

SEQ ID NO: 3821381 - RNA, 22 nt, Human
aucuccacccccagcugcuugu

SEQ ID NO: 3821382 - RNA, 12 nt, Human
aucuccaggauu

SEQ ID NO: 3821383 - RNA, 20 nt, Human
aucuccaggauugaagagca

SEQ ID NO: 3821384 - RNA, 16 nt, Human
aucuccauaaacauga

SEQ ID NO: 3821385 - RNA, 17 nt, Human
aucuccauggcuuccuc

SEQ ID NO: 3821386 - RNA, 18 nt, Human
aucucccaccuagcagca

SEQ ID NO: 3821387 - RNA, 17 nt, Human
aucucccauuuuggaau

SEQ ID NO: 3821388 - RNA, 14 nt, Human
aucuccccacucua

SEQ ID NO: 3821389 - RNA, 13 nt, Human
aucucccccagcc

SEQ ID NO: 3821390 - RNA, 22 nt, Human
aucucccucgaacccacacugc

SEQ ID NO: 3821391 - RNA, 14 nt, Human
aucucccugccucc

SEQ ID NO: 3821392 - RNA, 19 nt, Human
aucucccugccuccugccg

SEQ ID NO: 3821393 - RNA, 20 nt, Human
aucucccugccuggccccca

SEQ ID NO: 3821394 - RNA, 21 nt, Human
aucucccuggugcuuaugcuc

SEQ ID NO: 3821395 - RNA, 20 nt, Human
aucuccgucaacucauauuu

SEQ ID NO: 3821396 - RNA, 17 nt, Human
aucuccuagggcuaugg

SEQ ID NO: 3821397 - RNA, 17 nt, Human
aucuccuauaaucuguc

SEQ ID NO: 3821398 - RNA, 18 nt, Human
aucuccuauuuuuuuaaa

SEQ ID NO: 3821399 - RNA, 20 nt, Human
aucuccuauuuuuuuaaaau

SEQ ID NO: 3821400 - RNA, 19 nt, Human
aucuccucaaguccccaag

SEQ ID NO: 3821401 - RNA, 16 nt, Human
aucuccugccuuccuc

SEQ ID NO: 3821402 - RNA, 16 nt, Human
aucuccuugucuuuuu

SEQ ID NO: 3821403 - RNA, 15 nt, Human
aucuccuuucaggga

SEQ ID NO: 3821404 - RNA, 18 nt, Human
aucuccuuuguauucugu

SEQ ID NO: 3821405 - RNA, 20 nt, Human
aucucgccaccccuccuucc

SEQ ID NO: 3821406 - RNA, 21 nt, Human
aucucgccaccccuccuuccu

SEQ ID NO: 3821407 - RNA, 19 nt, Human
aucucggagcaucccggag

SEQ ID NO: 3821408 - RNA, 14 nt, Human
aucucggcucacug

SEQ ID NO: 3821409 - RNA, 16 nt, Human
aucucggcucacugca

SEQ ID NO: 3821410 - RNA, 15 nt, Human
aucucguauagaagu

SEQ ID NO: 3821411 - RNA, 13 nt, Human
aucucguuucaaa

SEQ ID NO: 3821412 - RNA, 14 nt, Human
aucucguuucaaaa

SEQ ID NO: 3821413 - RNA, 22 nt, Human
aucucguuuuucuucuuaagac

SEQ ID NO: 3821414 - RNA, 15 nt, Human
aucucuaauauggca

SEQ ID NO: 3821415 - RNA, 17 nt, Human
aucucuaccuucucccc

SEQ ID NO: 3821416 - RNA, 21 nt, Human
aucucuacgcaaaaaauaacu

SEQ ID NO: 3821417 - RNA, 20 nt, Human
aucucuacuaaaaauacaaa

SEQ ID NO: 3821418 - RNA, 13 nt, Human
aucucuauacugc

SEQ ID NO: 3821419 - RNA, 21 nt, Human
aucucuauauaaaaacaaaaa

SEQ ID NO: 3821420 - RNA, 17 nt, Human
aucucuauuauuggaaa

SEQ ID NO: 3821421 - RNA, 17 nt, Human
aucucuauuccccaccc

SEQ ID NO: 3821422 - RNA, 14 nt, Human
aucucuauuuaaua

SEQ ID NO: 3821423 - RNA, 16 nt, Human
aucucuauuuaauauu

SEQ ID NO: 3821424 - RNA, 19 nt, Human
aucucuauuuaauauuuau

SEQ ID NO: 3821425 - RNA, 14 nt, Human
aucucucaaaacuu

SEQ ID NO: 3821426 - RNA, 16 nt, Human
aucucucaaaucuguu

SEQ ID NO: 3821427 - RNA, 13 nt, Human
aucucucaggagc

SEQ ID NO: 3821428 - RNA, 16 nt, Human
aucucucaggagcaca

SEQ ID NO: 3821429 - RNA, 23 nt, Human
aucucucaggagcacaggcagcu

SEQ ID NO: 3821430 - RNA, 17 nt, Human
aucucucauccuccagu

SEQ ID NO: 3821431 - RNA, 14 nt, Human
aucucuccacugug

SEQ ID NO: 3821432 - RNA, 19 nt, Human
aucucuccacuuucagcug

SEQ ID NO: 3821433 - RNA, 14 nt, Human
aucucucccucccc

SEQ ID NO: 3821434 - RNA, 20 nt, Human
aucucuccuccaagacacug

SEQ ID NO: 3821435 - RNA, 14 nt, Human
aucucucgugauug

SEQ ID NO: 3821436 - RNA, 16 nt, Human
aucucucugcagcugc

SEQ ID NO: 3821437 - RNA, 19 nt, Human
aucucucugcagcugccgg

SEQ ID NO: 3821438 - RNA, 14 nt, Human
aucucucugcccaa

SEQ ID NO: 3821439 - RNA, 12 nt, Human
aucucucuggcc

SEQ ID NO: 3821440 - RNA, 16 nt, Human
aucucugaacuucagc

SEQ ID NO: 3821441 - RNA, 17 nt, Human
aucucugaacuucagcu

SEQ ID NO: 3821442 - RNA, 16 nt, Human
aucucugaagcauguu

SEQ ID NO: 3821443 - RNA, 18 nt, Human
aucucugaagccacaaau

SEQ ID NO: 3821444 - RNA, 19 nt, Human
aucucugaagccacaaaua

SEQ ID NO: 3821445 - RNA, 20 nt, Human
aucucugaguucuguguauu

SEQ ID NO: 3821446 - RNA, 23 nt, Human
aucucugcacccuggggccugga

SEQ ID NO: 3821447 - RNA, 22 nt, Human
aucucugggcuggaugagcucc

SEQ ID NO: 3821448 - RNA, 13 nt, Human
aucucuguaaagc

SEQ ID NO: 3821449 - RNA, 18 nt, Human
aucucuguaaagcuaaaa

SEQ ID NO: 3821450 - RNA, 17 nt, Human
aucucugucccauuccc

SEQ ID NO: 3821451 - RNA, 22 nt, Human
aucucugucccauucccuggga

SEQ ID NO: 3821452 - RNA, 14 nt, Human
aucucugugccuuc

SEQ ID NO: 3821453 - RNA, 20 nt, Human
aucucuguuauguacuguac

SEQ ID NO: 3821454 - RNA, 18 nt, Human
aucucuuagcuccccucc

SEQ ID NO: 3821455 - RNA, 23 nt, Human
aucucuuagcuccccuccaaccu

SEQ ID NO: 3821456 - RNA, 17 nt, Human
caauggaaaccucacgc

SEQ ID NO: 3821457 - RNA, 16 nt, Human
caauggaaacugaaug

SEQ ID NO: 3821458 - RNA, 17 nt, Human
caauggaagauuugccc

SEQ ID NO: 3821459 - RNA, 19 nt, Human
caauggacaagcaguggau

SEQ ID NO: 3821460 - RNA, 20 nt, Human
caauggagacugucucaaga

SEQ ID NO: 3821461 - RNA, 19 nt, Human
caauggauuugaugcuguu

SEQ ID NO: 3821462 - RNA, 19 nt, Human
caauggcgcagugccucug

SEQ ID NO: 3821463 - RNA, 20 nt, Human
caauggcgcagugccucugg

SEQ ID NO: 3821464 - RNA, 23 nt, Human
caauggcuaauucccagagugug

SEQ ID NO: 3821465 - RNA, 19 nt, Human
caauggcuaccuaaaaaga

SEQ ID NO: 3821466 - RNA, 18 nt, Human
caauggcuuacuccagga

SEQ ID NO: 3821467 - RNA, 23 nt, Human
caaugggagcugaggccacacuc

SEQ ID NO: 3821468 - RNA, 17 nt, Human
caaugggcacugggaug

SEQ ID NO: 3821469 - RNA, 23 nt, Human
caauggguuuuucccuguacagu

SEQ ID NO: 3821470 - RNA, 15 nt, Human
caaugguaauuauaa

SEQ ID NO: 3821471 - RNA, 17 nt, Human
caaugguaguuucugug

SEQ ID NO: 3821472 - RNA, 23 nt, Human
caaugguguuuuucuuguaaaug

SEQ ID NO: 3821473 - RNA, 13 nt, Human
caaugguuugcaa

SEQ ID NO: 3821474 - RNA, 17 nt, Human
caaugguuuuuaaauuu

SEQ ID NO: 3821475 - RNA, 14 nt, Human
caauguaaauauuu

SEQ ID NO: 3821476 - RNA, 19 nt, Human
caauguaaauauuuuaaag

SEQ ID NO: 3821477 - RNA, 12 nt, Human
caauguaauuau

SEQ ID NO: 3821478 - RNA, 14 nt, Human
caauguaauuauuu

SEQ ID NO: 3821479 - RNA, 17 nt, Human
caauguacccaccgggc

SEQ ID NO: 3821480 - RNA, 19 nt, Human
caauguagaggggaaaaga

SEQ ID NO: 3821481 - RNA, 14 nt, Human
caaugucacuuaaa

SEQ ID NO: 3821482 - RNA, 16 nt, Human
caaugucaggaacaga

SEQ ID NO: 3821483 - RNA, 21 nt, Human
caaugucaggaacagaaggau

SEQ ID NO: 3821484 - RNA, 16 nt, Human
caaugucugagugaac

SEQ ID NO: 3821485 - RNA, 20 nt, Human
caaugucugagugaaccugu

SEQ ID NO: 3821486 - RNA, 13 nt, Human
caaugucugcagc

SEQ ID NO: 3821487 - RNA, 17 nt, Human
caaugucugcagcccug

SEQ ID NO: 3821488 - RNA, 13 nt, Human
caaugucuggaga

SEQ ID NO: 3821489 - RNA, 23 nt, Human
caaugucuugaugcaugcacugu

SEQ ID NO: 3821490 - RNA, 19 nt, Human
caaugugaaaagaaaaaug

SEQ ID NO: 3821491 - RNA, 15 nt, Human
caaugugaacuuuau

SEQ ID NO: 3821492 - RNA, 20 nt, Human
caagagcugcccuccuuguc

SEQ ID NO: 3821493 - RNA, 17 nt, Human
caagagcuuaacagugu

SEQ ID NO: 3821494 - RNA, 12 nt, Human
caagaggaauga

SEQ ID NO: 3821495 - RNA, 14 nt, Human
caagaggagccccc

SEQ ID NO: 3821496 - RNA, 16 nt, Human
caagaggcuccugucc

SEQ ID NO: 3821497 - RNA, 14 nt, Human
caagaggcugcagc

SEQ ID NO: 3821498 - RNA, 12 nt, Human
caagaggcuggu

SEQ ID NO: 3821499 - RNA, 13 nt, Human
caagaggcugguu

SEQ ID NO: 3821500 - RNA, 19 nt, Human
caagagggacgccuggggg

SEQ ID NO: 3821501 - RNA, 14 nt, Human
caagagggcacugg

SEQ ID NO: 3821502 - RNA, 17 nt, Human
caagagggcacuggugg

SEQ ID NO: 3821503 - RNA, 19 nt, Human
caagagggcacugguggcc

SEQ ID NO: 3821504 - RNA, 14 nt, Human
caagagggggugga

SEQ ID NO: 3821505 - RNA, 15 nt, Human
caagaggggguggag

SEQ ID NO: 3821506 - RNA, 18 nt, Human
caagaggggguggagggg

SEQ ID NO: 3821507 - RNA, 19 nt, Human
caagagguuuggcuccugc

SEQ ID NO: 3821508 - RNA, 19 nt, Human
caagaguaguuauauaauu

SEQ ID NO: 3821509 - RNA, 19 nt, Human
caagagugaauucccucac

SEQ ID NO: 3821510 - RNA, 17 nt, Human
caagaguggccccaccu

SEQ ID NO: 3821511 - RNA, 18 nt, Human
caagaguggccccaccug

SEQ ID NO: 3821512 - RNA, 21 nt, Human
caagaguggccccaccuggcc

SEQ ID NO: 3821513 - RNA, 23 nt, Human
caagaguggccccaccuggcccu

SEQ ID NO: 3821514 - RNA, 14 nt, Human
caagauaaacauua

SEQ ID NO: 3821515 - RNA, 15 nt, Human
caagauaaacauuau

SEQ ID NO: 3821516 - RNA, 16 nt, Human
caagauaacugagaau

SEQ ID NO: 3821517 - RNA, 16 nt, Human
caagauaccuaaaaga

SEQ ID NO: 3821518 - RNA, 12 nt, Human
caagauagaaag

SEQ ID NO: 3821519 - RNA, 19 nt, Human
caagauauuguacauaaaa

SEQ ID NO: 3821520 - RNA, 17 nt, Human
caagaucaaaaaggcuu

SEQ ID NO: 3821521 - RNA, 13 nt, Human
caagaucccauuu

SEQ ID NO: 3821522 - RNA, 19 nt, Human
caagauccugucuuuaagg

SEQ ID NO: 3821523 - RNA, 12 nt, Human
caagaucuuuca

SEQ ID NO: 3821524 - RNA, 20 nt, Human
caagaugaaauuccauuugu

SEQ ID NO: 3821525 - RNA, 20 nt, Human
caagaugccaucuguguccu

SEQ ID NO: 3821526 - RNA, 16 nt, Human
caagauggcacagggc

SEQ ID NO: 3821527 - RNA, 15 nt, Human
caagauggcccaucc

SEQ ID NO: 3821528 - RNA, 18 nt, Human
caagaugggggcagggcu

SEQ ID NO: 3821529 - RNA, 19 nt, Human
caagauguccuccuuguuc

SEQ ID NO: 3821530 - RNA, 21 nt, Human
caagauguccuccuuguucua

SEQ ID NO: 3821531 - RNA, 12 nt, Human
caagaugugaau

SEQ ID NO: 3821532 - RNA, 13 nt, Human
caagaugugaauu

SEQ ID NO: 3821533 - RNA, 14 nt, Human
caagaugugaauua

SEQ ID NO: 3821534 - RNA, 18 nt, Human
caagaugugaauuauuga

SEQ ID NO: 3821535 - RNA, 23 nt, Human
caagaugugaauuauugacacug

SEQ ID NO: 3821536 - RNA, 12 nt, Human
caagauuagaag

SEQ ID NO: 3821537 - RNA, 20 nt, Human
caagauuagaagcugaaaac

SEQ ID NO: 3821538 - RNA, 17 nt, Human
caagauucacaccugac

SEQ ID NO: 3821539 - RNA, 13 nt, Human
caagauucccaga

SEQ ID NO: 3821540 - RNA, 16 nt, Human
caagauucccagagac

SEQ ID NO: 3821541 - RNA, 14 nt, Human
caagauucccagga

SEQ ID NO: 3821542 - RNA, 19 nt, Human
caagauuccggauccuaag

SEQ ID NO: 3821543 - RNA, 22 nt, Human
caagauuccggauccuaagcau

SEQ ID NO: 3821544 - RNA, 17 nt, Human
caagauugagcucucug

SEQ ID NO: 3821545 - RNA, 23 nt, Human
caagauugagcucucugcccuug

SEQ ID NO: 3821546 - RNA, 21 nt, Human
caagauugcuuaaaauagcaa

SEQ ID NO: 3821547 - RNA, 21 nt, Human
caagauugguguuuuuuucua

SEQ ID NO: 3821548 - RNA, 20 nt, Human
caagauugugucccauuccc

SEQ ID NO: 3821549 - RNA, 18 nt, Human
caagauuuuaaagacaug

SEQ ID NO: 3821550 - RNA, 19 nt, Human
caagauuuuccuuuuuuau

SEQ ID NO: 3821551 - RNA, 21 nt, Human
caagauuuuccuuuuuuauac

SEQ ID NO: 3821552 - RNA, 17 nt, Human
caagauuuucuacuuuu

SEQ ID NO: 3821553 - RNA, 14 nt, Human
caagcaaauguuac

SEQ ID NO: 3821554 - RNA, 18 nt, Human
caagcaacacagaggaau

SEQ ID NO: 3821555 - RNA, 19 nt, Human
caagcaaccuggguccaaa

SEQ ID NO: 3821556 - RNA, 14 nt, Human
caagcaagacugag

SEQ ID NO: 3821557 - RNA, 14 nt, Human
caagcaaguauuag

SEQ ID NO: 3821558 - RNA, 14 nt, Human
caagcaauccuccc

SEQ ID NO: 3821559 - RNA, 17 nt, Human
caagcacagugccugca

SEQ ID NO: 3821560 - RNA, 16 nt, Human
caagcacagugguggc

SEQ ID NO: 3821561 - RNA, 20 nt, Human
caagcacagugguggcaggg

SEQ ID NO: 3821562 - RNA, 21 nt, Human
caagcacagugguggcagggc

SEQ ID NO: 3821563 - RNA, 18 nt, Human
caagcaccuagccucgcu

SEQ ID NO: 3821564 - RNA, 15 nt, Human
caagcaccuccugcc

SEQ ID NO: 3821565 - RNA, 12 nt, Human
caagcacugugc

SEQ ID NO: 3821566 - RNA, 11 nt, Human
caagcagagga

SEQ ID NO: 3821567 - RNA, 14 nt, Human
caagcagaggacca

SEQ ID NO: 3821568 - RNA, 19 nt, Human
caagcagauacugcugugu

SEQ ID NO: 3821569 - RNA, 12 nt, Human
caagcagauucg

SEQ ID NO: 3821570 - RNA, 12 nt, Human
caagcagccaag

SEQ ID NO: 3821571 - RNA, 14 nt, Human
caagcagccaagcu

SEQ ID NO: 3821572 - RNA, 21 nt, Human
caagcagccugagcaacucuu

SEQ ID NO: 3821573 - RNA, 18 nt, Human
caagcagcuuagaguugg

SEQ ID NO: 3821574 - RNA, 12 nt, Human
caagcaggaagc

SEQ ID NO: 3821575 - RNA, 13 nt, Human
caagcaggaagcu

SEQ ID NO: 3821576 - RNA, 15 nt, Human
caagcaggaagcuca

SEQ ID NO: 3821577 - RNA, 16 nt, Human
caagcaggaagcucag

SEQ ID NO: 3821578 - RNA, 17 nt, Human
caagcaggaagcucaga

SEQ ID NO: 3821579 - RNA, 21 nt, Human
caagcaggaagcucagacugg

SEQ ID NO: 3821580 - RNA, 12 nt, Human
caagcagggagg

SEQ ID NO: 3821581 - RNA, 15 nt, Human
caagcagguuagaga

SEQ ID NO: 3821582 - RNA, 16 nt, Human
caagcaguagacaagc

SEQ ID NO: 3821583 - RNA, 16 nt, Human
caagcagucgugccug

SEQ ID NO: 3821584 - RNA, 21 nt, Human
caagcagucgugccugugucc

SEQ ID NO: 3821585 - RNA, 17 nt, Human
caagcauauaaaauuuu

SEQ ID NO: 3821586 - RNA, 17 nt, Human
caagcaucuccugagga

SEQ ID NO: 3821587 - RNA, 22 nt, Human
caagcauggucccacaucccug

SEQ ID NO: 3821588 - RNA, 17 nt, Human
caagcauucagaagaaa

SEQ ID NO: 3821589 - RNA, 14 nt, Human
caagcauucugucu

SEQ ID NO: 3821590 - RNA, 19 nt, Human
caagcauuuagauguauag

SEQ ID NO: 3821591 - RNA, 23 nt, Human
caagccaaaguggcauguuuugu

SEQ ID NO: 3821592 - RNA, 14 nt, Human
caagccaagcagcc

SEQ ID NO: 3821593 - RNA, 15 nt, Human
caagccaauccccuc

SEQ ID NO: 3821594 - RNA, 19 nt, Human
caagccacaagucuuccag

SEQ ID NO: 3821595 - RNA, 20 nt, Human
caagccacaagucuuccaga

SEQ ID NO: 3821596 - RNA, 15 nt, Human
caagccagaggcugg

SEQ ID NO: 3821597 - RNA, 12 nt, Human
caagccagcaag

SEQ ID NO: 3821598 - RNA, 22 nt, Human
caagccagcgggaauggcagcu

SEQ ID NO: 3821599 - RNA, 17 nt, Human
caagccauguauaaaug

SEQ ID NO: 3821600 - RNA, 17 nt, Human
caagcccagcacugcuu

SEQ ID NO: 3821601 - RNA, 14 nt, Human
caagcccaggaggg

SEQ ID NO: 3821602 - RNA, 19 nt, Human
caauauuuuccaugaaaau

SEQ ID NO: 3821603 - RNA, 22 nt, Human
caauauuuuccaugaaaaugca

SEQ ID NO: 3821604 - RNA, 20 nt, Human
caauauuuucuuuaaugcuu

SEQ ID NO: 3821605 - RNA, 23 nt, Human
caauauuuuuauaucaugcaaaa

SEQ ID NO: 3821606 - RNA, 18 nt, Human
caaucaaaggaaaauagu

SEQ ID NO: 3821607 - RNA, 17 nt, Human
caaucaaauaaguauuu

SEQ ID NO: 3821608 - RNA, 23 nt, Human
caaucaaauaaguauuuauaaua

SEQ ID NO: 3821609 - RNA, 12 nt, Human
caaucaacacua

SEQ ID NO: 3821610 - RNA, 17 nt, Human
caaucaagauaaaggac

SEQ ID NO: 3821611 - RNA, 18 nt, Human
caaucaagguuauaauuu

SEQ ID NO: 3821612 - RNA, 21 nt, Human
caaucaauaacagccgcucca

SEQ ID NO: 3821613 - RNA, 18 nt, Human
caaucagcuccuuccugg

SEQ ID NO: 3821614 - RNA, 16 nt, Human
caaucaguauaauucu

SEQ ID NO: 3821615 - RNA, 19 nt, Human
caaucaguauguauucuuu

SEQ ID NO: 3821616 - RNA, 16 nt, Human
caaucaguccccuccc

SEQ ID NO: 3821617 - RNA, 13 nt, Human
caaucauauguga

SEQ ID NO: 3821618 - RNA, 15 nt, Human
caaucauaugugauc

SEQ ID NO: 3821619 - RNA, 17 nt, Human
caaucauaugugaucug

SEQ ID NO: 3821620 - RNA, 15 nt, Human
caaucaucuguguga

SEQ ID NO: 3821621 - RNA, 13 nt, Human
caaucaugucagu

SEQ ID NO: 3821622 - RNA, 15 nt, Human
caaucauuguacagu

SEQ ID NO: 3821623 - RNA, 21 nt, Human
caaucauuguacaguuuguuu

SEQ ID NO: 3821624 - RNA, 23 nt, Human
caaucauuguacaguuuguuuac

SEQ ID NO: 3821625 - RNA, 14 nt, Human
caaucauuucucac

SEQ ID NO: 3821626 - RNA, 18 nt, Human
caauccagauggugggau

SEQ ID NO: 3821627 - RNA, 16 nt, Human
caauccagguacgcac

SEQ ID NO: 3821628 - RNA, 20 nt, Human
caauccaguggacuucgcag

SEQ ID NO: 3821629 - RNA, 17 nt, Human
caauccauguaagguau

SEQ ID NO: 3821630 - RNA, 21 nt, Human
caauccauguuaguuuuuacu

SEQ ID NO: 3821631 - RNA, 18 nt, Human
caaucccaaaagucacca

SEQ ID NO: 3821632 - RNA, 16 nt, Human
caaucccaccaacccu

SEQ ID NO: 3821633 - RNA, 22 nt, Human
caaucccaccaacccucagagc

SEQ ID NO: 3821634 - RNA, 14 nt, Human
caauccccuccuug

SEQ ID NO: 3821635 - RNA, 20 nt, Human
caaucccuuuauuacccccu

SEQ ID NO: 3821636 - RNA, 14 nt, Human
caauccucacuggg

SEQ ID NO: 3821637 - RNA, 18 nt, Human
caauccucacuggguggg

SEQ ID NO: 3821638 - RNA, 22 nt, Human
caauccucccacuucagccucc

SEQ ID NO: 3821639 - RNA, 15 nt, Human
caauccucccagaaa

SEQ ID NO: 3821640 - RNA, 19 nt, Human
caauccuggcucuguggcu

SEQ ID NO: 3821641 - RNA, 18 nt, Human
caauccugugggugaaga

SEQ ID NO: 3821642 - RNA, 22 nt, Human
caauccugugugguuuagugua

SEQ ID NO: 3821643 - RNA, 14 nt, Human
caauccuuacaaau

SEQ ID NO: 3821644 - RNA, 20 nt, Human
caauccuuacaaaugauugc

SEQ ID NO: 3821645 - RNA, 20 nt, Human
caaucuauuaauagcugccu

SEQ ID NO: 3821646 - RNA, 22 nt, Human
caaucuauuaauagcugccuua

SEQ ID NO: 3821647 - RNA, 13 nt, Human
caaucuauuauuu

SEQ ID NO: 3821648 - RNA, 20 nt, Human
caaucucaaauucucaaccu

SEQ ID NO: 3821649 - RNA, 14 nt, Human
caaucucaaggaau

SEQ ID NO: 3821650 - RNA, 20 nt, Human
caaucucaaggaaucuuuaa

SEQ ID NO: 3821651 - RNA, 17 nt, Human
caaucucccgcugcugc

SEQ ID NO: 3821652 - RNA, 18 nt, Human
caaucucggcucacugca

SEQ ID NO: 3821653 - RNA, 22 nt, Human
caaucucguauagaagucuuca

SEQ ID NO: 3821654 - RNA, 22 nt, Human
caaucucuucauuauucucugc

SEQ ID NO: 3821655 - RNA, 17 nt, Human
caaucucuuuuuguuug

SEQ ID NO: 3821656 - RNA, 20 nt, Human
caaucugaagauacaugucu

SEQ ID NO: 3821657 - RNA, 16 nt, Human
caaucuggauucauau

SEQ ID NO: 3821658 - RNA, 20 nt, Human
caaucuggauucauauuuaa

SEQ ID NO: 3821659 - RNA, 18 nt, Human
caaucuguaaaacuaaga

SEQ ID NO: 3821660 - RNA, 15 nt, Human
caaucuguaaacugu

SEQ ID NO: 3821661 - RNA, 14 nt, Human
caaucuuacuuugu

SEQ ID NO: 3821662 - RNA, 16 nt, Human
caaucuuacuuuguaa

SEQ ID NO: 3821663 - RNA, 19 nt, Human
caaucuuacuuuguaaauu

SEQ ID NO: 3821664 - RNA, 23 nt, Human
caaucuuacuuuguaaauucuga

SEQ ID NO: 3821665 - RNA, 15 nt, Human
caaucuucaauccuu

SEQ ID NO: 3821666 - RNA, 12 nt, Human
caaucuuguuuc

SEQ ID NO: 3821667 - RNA, 16 nt, Human
caaucuuugaaagacu

SEQ ID NO: 3821668 - RNA, 19 nt, Human
caaugaaaacucuuugcug

SEQ ID NO: 3821669 - RNA, 18 nt, Human
caaugaaagguacuauau

SEQ ID NO: 3821670 - RNA, 19 nt, Human
caaugaaauauugcuguau

SEQ ID NO: 3821671 - RNA, 19 nt, Human
caaugaaaugaauuaaagu

SEQ ID NO: 3821672 - RNA, 21 nt, Human
caaugaaaugcucuccuuucc

SEQ ID NO: 3821673 - RNA, 17 nt, Human
caaugaaccauaaauuc

SEQ ID NO: 3821674 - RNA, 23 nt, Human
caaugaauuuuauaaucugcagc

SEQ ID NO: 3821675 - RNA, 14 nt, Human
caaugacaaagcag

SEQ ID NO: 3821676 - RNA, 15 nt, Human
caaugacaaagcaga

SEQ ID NO: 3821677 - RNA, 14 nt, Human
caaugacacagucu

SEQ ID NO: 3821678 - RNA, 19 nt, Human
caaugacacagucuuggcu

SEQ ID NO: 3821679 - RNA, 19 nt, Human
caaugacaucucaggggcc

SEQ ID NO: 3821680 - RNA, 12 nt, Human
caaugacaugaa

SEQ ID NO: 3821681 - RNA, 20 nt, Human
caaugacaugaauuuuagcu

SEQ ID NO: 3821682 - RNA, 13 nt, Human
caaugaccuuuca

SEQ ID NO: 3821683 - RNA, 14 nt, Human
caaugaccuuucaa

SEQ ID NO: 3821684 - RNA, 15 nt, Human
caaugaccuuucaau

SEQ ID NO: 3821685 - RNA, 16 nt, Human
caaugaccuuucaaua

SEQ ID NO: 3821686 - RNA, 14 nt, Human
caaugacuaauucu

SEQ ID NO: 3821687 - RNA, 21 nt, Human
caaugacuaauucuugcauau

SEQ ID NO: 3821688 - RNA, 17 nt, Human
caaugacuuacuguaca

SEQ ID NO: 3821689 - RNA, 19 nt, Human
caaugagagcauaauuuaa

SEQ ID NO: 3821690 - RNA, 16 nt, Human
caaugagcuuucugaa

SEQ ID NO: 3821691 - RNA, 23 nt, Human
caaugagcuuucugaacagcugg

SEQ ID NO: 3821692 - RNA, 18 nt, Human
caaugaggucugaaaugg

SEQ ID NO: 3821693 - RNA, 20 nt, Human
caaugauauauggauaaugc

SEQ ID NO: 3821694 - RNA, 14 nt, Human
caaugaucuagguu

SEQ ID NO: 3821695 - RNA, 17 nt, Human
caaugaucuagguuuaa

SEQ ID NO: 3821696 - RNA, 20 nt, Human
caaugaucuagguuuaacuc

SEQ ID NO: 3821697 - RNA, 14 nt, Human
augaagaaaauacu

SEQ ID NO: 3821698 - RNA, 17 nt, Human
augaagaaaauacuuaa

SEQ ID NO: 3821699 - RNA, 20 nt, Human
augaagaaaauacuuaaaug

SEQ ID NO: 3821700 - RNA, 21 nt, Human
augaagaaguugauaugccuu

SEQ ID NO: 3821701 - RNA, 14 nt, Human
augaagaauagaaa

SEQ ID NO: 3821702 - RNA, 16 nt, Human
augaagaauagaaaca

SEQ ID NO: 3821703 - RNA, 13 nt, Human
augaagaauuuaa

SEQ ID NO: 3821704 - RNA, 14 nt, Human
augaagacaaaaca

SEQ ID NO: 3821705 - RNA, 16 nt, Human
augaagacaggacagu

SEQ ID NO: 3821706 - RNA, 21 nt, Human
augaagacaggacagugcuuc

SEQ ID NO: 3821707 - RNA, 21 nt, Human
augaagacuguuaaaugaaac

SEQ ID NO: 3821708 - RNA, 22 nt, Human
augaagacuguuaaaugaaacc

SEQ ID NO: 3821709 - RNA, 16 nt, Human
augaagagauuuuuca

SEQ ID NO: 3821710 - RNA, 11 nt, Human
augaagaggag

SEQ ID NO: 3821711 - RNA, 22 nt, Human
augaagauauuugcuuuaauaa

SEQ ID NO: 3821712 - RNA, 21 nt, Human
augaagaugucuaauaguuau

SEQ ID NO: 3821713 - RNA, 22 nt, Human
augaagauguuucaaaaaaucu

SEQ ID NO: 3821714 - RNA, 19 nt, Human
augaagauucuccugugcu

SEQ ID NO: 3821715 - RNA, 14 nt, Human
augaagcaaugcuu

SEQ ID NO: 3821716 - RNA, 15 nt, Human
augaagcaaugcuuc

SEQ ID NO: 3821717 - RNA, 15 nt, Human
augaagcagcuuuaa

SEQ ID NO: 3821718 - RNA, 13 nt, Human
augaagcaguauu

SEQ ID NO: 3821719 - RNA, 17 nt, Human
augaagccacagcccag

SEQ ID NO: 3821720 - RNA, 12 nt, Human
augaagccagcu

SEQ ID NO: 3821721 - RNA, 15 nt, Human
augaagcccaaguga

SEQ ID NO: 3821722 - RNA, 16 nt, Human
augaagcccaauaaac

SEQ ID NO: 3821723 - RNA, 23 nt, Human
augaagccgaccuuagauuuagu

SEQ ID NO: 3821724 - RNA, 20 nt, Human
augaagccuccuuagaaaaa

SEQ ID NO: 3821725 - RNA, 11 nt, Human
augaagccuuu

SEQ ID NO: 3821726 - RNA, 23 nt, Human
augaagcucaccuguugcuuaca

SEQ ID NO: 3821727 - RNA, 15 nt, Human
augaagcuuguguau

SEQ ID NO: 3821728 - RNA, 21 nt, Human
augaaggagaggcaacaucca

SEQ ID NO: 3821729 - RNA, 17 nt, Human
augaaggcuuuuggucu

SEQ ID NO: 3821730 - RNA, 15 nt, Human
augaagggcccgaga

SEQ ID NO: 3821731 - RNA, 17 nt, Human
augaagguuuuuguaaa

SEQ ID NO: 3821732 - RNA, 21 nt, Human
augaagguuuuuguaaagauu

SEQ ID NO: 3821733 - RNA, 21 nt, Human
augaaguaaagaacugcacau

SEQ ID NO: 3821734 - RNA, 14 nt, Human
augaaguaauaugc

SEQ ID NO: 3821735 - RNA, 21 nt, Human
augaaguacucauacauguua

SEQ ID NO: 3821736 - RNA, 17 nt, Human
augaaguaucuaaaagu

SEQ ID NO: 3821737 - RNA, 20 nt, Human
augaaguccaagcauuuaga

SEQ ID NO: 3821738 - RNA, 23 nt, Human
augaaguccaagcauuuagaugu

SEQ ID NO: 3821739 - RNA, 18 nt, Human
augaagucguugugaggg

SEQ ID NO: 3821740 - RNA, 14 nt, Human
augaagucucugaa

SEQ ID NO: 3821741 - RNA, 20 nt, Human
augaagugcgugaauguaug

SEQ ID NO: 3821742 - RNA, 18 nt, Human
augaaguguuagauagaa

SEQ ID NO: 3821743 - RNA, 17 nt, Human
augaaguuacuuucuua

SEQ ID NO: 3821744 - RNA, 16 nt, Human
augaaguugaaaauca

SEQ ID NO: 3821745 - RNA, 14 nt, Human
augaaguuuauaca

SEQ ID NO: 3821746 - RNA, 11 nt, Human
augagaaacug

SEQ ID NO: 3821747 - RNA, 14 nt, Human
augagaaagccuuc

SEQ ID NO: 3821748 - RNA, 15 nt, Human
augagaaauacaaaa

SEQ ID NO: 3821749 - RNA, 22 nt, Human
augagaaauacaaaaauacuca

SEQ ID NO: 3821750 - RNA, 15 nt, Human
augagaaaucuaaaa

SEQ ID NO: 3821751 - RNA, 18 nt, Human
augagaaaucuaaaaaac

SEQ ID NO: 3821752 - RNA, 14 nt, Human
augagaacaaagcu

SEQ ID NO: 3821753 - RNA, 16 nt, Human
augagaacaaagcugu

SEQ ID NO: 3821754 - RNA, 13 nt, Human
augagaacagacu

SEQ ID NO: 3821755 - RNA, 17 nt, Human
augagaacagauaaaga

SEQ ID NO: 3821756 - RNA, 22 nt, Human
augagaacagauaaagauugug

SEQ ID NO: 3821757 - RNA, 23 nt, Human
augagaagaaaauggaaccaggc

SEQ ID NO: 3821758 - RNA, 15 nt, Human
augagaagagggccu

SEQ ID NO: 3821759 - RNA, 16 nt, Human
augagaagagggccug

SEQ ID NO: 3821760 - RNA, 16 nt, Human
augagaaggaacuucc

SEQ ID NO: 3821761 - RNA, 22 nt, Human
augagaaguugauauagaacag

SEQ ID NO: 3821762 - RNA, 19 nt, Human
augagaauucagcugcccc

SEQ ID NO: 3821763 - RNA, 18 nt, Human
augagacaggaccuagga

SEQ ID NO: 3821764 - RNA, 18 nt, Human
augagaccacuguuauca

SEQ ID NO: 3821765 - RNA, 17 nt, Human
augagacucuagggucc

SEQ ID NO: 3821766 - RNA, 17 nt, Human
augagagacacacugaa

SEQ ID NO: 3821767 - RNA, 16 nt, Human
augagagcauaauuua

SEQ ID NO: 3821768 - RNA, 14 nt, Human
augagagcccagag

SEQ ID NO: 3821769 - RNA, 18 nt, Human
augagagcccagagguaa

SEQ ID NO: 3821770 - RNA, 14 nt, Human
augagaggaaauca

SEQ ID NO: 3821771 - RNA, 15 nt, Human
augagaggaaaucac

SEQ ID NO: 3821772 - RNA, 18 nt, Human
augagagggcaguguuuc

SEQ ID NO: 3821773 - RNA, 20 nt, Human
augagaguuuuggaugcagu

SEQ ID NO: 3821774 - RNA, 21 nt, Human
augagaguuuuggaugcagug

SEQ ID NO: 3821775 - RNA, 15 nt, Human
augagauagaagaug

SEQ ID NO: 3821776 - RNA, 18 nt, Human
augagaucaggcucugcc

SEQ ID NO: 3821777 - RNA, 23 nt, Human
augagaucuaagccuuuccauaa

SEQ ID NO: 3821778 - RNA, 14 nt, Human
augagaugcuggcu

SEQ ID NO: 3821779 - RNA, 15 nt, Human
augagaugcuggcuu

SEQ ID NO: 3821780 - RNA, 14 nt, Human
augagaugugugga

SEQ ID NO: 3821781 - RNA, 13 nt, Human
augagauugaauu

SEQ ID NO: 3821782 - RNA, 16 nt, Human
augagauuuuuaaaaa

SEQ ID NO: 3821783 - RNA, 20 nt, Human
augagauuuuuaaaaaauau

SEQ ID NO: 3821784 - RNA, 16 nt, Human
augagcaucaggccag

SEQ ID NO: 3821785 - RNA, 17 nt, Human
augagcaucaggccagg

SEQ ID NO: 3821786 - RNA, 18 nt, Human
augagcaucaggccaggc

SEQ ID NO: 3821787 - RNA, 20 nt, Human
augagcaucaggccaggccc

SEQ ID NO: 3821788 - RNA, 22 nt, Human
augagcaucaggccaggcccuc

SEQ ID NO: 3821789 - RNA, 15 nt, Human
augagcaucccagga

SEQ ID NO: 3821790 - RNA, 16 nt, Human
augagcauccugagcc

SEQ ID NO: 3821791 - RNA, 20 nt, Human
augagcauccugagccccgc

SEQ ID NO: 3821792 - RNA, 14 nt, Human
augagcauguuuag

SEQ ID NO: 3821793 - RNA, 23 nt, Human
augagcauuggauacagcaguag

SEQ ID NO: 3821794 - RNA, 18 nt, Human
augagccaccgcgcccag

SEQ ID NO: 3821795 - RNA, 11 nt, Human
augagccagac

SEQ ID NO: 3821796 - RNA, 14 nt, Human
augagcccagagaa

SEQ ID NO: 3821797 - RNA, 14 nt, Human
augagcccuaaaaa

SEQ ID NO: 3821798 - RNA, 15 nt, Human
augagccgcccaagg

SEQ ID NO: 3821799 - RNA, 16 nt, Human
augagccuacgcugaa

SEQ ID NO: 3821800 - RNA, 16 nt, Human
augagccucagcaucc

SEQ ID NO: 3821801 - RNA, 18 nt, Human
augagccucagcauccug

SEQ ID NO: 3821802 - RNA, 12 nt, Human
augagccugcug

SEQ ID NO: 3821803 - RNA, 20 nt, Human
augagccugcuggaagccca

SEQ ID NO: 3821804 - RNA, 14 nt, Human
augagccuggcaag

SEQ ID NO: 3821805 - RNA, 20 nt, Human
augagcuauuuccauuccag

SEQ ID NO: 3821806 - RNA, 23 nt, Human
augagcuauuuccauuccagaau

SEQ ID NO: 3821807 - RNA, 14 nt, Human
augagcuccagacc

SEQ ID NO: 3821808 - RNA, 15 nt, Human
augagcuccagaccc

SEQ ID NO: 3821809 - RNA, 17 nt, Human
augagcuccagaccccc

SEQ ID NO: 3821810 - RNA, 20 nt, Human
augagcucccacaagccuga

SEQ ID NO: 3821811 - RNA, 14 nt, Human
augagcuccucuuc

SEQ ID NO: 3821812 - RNA, 21 nt, Human
augagcucgcauuugucaaug

SEQ ID NO: 3821813 - RNA, 15 nt, Human
augagcucuacccag

SEQ ID NO: 3821814 - RNA, 18 nt, Human
augagcucuacccagggc

SEQ ID NO: 3821815 - RNA, 19 nt, Human
augagcucuacccagggcc

SEQ ID NO: 3821816 - RNA, 19 nt, Human
augagcucugaaaucuucc

SEQ ID NO: 3821817 - RNA, 16 nt, Human
augagcucuucauguu

SEQ ID NO: 3821818 - RNA, 12 nt, Human
augagcugaggg

SEQ ID NO: 3821819 - RNA, 17 nt, Human
augagcugaucugcgga

SEQ ID NO: 3821820 - RNA, 22 nt, Human
augagcugugcacaaaguggca

SEQ ID NO: 3821821 - RNA, 14 nt, Human
augagcuuaagaaa

SEQ ID NO: 3821822 - RNA, 15 nt, Human
augagcuugauuaaa

SEQ ID NO: 3821823 - RNA, 18 nt, Human
augagcuuuauguaauaa

SEQ ID NO: 3821824 - RNA, 22 nt, Human
augagcuuuauguaauaaugug

SEQ ID NO: 3821825 - RNA, 14 nt, Human
augagcuuucugaa

SEQ ID NO: 3821826 - RNA, 23 nt, Human
augagcuuucugaacagcuggug

SEQ ID NO: 3821827 - RNA, 19 nt, Human
augaggaaaauucuuaaaa

SEQ ID NO: 3821828 - RNA, 16 nt, Human
augaggaacuguagau

SEQ ID NO: 3821829 - RNA, 15 nt, Human
augaggaauguauau

SEQ ID NO: 3821830 - RNA, 18 nt, Human
augaggagagaaaauaua

SEQ ID NO: 3821831 - RNA, 19 nt, Human
augaggagagaaaauauau

SEQ ID NO: 3821832 - RNA, 21 nt, Human
augaggaggaugucccugggc

SEQ ID NO: 3821833 - RNA, 15 nt, Human
augaggaggggaggg

SEQ ID NO: 3821834 - RNA, 19 nt, Human
augaggagugaacauuugg

SEQ ID NO: 3821835 - RNA, 20 nt, Human
augaggaugcagagucagca

SEQ ID NO: 3821836 - RNA, 18 nt, Human
augaggcaaccugauugu

SEQ ID NO: 3821837 - RNA, 13 nt, Human
augaggcauuugu

SEQ ID NO: 3821838 - RNA, 21 nt, Human
augaggcauuuguuugaacug

SEQ ID NO: 3821839 - RNA, 12 nt, Human
augaggccagac

SEQ ID NO: 3821840 - RNA, 21 nt, Human
augaggccauggacucugucc

SEQ ID NO: 3821841 - RNA, 18 nt, Human
augaggccucaguggacu

SEQ ID NO: 3821842 - RNA, 22 nt, Human
augaggccucuuggaccucugc

SEQ ID NO: 3821843 - RNA, 16 nt, Human
augagggagaugccau

SEQ ID NO: 3821844 - RNA, 17 nt, Human
augagggaugggccugg

SEQ ID NO: 3821845 - RNA, 18 nt, Human
augagggcagcagccagc

SEQ ID NO: 3821846 - RNA, 19 nt, Human
augagggcagcagccagcc

SEQ ID NO: 3821847 - RNA, 23 nt, Human
augagggcagcagccagcccugc

SEQ ID NO: 3821848 - RNA, 11 nt, Human
augaggggaga

SEQ ID NO: 3821849 - RNA, 14 nt, Human
augaggggagagga

SEQ ID NO: 3821850 - RNA, 14 nt, Human
augagggggcucag

SEQ ID NO: 3821851 - RNA, 15 nt, Human
augagguacugagag

SEQ ID NO: 3821852 - RNA, 15 nt, Human
augaggucccaggca

SEQ ID NO: 3821853 - RNA, 17 nt, Human
augaggucccaggcaga

SEQ ID NO: 3821854 - RNA, 18 nt, Human
augaggucccaggcagag

SEQ ID NO: 3821855 - RNA, 13 nt, Human
augaggucuguuu

SEQ ID NO: 3821856 - RNA, 17 nt, Human
augaggugcugggaggg

SEQ ID NO: 3821857 - RNA, 19 nt, Human
augaggugcugggagggau

SEQ ID NO: 3821858 - RNA, 22 nt, Human
augagguucaacuguugauugc

SEQ ID NO: 3821859 - RNA, 18 nt, Human
augagguugcuuacuaag

SEQ ID NO: 3821860 - RNA, 17 nt, Human
augaguaacauuugcug

SEQ ID NO: 3821861 - RNA, 14 nt, Human
augaguacaaaugc

SEQ ID NO: 3821862 - RNA, 13 nt, Human
caauuccucuggg

SEQ ID NO: 3821863 - RNA, 13 nt, Human
caauuccugggcc

SEQ ID NO: 3821864 - RNA, 16 nt, Human
caauucgauauccgga

SEQ ID NO: 3821865 - RNA, 16 nt, Human
caauucuagucauaua

SEQ ID NO: 3821866 - RNA, 23 nt, Human
caauucucauuugucacacacuu

SEQ ID NO: 3821867 - RNA, 19 nt, Human
caauucucccgggacucug

SEQ ID NO: 3821868 - RNA, 20 nt, Human
caauucucccgggacucugc

SEQ ID NO: 3821869 - RNA, 13 nt, Human
caauucuccugcc

SEQ ID NO: 3821870 - RNA, 15 nt, Human
caauucuccugccuc

SEQ ID NO: 3821871 - RNA, 16 nt, Human
caauucuccugccuca

SEQ ID NO: 3821872 - RNA, 17 nt, Human
caauucuccugccucag

SEQ ID NO: 3821873 - RNA, 17 nt, Human
caauucuccugccuuug

SEQ ID NO: 3821874 - RNA, 17 nt, Human
caauucuucccuaucuu

SEQ ID NO: 3821875 - RNA, 21 nt, Human
caauucuucccuaucuuugcc

SEQ ID NO: 3821876 - RNA, 16 nt, Human
caauucuuuauacaac

SEQ ID NO: 3821877 - RNA, 19 nt, Human
caauucuuuauacaacagu

SEQ ID NO: 3821878 - RNA, 15 nt, Human
caauugaaguaaacu

SEQ ID NO: 3821879 - RNA, 19 nt, Human
caauugacugucacuguuc

SEQ ID NO: 3821880 - RNA, 21 nt, Human
caauugcacgcggagugaguu

SEQ ID NO: 3821881 - RNA, 23 nt, Human
caauugcacgcggagugaguuuu

SEQ ID NO: 3821882 - RNA, 15 nt, Human
caauugcaucuccca

SEQ ID NO: 3821883 - RNA, 17 nt, Human
caauugcaucucccaga

SEQ ID NO: 3821884 - RNA, 22 nt, Human
caauugcuuugucauauagcug

SEQ ID NO: 3821885 - RNA, 17 nt, Human
caauugggagcugccaa

SEQ ID NO: 3821886 - RNA, 16 nt, Human
caauugguuaaucuuu

SEQ ID NO: 3821887 - RNA, 16 nt, Human
caauugucacuuuuua

SEQ ID NO: 3821888 - RNA, 13 nt, Human
caauugucuuuuu

SEQ ID NO: 3821889 - RNA, 22 nt, Human
caauugugaaaaaauuuacuuu

SEQ ID NO: 3821890 - RNA, 15 nt, Human
caauugugcugccau

SEQ ID NO: 3821891 - RNA, 19 nt, Human
cacagggcagcugggccca

SEQ ID NO: 3821892 - RNA, 23 nt, Human
cacagggcaugccccggccaccu

SEQ ID NO: 3821893 - RNA, 19 nt, Human
cacagggccccagaaggca

SEQ ID NO: 3821894 - RNA, 21 nt, Human
cacagggccuuuggcaggugc

SEQ ID NO: 3821895 - RNA, 13 nt, Human
cacagggcuaaga

SEQ ID NO: 3821896 - RNA, 19 nt, Human
cacaggggaaaagaggagu

SEQ ID NO: 3821897 - RNA, 15 nt, Human
cacagggucccacag

SEQ ID NO: 3821898 - RNA, 18 nt, Human
cacagggucccacagcca

SEQ ID NO: 3821899 - RNA, 14 nt, Human
cacagggucugcac

SEQ ID NO: 3821900 - RNA, 15 nt, Human
cacagggucugcucu

SEQ ID NO: 3821901 - RNA, 17 nt, Human
cacagggucugcucuuu

SEQ ID NO: 3821902 - RNA, 14 nt, Human
cacagggugggccu

SEQ ID NO: 3821903 - RNA, 16 nt, Human
cacagggugggccucg

SEQ ID NO: 3821904 - RNA, 21 nt, Human
cacaggguucaaaaugucugu

SEQ ID NO: 3821905 - RNA, 22 nt, Human
cacaggguugggcccagaucug

SEQ ID NO: 3821906 - RNA, 23 nt, Human
cacaggguugggcccagaucugg

SEQ ID NO: 3821907 - RNA, 23 nt, Human
cacaggucaggggugacacagac

SEQ ID NO: 3821908 - RNA, 15 nt, Human
cacaggucuuuccua

SEQ ID NO: 3821909 - RNA, 19 nt, Human
cacaggugcaacagacuug

SEQ ID NO: 3821910 - RNA, 15 nt, Human
cacaggugcccgcca

SEQ ID NO: 3821911 - RNA, 20 nt, Human
cacagguggugucacugucc

SEQ ID NO: 3821912 - RNA, 21 nt, Human
cacagguggugucacuguccc

SEQ ID NO: 3821913 - RNA, 16 nt, Human
cacaggugugguguaa

SEQ ID NO: 3821914 - RNA, 21 nt, Human
cacagguuggaagagaaucac

SEQ ID NO: 3821915 - RNA, 14 nt, Human
cacaguaaaaauaa

SEQ ID NO: 3821916 - RNA, 21 nt, Human
cacaguaaaaauggaaacuau

SEQ ID NO: 3821917 - RNA, 18 nt, Human
augcuaagagaaguagaa

SEQ ID NO: 3821918 - RNA, 22 nt, Human
augcuaagagaaguagaaauca

SEQ ID NO: 3821919 - RNA, 21 nt, Human
augcuaagcaagcuaaccuua

SEQ ID NO: 3821920 - RNA, 21 nt, Human
augcuaauauaaguuucuuug

SEQ ID NO: 3821921 - RNA, 17 nt, Human
augcuaauauuaaaagu

SEQ ID NO: 3821922 - RNA, 17 nt, Human
augcuaaucuugugaaa

SEQ ID NO: 3821923 - RNA, 17 nt, Human
augcuaauuuaaagaga

SEQ ID NO: 3821924 - RNA, 17 nt, Human
augcuacacacugcaug

SEQ ID NO: 3821925 - RNA, 16 nt, Human
augcuaccaccagcug

SEQ ID NO: 3821926 - RNA, 14 nt, Human
augcuacgugugau

SEQ ID NO: 3821927 - RNA, 15 nt, Human
augcuacgugugauu

SEQ ID NO: 3821928 - RNA, 19 nt, Human
augcuacgugugauuuuuc

SEQ ID NO: 3821929 - RNA, 22 nt, Human
augcuacgugugauuuuucugg

SEQ ID NO: 3821930 - RNA, 23 nt, Human
augcuacugucucacugaaacau

SEQ ID NO: 3821931 - RNA, 17 nt, Human
augcuagcgcguugccu

SEQ ID NO: 3821932 - RNA, 19 nt, Human
augcuagcgcguugccugu

SEQ ID NO: 3821933 - RNA, 21 nt, Human
augcuaggaugcggaaauccc

SEQ ID NO: 3821934 - RNA, 19 nt, Human
augcuauaacuauguugau

SEQ ID NO: 3821935 - RNA, 14 nt, Human
augcuauugacaau

SEQ ID NO: 3821936 - RNA, 15 nt, Human
augcuauugacaaua

SEQ ID NO: 3821937 - RNA, 17 nt, Human
augcuauugacaauaaa

SEQ ID NO: 3821938 - RNA, 18 nt, Human
augcuauugacaauaaaa

SEQ ID NO: 3821939 - RNA, 20 nt, Human
augcuauuucuauauuuuca

SEQ ID NO: 3821940 - RNA, 21 nt, Human
augcuauuucuauauuuucau

SEQ ID NO: 3821941 - RNA, 13 nt, Human
augcuauuugaac

SEQ ID NO: 3821942 - RNA, 21 nt, Human
augcuauuugcaauuccugcu

SEQ ID NO: 3821943 - RNA, 15 nt, Human
augcucaaagaaauc

SEQ ID NO: 3821944 - RNA, 16 nt, Human
augcucaaguuuuuca

SEQ ID NO: 3821945 - RNA, 17 nt, Human
augcucagaccagcucu

SEQ ID NO: 3821946 - RNA, 18 nt, Human
augcucagcccugacugg

SEQ ID NO: 3821947 - RNA, 13 nt, Human
augcucaggcuac

SEQ ID NO: 3821948 - RNA, 12 nt, Human
augcucaggggc

SEQ ID NO: 3821949 - RNA, 18 nt, Human
augcucagguacagagaa

SEQ ID NO: 3821950 - RNA, 16 nt, Human
augcucauaacggauc

SEQ ID NO: 3821951 - RNA, 19 nt, Human
augcuccaagauucuagau

SEQ ID NO: 3821952 - RNA, 20 nt, Human
augcuccaagauucuagaug

SEQ ID NO: 3821953 - RNA, 17 nt, Human
augcuccagccaacccc

SEQ ID NO: 3821954 - RNA, 18 nt, Human
augcuccagccaaccccu

SEQ ID NO: 3821955 - RNA, 21 nt, Human
augcuccagccaaccccugug

SEQ ID NO: 3821956 - RNA, 13 nt, Human
augcuccagucaa

SEQ ID NO: 3821957 - RNA, 12 nt, Human
augcuccccaca

SEQ ID NO: 3821958 - RNA, 23 nt, Human
augcucccccauccuccccuucc

SEQ ID NO: 3821959 - RNA, 19 nt, Human
augcucccuccccugcccu

SEQ ID NO: 3821960 - RNA, 13 nt, Human
augcuccucuucc

SEQ ID NO: 3821961 - RNA, 14 nt, Human
augcuccucuuccc

SEQ ID NO: 3821962 - RNA, 16 nt, Human
augcuccucuucccca

SEQ ID NO: 3821963 - RNA, 14 nt, Human
augcuccuggccca

SEQ ID NO: 3821964 - RNA, 19 nt, Human
augcuccuggcccacugca

SEQ ID NO: 3821965 - RNA, 22 nt, Human
augcucucacuguuuguuuuua

SEQ ID NO: 3821966 - RNA, 19 nt, Human
augcucuccaaaccacuuu

SEQ ID NO: 3821967 - RNA, 19 nt, Human
augcucucucaaauuguca

SEQ ID NO: 3821968 - RNA, 16 nt, Human
augcucuuaauugcca

SEQ ID NO: 3821969 - RNA, 19 nt, Human
augcucuuaauugccaccu

SEQ ID NO: 3821970 - RNA, 15 nt, Human
augcucuuauuucau

SEQ ID NO: 3821971 - RNA, 17 nt, Human
augcucuuauuucauca

SEQ ID NO: 3821972 - RNA, 15 nt, Human
augcucuucugugga

SEQ ID NO: 3821973 - RNA, 21 nt, Human
augcucuugaccuuguagaga

SEQ ID NO: 3821974 - RNA, 12 nt, Human
augcucuuuccc

SEQ ID NO: 3821975 - RNA, 21 nt, Human
augcucuuucccacccagccu

SEQ ID NO: 3821976 - RNA, 23 nt, Human
augcucuuucccacccagccugg

SEQ ID NO: 3821977 - RNA, 18 nt, Human
augcucuuuuuuacucau

SEQ ID NO: 3821978 - RNA, 22 nt, Human
augcucuuuuuuacucauugaa

SEQ ID NO: 3821979 - RNA, 23 nt, Human
augcucuuuuuuacucauugaaa

SEQ ID NO: 3821980 - RNA, 12 nt, Human
augcugaaaaug

SEQ ID NO: 3821981 - RNA, 22 nt, Human
augcugaaaauugccuuucugu

SEQ ID NO: 3821982 - RNA, 19 nt, Human
augcugacauucaccugcc

SEQ ID NO: 3821983 - RNA, 20 nt, Human
augcugacauucaccugccc

SEQ ID NO: 3821984 - RNA, 19 nt, Human
augcugacccaugggcagg

SEQ ID NO: 3821985 - RNA, 19 nt, Human
augcugacuguacuccucc

SEQ ID NO: 3821986 - RNA, 20 nt, Human
augcugacuguacuccuccc

SEQ ID NO: 3821987 - RNA, 21 nt, Human
augcugagauuacagguguga

SEQ ID NO: 3821988 - RNA, 17 nt, Human
augcugaggguguuucu

SEQ ID NO: 3821989 - RNA, 14 nt, Human
augcugagucuccc

SEQ ID NO: 3821990 - RNA, 14 nt, Human
augcugaucaucgc

SEQ ID NO: 3821991 - RNA, 17 nt, Human
augcugaugaaucacug

SEQ ID NO: 3821992 - RNA, 19 nt, Human
augcugaugaaucacuguu

SEQ ID NO: 3821993 - RNA, 21 nt, Human
augcugaugaaucacuguuuu

SEQ ID NO: 3821994 - RNA, 16 nt, Human
augcugauguccucac

SEQ ID NO: 3821995 - RNA, 12 nt, Human
augcugauguuc

SEQ ID NO: 3821996 - RNA, 15 nt, Human
augcugauguucagu

SEQ ID NO: 3821997 - RNA, 20 nt, Human
augcugauguucaguguaau

SEQ ID NO: 3821998 - RNA, 15 nt, Human
augcugcaacaaaau

SEQ ID NO: 3821999 - RNA, 19 nt, Human
augcugcacagauggauuu

SEQ ID NO: 3822000 - RNA, 23 nt, Human
augcugcauuuuaauuuuaacca

SEQ ID NO: 3822001 - RNA, 17 nt, Human
augcugccaauauccua

SEQ ID NO: 3822002 - RNA, 19 nt, Human
augcugccaauauccuaau

SEQ ID NO: 3822003 - RNA, 21 nt, Human
augcugccaauauccuaauaa

SEQ ID NO: 3822004 - RNA, 23 nt, Human
augcugccaauauccuaauaaaa

SEQ ID NO: 3822005 - RNA, 15 nt, Human
augcugccuccagaa

SEQ ID NO: 3822006 - RNA, 23 nt, Human
augcugccuucccaugaaucugu

SEQ ID NO: 3822007 - RNA, 18 nt, Human
augcugccuuuucuuuaa

SEQ ID NO: 3822008 - RNA, 18 nt, Human
augcugcgcccuucccca

SEQ ID NO: 3822009 - RNA, 19 nt, Human
augcugcuaauucaaagcu

SEQ ID NO: 3822010 - RNA, 13 nt, Human
augcugcuacuua

SEQ ID NO: 3822011 - RNA, 15 nt, Human
augcugcugccccug

SEQ ID NO: 3822012 - RNA, 12 nt, Human
augcugcuggcc

SEQ ID NO: 3822013 - RNA, 12 nt, Human
augcugcuuuaa

SEQ ID NO: 3822014 - RNA, 17 nt, Human
augcugcuuuccccugu

SEQ ID NO: 3822015 - RNA, 18 nt, Human
augcugcuuuccccugug

SEQ ID NO: 3822016 - RNA, 23 nt, Human
augcugcuuuccccuguggggau

SEQ ID NO: 3822017 - RNA, 11 nt, Human
augcugcuuuu

SEQ ID NO: 3822018 - RNA, 18 nt, Human
augcugcuuuuauaucug

SEQ ID NO: 3822019 - RNA, 17 nt, Human
augcuggaaccugcaaa

SEQ ID NO: 3822020 - RNA, 16 nt, Human
augcuggacuggaggc

SEQ ID NO: 3822021 - RNA, 12 nt, Human
augcuggagaag

SEQ ID NO: 3822022 - RNA, 15 nt, Human
augcuggagaagaga

SEQ ID NO: 3822023 - RNA, 15 nt, Human
augcuggagagguua

SEQ ID NO: 3822024 - RNA, 13 nt, Human
augcuggagccug

SEQ ID NO: 3822025 - RNA, 14 nt, Human
augcuggagccugu

SEQ ID NO: 3822026 - RNA, 16 nt, Human
augcuggagccugugu

SEQ ID NO: 3822027 - RNA, 11 nt, Human
augcuggagcg

SEQ ID NO: 3822028 - RNA, 17 nt, Human
augcuggaugucugcca

SEQ ID NO: 3822029 - RNA, 22 nt, Human
augcuggaugucugccaauuuu

SEQ ID NO: 3822030 - RNA, 14 nt, Human
augcuggccagccu

SEQ ID NO: 3822031 - RNA, 17 nt, Human
augcuggccagccuggg

SEQ ID NO: 3822032 - RNA, 21 nt, Human
augcuggcccagggcccagag

SEQ ID NO: 3822033 - RNA, 23 nt, Human
augcuggcccagggcccagagcc

SEQ ID NO: 3822034 - RNA, 20 nt, Human
augcuggccuugccacacuc

SEQ ID NO: 3822035 - RNA, 15 nt, Human
caccugauguguaca

SEQ ID NO: 3822036 - RNA, 16 nt, Human
caccugauucaacuaa

SEQ ID NO: 3822037 - RNA, 17 nt, Human
caccugauucaacuaaa

SEQ ID NO: 3822038 - RNA, 21 nt, Human
caccugauucaacuaaaaaaa

SEQ ID NO: 3822039 - RNA, 17 nt, Human
caccugcaccucccccc

SEQ ID NO: 3822040 - RNA, 16 nt, Human
caccugcacuaacaga

SEQ ID NO: 3822041 - RNA, 23 nt, Human
caccugcacuuaaggcacucugu

SEQ ID NO: 3822042 - RNA, 16 nt, Human
caccugcagccucccu

SEQ ID NO: 3822043 - RNA, 14 nt, Human
caccugcagcuccc

SEQ ID NO: 3822044 - RNA, 15 nt, Human
caccugcagcucccu

SEQ ID NO: 3822045 - RNA, 14 nt, Human
caccugcaggucac

SEQ ID NO: 3822046 - RNA, 22 nt, Human
caccugcauccguaguucccug

SEQ ID NO: 3822047 - RNA, 15 nt, Human
caccugcauucuucc

SEQ ID NO: 3822048 - RNA, 20 nt, Human
caccugccacccugggccug

SEQ ID NO: 3822049 - RNA, 18 nt, Human
caccugccacuaggcugg

SEQ ID NO: 3822050 - RNA, 16 nt, Human
caccugccagggacag

SEQ ID NO: 3822051 - RNA, 17 nt, Human
caccugccauuugcacc

SEQ ID NO: 3822052 - RNA, 18 nt, Human
caccugcccaaccugcuc

SEQ ID NO: 3822053 - RNA, 22 nt, Human
caccugcccaucacaggguugg

SEQ ID NO: 3822054 - RNA, 16 nt, Human
caccugccccaacucu

SEQ ID NO: 3822055 - RNA, 14 nt, Human
caccugcccccugg

SEQ ID NO: 3822056 - RNA, 13 nt, Human
caccugcccccuu

SEQ ID NO: 3822057 - RNA, 21 nt, Human
caccugcccccuucucccaca

SEQ ID NO: 3822058 - RNA, 15 nt, Human
caccugccccucaac

SEQ ID NO: 3822059 - RNA, 14 nt, Human
caccugcccugccc

SEQ ID NO: 3822060 - RNA, 21 nt, Human
caccugcccugcccugccacc

SEQ ID NO: 3822061 - RNA, 23 nt, Human
caccugccgaccucguccucccc

SEQ ID NO: 3822062 - RNA, 14 nt, Human
caccugccuccucg

SEQ ID NO: 3822063 - RNA, 16 nt, Human
caccugccugcgucuu

SEQ ID NO: 3822064 - RNA, 21 nt, Human
caccugccugcgucuuccgcc

SEQ ID NO: 3822065 - RNA, 11 nt, Human
caccugccugg

SEQ ID NO: 3822066 - RNA, 12 nt, Human
caccugccuggc

SEQ ID NO: 3822067 - RNA, 13 nt, Human
caccugccuggcc

SEQ ID NO: 3822068 - RNA, 16 nt, Human
caccugccuggccggc

SEQ ID NO: 3822069 - RNA, 20 nt, Human
caccugccuggccggccagc

SEQ ID NO: 3822070 - RNA, 21 nt, Human
caccugccuggccggccagcc

SEQ ID NO: 3822071 - RNA, 18 nt, Human
caccugccuguuaggaga

SEQ ID NO: 3822072 - RNA, 19 nt, Human
caccugccuguugggccag

SEQ ID NO: 3822073 - RNA, 17 nt, Human
caccugcggugcuaucu

SEQ ID NO: 3822074 - RNA, 13 nt, Human
caccugcucccag

SEQ ID NO: 3822075 - RNA, 14 nt, Human
caccugcucccagg

SEQ ID NO: 3822076 - RNA, 23 nt, Human
caccugcugagaaaacaugccuc

SEQ ID NO: 3822077 - RNA, 19 nt, Human
augcuuaaagaauucaaau

SEQ ID NO: 3822078 - RNA, 20 nt, Human
augcuuaaagaauucaaauu

SEQ ID NO: 3822079 - RNA, 20 nt, Human
augcuuaacauacccgccua

SEQ ID NO: 3822080 - RNA, 19 nt, Human
augcuuacggccaucucuu

SEQ ID NO: 3822081 - RNA, 15 nt, Human
augcuuagucccuca

SEQ ID NO: 3822082 - RNA, 19 nt, Human
augcuuauguuagaaauaa

SEQ ID NO: 3822083 - RNA, 22 nt, Human
augcuuauuccaugacugcuug

SEQ ID NO: 3822084 - RNA, 16 nt, Human
augcuuauuuuaaaau

SEQ ID NO: 3822085 - RNA, 20 nt, Human
augcuucaaaguccacauua

SEQ ID NO: 3822086 - RNA, 12 nt, Human
augcuucauaca

SEQ ID NO: 3822087 - RNA, 19 nt, Human
augcuucauacagggaugg

SEQ ID NO: 3822088 - RNA, 23 nt, Human
augcuucauacagggaugguguu

SEQ ID NO: 3822089 - RNA, 19 nt, Human
augcuucaucauucccucu

SEQ ID NO: 3822090 - RNA, 21 nt, Human
augcuucaugaaaauccuacc

SEQ ID NO: 3822091 - RNA, 17 nt, Human
augcuucauucaauauu

SEQ ID NO: 3822092 - RNA, 16 nt, Human
augcuucauuuguaug

SEQ ID NO: 3822093 - RNA, 14 nt, Human
augcuuccagaaac

SEQ ID NO: 3822094 - RNA, 15 nt, Human
augcuuccuagaagu

SEQ ID NO: 3822095 - RNA, 15 nt, Human
augcuuccucccagc

SEQ ID NO: 3822096 - RNA, 15 nt, Human
augcuucuaaguaaa

SEQ ID NO: 3822097 - RNA, 16 nt, Human
augcuucuagaguuuu

SEQ ID NO: 3822098 - RNA, 13 nt, Human
augcuucucacug

SEQ ID NO: 3822099 - RNA, 19 nt, Human
augcuucucaucuugugaa

SEQ ID NO: 3822100 - RNA, 21 nt, Human
augcuucucaucuugugaaau

SEQ ID NO: 3822101 - RNA, 17 nt, Human
augcuucugacuucaua

SEQ ID NO: 3822102 - RNA, 21 nt, Human
augcuucuguuuuauaauuuu

SEQ ID NO: 3822103 - RNA, 20 nt, Human
augcuucuucagagacuccu

SEQ ID NO: 3822104 - RNA, 15 nt, Human
augcuucuuccuuac

SEQ ID NO: 3822105 - RNA, 15 nt, Human
augcuucuucucagg

SEQ ID NO: 3822106 - RNA, 12 nt, Human
augcuucuuuaa

SEQ ID NO: 3822107 - RNA, 14 nt, Human
augcuucuuuaaaa

SEQ ID NO: 3822108 - RNA, 17 nt, Human
augcuugcauaagagcu

SEQ ID NO: 3822109 - RNA, 16 nt, Human
augcuugccuagggcc

SEQ ID NO: 3822110 - RNA, 20 nt, Human
augcuugccuagggccuggu

SEQ ID NO: 3822111 - RNA, 21 nt, Human
augcuugccuagggccugguc

SEQ ID NO: 3822112 - RNA, 18 nt, Human
augcuugcggcaaaagga

SEQ ID NO: 3822113 - RNA, 16 nt, Human
augcuugcugcugauu

SEQ ID NO: 3822114 - RNA, 20 nt, Human
augcuuggaauaucugcugu

SEQ ID NO: 3822115 - RNA, 21 nt, Human
augcuuggaauaucugcugua

SEQ ID NO: 3822116 - RNA, 15 nt, Human
augcuuggcuucuca

SEQ ID NO: 3822117 - RNA, 18 nt, Human
augcuuguaacaagaaaa

SEQ ID NO: 3822118 - RNA, 16 nt, Human
augcuuguacauaaug

SEQ ID NO: 3822119 - RNA, 19 nt, Human
augcuuuaccaaacagcaa

SEQ ID NO: 3822120 - RNA, 14 nt, Human
augcuuuagcuuau

SEQ ID NO: 3822121 - RNA, 18 nt, Human
augcuuuaggauguacag

SEQ ID NO: 3822122 - RNA, 21 nt, Human
augcuuuaggauguacaguua

SEQ ID NO: 3822123 - RNA, 14 nt, Human
augcuuuauuugua

SEQ ID NO: 3822124 - RNA, 15 nt, Human
augcuuuauuuguaa

SEQ ID NO: 3822125 - RNA, 19 nt, Human
augcuuuauuuguaaauuu

SEQ ID NO: 3822126 - RNA, 15 nt, Human
augcuuuccaaaacc

SEQ ID NO: 3822127 - RNA, 23 nt, Human
augcuuuccauauuuuuuuccuu

SEQ ID NO: 3822128 - RNA, 14 nt, Human
augcuuuccuucuu

SEQ ID NO: 3822129 - RNA, 17 nt, Human
augcuuugaaacagaaa

SEQ ID NO: 3822130 - RNA, 18 nt, Human
augcuuugcuuugucugg

SEQ ID NO: 3822131 - RNA, 15 nt, Human
augcuuugugaacaa

SEQ ID NO: 3822132 - RNA, 16 nt, Human
augcuuugugugauug

SEQ ID NO: 3822133 - RNA, 22 nt, Human
augcuuuuugaauguuauuugu

SEQ ID NO: 3822134 - RNA, 21 nt, Human
auggaaaaaccauuugaagug

SEQ ID NO: 3822135 - RNA, 22 nt, Human
auggaaaaaugccaucaaauga

SEQ ID NO: 3822136 - RNA, 17 nt, Human
auggaaaacuuaguuug

SEQ ID NO: 3822137 - RNA, 12 nt, Human
auggaaaaggaa

SEQ ID NO: 3822138 - RNA, 14 nt, Human
auggaaaaggaaga

SEQ ID NO: 3822139 - RNA, 20 nt, Human
auggaaaaggaagacuagag

SEQ ID NO: 3822140 - RNA, 17 nt, Human
auggaaaaucagcugcu

SEQ ID NO: 3822141 - RNA, 20 nt, Human
auggaaaaugccaugaauua

SEQ ID NO: 3822142 - RNA, 22 nt, Human
auggaaacaagaugaaauucca

SEQ ID NO: 3822143 - RNA, 20 nt, Human
auggaaacagaggaccagca

SEQ ID NO: 3822144 - RNA, 13 nt, Human
auggaaaccucac

SEQ ID NO: 3822145 - RNA, 16 nt, Human
auggaaaccugaaaaa

SEQ ID NO: 3822146 - RNA, 13 nt, Human
auggaaacugaau

SEQ ID NO: 3822147 - RNA, 15 nt, Human
auggaaacugaaugc

SEQ ID NO: 3822148 - RNA, 11 nt, Human
auggaaagaau

SEQ ID NO: 3822149 - RNA, 19 nt, Human
auggaaagcuucagugcug

SEQ ID NO: 3822150 - RNA, 19 nt, Human
auggaaaggagaggaaaga

SEQ ID NO: 3822151 - RNA, 23 nt, Human
auggaaaggagccuaggccaggu

SEQ ID NO: 3822152 - RNA, 15 nt, Human
auggaaauauauauu

SEQ ID NO: 3822153 - RNA, 15 nt, Human
auggaaauauuaugc

SEQ ID NO: 3822154 - RNA, 17 nt, Human
auggaaauauuaugcaa

SEQ ID NO: 3822155 - RNA, 22 nt, Human
auggaaauauuaugcaaauucc

SEQ ID NO: 3822156 - RNA, 15 nt, Human
auggaaauuuaaagc

SEQ ID NO: 3822157 - RNA, 16 nt, Human
auggaaauuuugcuau

SEQ ID NO: 3822158 - RNA, 18 nt, Human
auggaacacaaacacauu

SEQ ID NO: 3822159 - RNA, 18 nt, Human
auggaacacucugagacu

SEQ ID NO: 3822160 - RNA, 19 nt, Human
auggaaccgcaggaagcug

SEQ ID NO: 3822161 - RNA, 20 nt, Human
auggaaccgcaggaagcugc

SEQ ID NO: 3822162 - RNA, 14 nt, Human
auggaaccuccuuu

SEQ ID NO: 3822163 - RNA, 21 nt, Human
auggaaccuccuuucucuucu

SEQ ID NO: 3822164 - RNA, 15 nt, Human
auggaacgcguugaa

SEQ ID NO: 3822165 - RNA, 18 nt, Human
auggaacgcguugaaauu

SEQ ID NO: 3822166 - RNA, 22 nt, Human
auggaacucagcugucuguggc

SEQ ID NO: 3822167 - RNA, 21 nt, Human
auggaacucuagggauaguca

SEQ ID NO: 3822168 - RNA, 18 nt, Human
auggaacuucuaauauau

SEQ ID NO: 3822169 - RNA, 13 nt, Human
auggaagaaagua

SEQ ID NO: 3822170 - RNA, 13 nt, Human
auggaagacacau

SEQ ID NO: 3822171 - RNA, 15 nt, Human
auggaagagaaaucu

SEQ ID NO: 3822172 - RNA, 22 nt, Human
auggaagcuuccaguccaaucu

SEQ ID NO: 3822173 - RNA, 16 nt, Human
auggaaggguuugugg

SEQ ID NO: 3822174 - RNA, 17 nt, Human
auggaaguaaagccuca

SEQ ID NO: 3822175 - RNA, 14 nt, Human
auggaauaacaugu

SEQ ID NO: 3822176 - RNA, 16 nt, Human
auggaauaacucugug

SEQ ID NO: 3822177 - RNA, 16 nt, Human
auggaaugcuguguua

SEQ ID NO: 3822178 - RNA, 21 nt, Human
auggaaugcuguguuaaauaa

SEQ ID NO: 3822179 - RNA, 18 nt, Human
auggaauggacauccugu

SEQ ID NO: 3822180 - RNA, 15 nt, Human
caccuugugucugua

SEQ ID NO: 3822181 - RNA, 14 nt, Human
caccuuuaaagugu

SEQ ID NO: 3822182 - RNA, 15 nt, Human
caccuuuagguucuu

SEQ ID NO: 3822183 - RNA, 15 nt, Human
caccuuuauuaaaau

SEQ ID NO: 3822184 - RNA, 14 nt, Human
caccuuuauucugg

SEQ ID NO: 3822185 - RNA, 22 nt, Human
caccuuucagauaacuguuauu

SEQ ID NO: 3822186 - RNA, 14 nt, Human
caccuuucagccca

SEQ ID NO: 3822187 - RNA, 22 nt, Human
caccuuucauaaucuuugcuuu

SEQ ID NO: 3822188 - RNA, 19 nt, Human
caccuuucccaucuuccaa

SEQ ID NO: 3822189 - RNA, 12 nt, Human
caccuuucuagu

SEQ ID NO: 3822190 - RNA, 13 nt, Human
caccuuucuaguu

SEQ ID NO: 3822191 - RNA, 17 nt, Human
caccuuuguccccaccg

SEQ ID NO: 3822192 - RNA, 13 nt, Human
caccuuuguguau

SEQ ID NO: 3822193 - RNA, 17 nt, Human
caccuuuguguauuuuu

SEQ ID NO: 3822194 - RNA, 21 nt, Human
caccuuuguguauuuuucaau

SEQ ID NO: 3822195 - RNA, 21 nt, Human
caccuuuguuuagaacacugg

SEQ ID NO: 3822196 - RNA, 11 nt, Human
caccuuuuaaa

SEQ ID NO: 3822197 - RNA, 19 nt, Human
caccuuuuucauacaaggc

SEQ ID NO: 3822198 - RNA, 21 nt, Human
caccuuuuucauacaaggccc

SEQ ID NO: 3822199 - RNA, 17 nt, Human
caccuuuuuucaacagu

SEQ ID NO: 3822200 - RNA, 12 nt, Human
cacgaaacuugu

SEQ ID NO: 3822201 - RNA, 14 nt, Human
cacgaaacuuguua

SEQ ID NO: 3822202 - RNA, 21 nt, Human
cacgaaacuuguuauugugaa

SEQ ID NO: 3822203 - RNA, 22 nt, Human
cacgaaacuuguuauugugaau

SEQ ID NO: 3822204 - RNA, 13 nt, Human
cacgaaagagaga

SEQ ID NO: 3822205 - RNA, 11 nt, Human
cacgaaagcac

SEQ ID NO: 3822206 - RNA, 14 nt, Human
cacgaaagcacaca

SEQ ID NO: 3822207 - RNA, 17 nt, Human
cacgaaauguuauuuuu

SEQ ID NO: 3822208 - RNA, 18 nt, Human
cacgaacccaccugcuga

SEQ ID NO: 3822209 - RNA, 19 nt, Human
cacgaacuuuagcugcauc

SEQ ID NO: 3822210 - RNA, 15 nt, Human
cacgaaguguugcau

SEQ ID NO: 3822211 - RNA, 16 nt, Human
cacgaaguguugcaug

SEQ ID NO: 3822212 - RNA, 18 nt, Human
cacgaaguguugcaugga

SEQ ID NO: 3822213 - RNA, 19 nt, Human
cacgaauauugcugauggu

SEQ ID NO: 3822214 - RNA, 22 nt, Human
cacgaauauugcugauggugca

SEQ ID NO: 3822215 - RNA, 22 nt, Human
cacgaauuugcuggggaaucuc

SEQ ID NO: 3822216 - RNA, 14 nt, Human
cacgacaguggaug

SEQ ID NO: 3822217 - RNA, 15 nt, Human
cacgaccgccccagu

SEQ ID NO: 3822218 - RNA, 17 nt, Human
cacgacugcccggcagg

SEQ ID NO: 3822219 - RNA, 16 nt, Human
cacgacuggccagggc

SEQ ID NO: 3822220 - RNA, 17 nt, Human
cacgacuggccagggcc

SEQ ID NO: 3822221 - RNA, 18 nt, Human
cacgagagcgcagcaucc

SEQ ID NO: 3822222 - RNA, 22 nt, Human
cacgagcaggcuacugucagcu

SEQ ID NO: 3822223 - RNA, 11 nt, Human
cacgagggcug

SEQ ID NO: 3822224 - RNA, 15 nt, Human
cacgaggucaggaga

SEQ ID NO: 3822225 - RNA, 20 nt, Human
cacgauaaauaaucggccca

SEQ ID NO: 3822226 - RNA, 15 nt, Human
cacgaugaaaaacuu

SEQ ID NO: 3822227 - RNA, 15 nt, Human
cacgauguggcccug

SEQ ID NO: 3822228 - RNA, 22 nt, Human
cacgauguggcccuggccugcu

SEQ ID NO: 3822229 - RNA, 12 nt, Human
cacgauuucugu

SEQ ID NO: 3822230 - RNA, 17 nt, Human
cacgauuuucuccagcu

SEQ ID NO: 3822231 - RNA, 19 nt, Human
cacgauuuucuccagcuca

SEQ ID NO: 3822232 - RNA, 15 nt, Human
cacgcaacuugaaau

SEQ ID NO: 3822233 - RNA, 13 nt, Human
cacgcacacacac

SEQ ID NO: 3822234 - RNA, 15 nt, Human
cacgcacacacacac

SEQ ID NO: 3822235 - RNA, 20 nt, Human
cacgcacacacacacacagg

SEQ ID NO: 3822236 - RNA, 18 nt, Human
cacgcacauauacacaca

SEQ ID NO: 3822237 - RNA, 13 nt, Human
cacgcaccugggu

SEQ ID NO: 3822238 - RNA, 21 nt, Human
caccaggcugagguccugauc

SEQ ID NO: 3822239 - RNA, 21 nt, Human
caccaggcugcucagggcugg

SEQ ID NO: 3822240 - RNA, 23 nt, Human
caccaggcuggcgcagccaaggc

SEQ ID NO: 3822241 - RNA, 16 nt, Human
caccagggcaucucug

SEQ ID NO: 3822242 - RNA, 19 nt, Human
caccagggcaucucugggc

SEQ ID NO: 3822243 - RNA, 23 nt, Human
caccagggcaucucugggcugga

SEQ ID NO: 3822244 - RNA, 16 nt, Human
caccagggccaaaagc

SEQ ID NO: 3822245 - RNA, 12 nt, Human
caccaggggcag

SEQ ID NO: 3822246 - RNA, 17 nt, Human
caccaggggcaggcaca

SEQ ID NO: 3822247 - RNA, 21 nt, Human
caccaggggcaggcacagcac

SEQ ID NO: 3822248 - RNA, 20 nt, Human
caccagguagaacgccaggg

SEQ ID NO: 3822249 - RNA, 19 nt, Human
caccaggugccuuucaaau

SEQ ID NO: 3822250 - RNA, 15 nt, Human
caccagucacugucc

SEQ ID NO: 3822251 - RNA, 17 nt, Human
caccagucacugucccu

SEQ ID NO: 3822252 - RNA, 16 nt, Human
caccagucauuuuuca

SEQ ID NO: 3822253 - RNA, 22 nt, Human
caccagugaaugaaagucuugu

SEQ ID NO: 3822254 - RNA, 21 nt, Human
caccagugacuuuuucuaaga

SEQ ID NO: 3822255 - RNA, 12 nt, Human
caccagugccuc

SEQ ID NO: 3822256 - RNA, 17 nt, Human
caccagugccucucccu

SEQ ID NO: 3822257 - RNA, 16 nt, Human
caccaguguccccucc

SEQ ID NO: 3822258 - RNA, 18 nt, Human
caccaguguccccuccac

SEQ ID NO: 3822259 - RNA, 18 nt, Human
caccaguuccuuucaaug

SEQ ID NO: 3822260 - RNA, 17 nt, Human
caccauagguagaaugu

SEQ ID NO: 3822261 - RNA, 13 nt, Human
caccauaugaauu

SEQ ID NO: 3822262 - RNA, 21 nt, Human
caccauauuaccacagacaua

SEQ ID NO: 3822263 - RNA, 15 nt, Human
caccaucacagcuug

SEQ ID NO: 3822264 - RNA, 16 nt, Human
caccaucacagcuugu

SEQ ID NO: 3822265 - RNA, 21 nt, Human
caccaucacagcuuguuuugg

SEQ ID NO: 3822266 - RNA, 17 nt, Human
caccaucaugucuggcu

SEQ ID NO: 3822267 - RNA, 15 nt, Human
caccaucccuuuuug

SEQ ID NO: 3822268 - RNA, 16 nt, Human
caccaucccuuuuuga

SEQ ID NO: 3822269 - RNA, 21 nt, Human
caccaucccuuuuugaagugu

SEQ ID NO: 3822270 - RNA, 17 nt, Human
caccaucgcuggccccu

SEQ ID NO: 3822271 - RNA, 14 nt, Human
caccaucucaggcc

SEQ ID NO: 3822272 - RNA, 20 nt, Human
caccaucucaggccaccugc

SEQ ID NO: 3822273 - RNA, 12 nt, Human
caccaucuuuua

SEQ ID NO: 3822274 - RNA, 22 nt, Human
caccaugagggaagaauaaaga

SEQ ID NO: 3822275 - RNA, 19 nt, Human
caccaugauuccuuuaaca

SEQ ID NO: 3822276 - RNA, 21 nt, Human
caccaugcagugccccuagcu

SEQ ID NO: 3822277 - RNA, 19 nt, Human
caccaugcugcuggggaag

SEQ ID NO: 3822278 - RNA, 22 nt, Human
caccaugcugcuggggaagaca

SEQ ID NO: 3822279 - RNA, 14 nt, Human
caccaugcuuccag

SEQ ID NO: 3822280 - RNA, 19 nt, Human
caccauguaaaacaaaaaa

SEQ ID NO: 3822281 - RNA, 18 nt, Human
caccauguacauagcuug

SEQ ID NO: 3822282 - RNA, 18 nt, Human
caccauguuugagcucag

SEQ ID NO: 3822283 - RNA, 22 nt, Human
caccauguuugagcucagaccc

SEQ ID NO: 3822284 - RNA, 23 nt, Human
caccauguuugagcucagacccc

SEQ ID NO: 3822285 - RNA, 17 nt, Human
caccauuauaaugaauu

SEQ ID NO: 3822286 - RNA, 22 nt, Human
caccauucaggaaccuggacca

SEQ ID NO: 3822287 - RNA, 13 nt, Human
caccauucagguc

SEQ ID NO: 3822288 - RNA, 13 nt, Human
caccauuccugga

SEQ ID NO: 3822289 - RNA, 20 nt, Human
caccauucguacauaauacu

SEQ ID NO: 3822290 - RNA, 14 nt, Human
caccauucugacuc

SEQ ID NO: 3822291 - RNA, 17 nt, Human
caccauuuaaaaacagg

SEQ ID NO: 3822292 - RNA, 18 nt, Human
caccauuuccccagggca

SEQ ID NO: 3822293 - RNA, 19 nt, Human
caccauuuccccagggcac

SEQ ID NO: 3822294 - RNA, 17 nt, Human
caccauuuggcaaugcc

SEQ ID NO: 3822295 - RNA, 18 nt, Human
caccauuuggcaucccug

SEQ ID NO: 3822296 - RNA, 22 nt, Human
caccauuuggcaucccugggcc

SEQ ID NO: 3822297 - RNA, 17 nt, Human
cacccaaagcauggacu

SEQ ID NO: 3822298 - RNA, 18 nt, Human
cacccaaagcauggacua

SEQ ID NO: 3822299 - RNA, 19 nt, Human
cacccaaagcugagccugc

SEQ ID NO: 3822300 - RNA, 23 nt, Human
cacccaacccuaucuccugacag

SEQ ID NO: 3822301 - RNA, 16 nt, Human
cacccaagcaaggcca

SEQ ID NO: 3822302 - RNA, 13 nt, Human
cacccaagcuugg

SEQ ID NO: 3822303 - RNA, 15 nt, Human
cacccaagcuuggca

SEQ ID NO: 3822304 - RNA, 17 nt, Human
cacccaagcuuggcagc

SEQ ID NO: 3822305 - RNA, 19 nt, Human
cacccaagcuuggcagccg

SEQ ID NO: 3822306 - RNA, 21 nt, Human
cacccaagcuuggcagccgag

SEQ ID NO: 3822307 - RNA, 15 nt, Human
cacccaagggccugg

SEQ ID NO: 3822308 - RNA, 17 nt, Human
cacccaagggccuggcc

SEQ ID NO: 3822309 - RNA, 18 nt, Human
cacccaagggccuggccu

SEQ ID NO: 3822310 - RNA, 23 nt, Human
cacccaauaaacauuaagauuga

SEQ ID NO: 3822311 - RNA, 16 nt, Human
cacccaauucaaaaca

SEQ ID NO: 3822312 - RNA, 15 nt, Human
cacccacacacucgc

SEQ ID NO: 3822313 - RNA, 15 nt, Human
cacccacaggcaugu

SEQ ID NO: 3822314 - RNA, 21 nt, Human
cacccacaugugacacauaug

SEQ ID NO: 3822315 - RNA, 16 nt, Human
cacccaccaacccuca

SEQ ID NO: 3822316 - RNA, 17 nt, Human
cacccaccaacccucag

SEQ ID NO: 3822317 - RNA, 22 nt, Human
cacccaccaguugaauuucauc

SEQ ID NO: 3822318 - RNA, 16 nt, Human
cacccaccccugcaca

SEQ ID NO: 3822319 - RNA, 12 nt, Human
cacccaccucag

SEQ ID NO: 3822320 - RNA, 13 nt, Human
cacccaccucagc

SEQ ID NO: 3822321 - RNA, 14 nt, Human
cacccaccucagcc

SEQ ID NO: 3822322 - RNA, 14 nt, Human
cacccaccucccug

SEQ ID NO: 3822323 - RNA, 15 nt, Human
cacccaccucccugc

SEQ ID NO: 3822324 - RNA, 21 nt, Human
cacccaccucccugccuccag

SEQ ID NO: 3822325 - RNA, 21 nt, Human
aaaagagagcagagaauauaa

SEQ ID NO: 3822326 - RNA, 16 nt, Human
aaaagagauauuuuaa

SEQ ID NO: 3822327 - RNA, 14 nt, Human
aaaagagauuucaa

SEQ ID NO: 3822328 - RNA, 16 nt, Human
aaaagagauuucaaga

SEQ ID NO: 3822329 - RNA, 15 nt, Human
aaaagaggggcuggg

SEQ ID NO: 3822330 - RNA, 21 nt, Human
aaaagagguuuuucuuaaaua

SEQ ID NO: 3822331 - RNA, 17 nt, Human
aaaagauaaacacaaga

SEQ ID NO: 3822332 - RNA, 19 nt, Human
aaaagauaaacacaagauu

SEQ ID NO: 3822333 - RNA, 12 nt, Human
aaaagauaaaga

SEQ ID NO: 3822334 - RNA, 17 nt, Human
aaaagauaaagaugauc

SEQ ID NO: 3822335 - RNA, 17 nt, Human
aaaagauaaauauuaua

SEQ ID NO: 3822336 - RNA, 14 nt, Human
aaaagauacauuug

SEQ ID NO: 3822337 - RNA, 16 nt, Human
aaaagauacauuugua

SEQ ID NO: 3822338 - RNA, 17 nt, Human
aaaagauaccuuaaaau

SEQ ID NO: 3822339 - RNA, 20 nt, Human
aaaagauacgacuuuauuuu

SEQ ID NO: 3822340 - RNA, 18 nt, Human
aaaagauauaagugcugu

SEQ ID NO: 3822341 - RNA, 11 nt, Human
aaaagauauau

SEQ ID NO: 3822342 - RNA, 23 nt, Human
aaaagaucuguuuugaaggcaaa

SEQ ID NO: 3822343 - RNA, 15 nt, Human
aaaagaugcaaugua

SEQ ID NO: 3822344 - RNA, 18 nt, Human
aaaagaugcacuuugcuu

SEQ ID NO: 3822345 - RNA, 13 nt, Human
aaaagaugcuucu

SEQ ID NO: 3822346 - RNA, 13 nt, Human
aaaagaugcuuuu

SEQ ID NO: 3822347 - RNA, 14 nt, Human
aaaagauguagauu

SEQ ID NO: 3822348 - RNA, 13 nt, Human
aaaagauuagcaa

SEQ ID NO: 3822349 - RNA, 13 nt, Human
aaaagauucauuu

SEQ ID NO: 3822350 - RNA, 12 nt, Human
aaaagauucuuc

SEQ ID NO: 3822351 - RNA, 21 nt, Human
aaaagauugaaguauuuugcu

SEQ ID NO: 3822352 - RNA, 14 nt, Human
aaaagauugcugaa

SEQ ID NO: 3822353 - RNA, 16 nt, Human
aaaagcaaaaaagaaa

SEQ ID NO: 3822354 - RNA, 12 nt, Human
aaaagcaaaauc

SEQ ID NO: 3822355 - RNA, 14 nt, Human
aaaagcaaaugaga

SEQ ID NO: 3822356 - RNA, 14 nt, Human
aaaagcacaagaag

SEQ ID NO: 3822357 - RNA, 13 nt, Human
aaaagcagacauu

SEQ ID NO: 3822358 - RNA, 14 nt, Human
aaaagcagacauuu

SEQ ID NO: 3822359 - RNA, 14 nt, Human
aaaagcagcuacca

SEQ ID NO: 3822360 - RNA, 17 nt, Human
aaaagcagcucuccccu

SEQ ID NO: 3822361 - RNA, 14 nt, Human
aaaagcauguacag

SEQ ID NO: 3822362 - RNA, 19 nt, Human
aaaagcauguacaguguuc

SEQ ID NO: 3822363 - RNA, 14 nt, Human
aaaagcauuuugua

SEQ ID NO: 3822364 - RNA, 15 nt, Human
aaaagcauuuuguaa

SEQ ID NO: 3822365 - RNA, 21 nt, Human
aaaagccaaggugucauuuau

SEQ ID NO: 3822366 - RNA, 20 nt, Human
aaaagccaucauguaaauua

SEQ ID NO: 3822367 - RNA, 17 nt, Human
aaaagccauguuuaaga

SEQ ID NO: 3822368 - RNA, 20 nt, Human
aaaagcccaaccucuuccuc

SEQ ID NO: 3822369 - RNA, 21 nt, Human
aaaagcccuagacuggugcua

SEQ ID NO: 3822370 - RNA, 21 nt, Human
aaaagccucaacuagucauuu

SEQ ID NO: 3822371 - RNA, 20 nt, Human
aaaagcgacccauucagaga

SEQ ID NO: 3822372 - RNA, 17 nt, Human
aaaagcgugagcuuaaa

SEQ ID NO: 3822373 - RNA, 21 nt, Human
aaaagcgugagcuuaaaauac

SEQ ID NO: 3822374 - RNA, 18 nt, Human
aaaagcucauauuuugua

SEQ ID NO: 3822375 - RNA, 17 nt, Human
aaaagcucauuucaugc

SEQ ID NO: 3822376 - RNA, 14 nt, Human
aaaagcucuuuuaa

SEQ ID NO: 3822377 - RNA, 21 nt, Human
aaaagcuuagcuuuagaaaca

SEQ ID NO: 3822378 - RNA, 17 nt, Human
aaaagcuucccucccug

SEQ ID NO: 3822379 - RNA, 13 nt, Human
aaaagcuucuuaa

SEQ ID NO: 3822380 - RNA, 13 nt, Human
aaaagcuuuguuu

SEQ ID NO: 3822381 - RNA, 14 nt, Human
aaaagcuuuuuauu

SEQ ID NO: 3822382 - RNA, 15 nt, Human
aaaaggaaaaagcuc

SEQ ID NO: 3822383 - RNA, 16 nt, Human
aaaaggaaaagaaaaa

SEQ ID NO: 3822384 - RNA, 23 nt, Human
aaaaggaaaagaaaaaaaaaaga

SEQ ID NO: 3822385 - RNA, 13 nt, Human
aaaaggaaagaaa

SEQ ID NO: 3822386 - RNA, 14 nt, Human
aaaaggaacugcag

SEQ ID NO: 3822387 - RNA, 13 nt, Human
aaaaggaagacua

SEQ ID NO: 3822388 - RNA, 14 nt, Human
aaaaggaagacuag

SEQ ID NO: 3822389 - RNA, 15 nt, Human
aaaaggaagacuaga

SEQ ID NO: 3822390 - RNA, 21 nt, Human
aaaaggaagguaguucaagaa

SEQ ID NO: 3822391 - RNA, 17 nt, Human
aaaaggacaucagcaaa

SEQ ID NO: 3822392 - RNA, 19 nt, Human
aaaaggacaucagcaaaca

SEQ ID NO: 3822393 - RNA, 15 nt, Human
aaaaggaguauacaa

SEQ ID NO: 3822394 - RNA, 15 nt, Human
aaaaggauacauaau

SEQ ID NO: 3822395 - RNA, 17 nt, Human
aaaaggauaguauuuuu

SEQ ID NO: 3822396 - RNA, 22 nt, Human
aaaaggauaguauuuuuaucca

SEQ ID NO: 3822397 - RNA, 19 nt, Human
aaaaggaugcacagaguug

SEQ ID NO: 3822398 - RNA, 14 nt, Human
aaaaggcauuguuu

SEQ ID NO: 3822399 - RNA, 15 nt, Human
aaaaggccaaaccuc

SEQ ID NO: 3822400 - RNA, 18 nt, Human
aaaaggccaguggaaauu

SEQ ID NO: 3822401 - RNA, 15 nt, Human
aaaaggccucuugua

SEQ ID NO: 3822402 - RNA, 23 nt, Human
aaaaggccucuuguaaagacugg

SEQ ID NO: 3822403 - RNA, 12 nt, Human
aaaaggccuggg

SEQ ID NO: 3822404 - RNA, 14 nt, Human
aaaaggccuggggu

SEQ ID NO: 3822405 - RNA, 17 nt, Human
aaaaggcuuauaaaaca

SEQ ID NO: 3822406 - RNA, 19 nt, Human
aaaaggcuuauaaaacaga

SEQ ID NO: 3822407 - RNA, 16 nt, Human
aaaagggaagaaacug

SEQ ID NO: 3822408 - RNA, 19 nt, Human
aaaagggaaguugugccuu

SEQ ID NO: 3822409 - RNA, 16 nt, Human
aaaagggacugagaaa

SEQ ID NO: 3822410 - RNA, 14 nt, Human
aaaagggaggggga

SEQ ID NO: 3822411 - RNA, 18 nt, Human
aaaagggauuacccaagc

SEQ ID NO: 3822412 - RNA, 23 nt, Human
aaaagggcagggcaucuccugug

SEQ ID NO: 3822413 - RNA, 10 nt, Human
aaaaggguca

SEQ ID NO: 3822414 - RNA, 22 nt, Human
aaaagguagcuuaccugacaca

SEQ ID NO: 3822415 - RNA, 18 nt, Human
aaaaggugauaaaaucau

SEQ ID NO: 3822416 - RNA, 20 nt, Human
aaaaggugccugugaggcag

SEQ ID NO: 3822417 - RNA, 13 nt, Human
aaaagguugaaua

SEQ ID NO: 3822418 - RNA, 15 nt, Human
aaaagguugaauaau

SEQ ID NO: 3822419 - RNA, 18 nt, Human
aaaagguuuacagaauuu

SEQ ID NO: 3822420 - RNA, 17 nt, Human
aaaagguuuuauuuugu

SEQ ID NO: 3822421 - RNA, 23 nt, Human
aaaaguaaguaccacucaggcca

SEQ ID NO: 3822422 - RNA, 21 nt, Human
aaaaguacauauuuauuuucu

SEQ ID NO: 3822423 - RNA, 13 nt, Human
aaaaguacauuua

SEQ ID NO: 3822424 - RNA, 15 nt, Human
aaaaguagaacuuug

SEQ ID NO: 3822425 - RNA, 17 nt, Human
aaaaguagaacuuugua

SEQ ID NO: 3822426 - RNA, 20 nt, Human
aaaaguagaacuuuguauag

SEQ ID NO: 3822427 - RNA, 19 nt, Human
aaaaguauguuagugcaaa

SEQ ID NO: 3822428 - RNA, 14 nt, Human
aaaaguauuauuuu

SEQ ID NO: 3822429 - RNA, 12 nt, Human
aaaaguauuuug

SEQ ID NO: 3822430 - RNA, 13 nt, Human
aaaaguauuuuga

SEQ ID NO: 3822431 - RNA, 19 nt, Human
aaaaguauuuugaaguuua

SEQ ID NO: 3822432 - RNA, 19 nt, Human
aaaagucacaauguucuuu

SEQ ID NO: 3822433 - RNA, 14 nt, Human
aaaagucagagaca

SEQ ID NO: 3822434 - RNA, 22 nt, Human
aaaaguccaauuuuaauuuagu

SEQ ID NO: 3822435 - RNA, 23 nt, Human
aaaagucucuauuuaaauucuuu

SEQ ID NO: 3822436 - RNA, 12 nt, Human
aaaagucugauu

SEQ ID NO: 3822437 - RNA, 22 nt, Human
aaaagucugauugguuuuaauu

SEQ ID NO: 3822438 - RNA, 14 nt, Human
aaaagucugucuuu

SEQ ID NO: 3822439 - RNA, 19 nt, Human
aaaagucuuaggugaacaa

SEQ ID NO: 3822440 - RNA, 23 nt, Human
aaaagucuucacucucugaagau

SEQ ID NO: 3822441 - RNA, 13 nt, Human
aaaagugaaauaa

SEQ ID NO: 3822442 - RNA, 20 nt, Human
aaaagugaaugaaagauuaa

SEQ ID NO: 3822443 - RNA, 15 nt, Human
aaaagugacacagca

SEQ ID NO: 3822444 - RNA, 20 nt, Human
aaaagugccauuaacaaaug

SEQ ID NO: 3822445 - RNA, 14 nt, Human
cacugccaggccag

SEQ ID NO: 3822446 - RNA, 18 nt, Human
cacugccaggccagccuc

SEQ ID NO: 3822447 - RNA, 17 nt, Human
cacugccauaaaacauu

SEQ ID NO: 3822448 - RNA, 16 nt, Human
cacugccaucuuaguu

SEQ ID NO: 3822449 - RNA, 22 nt, Human
cacugccaucuuaguuuggauu

SEQ ID NO: 3822450 - RNA, 17 nt, Human
cacugccauggaggcac

SEQ ID NO: 3822451 - RNA, 14 nt, Human
cacugcccaccccc

SEQ ID NO: 3822452 - RNA, 18 nt, Human
cacugcccauggacaggc

SEQ ID NO: 3822453 - RNA, 16 nt, Human
cacugccccaggcugc

SEQ ID NO: 3822454 - RNA, 17 nt, Human
cacugcccgagcuggug

SEQ ID NO: 3822455 - RNA, 18 nt, Human
cacugcccgagcuggugc

SEQ ID NO: 3822456 - RNA, 19 nt, Human
cacugcccgagcuggugca

SEQ ID NO: 3822457 - RNA, 15 nt, Human
cacugcccgcacacc

SEQ ID NO: 3822458 - RNA, 19 nt, Human
cacugcccgcacacccuca

SEQ ID NO: 3822459 - RNA, 15 nt, Human
cacugccucagguuc

SEQ ID NO: 3822460 - RNA, 23 nt, Human
cacugccuccccaaggcccccug

SEQ ID NO: 3822461 - RNA, 14 nt, Human
cacugccucucaca

SEQ ID NO: 3822462 - RNA, 16 nt, Human
cacugccucucacagc

SEQ ID NO: 3822463 - RNA, 16 nt, Human
cacugccucucccucu

SEQ ID NO: 3822464 - RNA, 18 nt, Human
cacugccucucccuggcc

SEQ ID NO: 3822465 - RNA, 20 nt, Human
cacugccucucccuggcccu

SEQ ID NO: 3822466 - RNA, 13 nt, Human
cacugccucugcc

SEQ ID NO: 3822467 - RNA, 23 nt, Human
cacugccucugccuuagaggagc

SEQ ID NO: 3822468 - RNA, 22 nt, Human
cacugccugauggaccugucac

SEQ ID NO: 3822469 - RNA, 14 nt, Human
cacugccugcccac

SEQ ID NO: 3822470 - RNA, 20 nt, Human
cacugccugccuuaagugag

SEQ ID NO: 3822471 - RNA, 17 nt, Human
cacuacacuccagccug

SEQ ID NO: 3822472 - RNA, 19 nt, Human
cacuacacuccagccugag

SEQ ID NO: 3822473 - RNA, 19 nt, Human
cacuacauaaacugacuuu

SEQ ID NO: 3822474 - RNA, 15 nt, Human
cacuacaugcagccc

SEQ ID NO: 3822475 - RNA, 20 nt, Human
cacuacaugugguuuauaga

SEQ ID NO: 3822476 - RNA, 21 nt, Human
cacuaccacgccaagcuaauu

SEQ ID NO: 3822477 - RNA, 23 nt, Human
cacuaccagcguauauauaagaa

SEQ ID NO: 3822478 - RNA, 22 nt, Human
cacuacccaucgguguccauuu

SEQ ID NO: 3822479 - RNA, 20 nt, Human
cacuaccgaaugugucuuua

SEQ ID NO: 3822480 - RNA, 18 nt, Human
cacuaccuccucagggau

SEQ ID NO: 3822481 - RNA, 13 nt, Human
cacuaccuggcug

SEQ ID NO: 3822482 - RNA, 12 nt, Human
cacuacugcagu

SEQ ID NO: 3822483 - RNA, 14 nt, Human
cacuacuggguguc

SEQ ID NO: 3822484 - RNA, 16 nt, Human
cacuacugggugucau

SEQ ID NO: 3822485 - RNA, 22 nt, Human
cacuacugggugucauuucauu

SEQ ID NO: 3822486 - RNA, 19 nt, Human
cacuagaauggauaaaaua

SEQ ID NO: 3822487 - RNA, 14 nt, Human
cacuagacaagcca

SEQ ID NO: 3822488 - RNA, 16 nt, Human
cacuagacccacugga

SEQ ID NO: 3822489 - RNA, 16 nt, Human
cacuagccagacacuc

SEQ ID NO: 3822490 - RNA, 16 nt, Human
cacuagcccaaugaaa

SEQ ID NO: 3822491 - RNA, 23 nt, Human
cacuagcccaaugaaaugaauua

SEQ ID NO: 3822492 - RNA, 19 nt, Human
cacuagccucaggggucug

SEQ ID NO: 3822493 - RNA, 21 nt, Human
cacuagccucuccaggaaugc

SEQ ID NO: 3822494 - RNA, 22 nt, Human
cacuagcucuuguugagccgug

SEQ ID NO: 3822495 - RNA, 15 nt, Human
cacuaggcugggugc

SEQ ID NO: 3822496 - RNA, 22 nt, Human
cacuaggcugggugcccacagc

SEQ ID NO: 3822497 - RNA, 14 nt, Human
cacuaggcuucugg

SEQ ID NO: 3822498 - RNA, 21 nt, Human
cacuagggcagggacaggaua

SEQ ID NO: 3822499 - RNA, 21 nt, Human
cacuaggggauauaggagagg

SEQ ID NO: 3822500 - RNA, 15 nt, Human
cacuagucugugugc

SEQ ID NO: 3822501 - RNA, 17 nt, Human
cacuaguuuugugccag

SEQ ID NO: 3822502 - RNA, 12 nt, Human
cacuauaaaugg

SEQ ID NO: 3822503 - RNA, 17 nt, Human
cacuauaaugugaaaug

SEQ ID NO: 3822504 - RNA, 19 nt, Human
cacuauaucuguauauaaa

SEQ ID NO: 3822505 - RNA, 16 nt, Human
cacuauccaugcacca

SEQ ID NO: 3822506 - RNA, 18 nt, Human
cacuauccaugcaccaaa

SEQ ID NO: 3822507 - RNA, 17 nt, Human
cacuaugaagcuaccuc

SEQ ID NO: 3822508 - RNA, 14 nt, Human
cacuaugaaucuau

SEQ ID NO: 3822509 - RNA, 12 nt, Human
cacuaugcauuu

SEQ ID NO: 3822510 - RNA, 14 nt, Human
cacuaugcauuuua

SEQ ID NO: 3822511 - RNA, 15 nt, Human
cacuaugcauuuuaa

SEQ ID NO: 3822512 - RNA, 22 nt, Human
cacuauggugccaauggaaccu

SEQ ID NO: 3822513 - RNA, 16 nt, Human
cacuauguugcccagg

SEQ ID NO: 3822514 - RNA, 22 nt, Human
cacuauuuauuuacaaauguuu

SEQ ID NO: 3822515 - RNA, 14 nt, Human
cacuauuuuaugca

SEQ ID NO: 3822516 - RNA, 14 nt, Human
cacuauuuucagaa

SEQ ID NO: 3822517 - RNA, 17 nt, Human
cacuauuuucagaaucu

SEQ ID NO: 3822518 - RNA, 22 nt, Human
cacuauuuuuauuuauauuuuu

SEQ ID NO: 3822519 - RNA, 18 nt, Human
cacucaaaagcugggcag

SEQ ID NO: 3822520 - RNA, 14 nt, Human
cacucaagaagcag

SEQ ID NO: 3822521 - RNA, 14 nt, Human
cacucaagaccaaa

SEQ ID NO: 3822522 - RNA, 22 nt, Human
cacucaagaccaaauggaaaca

SEQ ID NO: 3822523 - RNA, 15 nt, Human
cacucaagcacugau

SEQ ID NO: 3822524 - RNA, 12 nt, Human
cacucaagccaa

SEQ ID NO: 3822525 - RNA, 18 nt, Human
cacucaagccaagcagcc

SEQ ID NO: 3822526 - RNA, 13 nt, Human
cacucaagcuugg

SEQ ID NO: 3822527 - RNA, 14 nt, Human
cacucaaucucuga

SEQ ID NO: 3822528 - RNA, 23 nt, Human
cacucacacagccaggugccuug

SEQ ID NO: 3822529 - RNA, 21 nt, Human
cacucacacaggacccccuuc

SEQ ID NO: 3822530 - RNA, 16 nt, Human
cacucacagaccugga

SEQ ID NO: 3822531 - RNA, 18 nt, Human
cacucacagagucaaggc

SEQ ID NO: 3822532 - RNA, 13 nt, Human
cacucacaugaca

SEQ ID NO: 3822533 - RNA, 17 nt, Human
cacucaccgaagccacu

SEQ ID NO: 3822534 - RNA, 16 nt, Human
cacucacuaggccccc

SEQ ID NO: 3822535 - RNA, 22 nt, Human
cacucacuaggcccccacuugc

SEQ ID NO: 3822536 - RNA, 14 nt, Human
cacucacuccugag

SEQ ID NO: 3822537 - RNA, 21 nt, Human
cacucagaaaagacgcaccag

SEQ ID NO: 3822538 - RNA, 15 nt, Human
cacucagaagccugg

SEQ ID NO: 3822539 - RNA, 17 nt, Human
cacucagaagccugggg

SEQ ID NO: 3822540 - RNA, 15 nt, Human
cacucagagacaugc

SEQ ID NO: 3822541 - RNA, 22 nt, Human
cacucagcacaaggccaucugg

SEQ ID NO: 3822542 - RNA, 14 nt, Human
cacucagcaccccc

SEQ ID NO: 3822543 - RNA, 13 nt, Human
cacucagccccua

SEQ ID NO: 3822544 - RNA, 16 nt, Human
cacucagccccuagga

SEQ ID NO: 3822545 - RNA, 17 nt, Human
cacucagccccuaggag

SEQ ID NO: 3822546 - RNA, 13 nt, Human
cacucagcuguuc

SEQ ID NO: 3822547 - RNA, 19 nt, Human
cacucagcuuccuacccac

SEQ ID NO: 3822548 - RNA, 20 nt, Human
cacucaggaggcugaggcag

SEQ ID NO: 3822549 - RNA, 12 nt, Human
cacucaggcugg

SEQ ID NO: 3822550 - RNA, 14 nt, Human
cacucaggcuggag

SEQ ID NO: 3822551 - RNA, 20 nt, Human
cacucaucaauggggccagu

SEQ ID NO: 3822552 - RNA, 17 nt, Human
cacucaugcauuguccu

SEQ ID NO: 3822553 - RNA, 19 nt, Human
cacucaugcauuguccucu

SEQ ID NO: 3822554 - RNA, 12 nt, Human
cacucaugcuga

SEQ ID NO: 3822555 - RNA, 15 nt, Human
cacucaugcugaaag

SEQ ID NO: 3822556 - RNA, 22 nt, Human
cacucaugugacucuuuccaac

SEQ ID NO: 3822557 - RNA, 21 nt, Human
cacucauugcugagccucugc

SEQ ID NO: 3822558 - RNA, 16 nt, Human
cacucauuucaucuca

SEQ ID NO: 3822559 - RNA, 18 nt, Human
cacucauuucaucucauu

SEQ ID NO: 3822560 - RNA, 19 nt, Human
cacucauuucaucucauuu

SEQ ID NO: 3822561 - RNA, 22 nt, Human
cacucauuuucuauaacagaua

SEQ ID NO: 3822562 - RNA, 15 nt, Human
cacuccaagcccagc

SEQ ID NO: 3822563 - RNA, 15 nt, Human
cacuccaauuaagga

SEQ ID NO: 3822564 - RNA, 17 nt, Human
cacuccaauuaaggauu

SEQ ID NO: 3822565 - RNA, 22 nt, Human
cacuccaauuaaggauuuuaug

SEQ ID NO: 3822566 - RNA, 11 nt, Human
cacuccaccac

SEQ ID NO: 3822567 - RNA, 15 nt, Human
cacuccacccuccac

SEQ ID NO: 3822568 - RNA, 17 nt, Human
cacuccacccuccaccu

SEQ ID NO: 3822569 - RNA, 21 nt, Human
cacuccacccuccaccuucca

SEQ ID NO: 3822570 - RNA, 12 nt, Human
cacuccagccug

SEQ ID NO: 3822571 - RNA, 21 nt, Human
cacuccagccugggcgacaga

SEQ ID NO: 3822572 - RNA, 11 nt, Human
cacuccagcug

SEQ ID NO: 3822573 - RNA, 13 nt, Human
cacuccagugcca

SEQ ID NO: 3822574 - RNA, 21 nt, Human
cacuccaugcuuagucacugc

SEQ ID NO: 3822575 - RNA, 23 nt, Human
cacuccaugcuuagucacugccu

SEQ ID NO: 3822576 - RNA, 13 nt, Human
cacuccauuccca

SEQ ID NO: 3822577 - RNA, 13 nt, Human
cacucccaagucu

SEQ ID NO: 3822578 - RNA, 22 nt, Human
cacucccaccugacacaccagg

SEQ ID NO: 3822579 - RNA, 23 nt, Human
cacucccaccugacacaccaggc

SEQ ID NO: 3822580 - RNA, 13 nt, Human
cacucccacuucc

SEQ ID NO: 3822581 - RNA, 14 nt, Human
cacucccaggcagc

SEQ ID NO: 3822582 - RNA, 15 nt, Human
cacuccccaaccccc

SEQ ID NO: 3822583 - RNA, 14 nt, Human
cacuccccacaucc

SEQ ID NO: 3822584 - RNA, 15 nt, Human
cacuccccaccuuca

SEQ ID NO: 3822585 - RNA, 21 nt, Human
cacuccccagccagccuggcu

SEQ ID NO: 3822586 - RNA, 19 nt, Human
cacuccccagccugggccc

SEQ ID NO: 3822587 - RNA, 19 nt, Human
cacuccccgaagucuuuug

SEQ ID NO: 3822588 - RNA, 14 nt, Human
cacuccccugcugg

SEQ ID NO: 3822589 - RNA, 19 nt, Human
cacucccgagacggcacug

SEQ ID NO: 3822590 - RNA, 16 nt, Human
cacucccguuuucggu

SEQ ID NO: 3822591 - RNA, 15 nt, Human
cacucccuccagcac

SEQ ID NO: 3822592 - RNA, 16 nt, Human
cacucccugcaaccug

SEQ ID NO: 3822593 - RNA, 19 nt, Human
cacucccuucccauaagcu

SEQ ID NO: 3822594 - RNA, 15 nt, Human
cacucccuucuccuu

SEQ ID NO: 3822595 - RNA, 13 nt, Human
cacucccuugggc

SEQ ID NO: 3822596 - RNA, 21 nt, Human
cacucccuugguggcaagagc

SEQ ID NO: 3822597 - RNA, 17 nt, Human
cacuccggcccuccaga

SEQ ID NO: 3822598 - RNA, 21 nt, Human
cacuccggcccuccagagccc

SEQ ID NO: 3822599 - RNA, 20 nt, Human
cacuccggugugccugcagc

SEQ ID NO: 3822600 - RNA, 22 nt, Human
cacuccggugugccugcagccc

SEQ ID NO: 3822601 - RNA, 22 nt, Human
cacuccuagagaacgcagcccu

SEQ ID NO: 3822602 - RNA, 13 nt, Human
cacuccucagggc

SEQ ID NO: 3822603 - RNA, 12 nt, Human
cacuccucccuc

SEQ ID NO: 3822604 - RNA, 18 nt, Human
cacuccucugcugaccug

SEQ ID NO: 3822605 - RNA, 14 nt, Human
cacuccugagaccc

SEQ ID NO: 3822606 - RNA, 23 nt, Human
cacuccugagaccccuggccucc

SEQ ID NO: 3822607 - RNA, 14 nt, Human
cacuccugccaagg

SEQ ID NO: 3822608 - RNA, 14 nt, Human
cacuccugcucugc

SEQ ID NO: 3822609 - RNA, 15 nt, Human
cacuccugcucugcu

SEQ ID NO: 3822610 - RNA, 16 nt, Human
cacuccugcucugcuc

SEQ ID NO: 3822611 - RNA, 21 nt, Human
cacuccuucacagaugggugc

SEQ ID NO: 3822612 - RNA, 12 nt, Human
cacuccuuccug

SEQ ID NO: 3822613 - RNA, 14 nt, Human
cacuccuuccugcc

SEQ ID NO: 3822614 - RNA, 15 nt, Human
cacuccuuccugcca

SEQ ID NO: 3822615 - RNA, 21 nt, Human
cacuccuuccugccccaacuc

SEQ ID NO: 3822616 - RNA, 16 nt, Human
aaaauagagcuuuuaa

SEQ ID NO: 3822617 - RNA, 20 nt, Human
aaaauagaguguaguuuaca

SEQ ID NO: 3822618 - RNA, 12 nt, Human
aaaauagccugc

SEQ ID NO: 3822619 - RNA, 16 nt, Human
aaaauagcguucuugu

SEQ ID NO: 3822620 - RNA, 20 nt, Human
aaaauagcuaaauaccucaa

SEQ ID NO: 3822621 - RNA, 13 nt, Human
aaaauagcuugua

SEQ ID NO: 3822622 - RNA, 21 nt, Human
aaaauagcuuguauaguguaa

SEQ ID NO: 3822623 - RNA, 12 nt, Human
aaaauaggcagg

SEQ ID NO: 3822624 - RNA, 17 nt, Human
aaaauaggcuuuuuaau

SEQ ID NO: 3822625 - RNA, 19 nt, Human
aaaauaguaaaugcuuugu

SEQ ID NO: 3822626 - RNA, 18 nt, Human
aaaauaguggugugauuu

SEQ ID NO: 3822627 - RNA, 13 nt, Human
aaaauaguuuauu

SEQ ID NO: 3822628 - RNA, 14 nt, Human
aaaauaguuuauuu

SEQ ID NO: 3822629 - RNA, 20 nt, Human
aaaauaguuuggauauguaa

SEQ ID NO: 3822630 - RNA, 10 nt, Human
aaaauauaaa

SEQ ID NO: 3822631 - RNA, 14 nt, Human
aaaauauaaaauua

SEQ ID NO: 3822632 - RNA, 18 nt, Human
aaaauauaaagcaucuaa

SEQ ID NO: 3822633 - RNA, 22 nt, Human
aaaauauaauuguuuuuuaucu

SEQ ID NO: 3822634 - RNA, 11 nt, Human
aaaauauacau

SEQ ID NO: 3822635 - RNA, 11 nt, Human
aaaauauacug

SEQ ID NO: 3822636 - RNA, 16 nt, Human
aaaauauacuguaaag

SEQ ID NO: 3822637 - RNA, 17 nt, Human
aaaauauacuguaaaga

SEQ ID NO: 3822638 - RNA, 13 nt, Human
aaaauauagcuaa

SEQ ID NO: 3822639 - RNA, 21 nt, Human
aaaauauagcuguacaaauau

SEQ ID NO: 3822640 - RNA, 14 nt, Human
aaaauauauacuaa

SEQ ID NO: 3822641 - RNA, 13 nt, Human
aaaauauauauag

SEQ ID NO: 3822642 - RNA, 19 nt, Human
aaaauauauauagugcuau

SEQ ID NO: 3822643 - RNA, 17 nt, Human
aaaauaucuuuugaccu

SEQ ID NO: 3822644 - RNA, 13 nt, Human
aaaauauguauua

SEQ ID NO: 3822645 - RNA, 14 nt, Human
aaaauauguauuaa

SEQ ID NO: 3822646 - RNA, 17 nt, Human
aaaauauuaucuuugua

SEQ ID NO: 3822647 - RNA, 14 nt, Human
aaaauauuaugugu

SEQ ID NO: 3822648 - RNA, 15 nt, Human
aaaauauuauguguu

SEQ ID NO: 3822649 - RNA, 14 nt, Human
aaaauauucucuau

SEQ ID NO: 3822650 - RNA, 21 nt, Human
aaaauauugagcagaauucau

SEQ ID NO: 3822651 - RNA, 11 nt, Human
aaaauauuguu

SEQ ID NO: 3822652 - RNA, 23 nt, Human
aaaauauuguuucugcauucauu

SEQ ID NO: 3822653 - RNA, 12 nt, Human
aaaauauuuaaa

SEQ ID NO: 3822654 - RNA, 20 nt, Human
aaaauauuuaaaaaugucuu

SEQ ID NO: 3822655 - RNA, 14 nt, Human
aaaauauuuaaagg

SEQ ID NO: 3822656 - RNA, 11 nt, Human
aaaauauuuau

SEQ ID NO: 3822657 - RNA, 17 nt, Human
aaaauauuuaugaagaa

SEQ ID NO: 3822658 - RNA, 14 nt, Human
aaaauauuuggaau

SEQ ID NO: 3822659 - RNA, 15 nt, Human
aaaauauuuguacau

SEQ ID NO: 3822660 - RNA, 14 nt, Human
aaaauauuuucugu

SEQ ID NO: 3822661 - RNA, 21 nt, Human
aaaauauuuucuguguguucc

SEQ ID NO: 3822662 - RNA, 12 nt, Human
aaaauauuuuga

SEQ ID NO: 3822663 - RNA, 17 nt, Human
aaaauauuuugaucuuc

SEQ ID NO: 3822664 - RNA, 18 nt, Human
aaaauauuuugucuaaaa

SEQ ID NO: 3822665 - RNA, 20 nt, Human
aaaauauuuugucuaaaaug

SEQ ID NO: 3822666 - RNA, 15 nt, Human
aaaaucaaaacaaaa

SEQ ID NO: 3822667 - RNA, 14 nt, Human
aaaaucaaaacaag

SEQ ID NO: 3822668 - RNA, 12 nt, Human
aaaaucaacuuu

SEQ ID NO: 3822669 - RNA, 13 nt, Human
cagaccaccccgc

SEQ ID NO: 3822670 - RNA, 15 nt, Human
cagaccaccccgccu

SEQ ID NO: 3822671 - RNA, 22 nt, Human
cagaccacgcccguccugccug

SEQ ID NO: 3822672 - RNA, 13 nt, Human
cagaccagagcuc

SEQ ID NO: 3822673 - RNA, 16 nt, Human
cagaccauaauguuac

SEQ ID NO: 3822674 - RNA, 21 nt, Human
cagaccauggacacuacaccc

SEQ ID NO: 3822675 - RNA, 22 nt, Human
cagaccauggacacuacaccca

SEQ ID NO: 3822676 - RNA, 19 nt, Human
cagaccauuggggcuccca

SEQ ID NO: 3822677 - RNA, 20 nt, Human
cagaccauuggggcucccag

SEQ ID NO: 3822678 - RNA, 23 nt, Human
cagaccauuggggcucccagcca

SEQ ID NO: 3822679 - RNA, 21 nt, Human
cagacccccaccccuucccca

SEQ ID NO: 3822680 - RNA, 14 nt, Human
cagacccccacucu

SEQ ID NO: 3822681 - RNA, 17 nt, Human
cagacccccagcaaccc

SEQ ID NO: 3822682 - RNA, 15 nt, Human
cagacccccuggaga

SEQ ID NO: 3822683 - RNA, 13 nt, Human
cagaccccucugg

SEQ ID NO: 3822684 - RNA, 18 nt, Human
cagaccccucuggccagg

SEQ ID NO: 3822685 - RNA, 23 nt, Human
cagaccccuggcuuuucacugcu

SEQ ID NO: 3822686 - RNA, 12 nt, Human
cagacccggcug

SEQ ID NO: 3822687 - RNA, 15 nt, Human
cagacccuaccccac

SEQ ID NO: 3822688 - RNA, 16 nt, Human
cagacccuaccccacc

SEQ ID NO: 3822689 - RNA, 12 nt, Human
cagacccugccc

SEQ ID NO: 3822690 - RNA, 14 nt, Human
cagacccugcccug

SEQ ID NO: 3822691 - RNA, 11 nt, Human
cagacccugga

SEQ ID NO: 3822692 - RNA, 22 nt, Human
cagacccuggaggccccaaccc

SEQ ID NO: 3822693 - RNA, 21 nt, Human
cagaccgaacuguuguauaaa

SEQ ID NO: 3822694 - RNA, 16 nt, Human
cagaccuaaugcuccu

SEQ ID NO: 3822695 - RNA, 17 nt, Human
cagaccuaaugcuccuu

SEQ ID NO: 3822696 - RNA, 15 nt, Human
cagaccuccccagcc

SEQ ID NO: 3822697 - RNA, 22 nt, Human
cagaccuccccagccccuagcc

SEQ ID NO: 3822698 - RNA, 23 nt, Human
cagaccuccccagccccuagccc

SEQ ID NO: 3822699 - RNA, 13 nt, Human
cagaccucuggau

SEQ ID NO: 3822700 - RNA, 17 nt, Human
cagaccugauccuggag

SEQ ID NO: 3822701 - RNA, 20 nt, Human
cagaccugcuuuuugaaaug

SEQ ID NO: 3822702 - RNA, 18 nt, Human
cagaccuggagccccugg

SEQ ID NO: 3822703 - RNA, 20 nt, Human
cagaccuggagccccugggu

SEQ ID NO: 3822704 - RNA, 21 nt, Human
cagaccuucuaggacgccacc

SEQ ID NO: 3822705 - RNA, 19 nt, Human
cagaccuuguucacacucu

SEQ ID NO: 3822706 - RNA, 15 nt, Human
cagaccuuugaggau

SEQ ID NO: 3822707 - RNA, 20 nt, Human
cagaccuuuuaacuccucaa

SEQ ID NO: 3822708 - RNA, 15 nt, Human
cagacgccuggcugc

SEQ ID NO: 3822709 - RNA, 23 nt, Human
cagacgccuggcugcugaucgcc

SEQ ID NO: 3822710 - RNA, 15 nt, Human
cagacgccuuacugg

SEQ ID NO: 3822711 - RNA, 22 nt, Human
cagacgcucauucagcaucuga

SEQ ID NO: 3822712 - RNA, 17 nt, Human
cagacgcugcugucaca

SEQ ID NO: 3822713 - RNA, 22 nt, Human
cagacggaaggguaaacaauau

SEQ ID NO: 3822714 - RNA, 15 nt, Human
cagacuaagccagca

SEQ ID NO: 3822715 - RNA, 22 nt, Human
cagacuaagccagcaccggacc

SEQ ID NO: 3822716 - RNA, 14 nt, Human
cagacuagauguag

SEQ ID NO: 3822717 - RNA, 15 nt, Human
cagacuagauguagu

SEQ ID NO: 3822718 - RNA, 19 nt, Human
cagacuagauguaguauuu

SEQ ID NO: 3822719 - RNA, 20 nt, Human
cagacuagauguaguauuuu

SEQ ID NO: 3822720 - RNA, 22 nt, Human
cagacuaguuuaguuaaaugag

SEQ ID NO: 3822721 - RNA, 15 nt, Human
cagacuauuuuuaga

SEQ ID NO: 3822722 - RNA, 20 nt, Human
cagacuauuuuuagauuuuc

SEQ ID NO: 3822723 - RNA, 14 nt, Human
cagacucaauaaaa

SEQ ID NO: 3822724 - RNA, 13 nt, Human
cagacucagagcu

SEQ ID NO: 3822725 - RNA, 15 nt, Human
cagacucagagcucu

SEQ ID NO: 3822726 - RNA, 18 nt, Human
cagacucagagcucucuc

SEQ ID NO: 3822727 - RNA, 23 nt, Human
cagacucagagcucucucuacag

SEQ ID NO: 3822728 - RNA, 14 nt, Human
cagacucagcucug

SEQ ID NO: 3822729 - RNA, 17 nt, Human
cagacucaguuugucag

SEQ ID NO: 3822730 - RNA, 20 nt, Human
cagacucauacagaaggugg

SEQ ID NO: 3822731 - RNA, 16 nt, Human
cagacucauauuacug

SEQ ID NO: 3822732 - RNA, 18 nt, Human
cagacucauccugaacag

SEQ ID NO: 3822733 - RNA, 20 nt, Human
cagacucauccugaacagca

SEQ ID NO: 3822734 - RNA, 14 nt, Human
cagacucccauucc

SEQ ID NO: 3822735 - RNA, 20 nt, Human
cagacucccauuccugaaga

SEQ ID NO: 3822736 - RNA, 20 nt, Human
cagacuccugaggacagcug

SEQ ID NO: 3822737 - RNA, 21 nt, Human
cagacuccugugcaacuuucc

SEQ ID NO: 3822738 - RNA, 18 nt, Human
cagacuccuucaacaauu

SEQ ID NO: 3822739 - RNA, 18 nt, Human
cagacucuaagaaagaac

SEQ ID NO: 3822740 - RNA, 21 nt, Human
cagacucucagcccagaagaa

SEQ ID NO: 3822741 - RNA, 13 nt, Human
cagacugaccuug

SEQ ID NO: 3822742 - RNA, 17 nt, Human
cagacugaucaggaccu

SEQ ID NO: 3822743 - RNA, 15 nt, Human
cagacugcacccagg

SEQ ID NO: 3822744 - RNA, 17 nt, Human
cagacugcacccaggag

SEQ ID NO: 3822745 - RNA, 15 nt, Human
cagacugcagguugg

SEQ ID NO: 3822746 - RNA, 22 nt, Human
cagacugcuaguguucugucua

SEQ ID NO: 3822747 - RNA, 23 nt, Human
cagacugcugggacuggccaggu

SEQ ID NO: 3822748 - RNA, 14 nt, Human
cagacugcuuccaa

SEQ ID NO: 3822749 - RNA, 14 nt, Human
cagacugcuuuaaa

SEQ ID NO: 3822750 - RNA, 14 nt, Human
cagacuggaagcac

SEQ ID NO: 3822751 - RNA, 18 nt, Human
cagacuggaagcacagcu

SEQ ID NO: 3822752 - RNA, 20 nt, Human
cagacuggaagcacagcuuc

SEQ ID NO: 3822753 - RNA, 21 nt, Human
cagacuggaagcacagcuuca

SEQ ID NO: 3822754 - RNA, 11 nt, Human
cagacuggagg

SEQ ID NO: 3822755 - RNA, 16 nt, Human
cagacuggcuggcugc

SEQ ID NO: 3822756 - RNA, 21 nt, Human
cagacuggggcauccugugcc

SEQ ID NO: 3822757 - RNA, 18 nt, Human
cagacuggguuucuagcc

SEQ ID NO: 3822758 - RNA, 15 nt, Human
cagacuggugagcag

SEQ ID NO: 3822759 - RNA, 12 nt, Human
cagacuguguaa

SEQ ID NO: 3822760 - RNA, 14 nt, Human
cagacuguguaaaa

SEQ ID NO: 3822761 - RNA, 21 nt, Human
cagacuguguaaaaagagagc

SEQ ID NO: 3822762 - RNA, 16 nt, Human
cagagcaagcuuuuuu

SEQ ID NO: 3822763 - RNA, 19 nt, Human
cagagcaagcuuuuuuauu

SEQ ID NO: 3822764 - RNA, 20 nt, Human
cagagcaagcuuuuuuauuu

SEQ ID NO: 3822765 - RNA, 18 nt, Human
cagagcacagcagccccu

SEQ ID NO: 3822766 - RNA, 19 nt, Human
cagagcaccugcugucugg

SEQ ID NO: 3822767 - RNA, 19 nt, Human
cagagcaccuuagacaguc

SEQ ID NO: 3822768 - RNA, 21 nt, Human
cagagcaccuuagacaguccc

SEQ ID NO: 3822769 - RNA, 15 nt, Human
cagagcacugcucca

SEQ ID NO: 3822770 - RNA, 20 nt, Human
cagagcacuggguugcaggg

SEQ ID NO: 3822771 - RNA, 13 nt, Human
cagagcacuguau

SEQ ID NO: 3822772 - RNA, 15 nt, Human
cagagcagagaccau

SEQ ID NO: 3822773 - RNA, 17 nt, Human
cagagcagagaccaucc

SEQ ID NO: 3822774 - RNA, 20 nt, Human
cagagcagaugcagagagcc

SEQ ID NO: 3822775 - RNA, 14 nt, Human
cagagcaggaccuc

SEQ ID NO: 3822776 - RNA, 16 nt, Human
cagagcaggaccuccc

SEQ ID NO: 3822777 - RNA, 18 nt, Human
cagagcaggaccucccuu

SEQ ID NO: 3822778 - RNA, 13 nt, Human
cagagcaggcaau

SEQ ID NO: 3822779 - RNA, 14 nt, Human
cagagcaggggcag

SEQ ID NO: 3822780 - RNA, 19 nt, Human
cagagcaguugagaggaca

SEQ ID NO: 3822781 - RNA, 18 nt, Human
cagagcauuacgugagcc

SEQ ID NO: 3822782 - RNA, 21 nt, Human
cagagcauuacgugagccagg

SEQ ID NO: 3822783 - RNA, 17 nt, Human
cagagcauuccagucag

SEQ ID NO: 3822784 - RNA, 21 nt, Human
cagagcauuccagucaggcuc

SEQ ID NO: 3822785 - RNA, 13 nt, Human
cagagccacacau

SEQ ID NO: 3822786 - RNA, 17 nt, Human
cagagccacacaugggc

SEQ ID NO: 3822787 - RNA, 15 nt, Human
cagagccaggaagau

SEQ ID NO: 3822788 - RNA, 17 nt, Human
cagagccaggaagaucc

SEQ ID NO: 3822789 - RNA, 17 nt, Human
cagagccaggagaagcu

SEQ ID NO: 3822790 - RNA, 23 nt, Human
cagagccaggagaagcucagcug

SEQ ID NO: 3822791 - RNA, 23 nt, Human
cagagccaggggggugaggagcu

SEQ ID NO: 3822792 - RNA, 17 nt, Human
cagagccaugcugggaa

SEQ ID NO: 3822793 - RNA, 14 nt, Human
cagagccauggacu

SEQ ID NO: 3822794 - RNA, 20 nt, Human
cagagccaugucuucucccu

SEQ ID NO: 3822795 - RNA, 17 nt, Human
cagagcccacgccccca

SEQ ID NO: 3822796 - RNA, 19 nt, Human
cagagcccacgcccccacu

SEQ ID NO: 3822797 - RNA, 20 nt, Human
cagagcccacgcccccacug

SEQ ID NO: 3822798 - RNA, 13 nt, Human
cagagcccacucc

SEQ ID NO: 3822799 - RNA, 13 nt, Human
cagagcccagcuc

SEQ ID NO: 3822800 - RNA, 17 nt, Human
cagagcccaggcucggc

SEQ ID NO: 3822801 - RNA, 20 nt, Human
cagagccccacacggaggca

SEQ ID NO: 3822802 - RNA, 23 nt, Human
cagagccccacacggaggcaucu

SEQ ID NO: 3822803 - RNA, 22 nt, Human
cagagccccacagccccaucug

SEQ ID NO: 3822804 - RNA, 14 nt, Human
cagagcccccagga

SEQ ID NO: 3822805 - RNA, 16 nt, Human
cagagccccuccucca

SEQ ID NO: 3822806 - RNA, 15 nt, Human
cagagcccugcuccc

SEQ ID NO: 3822807 - RNA, 17 nt, Human
cagagcccugcucccuc

SEQ ID NO: 3822808 - RNA, 23 nt, Human
cagagcccugugaggcugggucc

SEQ ID NO: 3822809 - RNA, 18 nt, Human
cagagccggcccgccucu

SEQ ID NO: 3822810 - RNA, 22 nt, Human
cagagccggggugggguggcug

SEQ ID NO: 3822811 - RNA, 20 nt, Human
cagagccgugguccuuuggg

SEQ ID NO: 3822812 - RNA, 19 nt, Human
cagagccucccaaggagaa

SEQ ID NO: 3822813 - RNA, 16 nt, Human
cagagccucgcucugu

SEQ ID NO: 3822814 - RNA, 17 nt, Human
cagagccugccccagcg

SEQ ID NO: 3822815 - RNA, 16 nt, Human
cagagccuggggcucu

SEQ ID NO: 3822816 - RNA, 20 nt, Human
cagagccuuuggaugaccag

SEQ ID NO: 3822817 - RNA, 19 nt, Human
cagagcgccccucccuagu

SEQ ID NO: 3822818 - RNA, 22 nt, Human
cagagcgccgugaguucucagg

SEQ ID NO: 3822819 - RNA, 21 nt, Human
cagagcuaagggugggugcuc

SEQ ID NO: 3822820 - RNA, 17 nt, Human
cagagcuacacagggga

SEQ ID NO: 3822821 - RNA, 22 nt, Human
cagagcuacacaggggaaaaga

SEQ ID NO: 3822822 - RNA, 20 nt, Human
cagagcucuccagcuccaag

SEQ ID NO: 3822823 - RNA, 12 nt, Human
cagagcucucuc

SEQ ID NO: 3822824 - RNA, 17 nt, Human
cagagcucucucuacag

SEQ ID NO: 3822825 - RNA, 19 nt, Human
cagagcucuggagccaccu

SEQ ID NO: 3822826 - RNA, 19 nt, Human
cagagcugacacaggauga

SEQ ID NO: 3822827 - RNA, 13 nt, Human
cagagcugcccuc

SEQ ID NO: 3822828 - RNA, 18 nt, Human
cagagcugcccucuccug

SEQ ID NO: 3822829 - RNA, 19 nt, Human
cagagcugcccucuccugg

SEQ ID NO: 3822830 - RNA, 21 nt, Human
cagagcugcccucuccugggc

SEQ ID NO: 3822831 - RNA, 23 nt, Human
cagagcugcccucuccugggcag

SEQ ID NO: 3822832 - RNA, 16 nt, Human
cagagcugcgggcugg

SEQ ID NO: 3822833 - RNA, 16 nt, Human
cagagcugcuuccccg

SEQ ID NO: 3822834 - RNA, 16 nt, Human
cagagcuggaccagug

SEQ ID NO: 3822835 - RNA, 21 nt, Human
cagagcuggagaugaggccag

SEQ ID NO: 3822836 - RNA, 23 nt, Human
cagagcuggagaugaggccagac

SEQ ID NO: 3822837 - RNA, 18 nt, Human
cacuuaccuagauuuaca

SEQ ID NO: 3822838 - RNA, 15 nt, Human
cacuuacuguuucug

SEQ ID NO: 3822839 - RNA, 17 nt, Human
cacuuagcgaacccuuu

SEQ ID NO: 3822840 - RNA, 17 nt, Human
cacuuaucugaucagaa

SEQ ID NO: 3822841 - RNA, 20 nt, Human
cacuuauuccccauucuucc

SEQ ID NO: 3822842 - RNA, 17 nt, Human
cacuuauuucauaaaca

SEQ ID NO: 3822843 - RNA, 13 nt, Human
cacuucaaaacaa

SEQ ID NO: 3822844 - RNA, 19 nt, Human
cacuucacgcccuuggcca

SEQ ID NO: 3822845 - RNA, 21 nt, Human
cacuucacugcgaagacccuc

SEQ ID NO: 3822846 - RNA, 18 nt, Human
cacuucagagagcuggua

SEQ ID NO: 3822847 - RNA, 21 nt, Human
cacuucagcugacuuuucugu

SEQ ID NO: 3822848 - RNA, 18 nt, Human
cacuucaggucaggaguu

SEQ ID NO: 3822849 - RNA, 13 nt, Human
cacuucaucuucu

SEQ ID NO: 3822850 - RNA, 15 nt, Human
cacuucauguaaagu

SEQ ID NO: 3822851 - RNA, 13 nt, Human
cacuucauugaaa

SEQ ID NO: 3822852 - RNA, 22 nt, Human
cacuucauugagaguuuugucu

SEQ ID NO: 3822853 - RNA, 15 nt, Human
cacuuccaccagccu

SEQ ID NO: 3822854 - RNA, 17 nt, Human
cacuuccaccagccugc

SEQ ID NO: 3822855 - RNA, 18 nt, Human
cacuuccaccagccugca

SEQ ID NO: 3822856 - RNA, 19 nt, Human
cacuuccaccagccugcac

SEQ ID NO: 3822857 - RNA, 14 nt, Human
cacuuccaggggaa

SEQ ID NO: 3822858 - RNA, 17 nt, Human
cacuuccaggggaaccu

SEQ ID NO: 3822859 - RNA, 20 nt, Human
cacuuccaggggaaccugcc

SEQ ID NO: 3822860 - RNA, 18 nt, Human
cacuuccauacagcucua

SEQ ID NO: 3822861 - RNA, 16 nt, Human
cacuucccacccugcc

SEQ ID NO: 3822862 - RNA, 23 nt, Human
cacuucccagguaagcaggagga

SEQ ID NO: 3822863 - RNA, 16 nt, Human
cacuucccucuguuuc

SEQ ID NO: 3822864 - RNA, 17 nt, Human
cacuucccucuguuucu

SEQ ID NO: 3822865 - RNA, 11 nt, Human
cacuucccugg

SEQ ID NO: 3822866 - RNA, 12 nt, Human
cacuucccuggc

SEQ ID NO: 3822867 - RNA, 19 nt, Human
cacuucccuggcggcccca

SEQ ID NO: 3822868 - RNA, 12 nt, Human
cacuuccugccu

SEQ ID NO: 3822869 - RNA, 18 nt, Human
cacuuccuguccagagag

SEQ ID NO: 3822870 - RNA, 17 nt, Human
cacuuccuguuuuauaa

SEQ ID NO: 3822871 - RNA, 23 nt, Human
cacuucgcaccggagugucugga

SEQ ID NO: 3822872 - RNA, 21 nt, Human
cacuucgcgugcccucgcugc

SEQ ID NO: 3822873 - RNA, 17 nt, Human
cacuucggccagagcug

SEQ ID NO: 3822874 - RNA, 17 nt, Human
cacuucuaaaugaagug

SEQ ID NO: 3822875 - RNA, 20 nt, Human
cacuucuaaguugaguauau

SEQ ID NO: 3822876 - RNA, 13 nt, Human
cacuucucaggac

SEQ ID NO: 3822877 - RNA, 14 nt, Human
cacuucucaggaca

SEQ ID NO: 3822878 - RNA, 21 nt, Human
cacuucucaggacacaggccu

SEQ ID NO: 3822879 - RNA, 23 nt, Human
cacuucucaggacacaggccugu

SEQ ID NO: 3822880 - RNA, 17 nt, Human
cacuucucaucacacac

SEQ ID NO: 3822881 - RNA, 17 nt, Human
cacuucugacagccuca

SEQ ID NO: 3822882 - RNA, 19 nt, Human
cacuucugaccacacuucc

SEQ ID NO: 3822883 - RNA, 17 nt, Human
cacuucugacucuuccc

SEQ ID NO: 3822884 - RNA, 13 nt, Human
cacuucugccaga

SEQ ID NO: 3822885 - RNA, 17 nt, Human
cacuucugccagauguc

SEQ ID NO: 3822886 - RNA, 18 nt, Human
cacuucugggcuucaucu

SEQ ID NO: 3822887 - RNA, 19 nt, Human
cacuucuggguggggcagu

SEQ ID NO: 3822888 - RNA, 14 nt, Human
cacuucuguccaua

SEQ ID NO: 3822889 - RNA, 16 nt, Human
cacuucuguccuguga

SEQ ID NO: 3822890 - RNA, 18 nt, Human
cacuucuguccugugagg

SEQ ID NO: 3822891 - RNA, 20 nt, Human
cacuucugugagacccccac

SEQ ID NO: 3822892 - RNA, 13 nt, Human
cacuucuuccuuu

SEQ ID NO: 3822893 - RNA, 16 nt, Human
cacuucuucuguccaa

SEQ ID NO: 3822894 - RNA, 13 nt, Human
cacuucuuucccu

SEQ ID NO: 3822895 - RNA, 15 nt, Human
cacuucuuucccuuc

SEQ ID NO: 3822896 - RNA, 19 nt, Human
cacuucuuucccuuccucc

SEQ ID NO: 3822897 - RNA, 15 nt, Human
cacuucuuuuauaac

SEQ ID NO: 3822898 - RNA, 17 nt, Human
cacuugaacaaaaucug

SEQ ID NO: 3822899 - RNA, 18 nt, Human
cacuugaacaaaaucugu

SEQ ID NO: 3822900 - RNA, 17 nt, Human
cacuugagaauuacccu

SEQ ID NO: 3822901 - RNA, 14 nt, Human
cacuugaggccuga

SEQ ID NO: 3822902 - RNA, 17 nt, Human
cacuugaggccugaucu

SEQ ID NO: 3822903 - RNA, 22 nt, Human
cacuugaggucaggaguuccua

SEQ ID NO: 3822904 - RNA, 19 nt, Human
cacuugaugacccccaacc

SEQ ID NO: 3822905 - RNA, 16 nt, Human
cacuugaugugccauu

SEQ ID NO: 3822906 - RNA, 10 nt, Human
auucauuuaa

SEQ ID NO: 3822907 - RNA, 13 nt, Human
auucauuuaaaau

SEQ ID NO: 3822908 - RNA, 14 nt, Human
auucauuuaaguca

SEQ ID NO: 3822909 - RNA, 22 nt, Human
auucauuucaaagggagagaga

SEQ ID NO: 3822910 - RNA, 19 nt, Human
auucauuucacuguagcuc

SEQ ID NO: 3822911 - RNA, 18 nt, Human
auucauuuuaacaucuga

SEQ ID NO: 3822912 - RNA, 13 nt, Human
auucauuuucuag

SEQ ID NO: 3822913 - RNA, 14 nt, Human
auucauuuucuaga

SEQ ID NO: 3822914 - RNA, 15 nt, Human
auucauuuucuagau

SEQ ID NO: 3822915 - RNA, 15 nt, Human
auucauuuucucuaa

SEQ ID NO: 3822916 - RNA, 14 nt, Human
auuccaaaauauua

SEQ ID NO: 3822917 - RNA, 18 nt, Human
auuccaaaccaaauuuua

SEQ ID NO: 3822918 - RNA, 20 nt, Human
auuccaaagcaaaaccagaa

SEQ ID NO: 3822919 - RNA, 21 nt, Human
auuccaaagcuuuauuaccag

SEQ ID NO: 3822920 - RNA, 19 nt, Human
auuccaaagucucuaauuc

SEQ ID NO: 3822921 - RNA, 15 nt, Human
auuccaacaaagggu

SEQ ID NO: 3822922 - RNA, 18 nt, Human
auuccaacaaaggguuuu

SEQ ID NO: 3822923 - RNA, 19 nt, Human
auuccaacaaaggguuuua

SEQ ID NO: 3822924 - RNA, 15 nt, Human
auuccaacagugagu

SEQ ID NO: 3822925 - RNA, 15 nt, Human
auuccaaccccaacu

SEQ ID NO: 3822926 - RNA, 17 nt, Human
auuccaaccccaacucc

SEQ ID NO: 3822927 - RNA, 16 nt, Human
auuccaagacucuaga

SEQ ID NO: 3822928 - RNA, 17 nt, Human
auuccaagacucuagag

SEQ ID NO: 3822929 - RNA, 18 nt, Human
auuccaagacucuagagu

SEQ ID NO: 3822930 - RNA, 14 nt, Human
auuccaagucucca

SEQ ID NO: 3822931 - RNA, 17 nt, Human
auuccaagugauugaaa

SEQ ID NO: 3822932 - RNA, 15 nt, Human
auuccaauauuucug

SEQ ID NO: 3822933 - RNA, 12 nt, Human
auuccacagcug

SEQ ID NO: 3822934 - RNA, 12 nt, Human
auuccacaucua

SEQ ID NO: 3822935 - RNA, 18 nt, Human
auuccacuacaccuggcu

SEQ ID NO: 3822936 - RNA, 16 nt, Human
auuccagaaaggauau

SEQ ID NO: 3822937 - RNA, 21 nt, Human
auuccagaagaagagaagcug

SEQ ID NO: 3822938 - RNA, 22 nt, Human
auuccagaagaagagaagcugc

SEQ ID NO: 3822939 - RNA, 23 nt, Human
auuccagaagaagagaagcugcu

SEQ ID NO: 3822940 - RNA, 18 nt, Human
auuccagaccugaagaau

SEQ ID NO: 3822941 - RNA, 19 nt, Human
auuccagagaguggcuccu

SEQ ID NO: 3822942 - RNA, 19 nt, Human
auuccagagcguguaguga

SEQ ID NO: 3822943 - RNA, 14 nt, Human
auuccagaucccag

SEQ ID NO: 3822944 - RNA, 19 nt, Human
auuccagaucuuucagaaa

SEQ ID NO: 3822945 - RNA, 21 nt, Human
auuccagaucuuucagaaaua

SEQ ID NO: 3822946 - RNA, 17 nt, Human
auuccagccaucaccuu

SEQ ID NO: 3822947 - RNA, 21 nt, Human
auuccagcucauucauuuuau

SEQ ID NO: 3822948 - RNA, 13 nt, Human
auuccagcugucc

SEQ ID NO: 3822949 - RNA, 16 nt, Human
auuccagguuuaagua

SEQ ID NO: 3822950 - RNA, 16 nt, Human
auuccauauauccuuu

SEQ ID NO: 3822951 - RNA, 23 nt, Human
auuccauaucuugcgaauccaag

SEQ ID NO: 3822952 - RNA, 21 nt, Human
auuccauauuagaaaacuuug

SEQ ID NO: 3822953 - RNA, 14 nt, Human
auuccauccauaua

SEQ ID NO: 3822954 - RNA, 18 nt, Human
auuccaugaaucgcuucu

SEQ ID NO: 3822955 - RNA, 17 nt, Human
auuccaugaauguauca

SEQ ID NO: 3822956 - RNA, 14 nt, Human
auuccaugacugcu

SEQ ID NO: 3822957 - RNA, 17 nt, Human
auuccaugcuaagcaag

SEQ ID NO: 3822958 - RNA, 18 nt, Human
auuccauuuaucuuucua

SEQ ID NO: 3822959 - RNA, 22 nt, Human
auucccaacugaguguuauuug

SEQ ID NO: 3822960 - RNA, 16 nt, Human
auucccaagaaaugcu

SEQ ID NO: 3822961 - RNA, 15 nt, Human
auucccaagcucugc

SEQ ID NO: 3822962 - RNA, 12 nt, Human
auucccagagac

SEQ ID NO: 3822963 - RNA, 16 nt, Human
auucccagagacagga

SEQ ID NO: 3822964 - RNA, 21 nt, Human
auucccaggaguucugcucau

SEQ ID NO: 3822965 - RNA, 22 nt, Human
auucccagggaagugcucugau

SEQ ID NO: 3822966 - RNA, 14 nt, Human
auucccauugaaaa

SEQ ID NO: 3822967 - RNA, 15 nt, Human
auucccauuuugcaa

SEQ ID NO: 3822968 - RNA, 18 nt, Human
auucccauuuugcaaaau

SEQ ID NO: 3822969 - RNA, 22 nt, Human
auuccccacccugaaagcccug

SEQ ID NO: 3822970 - RNA, 20 nt, Human
auuccccagauugcaacagg

SEQ ID NO: 3822971 - RNA, 21 nt, Human
auuccccagguggcugaccca

SEQ ID NO: 3822972 - RNA, 17 nt, Human
auuccccauugccuccu

SEQ ID NO: 3822973 - RNA, 13 nt, Human
auuccccucugcu

SEQ ID NO: 3822974 - RNA, 15 nt, Human
auucccgcaguggga

SEQ ID NO: 3822975 - RNA, 18 nt, Human
auucccguuuugucacuu

SEQ ID NO: 3822976 - RNA, 21 nt, Human
auucccguuuugucacuuuuu

SEQ ID NO: 3822977 - RNA, 23 nt, Human
auucccguuuugucacuuuuucu

SEQ ID NO: 3822978 - RNA, 17 nt, Human
auucccucacucgucuc

SEQ ID NO: 3822979 - RNA, 20 nt, Human
auucccucacucgucucccc

SEQ ID NO: 3822980 - RNA, 18 nt, Human
auucccucgucuuuccca

SEQ ID NO: 3822981 - RNA, 17 nt, Human
auucccugauuuaauau

SEQ ID NO: 3822982 - RNA, 14 nt, Human
auucccuggaccag

SEQ ID NO: 3822983 - RNA, 23 nt, Human
auucccuucgacagcauuuuccu

SEQ ID NO: 3822984 - RNA, 16 nt, Human
auucccuuguuauuca

SEQ ID NO: 3822985 - RNA, 21 nt, Human
auuccgacaaccgaugcucca

SEQ ID NO: 3822986 - RNA, 19 nt, Human
auuccggauccuaagcauc

SEQ ID NO: 3822987 - RNA, 23 nt, Human
auuccguagccagcugcucccca

SEQ ID NO: 3822988 - RNA, 18 nt, Human
auuccuacaauauauauu

SEQ ID NO: 3822989 - RNA, 16 nt, Human
auuccuacagcacuac

SEQ ID NO: 3822990 - RNA, 19 nt, Human
auuccuagauaaaaagaug

SEQ ID NO: 3822991 - RNA, 21 nt, Human
auuccuagauaaaaagauggc

SEQ ID NO: 3822992 - RNA, 14 nt, Human
auuccuaguuggug

SEQ ID NO: 3822993 - RNA, 16 nt, Human
auuccuaguuggugag

SEQ ID NO: 3822994 - RNA, 21 nt, Human
auuccuauacgcagcgugcuu

SEQ ID NO: 3822995 - RNA, 20 nt, Human
auuccuauauccugugacug

SEQ ID NO: 3822996 - RNA, 19 nt, Human
auuccuauugugauuugac

SEQ ID NO: 3822997 - RNA, 19 nt, Human
auuccucauccucagaugc

SEQ ID NO: 3822998 - RNA, 21 nt, Human
auuccucauccucagaugcuc

SEQ ID NO: 3822999 - RNA, 16 nt, Human
auuccucaugaaugua

SEQ ID NO: 3823000 - RNA, 23 nt, Human
auuccucaugaauguaaauuugu

SEQ ID NO: 3823001 - RNA, 15 nt, Human
auuccuccaccugcc

SEQ ID NO: 3823002 - RNA, 15 nt, Human
auuccuccugcucau

SEQ ID NO: 3823003 - RNA, 20 nt, Human
auuccuccugcucauauugu

SEQ ID NO: 3823004 - RNA, 16 nt, Human
auuccucuuugcuuug

SEQ ID NO: 3823005 - RNA, 16 nt, Human
auuccugaagaaccag

SEQ ID NO: 3823006 - RNA, 19 nt, Human
auuccugaaugaaauauca

SEQ ID NO: 3823007 - RNA, 14 nt, Human
auuccugacccagg

SEQ ID NO: 3823008 - RNA, 22 nt, Human
auuccugacccaggccgcagcu

SEQ ID NO: 3823009 - RNA, 23 nt, Human
auuccuggagcccgaggcaccag

SEQ ID NO: 3823010 - RNA, 13 nt, Human
auuccugggcaca

SEQ ID NO: 3823011 - RNA, 18 nt, Human
auuccugguacccagcca

SEQ ID NO: 3823012 - RNA, 20 nt, Human
auuccugguacccagccauc

SEQ ID NO: 3823013 - RNA, 21 nt, Human
auuccuguacugugucucaug

SEQ ID NO: 3823014 - RNA, 22 nt, Human
auuccuguggauguaaagugau

SEQ ID NO: 3823015 - RNA, 20 nt, Human
auuccuuagcuuagaccuca

SEQ ID NO: 3823016 - RNA, 23 nt, Human
auuccuuagcuuagaccucagcc

SEQ ID NO: 3823017 - RNA, 24 nt, Human
auuccuuagcuuagaccucagccu

SEQ ID NO: 3823018 - RNA, 18 nt, Human
auuccuuccuguucugaa

SEQ ID NO: 3823019 - RNA, 22 nt, Human
auuccuucucugaacacaggca

SEQ ID NO: 3823020 - RNA, 14 nt, Human
auuccuucuggccu

SEQ ID NO: 3823021 - RNA, 17 nt, Human
auuccuucuuugauaau

SEQ ID NO: 3823022 - RNA, 13 nt, Human
auuccuugauaau

SEQ ID NO: 3823023 - RNA, 12 nt, Human
auuccuuucccu

SEQ ID NO: 3823024 - RNA, 14 nt, Human
auuccuuucccuuc

SEQ ID NO: 3823025 - RNA, 19 nt, Human
auuccuuucccuuccucuu

SEQ ID NO: 3823026 - RNA, 14 nt, Human
auuccuuucccuuu

SEQ ID NO: 3823027 - RNA, 15 nt, Human
auuccuuucccuuua

SEQ ID NO: 3823028 - RNA, 17 nt, Human
auuccuuucucauccca

SEQ ID NO: 3823029 - RNA, 18 nt, Human
auuccuuugaagaggaaa

SEQ ID NO: 3823030 - RNA, 23 nt, Human
auuccuuugucuucaaacuguga

SEQ ID NO: 3823031 - RNA, 22 nt, Human
auuccuuuguuacuucucuaau

SEQ ID NO: 3823032 - RNA, 20 nt, Human
auuccuuuucuuguuuauca

SEQ ID NO: 3823033 - RNA, 18 nt, Human
auuccuuuuguguacagu

SEQ ID NO: 3823034 - RNA, 15 nt, Human
auuccuuuuuauuua

SEQ ID NO: 3823035 - RNA, 20 nt, Human
auuccuuuuuauuuauaugu

SEQ ID NO: 3823036 - RNA, 21 nt, Human
auuccuuuuuauuuauaugua

SEQ ID NO: 3823037 - RNA, 14 nt, Human
auucgagcuauauu

SEQ ID NO: 3823038 - RNA, 15 nt, Human
auucgagcuauauuu

SEQ ID NO: 3823039 - RNA, 17 nt, Human
auucgccacacaguauu

SEQ ID NO: 3823040 - RNA, 19 nt, Human
auucgccacacaguauuuu

SEQ ID NO: 3823041 - RNA, 14 nt, Human
auucgcuugagaaa

SEQ ID NO: 3823042 - RNA, 21 nt, Human
auucggaacuguccuuuccuu

SEQ ID NO: 3823043 - RNA, 15 nt, Human
auucgggccccaccu

SEQ ID NO: 3823044 - RNA, 17 nt, Human
auucgggccccaccugc

SEQ ID NO: 3823045 - RNA, 23 nt, Human
cagacuccuucaacaauucuaaa

SEQ ID NO: 3823046 - RNA, 22 nt, Human
cagacucgauucauauugaaua

SEQ ID NO: 3823047 - RNA, 17 nt, Human
cagacucuaagaaagaa

SEQ ID NO: 3823048 - RNA, 20 nt, Human
cagacucuacagaggccaug

SEQ ID NO: 3823049 - RNA, 23 nt, Human
cagacucuacagaggccaugggc

SEQ ID NO: 3823050 - RNA, 16 nt, Human
auucugggaauguaua

SEQ ID NO: 3823051 - RNA, 17 nt, Human
auucugggaauguauag

SEQ ID NO: 3823052 - RNA, 15 nt, Human
auucuggucucucua

SEQ ID NO: 3823053 - RNA, 12 nt, Human
auucuguaaaug

SEQ ID NO: 3823054 - RNA, 12 nt, Human
auucuguacaua

SEQ ID NO: 3823055 - RNA, 19 nt, Human
auucuguacauagccuaua

SEQ ID NO: 3823056 - RNA, 20 nt, Human
auucuguacauagccuauau

SEQ ID NO: 3823057 - RNA, 21 nt, Human
auucuguacugauuuuuguaa

SEQ ID NO: 3823058 - RNA, 15 nt, Human
auucuguagauucug

SEQ ID NO: 3823059 - RNA, 18 nt, Human
cagcauugauauuugugc

SEQ ID NO: 3823060 - RNA, 22 nt, Human
cagcauugauauuugugcauuu

SEQ ID NO: 3823061 - RNA, 18 nt, Human
cagcauuuagcuggccac

SEQ ID NO: 3823062 - RNA, 22 nt, Human
cagcauuuagcuggccacaugg

SEQ ID NO: 3823063 - RNA, 21 nt, Human
cagcauuuccacaccaagcag

SEQ ID NO: 3823064 - RNA, 15 nt, Human
cagcauuucugaagu

SEQ ID NO: 3823065 - RNA, 11 nt, Human
cagcauuugau

SEQ ID NO: 3823066 - RNA, 12 nt, Human
cagcauuugaua

SEQ ID NO: 3823067 - RNA, 14 nt, Human
cagcauuugauaau

SEQ ID NO: 3823068 - RNA, 17 nt, Human
cagcauuugauaaugau

SEQ ID NO: 3823069 - RNA, 22 nt, Human
cagcauuuguguguuacaaugu

SEQ ID NO: 3823070 - RNA, 23 nt, Human
cagcauuuuccucugcuuugaaa

SEQ ID NO: 3823071 - RNA, 19 nt, Human
cagccaaacccaugaggca

SEQ ID NO: 3823072 - RNA, 17 nt, Human
cagccaaagauaaucuc

SEQ ID NO: 3823073 - RNA, 20 nt, Human
cagccaaagauaaucucuca

SEQ ID NO: 3823074 - RNA, 18 nt, Human
cagccaaagccuccucca

SEQ ID NO: 3823075 - RNA, 22 nt, Human
cagccaaauguaauugaauaaa

SEQ ID NO: 3823076 - RNA, 14 nt, Human
cagccaaauuuaaa

SEQ ID NO: 3823077 - RNA, 23 nt, Human
cagccaacagcuacaacagccuc

SEQ ID NO: 3823078 - RNA, 23 nt, Human
cagccaacagguggcaggaccag

SEQ ID NO: 3823079 - RNA, 14 nt, Human
cagccaacuagccc

SEQ ID NO: 3823080 - RNA, 20 nt, Human
cagccaacuagccccugggg

SEQ ID NO: 3823081 - RNA, 18 nt, Human
cagccaacuauggccugu

SEQ ID NO: 3823082 - RNA, 19 nt, Human
cagccaagcacaguggugg

SEQ ID NO: 3823083 - RNA, 14 nt, Human
cagccaaguuuuau

SEQ ID NO: 3823084 - RNA, 15 nt, Human
cagccaauauuuaaa

SEQ ID NO: 3823085 - RNA, 11 nt, Human
cagccacacac

SEQ ID NO: 3823086 - RNA, 14 nt, Human
cagccacacacaca

SEQ ID NO: 3823087 - RNA, 15 nt, Human
cagccacacacacag

SEQ ID NO: 3823088 - RNA, 14 nt, Human
cagccacacuucuc

SEQ ID NO: 3823089 - RNA, 16 nt, Human
cagccacacuucucag

SEQ ID NO: 3823090 - RNA, 17 nt, Human
cagccacacuucucagg

SEQ ID NO: 3823091 - RNA, 14 nt, Human
cagccacacuugaa

SEQ ID NO: 3823092 - RNA, 23 nt, Human
cagccacaguuuccucaucuguc

SEQ ID NO: 3823093 - RNA, 17 nt, Human
cagccacauuccugaug

SEQ ID NO: 3823094 - RNA, 15 nt, Human
cagccaccccaugcu

SEQ ID NO: 3823095 - RNA, 18 nt, Human
cagccaccccaugcuggc

SEQ ID NO: 3823096 - RNA, 19 nt, Human
cagccaccccaugcuggcc

SEQ ID NO: 3823097 - RNA, 17 nt, Human
cagccaccccgggcucu

SEQ ID NO: 3823098 - RNA, 20 nt, Human
cagccacccugaggagucug

SEQ ID NO: 3823099 - RNA, 21 nt, Human
cagccacccugaggagucuga

SEQ ID NO: 3823100 - RNA, 20 nt, Human
cagccacggacgcuggcucc

SEQ ID NO: 3823101 - RNA, 20 nt, Human
cagccacuccccagccagcc

SEQ ID NO: 3823102 - RNA, 16 nt, Human
cagccacuccccggca

SEQ ID NO: 3823103 - RNA, 21 nt, Human
cagccacucgggaggcugaga

SEQ ID NO: 3823104 - RNA, 16 nt, Human
cagccacuuaggacaa

SEQ ID NO: 3823105 - RNA, 22 nt, Human
cagccagaaccccgagcccuac

SEQ ID NO: 3823106 - RNA, 12 nt, Human
cagccagaacuc

SEQ ID NO: 3823107 - RNA, 16 nt, Human
cagccagaccagcagg

SEQ ID NO: 3823108 - RNA, 15 nt, Human
cagccagacuggcac

SEQ ID NO: 3823109 - RNA, 15 nt, Human
cagccagaguuccug

SEQ ID NO: 3823110 - RNA, 19 nt, Human
cagccagaguuccugcgga

SEQ ID NO: 3823111 - RNA, 23 nt, Human
cagccagcaaugauguccagaag

SEQ ID NO: 3823112 - RNA, 14 nt, Human
cagccagcaccugg

SEQ ID NO: 3823113 - RNA, 16 nt, Human
cagccagcaccuggca

SEQ ID NO: 3823114 - RNA, 12 nt, Human
cagccagcagcc

SEQ ID NO: 3823115 - RNA, 23 nt, Human
cagccagcaguucagagcugccc

SEQ ID NO: 3823116 - RNA, 11 nt, Human
cagccagccca

SEQ ID NO: 3823117 - RNA, 15 nt, Human
cagccagcccagccc

SEQ ID NO: 3823118 - RNA, 17 nt, Human
cagccagcccugccugg

SEQ ID NO: 3823119 - RNA, 20 nt, Human
cagccagcccugccuggagg

SEQ ID NO: 3823120 - RNA, 14 nt, Human
cagccagccgugag

SEQ ID NO: 3823121 - RNA, 11 nt, Human
cagccagccuc

SEQ ID NO: 3823122 - RNA, 23 nt, Human
cagccagccucgcccauccccuu

SEQ ID NO: 3823123 - RNA, 14 nt, Human
cagccagccuggcu

SEQ ID NO: 3823124 - RNA, 15 nt, Human
cagccagccuggcug

SEQ ID NO: 3823125 - RNA, 18 nt, Human
cagccagcgccucccucc

SEQ ID NO: 3823126 - RNA, 21 nt, Human
cagccagcgccucccuccacc

SEQ ID NO: 3823127 - RNA, 23 nt, Human
cagccagcgucggucugugcccc

SEQ ID NO: 3823128 - RNA, 12 nt, Human
cagccagcucuc

SEQ ID NO: 3823129 - RNA, 16 nt, Human
cagccaggacaccggg

SEQ ID NO: 3823130 - RNA, 22 nt, Human
cagccaggaccauaccgggucu

SEQ ID NO: 3823131 - RNA, 11 nt, Human
cagccaggagc

SEQ ID NO: 3823132 - RNA, 22 nt, Human
cagccaggagcugggcagaagg

SEQ ID NO: 3823133 - RNA, 18 nt, Human
cagccaggagcugucacc

SEQ ID NO: 3823134 - RNA, 18 nt, Human
cagccaggccacuggccc

SEQ ID NO: 3823135 - RNA, 13 nt, Human
cagccaggcccag

SEQ ID NO: 3823136 - RNA, 17 nt, Human
cagccaggcccagccga

SEQ ID NO: 3823137 - RNA, 21 nt, Human
cagccaggcccagccgacccc

SEQ ID NO: 3823138 - RNA, 15 nt, Human
cagccaggccccagg

SEQ ID NO: 3823139 - RNA, 13 nt, Human
cagccaggcgggc

SEQ ID NO: 3823140 - RNA, 19 nt, Human
cagccaggcgggcucaagg

SEQ ID NO: 3823141 - RNA, 16 nt, Human
cagccaggcucugugc

SEQ ID NO: 3823142 - RNA, 22 nt, Human
cagccaggcucugugcugaccc

SEQ ID NO: 3823143 - RNA, 23 nt, Human
cagccaggcucugugcugacccu

SEQ ID NO: 3823144 - RNA, 14 nt, Human
cagccagggagagc

SEQ ID NO: 3823145 - RNA, 24 nt, Human
cagccagggagagcccaggagcuc

SEQ ID NO: 3823146 - RNA, 20 nt, Human
cagccagggaggacaagcag

SEQ ID NO: 3823147 - RNA, 16 nt, Human
cagccagggccugcga

SEQ ID NO: 3823148 - RNA, 15 nt, Human
cagccagggcugcua

SEQ ID NO: 3823149 - RNA, 16 nt, Human
cagccaggugccuugg

SEQ ID NO: 3823150 - RNA, 22 nt, Human
cagccaguaaaugggggugcau

SEQ ID NO: 3823151 - RNA, 22 nt, Human
cagccagucccguuucauuuag

SEQ ID NO: 3823152 - RNA, 18 nt, Human
cagccagugagaugaggg

SEQ ID NO: 3823153 - RNA, 17 nt, Human
cagccagugcccugagc

SEQ ID NO: 3823154 - RNA, 18 nt, Human
cagccagugcccugagcc

SEQ ID NO: 3823155 - RNA, 21 nt, Human
cagccagugcccugagccagg

SEQ ID NO: 3823156 - RNA, 18 nt, Human
cagccauaggcccuuuca

SEQ ID NO: 3823157 - RNA, 20 nt, Human
cagccauaggcccuuucagu

SEQ ID NO: 3823158 - RNA, 16 nt, Human
cagccaucaaaaugcu

SEQ ID NO: 3823159 - RNA, 17 nt, Human
cagccaucaaaaugcuu

SEQ ID NO: 3823160 - RNA, 20 nt, Human
cagccaugccagcuggccuu

SEQ ID NO: 3823161 - RNA, 14 nt, Human
cagccauguacaga

SEQ ID NO: 3823162 - RNA, 17 nt, Human
cagccaugugcugcgug

SEQ ID NO: 3823163 - RNA, 21 nt, Human
cagccaugugcugcgugccug

SEQ ID NO: 3823164 - RNA, 16 nt, Human
cagccauuaccaugga

SEQ ID NO: 3823165 - RNA, 15 nt, Human
cagccauugcaccca

SEQ ID NO: 3823166 - RNA, 19 nt, Human
cagccauuggcuauuuaaa

SEQ ID NO: 3823167 - RNA, 21 nt, Human
cagcccaaaggggacaggccu

SEQ ID NO: 3823168 - RNA, 10 nt, Human
cagcccaagu

SEQ ID NO: 3823169 - RNA, 22 nt, Human
cagcccaauccagguacgcaca

SEQ ID NO: 3823170 - RNA, 17 nt, Human
cagcccaaucugccaga

SEQ ID NO: 3823171 - RNA, 17 nt, Human
cagcccaccccauggcc

SEQ ID NO: 3823172 - RNA, 18 nt, Human
cagcccacccuccugucu

SEQ ID NO: 3823173 - RNA, 22 nt, Human
cagcccacccuccugucuuccc

SEQ ID NO: 3823174 - RNA, 15 nt, Human
cagcccacguccugu

SEQ ID NO: 3823175 - RNA, 15 nt, Human
cagcccacuggauca

SEQ ID NO: 3823176 - RNA, 15 nt, Human
cagcccacuucugcc

SEQ ID NO: 3823177 - RNA, 11 nt, Human
cagcccagaga

SEQ ID NO: 3823178 - RNA, 21 nt, Human
cagcccagagacauacuugaa

SEQ ID NO: 3823179 - RNA, 13 nt, Human
cagcccagcccag

SEQ ID NO: 3823180 - RNA, 14 nt, Human
cagcccagcccagc

SEQ ID NO: 3823181 - RNA, 13 nt, Human
cagcccagcugcu

SEQ ID NO: 3823182 - RNA, 23 nt, Human
cagcccagcugcucugcccagag

SEQ ID NO: 3823183 - RNA, 20 nt, Human
cagcccaggaagucucaucu

SEQ ID NO: 3823184 - RNA, 12 nt, Human
cagcccagggac

SEQ ID NO: 3823185 - RNA, 18 nt, Human
cagcccagggcuccugca

SEQ ID NO: 3823186 - RNA, 11 nt, Human
cagcccagggu

SEQ ID NO: 3823187 - RNA, 12 nt, Human
cagcccauccau

SEQ ID NO: 3823188 - RNA, 18 nt, Human
cagcccauccauuaggcc

SEQ ID NO: 3823189 - RNA, 18 nt, Human
cagcccauggcccugugc

SEQ ID NO: 3823190 - RNA, 18 nt, Human
cagcccauucucucuccu

SEQ ID NO: 3823191 - RNA, 12 nt, Human
cagcccauuucu

SEQ ID NO: 3823192 - RNA, 16 nt, Human
cagcccauuucuccag

SEQ ID NO: 3823193 - RNA, 20 nt, Human
cagcccauuucuccagaacc

SEQ ID NO: 3823194 - RNA, 17 nt, Human
cagcccauuugggcaga

SEQ ID NO: 3823195 - RNA, 22 nt, Human
cagcacagccucuuagaugcag

SEQ ID NO: 3823196 - RNA, 17 nt, Human
cagcacagcucccugcc

SEQ ID NO: 3823197 - RNA, 22 nt, Human
cagcacagcuuagauuucauag

SEQ ID NO: 3823198 - RNA, 13 nt, Human
cagcacagcuuga

SEQ ID NO: 3823199 - RNA, 17 nt, Human
cagcacagcuugaccug

SEQ ID NO: 3823200 - RNA, 18 nt, Human
cagcacagggauccgacu

SEQ ID NO: 3823201 - RNA, 11 nt, Human
cagcaccaaau

SEQ ID NO: 3823202 - RNA, 13 nt, Human
cagcaccaccagg

SEQ ID NO: 3823203 - RNA, 14 nt, Human
cagcaccacucaag

SEQ ID NO: 3823204 - RNA, 21 nt, Human
cagcaccauccgccagggccc

SEQ ID NO: 3823205 - RNA, 16 nt, Human
cagcaccccugucucu

SEQ ID NO: 3823206 - RNA, 17 nt, Human
cagcacccuauaaauca

SEQ ID NO: 3823207 - RNA, 15 nt, Human
cagcaccgaggggcc

SEQ ID NO: 3823208 - RNA, 18 nt, Human
cagcaccgaggggccuuu

SEQ ID NO: 3823209 - RNA, 19 nt, Human
cagcaccggaccagccugg

SEQ ID NO: 3823210 - RNA, 22 nt, Human
cagcaccggaccagccuggccc

SEQ ID NO: 3823211 - RNA, 15 nt, Human
cagcaccucagccug

SEQ ID NO: 3823212 - RNA, 16 nt, Human
cagcaccuccaggccu

SEQ ID NO: 3823213 - RNA, 14 nt, Human
cagcaccuccucag

SEQ ID NO: 3823214 - RNA, 17 nt, Human
cagcaccuccucagccu

SEQ ID NO: 3823215 - RNA, 12 nt, Human
cagcaccuggca

SEQ ID NO: 3823216 - RNA, 13 nt, Human
cagcaccugucuc

SEQ ID NO: 3823217 - RNA, 16 nt, Human
cagcaccuugugccug

SEQ ID NO: 3823218 - RNA, 19 nt, Human
cagcaccuugugccugggg

SEQ ID NO: 3823219 - RNA, 15 nt, Human
cagcacgauuucugu

SEQ ID NO: 3823220 - RNA, 14 nt, Human
cagcacuaaacuug

SEQ ID NO: 3823221 - RNA, 19 nt, Human
cagcacuaaagcaguggac

SEQ ID NO: 3823222 - RNA, 14 nt, Human
cagcacuacucugu

SEQ ID NO: 3823223 - RNA, 15 nt, Human
cagcacuacugggug

SEQ ID NO: 3823224 - RNA, 19 nt, Human
cagcacuacugggugucau

SEQ ID NO: 3823225 - RNA, 20 nt, Human
cagcacuacugggugucauu

SEQ ID NO: 3823226 - RNA, 20 nt, Human
cagcacuaugcuuuccuucu

SEQ ID NO: 3823227 - RNA, 17 nt, Human
cagcacucacacaggac

SEQ ID NO: 3823228 - RNA, 22 nt, Human
cagcacucgcuagcaguggcag

SEQ ID NO: 3823229 - RNA, 17 nt, Human
cagcacugaggaagaac

SEQ ID NO: 3823230 - RNA, 13 nt, Human
cagcacugcccaa

SEQ ID NO: 3823231 - RNA, 16 nt, Human
cagcacugcuugagga

SEQ ID NO: 3823232 - RNA, 23 nt, Human
cagcacuggcucucuccaggauc

SEQ ID NO: 3823233 - RNA, 12 nt, Human
cagcacuguccc

SEQ ID NO: 3823234 - RNA, 18 nt, Human
cagcacugucccuugccu

SEQ ID NO: 3823235 - RNA, 20 nt, Human
cagcacugucccuugccuca

SEQ ID NO: 3823236 - RNA, 16 nt, Human
cagcacuuggcccuuc

SEQ ID NO: 3823237 - RNA, 21 nt, Human
cagcacuugucucauuuuaau

SEQ ID NO: 3823238 - RNA, 16 nt, Human
cagcacuuugggaggc

SEQ ID NO: 3823239 - RNA, 18 nt, Human
cagcacuuugggaggcug

SEQ ID NO: 3823240 - RNA, 22 nt, Human
cagcacuuugggaggcugaggu

SEQ ID NO: 3823241 - RNA, 22 nt, Human
cagcagaaaugccuuacccuca

SEQ ID NO: 3823242 - RNA, 15 nt, Human
cagcagaagacaaaa

SEQ ID NO: 3823243 - RNA, 12 nt, Human
cagcagacagag

SEQ ID NO: 3823244 - RNA, 14 nt, Human
cagcagacagagcc

SEQ ID NO: 3823245 - RNA, 13 nt, Human
cagcagacauugu

SEQ ID NO: 3823246 - RNA, 16 nt, Human
cagcagacauugucag

SEQ ID NO: 3823247 - RNA, 14 nt, Human
cagcagacuaugaa

SEQ ID NO: 3823248 - RNA, 18 nt, Human
cagcagagacuugggaca

SEQ ID NO: 3823249 - RNA, 19 nt, Human
cagcagagacuugggacau

SEQ ID NO: 3823250 - RNA, 13 nt, Human
cagcagagcaccu

SEQ ID NO: 3823251 - RNA, 9 nt, Human
cagcagagu

SEQ ID NO: 3823252 - RNA, 13 nt, Human
cagcagagugugg

SEQ ID NO: 3823253 - RNA, 16 nt, Human
cagcagaucccagcuc

SEQ ID NO: 3823254 - RNA, 18 nt, Human
cagcagaucccagcucac

SEQ ID NO: 3823255 - RNA, 14 nt, Human
cagcagauuauuca

SEQ ID NO: 3823256 - RNA, 14 nt, Human
cagcagauuggaag

SEQ ID NO: 3823257 - RNA, 18 nt, Human
cagcagauuggaaggaga

SEQ ID NO: 3823258 - RNA, 20 nt, Human
cagcagauuggaaggagaca

SEQ ID NO: 3823259 - RNA, 11 nt, Human
cagcagcaaga

SEQ ID NO: 3823260 - RNA, 13 nt, Human
cagcagcaagaaa

SEQ ID NO: 3823261 - RNA, 20 nt, Human
cagcagcaagaaaaaaaaau

SEQ ID NO: 3823262 - RNA, 16 nt, Human
cagcagcagcagguga

SEQ ID NO: 3823263 - RNA, 15 nt, Human
cagcagcagcccaag

SEQ ID NO: 3823264 - RNA, 13 nt, Human
cagcagcagcccu

SEQ ID NO: 3823265 - RNA, 15 nt, Human
cagcagcagcccugc

SEQ ID NO: 3823266 - RNA, 11 nt, Human
cagcagccagc

SEQ ID NO: 3823267 - RNA, 13 nt, Human
cagcagccagcca

SEQ ID NO: 3823268 - RNA, 19 nt, Human
cagcagccagcccugccug

SEQ ID NO: 3823269 - RNA, 20 nt, Human
cagcagccagcucucagcca

SEQ ID NO: 3823270 - RNA, 13 nt, Human
cagcagcccaagc

SEQ ID NO: 3823271 - RNA, 12 nt, Human
cagcagccccca

SEQ ID NO: 3823272 - RNA, 20 nt, Human
cagcagcccccagcucccac

SEQ ID NO: 3823273 - RNA, 13 nt, Human
cagcagccccugc

SEQ ID NO: 3823274 - RNA, 24 nt, Human
cagcagcccuaaggaucucucagg

SEQ ID NO: 3823275 - RNA, 14 nt, Human
cagcagcccuccuc

SEQ ID NO: 3823276 - RNA, 15 nt, Human
cagcagcccuccuca

SEQ ID NO: 3823277 - RNA, 17 nt, Human
cagcagcccuccucacc

SEQ ID NO: 3823278 - RNA, 18 nt, Human
cagcuggacccugaccag

SEQ ID NO: 3823279 - RNA, 23 nt, Human
cagcuggacccugaccagcuccc

SEQ ID NO: 3823280 - RNA, 17 nt, Human
cagcuggacucugcauc

SEQ ID NO: 3823281 - RNA, 14 nt, Human
cagcuggaggcagg

SEQ ID NO: 3823282 - RNA, 23 nt, Human
cagcuggaggcaggggcuuccug

SEQ ID NO: 3823283 - RNA, 13 nt, Human
cagcuggccugga

SEQ ID NO: 3823284 - RNA, 22 nt, Human
cagcuggcucuacuuccccaug

SEQ ID NO: 3823285 - RNA, 12 nt, Human
cagcugggagaa

SEQ ID NO: 3823286 - RNA, 12 nt, Human
cagcugggaggc

SEQ ID NO: 3823287 - RNA, 13 nt, Human
cagcugggaggca

SEQ ID NO: 3823288 - RNA, 22 nt, Human
cagcugggaggcaagaggggug

SEQ ID NO: 3823289 - RNA, 15 nt, Human
cagcugggcccaacc

SEQ ID NO: 3823290 - RNA, 14 nt, Human
cagcugggcucugc

SEQ ID NO: 3823291 - RNA, 18 nt, Human
cagcugggcucugccacc

SEQ ID NO: 3823292 - RNA, 18 nt, Human
cagcuggggccaggcugg

SEQ ID NO: 3823293 - RNA, 19 nt, Human
cagcuggggccaggcuggg

SEQ ID NO: 3823294 - RNA, 18 nt, Human
cagcuggggcguggggag

SEQ ID NO: 3823295 - RNA, 20 nt, Human
cagcuggggcguggggaggg

SEQ ID NO: 3823296 - RNA, 14 nt, Human
cagcuggggugcag

SEQ ID NO: 3823297 - RNA, 15 nt, Human
cagcuggggugcagg

SEQ ID NO: 3823298 - RNA, 18 nt, Human
cagcuggggugcagggau

SEQ ID NO: 3823299 - RNA, 19 nt, Human
cagcuggggugcagggaug

SEQ ID NO: 3823300 - RNA, 23 nt, Human
cagcugggguggggaccucaggc

SEQ ID NO: 3823301 - RNA, 16 nt, Human
cagcugggucaggcag

SEQ ID NO: 3823302 - RNA, 22 nt, Human
cagcuggguggcacugccaugc

SEQ ID NO: 3823303 - RNA, 19 nt, Human
cagcuggugcccugcuuuc

SEQ ID NO: 3823304 - RNA, 20 nt, Human
cagcuggugcccugcuuuca

SEQ ID NO: 3823305 - RNA, 21 nt, Human
cagcuggugcccugcuuucag

SEQ ID NO: 3823306 - RNA, 22 nt, Human
cagcugguguagcuacagagaa

SEQ ID NO: 3823307 - RNA, 14 nt, Human
cagcuguauagcug

SEQ ID NO: 3823308 - RNA, 18 nt, Human
cagcuguaugauucccag

SEQ ID NO: 3823309 - RNA, 19 nt, Human
cagcuguaugauucccagc

SEQ ID NO: 3823310 - RNA, 15 nt, Human
cagcuguccccccac

SEQ ID NO: 3823311 - RNA, 16 nt, Human
cagcuguccccccacu

SEQ ID NO: 3823312 - RNA, 12 nt, Human
cagcugucccug

SEQ ID NO: 3823313 - RNA, 14 nt, Human
cagcugucccuguc

SEQ ID NO: 3823314 - RNA, 15 nt, Human
cagcugucccuguca

SEQ ID NO: 3823315 - RNA, 24 nt, Human
cagcugucccuugcuugccugcag

SEQ ID NO: 3823316 - RNA, 17 nt, Human
cagcuguccucccucca

SEQ ID NO: 3823317 - RNA, 18 nt, Human
cagcuguccucccuccac

SEQ ID NO: 3823318 - RNA, 22 nt, Human
cagcuguccugcagcaaacacu

SEQ ID NO: 3823319 - RNA, 18 nt, Human
cagcugucuuuuggagga

SEQ ID NO: 3823320 - RNA, 11 nt, Human
cagcugugccu

SEQ ID NO: 3823321 - RNA, 20 nt, Human
cagcugugccucgcucccca

SEQ ID NO: 3823322 - RNA, 24 nt, Human
cagcugugcucuggacaggcaugu

SEQ ID NO: 3823323 - RNA, 11 nt, Human
cagcugugcuu

SEQ ID NO: 3823324 - RNA, 23 nt, Human
cagcuguguccggcccaguuuug

SEQ ID NO: 3823325 - RNA, 19 nt, Human
cagcuguucagauuggaca

SEQ ID NO: 3823326 - RNA, 20 nt, Human
cagcuguucagauuggacau

SEQ ID NO: 3823327 - RNA, 19 nt, Human
cagcuguucagcugguuga

SEQ ID NO: 3823328 - RNA, 23 nt, Human
cagcuguugagccccuccuaguu

SEQ ID NO: 3823329 - RNA, 14 nt, Human
cagcuguugucucu

SEQ ID NO: 3823330 - RNA, 17 nt, Human
cagcuguugucucuucu

SEQ ID NO: 3823331 - RNA, 21 nt, Human
cagcuguugucucuucuccuu

SEQ ID NO: 3823332 - RNA, 24 nt, Human
cagcuguuucuagaguuccuacca

SEQ ID NO: 3823333 - RNA, 16 nt, Human
cagcuuagauuucaua

SEQ ID NO: 3823334 - RNA, 16 nt, Human
cagcuuagggcccugg

SEQ ID NO: 3823335 - RNA, 20 nt, Human
cagcuuagggcccuggaggc

SEQ ID NO: 3823336 - RNA, 18 nt, Human
cagcuuauaaugggcucu

SEQ ID NO: 3823337 - RNA, 13 nt, Human
cagcuuauacgaa

SEQ ID NO: 3823338 - RNA, 19 nt, Human
cagcuuauacgaaauaauu

SEQ ID NO: 3823339 - RNA, 15 nt, Human
cagcuuaucucuuuu

SEQ ID NO: 3823340 - RNA, 19 nt, Human
cagcuuaucucuuuuauau

SEQ ID NO: 3823341 - RNA, 23 nt, Human
caggccccgcuuguccagcgccu

SEQ ID NO: 3823342 - RNA, 14 nt, Human
caggccccucccuc

SEQ ID NO: 3823343 - RNA, 17 nt, Human
caggccccucccucucc

SEQ ID NO: 3823344 - RNA, 22 nt, Human
caggccccuggaggcugccucc

SEQ ID NO: 3823345 - RNA, 13 nt, Human
caggcccggcucc

SEQ ID NO: 3823346 - RNA, 14 nt, Human
caggcccggcucca

SEQ ID NO: 3823347 - RNA, 15 nt, Human
caggcccggcuccag

SEQ ID NO: 3823348 - RNA, 21 nt, Human
caggcccggcuccaggcuccu

SEQ ID NO: 3823349 - RNA, 15 nt, Human
caggcccgucugucc

SEQ ID NO: 3823350 - RNA, 21 nt, Human
caggcccgucuguccaucugc

SEQ ID NO: 3823351 - RNA, 22 nt, Human
caggcccgucuguccaucugcc

SEQ ID NO: 3823352 - RNA, 22 nt, Human
caggcccucccuguuccccaga

SEQ ID NO: 3823353 - RNA, 16 nt, Human
caggcccuccucuccc

SEQ ID NO: 3823354 - RNA, 13 nt, Human
caggcccucugcc

SEQ ID NO: 3823355 - RNA, 19 nt, Human
caggcccucugcccacucc

SEQ ID NO: 3823356 - RNA, 16 nt, Human
caggcccugcaguguu

SEQ ID NO: 3823357 - RNA, 15 nt, Human
caggcccugcuccug

SEQ ID NO: 3823358 - RNA, 15 nt, Human
caggcccuggaacuc

SEQ ID NO: 3823359 - RNA, 20 nt, Human
caggcccuggccuccccugc

SEQ ID NO: 3823360 - RNA, 22 nt, Human
caggcccuggccuccccugcca

SEQ ID NO: 3823361 - RNA, 20 nt, Human
caggcccuggcuaagaccca

SEQ ID NO: 3823362 - RNA, 22 nt, Human
caggcccuggcugagggcagcu

SEQ ID NO: 3823363 - RNA, 18 nt, Human
caggcccuuccucuccac

SEQ ID NO: 3823364 - RNA, 20 nt, Human
caggcccuuccucuccacug

SEQ ID NO: 3823365 - RNA, 21 nt, Human
caggcccuuccucuccacugc

SEQ ID NO: 3823366 - RNA, 20 nt, Human
caggcccuuugaagccucag

SEQ ID NO: 3823367 - RNA, 21 nt, Human
caggcccuuugaagccucagc

SEQ ID NO: 3823368 - RNA, 22 nt, Human
caggcccuuugaagccucagcu

SEQ ID NO: 3823369 - RNA, 20 nt, Human
caggccgccccagccucuga

SEQ ID NO: 3823370 - RNA, 23 nt, Human
caggccgccccagccucugagcc

SEQ ID NO: 3823371 - RNA, 18 nt, Human
caggccgcgcccuuuccc

SEQ ID NO: 3823372 - RNA, 13 nt, Human
caggccggcagcc

SEQ ID NO: 3823373 - RNA, 14 nt, Human
caggccggccagcc

SEQ ID NO: 3823374 - RNA, 14 nt, Human
caggccgggcagag

SEQ ID NO: 3823375 - RNA, 19 nt, Human
caggccgggccuguacagu

SEQ ID NO: 3823376 - RNA, 18 nt, Human
caggccguccucccgggc

SEQ ID NO: 3823377 - RNA, 22 nt, Human
caggccguccucccgggcccuc

SEQ ID NO: 3823378 - RNA, 13 nt, Human
caggccuauuuca

SEQ ID NO: 3823379 - RNA, 16 nt, Human
caggccuauuucauca

SEQ ID NO: 3823380 - RNA, 12 nt, Human
caggccucaccu

SEQ ID NO: 3823381 - RNA, 22 nt, Human
caggccucaccucuacccaaac

SEQ ID NO: 3823382 - RNA, 17 nt, Human
caggccucagggcuccu

SEQ ID NO: 3823383 - RNA, 16 nt, Human
caggccucccucucuc

SEQ ID NO: 3823384 - RNA, 18 nt, Human
caggccucccucucucuu

SEQ ID NO: 3823385 - RNA, 19 nt, Human
caggccucccucucucuuc

SEQ ID NO: 3823386 - RNA, 18 nt, Human
caggccucccugccagua

SEQ ID NO: 3823387 - RNA, 12 nt, Human
caggccuccuac

SEQ ID NO: 3823388 - RNA, 17 nt, Human
caggccucuccauuugc

SEQ ID NO: 3823389 - RNA, 12 nt, Human
caggccucugug

SEQ ID NO: 3823390 - RNA, 15 nt, Human
caggccugaaagagg

SEQ ID NO: 3823391 - RNA, 20 nt, Human
caggccugaaagaggcugag

SEQ ID NO: 3823392 - RNA, 23 nt, Human
caggccugaaagaggcugaggcc

SEQ ID NO: 3823393 - RNA, 15 nt, Human
caggccugacucuca

SEQ ID NO: 3823394 - RNA, 18 nt, Human
caggccugagauuucauc

SEQ ID NO: 3823395 - RNA, 14 nt, Human
caggccugccagac

SEQ ID NO: 3823396 - RNA, 12 nt, Human
caggccugccuc

SEQ ID NO: 3823397 - RNA, 13 nt, Human
caggccugccucc

SEQ ID NO: 3823398 - RNA, 14 nt, Human
caggccugccuccc

SEQ ID NO: 3823399 - RNA, 15 nt, Human
caggccugccuccca

SEQ ID NO: 3823400 - RNA, 15 nt, Human
caggccuggccuugg

SEQ ID NO: 3823401 - RNA, 14 nt, Human
caggccugggucug

SEQ ID NO: 3823402 - RNA, 20 nt, Human
caggccugggucugugucuc

SEQ ID NO: 3823403 - RNA, 17 nt, Human
caggccuuaucuccaag

SEQ ID NO: 3823404 - RNA, 22 nt, Human
caggccuuaucuccaagaccag

SEQ ID NO: 3823405 - RNA, 16 nt, Human
caggccuuugagcuca

SEQ ID NO: 3823406 - RNA, 22 nt, Human
caggcgcaagggaggcccagcg

SEQ ID NO: 3823407 - RNA, 17 nt, Human
caggcgccggcgggcgg

SEQ ID NO: 3823408 - RNA, 15 nt, Human
caggcgcugugcuau

SEQ ID NO: 3823409 - RNA, 19 nt, Human
caggcgggacagugcugca

SEQ ID NO: 3823410 - RNA, 17 nt, Human
caggcggugggcaccca

SEQ ID NO: 3823411 - RNA, 21 nt, Human
caggcggugggcacccacccu

SEQ ID NO: 3823412 - RNA, 22 nt, Human
caggcguagaucaccagaauaa

SEQ ID NO: 3823413 - RNA, 22 nt, Human
caggcuaauuuuuuuguauuuu

SEQ ID NO: 3823414 - RNA, 20 nt, Human
caggcuacacugacacuggu

SEQ ID NO: 3823415 - RNA, 14 nt, Human
caggcuacugucag

SEQ ID NO: 3823416 - RNA, 21 nt, Human
caggcuauguauaaaauacau

SEQ ID NO: 3823417 - RNA, 16 nt, Human
caggcucacugccagg

SEQ ID NO: 3823418 - RNA, 11 nt, Human
caggcucagag

SEQ ID NO: 3823419 - RNA, 15 nt, Human
caggcucagagggug

SEQ ID NO: 3823420 - RNA, 14 nt, Human
caggcucaggcagg

SEQ ID NO: 3823421 - RNA, 19 nt, Human
caggcucaggcaggggccu

SEQ ID NO: 3823422 - RNA, 21 nt, Human
caggcucaggcaggggccucc

SEQ ID NO: 3823423 - RNA, 23 nt, Human
caggcucccaggagccugcccag

SEQ ID NO: 3823424 - RNA, 16 nt, Human
caggcucccagggaca

SEQ ID NO: 3823425 - RNA, 22 nt, Human
caggcucccagggacaccuggg

SEQ ID NO: 3823426 - RNA, 12 nt, Human
caggcuccgccc

SEQ ID NO: 3823427 - RNA, 16 nt, Human
caggcuccgcccuuag

SEQ ID NO: 3823428 - RNA, 22 nt, Human
caggcuccgcccuuaguccccc

SEQ ID NO: 3823429 - RNA, 16 nt, Human
caggcuccugccacca

SEQ ID NO: 3823430 - RNA, 15 nt, Human
caggcuccugugaua

SEQ ID NO: 3823431 - RNA, 13 nt, Human
caggcuccuuccu

SEQ ID NO: 3823432 - RNA, 18 nt, Human
caggcuccuuccugucuu

SEQ ID NO: 3823433 - RNA, 15 nt, Human
caggcucggccugcc

SEQ ID NO: 3823434 - RNA, 20 nt, Human
caggcucggccugcccccac

SEQ ID NO: 3823435 - RNA, 23 nt, Human
caggcucggccugcccccacccc

SEQ ID NO: 3823436 - RNA, 21 nt, Human
caggcucguggacugaguggg

SEQ ID NO: 3823437 - RNA, 19 nt, Human
caggcucucaggccagcug

SEQ ID NO: 3823438 - RNA, 15 nt, Human
caggcucucugggcu

SEQ ID NO: 3823439 - RNA, 14 nt, Human
caggcucugcccug

SEQ ID NO: 3823440 - RNA, 21 nt, Human
caggcucugcccugcccuagc

SEQ ID NO: 3823441 - RNA, 18 nt, Human
caggcucugugcugaccc

SEQ ID NO: 3823442 - RNA, 12 nt, Human
caggcucuuagc

SEQ ID NO: 3823443 - RNA, 18 nt, Human
caggcucuuagcagcuuc

SEQ ID NO: 3823444 - RNA, 18 nt, Human
caggcucuucuccuuuca

SEQ ID NO: 3823445 - RNA, 19 nt, Human
caggcugacguuccgggca

SEQ ID NO: 3823446 - RNA, 22 nt, Human
caggcugagguccugaucagcu

SEQ ID NO: 3823447 - RNA, 17 nt, Human
caggcugagugcaggcc

SEQ ID NO: 3823448 - RNA, 18 nt, Human
caggcugagugcaggccc

SEQ ID NO: 3823449 - RNA, 19 nt, Human
caggcugagugcaggccca

SEQ ID NO: 3823450 - RNA, 16 nt, Human
caggcugauuucuagg

SEQ ID NO: 3823451 - RNA, 17 nt, Human
caggcugauuucuaggu

SEQ ID NO: 3823452 - RNA, 19 nt, Human
caggcugcagcuggacaga

SEQ ID NO: 3823453 - RNA, 20 nt, Human
caggcugcagcuggacagag

SEQ ID NO: 3823454 - RNA, 18 nt, Human
caggcugcauagaaggag

SEQ ID NO: 3823455 - RNA, 22 nt, Human
caggcugcauagaaggaggaga

SEQ ID NO: 3823456 - RNA, 21 nt, Human
caggcugccaaggccagagug

SEQ ID NO: 3823457 - RNA, 17 nt, Human
caggcugccagugccug

SEQ ID NO: 3823458 - RNA, 20 nt, Human
caggcugccagugccugggu

SEQ ID NO: 3823459 - RNA, 16 nt, Human
caggcugccucccuug

SEQ ID NO: 3823460 - RNA, 21 nt, Human
caggcugccugagcaccuccc

SEQ ID NO: 3823461 - RNA, 14 nt, Human
caggcugccugagu

SEQ ID NO: 3823462 - RNA, 16 nt, Human
caggcugcggccccuc

SEQ ID NO: 3823463 - RNA, 20 nt, Human
caggcugcggccccuccccc

SEQ ID NO: 3823464 - RNA, 18 nt, Human
caggcugcucagggcugg

SEQ ID NO: 3823465 - RNA, 20 nt, Human
caggcugcucuugaacuccu

SEQ ID NO: 3823466 - RNA, 12 nt, Human
caggcugcugga

SEQ ID NO: 3823467 - RNA, 14 nt, Human
caggcugcuggagg

SEQ ID NO: 3823468 - RNA, 13 nt, Human
caggcugcuggcg

SEQ ID NO: 3823469 - RNA, 21 nt, Human
caggcugcuggcgccucugca

SEQ ID NO: 3823470 - RNA, 22 nt, Human
caggcugcuggcgccucugcaa

SEQ ID NO: 3823471 - RNA, 23 nt, Human
caggcugcuggggccucagacga

SEQ ID NO: 3823472 - RNA, 14 nt, Human
caggcuggacgugg

SEQ ID NO: 3823473 - RNA, 16 nt, Human
caggcuggaguuauug

SEQ ID NO: 3823474 - RNA, 21 nt, Human
caggcuggcaccgccuucucu

SEQ ID NO: 3823475 - RNA, 13 nt, Human
caggcuggcagcu

SEQ ID NO: 3823476 - RNA, 15 nt, Human
caggcuggcagcucu

SEQ ID NO: 3823477 - RNA, 18 nt, Human
caggcuggcagcucucca

SEQ ID NO: 3823478 - RNA, 14 nt, Human
caggcuggccagcc

SEQ ID NO: 3823479 - RNA, 17 nt, Human
caggcuggccagcccca

SEQ ID NO: 3823480 - RNA, 23 nt, Human
caggcuggccagccccacagccc

SEQ ID NO: 3823481 - RNA, 15 nt, Human
caggcuggccagccg

SEQ ID NO: 3823482 - RNA, 12 nt, Human
caggcuggcccu

SEQ ID NO: 3823483 - RNA, 15 nt, Human
caggcuggcccugcc

SEQ ID NO: 3823484 - RNA, 21 nt, Human
caggcuggccuggggucaggc

SEQ ID NO: 3823485 - RNA, 16 nt, Human
auuuguuugugcuucu

SEQ ID NO: 3823486 - RNA, 18 nt, Human
auuuguuugugcuucuaa

SEQ ID NO: 3823487 - RNA, 22 nt, Human
auuuguuuguuuguuuuauuca

SEQ ID NO: 3823488 - RNA, 16 nt, Human
auuuguuuuggauaua

SEQ ID NO: 3823489 - RNA, 17 nt, Human
auuuguuuuuaaacugu

SEQ ID NO: 3823490 - RNA, 18 nt, Human
auuuguuuuuaaacugua

SEQ ID NO: 3823491 - RNA, 21 nt, Human
auuuguuuuuaaacuguacag

SEQ ID NO: 3823492 - RNA, 22 nt, Human
auuuguuuuuguauuuuuaaug

SEQ ID NO: 3823493 - RNA, 12 nt, Human
auuuuaaaaaag

SEQ ID NO: 3823494 - RNA, 13 nt, Human
auuuuaaaaaagg

SEQ ID NO: 3823495 - RNA, 19 nt, Human
auuuuaaaaaaugaaaaua

SEQ ID NO: 3823496 - RNA, 23 nt, Human
auuuuaaaaaaugaaaauaagug

SEQ ID NO: 3823497 - RNA, 17 nt, Human
auuuuaaaaaaugguca

SEQ ID NO: 3823498 - RNA, 14 nt, Human
auuuuaaaaagucu

SEQ ID NO: 3823499 - RNA, 18 nt, Human
auuuuaaaaauacauauc

SEQ ID NO: 3823500 - RNA, 13 nt, Human
auuuuaaaaauga

SEQ ID NO: 3823501 - RNA, 14 nt, Human
auuuuaaaauaaac

SEQ ID NO: 3823502 - RNA, 23 nt, Human
auuuuaaaauagcguucuuguaa

SEQ ID NO: 3823503 - RNA, 20 nt, Human
auuuuaaaaucuccuaaaug

SEQ ID NO: 3823504 - RNA, 12 nt, Human
auuuuaaaaugu

SEQ ID NO: 3823505 - RNA, 13 nt, Human
auuuuaaaaugua

SEQ ID NO: 3823506 - RNA, 15 nt, Human
auuuuaaaauguaca

SEQ ID NO: 3823507 - RNA, 13 nt, Human
auuuuaaaauuuc

SEQ ID NO: 3823508 - RNA, 15 nt, Human
auuuuaaaauuuguu

SEQ ID NO: 3823509 - RNA, 19 nt, Human
cagggcaucuugcuggcua

SEQ ID NO: 3823510 - RNA, 19 nt, Human
cagggcaugcauuuugcag

SEQ ID NO: 3823511 - RNA, 20 nt, Human
cagggcauggccagguggcc

SEQ ID NO: 3823512 - RNA, 20 nt, Human
cagggccaaacgcugagcca

SEQ ID NO: 3823513 - RNA, 18 nt, Human
cagggccaacccuucucc

SEQ ID NO: 3823514 - RNA, 17 nt, Human
cagggccacgcuccagc

SEQ ID NO: 3823515 - RNA, 18 nt, Human
cagggccacgcuccagcu

SEQ ID NO: 3823516 - RNA, 20 nt, Human
cagggccacgugccaggccc

SEQ ID NO: 3823517 - RNA, 21 nt, Human
cagggccacgugccaggcccg

SEQ ID NO: 3823518 - RNA, 19 nt, Human
cagggccagaaguagcuuu

SEQ ID NO: 3823519 - RNA, 22 nt, Human
cagggccagaugagcagaagcu

SEQ ID NO: 3823520 - RNA, 12 nt, Human
cagggccaggac

SEQ ID NO: 3823521 - RNA, 13 nt, Human
cagggccaggacu

SEQ ID NO: 3823522 - RNA, 12 nt, Human
cagggccagggc

SEQ ID NO: 3823523 - RNA, 13 nt, Human
cagggccagggcc

SEQ ID NO: 3823524 - RNA, 18 nt, Human
cagggccagggcccugca

SEQ ID NO: 3823525 - RNA, 21 nt, Human
cagggccaguggggccugugg

SEQ ID NO: 3823526 - RNA, 23 nt, Human
cagggccaugcugaggccugggc

SEQ ID NO: 3823527 - RNA, 16 nt, Human
cagggccauggcucag

SEQ ID NO: 3823528 - RNA, 17 nt, Human
cagggccauggcucagg

SEQ ID NO: 3823529 - RNA, 21 nt, Human
cagggccaugucagacacaga

SEQ ID NO: 3823530 - RNA, 14 nt, Human
cagggcccacaccc

SEQ ID NO: 3823531 - RNA, 17 nt, Human
cagggcccacacccccu

SEQ ID NO: 3823532 - RNA, 16 nt, Human
cagggcccagagccca

SEQ ID NO: 3823533 - RNA, 13 nt, Human
cagggcccagagg

SEQ ID NO: 3823534 - RNA, 16 nt, Human
cagggcccagaggcug

SEQ ID NO: 3823535 - RNA, 15 nt, Human
cagggccccagaagg

SEQ ID NO: 3823536 - RNA, 17 nt, Human
cagggccccagaaggca

SEQ ID NO: 3823537 - RNA, 21 nt, Human
cagggccccagaaggcaggga

SEQ ID NO: 3823538 - RNA, 18 nt, Human
cagggccccucacccugc

SEQ ID NO: 3823539 - RNA, 22 nt, Human
cagggccccucacccugccuua

SEQ ID NO: 3823540 - RNA, 15 nt, Human
cagggccccucuccc

SEQ ID NO: 3823541 - RNA, 23 nt, Human
cagggccgaccagaggagccuuu

SEQ ID NO: 3823542 - RNA, 14 nt, Human
cagggccgccaggg

SEQ ID NO: 3823543 - RNA, 22 nt, Human
cagggccgccagggagaccugg

SEQ ID NO: 3823544 - RNA, 21 nt, Human
cagggccgcccgggcccagag

SEQ ID NO: 3823545 - RNA, 22 nt, Human
cagggccgcccgggcccagagg

SEQ ID NO: 3823546 - RNA, 12 nt, Human
cagggccgggga

SEQ ID NO: 3823547 - RNA, 22 nt, Human
cagggccggggaacuggccaag

SEQ ID NO: 3823548 - RNA, 19 nt, Human
cagggccuagcugcuacaa

SEQ ID NO: 3823549 - RNA, 22 nt, Human
cagggccuagcugcuacaaaga

SEQ ID NO: 3823550 - RNA, 23 nt, Human
cagggccuagcugcuacaaagaa

SEQ ID NO: 3823551 - RNA, 16 nt, Human
cagggccucacacggu

SEQ ID NO: 3823552 - RNA, 13 nt, Human
cagggccucugcg

SEQ ID NO: 3823553 - RNA, 21 nt, Human
cagggccucugcggagcacac

SEQ ID NO: 3823554 - RNA, 18 nt, Human
cagggccugagccuggcc

SEQ ID NO: 3823555 - RNA, 20 nt, Human
cagggccugagccuggccag

SEQ ID NO: 3823556 - RNA, 21 nt, Human
cagggccugagccuggccagc

SEQ ID NO: 3823557 - RNA, 13 nt, Human
cagggccuggccc

SEQ ID NO: 3823558 - RNA, 12 nt, Human
cagggccugggg

SEQ ID NO: 3823559 - RNA, 14 nt, Human
cagggccuggggcc

SEQ ID NO: 3823560 - RNA, 19 nt, Human
cagggccuggggccugaga

SEQ ID NO: 3823561 - RNA, 20 nt, Human
cagggccuggggccugagag

SEQ ID NO: 3823562 - RNA, 23 nt, Human
cagggccuggggccugagagaau

SEQ ID NO: 3823563 - RNA, 18 nt, Human
cagggccugguugaagaa

SEQ ID NO: 3823564 - RNA, 14 nt, Human
cagggccugucuca

SEQ ID NO: 3823565 - RNA, 16 nt, Human
cagggccuugcccaga

SEQ ID NO: 3823566 - RNA, 17 nt, Human
cagggccuugcccagag

SEQ ID NO: 3823567 - RNA, 18 nt, Human
cagggccuugcccagaga

SEQ ID NO: 3823568 - RNA, 19 nt, Human
cagggccuugcccagagau

SEQ ID NO: 3823569 - RNA, 21 nt, Human
cagggcgggcagagggcugga

SEQ ID NO: 3823570 - RNA, 22 nt, Human
cagggcuacccugagcugaggc

SEQ ID NO: 3823571 - RNA, 18 nt, Human
cagggcuagugacuugug

SEQ ID NO: 3823572 - RNA, 19 nt, Human
cagggcuauagcucaggac

SEQ ID NO: 3823573 - RNA, 16 nt, Human
cagggcucagccuggu

SEQ ID NO: 3823574 - RNA, 19 nt, Human
cagggcucagccugguggg

SEQ ID NO: 3823575 - RNA, 20 nt, Human
cagggcucagcggggacagc

SEQ ID NO: 3823576 - RNA, 13 nt, Human
cagggcucaggau

SEQ ID NO: 3823577 - RNA, 22 nt, Human
cagggcuccagccccucuugga

SEQ ID NO: 3823578 - RNA, 18 nt, Human
cagggcucccacagagac

SEQ ID NO: 3823579 - RNA, 21 nt, Human
cagggcucccaggggucuccc

SEQ ID NO: 3823580 - RNA, 18 nt, Human
cagggcuccucccagcuu

SEQ ID NO: 3823581 - RNA, 19 nt, Human
cagggcuccucccagcuug

SEQ ID NO: 3823582 - RNA, 20 nt, Human
cagggcuccugccuucuguc

SEQ ID NO: 3823583 - RNA, 23 nt, Human
cagggcuccugccuucuguccug

SEQ ID NO: 3823584 - RNA, 13 nt, Human
cagggcuccuggg

SEQ ID NO: 3823585 - RNA, 21 nt, Human
cagggcuccuugugggccugg

SEQ ID NO: 3823586 - RNA, 23 nt, Human
cagggcuccuugugggccugggc

SEQ ID NO: 3823587 - RNA, 15 nt, Human
cagggcucuccuggc

SEQ ID NO: 3823588 - RNA, 20 nt, Human
cagggcucucuuuccuucuu

SEQ ID NO: 3823589 - RNA, 22 nt, Human
cagggcucucuuuccuucuugc

SEQ ID NO: 3823590 - RNA, 17 nt, Human
cagggcucugccccagu

SEQ ID NO: 3823591 - RNA, 16 nt, Human
cagggcugcccugaga

SEQ ID NO: 3823592 - RNA, 23 nt, Human
cagggcugcccugagaagcugcu

SEQ ID NO: 3823593 - RNA, 21 nt, Human
cagggcuggacugaggccuga

SEQ ID NO: 3823594 - RNA, 23 nt, Human
cagggcuggacugaggccugagc

SEQ ID NO: 3823595 - RNA, 13 nt, Human
cagggcuggagaa

SEQ ID NO: 3823596 - RNA, 17 nt, Human
cagggcuggcccagccc

SEQ ID NO: 3823597 - RNA, 19 nt, Human
cagggcuggccccagggca

SEQ ID NO: 3823598 - RNA, 13 nt, Human
cagggcugggagg

SEQ ID NO: 3823599 - RNA, 19 nt, Human
cagggcugggaggaaggac

SEQ ID NO: 3823600 - RNA, 13 nt, Human
cagggcugugcac

SEQ ID NO: 3823601 - RNA, 19 nt, Human
cagggcugugcuugaaggc

SEQ ID NO: 3823602 - RNA, 23 nt, Human
cagggcugugcuugaaggcccug

SEQ ID NO: 3823603 - RNA, 23 nt, Human
cagggcuuaccuguacacugacu

SEQ ID NO: 3823604 - RNA, 18 nt, Human
cagggcuuacggcccugg

SEQ ID NO: 3823605 - RNA, 23 nt, Human
cagggcuuacggcccuggccuug

SEQ ID NO: 3823606 - RNA, 22 nt, Human
cagggcuuuacuccguaacaga

SEQ ID NO: 3823607 - RNA, 14 nt, Human
caggggaaaagagg

SEQ ID NO: 3823608 - RNA, 20 nt, Human
caggggaaaaucagccugcu

SEQ ID NO: 3823609 - RNA, 23 nt, Human
caggggaaagaugagcuuuucua

SEQ ID NO: 3823610 - RNA, 17 nt, Human
caggggaacacugggga

SEQ ID NO: 3823611 - RNA, 16 nt, Human
caggggaaccugccau

SEQ ID NO: 3823612 - RNA, 17 nt, Human
caggggaccacaccucc

SEQ ID NO: 3823613 - RNA, 20 nt, Human
caggggacucagcccugagg

SEQ ID NO: 3823614 - RNA, 23 nt, Human
caggggacucagcccugagguga

SEQ ID NO: 3823615 - RNA, 16 nt, Human
caggggagauccuugu

SEQ ID NO: 3823616 - RNA, 20 nt, Human
caggggagcagaggggcaga

SEQ ID NO: 3823617 - RNA, 12 nt, Human
caggggagcccu

SEQ ID NO: 3823618 - RNA, 21 nt, Human
caggggaggccaucuggagag

SEQ ID NO: 3823619 - RNA, 18 nt, Human
caggggagggucagccag

SEQ ID NO: 3823620 - RNA, 22 nt, Human
caggggagggucagccagggcc

SEQ ID NO: 3823621 - RNA, 14 nt, Human
caggggauugaagc

SEQ ID NO: 3823622 - RNA, 18 nt, Human
caggggcaaacaccugcu

SEQ ID NO: 3823623 - RNA, 14 nt, Human
caggggcagcccca

SEQ ID NO: 3823624 - RNA, 18 nt, Human
caggggcagccccaggcc

SEQ ID NO: 3823625 - RNA, 14 nt, Human
caggggcaggcaca

SEQ ID NO: 3823626 - RNA, 22 nt, Human
caggggcaggcacagcacaggg

SEQ ID NO: 3823627 - RNA, 22 nt, Human
caggggcccaaggcggccccuc

SEQ ID NO: 3823628 - RNA, 20 nt, Human
caggaugaugacuauggaaa

SEQ ID NO: 3823629 - RNA, 22 nt, Human
caggaugaugacuauggaaaga

SEQ ID NO: 3823630 - RNA, 17 nt, Human
caggaugauuguacaga

SEQ ID NO: 3823631 - RNA, 17 nt, Human
caggaugcccagggcca

SEQ ID NO: 3823632 - RNA, 15 nt, Human
caggaugcuuugguu

SEQ ID NO: 3823633 - RNA, 23 nt, Human
caggauggcccuucccacuggag

SEQ ID NO: 3823634 - RNA, 17 nt, Human
caggauggccuggccag

SEQ ID NO: 3823635 - RNA, 14 nt, Human
caggauggcgcagg

SEQ ID NO: 3823636 - RNA, 21 nt, Human
caggaugggggcuggccucug

SEQ ID NO: 3823637 - RNA, 23 nt, Human
caggaugggguauggauucuaaa

SEQ ID NO: 3823638 - RNA, 18 nt, Human
caggauggucuccaucuc

SEQ ID NO: 3823639 - RNA, 16 nt, Human
caggauuccucuuuuc

SEQ ID NO: 3823640 - RNA, 19 nt, Human
caggauucucaccagcugu

SEQ ID NO: 3823641 - RNA, 21 nt, Human
caggauucuuccucccucccu

SEQ ID NO: 3823642 - RNA, 13 nt, Human
caggauugcgaga

SEQ ID NO: 3823643 - RNA, 15 nt, Human
caggauuggggaaga

SEQ ID NO: 3823644 - RNA, 18 nt, Human
caggauuuaaaaacugga

SEQ ID NO: 3823645 - RNA, 16 nt, Human
caggauuugcacagaa

SEQ ID NO: 3823646 - RNA, 19 nt, Human
caggauuuguucucugucc

SEQ ID NO: 3823647 - RNA, 20 nt, Human
caggauuuguucucugucca

SEQ ID NO: 3823648 - RNA, 18 nt, Human
caggcaaaauccuugcuu

SEQ ID NO: 3823649 - RNA, 16 nt, Human
caggcaaagcaaguga

SEQ ID NO: 3823650 - RNA, 18 nt, Human
caggcaacugaggcagac

SEQ ID NO: 3823651 - RNA, 22 nt, Human
caggcaacugaggcagacagca

SEQ ID NO: 3823652 - RNA, 17 nt, Human
caggcaacuucaguccu

SEQ ID NO: 3823653 - RNA, 21 nt, Human
caggcaagcaccuccugccuc

SEQ ID NO: 3823654 - RNA, 14 nt, Human
caggcaaugcuggc

SEQ ID NO: 3823655 - RNA, 17 nt, Human
caggcaaugcuggcugu

SEQ ID NO: 3823656 - RNA, 19 nt, Human
caggcaaugcuggcuguug

SEQ ID NO: 3823657 - RNA, 21 nt, Human
caggcaaugcuggcuguuggc

SEQ ID NO: 3823658 - RNA, 15 nt, Human
caggcaauggccuaa

SEQ ID NO: 3823659 - RNA, 14 nt, Human
caggcacacacugu

SEQ ID NO: 3823660 - RNA, 23 nt, Human
caggcacacacugugcuuucuau

SEQ ID NO: 3823661 - RNA, 14 nt, Human
caggcacacagcua

SEQ ID NO: 3823662 - RNA, 20 nt, Human
caggcacacagcuacucucc

SEQ ID NO: 3823663 - RNA, 23 nt, Human
caggcacacagcuacucucccca

SEQ ID NO: 3823664 - RNA, 19 nt, Human
caggcacacgccaccucgc

SEQ ID NO: 3823665 - RNA, 15 nt, Human
caggcacacuucuuc

SEQ ID NO: 3823666 - RNA, 16 nt, Human
caggcacagcacaggg

SEQ ID NO: 3823667 - RNA, 13 nt, Human
caggcacaggaug

SEQ ID NO: 3823668 - RNA, 12 nt, Human
caggcacaggca

SEQ ID NO: 3823669 - RNA, 16 nt, Human
caggcacaggcagggc

SEQ ID NO: 3823670 - RNA, 17 nt, Human
caggcacaggcagggca

SEQ ID NO: 3823671 - RNA, 15 nt, Human
caggcacaggucagg

SEQ ID NO: 3823672 - RNA, 15 nt, Human
caggcaccaaaagaa

SEQ ID NO: 3823673 - RNA, 18 nt, Human
caggcaccagucccuguc

SEQ ID NO: 3823674 - RNA, 22 nt, Human
caggcacccaccaucaugucug

SEQ ID NO: 3823675 - RNA, 15 nt, Human
caggcacccccugga

SEQ ID NO: 3823676 - RNA, 16 nt, Human
caggcacccuucuuuc

SEQ ID NO: 3823677 - RNA, 16 nt, Human
caggcaccgagaaugu

SEQ ID NO: 3823678 - RNA, 17 nt, Human
caggcaccgagaauguu

SEQ ID NO: 3823679 - RNA, 16 nt, Human
caggcacuagccuuug

SEQ ID NO: 3823680 - RNA, 20 nt, Human
caggcacucaaugcagccag

SEQ ID NO: 3823681 - RNA, 22 nt, Human
caggcacugagauaccagcgag

SEQ ID NO: 3823682 - RNA, 23 nt, Human
caggcacugagauaccagcgagg

SEQ ID NO: 3823683 - RNA, 14 nt, Human
caggcacugcaaac

SEQ ID NO: 3823684 - RNA, 13 nt, Human
caggcacugcccu

SEQ ID NO: 3823685 - RNA, 16 nt, Human
caggcacugcugccca

SEQ ID NO: 3823686 - RNA, 16 nt, Human
caggcacugggcauga

SEQ ID NO: 3823687 - RNA, 17 nt, Human
caggcacugggcaugag

SEQ ID NO: 3823688 - RNA, 20 nt, Human
caggcacuuggcagccuugu

SEQ ID NO: 3823689 - RNA, 15 nt, Human
caggcagaaagaguu

SEQ ID NO: 3823690 - RNA, 11 nt, Human
caggcagacac

SEQ ID NO: 3823691 - RNA, 12 nt, Human
caggcagacacg

SEQ ID NO: 3823692 - RNA, 21 nt, Human
caggcagacuacacaggauga

SEQ ID NO: 3823693 - RNA, 14 nt, Human
caggcagagaauca

SEQ ID NO: 3823694 - RNA, 16 nt, Human
caggcagaucaccuga

SEQ ID NO: 3823695 - RNA, 15 nt, Human
caggcagauccagga

SEQ ID NO: 3823696 - RNA, 13 nt, Human
caggcagaucugu

SEQ ID NO: 3823697 - RNA, 15 nt, Human
caggcagcacagaga

SEQ ID NO: 3823698 - RNA, 12 nt, Human
caggcagcagag

SEQ ID NO: 3823699 - RNA, 23 nt, Human
caggcagcagagacuugggacau

SEQ ID NO: 3823700 - RNA, 15 nt, Human
caggcagccaggcca

SEQ ID NO: 3823701 - RNA, 12 nt, Human
caggcagccagu

SEQ ID NO: 3823702 - RNA, 20 nt, Human
caggcagccagugcccugag

SEQ ID NO: 3823703 - RNA, 24 nt, Human
caggcagccagugcccugagccag

SEQ ID NO: 3823704 - RNA, 17 nt, Human
caggcagccucugucag

SEQ ID NO: 3823705 - RNA, 18 nt, Human
caggcagcgauggucuca

SEQ ID NO: 3823706 - RNA, 13 nt, Human
caggcagcgccaa

SEQ ID NO: 3823707 - RNA, 19 nt, Human
caggcagcgccaagugcgu

SEQ ID NO: 3823708 - RNA, 20 nt, Human
caggcagcgccaagugcgug

SEQ ID NO: 3823709 - RNA, 17 nt, Human
caggcagcggggagggg

SEQ ID NO: 3823710 - RNA, 16 nt, Human
caaaacaaaacaacau

SEQ ID NO: 3823711 - RNA, 22 nt, Human
caaaacaaagcaauucuuucaa

SEQ ID NO: 3823712 - RNA, 22 nt, Human
caaaacaaaggccuaauucuau

SEQ ID NO: 3823713 - RNA, 23 nt, Human
caaaacacacgcgcgcacacaca

SEQ ID NO: 3823714 - RNA, 12 nt, Human
caaaacacugug

SEQ ID NO: 3823715 - RNA, 16 nt, Human
caaaacacuguggaac

SEQ ID NO: 3823716 - RNA, 19 nt, Human
caaaacagagaugugauaa

SEQ ID NO: 3823717 - RNA, 13 nt, Human
caaaacagauugu

SEQ ID NO: 3823718 - RNA, 18 nt, Human
caaaacagauuguuugca

SEQ ID NO: 3823719 - RNA, 18 nt, Human
caaaacagcguuuaagac

SEQ ID NO: 3823720 - RNA, 21 nt, Human
caaaacaguauugacuuguau

SEQ ID NO: 3823721 - RNA, 22 nt, Human
caaaacaugucuccuauccugg

SEQ ID NO: 3823722 - RNA, 15 nt, Human
caaaacauuccguuu

SEQ ID NO: 3823723 - RNA, 23 nt, Human
caaaaccaaaaguuauuaaaauu

SEQ ID NO: 3823724 - RNA, 21 nt, Human
caaaaccacagcccugucagu

SEQ ID NO: 3823725 - RNA, 15 nt, Human
caaaaccauugcuuc

SEQ ID NO: 3823726 - RNA, 16 nt, Human
caaaaccauugcuuca

SEQ ID NO: 3823727 - RNA, 17 nt, Human
caaaaccauugcuucac

SEQ ID NO: 3823728 - RNA, 14 nt, Human
caaaacccagcugc

SEQ ID NO: 3823729 - RNA, 19 nt, Human
caaaaccccccagauauca

SEQ ID NO: 3823730 - RNA, 19 nt, Human
caaaacgcauggagugugu

SEQ ID NO: 3823731 - RNA, 23 nt, Human
caaaacgcauggaguguguauug

SEQ ID NO: 3823732 - RNA, 13 nt, Human
caaaacggggcag

SEQ ID NO: 3823733 - RNA, 14 nt, Human
caaaacgucuuauu

SEQ ID NO: 3823734 - RNA, 20 nt, Human
caaaacucaaaugcuuggcu

SEQ ID NO: 3823735 - RNA, 21 nt, Human
caaaacucauuuccuauguaa

SEQ ID NO: 3823736 - RNA, 21 nt, Human
caaaacuccugccccuguucu

SEQ ID NO: 3823737 - RNA, 15 nt, Human
caaaacucuccucug

SEQ ID NO: 3823738 - RNA, 21 nt, Human
caaaacucuccucugcugcug

SEQ ID NO: 3823739 - RNA, 23 nt, Human
caaaacucuccucugcugcuggc

SEQ ID NO: 3823740 - RNA, 15 nt, Human
caaaacugcauuuca

SEQ ID NO: 3823741 - RNA, 22 nt, Human
caaaacugccucaggaggcagg

SEQ ID NO: 3823742 - RNA, 12 nt, Human
caaaacugcucc

SEQ ID NO: 3823743 - RNA, 23 nt, Human
caaaacuucagacauagaauuaa

SEQ ID NO: 3823744 - RNA, 17 nt, Human
caaaacuucuugucaga

SEQ ID NO: 3823745 - RNA, 19 nt, Human
caaaacuucuugucagaca

SEQ ID NO: 3823746 - RNA, 17 nt, Human
caaaacuuuaaaccugu

SEQ ID NO: 3823747 - RNA, 12 nt, Human
caaaagaaaaac

SEQ ID NO: 3823748 - RNA, 18 nt, Human
caaaagaagcccccagcu

SEQ ID NO: 3823749 - RNA, 19 nt, Human
caaaagaagcccccagcua

SEQ ID NO: 3823750 - RNA, 12 nt, Human
caaaagaaguaa

SEQ ID NO: 3823751 - RNA, 22 nt, Human
caaaagacaauucuuuauacaa

SEQ ID NO: 3823752 - RNA, 16 nt, Human
caaaagacauguugua

SEQ ID NO: 3823753 - RNA, 12 nt, Human
caaaagagaaaa

SEQ ID NO: 3823754 - RNA, 19 nt, Human
caaaagagaaaaaaaauua

SEQ ID NO: 3823755 - RNA, 19 nt, Human
caaaagaguguaaaauauu

SEQ ID NO: 3823756 - RNA, 13 nt, Human
caaaagauaauau

SEQ ID NO: 3823757 - RNA, 20 nt, Human
caaaagaugcucuucugugg

SEQ ID NO: 3823758 - RNA, 21 nt, Human
caaaagauguauccuuccaau

SEQ ID NO: 3823759 - RNA, 19 nt, Human
caaaagauugcugaaauuu

SEQ ID NO: 3823760 - RNA, 23 nt, Human
caaaagcaagacuguugcucaaa

SEQ ID NO: 3823761 - RNA, 14 nt, Human
caaaagcacccuug

SEQ ID NO: 3823762 - RNA, 13 nt, Human
caaaagccuugug

SEQ ID NO: 3823763 - RNA, 14 nt, Human
caaaagccuugugu

SEQ ID NO: 3823764 - RNA, 20 nt, Human
caaaagcuucccucccugcu

SEQ ID NO: 3823765 - RNA, 15 nt, Human
caaaaggaaaaagcu

SEQ ID NO: 3823766 - RNA, 22 nt, Human
caaaaggaucuuuguggccaag

SEQ ID NO: 3823767 - RNA, 24 nt, Human
caaaaggaucuuuguggccaagga

SEQ ID NO: 3823768 - RNA, 18 nt, Human
caaaaggcuccauauaua

SEQ ID NO: 3823769 - RNA, 19 nt, Human
caaaagggccaaagaacca

SEQ ID NO: 3823770 - RNA, 20 nt, Human
caaaagggccaaagaaccaa

SEQ ID NO: 3823771 - RNA, 13 nt, Human
caaaagggucaga

SEQ ID NO: 3823772 - RNA, 17 nt, Human
cagugaaguugcugcuu

SEQ ID NO: 3823773 - RNA, 20 nt, Human
cagugaaugauucaguguua

SEQ ID NO: 3823774 - RNA, 16 nt, Human
cagugaauuuuugcaa

SEQ ID NO: 3823775 - RNA, 19 nt, Human
cagugaauuuuugcaauaa

SEQ ID NO: 3823776 - RNA, 14 nt, Human
cagugacaaaccau

SEQ ID NO: 3823777 - RNA, 23 nt, Human
cagugacacgucucgccaagcag

SEQ ID NO: 3823778 - RNA, 16 nt, Human
cagugacagaguucac

SEQ ID NO: 3823779 - RNA, 16 nt, Human
cagugaccugaggaag

SEQ ID NO: 3823780 - RNA, 16 nt, Human
cagugacgugcaccug

SEQ ID NO: 3823781 - RNA, 18 nt, Human
cagugacgugcaccugua

SEQ ID NO: 3823782 - RNA, 18 nt, Human
cagugacucgggcuccug

SEQ ID NO: 3823783 - RNA, 20 nt, Human
cagugacucgggcuccugug

SEQ ID NO: 3823784 - RNA, 17 nt, Human
cagugacuucugagauc

SEQ ID NO: 3823785 - RNA, 14 nt, Human
cagugagaaaaagc

SEQ ID NO: 3823786 - RNA, 13 nt, Human
cagugagagcaga

SEQ ID NO: 3823787 - RNA, 19 nt, Human
cagugagauuacagaggaa

SEQ ID NO: 3823788 - RNA, 16 nt, Human
cagugagcacucccaa

SEQ ID NO: 3823789 - RNA, 19 nt, Human
cagugagcagccuggagcc

SEQ ID NO: 3823790 - RNA, 13 nt, Human
cagugagccaaga

SEQ ID NO: 3823791 - RNA, 19 nt, Human
cagugagccgcaucuucuc

SEQ ID NO: 3823792 - RNA, 12 nt, Human
cagugagccuga

SEQ ID NO: 3823793 - RNA, 13 nt, Human
cagugagcugugu

SEQ ID NO: 3823794 - RNA, 13 nt, Human
cagugaggcccag

SEQ ID NO: 3823795 - RNA, 16 nt, Human
cagugaggcccaggga

SEQ ID NO: 3823796 - RNA, 12 nt, Human
cagugaggcucu

SEQ ID NO: 3823797 - RNA, 13 nt, Human
cagugaggcucug

SEQ ID NO: 3823798 - RNA, 17 nt, Human
cagugaggcucugcccu

SEQ ID NO: 3823799 - RNA, 20 nt, Human
cagugaggcucugcccuugg

SEQ ID NO: 3823800 - RNA, 21 nt, Human
cagugaggcucugcccuuggu

SEQ ID NO: 3823801 - RNA, 21 nt, Human
cagugagggagggcugucauc

SEQ ID NO: 3823802 - RNA, 15 nt, Human
cagugagguccuggg

SEQ ID NO: 3823803 - RNA, 20 nt, Human
cagugagguccugggggccu

SEQ ID NO: 3823804 - RNA, 20 nt, Human
cagugagucgaggacaggga

SEQ ID NO: 3823805 - RNA, 22 nt, Human
cagugagucgaggacagggagg

SEQ ID NO: 3823806 - RNA, 23 nt, Human
cagugagucgaggacagggaggu

SEQ ID NO: 3823807 - RNA, 18 nt, Human
cagugagucucuggggca

SEQ ID NO: 3823808 - RNA, 15 nt, Human
cagugagucucuuca

SEQ ID NO: 3823809 - RNA, 18 nt, Human
cagugagucucuucagaa

SEQ ID NO: 3823810 - RNA, 14 nt, Human
cagugagugagccu

SEQ ID NO: 3823811 - RNA, 19 nt, Human
cagugagugagccuggcuc

SEQ ID NO: 3823812 - RNA, 15 nt, Human
cagugauauggcaga

SEQ ID NO: 3823813 - RNA, 12 nt, Human
cagugauauucu

SEQ ID NO: 3823814 - RNA, 13 nt, Human
cagugaucuccau

SEQ ID NO: 3823815 - RNA, 17 nt, Human
cagugaugggagaguag

SEQ ID NO: 3823816 - RNA, 20 nt, Human
cagugauuaaggucucucuu

SEQ ID NO: 3823817 - RNA, 23 nt, Human
cagugauuaaggucucucuuugg

SEQ ID NO: 3823818 - RNA, 16 nt, Human
cagugauugucuuaau

SEQ ID NO: 3823819 - RNA, 15 nt, Human
cagugauuuuuaucc

SEQ ID NO: 3823820 - RNA, 16 nt, Human
cagugauuuuuaucca

SEQ ID NO: 3823821 - RNA, 20 nt, Human
cagugcaaaugucagauaca

SEQ ID NO: 3823822 - RNA, 15 nt, Human
cagugcaacacugaa

SEQ ID NO: 3823823 - RNA, 17 nt, Human
cagugcaacagcacugg

SEQ ID NO: 3823824 - RNA, 14 nt, Human
cagugcaaccucug

SEQ ID NO: 3823825 - RNA, 19 nt, Human
cagugcaaccucugcuucc

SEQ ID NO: 3823826 - RNA, 21 nt, Human
cagugcaaccucugcuuccca

SEQ ID NO: 3823827 - RNA, 12 nt, Human
cagugcacauga

SEQ ID NO: 3823828 - RNA, 14 nt, Human
cagugcagauggag

SEQ ID NO: 3823829 - RNA, 22 nt, Human
cagugcagcaaccagagcacug

SEQ ID NO: 3823830 - RNA, 16 nt, Human
cagugcagcccgugug

SEQ ID NO: 3823831 - RNA, 22 nt, Human
cagugcagcccguguggccccu

SEQ ID NO: 3823832 - RNA, 18 nt, Human
cagugcaggcuggccagc

SEQ ID NO: 3823833 - RNA, 14 nt, Human
cagugcauauuccu

SEQ ID NO: 3823834 - RNA, 15 nt, Human
cagugcaucucagcc

SEQ ID NO: 3823835 - RNA, 16 nt, Human
cagugcaucucagccc

SEQ ID NO: 3823836 - RNA, 14 nt, Human
cagugcaugcuguc

SEQ ID NO: 3823837 - RNA, 17 nt, Human
cagugcaugguggccag

SEQ ID NO: 3823838 - RNA, 11 nt, Human
cagugccaacu

SEQ ID NO: 3823839 - RNA, 17 nt, Human
cagugccaacuccucac

SEQ ID NO: 3823840 - RNA, 23 nt, Human
cagugccaaggaccuccucuucc

SEQ ID NO: 3823841 - RNA, 14 nt, Human
cagugccagcaaug

SEQ ID NO: 3823842 - RNA, 20 nt, Human
cagugccauguaaaucccca

SEQ ID NO: 3823843 - RNA, 14 nt, Human
cagugccauugucu

SEQ ID NO: 3823844 - RNA, 15 nt, Human
cagugccauugucuu

SEQ ID NO: 3823845 - RNA, 19 nt, Human
cagugccauugucuuuaua

SEQ ID NO: 3823846 - RNA, 21 nt, Human
cagugccauugucuuuauaug

SEQ ID NO: 3823847 - RNA, 22 nt, Human
cagugccauugucuuuauauga

SEQ ID NO: 3823848 - RNA, 15 nt, Human
cagugcccacaggau

SEQ ID NO: 3823849 - RNA, 18 nt, Human
cagugcccacaggaucag

SEQ ID NO: 3823850 - RNA, 21 nt, Human
cagugcccacaggaucagucu

SEQ ID NO: 3823851 - RNA, 21 nt, Human
cagugcccaccaacaucccau

SEQ ID NO: 3823852 - RNA, 19 nt, Human
cagugcccauuccucaccu

SEQ ID NO: 3823853 - RNA, 12 nt, Human
cagugcccccac

SEQ ID NO: 3823854 - RNA, 20 nt, Human
cagugcccccacugaccaga

SEQ ID NO: 3823855 - RNA, 22 nt, Human
cagugcccccacugaccagaac

SEQ ID NO: 3823856 - RNA, 22 nt, Human
cagugccccgucuacagcuccc

SEQ ID NO: 3823857 - RNA, 19 nt, Human
cagugcccucauuuuaugu

SEQ ID NO: 3823858 - RNA, 18 nt, Human
cagugcccuccagccccg

SEQ ID NO: 3823859 - RNA, 15 nt, Human
cagugcccuccagga

SEQ ID NO: 3823860 - RNA, 14 nt, Human
cagugcccugagcc

SEQ ID NO: 3823861 - RNA, 15 nt, Human
cagugcccugauccc

SEQ ID NO: 3823862 - RNA, 24 nt, Human
cagugcccuggggcugaucucagg

SEQ ID NO: 3823863 - RNA, 22 nt, Human
cagugccgccgccucgcccacc

SEQ ID NO: 3823864 - RNA, 18 nt, Human
caggcagcuggaugagac

SEQ ID NO: 3823865 - RNA, 22 nt, Human
caggcagcugucacugcugcuu

SEQ ID NO: 3823866 - RNA, 20 nt, Human
caggcagcuuuaaccauuaa

SEQ ID NO: 3823867 - RNA, 18 nt, Human
caggcaggcucccaggga

SEQ ID NO: 3823868 - RNA, 12 nt, Human
caggcagggcag

SEQ ID NO: 3823869 - RNA, 18 nt, Human
caggcagggcaggaccag

SEQ ID NO: 3823870 - RNA, 13 nt, Human
caggcagggcucu

SEQ ID NO: 3823871 - RNA, 20 nt, Human
caggcagggcucuccuggcu

SEQ ID NO: 3823872 - RNA, 16 nt, Human
caggcaggggcccugc

SEQ ID NO: 3823873 - RNA, 21 nt, Human
caggcaggggcccugcagcuc

SEQ ID NO: 3823874 - RNA, 16 nt, Human
caggcaggggccucca

SEQ ID NO: 3823875 - RNA, 18 nt, Human
caggcaggggccuccaug

SEQ ID NO: 3823876 - RNA, 12 nt, Human
caggcaggggug

SEQ ID NO: 3823877 - RNA, 13 nt, Human
caggcaggggugg

SEQ ID NO: 3823878 - RNA, 14 nt, Human
caggcauagaggcu

SEQ ID NO: 3823879 - RNA, 18 nt, Human
caggcauagaggcuucuc

SEQ ID NO: 3823880 - RNA, 19 nt, Human
caggcauagaggcuucucc

SEQ ID NO: 3823881 - RNA, 17 nt, Human
caggcauaggccugggu

SEQ ID NO: 3823882 - RNA, 18 nt, Human
caggcauaggccugggug

SEQ ID NO: 3823883 - RNA, 22 nt, Human
caggcaucauuccaccauggcu

SEQ ID NO: 3823884 - RNA, 24 nt, Human
caggcaugcuggcucccagggcca

SEQ ID NO: 3823885 - RNA, 16 nt, Human
caggcaugggccacca

SEQ ID NO: 3823886 - RNA, 22 nt, Human
caggcaugucccaugugagcug

SEQ ID NO: 3823887 - RNA, 15 nt, Human
caggcauguucucug

SEQ ID NO: 3823888 - RNA, 19 nt, Human
caggcauguucucugagga

SEQ ID NO: 3823889 - RNA, 20 nt, Human
caggcauguucucugaggac

SEQ ID NO: 3823890 - RNA, 21 nt, Human
caggcauuccccaggaggcca

SEQ ID NO: 3823891 - RNA, 21 nt, Human
caggcauugccucggcuggcu

SEQ ID NO: 3823892 - RNA, 22 nt, Human
caggcauugccucggcuggcuc

SEQ ID NO: 3823893 - RNA, 16 nt, Human
caggcauuuccugggu

SEQ ID NO: 3823894 - RNA, 17 nt, Human
caggcauuuccugggug

SEQ ID NO: 3823895 - RNA, 18 nt, Human
caggcauuugacugaaga

SEQ ID NO: 3823896 - RNA, 21 nt, Human
caggcauuugacugaagaugc

SEQ ID NO: 3823897 - RNA, 18 nt, Human
caggccaaacucaccugc

SEQ ID NO: 3823898 - RNA, 23 nt, Human
caggccaaacucaccugccccuc

SEQ ID NO: 3823899 - RNA, 22 nt, Human
caggccaaaggggaccuggaag

SEQ ID NO: 3823900 - RNA, 19 nt, Human
caggccaaagugccgguga

SEQ ID NO: 3823901 - RNA, 21 nt, Human
caggccaagagcagaggcagc

SEQ ID NO: 3823902 - RNA, 15 nt, Human
caggccaaggucuga

SEQ ID NO: 3823903 - RNA, 19 nt, Human
caggccaaggucugagcca

SEQ ID NO: 3823904 - RNA, 23 nt, Human
caggccacauggggcugggcagc

SEQ ID NO: 3823905 - RNA, 23 nt, Human
caggccaccauauucagugcugu

SEQ ID NO: 3823906 - RNA, 11 nt, Human
caggccaccuc

SEQ ID NO: 3823907 - RNA, 18 nt, Human
caggccaccuccagaaac

SEQ ID NO: 3823908 - RNA, 17 nt, Human
caggccaccugcccccu

SEQ ID NO: 3823909 - RNA, 18 nt, Human
caggccaccugcccccuu

SEQ ID NO: 3823910 - RNA, 21 nt, Human
caggccaccuggcucucaccu

SEQ ID NO: 3823911 - RNA, 22 nt, Human
caggccaccuggcucucaccuc

SEQ ID NO: 3823912 - RNA, 16 nt, Human
caggccacggcagccu

SEQ ID NO: 3823913 - RNA, 17 nt, Human
caggccacggcagccua

SEQ ID NO: 3823914 - RNA, 19 nt, Human
caggccagagggagugaca

SEQ ID NO: 3823915 - RNA, 21 nt, Human
caggccagagggagugacaga

SEQ ID NO: 3823916 - RNA, 15 nt, Human
cauaggucacuggcu

SEQ ID NO: 3823917 - RNA, 16 nt, Human
cauaggucacuggcuc

SEQ ID NO: 3823918 - RNA, 17 nt, Human
cauaggucacuggcucu

SEQ ID NO: 3823919 - RNA, 17 nt, Human
cagggccaggccucucc

SEQ ID NO: 3823920 - RNA, 15 nt, Human
cagggccagggcccu

SEQ ID NO: 3823921 - RNA, 19 nt, Human
cagggccagggcccugcag

SEQ ID NO: 3823922 - RNA, 16 nt, Human
cagggccagugcaguu

SEQ ID NO: 3823923 - RNA, 16 nt, Human
cagggccaugccugcc

SEQ ID NO: 3823924 - RNA, 14 nt, Human
cagggccaugcuga

SEQ ID NO: 3823925 - RNA, 22 nt, Human
cagggccauggcucaggguggu

SEQ ID NO: 3823926 - RNA, 17 nt, Human
cagggcccaagucccug

SEQ ID NO: 3823927 - RNA, 18 nt, Human
cagggcccaagucccugu

SEQ ID NO: 3823928 - RNA, 12 nt, Human
cagggcccagag

SEQ ID NO: 3823929 - RNA, 15 nt, Human
cagggcccagagccc

SEQ ID NO: 3823930 - RNA, 21 nt, Human
cagggcccagagcccagcucc

SEQ ID NO: 3823931 - RNA, 22 nt, Human
cagggcccagagcccagcucca

SEQ ID NO: 3823932 - RNA, 16 nt, Human
cagggccccagcacua

SEQ ID NO: 3823933 - RNA, 21 nt, Human
cagggcccccagcgagagucc

SEQ ID NO: 3823934 - RNA, 15 nt, Human
cagggcccccaucuc

SEQ ID NO: 3823935 - RNA, 19 nt, Human
cagggcccgggaagcaaau

SEQ ID NO: 3823936 - RNA, 15 nt, Human
cagggcccugagcuc

SEQ ID NO: 3823937 - RNA, 21 nt, Human
cagggcccugagcucggugga

SEQ ID NO: 3823938 - RNA, 18 nt, Human
cagggcccugcagagggg

SEQ ID NO: 3823939 - RNA, 14 nt, Human
cagggccgaccaga

SEQ ID NO: 3823940 - RNA, 19 nt, Human
cagggccgauggggcaguc

SEQ ID NO: 3823941 - RNA, 19 nt, Human
cagggccgcccgggcccag

SEQ ID NO: 3823942 - RNA, 20 nt, Human
cagggccgcccgggcccaga

SEQ ID NO: 3823943 - RNA, 20 nt, Human
cagggccggggaacuggcca

SEQ ID NO: 3823944 - RNA, 21 nt, Human
cagggccuagcugcuacaaag

SEQ ID NO: 3823945 - RNA, 23 nt, Human
cagggccuccagcccucucacug

SEQ ID NO: 3823946 - RNA, 17 nt, Human
cagggccucugcggagc

SEQ ID NO: 3823947 - RNA, 19 nt, Human
cagggccugagccuggcca

SEQ ID NO: 3823948 - RNA, 22 nt, Human
cagggccugagccuggccagcc

SEQ ID NO: 3823949 - RNA, 13 nt, Human
cagggccugcgag

SEQ ID NO: 3823950 - RNA, 11 nt, Human
cagggccuggc

SEQ ID NO: 3823951 - RNA, 15 nt, Human
cagggccuggcccau

SEQ ID NO: 3823952 - RNA, 13 nt, Human
cagggccuggcuc

SEQ ID NO: 3823953 - RNA, 19 nt, Human
cagggccuggcucaggugg

SEQ ID NO: 3823954 - RNA, 15 nt, Human
cagggccuggggccu

SEQ ID NO: 3823955 - RNA, 22 nt, Human
cagggccuggggccugagagaa

SEQ ID NO: 3823956 - RNA, 15 nt, Human
cagggccuugcccag

SEQ ID NO: 3823957 - RNA, 20 nt, Human
cagggcgagacucugucuca

SEQ ID NO: 3823958 - RNA, 16 nt, Human
cagggcgggcagaggg

SEQ ID NO: 3823959 - RNA, 17 nt, Human
cagggcgggcagagggc

SEQ ID NO: 3823960 - RNA, 22 nt, Human
cagggcgggcagagggcuggag

SEQ ID NO: 3823961 - RNA, 17 nt, Human
cagggcuacccuccccc

SEQ ID NO: 3823962 - RNA, 16 nt, Human
cagggcuacccugagc

SEQ ID NO: 3823963 - RNA, 18 nt, Human
cagggcuacccugagcug

SEQ ID NO: 3823964 - RNA, 14 nt, Human
cagggcucagccug

SEQ ID NO: 3823965 - RNA, 15 nt, Human
cagggcucagccugg

SEQ ID NO: 3823966 - RNA, 21 nt, Human
cagggcucagcggggacagcu

SEQ ID NO: 3823967 - RNA, 23 nt, Human
cagggcucagcggggacagcucc

SEQ ID NO: 3823968 - RNA, 13 nt, Human
cagggcuccagcc

SEQ ID NO: 3823969 - RNA, 15 nt, Human
cagggcucccacaga

SEQ ID NO: 3823970 - RNA, 13 nt, Human
cagggcuccuccc

SEQ ID NO: 3823971 - RNA, 16 nt, Human
cagggcuccucccagc

SEQ ID NO: 3823972 - RNA, 11 nt, Human
cagggcuccug

SEQ ID NO: 3823973 - RNA, 12 nt, Human
cagggcuccugc

SEQ ID NO: 3823974 - RNA, 14 nt, Human
cagggcuccugcac

SEQ ID NO: 3823975 - RNA, 19 nt, Human
cagggcucuccuggcuucc

SEQ ID NO: 3823976 - RNA, 19 nt, Human
cagggcucugccccagagg

SEQ ID NO: 3823977 - RNA, 20 nt, Human
cagggcucugccccagaggc

SEQ ID NO: 3823978 - RNA, 15 nt, Human
cagggcucuguaagu

SEQ ID NO: 3823979 - RNA, 18 nt, Human
cagggcugaggccucuca

SEQ ID NO: 3823980 - RNA, 15 nt, Human
cagggcugcccugag

SEQ ID NO: 3823981 - RNA, 18 nt, Human
cagggcugcuagacggag

SEQ ID NO: 3823982 - RNA, 23 nt, Human
cagggcugcugggggcaacuggc

SEQ ID NO: 3823983 - RNA, 20 nt, Human
cagggcuggacugaggccug

SEQ ID NO: 3823984 - RNA, 22 nt, Human
cagggcuggacugaggccugag

SEQ ID NO: 3823985 - RNA, 19 nt, Human
cagggcuggcccagcccug

SEQ ID NO: 3823986 - RNA, 13 nt, Human
cagggcuggcucc

SEQ ID NO: 3823987 - RNA, 18 nt, Human
cagggcuggcuccugauc

SEQ ID NO: 3823988 - RNA, 18 nt, Human
cagggcuuaccuguacac

SEQ ID NO: 3823989 - RNA, 19 nt, Human
cagggcuuaccuguacacu

SEQ ID NO: 3823990 - RNA, 21 nt, Human
cagggcuuaccuguacacuga

SEQ ID NO: 3823991 - RNA, 16 nt, Human
cagggcuuacggcccu

SEQ ID NO: 3823992 - RNA, 14 nt, Human
cagggcuuuaaaau

SEQ ID NO: 3823993 - RNA, 19 nt, Human
caggggaaaaucagccugc

SEQ ID NO: 3823994 - RNA, 18 nt, Human
caggggaaagaugagcuu

SEQ ID NO: 3823995 - RNA, 17 nt, Human
caggggaauauuuuauu

SEQ ID NO: 3823996 - RNA, 19 nt, Human
caggggaauauuuuauuca

SEQ ID NO: 3823997 - RNA, 23 nt, Human
caggggaauauuuuauucaaggu

SEQ ID NO: 3823998 - RNA, 16 nt, Human
caggggacaggauggu

SEQ ID NO: 3823999 - RNA, 16 nt, Human
caggggaccuccuggg

SEQ ID NO: 3824000 - RNA, 18 nt, Human
caggggacucagcccuga

SEQ ID NO: 3824001 - RNA, 13 nt, Human
caggggagcccuc

SEQ ID NO: 3824002 - RNA, 20 nt, Human
caggggagggucagccaggg

SEQ ID NO: 3824003 - RNA, 18 nt, Human
caggggagucccgucagg

SEQ ID NO: 3824004 - RNA, 16 nt, Human
caggggauggcguggu

SEQ ID NO: 3824005 - RNA, 17 nt, Human
caggggauugaagcccu

SEQ ID NO: 3824006 - RNA, 20 nt, Human
caggggauugaagcccucca

SEQ ID NO: 3824007 - RNA, 12 nt, Human
caggggcagcuc

SEQ ID NO: 3824008 - RNA, 16 nt, Human
caggggcaggcacagc

SEQ ID NO: 3824009 - RNA, 17 nt, Human
caggggcaggcacagca

SEQ ID NO: 3824010 - RNA, 20 nt, Human
caggggcauguauuggccug

SEQ ID NO: 3824011 - RNA, 21 nt, Human
caggggcauguauuggccugg

SEQ ID NO: 3824012 - RNA, 20 nt, Human
caggggcccaaggcggcccc

SEQ ID NO: 3824013 - RNA, 15 nt, Human
caggggccccuccag

SEQ ID NO: 3824014 - RNA, 17 nt, Human
caggggccccuccagcu

SEQ ID NO: 3824015 - RNA, 18 nt, Human
caggggccccuccagcuu

SEQ ID NO: 3824016 - RNA, 17 nt, Human
caggggcccuggagcag

SEQ ID NO: 3824017 - RNA, 23 nt, Human
caggggccuggagauccuccugc

SEQ ID NO: 3824018 - RNA, 15 nt, Human
caggggcguggaggg

SEQ ID NO: 3824019 - RNA, 18 nt, Human
caggggcuacaagaggga

SEQ ID NO: 3824020 - RNA, 17 nt, Human
caggggcuccaugccag

SEQ ID NO: 3824021 - RNA, 18 nt, Human
caggggcuccaugccagc

SEQ ID NO: 3824022 - RNA, 21 nt, Human
caggggcucccuccgccccca

SEQ ID NO: 3824023 - RNA, 16 nt, Human
caggggcucuggagag

SEQ ID NO: 3824024 - RNA, 17 nt, Human
caggggcucuggagaga

SEQ ID NO: 3824025 - RNA, 20 nt, Human
caggggcucuggagagaaac

SEQ ID NO: 3824026 - RNA, 16 nt, Human
caggggcugcccgcuc

SEQ ID NO: 3824027 - RNA, 18 nt, Human
caggggcugcccgcuccc

SEQ ID NO: 3824028 - RNA, 20 nt, Human
caggggcugcccgcucccag

SEQ ID NO: 3824029 - RNA, 16 nt, Human
caggggcugcuuccuc

SEQ ID NO: 3824030 - RNA, 20 nt, Human
caggggcugcuuccuccugg

SEQ ID NO: 3824031 - RNA, 22 nt, Human
caggggcugcuuccuccuggaa

SEQ ID NO: 3824032 - RNA, 17 nt, Human
caggggcuggcuucagg

SEQ ID NO: 3824033 - RNA, 15 nt, Human
caggggcuguuugag

SEQ ID NO: 3824034 - RNA, 17 nt, Human
caggggcuuccuggugc

SEQ ID NO: 3824035 - RNA, 13 nt, Human
caggggcuugacu

SEQ ID NO: 3824036 - RNA, 14 nt, Human
cagggggaagaagc

SEQ ID NO: 3824037 - RNA, 11 nt, Human
cagggggaagg

SEQ ID NO: 3824038 - RNA, 18 nt, Human
cagggggacuagccccug

SEQ ID NO: 3824039 - RNA, 11 nt, Human
cagggggccag

SEQ ID NO: 3824040 - RNA, 13 nt, Human
cagggggcugcug

SEQ ID NO: 3824041 - RNA, 19 nt, Human
cagggggguugugaggccu

SEQ ID NO: 3824042 - RNA, 16 nt, Human
cagggggucuggcugg

SEQ ID NO: 3824043 - RNA, 18 nt, Human
cagggggucuggcuggug

SEQ ID NO: 3824044 - RNA, 16 nt, Human
cagggggugugucugc

SEQ ID NO: 3824045 - RNA, 23 nt, Human
caggggucacugaggccugagac

SEQ ID NO: 3824046 - RNA, 13 nt, Human
caggggucucccu

SEQ ID NO: 3824047 - RNA, 17 nt, Human
caggggucucccuggag

SEQ ID NO: 3824048 - RNA, 16 nt, Human
caggggucucccuggc

SEQ ID NO: 3824049 - RNA, 17 nt, Human
caggggucucccuggcu

SEQ ID NO: 3824050 - RNA, 19 nt, Human
caggggucucccuggcucc

SEQ ID NO: 3824051 - RNA, 20 nt, Human
caggggucucccuggcuccc

SEQ ID NO: 3824052 - RNA, 22 nt, Human
caggggucucccuggcucccuc

SEQ ID NO: 3824053 - RNA, 15 nt, Human
caggggugacacaga

SEQ ID NO: 3824054 - RNA, 15 nt, Human
caggggugcccccuc

SEQ ID NO: 3824055 - RNA, 17 nt, Human
caggggugcccccuccu

SEQ ID NO: 3824056 - RNA, 23 nt, Human
caggggugcccccuccucuccca

SEQ ID NO: 3824057 - RNA, 22 nt, Human
cagggguggaggagagccuggu

SEQ ID NO: 3824058 - RNA, 22 nt, Human
cagggguggcugccucauuuag

SEQ ID NO: 3824059 - RNA, 21 nt, Human
cagggguucgagaccagucug

SEQ ID NO: 3824060 - RNA, 17 nt, Human
caucaguguuaaaaaau

SEQ ID NO: 3824061 - RNA, 20 nt, Human
caucaguuagagcugacaca

SEQ ID NO: 3824062 - RNA, 15 nt, Human
caucaguuauucauu

SEQ ID NO: 3824063 - RNA, 19 nt, Human
caucaguuuuguuuacuca

SEQ ID NO: 3824064 - RNA, 17 nt, Human
caucauaggaagggacc

SEQ ID NO: 3824065 - RNA, 15 nt, Human
caucaucagggccug

SEQ ID NO: 3824066 - RNA, 16 nt, Human
caucauccagaugugg

SEQ ID NO: 3824067 - RNA, 18 nt, Human
caucaucuguagauacua

SEQ ID NO: 3824068 - RNA, 20 nt, Human
caucaugaggaaagcaguug

SEQ ID NO: 3824069 - RNA, 12 nt, Human
caucaugcagcu

SEQ ID NO: 3824070 - RNA, 18 nt, Human
caucaugccucugaggcc

SEQ ID NO: 3824071 - RNA, 22 nt, Human
caucaugccucugaggccagcc

SEQ ID NO: 3824072 - RNA, 23 nt, Human
caucaugccucugaggccagccu

SEQ ID NO: 3824073 - RNA, 21 nt, Human
caucauggauucauuacagcu

SEQ ID NO: 3824074 - RNA, 21 nt, Human
caucauggggggagcacccug

SEQ ID NO: 3824075 - RNA, 20 nt, Human
caucauguaaauuaccagua

SEQ ID NO: 3824076 - RNA, 10 nt, Human
caucauguca

SEQ ID NO: 3824077 - RNA, 15 nt, Human
caucaugucuauugu

SEQ ID NO: 3824078 - RNA, 13 nt, Human
caucaugucuggc

SEQ ID NO: 3824079 - RNA, 14 nt, Human
caucaugucuggcu

SEQ ID NO: 3824080 - RNA, 15 nt, Human
caucaugucuggcua

SEQ ID NO: 3824081 - RNA, 17 nt, Human
caucauuacccuucccu

SEQ ID NO: 3824082 - RNA, 20 nt, Human
caucauuacccuucccugca

SEQ ID NO: 3824083 - RNA, 18 nt, Human
caggguauggacuaucug

SEQ ID NO: 3824084 - RNA, 20 nt, Human
caggguauuccagagugggg

SEQ ID NO: 3824085 - RNA, 21 nt, Human
caggguauuccagagugggga

SEQ ID NO: 3824086 - RNA, 16 nt, Human
caggguauugcuugcc

SEQ ID NO: 3824087 - RNA, 20 nt, Human
cagggucacugaaggccugg

SEQ ID NO: 3824088 - RNA, 10 nt, Human
cagggucaga

SEQ ID NO: 3824089 - RNA, 14 nt, Human
cagggucaggagag

SEQ ID NO: 3824090 - RNA, 18 nt, Human
cagggucauguuugcagg

SEQ ID NO: 3824091 - RNA, 21 nt, Human
caggguccaacauagagccgg

SEQ ID NO: 3824092 - RNA, 22 nt, Human
caggguccacaggaagugaaga

SEQ ID NO: 3824093 - RNA, 18 nt, Human
cagggucccacagccacg

SEQ ID NO: 3824094 - RNA, 21 nt, Human
cagggucccauuucucacuga

SEQ ID NO: 3824095 - RNA, 16 nt, Human
cagggucccucugugu

SEQ ID NO: 3824096 - RNA, 15 nt, Human
cagggucccugcugu

SEQ ID NO: 3824097 - RNA, 12 nt, Human
cagggucccugg

SEQ ID NO: 3824098 - RNA, 14 nt, Human
caggguccuuuuga

SEQ ID NO: 3824099 - RNA, 22 nt, Human
caggguccuuuugacacugcuc

SEQ ID NO: 3824100 - RNA, 23 nt, Human
cagggucucacuauguugcccag

SEQ ID NO: 3824101 - RNA, 23 nt, Human
cagggucucacucugucgcccag

SEQ ID NO: 3824102 - RNA, 21 nt, Human
cagggucucuaccauccccug

SEQ ID NO: 3824103 - RNA, 19 nt, Human
cagggucucuagugcugug

SEQ ID NO: 3824104 - RNA, 20 nt, Human
cagggucucuagugcuguga

SEQ ID NO: 3824105 - RNA, 21 nt, Human
cagggucucuagugcugugaa

SEQ ID NO: 3824106 - RNA, 16 nt, Human
cagggucucucccuca

SEQ ID NO: 3824107 - RNA, 20 nt, Human
cagggucucucccucaggug

SEQ ID NO: 3824108 - RNA, 16 nt, Human
cagggucucugcugcc

SEQ ID NO: 3824109 - RNA, 19 nt, Human
cagggucucugcugccgcc

SEQ ID NO: 3824110 - RNA, 20 nt, Human
cagggucugcucuuucucug

SEQ ID NO: 3824111 - RNA, 21 nt, Human
cagggucugcucuuucucugc

SEQ ID NO: 3824112 - RNA, 19 nt, Human
cagggucugugugaaugug

SEQ ID NO: 3824113 - RNA, 20 nt, Human
cagggucugugugaaugugg

SEQ ID NO: 3824114 - RNA, 17 nt, Human
cagggucuucccuaccu

SEQ ID NO: 3824115 - RNA, 21 nt, Human
cagggucuucccuaccucagg

SEQ ID NO: 3824116 - RNA, 15 nt, Human
cagggucuuuucauc

SEQ ID NO: 3824117 - RNA, 22 nt, Human
cagggucuuuucaucugggaaa

SEQ ID NO: 3824118 - RNA, 23 nt, Human
cagggucuuuucaucugggaaag

SEQ ID NO: 3824119 - RNA, 14 nt, Human
cagggugaggaugg

SEQ ID NO: 3824120 - RNA, 13 nt, Human
cagggugcagagg

SEQ ID NO: 3824121 - RNA, 20 nt, Human
cagggugcaguaucaugccc

SEQ ID NO: 3824122 - RNA, 13 nt, Human
cagggugcugugg

SEQ ID NO: 3824123 - RNA, 12 nt, Human
caggguggcagc

SEQ ID NO: 3824124 - RNA, 14 nt, Human
caggguggccacac

SEQ ID NO: 3824125 - RNA, 17 nt, Human
cagggugggauggagga

SEQ ID NO: 3824126 - RNA, 18 nt, Human
cagggugggauggaggag

SEQ ID NO: 3824127 - RNA, 16 nt, Human
cagggugucugccccc

SEQ ID NO: 3824128 - RNA, 12 nt, Human
cagggugugucu

SEQ ID NO: 3824129 - RNA, 23 nt, Human
caggguguugggauacugcaggg

SEQ ID NO: 3824130 - RNA, 15 nt, Human
caggguuaagaagac

SEQ ID NO: 3824131 - RNA, 18 nt, Human
caggguucaaaaugucug

SEQ ID NO: 3824132 - RNA, 18 nt, Human
caggguucccccagcccu

SEQ ID NO: 3824133 - RNA, 21 nt, Human
caggguucccccagcccugug

SEQ ID NO: 3824134 - RNA, 22 nt, Human
caggguucccccagcccugugg

SEQ ID NO: 3824135 - RNA, 23 nt, Human
caggguucucccucccaccuuaa

SEQ ID NO: 3824136 - RNA, 15 nt, Human
caggguucuccucuc

SEQ ID NO: 3824137 - RNA, 23 nt, Human
caggguucucuuagcaacucaga

SEQ ID NO: 3824138 - RNA, 19 nt, Human
caggguugaccccagagga

SEQ ID NO: 3824139 - RNA, 12 nt, Human
caggguuggccc

SEQ ID NO: 3824140 - RNA, 16 nt, Human
caggguuggccccugc

SEQ ID NO: 3824141 - RNA, 14 nt, Human
caggguugggccca

SEQ ID NO: 3824142 - RNA, 16 nt, Human
caggguugggcccaga

SEQ ID NO: 3824143 - RNA, 17 nt, Human
caggguuucgagaagcu

SEQ ID NO: 3824144 - RNA, 21 nt, Human
caggguuuggcugugucuaaa

SEQ ID NO: 3824145 - RNA, 17 nt, Human
caggguuuuaucucugu

SEQ ID NO: 3824146 - RNA, 19 nt, Human
caggguuuuaucucugucu

SEQ ID NO: 3824147 - RNA, 15 nt, Human
cagguaaacuccugu

SEQ ID NO: 3824148 - RNA, 19 nt, Human
cagguaaagggcaaauaau

SEQ ID NO: 3824149 - RNA, 21 nt, Human
cagguaacaggcagauacagg

SEQ ID NO: 3824150 - RNA, 15 nt, Human
cagguaaugagggac

SEQ ID NO: 3824151 - RNA, 22 nt, Human
cagguaaugagggacuggaacc

SEQ ID NO: 3824152 - RNA, 19 nt, Human
cagguaaugugaauaaauu

SEQ ID NO: 3824153 - RNA, 16 nt, Human
cagguacagagaagga

SEQ ID NO: 3824154 - RNA, 14 nt, Human
cagguaccagcugc

SEQ ID NO: 3824155 - RNA, 16 nt, Human
cagguaccagcugcgc

SEQ ID NO: 3824156 - RNA, 17 nt, Human
cagguaccagcugcgcu

SEQ ID NO: 3824157 - RNA, 14 nt, Human
cagguaccaguucu

SEQ ID NO: 3824158 - RNA, 14 nt, Human
cagguacgcacaga

SEQ ID NO: 3824159 - RNA, 16 nt, Human
cagguacgcacagaca

SEQ ID NO: 3824160 - RNA, 17 nt, Human
cagguagaacgccaggg

SEQ ID NO: 3824161 - RNA, 19 nt, Human
cagguagaacgccagggac

SEQ ID NO: 3824162 - RNA, 22 nt, Human
cagguagaagguugacacaguu

SEQ ID NO: 3824163 - RNA, 20 nt, Human
cagguagaauuaucuaauuu

SEQ ID NO: 3824164 - RNA, 18 nt, Human
cagguagaccugucuccu

SEQ ID NO: 3824165 - RNA, 15 nt, Human
cagguagccugcugg

SEQ ID NO: 3824166 - RNA, 18 nt, Human
cagguagcugaaagggga

SEQ ID NO: 3824167 - RNA, 15 nt, Human
cagguagcugccccu

SEQ ID NO: 3824168 - RNA, 21 nt, Human
cagguagcugccccuggcucu

SEQ ID NO: 3824169 - RNA, 15 nt, Human
cagguaggaauauua

SEQ ID NO: 3824170 - RNA, 23 nt, Human
cagguaggaauauuauauuugga

SEQ ID NO: 3824171 - RNA, 23 nt, Human
cagguaguugcaauugaauuaaa

SEQ ID NO: 3824172 - RNA, 15 nt, Human
cagguauaccucacu

SEQ ID NO: 3824173 - RNA, 16 nt, Human
cagguauaccucacuu

SEQ ID NO: 3824174 - RNA, 15 nt, Human
cagguauauacuuug

SEQ ID NO: 3824175 - RNA, 22 nt, Human
cagguaucuccaggauugaaga

SEQ ID NO: 3824176 - RNA, 23 nt, Human
cagguauggaaggguuuguggcu

SEQ ID NO: 3824177 - RNA, 14 nt, Human
cagguauggcucug

SEQ ID NO: 3824178 - RNA, 14 nt, Human
cagguauguugccu

SEQ ID NO: 3824179 - RNA, 15 nt, Human
cagguauguugccuu

SEQ ID NO: 3824180 - RNA, 16 nt, Human
cagguauguugccuuu

SEQ ID NO: 3824181 - RNA, 18 nt, Human
cagguauuuuauaauucu

SEQ ID NO: 3824182 - RNA, 19 nt, Human
cagguauuuuauaauucug

SEQ ID NO: 3824183 - RNA, 23 nt, Human
cagguauuuuauaauucugggaa

SEQ ID NO: 3824184 - RNA, 11 nt, Human
cagguauuuug

SEQ ID NO: 3824185 - RNA, 17 nt, Human
caggucaacagaaugaa

SEQ ID NO: 3824186 - RNA, 21 nt, Human
caggucaacagaaugaaaaau

SEQ ID NO: 3824187 - RNA, 22 nt, Human
caggucaauacaguacaggcag

SEQ ID NO: 3824188 - RNA, 16 nt, Human
caggucagggugagga

SEQ ID NO: 3824189 - RNA, 20 nt, Human
caggucauauuaauauauuu

SEQ ID NO: 3824190 - RNA, 21 nt, Human
cagguccaaugagcuuucuga

SEQ ID NO: 3824191 - RNA, 13 nt, Human
cagguccagcucu

SEQ ID NO: 3824192 - RNA, 14 nt, Human
cagguccagcucug

SEQ ID NO: 3824193 - RNA, 17 nt, Human
caggucccaccuccagc

SEQ ID NO: 3824194 - RNA, 19 nt, Human
caggucccaccuccagccc

SEQ ID NO: 3824195 - RNA, 14 nt, Human
caggucccccugca

SEQ ID NO: 3824196 - RNA, 15 nt, Human
caggucccccugcag

SEQ ID NO: 3824197 - RNA, 18 nt, Human
caggucccccugcagcua

SEQ ID NO: 3824198 - RNA, 12 nt, Human
caggucccuaau

SEQ ID NO: 3824199 - RNA, 16 nt, Human
caggucccuaauaaag

SEQ ID NO: 3824200 - RNA, 18 nt, Human
caggucccuaauaaagcu

SEQ ID NO: 3824201 - RNA, 19 nt, Human
caggucccuaauaaagcug

SEQ ID NO: 3824202 - RNA, 16 nt, Human
caggucccuccccuuc

SEQ ID NO: 3824203 - RNA, 14 nt, Human
cagguccucccugc

SEQ ID NO: 3824204 - RNA, 15 nt, Human
caugcucagcccuga

SEQ ID NO: 3824205 - RNA, 20 nt, Human
caugcucagcccugacuggu

SEQ ID NO: 3824206 - RNA, 16 nt, Human
caugcuccccugugcc

SEQ ID NO: 3824207 - RNA, 18 nt, Human
caugcuccccugugccag

SEQ ID NO: 3824208 - RNA, 19 nt, Human
caugcuccccugugccagc

SEQ ID NO: 3824209 - RNA, 16 nt, Human
caugcuccucuucccc

SEQ ID NO: 3824210 - RNA, 22 nt, Human
caugcuccuuaauggcgccaug

SEQ ID NO: 3824211 - RNA, 12 nt, Human
caugcuccuuac

SEQ ID NO: 3824212 - RNA, 20 nt, Human
caugcucuccaaaccacuuu

SEQ ID NO: 3824213 - RNA, 14 nt, Human
caugcucucugcag

SEQ ID NO: 3824214 - RNA, 23 nt, Human
caugcucucugcagccagcccag

SEQ ID NO: 3824215 - RNA, 21 nt, Human
caugcucugagaagaggagcc

SEQ ID NO: 3824216 - RNA, 22 nt, Human
caugcucugagaagaggagccc

SEQ ID NO: 3824217 - RNA, 17 nt, Human
caugcucuuagaaaauu

SEQ ID NO: 3824218 - RNA, 21 nt, Human
caugcucuugaccuuguagag

SEQ ID NO: 3824219 - RNA, 17 nt, Human
caugcugaggccugggc

SEQ ID NO: 3824220 - RNA, 15 nt, Human
caugcugagucuccc

SEQ ID NO: 3824221 - RNA, 17 nt, Human
caugcugccaauauccu

SEQ ID NO: 3824222 - RNA, 14 nt, Human
caugcugcccugug

SEQ ID NO: 3824223 - RNA, 22 nt, Human
caugcugccuuauucagggaag

SEQ ID NO: 3824224 - RNA, 14 nt, Human
caugcugcugggga

SEQ ID NO: 3824225 - RNA, 16 nt, Human
caugcugcuggggaag

SEQ ID NO: 3824226 - RNA, 17 nt, Human
caugcugcuggggaaga

SEQ ID NO: 3824227 - RNA, 21 nt, Human
caugcugcuggggaagacagu

SEQ ID NO: 3824228 - RNA, 23 nt, Human
caugcuggaaccugcaaaaaaua

SEQ ID NO: 3824229 - RNA, 18 nt, Human
caugcuggacaggucugg

SEQ ID NO: 3824230 - RNA, 22 nt, Human
caugcuggacaggucugggaga

SEQ ID NO: 3824231 - RNA, 15 nt, Human
caugcuggagccugu

SEQ ID NO: 3824232 - RNA, 16 nt, Human
caugcuggagccugug

SEQ ID NO: 3824233 - RNA, 19 nt, Human
caugcuggagccuguguaa

SEQ ID NO: 3824234 - RNA, 22 nt, Human
caugcuggaggugacaucucuu

SEQ ID NO: 3824235 - RNA, 16 nt, Human
caugcuggccagccug

SEQ ID NO: 3824236 - RNA, 23 nt, Human
caugcugggaagacgccugagcu

SEQ ID NO: 3824237 - RNA, 19 nt, Human
caugcugggauuuccaacu

SEQ ID NO: 3824238 - RNA, 18 nt, Human
caugcuggguucugcaca

SEQ ID NO: 3824239 - RNA, 23 nt, Human
caugcugucuacacuaagagaga

SEQ ID NO: 3824240 - RNA, 21 nt, Human
caugcugucuggcacagccug

SEQ ID NO: 3824241 - RNA, 13 nt, Human
caugcuguguaag

SEQ ID NO: 3824242 - RNA, 19 nt, Human
caugcuguguaagcugugu

SEQ ID NO: 3824243 - RNA, 14 nt, Human
caugcugugugacu

SEQ ID NO: 3824244 - RNA, 17 nt, Human
caugcugugugacucaa

SEQ ID NO: 3824245 - RNA, 21 nt, Human
caugcugugugacucaaacca

SEQ ID NO: 3824246 - RNA, 22 nt, Human
caugcugugugacucaaaccaa

SEQ ID NO: 3824247 - RNA, 15 nt, Human
caugcuuagucacug

SEQ ID NO: 3824248 - RNA, 21 nt, Human
caugcuuauuccaugacugcu

SEQ ID NO: 3824249 - RNA, 16 nt, Human
caugcuucacaauguu

SEQ ID NO: 3824250 - RNA, 19 nt, Human
caugcuucaugaaaauccu

SEQ ID NO: 3824251 - RNA, 20 nt, Human
caugcuucucaucuugugaa

SEQ ID NO: 3824252 - RNA, 14 nt, Human
caugcuucuucuca

SEQ ID NO: 3824253 - RNA, 14 nt, Human
caugcuuuaaagug

SEQ ID NO: 3824254 - RNA, 15 nt, Human
caugcuuuaaagugu

SEQ ID NO: 3824255 - RNA, 19 nt, Human
caugcuuuaaaguguaaua

SEQ ID NO: 3824256 - RNA, 23 nt, Human
caugcuuuaaaguguaauaauau

SEQ ID NO: 3824257 - RNA, 16 nt, Human
cauggaaaaacuuccu

SEQ ID NO: 3824258 - RNA, 16 nt, Human
cauggaaaaaugccau

SEQ ID NO: 3824259 - RNA, 21 nt, Human
cauggaaaaaugccaucaaau

SEQ ID NO: 3824260 - RNA, 17 nt, Human
cauggaaaccugaaaaa

SEQ ID NO: 3824261 - RNA, 18 nt, Human
cauggaaaccugaaaaaa

SEQ ID NO: 3824262 - RNA, 14 nt, Human
cauggaaauauuau

SEQ ID NO: 3824263 - RNA, 16 nt, Human
cauggaaauauuaugc

SEQ ID NO: 3824264 - RNA, 21 nt, Human
cauggaaaucagccaaguuuu

SEQ ID NO: 3824265 - RNA, 15 nt, Human
cauggaaauuuaaag

SEQ ID NO: 3824266 - RNA, 16 nt, Human
cauggaaauuuaaagc

SEQ ID NO: 3824267 - RNA, 17 nt, Human
cauggaaauuuaaagca

SEQ ID NO: 3824268 - RNA, 13 nt, Human
cauggaacacaaa

SEQ ID NO: 3824269 - RNA, 23 nt, Human
cauggaacgcguugaaauuguaa

SEQ ID NO: 3824270 - RNA, 16 nt, Human
cauggaacucauuccu

SEQ ID NO: 3824271 - RNA, 20 nt, Human
cauggaaguacuauaauuua

SEQ ID NO: 3824272 - RNA, 14 nt, Human
cauggaaugagggu

SEQ ID NO: 3824273 - RNA, 21 nt, Human
cauggaaugcuugaaaaaugu

SEQ ID NO: 3824274 - RNA, 18 nt, Human
cauggaauggacauccug

SEQ ID NO: 3824275 - RNA, 21 nt, Human
cauggaaugguuauaaaagug

SEQ ID NO: 3824276 - RNA, 22 nt, Human
cauggaaugguuauaaaaguga

SEQ ID NO: 3824277 - RNA, 16 nt, Human
cauggaauuuguaagu

SEQ ID NO: 3824278 - RNA, 23 nt, Human
cauggacaauggaccggagagug

SEQ ID NO: 3824279 - RNA, 18 nt, Human
cauggacacuacacccag

SEQ ID NO: 3824280 - RNA, 20 nt, Human
cauggacacuacacccagca

SEQ ID NO: 3824281 - RNA, 22 nt, Human
cauggacacuacacccagcaau

SEQ ID NO: 3824282 - RNA, 14 nt, Human
cauggacacuccag

SEQ ID NO: 3824283 - RNA, 15 nt, Human
cauggacagaagaag

SEQ ID NO: 3824284 - RNA, 15 nt, Human
cauggacaggcuggc

SEQ ID NO: 3824285 - RNA, 18 nt, Human
cauggacauuuagaagaa

SEQ ID NO: 3824286 - RNA, 21 nt, Human
cauggaccacuguuucuugcu

SEQ ID NO: 3824287 - RNA, 18 nt, Human
cagugauauggcagaaga

SEQ ID NO: 3824288 - RNA, 23 nt, Human
cagugauauggcagaagacacca

SEQ ID NO: 3824289 - RNA, 22 nt, Human
cagugauauucuuuguuaauuu

SEQ ID NO: 3824290 - RNA, 17 nt, Human
cagugaucaaaguccga

SEQ ID NO: 3824291 - RNA, 17 nt, Human
cagugauuaccagggac

SEQ ID NO: 3824292 - RNA, 22 nt, Human
cagugauuaccagggacugagg

SEQ ID NO: 3824293 - RNA, 19 nt, Human
cagugauucgagcuauauu

SEQ ID NO: 3824294 - RNA, 20 nt, Human
cagugauugucuuaauauug

SEQ ID NO: 3824295 - RNA, 19 nt, Human
cagugauuuuuuucuugua

SEQ ID NO: 3824296 - RNA, 13 nt, Human
cagugcaaaugca

SEQ ID NO: 3824297 - RNA, 18 nt, Human
cagugcaaaugcaugcuu

SEQ ID NO: 3824298 - RNA, 15 nt, Human
cagugcaaaugucag

SEQ ID NO: 3824299 - RNA, 16 nt, Human
cagugcaaccucugcu

SEQ ID NO: 3824300 - RNA, 22 nt, Human
cagugcaagagacucuggccuc

SEQ ID NO: 3824301 - RNA, 22 nt, Human
cagugcaaugguauaaauuuca

SEQ ID NO: 3824302 - RNA, 12 nt, Human
cagugcagaaug

SEQ ID NO: 3824303 - RNA, 14 nt, Human
cagugcagaaugua

SEQ ID NO: 3824304 - RNA, 22 nt, Human
cagugcagaauguaagugggcc

SEQ ID NO: 3824305 - RNA, 14 nt, Human
cagugcaggcuggc

SEQ ID NO: 3824306 - RNA, 16 nt, Human
cagugcaggcuggcca

SEQ ID NO: 3824307 - RNA, 17 nt, Human
cagugcaggcuggccag

SEQ ID NO: 3824308 - RNA, 19 nt, Human
cagugcaggcuggccagcc

SEQ ID NO: 3824309 - RNA, 20 nt, Human
cagugcaggcuggccagccg

SEQ ID NO: 3824310 - RNA, 22 nt, Human
cagugcauaguuguagacaaag

SEQ ID NO: 3824311 - RNA, 12 nt, Human
cagugcaucuca

SEQ ID NO: 3824312 - RNA, 18 nt, Human
cagugcaucucagcccac

SEQ ID NO: 3824313 - RNA, 13 nt, Human
cagugcaugcugu

SEQ ID NO: 3824314 - RNA, 14 nt, Human
cagugcaugguggc

SEQ ID NO: 3824315 - RNA, 21 nt, Human
cagugcaugguggccagaggu

SEQ ID NO: 3824316 - RNA, 10 nt, Human
cagugccaac

SEQ ID NO: 3824317 - RNA, 18 nt, Human
cagugccaacuguggcug

SEQ ID NO: 3824318 - RNA, 19 nt, Human
cagugccaagcacagugcc

SEQ ID NO: 3824319 - RNA, 12 nt, Human
cagugccaagga

SEQ ID NO: 3824320 - RNA, 15 nt, Human
cagugccagcaauga

SEQ ID NO: 3824321 - RNA, 17 nt, Human
cagugccagcaaugaca

SEQ ID NO: 3824322 - RNA, 12 nt, Human
cagugcccacag

SEQ ID NO: 3824323 - RNA, 17 nt, Human
cagugcccacaggauca

SEQ ID NO: 3824324 - RNA, 15 nt, Human
cagugcccagguggc

SEQ ID NO: 3824325 - RNA, 14 nt, Human
cagugcccauuccu

SEQ ID NO: 3824326 - RNA, 15 nt, Human
cagugcccccacuga

SEQ ID NO: 3824327 - RNA, 17 nt, Human
cagugcccccacugacc

SEQ ID NO: 3824328 - RNA, 23 nt, Human
cagugcccccacugaccagaacu

SEQ ID NO: 3824329 - RNA, 14 nt, Human
cagugccccuagcu

SEQ ID NO: 3824330 - RNA, 16 nt, Human
cagugcccuccagccc

SEQ ID NO: 3824331 - RNA, 22 nt, Human
cagugcccucuccccucagccu

SEQ ID NO: 3824332 - RNA, 14 nt, Human
cagugcccuggggc

SEQ ID NO: 3824333 - RNA, 15 nt, Human
cagugccgagaagga

SEQ ID NO: 3824334 - RNA, 18 nt, Human
cagugccgagaaggaagc

SEQ ID NO: 3824335 - RNA, 20 nt, Human
cagugccgccgccucgccca

SEQ ID NO: 3824336 - RNA, 19 nt, Human
cagugccuaaaauaagaau

SEQ ID NO: 3824337 - RNA, 20 nt, Human
cagugccucucccugcugcu

SEQ ID NO: 3824338 - RNA, 10 nt, Human
cagugccugc

SEQ ID NO: 3824339 - RNA, 11 nt, Human
cagugccugcu

SEQ ID NO: 3824340 - RNA, 21 nt, Human
cagugccuuaccuccugccca

SEQ ID NO: 3824341 - RNA, 22 nt, Human
cagugccuuaccuccugcccag

SEQ ID NO: 3824342 - RNA, 23 nt, Human
cagugccuuaccuccugcccagg

SEQ ID NO: 3824343 - RNA, 13 nt, Human
cagugccuuaugg

SEQ ID NO: 3824344 - RNA, 15 nt, Human
cagugccuuauggaa

SEQ ID NO: 3824345 - RNA, 17 nt, Human
cagugccuuauggaaca

SEQ ID NO: 3824346 - RNA, 18 nt, Human
cagugccuucaauaaaug

SEQ ID NO: 3824347 - RNA, 16 nt, Human
cagugccuuccauaau

SEQ ID NO: 3824348 - RNA, 15 nt, Human
caagccuggucagcc

SEQ ID NO: 3824349 - RNA, 21 nt, Human
caagccuguaaucccagcuac

SEQ ID NO: 3824350 - RNA, 14 nt, Human
caagccuugauugg

SEQ ID NO: 3824351 - RNA, 17 nt, Human
caagcgaggucaacaga

SEQ ID NO: 3824352 - RNA, 15 nt, Human
caagcgauucucuug

SEQ ID NO: 3824353 - RNA, 18 nt, Human
caagcgauucuucugcuu

SEQ ID NO: 3824354 - RNA, 22 nt, Human
caagcgauucuucugcuucagc

SEQ ID NO: 3824355 - RNA, 20 nt, Human
caagcgauuuuccugcuuca

SEQ ID NO: 3824356 - RNA, 16 nt, Human
caagcgcauccaaucu

SEQ ID NO: 3824357 - RNA, 14 nt, Human
caagcgcccuggcc

SEQ ID NO: 3824358 - RNA, 19 nt, Human
caagcgcccuggcccccac

SEQ ID NO: 3824359 - RNA, 23 nt, Human
caagcgcccuggcccccacaugg

SEQ ID NO: 3824360 - RNA, 13 nt, Human
caagcgccuggag

SEQ ID NO: 3824361 - RNA, 18 nt, Human
caagcggguggcucuggg

SEQ ID NO: 3824362 - RNA, 16 nt, Human
caagcggugucucucc

SEQ ID NO: 3824363 - RNA, 18 nt, Human
caagcgugagccacugca

SEQ ID NO: 3824364 - RNA, 14 nt, Human
caagcuaagcacug

SEQ ID NO: 3824365 - RNA, 16 nt, Human
caagcuaauaaaauau

SEQ ID NO: 3824366 - RNA, 22 nt, Human
caagcuaauaaaauaucauuca

SEQ ID NO: 3824367 - RNA, 17 nt, Human
caagcuaggugcuaauu

SEQ ID NO: 3824368 - RNA, 18 nt, Human
caagcuauuccuuucccu

SEQ ID NO: 3824369 - RNA, 19 nt, Human
caagcuauuccuuucccuu

SEQ ID NO: 3824370 - RNA, 20 nt, Human
caagcuauuccuuucccuuc

SEQ ID NO: 3824371 - RNA, 16 nt, Human
caagcucaaagcgugg

SEQ ID NO: 3824372 - RNA, 19 nt, Human
caagcucacaguuccucgc

SEQ ID NO: 3824373 - RNA, 15 nt, Human
caagcucagaaggcu

SEQ ID NO: 3824374 - RNA, 18 nt, Human
caagcucaggaccaggca

SEQ ID NO: 3824375 - RNA, 12 nt, Human
caagcuccaagc

SEQ ID NO: 3824376 - RNA, 13 nt, Human
caagcuccaagcc

SEQ ID NO: 3824377 - RNA, 14 nt, Human
caagcuccaagccc

SEQ ID NO: 3824378 - RNA, 16 nt, Human
caagcuccgcaggacu

SEQ ID NO: 3824379 - RNA, 17 nt, Human
caagcuccgcaggacuu

SEQ ID NO: 3824380 - RNA, 20 nt, Human
caagcuccgccucccggguu

SEQ ID NO: 3824381 - RNA, 16 nt, Human
caagcuccuccucccu

SEQ ID NO: 3824382 - RNA, 17 nt, Human
caagcuccuccucccug

SEQ ID NO: 3824383 - RNA, 17 nt, Human
caagcucuagugggaag

SEQ ID NO: 3824384 - RNA, 14 nt, Human
caagcucugaggga

SEQ ID NO: 3824385 - RNA, 23 nt, Human
caagcucugagggaaagggcccu

SEQ ID NO: 3824386 - RNA, 13 nt, Human
caagcucuuccuu

SEQ ID NO: 3824387 - RNA, 14 nt, Human
caagcugaaauuuu

SEQ ID NO: 3824388 - RNA, 23 nt, Human
caagcugaguuuccuaugggaac

SEQ ID NO: 3824389 - RNA, 19 nt, Human
caagcugauuaaaugacac

SEQ ID NO: 3824390 - RNA, 19 nt, Human
caagcugccucccugucca

SEQ ID NO: 3824391 - RNA, 16 nt, Human
caagcugcucugagcc

SEQ ID NO: 3824392 - RNA, 12 nt, Human
caagcuggaagc

SEQ ID NO: 3824393 - RNA, 11 nt, Human
caagcuggccu

SEQ ID NO: 3824394 - RNA, 22 nt, Human
caagcuggcugggguggccugu

SEQ ID NO: 3824395 - RNA, 22 nt, Human
caagcuggucccacucagucca

SEQ ID NO: 3824396 - RNA, 22 nt, Human
caagcugguggcucugugugcu

SEQ ID NO: 3824397 - RNA, 17 nt, Human
caagcuguccagagaaa

SEQ ID NO: 3824398 - RNA, 14 nt, Human
caagcugugagaca

SEQ ID NO: 3824399 - RNA, 22 nt, Human
caagcugugagacagugggaaa

SEQ ID NO: 3824400 - RNA, 18 nt, Human
caagcugugccacccugg

SEQ ID NO: 3824401 - RNA, 20 nt, Human
caagcugugccacccugggc

SEQ ID NO: 3824402 - RNA, 17 nt, Human
caagcuguugaccaggc

SEQ ID NO: 3824403 - RNA, 14 nt, Human
caagcuguuuucuu

SEQ ID NO: 3824404 - RNA, 20 nt, Human
caagcuuaauggcugauaau

SEQ ID NO: 3824405 - RNA, 19 nt, Human
caagcuucccuccaucccc

SEQ ID NO: 3824406 - RNA, 24 nt, Human
caagcuucugagacgucaugagga

SEQ ID NO: 3824407 - RNA, 13 nt, Human
caagcuucuuuua

SEQ ID NO: 3824408 - RNA, 16 nt, Human
caagcuuggcagccga

SEQ ID NO: 3824409 - RNA, 17 nt, Human
caagcuuguccaacccg

SEQ ID NO: 3824410 - RNA, 13 nt, Human
caagcuuuaaauu

SEQ ID NO: 3824411 - RNA, 21 nt, Human
caagcuuuuacaacagugcug

SEQ ID NO: 3824412 - RNA, 13 nt, Human
caagcuuuuuuau

SEQ ID NO: 3824413 - RNA, 12 nt, Human
caaggaaaaaga

SEQ ID NO: 3824414 - RNA, 17 nt, Human
caaggaaaaagaaaaua

SEQ ID NO: 3824415 - RNA, 17 nt, Human
caaggaaagccccagca

SEQ ID NO: 3824416 - RNA, 15 nt, Human
caaggaaaggcaaau

SEQ ID NO: 3824417 - RNA, 19 nt, Human
caaggaaaggggagaaggg

SEQ ID NO: 3824418 - RNA, 22 nt, Human
caaggaaagggggucccagugg

SEQ ID NO: 3824419 - RNA, 16 nt, Human
caaggaacaaaaaaac

SEQ ID NO: 3824420 - RNA, 18 nt, Human
caaggaacuugaaaaaua

SEQ ID NO: 3824421 - RNA, 17 nt, Human
caaggaagauauacaug

SEQ ID NO: 3824422 - RNA, 12 nt, Human
caaggaaggaaa

SEQ ID NO: 3824423 - RNA, 17 nt, Human
caaggaaggaaagaaag

SEQ ID NO: 3824424 - RNA, 17 nt, Human
caaggaagggauguauu

SEQ ID NO: 3824425 - RNA, 18 nt, Human
caaggaagggauguauuu

SEQ ID NO: 3824426 - RNA, 16 nt, Human
caaggaauuucuuaac

SEQ ID NO: 3824427 - RNA, 21 nt, Human
caaggaauuucuuaacuucuu

SEQ ID NO: 3824428 - RNA, 22 nt, Human
caaggacacgcgccccccuccc

SEQ ID NO: 3824429 - RNA, 21 nt, Human
caaggacagaaggcuccugcc

SEQ ID NO: 3824430 - RNA, 20 nt, Human
caaggaccaacaagggcagu

SEQ ID NO: 3824431 - RNA, 23 nt, Human
caaggaccaacaagggcagugga

SEQ ID NO: 3824432 - RNA, 15 nt, Human
caaggaccccucacc

SEQ ID NO: 3824433 - RNA, 19 nt, Human
caaggaccuccucuucccc

SEQ ID NO: 3824434 - RNA, 15 nt, Human
caaggacgcuucaca

SEQ ID NO: 3824435 - RNA, 19 nt, Human
caaggacuaggguccuggg

SEQ ID NO: 3824436 - RNA, 13 nt, Human
caaggacugagca

SEQ ID NO: 3824437 - RNA, 20 nt, Human
caaggacugagcacccucug

SEQ ID NO: 3824438 - RNA, 19 nt, Human
caaggacuuccuguccagc

SEQ ID NO: 3824439 - RNA, 21 nt, Human
caaggacuuccuguccagcuc

SEQ ID NO: 3824440 - RNA, 22 nt, Human
caaggacuuccuguccagcucc

SEQ ID NO: 3824441 - RNA, 18 nt, Human
caaggacuugaaagcauc

SEQ ID NO: 3824442 - RNA, 15 nt, Human
caaggacuuugcagc

SEQ ID NO: 3824443 - RNA, 16 nt, Human
caaggacuuugcagcc

SEQ ID NO: 3824444 - RNA, 15 nt, Human
caaggagaggaggca

SEQ ID NO: 3824445 - RNA, 23 nt, Human
caaggagaugaagcaaacacauu

SEQ ID NO: 3824446 - RNA, 14 nt, Human
caaggagccaaaca

SEQ ID NO: 3824447 - RNA, 14 nt, Human
caaggagcugagaa

SEQ ID NO: 3824448 - RNA, 18 nt, Human
caaggagcugagaauaga

SEQ ID NO: 3824449 - RNA, 20 nt, Human
caaggagcugagaauagaag

SEQ ID NO: 3824450 - RNA, 13 nt, Human
caaggagcugcua

SEQ ID NO: 3824451 - RNA, 14 nt, Human
caaggaggcuggcu

SEQ ID NO: 3824452 - RNA, 20 nt, Human
caaggagggcacaggugucu

SEQ ID NO: 3824453 - RNA, 18 nt, Human
caaggagucacugagacc

SEQ ID NO: 3824454 - RNA, 23 nt, Human
caaggaguuccaugaagaccaca

SEQ ID NO: 3824455 - RNA, 16 nt, Human
caaggauagaugcugg

SEQ ID NO: 3824456 - RNA, 23 nt, Human
caaggauagaugcuggcccaggg

SEQ ID NO: 3824457 - RNA, 13 nt, Human
caaggauccugag

SEQ ID NO: 3824458 - RNA, 15 nt, Human
caaggauccugagcc

SEQ ID NO: 3824459 - RNA, 19 nt, Human
caaggauccugagccagau

SEQ ID NO: 3824460 - RNA, 19 nt, Human
caaggaugccccguccccc

SEQ ID NO: 3824461 - RNA, 16 nt, Human
caaggcaaggcaggug

SEQ ID NO: 3824462 - RNA, 18 nt, Human
caaggcaaggcaggugcc

SEQ ID NO: 3824463 - RNA, 14 nt, Human
caaggcaaggcugu

SEQ ID NO: 3824464 - RNA, 13 nt, Human
caaggcaaggggu

SEQ ID NO: 3824465 - RNA, 15 nt, Human
caaggcacucuagau

SEQ ID NO: 3824466 - RNA, 16 nt, Human
caaggcacucuagauu

SEQ ID NO: 3824467 - RNA, 17 nt, Human
caaggcacucuagauuc

SEQ ID NO: 3824468 - RNA, 13 nt, Human
caaggcacugccu

SEQ ID NO: 3824469 - RNA, 16 nt, Human
caaggcacugccugau

SEQ ID NO: 3824470 - RNA, 15 nt, Human
caaggcacugucacu

SEQ ID NO: 3824471 - RNA, 24 nt, Human
caaggcacuucauguaaaguguca

SEQ ID NO: 3824472 - RNA, 13 nt, Human
caaggcagaggcc

SEQ ID NO: 3824473 - RNA, 15 nt, Human
caaggcagaggccug

SEQ ID NO: 3824474 - RNA, 20 nt, Human
caaggcagaggccugggcug

SEQ ID NO: 3824475 - RNA, 12 nt, Human
caaggcagccgu

SEQ ID NO: 3824476 - RNA, 16 nt, Human
caaggcaggugccucc

SEQ ID NO: 3824477 - RNA, 15 nt, Human
caaggccaaaggaag

SEQ ID NO: 3824478 - RNA, 17 nt, Human
caaggccaaaggaagca

SEQ ID NO: 3824479 - RNA, 19 nt, Human
caaggccaaaggaagcaca

SEQ ID NO: 3824480 - RNA, 12 nt, Human
caaggccaccuc

SEQ ID NO: 3824481 - RNA, 14 nt, Human
caaggccaccucuu

SEQ ID NO: 3824482 - RNA, 17 nt, Human
caaggccagaguggccu

SEQ ID NO: 3824483 - RNA, 19 nt, Human
caaggccagaguggccugg

SEQ ID NO: 3824484 - RNA, 15 nt, Human
caaggccagggacag

SEQ ID NO: 3824485 - RNA, 14 nt, Human
caaggccaucuggg

SEQ ID NO: 3824486 - RNA, 17 nt, Human
caaggccaucugggcuc

SEQ ID NO: 3824487 - RNA, 15 nt, Human
caaggcccacaggag

SEQ ID NO: 3824488 - RNA, 14 nt, Human
caaggccccagaga

SEQ ID NO: 3824489 - RNA, 15 nt, Human
caaggcccccugccu

SEQ ID NO: 3824490 - RNA, 13 nt, Human
caaggcccugcug

SEQ ID NO: 3824491 - RNA, 22 nt, Human
caaggcccugcugcccaaucuc

SEQ ID NO: 3824492 - RNA, 16 nt, Human
caaggccgaagcucug

SEQ ID NO: 3824493 - RNA, 12 nt, Human
caagucauggcu

SEQ ID NO: 3824494 - RNA, 17 nt, Human
caagucauguaaauacu

SEQ ID NO: 3824495 - RNA, 19 nt, Human
caagucauguaaauacugu

SEQ ID NO: 3824496 - RNA, 13 nt, Human
caagucaugugca

SEQ ID NO: 3824497 - RNA, 15 nt, Human
caaguccaaauguuu

SEQ ID NO: 3824498 - RNA, 21 nt, Human
caaguccagauuuacacuggg

SEQ ID NO: 3824499 - RNA, 22 nt, Human
caaguccagauuuacacuggga

SEQ ID NO: 3824500 - RNA, 13 nt, Human
caaguccaggucc

SEQ ID NO: 3824501 - RNA, 24 nt, Human
caaguccagguccugguggggcag

SEQ ID NO: 3824502 - RNA, 23 nt, Human
caagucccaccgguugcuucugg

SEQ ID NO: 3824503 - RNA, 17 nt, Human
caagucccagcgcggcu

SEQ ID NO: 3824504 - RNA, 14 nt, Human
caaguccccaagau

SEQ ID NO: 3824505 - RNA, 17 nt, Human
caagucccccaagaccu

SEQ ID NO: 3824506 - RNA, 19 nt, Human
caagucccuguuuucugag

SEQ ID NO: 3824507 - RNA, 20 nt, Human
caagucccuguuuucugagc

SEQ ID NO: 3824508 - RNA, 22 nt, Human
caagucccuguuuucugagccc

SEQ ID NO: 3824509 - RNA, 23 nt, Human
caagucccuguuuucugagcccg

SEQ ID NO: 3824510 - RNA, 14 nt, Human
caaguccugaagag

SEQ ID NO: 3824511 - RNA, 20 nt, Human
caaguccugaagaggcgggc

SEQ ID NO: 3824512 - RNA, 23 nt, Human
caaguccuuaccucuuccggaga

SEQ ID NO: 3824513 - RNA, 16 nt, Human
caaguccuuuuguaaa

SEQ ID NO: 3824514 - RNA, 17 nt, Human
caaguccuuuuguaaag

SEQ ID NO: 3824515 - RNA, 18 nt, Human
caaguccuuuuguaaagu

SEQ ID NO: 3824516 - RNA, 17 nt, Human
caagucgaugaacuauu

SEQ ID NO: 3824517 - RNA, 16 nt, Human
caagucggaacagcag

SEQ ID NO: 3824518 - RNA, 17 nt, Human
caagucuccuuccccuu

SEQ ID NO: 3824519 - RNA, 22 nt, Human
caagucucugcuggcccagcca

SEQ ID NO: 3824520 - RNA, 23 nt, Human
caagucucugcuggcccagccaa

SEQ ID NO: 3824521 - RNA, 23 nt, Human
caagucugugccuggagcuccug

SEQ ID NO: 3824522 - RNA, 13 nt, Human
caagucuguguuc

SEQ ID NO: 3824523 - RNA, 20 nt, Human
caagucuguuuacugcaagg

SEQ ID NO: 3824524 - RNA, 14 nt, Human
caagucuucccuga

SEQ ID NO: 3824525 - RNA, 17 nt, Human
caagucuuucucuuucc

SEQ ID NO: 3824526 - RNA, 20 nt, Human
caagucuuucucuuucccug

SEQ ID NO: 3824527 - RNA, 23 nt, Human
caagugaaaaaggaggaagagaa

SEQ ID NO: 3824528 - RNA, 22 nt, Human
caagugaaauaacaaaauggac

SEQ ID NO: 3824529 - RNA, 19 nt, Human
caagugaacacuagccaga

SEQ ID NO: 3824530 - RNA, 21 nt, Human
caagugaccuauaccuguguu

SEQ ID NO: 3824531 - RNA, 18 nt, Human
caagugacuguaucugug

SEQ ID NO: 3824532 - RNA, 16 nt, Human
caagugagcaaaccug

SEQ ID NO: 3824533 - RNA, 20 nt, Human
caagugagcaaaccugcccc

SEQ ID NO: 3824534 - RNA, 21 nt, Human
caagugagcaaaccugcccca

SEQ ID NO: 3824535 - RNA, 19 nt, Human
caagugaucugcccaccuc

SEQ ID NO: 3824536 - RNA, 21 nt, Human
caagugauucucaugccucag

SEQ ID NO: 3824537 - RNA, 22 nt, Human
caagugauucucaugccucagc

SEQ ID NO: 3824538 - RNA, 19 nt, Human
caagugauugggacagagg

SEQ ID NO: 3824539 - RNA, 14 nt, Human
caagugcacggggc

SEQ ID NO: 3824540 - RNA, 20 nt, Human
caagugcacuuucuaauguu

SEQ ID NO: 3824541 - RNA, 17 nt, Human
caagugcaugcucucug

SEQ ID NO: 3824542 - RNA, 14 nt, Human
caagugccagaggu

SEQ ID NO: 3824543 - RNA, 16 nt, Human
caagugccagaggugg

SEQ ID NO: 3824544 - RNA, 19 nt, Human
caagugccagaggugggca

SEQ ID NO: 3824545 - RNA, 20 nt, Human
caagugccagaggugggcag

SEQ ID NO: 3824546 - RNA, 13 nt, Human
caagugccuuaau

SEQ ID NO: 3824547 - RNA, 14 nt, Human
caagugcugaacag

SEQ ID NO: 3824548 - RNA, 13 nt, Human
caagugcuggagu

SEQ ID NO: 3824549 - RNA, 21 nt, Human
caagugcuggcaccaccaggc

SEQ ID NO: 3824550 - RNA, 22 nt, Human
caaguggaccuuaggccuuccu

SEQ ID NO: 3824551 - RNA, 19 nt, Human
caaguggaccuugagacca

SEQ ID NO: 3824552 - RNA, 16 nt, Human
caaguggacucagggc

SEQ ID NO: 3824553 - RNA, 23 nt, Human
caaguggcaaagcuguucuuccu

SEQ ID NO: 3824554 - RNA, 17 nt, Human
caaguggcauaaagcau

SEQ ID NO: 3824555 - RNA, 18 nt, Human
caaguggcauaaagcaua

SEQ ID NO: 3824556 - RNA, 19 nt, Human
caaguggcaugugcuguga

SEQ ID NO: 3824557 - RNA, 13 nt, Human
caagugggggcag

SEQ ID NO: 3824558 - RNA, 17 nt, Human
caaguggggugcuggga

SEQ ID NO: 3824559 - RNA, 19 nt, Human
caagugguuuccacaugcu

SEQ ID NO: 3824560 - RNA, 21 nt, Human
caaguguaaaauauuuugaau

SEQ ID NO: 3824561 - RNA, 18 nt, Human
caaguguaaugaauaccu

SEQ ID NO: 3824562 - RNA, 22 nt, Human
caaguguaugcacgugugcaca

SEQ ID NO: 3824563 - RNA, 20 nt, Human
caagugucucaguccaccug

SEQ ID NO: 3824564 - RNA, 19 nt, Human
caagugugaacaaaagaug

SEQ ID NO: 3824565 - RNA, 14 nt, Human
caagugugaauacu

SEQ ID NO: 3824566 - RNA, 16 nt, Human
caagugugaauacugc

SEQ ID NO: 3824567 - RNA, 15 nt, Human
caagugugcauauug

SEQ ID NO: 3824568 - RNA, 16 nt, Human
caagugugcuaaaaau

SEQ ID NO: 3824569 - RNA, 21 nt, Human
caagugugggccacuguggug

SEQ ID NO: 3824570 - RNA, 18 nt, Human
caagugugggggguccuu

SEQ ID NO: 3824571 - RNA, 22 nt, Human
caagugugguagggacuuaaaa

SEQ ID NO: 3824572 - RNA, 19 nt, Human
caagugugugcacaugugu

SEQ ID NO: 3824573 - RNA, 21 nt, Human
caagugugugcacaugugugc

SEQ ID NO: 3824574 - RNA, 16 nt, Human
caagugugugcaugug

SEQ ID NO: 3824575 - RNA, 19 nt, Human
caaguguuguuuuuuaagu

SEQ ID NO: 3824576 - RNA, 14 nt, Human
caaguuaaauaaau

SEQ ID NO: 3824577 - RNA, 13 nt, Human
caaguuaaaugua

SEQ ID NO: 3824578 - RNA, 20 nt, Human
caaguuacagcugugacaau

SEQ ID NO: 3824579 - RNA, 14 nt, Human
caaguuagcucagg

SEQ ID NO: 3824580 - RNA, 19 nt, Human
caaguuagcucaggaggcu

SEQ ID NO: 3824581 - RNA, 16 nt, Human
caaguuaguucaaucu

SEQ ID NO: 3824582 - RNA, 19 nt, Human
caaguuauugacaaacucu

SEQ ID NO: 3824583 - RNA, 20 nt, Human
caaguuauuguacagcuguu

SEQ ID NO: 3824584 - RNA, 19 nt, Human
caaguucccaguuggagcu

SEQ ID NO: 3824585 - RNA, 21 nt, Human
caaguuccucuagugcccucc

SEQ ID NO: 3824586 - RNA, 15 nt, Human
caaguucgucuguug

SEQ ID NO: 3824587 - RNA, 12 nt, Human
caaguucuaaga

SEQ ID NO: 3824588 - RNA, 17 nt, Human
caaguucuaagauucua

SEQ ID NO: 3824589 - RNA, 18 nt, Human
caaguucuaagauucuaa

SEQ ID NO: 3824590 - RNA, 18 nt, Human
caaguucuagagaagagg

SEQ ID NO: 3824591 - RNA, 21 nt, Human
caaguucuagagaagaggcug

SEQ ID NO: 3824592 - RNA, 19 nt, Human
caaguugaagacuuuguuu

SEQ ID NO: 3824593 - RNA, 19 nt, Human
caaguugagcuaugacuua

SEQ ID NO: 3824594 - RNA, 15 nt, Human
caaguugcgacggag

SEQ ID NO: 3824595 - RNA, 20 nt, Human
caaguugcgacggagagaaa

SEQ ID NO: 3824596 - RNA, 14 nt, Human
caaguuggacuggg

SEQ ID NO: 3824597 - RNA, 13 nt, Human
caaguugugcuug

SEQ ID NO: 3824598 - RNA, 20 nt, Human
caaguuguggugcugacaaa

SEQ ID NO: 3824599 - RNA, 19 nt, Human
caaguuguucgggccaagg

SEQ ID NO: 3824600 - RNA, 20 nt, Human
caaguuuacucaacccucuc

SEQ ID NO: 3824601 - RNA, 14 nt, Human
caaguuuauauaua

SEQ ID NO: 3824602 - RNA, 17 nt, Human
caaguuuccaagcaaau

SEQ ID NO: 3824603 - RNA, 14 nt, Human
caaguuuuaaaguu

SEQ ID NO: 3824604 - RNA, 22 nt, Human
caaguuuuaggacaaacagcuc

SEQ ID NO: 3824605 - RNA, 17 nt, Human
caaguuuuccauauuuu

SEQ ID NO: 3824606 - RNA, 13 nt, Human
caguucugcuccu

SEQ ID NO: 3824607 - RNA, 15 nt, Human
caguucugcuccucu

SEQ ID NO: 3824608 - RNA, 16 nt, Human
caguucugcuccucuc

SEQ ID NO: 3824609 - RNA, 17 nt, Human
caguucugcuccucucc

SEQ ID NO: 3824610 - RNA, 21 nt, Human
caguucuggauggugugccuu

SEQ ID NO: 3824611 - RNA, 20 nt, Human
caguucugggugcucccuac

SEQ ID NO: 3824612 - RNA, 23 nt, Human
caguucugugaucugggucucua

SEQ ID NO: 3824613 - RNA, 20 nt, Human
caguucugugguuucauguu

SEQ ID NO: 3824614 - RNA, 19 nt, Human
caguucuucgacuguuguu

SEQ ID NO: 3824615 - RNA, 17 nt, Human
caguucuucgggaagag

SEQ ID NO: 3824616 - RNA, 23 nt, Human
caguucuucgggaagagaggagu

SEQ ID NO: 3824617 - RNA, 16 nt, Human
caguucuugugugguu

SEQ ID NO: 3824618 - RNA, 17 nt, Human
caguucuuugggccaga

SEQ ID NO: 3824619 - RNA, 21 nt, Human
caguucuuugggccagacaug

SEQ ID NO: 3824620 - RNA, 22 nt, Human
caguucuuugggccagacaugc

SEQ ID NO: 3824621 - RNA, 18 nt, Human
caguugaaaagacuccaa

SEQ ID NO: 3824622 - RNA, 23 nt, Human
caguugaaaagacuccaaagaaa

SEQ ID NO: 3824623 - RNA, 20 nt, Human
caguugaaugacaacagaag

SEQ ID NO: 3824624 - RNA, 18 nt, Human
caguugagacaagaaaau

SEQ ID NO: 3824625 - RNA, 17 nt, Human
caguugcaauaauacuu

SEQ ID NO: 3824626 - RNA, 12 nt, Human
caguugcacagc

SEQ ID NO: 3824627 - RNA, 18 nt, Human
caguugcacagcaucuca

SEQ ID NO: 3824628 - RNA, 21 nt, Human
caguugcacagcaucucagcu

SEQ ID NO: 3824629 - RNA, 22 nt, Human
caguugcacagcaucucagcuc

SEQ ID NO: 3824630 - RNA, 19 nt, Human
caguugcacuucuaagacu

SEQ ID NO: 3824631 - RNA, 14 nt, Human
caguugcagucacu

SEQ ID NO: 3824632 - RNA, 19 nt, Human
caguugcauguaguaacac

SEQ ID NO: 3824633 - RNA, 23 nt, Human
caguugccagucaccccggccac

SEQ ID NO: 3824634 - RNA, 17 nt, Human
caguugcccagccucuu

SEQ ID NO: 3824635 - RNA, 19 nt, Human
cacacacauacacacauau

SEQ ID NO: 3824636 - RNA, 13 nt, Human
cacacacaugcac

SEQ ID NO: 3824637 - RNA, 14 nt, Human
cacacacaugcaca

SEQ ID NO: 3824638 - RNA, 18 nt, Human
cacacacaugcuucccuu

SEQ ID NO: 3824639 - RNA, 14 nt, Human
cacacaccuagcca

SEQ ID NO: 3824640 - RNA, 15 nt, Human
cacacaccuguaguc

SEQ ID NO: 3824641 - RNA, 20 nt, Human
cacacaccuguagucccagc

SEQ ID NO: 3824642 - RNA, 17 nt, Human
cacacacgcacgcacac

SEQ ID NO: 3824643 - RNA, 20 nt, Human
cacacacgcgcgcgcacaca

SEQ ID NO: 3824644 - RNA, 14 nt, Human
cacacacugaugcu

SEQ ID NO: 3824645 - RNA, 22 nt, Human
cacacacugugcuuucuauugu

SEQ ID NO: 3824646 - RNA, 11 nt, Human
cacacagaaaa

SEQ ID NO: 3824647 - RNA, 12 nt, Human
cacacagaaaau

SEQ ID NO: 3824648 - RNA, 18 nt, Human
cacacagaaaauauacug

SEQ ID NO: 3824649 - RNA, 19 nt, Human
cacacagaaaauauacugu

SEQ ID NO: 3824650 - RNA, 22 nt, Human
cacacagaaaauauacuguaaa

SEQ ID NO: 3824651 - RNA, 23 nt, Human
cacacagaaaauauacuguaaag

SEQ ID NO: 3824652 - RNA, 12 nt, Human
cacacagaaaua

SEQ ID NO: 3824653 - RNA, 18 nt, Human
cacacagaaauauauaua

SEQ ID NO: 3824654 - RNA, 14 nt, Human
cacacagaccacca

SEQ ID NO: 3824655 - RNA, 22 nt, Human
cacacagaccccucgcaacugu

SEQ ID NO: 3824656 - RNA, 22 nt, Human
cacacagacuguugucccugca

SEQ ID NO: 3824657 - RNA, 18 nt, Human
cacacagaggaagagcag

SEQ ID NO: 3824658 - RNA, 22 nt, Human
cacacagaggaagagcaggcac

SEQ ID NO: 3824659 - RNA, 16 nt, Human
cacacagauacacaca

SEQ ID NO: 3824660 - RNA, 17 nt, Human
cacacagauacacacac

SEQ ID NO: 3824661 - RNA, 13 nt, Human
cacacagccacac

SEQ ID NO: 3824662 - RNA, 14 nt, Human
cacacagccacaca

SEQ ID NO: 3824663 - RNA, 23 nt, Human
cauucguuguguuuuuuaagaua

SEQ ID NO: 3824664 - RNA, 19 nt, Human
cauucuaaugauggcccau

SEQ ID NO: 3824665 - RNA, 22 nt, Human
cauucuaaugauggcccauucu

SEQ ID NO: 3824666 - RNA, 19 nt, Human
cauucuacacagagcagga

SEQ ID NO: 3824667 - RNA, 22 nt, Human
cauucuacacagagcaggacug

SEQ ID NO: 3824668 - RNA, 15 nt, Human
cauucuacugaaaag

SEQ ID NO: 3824669 - RNA, 21 nt, Human
cauucuagaugcaagucucuu

SEQ ID NO: 3824670 - RNA, 18 nt, Human
cauucuaucaagcccagg

SEQ ID NO: 3824671 - RNA, 23 nt, Human
cauucuaucaagcccaggugcca

SEQ ID NO: 3824672 - RNA, 18 nt, Human
cauucuauugccuucuuu

SEQ ID NO: 3824673 - RNA, 20 nt, Human
cauucuauugccuucuuuga

SEQ ID NO: 3824674 - RNA, 21 nt, Human
cauucuauugccuucuuugaa

SEQ ID NO: 3824675 - RNA, 16 nt, Human
cauucucaagcccugc

SEQ ID NO: 3824676 - RNA, 17 nt, Human
cauucucaagcccugca

SEQ ID NO: 3824677 - RNA, 20 nt, Human
cauucucacaggucccaaau

SEQ ID NO: 3824678 - RNA, 14 nt, Human
cauucucaggcacc

SEQ ID NO: 3824679 - RNA, 15 nt, Human
cauucucaggcacca

SEQ ID NO: 3824680 - RNA, 20 nt, Human
cauucucaguuuuucuuaau

SEQ ID NO: 3824681 - RNA, 17 nt, Human
cauucucauaauuccua

SEQ ID NO: 3824682 - RNA, 14 nt, Human
cauucucaucugca

SEQ ID NO: 3824683 - RNA, 21 nt, Human
cauucucaucugcacccuucu

SEQ ID NO: 3824684 - RNA, 15 nt, Human
cauucucauggagaa

SEQ ID NO: 3824685 - RNA, 16 nt, Human
cauucucauggagaag

SEQ ID NO: 3824686 - RNA, 13 nt, Human
cauucucauugca

SEQ ID NO: 3824687 - RNA, 19 nt, Human
cauucucauugcagaauaa

SEQ ID NO: 3824688 - RNA, 19 nt, Human
cauucuccaccugccaggg

SEQ ID NO: 3824689 - RNA, 22 nt, Human
cauucuccagggguuuacagug

SEQ ID NO: 3824690 - RNA, 12 nt, Human
cauucuccauuu

SEQ ID NO: 3824691 - RNA, 21 nt, Human
cauucucccagguaccagcug

SEQ ID NO: 3824692 - RNA, 12 nt, Human
cauucuccccag

SEQ ID NO: 3824693 - RNA, 15 nt, Human
cauucuccccagugu

SEQ ID NO: 3824694 - RNA, 15 nt, Human
cauucuccugccugu

SEQ ID NO: 3824695 - RNA, 20 nt, Human
cauucucuaauauccacuug

SEQ ID NO: 3824696 - RNA, 12 nt, Human
cauucucucucc

SEQ ID NO: 3824697 - RNA, 12 nt, Human
cauucucugaag

SEQ ID NO: 3824698 - RNA, 19 nt, Human
cauucucugucucauccau

SEQ ID NO: 3824699 - RNA, 13 nt, Human
cauucucuuuuaa

SEQ ID NO: 3824700 - RNA, 14 nt, Human
cauucucuuuuaau

SEQ ID NO: 3824701 - RNA, 12 nt, Human
cauucugaauua

SEQ ID NO: 3824702 - RNA, 21 nt, Human
cauucugaauuaauuaauuug

SEQ ID NO: 3824703 - RNA, 16 nt, Human
cauucugacucgguuu

SEQ ID NO: 3824704 - RNA, 19 nt, Human
cauucugacucgguuucuc

SEQ ID NO: 3824705 - RNA, 15 nt, Human
cauucugagaccaaa

SEQ ID NO: 3824706 - RNA, 16 nt, Human
cauucugcccuguggg

SEQ ID NO: 3824707 - RNA, 18 nt, Human
cauucugcccugugggac

SEQ ID NO: 3824708 - RNA, 20 nt, Human
cauucugcccugugggaccc

SEQ ID NO: 3824709 - RNA, 18 nt, Human
cauucugccgcccccucc

SEQ ID NO: 3824710 - RNA, 18 nt, Human
cauucugccucucuagga

SEQ ID NO: 3824711 - RNA, 16 nt, Human
cauucugccugcccag

SEQ ID NO: 3824712 - RNA, 19 nt, Human
cauucugccugcccaggcc

SEQ ID NO: 3824713 - RNA, 20 nt, Human
cauucugccugcccaggccc

SEQ ID NO: 3824714 - RNA, 14 nt, Human
cauucugcuccuuc

SEQ ID NO: 3824715 - RNA, 17 nt, Human
cauucuggcaguuuuga

SEQ ID NO: 3824716 - RNA, 19 nt, Human
cauucuggcaguuuugaca

SEQ ID NO: 3824717 - RNA, 20 nt, Human
cauucuggcaguuuugacau

SEQ ID NO: 3824718 - RNA, 20 nt, Human
cauucuggggaaacaacauu

SEQ ID NO: 3824719 - RNA, 21 nt, Human
cauucuggucaagggcuguca

SEQ ID NO: 3824720 - RNA, 18 nt, Human
cauucuggucucgucuuc

SEQ ID NO: 3824721 - RNA, 16 nt, Human
cauucuggucucucua

SEQ ID NO: 3824722 - RNA, 11 nt, Human
cauucuguccu

SEQ ID NO: 3824723 - RNA, 15 nt, Human
cauucugucuugaag

SEQ ID NO: 3824724 - RNA, 19 nt, Human
cauucuuacuaaaaaguau

SEQ ID NO: 3824725 - RNA, 21 nt, Human
cauucuuacuuacuaaaauau

SEQ ID NO: 3824726 - RNA, 22 nt, Human
cauucuuacuuacuaaaauaua

SEQ ID NO: 3824727 - RNA, 21 nt, Human
cauucuuagccuguggcagua

SEQ ID NO: 3824728 - RNA, 17 nt, Human
cauucuuagcucuuaau

SEQ ID NO: 3824729 - RNA, 12 nt, Human
cauucuucaaga

SEQ ID NO: 3824730 - RNA, 14 nt, Human
cauucuucccuuau

SEQ ID NO: 3824731 - RNA, 13 nt, Human
cauucuuccuagu

SEQ ID NO: 3824732 - RNA, 21 nt, Human
cauucuuccuaguuuucuccu

SEQ ID NO: 3824733 - RNA, 18 nt, Human
cauucuucucuguugucg

SEQ ID NO: 3824734 - RNA, 19 nt, Human
cauucuucugagcacuguu

SEQ ID NO: 3824735 - RNA, 17 nt, Human
cauucuugaaagcugug

SEQ ID NO: 3824736 - RNA, 12 nt, Human
cauucuuggcuu

SEQ ID NO: 3824737 - RNA, 21 nt, Human
cauucuugguuggcuggccuu

SEQ ID NO: 3824738 - RNA, 22 nt, Human
cauucuuguaaggcuuugauua

SEQ ID NO: 3824739 - RNA, 13 nt, Human
cauucuuucccag

SEQ ID NO: 3824740 - RNA, 13 nt, Human
cauucuuugcagg

SEQ ID NO: 3824741 - RNA, 19 nt, Human
cauucuuuuugcucuaaaa

SEQ ID NO: 3824742 - RNA, 23 nt, Human
cauucuuuuugcucuaaaauauu

SEQ ID NO: 3824743 - RNA, 15 nt, Human
cauugaaaagagcug

SEQ ID NO: 3824744 - RNA, 17 nt, Human
cauugaaaauaggagag

SEQ ID NO: 3824745 - RNA, 22 nt, Human
cauugaaaauguaaguaaaugu

SEQ ID NO: 3824746 - RNA, 22 nt, Human
cauugaaaauuauuaaucagaa

SEQ ID NO: 3824747 - RNA, 22 nt, Human
cauugaaagagaaccaguuuca

SEQ ID NO: 3824748 - RNA, 19 nt, Human
cauugaaaucuuuuugcuu

SEQ ID NO: 3824749 - RNA, 21 nt, Human
cauugaaaugagcaccuccau

SEQ ID NO: 3824750 - RNA, 14 nt, Human
cauugaaaugucac

SEQ ID NO: 3824751 - RNA, 14 nt, Human
cauugaacacaaac

SEQ ID NO: 3824752 - RNA, 15 nt, Human
cauugaacacaaacu

SEQ ID NO: 3824753 - RNA, 16 nt, Human
cauugaacacaaacug

SEQ ID NO: 3824754 - RNA, 22 nt, Human
cauugaacacaaacuguaaaua

SEQ ID NO: 3824755 - RNA, 17 nt, Human
cauugaagccgacucug

SEQ ID NO: 3824756 - RNA, 21 nt, Human
cauugaagccgacucuggccc

SEQ ID NO: 3824757 - RNA, 23 nt, Human
cauugaagccgacucuggcccug

SEQ ID NO: 3824758 - RNA, 14 nt, Human
cauugaaggcuuaa

SEQ ID NO: 3824759 - RNA, 15 nt, Human
cauugaaucuguaug

SEQ ID NO: 3824760 - RNA, 18 nt, Human
cauugacaaaucugugua

SEQ ID NO: 3824761 - RNA, 14 nt, Human
cauugacauguaca

SEQ ID NO: 3824762 - RNA, 21 nt, Human
cauugacauguacagagaacu

SEQ ID NO: 3824763 - RNA, 22 nt, Human
cauugacauguacagagaacua

SEQ ID NO: 3824764 - RNA, 17 nt, Human
cauugaccaagaacugc

SEQ ID NO: 3824765 - RNA, 18 nt, Human
cauugaccaagaacugca

SEQ ID NO: 3824766 - RNA, 20 nt, Human
cauugaccaagaacugcaug

SEQ ID NO: 3824767 - RNA, 21 nt, Human
cauugaccgcgacuaauuuca

SEQ ID NO: 3824768 - RNA, 21 nt, Human
cauugaccuauuuccagaaau

SEQ ID NO: 3824769 - RNA, 13 nt, Human
cauugaccugagg

SEQ ID NO: 3824770 - RNA, 14 nt, Human
cauugaccugaggc

SEQ ID NO: 3824771 - RNA, 22 nt, Human
cauugaccugaggcccuucucu

SEQ ID NO: 3824772 - RNA, 19 nt, Human
cauugacgauuccuucucu

SEQ ID NO: 3824773 - RNA, 22 nt, Human
cauugacuauuuuuguuuuuau

SEQ ID NO: 3824774 - RNA, 16 nt, Human
cauugacuuuccccac

SEQ ID NO: 3824775 - RNA, 21 nt, Human
cauugacuuuccccaccagau

SEQ ID NO: 3824776 - RNA, 18 nt, Human
cauugagaacugcauaug

SEQ ID NO: 3824777 - RNA, 19 nt, Human
cauugagaacugcauaugu

SEQ ID NO: 3824778 - RNA, 21 nt, Human
cauugagcugauauaaauucu

SEQ ID NO: 3824779 - RNA, 23 nt, Human
cauccauuucaucuauuucugag

SEQ ID NO: 3824780 - RNA, 18 nt, Human
caucccaaccaggcaccu

SEQ ID NO: 3824781 - RNA, 20 nt, Human
caucccaaccaggcaccucu

SEQ ID NO: 3824782 - RNA, 19 nt, Human
caucccacgcacuccauga

SEQ ID NO: 3824783 - RNA, 20 nt, Human
caucccagcaccugccuccu

SEQ ID NO: 3824784 - RNA, 13 nt, Human
caucccagcccaa

SEQ ID NO: 3824785 - RNA, 17 nt, Human
caucccagccccaauga

SEQ ID NO: 3824786 - RNA, 20 nt, Human
caucccagccccaauuuucu

SEQ ID NO: 3824787 - RNA, 20 nt, Human
caucccaggaugcugggugg

SEQ ID NO: 3824788 - RNA, 12 nt, Human
caucccaucauc

SEQ ID NO: 3824789 - RNA, 15 nt, Human
caucccaucccaucc

SEQ ID NO: 3824790 - RNA, 18 nt, Human
caucccaucccaucccgc

SEQ ID NO: 3824791 - RNA, 19 nt, Human
caucccaucuaagcugcag

SEQ ID NO: 3824792 - RNA, 17 nt, Human
caucccaugaacacacu

SEQ ID NO: 3824793 - RNA, 18 nt, Human
caucccaugagacccugg

SEQ ID NO: 3824794 - RNA, 17 nt, Human
caucccauguaacagaa

SEQ ID NO: 3824795 - RNA, 13 nt, Human
caucccauuccag

SEQ ID NO: 3824796 - RNA, 22 nt, Human
caucccauuccaggcagccucu

SEQ ID NO: 3824797 - RNA, 15 nt, Human
caucccauugcccug

SEQ ID NO: 3824798 - RNA, 16 nt, Human
cauccccacccuugga

SEQ ID NO: 3824799 - RNA, 14 nt, Human
cauccccacucacg

SEQ ID NO: 3824800 - RNA, 21 nt, Human
cauccccaggggucccagcca

SEQ ID NO: 3824801 - RNA, 13 nt, Human
cauccccccucac

SEQ ID NO: 3824802 - RNA, 13 nt, Human
caucccccugccc

SEQ ID NO: 3824803 - RNA, 19 nt, Human
caucccccugcccucgugg

SEQ ID NO: 3824804 - RNA, 19 nt, Human
cauccccuggacugggagg

SEQ ID NO: 3824805 - RNA, 22 nt, Human
cauccccuuacccuuagaaucc

SEQ ID NO: 3824806 - RNA, 19 nt, Human
cauccccuugaacucuuca

SEQ ID NO: 3824807 - RNA, 23 nt, Human
caucccgacauggacccggagcu

SEQ ID NO: 3824808 - RNA, 17 nt, Human
caucccgagcaccucca

SEQ ID NO: 3824809 - RNA, 18 nt, Human
caucccggaggaaaucug

SEQ ID NO: 3824810 - RNA, 19 nt, Human
caucccggaggaaaucugc

SEQ ID NO: 3824811 - RNA, 12 nt, Human
caucccuacccc

SEQ ID NO: 3824812 - RNA, 22 nt, Human
caucccuacccccuaagagcca

SEQ ID NO: 3824813 - RNA, 20 nt, Human
caucccucacccauccuaga

SEQ ID NO: 3824814 - RNA, 13 nt, Human
caucccuccccag

SEQ ID NO: 3824815 - RNA, 14 nt, Human
caucccuccccagu

SEQ ID NO: 3824816 - RNA, 20 nt, Human
caucccucccuccaccuccc

SEQ ID NO: 3824817 - RNA, 16 nt, Human
cacacagccacacaca

SEQ ID NO: 3824818 - RNA, 17 nt, Human
cacacagccacacacac

SEQ ID NO: 3824819 - RNA, 21 nt, Human
cacacagccacacacacagaa

SEQ ID NO: 3824820 - RNA, 21 nt, Human
cacacagccaggugccuugga

SEQ ID NO: 3824821 - RNA, 16 nt, Human
cacacagcucuguccu

SEQ ID NO: 3824822 - RNA, 18 nt, Human
cacacagcugggcugugg

SEQ ID NO: 3824823 - RNA, 19 nt, Human
cacacaggacccccuuccc

SEQ ID NO: 3824824 - RNA, 20 nt, Human
cacacaggacccccuucccc

SEQ ID NO: 3824825 - RNA, 10 nt, Human
cacacaggca

SEQ ID NO: 3824826 - RNA, 13 nt, Human
cacacaggcaacu

SEQ ID NO: 3824827 - RNA, 16 nt, Human
cacacaggcaacugag

SEQ ID NO: 3824828 - RNA, 12 nt, Human
cacacagggcag

SEQ ID NO: 3824829 - RNA, 14 nt, Human
cacacagguguuga

SEQ ID NO: 3824830 - RNA, 21 nt, Human
cacacaguauuaagugacagu

SEQ ID NO: 3824831 - RNA, 13 nt, Human
cacacaguauuuu

SEQ ID NO: 3824832 - RNA, 14 nt, Human
cacacaguauuuuu

SEQ ID NO: 3824833 - RNA, 21 nt, Human
cacacagugagucgaggacag

SEQ ID NO: 3824834 - RNA, 14 nt, Human
cacacauacacaca

SEQ ID NO: 3824835 - RNA, 23 nt, Human
cacacauagauuaauggcacuga

SEQ ID NO: 3824836 - RNA, 21 nt, Human
cacacauauaaacaucacaca

SEQ ID NO: 3824837 - RNA, 13 nt, Human
cacacaucaggag

SEQ ID NO: 3824838 - RNA, 22 nt, Human
cacacaucaucuguaagcuguu

SEQ ID NO: 3824839 - RNA, 14 nt, Human
cacacauccacccc

SEQ ID NO: 3824840 - RNA, 20 nt, Human
cacacaugagcaucaggcca

SEQ ID NO: 3824841 - RNA, 21 nt, Human
cacacaugagcaucaggccag

SEQ ID NO: 3824842 - RNA, 15 nt, Human
cacacaugcaaggga

SEQ ID NO: 3824843 - RNA, 14 nt, Human
cacacaugcacaca

SEQ ID NO: 3824844 - RNA, 16 nt, Human
cacacaugcauacaca

SEQ ID NO: 3824845 - RNA, 16 nt, Human
cacacauuucacuguc

SEQ ID NO: 3824846 - RNA, 19 nt, Human
cacacauuucacugucugu

SEQ ID NO: 3824847 - RNA, 20 nt, Human
cacaccaagcugugccaccc

SEQ ID NO: 3824848 - RNA, 13 nt, Human
cacaccagagaac

SEQ ID NO: 3824849 - RNA, 12 nt, Human
cacaccagagcc

SEQ ID NO: 3824850 - RNA, 13 nt, Human
cacaccagagccc

SEQ ID NO: 3824851 - RNA, 21 nt, Human
cacaccagagcccaccuuggc

SEQ ID NO: 3824852 - RNA, 13 nt, Human
cacaccaggcugu

SEQ ID NO: 3824853 - RNA, 14 nt, Human
cacaccaggcugug

SEQ ID NO: 3824854 - RNA, 19 nt, Human
cacaccagggccagccucu

SEQ ID NO: 3824855 - RNA, 21 nt, Human
cacaccauaagcuacugccau

SEQ ID NO: 3824856 - RNA, 21 nt, Human
cacacccaccguccgcccugc

SEQ ID NO: 3824857 - RNA, 22 nt, Human
cacacccaccguccgcccugcu

SEQ ID NO: 3824858 - RNA, 16 nt, Human
cacacccacucagcuc

SEQ ID NO: 3824859 - RNA, 12 nt, Human
cacacccagccu

SEQ ID NO: 3824860 - RNA, 15 nt, Human
cacacccagccucag

SEQ ID NO: 3824861 - RNA, 18 nt, Human
cacacccagccucagucc

SEQ ID NO: 3824862 - RNA, 12 nt, Human
cacaccccaccu

SEQ ID NO: 3824863 - RNA, 12 nt, Human
cacaccccacuc

SEQ ID NO: 3824864 - RNA, 17 nt, Human
cacaccccacucccaca

SEQ ID NO: 3824865 - RNA, 18 nt, Human
cacacccucacucugcca

SEQ ID NO: 3824866 - RNA, 20 nt, Human
cacacccucacucugccagg

SEQ ID NO: 3824867 - RNA, 21 nt, Human
cacacccucccccgccacucc

SEQ ID NO: 3824868 - RNA, 21 nt, Human
cacacccugaggucagggagu

SEQ ID NO: 3824869 - RNA, 12 nt, Human
cacacccugcaa

SEQ ID NO: 3824870 - RNA, 16 nt, Human
cacacccugcaaggcc

SEQ ID NO: 3824871 - RNA, 21 nt, Human
cacacccuguacuguucugug

SEQ ID NO: 3824872 - RNA, 14 nt, Human
cacaccucacucuu

SEQ ID NO: 3824873 - RNA, 13 nt, Human
cacaccucaguuc

SEQ ID NO: 3824874 - RNA, 10 nt, Human
cacaccuccu

SEQ ID NO: 3824875 - RNA, 19 nt, Human
cacaccuccucccacugcc

SEQ ID NO: 3824876 - RNA, 12 nt, Human
cacaccucugcc

SEQ ID NO: 3824877 - RNA, 13 nt, Human
cacaccucugcca

SEQ ID NO: 3824878 - RNA, 17 nt, Human
cacaccuguaaucccag

SEQ ID NO: 3824879 - RNA, 20 nt, Human
cacaccuguaaucccagcac

SEQ ID NO: 3824880 - RNA, 16 nt, Human
cacaccuguaauucca

SEQ ID NO: 3824881 - RNA, 16 nt, Human
cacacgcacacacaca

SEQ ID NO: 3824882 - RNA, 21 nt, Human
cacacgcacauauacacacac

SEQ ID NO: 3824883 - RNA, 22 nt, Human
cacacgcuccucccucugaggc

SEQ ID NO: 3824884 - RNA, 16 nt, Human
cacacgcugcucugcc

SEQ ID NO: 3824885 - RNA, 17 nt, Human
cacacgcugcucugccc

SEQ ID NO: 3824886 - RNA, 22 nt, Human
cacacggacacucaaaagcugg

SEQ ID NO: 3824887 - RNA, 19 nt, Human
cacacgguuugaagccugg

SEQ ID NO: 3824888 - RNA, 24 nt, Human
cacacgucugacccucuccacccc

SEQ ID NO: 3824889 - RNA, 19 nt, Human
cacacuaaccaagcugagu

SEQ ID NO: 3824890 - RNA, 19 nt, Human
cacacuacaccacacacaa

SEQ ID NO: 3824891 - RNA, 20 nt, Human
cacacuacaccacacacaac

SEQ ID NO: 3824892 - RNA, 19 nt, Human
cacacuaucauaguuaaca

SEQ ID NO: 3824893 - RNA, 18 nt, Human
cacacucacuccugagac

SEQ ID NO: 3824894 - RNA, 20 nt, Human
cacacucagauccuccucau

SEQ ID NO: 3824895 - RNA, 14 nt, Human
cacacuccaucagc

SEQ ID NO: 3824896 - RNA, 17 nt, Human
cacacuccaucagcuua

SEQ ID NO: 3824897 - RNA, 22 nt, Human
cacacucuccaucacccucuuc

SEQ ID NO: 3824898 - RNA, 17 nt, Human
cacacugcaacaggaac

SEQ ID NO: 3824899 - RNA, 19 nt, Human
cacacugcaagagccuugg

SEQ ID NO: 3824900 - RNA, 13 nt, Human
cacacuggacucc

SEQ ID NO: 3824901 - RNA, 12 nt, Human
cacacuggcuca

SEQ ID NO: 3824902 - RNA, 15 nt, Human
cacacuggcucaccc

SEQ ID NO: 3824903 - RNA, 16 nt, Human
cacacuggcucaccca

SEQ ID NO: 3824904 - RNA, 19 nt, Human
cacacugggacuugcaaaa

SEQ ID NO: 3824905 - RNA, 22 nt, Human
cacacugggugguggccugguc

SEQ ID NO: 3824906 - RNA, 19 nt, Human
cacacugguacuuagaguu

SEQ ID NO: 3824907 - RNA, 22 nt, Human
cacacugguacuuagaguuucu

SEQ ID NO: 3824908 - RNA, 15 nt, Human
cacacugguucucaa

SEQ ID NO: 3824909 - RNA, 18 nt, Human
cacacugucaugcuucau

SEQ ID NO: 3824910 - RNA, 20 nt, Human
cacacugucaugcuucauca

SEQ ID NO: 3824911 - RNA, 21 nt, Human
cacacugucaugcuucaucau

SEQ ID NO: 3824912 - RNA, 22 nt, Human
cacacugucaugcuucaucauu

SEQ ID NO: 3824913 - RNA, 17 nt, Human
cacacugugacacacua

SEQ ID NO: 3824914 - RNA, 19 nt, Human
cacacugugacacacuaca

SEQ ID NO: 3824915 - RNA, 12 nt, Human
cacacuuagcug

SEQ ID NO: 3824916 - RNA, 17 nt, Human
cacacuucaggcucuuc

SEQ ID NO: 3824917 - RNA, 18 nt, Human
cacacuucaggcucuucu

SEQ ID NO: 3824918 - RNA, 18 nt, Human
cacacuuccaccagccug

SEQ ID NO: 3824919 - RNA, 19 nt, Human
cacacuuccaccagccugc

SEQ ID NO: 3824920 - RNA, 14 nt, Human
cacacuuccagaca

SEQ ID NO: 3824921 - RNA, 12 nt, Human
cacacuucccug

SEQ ID NO: 3824922 - RNA, 14 nt, Human
cacacuucccuggc

SEQ ID NO: 3824923 - RNA, 13 nt, Human
cacacuuccuguc

SEQ ID NO: 3824924 - RNA, 15 nt, Human
ccaacccuucccuga

SEQ ID NO: 3824925 - RNA, 11 nt, Human
ccaacccuucu

SEQ ID NO: 3824926 - RNA, 13 nt, Human
ccaacccuucucc

SEQ ID NO: 3824927 - RNA, 16 nt, Human
ccaaccgacaggcccu

SEQ ID NO: 3824928 - RNA, 22 nt, Human
ccaaccucagggcucccagggg

SEQ ID NO: 3824929 - RNA, 17 nt, Human
ccaaccucuuccuccug

SEQ ID NO: 3824930 - RNA, 12 nt, Human
ccaaccugacca

SEQ ID NO: 3824931 - RNA, 22 nt, Human
ccaaccugaccaacauggagaa

SEQ ID NO: 3824932 - RNA, 18 nt, Human
ccaaccugcaaagaucug

SEQ ID NO: 3824933 - RNA, 19 nt, Human
ccaaccugcaaagaucugu

SEQ ID NO: 3824934 - RNA, 15 nt, Human
ccaaccugcucuccu

SEQ ID NO: 3824935 - RNA, 16 nt, Human
ccaaccugcucuccuc

SEQ ID NO: 3824936 - RNA, 20 nt, Human
ccaaccugcucuccucuucu

SEQ ID NO: 3824937 - RNA, 12 nt, Human
ccaaccugcuga

SEQ ID NO: 3824938 - RNA, 14 nt, Human
ccaaccuggacaac

SEQ ID NO: 3824939 - RNA, 17 nt, Human
ccaaccuggggagccag

SEQ ID NO: 3824940 - RNA, 16 nt, Human
ccaaccuguaauaaau

SEQ ID NO: 3824941 - RNA, 18 nt, Human
ccaaccuguaauaaauau

SEQ ID NO: 3824942 - RNA, 20 nt, Human
ccaaccuguaauaaauauga

SEQ ID NO: 3824943 - RNA, 19 nt, Human
ccaaccuuacuuacagcau

SEQ ID NO: 3824944 - RNA, 12 nt, Human
ccaaccuuccca

SEQ ID NO: 3824945 - RNA, 18 nt, Human
ccaaccuuucccucaccc

SEQ ID NO: 3824946 - RNA, 20 nt, Human
ccaaccuuucccucaccccc

SEQ ID NO: 3824947 - RNA, 14 nt, Human
ccaacgaaaagcac

SEQ ID NO: 3824948 - RNA, 15 nt, Human
ccaacgcacaggaaa

SEQ ID NO: 3824949 - RNA, 15 nt, Human
ccaacgcuccaaagu

SEQ ID NO: 3824950 - RNA, 16 nt, Human
ccaacguggggcagca

SEQ ID NO: 3824951 - RNA, 21 nt, Human
ccaacguuuggaagauccugu

SEQ ID NO: 3824952 - RNA, 22 nt, Human
ccaacuacaaccaagcucucug

SEQ ID NO: 3824953 - RNA, 22 nt, Human
ccaacuacuguguuaugcaaaa

SEQ ID NO: 3824954 - RNA, 14 nt, Human
ccaacuaugauuau

SEQ ID NO: 3824955 - RNA, 14 nt, Human
ccaacuauggccug

SEQ ID NO: 3824956 - RNA, 18 nt, Human
ccaacucaccccagcccc

SEQ ID NO: 3824957 - RNA, 18 nt, Human
ccaacuccaacauccacu

SEQ ID NO: 3824958 - RNA, 13 nt, Human
ccaacuccagcaa

SEQ ID NO: 3824959 - RNA, 14 nt, Human
ccaacuccagcaac

SEQ ID NO: 3824960 - RNA, 11 nt, Human
ccaacuccagu

SEQ ID NO: 3824961 - RNA, 21 nt, Human
ccaacuccaguacuggagcuu

SEQ ID NO: 3824962 - RNA, 19 nt, Human
ccaacuccuaguucuagaa

SEQ ID NO: 3824963 - RNA, 15 nt, Human
ccaacuccuuccagc

SEQ ID NO: 3824964 - RNA, 19 nt, Human
ccaacucgggcucccgggu

SEQ ID NO: 3824965 - RNA, 22 nt, Human
ccaacucugagcccauguucug

SEQ ID NO: 3824966 - RNA, 14 nt, Human
ccaacugcugcccc

SEQ ID NO: 3824967 - RNA, 15 nt, Human
ccaacugcugcccca

SEQ ID NO: 3824968 - RNA, 13 nt, Human
ccaacugcugcuu

SEQ ID NO: 3824969 - RNA, 17 nt, Human
ccaacuggaagcacaga

SEQ ID NO: 3824970 - RNA, 17 nt, Human
ccaacugggcccaagac

SEQ ID NO: 3824971 - RNA, 13 nt, Human
ccaacugugagca

SEQ ID NO: 3824972 - RNA, 14 nt, Human
ccaacuguggcugg

SEQ ID NO: 3824973 - RNA, 16 nt, Human
ccaacuguggcugguc

SEQ ID NO: 3824974 - RNA, 15 nt, Human
ccaacuguguagcau

SEQ ID NO: 3824975 - RNA, 18 nt, Human
ccaacuguguucauuaga

SEQ ID NO: 3824976 - RNA, 23 nt, Human
ccaacuguucagcuguccucccu

SEQ ID NO: 3824977 - RNA, 21 nt, Human
ccaacuucauuugaugcuaaa

SEQ ID NO: 3824978 - RNA, 19 nt, Human
ccaacuucucuugcuuucu

SEQ ID NO: 3824979 - RNA, 19 nt, Human
ccaacuucuucagagcuga

SEQ ID NO: 3824980 - RNA, 10 nt, Human
ccaacuugag

SEQ ID NO: 3824981 - RNA, 21 nt, Human
ccaacuugagggcccagagca

SEQ ID NO: 3824982 - RNA, 17 nt, Human
ccaacuuggcugcagga

SEQ ID NO: 3824983 - RNA, 13 nt, Human
ccaacuuggcuuu

SEQ ID NO: 3824984 - RNA, 21 nt, Human
ccaacuugguucugcuucaau

SEQ ID NO: 3824985 - RNA, 19 nt, Human
ccaacuuucaagaacuugu

SEQ ID NO: 3824986 - RNA, 13 nt, Human
ccaacuuucugua

SEQ ID NO: 3824987 - RNA, 18 nt, Human
ccaagaaacugagaccaa

SEQ ID NO: 3824988 - RNA, 13 nt, Human
ccaagaaagcagg

SEQ ID NO: 3824989 - RNA, 21 nt, Human
ccaagaaagcucacuguagcu

SEQ ID NO: 3824990 - RNA, 18 nt, Human
ccaagaacagcaggccca

SEQ ID NO: 3824991 - RNA, 18 nt, Human
ccaagaacugaaaacaua

SEQ ID NO: 3824992 - RNA, 15 nt, Human
ccaagaacugcaugg

SEQ ID NO: 3824993 - RNA, 12 nt, Human
ccaagaagggcu

SEQ ID NO: 3824994 - RNA, 19 nt, Human
ccaagaauagaugcugacu

SEQ ID NO: 3824995 - RNA, 22 nt, Human
ccaagaauagcaucuguacaaa

SEQ ID NO: 3824996 - RNA, 15 nt, Human
ccaagaauauugcaa

SEQ ID NO: 3824997 - RNA, 21 nt, Human
ccaagaauauugcaaaauaca

SEQ ID NO: 3824998 - RNA, 19 nt, Human
ccaagaauccacauuucua

SEQ ID NO: 3824999 - RNA, 11 nt, Human
ccaagaaucuu

SEQ ID NO: 3825000 - RNA, 12 nt, Human
ccaagaaugcaa

SEQ ID NO: 3825001 - RNA, 14 nt, Human
ccaagaaugcugaa

SEQ ID NO: 3825002 - RNA, 15 nt, Human
ccaagaaugcugaaa

SEQ ID NO: 3825003 - RNA, 13 nt, Human
ccaagacaaauca

SEQ ID NO: 3825004 - RNA, 18 nt, Human
ccaagacaaaucaacaga

SEQ ID NO: 3825005 - RNA, 18 nt, Human
ccaagacagaugccccag

SEQ ID NO: 3825006 - RNA, 19 nt, Human
ccaagacagaugccccaga

SEQ ID NO: 3825007 - RNA, 23 nt, Human
ccaagacaugucuguucuacaua

SEQ ID NO: 3825008 - RNA, 16 nt, Human
ccaagacuccagcccu

SEQ ID NO: 3825009 - RNA, 15 nt, Human
ccaagacucccauga

SEQ ID NO: 3825010 - RNA, 19 nt, Human
ccaagacucccaugaggga

SEQ ID NO: 3825011 - RNA, 15 nt, Human
ccaagacucuagagu

SEQ ID NO: 3825012 - RNA, 23 nt, Human
ccaagacugcuguggccaggagg

SEQ ID NO: 3825013 - RNA, 21 nt, Human
ccaagacuugguguccuuucc

SEQ ID NO: 3825014 - RNA, 23 nt, Human
ccaagagaaaggccugcacacaa

SEQ ID NO: 3825015 - RNA, 20 nt, Human
ccaagagaaggggaagcacu

SEQ ID NO: 3825016 - RNA, 20 nt, Human
ccaagagacaugcugacuuu

SEQ ID NO: 3825017 - RNA, 14 nt, Human
ccaagagagaaaga

SEQ ID NO: 3825018 - RNA, 15 nt, Human
ccaagagagaaagaa

SEQ ID NO: 3825019 - RNA, 20 nt, Human
ccaagagagggccaugcaau

SEQ ID NO: 3825020 - RNA, 21 nt, Human
ccaagagauugcuaauugcug

SEQ ID NO: 3825021 - RNA, 20 nt, Human
ccaagagcaaggaagguaaa

SEQ ID NO: 3825022 - RNA, 16 nt, Human
ccaagagcaucaugcc

SEQ ID NO: 3825023 - RNA, 21 nt, Human
ccaagagcaucaugccucuga

SEQ ID NO: 3825024 - RNA, 21 nt, Human
caugccucccccuagccauuu

SEQ ID NO: 3825025 - RNA, 15 nt, Human
caugccucucucagg

SEQ ID NO: 3825026 - RNA, 17 nt, Human
caugccucucucaggcc

SEQ ID NO: 3825027 - RNA, 13 nt, Human
caugccucugagg

SEQ ID NO: 3825028 - RNA, 22 nt, Human
caugccucugauaugggacuga

SEQ ID NO: 3825029 - RNA, 23 nt, Human
caugccucugauaugggacugag

SEQ ID NO: 3825030 - RNA, 20 nt, Human
caugccugccccccucaucu

SEQ ID NO: 3825031 - RNA, 17 nt, Human
caugccugcuuuagaau

SEQ ID NO: 3825032 - RNA, 17 nt, Human
caugccuggacaaaccc

SEQ ID NO: 3825033 - RNA, 13 nt, Human
caugccuggaugg

SEQ ID NO: 3825034 - RNA, 23 nt, Human
caugccuggauggggcugcaccg

SEQ ID NO: 3825035 - RNA, 14 nt, Human
caugccuggcuucg

SEQ ID NO: 3825036 - RNA, 18 nt, Human
caugccuguccagccugg

SEQ ID NO: 3825037 - RNA, 13 nt, Human
caugccuguggcu

SEQ ID NO: 3825038 - RNA, 15 nt, Human
caugccuguggcugc

SEQ ID NO: 3825039 - RNA, 16 nt, Human
caugccuguggcugcg

SEQ ID NO: 3825040 - RNA, 19 nt, Human
caugccuguggcugcgcuu

SEQ ID NO: 3825041 - RNA, 16 nt, Human
caugccuuuguaaguu

SEQ ID NO: 3825042 - RNA, 22 nt, Human
caugcgacacugggaggccagu

SEQ ID NO: 3825043 - RNA, 21 nt, Human
caugcgcccccuccgcccugc

SEQ ID NO: 3825044 - RNA, 14 nt, Human
caugcgcucagggc

SEQ ID NO: 3825045 - RNA, 22 nt, Human
caugcgcucagggccaugcuga

SEQ ID NO: 3825046 - RNA, 16 nt, Human
caugcggcccagcccg

SEQ ID NO: 3825047 - RNA, 16 nt, Human
caugcggcccaggaug

SEQ ID NO: 3825048 - RNA, 21 nt, Human
caugcgggcugggcagcuguu

SEQ ID NO: 3825049 - RNA, 14 nt, Human
caugcgguagccag

SEQ ID NO: 3825050 - RNA, 17 nt, Human
caugcgguagccagcac

SEQ ID NO: 3825051 - RNA, 21 nt, Human
caugcgguagccagcacacag

SEQ ID NO: 3825052 - RNA, 17 nt, Human
caugcuaacaaagacaa

SEQ ID NO: 3825053 - RNA, 22 nt, Human
caugcuaauauaaguuucuuug

SEQ ID NO: 3825054 - RNA, 14 nt, Human
caugcuaggaugcg

SEQ ID NO: 3825055 - RNA, 19 nt, Human
caugcucaucugcuggucc

SEQ ID NO: 3825056 - RNA, 22 nt, Human
caugcuccagauuagagccugu

SEQ ID NO: 3825057 - RNA, 14 nt, Human
caugcuccucacug

SEQ ID NO: 3825058 - RNA, 15 nt, Human
caugcuccucacugc

SEQ ID NO: 3825059 - RNA, 19 nt, Human
caugcuccucacugcccgc

SEQ ID NO: 3825060 - RNA, 14 nt, Human
caugcuccucuucc

SEQ ID NO: 3825061 - RNA, 17 nt, Human
caugcuccucuucccca

SEQ ID NO: 3825062 - RNA, 18 nt, Human
caugcuccucuuccccag

SEQ ID NO: 3825063 - RNA, 13 nt, Human
caugcuccuggcc

SEQ ID NO: 3825064 - RNA, 16 nt, Human
caugcuccuggcccac

SEQ ID NO: 3825065 - RNA, 20 nt, Human
caugcuccuggcccacugca

SEQ ID NO: 3825066 - RNA, 19 nt, Human
caugcucucugcagccagc

SEQ ID NO: 3825067 - RNA, 20 nt, Human
caugcucucugcagccagcc

SEQ ID NO: 3825068 - RNA, 15 nt, Human
caugcugaagccaaa

SEQ ID NO: 3825069 - RNA, 16 nt, Human
caugggaaggugggcg

SEQ ID NO: 3825070 - RNA, 14 nt, Human
caugggaaugaaug

SEQ ID NO: 3825071 - RNA, 18 nt, Human
caugggaaugaaugucag

SEQ ID NO: 3825072 - RNA, 17 nt, Human
caugggaccacaacuau

SEQ ID NO: 3825073 - RNA, 15 nt, Human
caugggagcagucca

SEQ ID NO: 3825074 - RNA, 14 nt, Human
caugggagggggcu

SEQ ID NO: 3825075 - RNA, 21 nt, Human
caugggaggugaaaggggcac

SEQ ID NO: 3825076 - RNA, 22 nt, Human
caugggauacaaccucccucuu

SEQ ID NO: 3825077 - RNA, 19 nt, Human
caugggcacaaagggccca

SEQ ID NO: 3825078 - RNA, 21 nt, Human
caugggcacaaagggcccaga

SEQ ID NO: 3825079 - RNA, 14 nt, Human
caugggcacugcug

SEQ ID NO: 3825080 - RNA, 15 nt, Human
caugggcacugcugg

SEQ ID NO: 3825081 - RNA, 19 nt, Human
caugggcacugcugggugg

SEQ ID NO: 3825082 - RNA, 23 nt, Human
caugggcacugcuggguggccca

SEQ ID NO: 3825083 - RNA, 15 nt, Human
caugggcagagccca

SEQ ID NO: 3825084 - RNA, 14 nt, Human
caugggcaggagac

SEQ ID NO: 3825085 - RNA, 17 nt, Human
caugggccagccccucc

SEQ ID NO: 3825086 - RNA, 20 nt, Human
caugggcccaggccucacca

SEQ ID NO: 3825087 - RNA, 24 nt, Human
caugggccuggccaccucucuccu

SEQ ID NO: 3825088 - RNA, 12 nt, Human
caugggcuucac

SEQ ID NO: 3825089 - RNA, 20 nt, Human
caugggcuucacuguauaaa

SEQ ID NO: 3825090 - RNA, 20 nt, Human
cauggggagggauucugguu

SEQ ID NO: 3825091 - RNA, 19 nt, Human
cauggggcugauuguauuu

SEQ ID NO: 3825092 - RNA, 13 nt, Human
caugggggagggg

SEQ ID NO: 3825093 - RNA, 21 nt, Human
caugggggagggggcagaagu

SEQ ID NO: 3825094 - RNA, 21 nt, Human
cauggggggagcacccugagg

SEQ ID NO: 3825095 - RNA, 13 nt, Human
cauggggugggcc

SEQ ID NO: 3825096 - RNA, 22 nt, Human
caugggguuggcugggcccaga

SEQ ID NO: 3825097 - RNA, 22 nt, Human
cauggguagcuucugaccucag

SEQ ID NO: 3825098 - RNA, 15 nt, Human
caugggucgcccaug

SEQ ID NO: 3825099 - RNA, 15 nt, Human
cauggguuaugugua

SEQ ID NO: 3825100 - RNA, 16 nt, Human
cauggguuuuguaggu

SEQ ID NO: 3825101 - RNA, 13 nt, Human
caugguaauuuau

SEQ ID NO: 3825102 - RNA, 19 nt, Human
caugguacccccuucuggg

SEQ ID NO: 3825103 - RNA, 21 nt, Human
caugguacccccuucugggca

SEQ ID NO: 3825104 - RNA, 16 nt, Human
cauggucacacacuga

SEQ ID NO: 3825105 - RNA, 19 nt, Human
cauggucccacaucccugg

SEQ ID NO: 3825106 - RNA, 22 nt, Human
cauggucccacaucccugggcc

SEQ ID NO: 3825107 - RNA, 16 nt, Human
caugguccccaagacc

SEQ ID NO: 3825108 - RNA, 18 nt, Human
caugguccccauggcaug

SEQ ID NO: 3825109 - RNA, 14 nt, Human
cauggucccugccu

SEQ ID NO: 3825110 - RNA, 19 nt, Human
cauggucggaaaacaugcu

SEQ ID NO: 3825111 - RNA, 13 nt, Human
cauggucugcccu

SEQ ID NO: 3825112 - RNA, 11 nt, Human
cauggugaaaa

SEQ ID NO: 3825113 - RNA, 15 nt, Human
cauggugaaaagcuc

SEQ ID NO: 3825114 - RNA, 18 nt, Human
cauggugaaaauguacug

SEQ ID NO: 3825115 - RNA, 23 nt, Human
cauggugaagugcuuggaacaua

SEQ ID NO: 3825116 - RNA, 16 nt, Human
cauggugccccaggac

SEQ ID NO: 3825117 - RNA, 17 nt, Human
cauggugccccaggacc

SEQ ID NO: 3825118 - RNA, 18 nt, Human
cauggugccccaggacca

SEQ ID NO: 3825119 - RNA, 19 nt, Human
cauggugccccaggaccag

SEQ ID NO: 3825120 - RNA, 20 nt, Human
cauggugccccaggaccagc

SEQ ID NO: 3825121 - RNA, 15 nt, Human
cauggugccucugga

SEQ ID NO: 3825122 - RNA, 16 nt, Human
cauggugccucuggag

SEQ ID NO: 3825123 - RNA, 13 nt, Human
cauggugccugag

SEQ ID NO: 3825124 - RNA, 18 nt, Human
caugguggcaugcaccug

SEQ ID NO: 3825125 - RNA, 13 nt, Human
caugguggccaga

SEQ ID NO: 3825126 - RNA, 18 nt, Human
caugguggcgcaagccug

SEQ ID NO: 3825127 - RNA, 18 nt, Human
caugguggggucuccuca

SEQ ID NO: 3825128 - RNA, 19 nt, Human
cauggugguugggacccag

SEQ ID NO: 3825129 - RNA, 22 nt, Human
cauggugguugggacccagugg

SEQ ID NO: 3825130 - RNA, 19 nt, Human
caugguguaauaagacaua

SEQ ID NO: 3825131 - RNA, 12 nt, Human
cauggugucugg

SEQ ID NO: 3825132 - RNA, 23 nt, Human
cauggugugaaagucagaugccc

SEQ ID NO: 3825133 - RNA, 18 nt, Human
cauggugugaucgucuga

SEQ ID NO: 3825134 - RNA, 19 nt, Human
caugguuaagguaaaguaa

SEQ ID NO: 3825135 - RNA, 16 nt, Human
caugguugagaaauga

SEQ ID NO: 3825136 - RNA, 19 nt, Human
caugguuuaaaagaaaaaa

SEQ ID NO: 3825137 - RNA, 20 nt, Human
caugguuuaaaagaaaaaau

SEQ ID NO: 3825138 - RNA, 15 nt, Human
caugguuucagcacu

SEQ ID NO: 3825139 - RNA, 14 nt, Human
cauguaaaacaaaa

SEQ ID NO: 3825140 - RNA, 17 nt, Human
cauguaaaacagaaaaa

SEQ ID NO: 3825141 - RNA, 16 nt, Human
cauguaaaagagucau

SEQ ID NO: 3825142 - RNA, 22 nt, Human
cauguaaacacgccugcaaacg

SEQ ID NO: 3825143 - RNA, 16 nt, Human
cauguaaagaaauguc

SEQ ID NO: 3825144 - RNA, 21 nt, Human
cauguaaagcaguauuaaaau

SEQ ID NO: 3825145 - RNA, 14 nt, Human
cauguaaauaaaua

SEQ ID NO: 3825146 - RNA, 18 nt, Human
cauguaaauaccagacug

SEQ ID NO: 3825147 - RNA, 22 nt, Human
cauguaaauaccagacugcagg

SEQ ID NO: 3825148 - RNA, 18 nt, Human
cauguaaauguaaacuca

SEQ ID NO: 3825149 - RNA, 17 nt, Human
cauguaaauugacugua

SEQ ID NO: 3825150 - RNA, 13 nt, Human
cauguaacagaaa

SEQ ID NO: 3825151 - RNA, 17 nt, Human
cauguaaccggcauguu

SEQ ID NO: 3825152 - RNA, 16 nt, Human
cauguaacuauagacu

SEQ ID NO: 3825153 - RNA, 14 nt, Human
cauguaacugccua

SEQ ID NO: 3825154 - RNA, 23 nt, Human
cauguaauauaaagauguuaaaa

SEQ ID NO: 3825155 - RNA, 14 nt, Human
cauguaaucaguuu

SEQ ID NO: 3825156 - RNA, 19 nt, Human
cauguaauguuaauguuau

SEQ ID NO: 3825157 - RNA, 19 nt, Human
cauguaauuuuauuuuaaa

SEQ ID NO: 3825158 - RNA, 21 nt, Human
cauguacaaaaucgauuggcu

SEQ ID NO: 3825159 - RNA, 19 nt, Human
cauguacaguguucuguuu

SEQ ID NO: 3825160 - RNA, 22 nt, Human
cauguacaguguucuguuuaau

SEQ ID NO: 3825161 - RNA, 20 nt, Human
cauguacaugaagaagcuaa

SEQ ID NO: 3825162 - RNA, 14 nt, Human
cauguacauuugga

SEQ ID NO: 3825163 - RNA, 19 nt, Human
cauguaccauuugcauggc

SEQ ID NO: 3825164 - RNA, 13 nt, Human
cauguaccucccc

SEQ ID NO: 3825165 - RNA, 17 nt, Human
cauguaccuccccugcc

SEQ ID NO: 3825166 - RNA, 21 nt, Human
cauguaccuccccugccuugc

SEQ ID NO: 3825167 - RNA, 19 nt, Human
cauguacugagccuuguaa

SEQ ID NO: 3825168 - RNA, 22 nt, Human
cauguacugagccuuguaauuc

SEQ ID NO: 3825169 - RNA, 17 nt, Human
cauguacugcauuauuu

SEQ ID NO: 3825170 - RNA, 13 nt, Human
cauguacuguagu

SEQ ID NO: 3825171 - RNA, 14 nt, Human
cauguacuguaguu

SEQ ID NO: 3825172 - RNA, 21 nt, Human
cauguacuuguuugcaagcag

SEQ ID NO: 3825173 - RNA, 15 nt, Human
cauguagaagcugca

SEQ ID NO: 3825174 - RNA, 19 nt, Human
cauguagaagcugcaucuu

SEQ ID NO: 3825175 - RNA, 13 nt, Human
cauguagagaaaa

SEQ ID NO: 3825176 - RNA, 13 nt, Human
cauguagcccccu

SEQ ID NO: 3825177 - RNA, 18 nt, Human
cauguaggaaguaggaag

SEQ ID NO: 3825178 - RNA, 22 nt, Human
cauguaguaacacuaauauauu

SEQ ID NO: 3825179 - RNA, 17 nt, Human
cauguaguaucaaauau

SEQ ID NO: 3825180 - RNA, 18 nt, Human
cauguaguaucaaauauu

SEQ ID NO: 3825181 - RNA, 22 nt, Human
cauguaguaucaaauauuagau

SEQ ID NO: 3825182 - RNA, 23 nt, Human
ccaagagcaucaugccucugagg

SEQ ID NO: 3825183 - RNA, 22 nt, Human
ccaagagcugaggcaauucuaa

SEQ ID NO: 3825184 - RNA, 21 nt, Human
ccaagaggaaguucagaucuu

SEQ ID NO: 3825185 - RNA, 23 nt, Human
ccaagaggcugguuuuggcaucu

SEQ ID NO: 3825186 - RNA, 21 nt, Human
ccaagaggcuguucccaccag

SEQ ID NO: 3825187 - RNA, 21 nt, Human
ccaagagguuuggcuccugcc

SEQ ID NO: 3825188 - RNA, 15 nt, Human
ccaagagucuaaaga

SEQ ID NO: 3825189 - RNA, 16 nt, Human
ccaagagucuaaagau

SEQ ID NO: 3825190 - RNA, 16 nt, Human
ccaagaguggccccac

SEQ ID NO: 3825191 - RNA, 19 nt, Human
ccaagaguggccccaccug

SEQ ID NO: 3825192 - RNA, 21 nt, Human
ccaagaguggccccaccuggc

SEQ ID NO: 3825193 - RNA, 21 nt, Human
ccaagauaggaccuugggcca

SEQ ID NO: 3825194 - RNA, 22 nt, Human
ccaagauauuuuuaucccaaga

SEQ ID NO: 3825195 - RNA, 16 nt, Human
ccaagauucuagauga

SEQ ID NO: 3825196 - RNA, 22 nt, Human
ccaagauuuuccucuugugauu

SEQ ID NO: 3825197 - RNA, 20 nt, Human
ccaagcaaaggugaagagac

SEQ ID NO: 3825198 - RNA, 17 nt, Human
ccaagcacagcagccug

SEQ ID NO: 3825199 - RNA, 18 nt, Human
ccaagcacagcagccugg

SEQ ID NO: 3825200 - RNA, 16 nt, Human
ccaagcacaguggugg

SEQ ID NO: 3825201 - RNA, 23 nt, Human
ccaagcacagugguggcagggcc

SEQ ID NO: 3825202 - RNA, 20 nt, Human
ccaagcaccugggauuacaa

SEQ ID NO: 3825203 - RNA, 21 nt, Human
ccaagcacugugcucagggcu

SEQ ID NO: 3825204 - RNA, 18 nt, Human
ccaagcacuucuuuuucu

SEQ ID NO: 3825205 - RNA, 19 nt, Human
ccaagcacuuucaguccaa

SEQ ID NO: 3825206 - RNA, 12 nt, Human
ccaagcagccaa

SEQ ID NO: 3825207 - RNA, 18 nt, Human
ccaagcagccaagcuccu

SEQ ID NO: 3825208 - RNA, 13 nt, Human
ccaagcaggaagc

SEQ ID NO: 3825209 - RNA, 14 nt, Human
ccaagcaggaagcu

SEQ ID NO: 3825210 - RNA, 17 nt, Human
ccaagcaggaagcucag

SEQ ID NO: 3825211 - RNA, 18 nt, Human
ccaagcaggaagcucaga

SEQ ID NO: 3825212 - RNA, 11 nt, Human
cauuucagaaa

SEQ ID NO: 3825213 - RNA, 21 nt, Human
cauuucagaaguuaguuugua

SEQ ID NO: 3825214 - RNA, 22 nt, Human
cauuucagaguucuuuuugaag

SEQ ID NO: 3825215 - RNA, 22 nt, Human
cauuucaggagcagccucagaa

SEQ ID NO: 3825216 - RNA, 20 nt, Human
cauuucauauucuuucaauu

SEQ ID NO: 3825217 - RNA, 16 nt, Human
cauuucaucauuguuu

SEQ ID NO: 3825218 - RNA, 19 nt, Human
cauuucaucauuguuucug

SEQ ID NO: 3825219 - RNA, 21 nt, Human
cauuucaucauuguuucugca

SEQ ID NO: 3825220 - RNA, 17 nt, Human
cauuucauccuuucacu

SEQ ID NO: 3825221 - RNA, 21 nt, Human
cauuucaucuaccauuuucug

SEQ ID NO: 3825222 - RNA, 16 nt, Human
cauuucaucuauuucu

SEQ ID NO: 3825223 - RNA, 17 nt, Human
cauuucaucuauuucug

SEQ ID NO: 3825224 - RNA, 18 nt, Human
cauuucaucuauuucuga

SEQ ID NO: 3825225 - RNA, 15 nt, Human
cauuucaucucauuu

SEQ ID NO: 3825226 - RNA, 22 nt, Human
cauuucaugcucugcaaaagga

SEQ ID NO: 3825227 - RNA, 12 nt, Human
cauuucauucca

SEQ ID NO: 3825228 - RNA, 19 nt, Human
cauuucauuccauugccua

SEQ ID NO: 3825229 - RNA, 15 nt, Human
cauuucauuccuaac

SEQ ID NO: 3825230 - RNA, 18 nt, Human
cauuucauuccuaacaca

SEQ ID NO: 3825231 - RNA, 21 nt, Human
cauuucauuccuaacacagca

SEQ ID NO: 3825232 - RNA, 20 nt, Human
cauuucauuguaugaugugu

SEQ ID NO: 3825233 - RNA, 14 nt, Human
cauuucauuuccua

SEQ ID NO: 3825234 - RNA, 12 nt, Human
cauuuccaugua

SEQ ID NO: 3825235 - RNA, 17 nt, Human
cauuuccauguaugcau

SEQ ID NO: 3825236 - RNA, 18 nt, Human
cauuucccaacacaaaga

SEQ ID NO: 3825237 - RNA, 17 nt, Human
ccaccaccucccucacc

SEQ ID NO: 3825238 - RNA, 14 nt, Human
ccaccaccucugug

SEQ ID NO: 3825239 - RNA, 19 nt, Human
ccaccacgauguggcccug

SEQ ID NO: 3825240 - RNA, 20 nt, Human
ccaccacgauguggcccugg

SEQ ID NO: 3825241 - RNA, 21 nt, Human
ccaccacgauguggcccuggc

SEQ ID NO: 3825242 - RNA, 23 nt, Human
ccaccacuggccaccaggcuggc

SEQ ID NO: 3825243 - RNA, 13 nt, Human
ccaccagaagccc

SEQ ID NO: 3825244 - RNA, 16 nt, Human
ccaccagaagcccaga

SEQ ID NO: 3825245 - RNA, 20 nt, Human
ccaccagagaccguccucac

SEQ ID NO: 3825246 - RNA, 22 nt, Human
ccaccagagaccguccucaccc

SEQ ID NO: 3825247 - RNA, 13 nt, Human
ccaccagaugcug

SEQ ID NO: 3825248 - RNA, 18 nt, Human
ccaccagcaucaccugcc

SEQ ID NO: 3825249 - RNA, 15 nt, Human
ccaccagcugugucc

SEQ ID NO: 3825250 - RNA, 19 nt, Human
ccaccaggccaccucccca

SEQ ID NO: 3825251 - RNA, 12 nt, Human
ccaccaggcugg

SEQ ID NO: 3825252 - RNA, 21 nt, Human
ccaccaggcuggcgcagccaa

SEQ ID NO: 3825253 - RNA, 20 nt, Human
ccaccagggcaucucugggc

SEQ ID NO: 3825254 - RNA, 21 nt, Human
ccaccagggcaucucugggcu

SEQ ID NO: 3825255 - RNA, 23 nt, Human
ccaccaggucucccgggaagcca

SEQ ID NO: 3825256 - RNA, 19 nt, Human
ccaccaggugccuuucaaa

SEQ ID NO: 3825257 - RNA, 24 nt, Human
ccaccagugccucucccugcugcu

SEQ ID NO: 3825258 - RNA, 19 nt, Human
ccaccauaugaauuguaca

SEQ ID NO: 3825259 - RNA, 22 nt, Human
ccaccauauucagugcuguggc

SEQ ID NO: 3825260 - RNA, 16 nt, Human
ccaccaucaagccacc

SEQ ID NO: 3825261 - RNA, 18 nt, Human
ccaccaucaugucuggcu

SEQ ID NO: 3825262 - RNA, 19 nt, Human
ccaccaucaugucuggcua

SEQ ID NO: 3825263 - RNA, 11 nt, Human
ccaccaucugc

SEQ ID NO: 3825264 - RNA, 18 nt, Human
ccaccaucugcugucuuu

SEQ ID NO: 3825265 - RNA, 16 nt, Human
ccaccaugccaggcua

SEQ ID NO: 3825266 - RNA, 22 nt, Human
ccaccaugcccagcucagaggg

SEQ ID NO: 3825267 - RNA, 16 nt, Human
ccaccauggccagcca

SEQ ID NO: 3825268 - RNA, 21 nt, Human
ccaccauggccagccaacuuu

SEQ ID NO: 3825269 - RNA, 16 nt, Human
ccaccauuuggcaucc

SEQ ID NO: 3825270 - RNA, 21 nt, Human
ccacccaacccuaucuccuga

SEQ ID NO: 3825271 - RNA, 21 nt, Human
ccacccaagcuuggcagccga

SEQ ID NO: 3825272 - RNA, 17 nt, Human
ccacccaagggccuggc

SEQ ID NO: 3825273 - RNA, 15 nt, Human
ccacccaaugcugau

SEQ ID NO: 3825274 - RNA, 13 nt, Human
ccacccaccucag

SEQ ID NO: 3825275 - RNA, 17 nt, Human
ccacccaccucccugcc

SEQ ID NO: 3825276 - RNA, 19 nt, Human
ccacccaccucccugccuc

SEQ ID NO: 3825277 - RNA, 22 nt, Human
ccacccagaaugagacauccag

SEQ ID NO: 3825278 - RNA, 11 nt, Human
ccacccagccc

SEQ ID NO: 3825279 - RNA, 22 nt, Human
ccacccagcccauucucucucc

SEQ ID NO: 3825280 - RNA, 12 nt, Human
ccacccaggcca

SEQ ID NO: 3825281 - RNA, 14 nt, Human
ccacccaggccagg

SEQ ID NO: 3825282 - RNA, 23 nt, Human
ccacccaggggcagccccaggcc

SEQ ID NO: 3825283 - RNA, 13 nt, Human
ccaccccaagaga

SEQ ID NO: 3825284 - RNA, 17 nt, Human
ccaccccaauccuccca

SEQ ID NO: 3825285 - RNA, 15 nt, Human
ccaccccacacacgc

SEQ ID NO: 3825286 - RNA, 14 nt, Human
ccaccccacccccu

SEQ ID NO: 3825287 - RNA, 16 nt, Human
ccaccccaccugcagg

SEQ ID NO: 3825288 - RNA, 12 nt, Human
ccaccccagccu

SEQ ID NO: 3825289 - RNA, 14 nt, Human
ccaccccagccuaa

SEQ ID NO: 3825290 - RNA, 12 nt, Human
ccaccccaggac

SEQ ID NO: 3825291 - RNA, 14 nt, Human
ccaccccagggcag

SEQ ID NO: 3825292 - RNA, 19 nt, Human
ccaccccagggcagccagg

SEQ ID NO: 3825293 - RNA, 22 nt, Human
ccaccccagugcacccacucug

SEQ ID NO: 3825294 - RNA, 16 nt, Human
ccaccccauucccgca

SEQ ID NO: 3825295 - RNA, 18 nt, Human
ccaccccauuuucugugg

SEQ ID NO: 3825296 - RNA, 21 nt, Human
ccacccccaccaagggcgcaa

SEQ ID NO: 3825297 - RNA, 13 nt, Human
ccacccccagccc

SEQ ID NO: 3825298 - RNA, 15 nt, Human
ccacccccagcugcu

SEQ ID NO: 3825299 - RNA, 18 nt, Human
ccacccccaggaccccug

SEQ ID NO: 3825300 - RNA, 18 nt, Human
ccaccccccacucugugc

SEQ ID NO: 3825301 - RNA, 13 nt, Human
ccaccccccaggc

SEQ ID NO: 3825302 - RNA, 12 nt, Human
ccacccccuagg

SEQ ID NO: 3825303 - RNA, 12 nt, Human
ccacccccucaa

SEQ ID NO: 3825304 - RNA, 17 nt, Human
ccacccccuccccaggg

SEQ ID NO: 3825305 - RNA, 12 nt, Human
ccacccccuuca

SEQ ID NO: 3825306 - RNA, 17 nt, Human
ccacccccuucagugcc

SEQ ID NO: 3825307 - RNA, 18 nt, Human
ccacccccuucucugcuc

SEQ ID NO: 3825308 - RNA, 15 nt, Human
ccaccccgcucugca

SEQ ID NO: 3825309 - RNA, 19 nt, Human
ccaccccggcccccugccc

SEQ ID NO: 3825310 - RNA, 20 nt, Human
ccaccccgggcucucugcug

SEQ ID NO: 3825311 - RNA, 13 nt, Human
ccaccccuacccc

SEQ ID NO: 3825312 - RNA, 13 nt, Human
ccaccccuccaga

SEQ ID NO: 3825313 - RNA, 14 nt, Human
ccaccccucccucu

SEQ ID NO: 3825314 - RNA, 16 nt, Human
ccaccccuccuuccuu

SEQ ID NO: 3825315 - RNA, 22 nt, Human
ccaccccuggaagagcccaguc

SEQ ID NO: 3825316 - RNA, 14 nt, Human
ccaccccugugcuc

SEQ ID NO: 3825317 - RNA, 13 nt, Human
ccaccccuuagau

SEQ ID NO: 3825318 - RNA, 16 nt, Human
ccacccgaugcugcuu

SEQ ID NO: 3825319 - RNA, 15 nt, Human
ccacccguggagaug

SEQ ID NO: 3825320 - RNA, 22 nt, Human
ccacccuaccuguucagugucc

SEQ ID NO: 3825321 - RNA, 17 nt, Human
ccacccucacuggcucu

SEQ ID NO: 3825322 - RNA, 19 nt, Human
ccacccucacuggcucucc

SEQ ID NO: 3825323 - RNA, 21 nt, Human
ccacccuccccucucuugcac

SEQ ID NO: 3825324 - RNA, 19 nt, Human
ccacccuccugucuuccca

SEQ ID NO: 3825325 - RNA, 23 nt, Human
ccacccuccugucuucccagggu

SEQ ID NO: 3825326 - RNA, 19 nt, Human
ccacccucggggauguguc

SEQ ID NO: 3825327 - RNA, 20 nt, Human
ccacccucggggaugugucc

SEQ ID NO: 3825328 - RNA, 18 nt, Human
ccacccucguggacaccu

SEQ ID NO: 3825329 - RNA, 19 nt, Human
ccacccucguggacaccug

SEQ ID NO: 3825330 - RNA, 20 nt, Human
ccacccucguggacaccugc

SEQ ID NO: 3825331 - RNA, 20 nt, Human
ccacccucugagcuuugcau

SEQ ID NO: 3825332 - RNA, 15 nt, Human
ccacccugagccggc

SEQ ID NO: 3825333 - RNA, 15 nt, Human
ccacccugaggaguc

SEQ ID NO: 3825334 - RNA, 21 nt, Human
ccacccugaggagucugaggu

SEQ ID NO: 3825335 - RNA, 20 nt, Human
ccacccugcucauccacucu

SEQ ID NO: 3825336 - RNA, 13 nt, Human
ccacccugcucuc

SEQ ID NO: 3825337 - RNA, 15 nt, Human
ccacccugcugccuu

SEQ ID NO: 3825338 - RNA, 15 nt, Human
ccacccugcugcugg

SEQ ID NO: 3825339 - RNA, 19 nt, Human
ccacccugcuuggcccagg

SEQ ID NO: 3825340 - RNA, 13 nt, Human
ccacccugggccc

SEQ ID NO: 3825341 - RNA, 13 nt, Human
ccacccugggcuc

SEQ ID NO: 3825342 - RNA, 15 nt, Human
ccacccugggcucug

SEQ ID NO: 3825343 - RNA, 23 nt, Human
ccacccugggcucugugggcugc

SEQ ID NO: 3825344 - RNA, 21 nt, Human
ccacccuguaccucaucccau

SEQ ID NO: 3825345 - RNA, 18 nt, Human
ccacccugucccccagcu

SEQ ID NO: 3825346 - RNA, 21 nt, Human
ccacccugucccccagcucug

SEQ ID NO: 3825347 - RNA, 22 nt, Human
ccacccugucccccagcucugg

SEQ ID NO: 3825348 - RNA, 17 nt, Human
ccacccuguuccugcug

SEQ ID NO: 3825349 - RNA, 14 nt, Human
ccacccuuccccuc

SEQ ID NO: 3825350 - RNA, 20 nt, Human
ccacccuuggaggcugucuu

SEQ ID NO: 3825351 - RNA, 23 nt, Human
ccacccuuuggggggggcccgcc

SEQ ID NO: 3825352 - RNA, 16 nt, Human
ccaccgcagaaggaag

SEQ ID NO: 3825353 - RNA, 14 nt, Human
ccaccgcagacagg

SEQ ID NO: 3825354 - RNA, 13 nt, Human
ccaccgccauggc

SEQ ID NO: 3825355 - RNA, 17 nt, Human
ccaccgccauggcuucc

SEQ ID NO: 3825356 - RNA, 18 nt, Human
ccaccgccauggcuucca

SEQ ID NO: 3825357 - RNA, 15 nt, Human
cauuuguauuuugug

SEQ ID NO: 3825358 - RNA, 17 nt, Human
cauuuguauuuugugug

SEQ ID NO: 3825359 - RNA, 18 nt, Human
cauuuguauuuuguguga

SEQ ID NO: 3825360 - RNA, 12 nt, Human
cauuugucauuu

SEQ ID NO: 3825361 - RNA, 12 nt, Human
cauuugucccaa

SEQ ID NO: 3825362 - RNA, 13 nt, Human
cauuugucccaag

SEQ ID NO: 3825363 - RNA, 12 nt, Human
cauuugugauau

SEQ ID NO: 3825364 - RNA, 22 nt, Human
cauuugugauauauguauuaau

SEQ ID NO: 3825365 - RNA, 18 nt, Human
cauuuguggcagucccuu

SEQ ID NO: 3825366 - RNA, 17 nt, Human
cauuuguggguuuuuau

SEQ ID NO: 3825367 - RNA, 15 nt, Human
cauuuguuaaaauua

SEQ ID NO: 3825368 - RNA, 15 nt, Human
cauuuguuauucuua

SEQ ID NO: 3825369 - RNA, 14 nt, Human
cauuuguucacuga

SEQ ID NO: 3825370 - RNA, 13 nt, Human
cauuuguucauau

SEQ ID NO: 3825371 - RNA, 14 nt, Human
cauuuguucauauu

SEQ ID NO: 3825372 - RNA, 19 nt, Human
cauuuguucauauuaagaa

SEQ ID NO: 3825373 - RNA, 20 nt, Human
cauuuguucauauuaagaau

SEQ ID NO: 3825374 - RNA, 19 nt, Human
cauuuguugccagauuuca

SEQ ID NO: 3825375 - RNA, 20 nt, Human
cauuuguuuauguaauuuca

SEQ ID NO: 3825376 - RNA, 13 nt, Human
cauuuuaaaaaca

SEQ ID NO: 3825377 - RNA, 18 nt, Human
cauuuuaaaaaugaaauu

SEQ ID NO: 3825378 - RNA, 22 nt, Human
cauuuuaaacaaaauagaaagu

SEQ ID NO: 3825379 - RNA, 18 nt, Human
cauuuuaaaguuaaacau

SEQ ID NO: 3825380 - RNA, 17 nt, Human
cauuuuaaaguuaguau

SEQ ID NO: 3825381 - RNA, 16 nt, Human
cauuuuaaauaaaaga

SEQ ID NO: 3825382 - RNA, 17 nt, Human
cauuuuaaauaaaagaa

SEQ ID NO: 3825383 - RNA, 17 nt, Human
cauuuuaaauggacaga

SEQ ID NO: 3825384 - RNA, 16 nt, Human
cauuuuaacaucugag

SEQ ID NO: 3825385 - RNA, 14 nt, Human
cauuuuaauucauc

SEQ ID NO: 3825386 - RNA, 19 nt, Human
cauuuuaauuuuaaccaaa

SEQ ID NO: 3825387 - RNA, 19 nt, Human
cauuuuacacacuguacac

SEQ ID NO: 3825388 - RNA, 22 nt, Human
cauuuuaccaucacacauguuc

SEQ ID NO: 3825389 - RNA, 20 nt, Human
cauuuuacccacacacagau

SEQ ID NO: 3825390 - RNA, 23 nt, Human
cauuuuaccuuugacaaagguaa

SEQ ID NO: 3825391 - RNA, 16 nt, Human
cauuuuacuguacaga

SEQ ID NO: 3825392 - RNA, 22 nt, Human
cauuuuacuuuuuccuggcuca

SEQ ID NO: 3825393 - RNA, 20 nt, Human
cauuuuagaagacucuacca

SEQ ID NO: 3825394 - RNA, 17 nt, Human
cauuuuagacaguaagu

SEQ ID NO: 3825395 - RNA, 19 nt, Human
cauuuuagacaguaaguau

SEQ ID NO: 3825396 - RNA, 16 nt, Human
cauuuuagcuaauuua

SEQ ID NO: 3825397 - RNA, 19 nt, Human
cauuuuagggguagcauuu

SEQ ID NO: 3825398 - RNA, 15 nt, Human
cauuuuagucacuuu

SEQ ID NO: 3825399 - RNA, 14 nt, Human
cauuuuaguucuuu

SEQ ID NO: 3825400 - RNA, 14 nt, Human
cauuuuauauguca

SEQ ID NO: 3825401 - RNA, 19 nt, Human
cauuuuauaugucaaagca

SEQ ID NO: 3825402 - RNA, 18 nt, Human
caccuguaaagugccuua

SEQ ID NO: 3825403 - RNA, 14 nt, Human
caccuguaagaaac

SEQ ID NO: 3825404 - RNA, 17 nt, Human
caccuguaaucccagca

SEQ ID NO: 3825405 - RNA, 20 nt, Human
caccuguaauuccagcacuu

SEQ ID NO: 3825406 - RNA, 11 nt, Human
caccuguacag

SEQ ID NO: 3825407 - RNA, 18 nt, Human
caccuguacaguggaacc

SEQ ID NO: 3825408 - RNA, 16 nt, Human
caccuguacucaggag

SEQ ID NO: 3825409 - RNA, 15 nt, Human
caccuguacucuucc

SEQ ID NO: 3825410 - RNA, 16 nt, Human
caccuguagucccagc

SEQ ID NO: 3825411 - RNA, 17 nt, Human
caccuguagucccagcu

SEQ ID NO: 3825412 - RNA, 18 nt, Human
caccuguagucccagcua

SEQ ID NO: 3825413 - RNA, 22 nt, Human
caccuguagucccagcuacuug

SEQ ID NO: 3825414 - RNA, 16 nt, Human
caccugucccaccuca

SEQ ID NO: 3825415 - RNA, 15 nt, Human
caccugucgcccagu

SEQ ID NO: 3825416 - RNA, 18 nt, Human
caccugucgcccagugcc

SEQ ID NO: 3825417 - RNA, 18 nt, Human
caccugucucagccuccc

SEQ ID NO: 3825418 - RNA, 11 nt, Human
caccugucugc

SEQ ID NO: 3825419 - RNA, 15 nt, Human
caccugucugcucca

SEQ ID NO: 3825420 - RNA, 20 nt, Human
caccugucugcuccagcucu

SEQ ID NO: 3825421 - RNA, 21 nt, Human
caccugucugcuccagcucug

SEQ ID NO: 3825422 - RNA, 11 nt, Human
caccugucugu

SEQ ID NO: 3825423 - RNA, 20 nt, Human
caccugucuugccuuuuuca

SEQ ID NO: 3825424 - RNA, 23 nt, Human
caccugugcagcgaagcuuagcg

SEQ ID NO: 3825425 - RNA, 20 nt, Human
caccuguugcuuacaauuuu

SEQ ID NO: 3825426 - RNA, 20 nt, Human
caccuguuuuuaagcuguuu

SEQ ID NO: 3825427 - RNA, 14 nt, Human
caccuuaaauuaaa

SEQ ID NO: 3825428 - RNA, 15 nt, Human
caccuuaaauuaaac

SEQ ID NO: 3825429 - RNA, 22 nt, Human
caccuuaaauuaaacaauuuau

SEQ ID NO: 3825430 - RNA, 14 nt, Human
caccuuaauaugcu

SEQ ID NO: 3825431 - RNA, 19 nt, Human
caccuuagacagucccugc

SEQ ID NO: 3825432 - RNA, 14 nt, Human
caccuuagaccacc

SEQ ID NO: 3825433 - RNA, 19 nt, Human
caccuuagaccaccaagcc

SEQ ID NO: 3825434 - RNA, 22 nt, Human
caccuuagccugcccuccuuuc

SEQ ID NO: 3825435 - RNA, 14 nt, Human
caccuuaggcaggg

SEQ ID NO: 3825436 - RNA, 15 nt, Human
caccuuauauuuacg

SEQ ID NO: 3825437 - RNA, 17 nt, Human
caccuucaauuccuggg

SEQ ID NO: 3825438 - RNA, 18 nt, Human
caccuucaauuccugggc

SEQ ID NO: 3825439 - RNA, 20 nt, Human
caccuucagaggcugaggug

SEQ ID NO: 3825440 - RNA, 23 nt, Human
caccuucaguaacccccacugga

SEQ ID NO: 3825441 - RNA, 16 nt, Human
caccuucauuuugagg

SEQ ID NO: 3825442 - RNA, 14 nt, Human
caccuuccagcucc

SEQ ID NO: 3825443 - RNA, 18 nt, Human
caccuucccacuuuccca

SEQ ID NO: 3825444 - RNA, 15 nt, Human
caccuucccagcucu

SEQ ID NO: 3825445 - RNA, 17 nt, Human
caccuucccagcucucc

SEQ ID NO: 3825446 - RNA, 19 nt, Human
caccuucccagcucucccu

SEQ ID NO: 3825447 - RNA, 22 nt, Human
caccuucccagcucucccucug

SEQ ID NO: 3825448 - RNA, 13 nt, Human
caccuucccaugc

SEQ ID NO: 3825449 - RNA, 19 nt, Human
caccuucccccucccccag

SEQ ID NO: 3825450 - RNA, 18 nt, Human
caccuucccuugccacuu

SEQ ID NO: 3825451 - RNA, 12 nt, Human
caccuucugagu

SEQ ID NO: 3825452 - RNA, 18 nt, Human
caccuugaacaccacgcu

SEQ ID NO: 3825453 - RNA, 13 nt, Human
caccuugacaggg

SEQ ID NO: 3825454 - RNA, 13 nt, Human
caccuuggcucaa

SEQ ID NO: 3825455 - RNA, 19 nt, Human
caccuugggaugaugccuc

SEQ ID NO: 3825456 - RNA, 20 nt, Human
caccuugggaugaugccuca

SEQ ID NO: 3825457 - RNA, 18 nt, Human
caccuuggggcuugacuu

SEQ ID NO: 3825458 - RNA, 20 nt, Human
caccuuggggcuugacuuuu

SEQ ID NO: 3825459 - RNA, 22 nt, Human
caccuugguuccuggggcaucc

SEQ ID NO: 3825460 - RNA, 15 nt, Human
caccuugugccuggg

SEQ ID NO: 3825461 - RNA, 21 nt, Human
caccuugugucuguacacgug

SEQ ID NO: 3825462 - RNA, 14 nt, Human
caccuuuacuuuag

SEQ ID NO: 3825463 - RNA, 14 nt, Human
caccuuuagguucu

SEQ ID NO: 3825464 - RNA, 12 nt, Human
caccuuuauuaa

SEQ ID NO: 3825465 - RNA, 17 nt, Human
caccuuuauuaaaaucu

SEQ ID NO: 3825466 - RNA, 21 nt, Human
caccuuucagauaacuguuau

SEQ ID NO: 3825467 - RNA, 14 nt, Human
caccuuucccaucu

SEQ ID NO: 3825468 - RNA, 15 nt, Human
caccuuucccuaaag

SEQ ID NO: 3825469 - RNA, 20 nt, Human
caccuuucccuaaagacccu

SEQ ID NO: 3825470 - RNA, 19 nt, Human
caccuuuccucaaauguug

SEQ ID NO: 3825471 - RNA, 17 nt, Human
caccuuucuaguugaaa

SEQ ID NO: 3825472 - RNA, 16 nt, Human
caccuuucuccuuugu

SEQ ID NO: 3825473 - RNA, 15 nt, Human
caccuuugcaggcau

SEQ ID NO: 3825474 - RNA, 20 nt, Human
caccuuuguagcacucaggc

SEQ ID NO: 3825475 - RNA, 21 nt, Human
caccuuuguagcacucaggcu

SEQ ID NO: 3825476 - RNA, 19 nt, Human
caccuuuguuucuccccca

SEQ ID NO: 3825477 - RNA, 20 nt, Human
caccuuuucagcgauguaug

SEQ ID NO: 3825478 - RNA, 20 nt, Human
caccuuuugggaauguuuua

SEQ ID NO: 3825479 - RNA, 22 nt, Human
cacgaaagagagagaaacaaac

SEQ ID NO: 3825480 - RNA, 13 nt, Human
cacgaaauguuau

SEQ ID NO: 3825481 - RNA, 16 nt, Human
cacgaaauguuauuuu

SEQ ID NO: 3825482 - RNA, 22 nt, Human
cacgaacccaccugcugagaga

SEQ ID NO: 3825483 - RNA, 16 nt, Human
cacgaauauugcugau

SEQ ID NO: 3825484 - RNA, 17 nt, Human
cacgaauuucugugccc

SEQ ID NO: 3825485 - RNA, 18 nt, Human
cacgaauuugcuggggaa

SEQ ID NO: 3825486 - RNA, 14 nt, Human
cacgaccggggcca

SEQ ID NO: 3825487 - RNA, 15 nt, Human
cacgacgcugcagag

SEQ ID NO: 3825488 - RNA, 17 nt, Human
cacgacuucuguuucac

SEQ ID NO: 3825489 - RNA, 15 nt, Human
cacgagagcgcagca

SEQ ID NO: 3825490 - RNA, 23 nt, Human
cacgagcagacacccuuggagcu

SEQ ID NO: 3825491 - RNA, 13 nt, Human
cacgagggcuggc

SEQ ID NO: 3825492 - RNA, 17 nt, Human
cacgagggcuggcuggc

SEQ ID NO: 3825493 - RNA, 19 nt, Human
cacgauccugccacccugu

SEQ ID NO: 3825494 - RNA, 12 nt, Human
cacgaugaaaaa

SEQ ID NO: 3825495 - RNA, 16 nt, Human
cacgauguggcccugg

SEQ ID NO: 3825496 - RNA, 18 nt, Human
cacgauguggcccuggcc

SEQ ID NO: 3825497 - RNA, 14 nt, Human
cacgauuucuguuu

SEQ ID NO: 3825498 - RNA, 16 nt, Human
cacgauuucuguuuag

SEQ ID NO: 3825499 - RNA, 23 nt, Human
cacgauuuucuccagcucagaac

SEQ ID NO: 3825500 - RNA, 13 nt, Human
cacgcaacuugaa

SEQ ID NO: 3825501 - RNA, 12 nt, Human
cacgcacacaca

SEQ ID NO: 3825502 - RNA, 17 nt, Human
ccaaggagucacugaga

SEQ ID NO: 3825503 - RNA, 19 nt, Human
ccaaggagucacugagacc

SEQ ID NO: 3825504 - RNA, 13 nt, Human
ccaaggcaaggca

SEQ ID NO: 3825505 - RNA, 15 nt, Human
ccaaggcagaggccu

SEQ ID NO: 3825506 - RNA, 20 nt, Human
ccaaggcagaggccugggcu

SEQ ID NO: 3825507 - RNA, 20 nt, Human
ccaaggcauaucaugcuuug

SEQ ID NO: 3825508 - RNA, 21 nt, Human
ccaaggccaaaggaagcacau

SEQ ID NO: 3825509 - RNA, 18 nt, Human
ccaaggccagaguggccu

SEQ ID NO: 3825510 - RNA, 16 nt, Human
ccaaggccaggccuug

SEQ ID NO: 3825511 - RNA, 16 nt, Human
ccaaggccagggacag

SEQ ID NO: 3825512 - RNA, 20 nt, Human
ccaaggcccccugccugccc

SEQ ID NO: 3825513 - RNA, 16 nt, Human
ccaaggcggccccucc

SEQ ID NO: 3825514 - RNA, 17 nt, Human
ccaaggcugcgucugga

SEQ ID NO: 3825515 - RNA, 18 nt, Human
ccaaggcugcgucuggag

SEQ ID NO: 3825516 - RNA, 19 nt, Human
ccaaggcugcgucuggagg

SEQ ID NO: 3825517 - RNA, 17 nt, Human
ccaagggaaaggggugc

SEQ ID NO: 3825518 - RNA, 19 nt, Human
ccaagggaaccuguguccg

SEQ ID NO: 3825519 - RNA, 18 nt, Human
ccaagggaggcugcugcu

SEQ ID NO: 3825520 - RNA, 22 nt, Human
ccaagggaggcugcugcugcuc

SEQ ID NO: 3825521 - RNA, 13 nt, Human
ccaagggaucugg

SEQ ID NO: 3825522 - RNA, 19 nt, Human
ccaagggaugaaagagaag

SEQ ID NO: 3825523 - RNA, 19 nt, Human
ccaagggcauaaauuauug

SEQ ID NO: 3825524 - RNA, 13 nt, Human
ccaagggcccaaa

SEQ ID NO: 3825525 - RNA, 19 nt, Human
ccaagggccuggccugagc

SEQ ID NO: 3825526 - RNA, 13 nt, Human
ccaagggcugccg

SEQ ID NO: 3825527 - RNA, 21 nt, Human
ccaagggcuucugcacccucc

SEQ ID NO: 3825528 - RNA, 22 nt, Human
ccaagggcuucugcacccucca

SEQ ID NO: 3825529 - RNA, 22 nt, Human
ccaaggggaauguuugccucug

SEQ ID NO: 3825530 - RNA, 20 nt, Human
ccaaggggagucaccuuccc

SEQ ID NO: 3825531 - RNA, 21 nt, Human
ccaaggggcaaauuuuuauuu

SEQ ID NO: 3825532 - RNA, 15 nt, Human
ccaaggggcagucug

SEQ ID NO: 3825533 - RNA, 20 nt, Human
ccaaggggcagucuggaggg

SEQ ID NO: 3825534 - RNA, 22 nt, Human
ccaaggggccugagcaguccuu

SEQ ID NO: 3825535 - RNA, 18 nt, Human
ccaaggggugggccacag

SEQ ID NO: 3825536 - RNA, 23 nt, Human
ccaaggguucagagacucagggc

SEQ ID NO: 3825537 - RNA, 20 nt, Human
ccaagguagaaugaccuugu

SEQ ID NO: 3825538 - RNA, 15 nt, Human
ccaaggucugagcca

SEQ ID NO: 3825539 - RNA, 16 nt, Human
ccaagguggcacggug

SEQ ID NO: 3825540 - RNA, 17 nt, Human
ccaaggugggcugagcc

SEQ ID NO: 3825541 - RNA, 18 nt, Human
ccaagguguccuacagaa

SEQ ID NO: 3825542 - RNA, 22 nt, Human
ccaagguuggagcccagggcau

SEQ ID NO: 3825543 - RNA, 20 nt, Human
ccaagguuuaaacuucucug

SEQ ID NO: 3825544 - RNA, 20 nt, Human
ccaagguuuaaagagucuag

SEQ ID NO: 3825545 - RNA, 23 nt, Human
ccaagguuuaaagagucuagauu

SEQ ID NO: 3825546 - RNA, 19 nt, Human
ccaagguuuuauaaggcug

SEQ ID NO: 3825547 - RNA, 20 nt, Human
ccaagguuuuauaaggcuga

SEQ ID NO: 3825548 - RNA, 21 nt, Human
ccaaguaagaggcuggaguug

SEQ ID NO: 3825549 - RNA, 20 nt, Human
ccaaguagucugcucacagu

SEQ ID NO: 3825550 - RNA, 17 nt, Human
ccaaguccagguccugg

SEQ ID NO: 3825551 - RNA, 15 nt, Human
ccaagucccuguuuu

SEQ ID NO: 3825552 - RNA, 13 nt, Human
ccaaguccgcaga

SEQ ID NO: 3825553 - RNA, 19 nt, Human
ccaaguccugaagaggcgg

SEQ ID NO: 3825554 - RNA, 20 nt, Human
ccaaguccugaagaggcggg

SEQ ID NO: 3825555 - RNA, 14 nt, Human
ccaagugcaggcug

SEQ ID NO: 3825556 - RNA, 15 nt, Human
ccaagugccagaggu

SEQ ID NO: 3825557 - RNA, 23 nt, Human
ccaagugccagaggugggcaggu

SEQ ID NO: 3825558 - RNA, 18 nt, Human
ccaaguggagccugacag

SEQ ID NO: 3825559 - RNA, 15 nt, Human
ccaaguggcagagcu

SEQ ID NO: 3825560 - RNA, 19 nt, Human
ccaaguggcagagcuugga

SEQ ID NO: 3825561 - RNA, 12 nt, Human
ccaaguggcucc

SEQ ID NO: 3825562 - RNA, 13 nt, Human
ccaaguggcuccc

SEQ ID NO: 3825563 - RNA, 18 nt, Human
ccaagugggggcagaggg

SEQ ID NO: 3825564 - RNA, 14 nt, Human
ccaagugugaacaa

SEQ ID NO: 3825565 - RNA, 19 nt, Human
ccaagugugcauauuguac

SEQ ID NO: 3825566 - RNA, 22 nt, Human
ccaagugugcauauuguacacu

SEQ ID NO: 3825567 - RNA, 12 nt, Human
ccaagugugcua

SEQ ID NO: 3825568 - RNA, 12 nt, Human
ccaagugugugu

SEQ ID NO: 3825569 - RNA, 13 nt, Human
ccaagugugugug

SEQ ID NO: 3825570 - RNA, 14 nt, Human
ccaagugugugugc

SEQ ID NO: 3825571 - RNA, 14 nt, Human
ccaaguuauauaaa

SEQ ID NO: 3825572 - RNA, 13 nt, Human
ccaaguuccucua

SEQ ID NO: 3825573 - RNA, 15 nt, Human
ccaaguucucaccuc

SEQ ID NO: 3825574 - RNA, 22 nt, Human
ccaaguugauuuaguguuuuua

SEQ ID NO: 3825575 - RNA, 17 nt, Human
ccaaguuuacucaaccc

SEQ ID NO: 3825576 - RNA, 21 nt, Human
ccaaguuuacucaacccucuc

SEQ ID NO: 3825577 - RNA, 17 nt, Human
ccaaguuuccauagcaa

SEQ ID NO: 3825578 - RNA, 20 nt, Human
ccaaguuuccauagcaacag

SEQ ID NO: 3825579 - RNA, 17 nt, Human
ccaaguuuugugaaauu

SEQ ID NO: 3825580 - RNA, 23 nt, Human
ccaauaaaagcaauuccaaccuu

SEQ ID NO: 3825581 - RNA, 13 nt, Human
ccaauaaacagga

SEQ ID NO: 3825582 - RNA, 13 nt, Human
ccaauaaaccagg

SEQ ID NO: 3825583 - RNA, 14 nt, Human
ccaauaaaccaggu

SEQ ID NO: 3825584 - RNA, 22 nt, Human
ccaauaaaugugaaauucuguc

SEQ ID NO: 3825585 - RNA, 22 nt, Human
ccaauaauaaaugcccucuucu

SEQ ID NO: 3825586 - RNA, 21 nt, Human
ccaauagcacuuucauugcca

SEQ ID NO: 3825587 - RNA, 14 nt, Human
ccaauagcugccca

SEQ ID NO: 3825588 - RNA, 18 nt, Human
ccaauagggcugagcucu

SEQ ID NO: 3825589 - RNA, 12 nt, Human
ccaauauccuaa

SEQ ID NO: 3825590 - RNA, 14 nt, Human
ccaauauccuaaua

SEQ ID NO: 3825591 - RNA, 16 nt, Human
ccaauauccuaauaaa

SEQ ID NO: 3825592 - RNA, 18 nt, Human
ccaauauccuaauaaaaa

SEQ ID NO: 3825593 - RNA, 15 nt, Human
ccaauauguauugua

SEQ ID NO: 3825594 - RNA, 22 nt, Human
ccaauauguauuguaaacaugu

SEQ ID NO: 3825595 - RNA, 15 nt, Human
ccaauauuaaaucug

SEQ ID NO: 3825596 - RNA, 18 nt, Human
ccaauauuaaaucugcug

SEQ ID NO: 3825597 - RNA, 12 nt, Human
ccaauauuauaa

SEQ ID NO: 3825598 - RNA, 16 nt, Human
ccaauauuguacaguu

SEQ ID NO: 3825599 - RNA, 14 nt, Human
ccaauauuuguaga

SEQ ID NO: 3825600 - RNA, 20 nt, Human
ccaauauuuucuuuaaugcu

SEQ ID NO: 3825601 - RNA, 17 nt, Human
ccaaucaagauaaagga

SEQ ID NO: 3825602 - RNA, 14 nt, Human
ccaaucagcacuga

SEQ ID NO: 3825603 - RNA, 18 nt, Human
ccaaucccagcuaccuca

SEQ ID NO: 3825604 - RNA, 17 nt, Human
ccaauccccuccuuggg

SEQ ID NO: 3825605 - RNA, 13 nt, Human
ccaauccuauguu

SEQ ID NO: 3825606 - RNA, 14 nt, Human
ccaauccuauguuu

SEQ ID NO: 3825607 - RNA, 16 nt, Human
ccaauccucccagaaa

SEQ ID NO: 3825608 - RNA, 17 nt, Human
ccagccuggccaacaug

SEQ ID NO: 3825609 - RNA, 23 nt, Human
ccagccuggccacgcagccagga

SEQ ID NO: 3825610 - RNA, 14 nt, Human
ccagccuggcccag

SEQ ID NO: 3825611 - RNA, 14 nt, Human
ccagccuggccucc

SEQ ID NO: 3825612 - RNA, 21 nt, Human
ccagccuggccuccugccucu

SEQ ID NO: 3825613 - RNA, 23 nt, Human
ccagccuggcucccacaggcagc

SEQ ID NO: 3825614 - RNA, 18 nt, Human
ccagccuggcuucuggag

SEQ ID NO: 3825615 - RNA, 21 nt, Human
ccagccuggcuucuggagccc

SEQ ID NO: 3825616 - RNA, 16 nt, Human
ccagccugggaggcac

SEQ ID NO: 3825617 - RNA, 23 nt, Human
ccagccugggaggcacagcaaac

SEQ ID NO: 3825618 - RNA, 23 nt, Human
ccagccugggcagccaggcugcc

SEQ ID NO: 3825619 - RNA, 14 nt, Human
ccagccugggccca

SEQ ID NO: 3825620 - RNA, 22 nt, Human
ccagccugggcccaucucccug

SEQ ID NO: 3825621 - RNA, 20 nt, Human
ccagccuggggccuggcagg

SEQ ID NO: 3825622 - RNA, 15 nt, Human
ccagccuuccucugc

SEQ ID NO: 3825623 - RNA, 18 nt, Human
ccagccuucuuccauccc

SEQ ID NO: 3825624 - RNA, 20 nt, Human
ccagccuugaccauucucca

SEQ ID NO: 3825625 - RNA, 22 nt, Human
ccagccuugaccauucuccacc

SEQ ID NO: 3825626 - RNA, 19 nt, Human
ccagccuuucucccaggcc

SEQ ID NO: 3825627 - RNA, 19 nt, Human
ccagccuuuggccuuggcu

SEQ ID NO: 3825628 - RNA, 16 nt, Human
ccagcgagcccuggug

SEQ ID NO: 3825629 - RNA, 13 nt, Human
ccagcgagcgccc

SEQ ID NO: 3825630 - RNA, 20 nt, Human
ccagcgagcgcccagcuccu

SEQ ID NO: 3825631 - RNA, 17 nt, Human
ccagcgagggcgugucu

SEQ ID NO: 3825632 - RNA, 18 nt, Human
ccagcgaucucuccacug

SEQ ID NO: 3825633 - RNA, 19 nt, Human
ccagcgaucucuccacugu

SEQ ID NO: 3825634 - RNA, 18 nt, Human
ccagcgauucccucuccc

SEQ ID NO: 3825635 - RNA, 19 nt, Human
ccagcgauucccucuccca

SEQ ID NO: 3825636 - RNA, 21 nt, Human
ccagcgauucccucucccagg

SEQ ID NO: 3825637 - RNA, 22 nt, Human
ccagcgauucccucucccaggc

SEQ ID NO: 3825638 - RNA, 16 nt, Human
ccagcgcccgcugggc

SEQ ID NO: 3825639 - RNA, 18 nt, Human
ccagcgcccgcugggcug

SEQ ID NO: 3825640 - RNA, 18 nt, Human
ccagcgccucccuccacc

SEQ ID NO: 3825641 - RNA, 19 nt, Human
ccagcgccucccuccaccc

SEQ ID NO: 3825642 - RNA, 21 nt, Human
ccagcgcggacauccccugcu

SEQ ID NO: 3825643 - RNA, 15 nt, Human
ccagcgcucugccuc

SEQ ID NO: 3825644 - RNA, 14 nt, Human
ccagcgcugagugg

SEQ ID NO: 3825645 - RNA, 13 nt, Human
ccagcggacacac

SEQ ID NO: 3825646 - RNA, 20 nt, Human
ccacaggcucaggcaggggc

SEQ ID NO: 3825647 - RNA, 18 nt, Human
ccacaggcuuagggacag

SEQ ID NO: 3825648 - RNA, 19 nt, Human
ccacaggcuuagggacagg

SEQ ID NO: 3825649 - RNA, 16 nt, Human
ccacagggaacccugc

SEQ ID NO: 3825650 - RNA, 19 nt, Human
ccacagggcaccugccacc

SEQ ID NO: 3825651 - RNA, 20 nt, Human
ccacagggucccacagccac

SEQ ID NO: 3825652 - RNA, 14 nt, Human
ccacaggucuagac

SEQ ID NO: 3825653 - RNA, 14 nt, Human
ccacaggugugagc

SEQ ID NO: 3825654 - RNA, 16 nt, Human
ccacaguaaguuccua

SEQ ID NO: 3825655 - RNA, 19 nt, Human
ccacaguagaacugucugu

SEQ ID NO: 3825656 - RNA, 20 nt, Human
ccacaguagaacugucugug

SEQ ID NO: 3825657 - RNA, 19 nt, Human
ccacagucucccccacccu

SEQ ID NO: 3825658 - RNA, 23 nt, Human
ccacagugacucgggcuccugug

SEQ ID NO: 3825659 - RNA, 19 nt, Human
ccacagugucaggcacugg

SEQ ID NO: 3825660 - RNA, 23 nt, Human
ccacaguguuggcgagaggaggg

SEQ ID NO: 3825661 - RNA, 22 nt, Human
ccacaguucaguggcagggcuc

SEQ ID NO: 3825662 - RNA, 16 nt, Human
ccacaguugccaccac

SEQ ID NO: 3825663 - RNA, 20 nt, Human
ccacaguugccaccaccucu

SEQ ID NO: 3825664 - RNA, 14 nt, Human
ccacaguugcucua

SEQ ID NO: 3825665 - RNA, 14 nt, Human
ccacaucaaagagg

SEQ ID NO: 3825666 - RNA, 22 nt, Human
ccacaucaauauugucauuccu

SEQ ID NO: 3825667 - RNA, 18 nt, Human
ccacauccaacuccagca

SEQ ID NO: 3825668 - RNA, 20 nt, Human
ccacauccacacacgcagga

SEQ ID NO: 3825669 - RNA, 22 nt, Human
ccacauccacacacgcaggaac

SEQ ID NO: 3825670 - RNA, 23 nt, Human
ccacauccccgcuggcugggggc

SEQ ID NO: 3825671 - RNA, 16 nt, Human
ccacaucccugggccu

SEQ ID NO: 3825672 - RNA, 17 nt, Human
ccacaucccuuugaaac

SEQ ID NO: 3825673 - RNA, 20 nt, Human
ccacauccuccguccagccg

SEQ ID NO: 3825674 - RNA, 22 nt, Human
ccacaucuaagccugaaggggc

SEQ ID NO: 3825675 - RNA, 23 nt, Human
ccacaucuaagccugaaggggcg

SEQ ID NO: 3825676 - RNA, 13 nt, Human
ccacaucugccuu

SEQ ID NO: 3825677 - RNA, 14 nt, Human
ccacaucugccuua

SEQ ID NO: 3825678 - RNA, 23 nt, Human
ccacaucuugaucugcucagccc

SEQ ID NO: 3825679 - RNA, 19 nt, Human
ccacaucuugcucugcuga

SEQ ID NO: 3825680 - RNA, 20 nt, Human
ccacaucuugcucugcugac

SEQ ID NO: 3825681 - RNA, 14 nt, Human
ccacaugaaaccua

SEQ ID NO: 3825682 - RNA, 19 nt, Human
ccacaugagucccaguggg

SEQ ID NO: 3825683 - RNA, 23 nt, Human
ccacaugagucccagugggaggc

SEQ ID NO: 3825684 - RNA, 14 nt, Human
ccacaugccccauc

SEQ ID NO: 3825685 - RNA, 17 nt, Human
ccacaugcggagaacaa

SEQ ID NO: 3825686 - RNA, 17 nt, Human
ccacauggcacagagau

SEQ ID NO: 3825687 - RNA, 18 nt, Human
ccacauggcggagaguuu

SEQ ID NO: 3825688 - RNA, 18 nt, Human
ccacaugggagcagucca

SEQ ID NO: 3825689 - RNA, 20 nt, Human
ccacauguacagacauacau

SEQ ID NO: 3825690 - RNA, 16 nt, Human
ccacauuccugaugcu

SEQ ID NO: 3825691 - RNA, 22 nt, Human
ccacauugggcagcgcccuucc

SEQ ID NO: 3825692 - RNA, 17 nt, Human
ccacauuuagucucuuu

SEQ ID NO: 3825693 - RNA, 20 nt, Human
ccacauuuagucucuuuauu

SEQ ID NO: 3825694 - RNA, 23 nt, Human
ccacauuuagucucuuuauuccu

SEQ ID NO: 3825695 - RNA, 14 nt, Human
ccacauuucuaaaa

SEQ ID NO: 3825696 - RNA, 13 nt, Human
ccacauuuggaau

SEQ ID NO: 3825697 - RNA, 12 nt, Human
ccaccaaagcug

SEQ ID NO: 3825698 - RNA, 14 nt, Human
ccaccaaagcugcc

SEQ ID NO: 3825699 - RNA, 19 nt, Human
ccaccaaagcugcccacug

SEQ ID NO: 3825700 - RNA, 14 nt, Human
ccaccaacauacuc

SEQ ID NO: 3825701 - RNA, 21 nt, Human
ccaccaacauacucccaucug

SEQ ID NO: 3825702 - RNA, 15 nt, Human
ccaccaacaucccau

SEQ ID NO: 3825703 - RNA, 12 nt, Human
ccaccaacccau

SEQ ID NO: 3825704 - RNA, 15 nt, Human
ccaccaacccucaga

SEQ ID NO: 3825705 - RNA, 15 nt, Human
ccaccaacucuugca

SEQ ID NO: 3825706 - RNA, 15 nt, Human
ccaccaacuggcccu

SEQ ID NO: 3825707 - RNA, 14 nt, Human
ccaccaagccuuga

SEQ ID NO: 3825708 - RNA, 11 nt, Human
ccaccaagguc

SEQ ID NO: 3825709 - RNA, 15 nt, Human
ccaccacacauccca

SEQ ID NO: 3825710 - RNA, 20 nt, Human
ccaccacacaucccagccca

SEQ ID NO: 3825711 - RNA, 14 nt, Human
ccaccacacccagc

SEQ ID NO: 3825712 - RNA, 16 nt, Human
ccaccacacccagccc

SEQ ID NO: 3825713 - RNA, 15 nt, Human
ccaccacagccagca

SEQ ID NO: 3825714 - RNA, 17 nt, Human
ccaccaccaauugccaa

SEQ ID NO: 3825715 - RNA, 14 nt, Human
ccaccaccccagcu

SEQ ID NO: 3825716 - RNA, 20 nt, Human
ccaccaccccccacucugug

SEQ ID NO: 3825717 - RNA, 24 nt, Human
ccaccaccccccacucugugccug

SEQ ID NO: 3825718 - RNA, 13 nt, Human
ccaccaccccuac

SEQ ID NO: 3825719 - RNA, 17 nt, Human
ccaccacuaggacucug

SEQ ID NO: 3825720 - RNA, 19 nt, Human
ccaccacuggccaccaggc

SEQ ID NO: 3825721 - RNA, 15 nt, Human
ccaccagaagcccag

SEQ ID NO: 3825722 - RNA, 23 nt, Human
ccaccagacugacaaauguguau

SEQ ID NO: 3825723 - RNA, 16 nt, Human
ccaccagcucugccgu

SEQ ID NO: 3825724 - RNA, 14 nt, Human
ccaccagcuguguc

SEQ ID NO: 3825725 - RNA, 16 nt, Human
ccaccaggaaccucuu

SEQ ID NO: 3825726 - RNA, 13 nt, Human
ccaccaggagaac

SEQ ID NO: 3825727 - RNA, 14 nt, Human
ccaccaggagaacc

SEQ ID NO: 3825728 - RNA, 13 nt, Human
ccaccaggccacc

SEQ ID NO: 3825729 - RNA, 20 nt, Human
ccaccaggcugcucagggcu

SEQ ID NO: 3825730 - RNA, 19 nt, Human
ccaccaggcuggcgcagcc

SEQ ID NO: 3825731 - RNA, 23 nt, Human
ccaccaggcuggcgcagccaagg

SEQ ID NO: 3825732 - RNA, 13 nt, Human
ccaccaggucucc

SEQ ID NO: 3825733 - RNA, 17 nt, Human
ccaccaggucucccggg

SEQ ID NO: 3825734 - RNA, 13 nt, Human
ccaccagugccuc

SEQ ID NO: 3825735 - RNA, 14 nt, Human
ccaccagugccucu

SEQ ID NO: 3825736 - RNA, 15 nt, Human
ccaccagugccucuc

SEQ ID NO: 3825737 - RNA, 20 nt, Human
ccaccagugccucucccugc

SEQ ID NO: 3825738 - RNA, 12 nt, Human
ccaccaguucuc

SEQ ID NO: 3825739 - RNA, 18 nt, Human
ccaccauauucagugcug

SEQ ID NO: 3825740 - RNA, 13 nt, Human
ccaccaucaagcc

SEQ ID NO: 3825741 - RNA, 15 nt, Human
ccaccaucaagccac

SEQ ID NO: 3825742 - RNA, 15 nt, Human
ccaccauccugcagc

SEQ ID NO: 3825743 - RNA, 13 nt, Human
ccaccaucugcug

SEQ ID NO: 3825744 - RNA, 16 nt, Human
ccaccauggccagcua

SEQ ID NO: 3825745 - RNA, 23 nt, Human
ccaccauggcuaaggcaccagcc

SEQ ID NO: 3825746 - RNA, 19 nt, Human
ccaccaugggguccuacca

SEQ ID NO: 3825747 - RNA, 14 nt, Human
ccaccaugucugcc

SEQ ID NO: 3825748 - RNA, 14 nt, Human
ccaccauuccugga

SEQ ID NO: 3825749 - RNA, 15 nt, Human
ccaccauuccuggaa

SEQ ID NO: 3825750 - RNA, 22 nt, Human
ccaccauuuggcaucccugggc

SEQ ID NO: 3825751 - RNA, 16 nt, Human
ccacccaaagcagugg

SEQ ID NO: 3825752 - RNA, 17 nt, Human
ccacccaagcaggaggc

SEQ ID NO: 3825753 - RNA, 14 nt, Human
ccacccaagcuugg

SEQ ID NO: 3825754 - RNA, 15 nt, Human
ccacccaagcuuggc

SEQ ID NO: 3825755 - RNA, 16 nt, Human
ccacccaagcuuggca

SEQ ID NO: 3825756 - RNA, 20 nt, Human
ccacccaagggccuggccug

SEQ ID NO: 3825757 - RNA, 16 nt, Human
ccacccaccucagccu

SEQ ID NO: 3825758 - RNA, 15 nt, Human
ccacccacuucccug

SEQ ID NO: 3825759 - RNA, 17 nt, Human
ccacccagaggcagcag

SEQ ID NO: 3825760 - RNA, 12 nt, Human
ccacccagccca

SEQ ID NO: 3825761 - RNA, 21 nt, Human
ccacccaggagccccgaggcc

SEQ ID NO: 3825762 - RNA, 23 nt, Human
ccacccaggagccccgaggccuu

SEQ ID NO: 3825763 - RNA, 14 nt, Human
ccacccaucgcugu

SEQ ID NO: 3825764 - RNA, 17 nt, Human
ccaccccaagagaacuc

SEQ ID NO: 3825765 - RNA, 17 nt, Human
ccaccccacccccuuca

SEQ ID NO: 3825766 - RNA, 19 nt, Human
ccaccccagaaauggugaa

SEQ ID NO: 3825767 - RNA, 18 nt, Human
ccaccccagcugcucccc

SEQ ID NO: 3825768 - RNA, 18 nt, Human
ccaccccagggcagccag

SEQ ID NO: 3825769 - RNA, 12 nt, Human
ccaccccaugcu

SEQ ID NO: 3825770 - RNA, 13 nt, Human
ccaccccauggcc

SEQ ID NO: 3825771 - RNA, 13 nt, Human
ccagcuuuucaaa

SEQ ID NO: 3825772 - RNA, 16 nt, Human
ccagcuuuuccucccu

SEQ ID NO: 3825773 - RNA, 14 nt, Human
ccaggaaaaagaac

SEQ ID NO: 3825774 - RNA, 19 nt, Human
ccaggaaacuccacaucug

SEQ ID NO: 3825775 - RNA, 21 nt, Human
ccaggaaacuccacaucugcc

SEQ ID NO: 3825776 - RNA, 23 nt, Human
ccaggaaacucugcauucuagua

SEQ ID NO: 3825777 - RNA, 15 nt, Human
ccaggaaacucuugc

SEQ ID NO: 3825778 - RNA, 19 nt, Human
ccaggaaaggauuuuauaa

SEQ ID NO: 3825779 - RNA, 17 nt, Human
ccaggaaaggcuccagg

SEQ ID NO: 3825780 - RNA, 22 nt, Human
ccaggaaaggcuccaggagcag

SEQ ID NO: 3825781 - RNA, 13 nt, Human
ccaggaacaagcu

SEQ ID NO: 3825782 - RNA, 21 nt, Human
ccaggaacaaucgauggccuu

SEQ ID NO: 3825783 - RNA, 22 nt, Human
ccaggaacacccgacuccucaa

SEQ ID NO: 3825784 - RNA, 18 nt, Human
ccaggaacagcaaaugca

SEQ ID NO: 3825785 - RNA, 24 nt, Human
ccaggaaccacaccacaucuaagc

SEQ ID NO: 3825786 - RNA, 14 nt, Human
ccaggaaccuccuc

SEQ ID NO: 3825787 - RNA, 17 nt, Human
ccaggaagaucccccag

SEQ ID NO: 3825788 - RNA, 18 nt, Human
ccaggaagaucccccaga

SEQ ID NO: 3825789 - RNA, 10 nt, Human
ccaggaagcc

SEQ ID NO: 3825790 - RNA, 14 nt, Human
ccaggaagccagca

SEQ ID NO: 3825791 - RNA, 16 nt, Human
ccaguuaauuuuucca

SEQ ID NO: 3825792 - RNA, 13 nt, Human
ccaguucacccug

SEQ ID NO: 3825793 - RNA, 14 nt, Human
ccaguucaggaguc

SEQ ID NO: 3825794 - RNA, 17 nt, Human
ccaguucaguaccugga

SEQ ID NO: 3825795 - RNA, 21 nt, Human
ccaguucaguaccuggaggag

SEQ ID NO: 3825796 - RNA, 23 nt, Human
ccaguucaguaccuggaggagga

SEQ ID NO: 3825797 - RNA, 15 nt, Human
ccaguuccucuuuug

SEQ ID NO: 3825798 - RNA, 23 nt, Human
ccaguuccuuucaaugguuugca

SEQ ID NO: 3825799 - RNA, 19 nt, Human
ccaguucgccuggagcccu

SEQ ID NO: 3825800 - RNA, 15 nt, Human
ccaguucugcuccuc

SEQ ID NO: 3825801 - RNA, 17 nt, Human
ccaguucugcuccucuc

SEQ ID NO: 3825802 - RNA, 20 nt, Human
ccaguucugcuccucuccag

SEQ ID NO: 3825803 - RNA, 21 nt, Human
ccaguucugcuccucuccagg

SEQ ID NO: 3825804 - RNA, 19 nt, Human
ccaguucuucgacuguugu

SEQ ID NO: 3825805 - RNA, 17 nt, Human
ccaguugaauaaaagug

SEQ ID NO: 3825806 - RNA, 18 nt, Human
ccaguugaauaaaagugc

SEQ ID NO: 3825807 - RNA, 20 nt, Human
ccaguugcacuuggccucug

SEQ ID NO: 3825808 - RNA, 17 nt, Human
ccaguugggagcacugg

SEQ ID NO: 3825809 - RNA, 17 nt, Human
ccaguuggguggaugcc

SEQ ID NO: 3825810 - RNA, 20 nt, Human
ccaguuggguggaugccugg

SEQ ID NO: 3825811 - RNA, 13 nt, Human
ccaguuggucccc

SEQ ID NO: 3825812 - RNA, 20 nt, Human
ccaguuggucccccuuccau

SEQ ID NO: 3825813 - RNA, 12 nt, Human
ccaguuguccuc

SEQ ID NO: 3825814 - RNA, 13 nt, Human
ccaguuguccucc

SEQ ID NO: 3825815 - RNA, 15 nt, Human
ccaguuguccuccuu

SEQ ID NO: 3825816 - RNA, 16 nt, Human
ccaguuguccuccuuc

SEQ ID NO: 3825817 - RNA, 10 nt, Human
ccaguugugg

SEQ ID NO: 3825818 - RNA, 17 nt, Human
ccaguuuaaccugaugc

SEQ ID NO: 3825819 - RNA, 21 nt, Human
ccaguuucuaaacuggagacu

SEQ ID NO: 3825820 - RNA, 14 nt, Human
ccaguuucugccuc

SEQ ID NO: 3825821 - RNA, 15 nt, Human
ccaguuucugccucu

SEQ ID NO: 3825822 - RNA, 14 nt, Human
ccaguuugcagaaa

SEQ ID NO: 3825823 - RNA, 16 nt, Human
ccaguuuuguuuggac

SEQ ID NO: 3825824 - RNA, 14 nt, Human
ccaguuuuuauuaa

SEQ ID NO: 3825825 - RNA, 12 nt, Human
ccauaaaacauu

SEQ ID NO: 3825826 - RNA, 20 nt, Human
aaagaugguaucauauauuu

SEQ ID NO: 3825827 - RNA, 23 nt, Human
aaagaugguguggguguccugcc

SEQ ID NO: 3825828 - RNA, 15 nt, Human
aaagauucauuuuua

SEQ ID NO: 3825829 - RNA, 20 nt, Human
aaagauucauuuuuaaucau

SEQ ID NO: 3825830 - RNA, 12 nt, Human
aaagauucuaua

SEQ ID NO: 3825831 - RNA, 18 nt, Human
aaagauucuauaguucua

SEQ ID NO: 3825832 - RNA, 22 nt, Human
aaagauucugaccuuaaaugca

SEQ ID NO: 3825833 - RNA, 17 nt, Human
aaagauucuuuuucuga

SEQ ID NO: 3825834 - RNA, 17 nt, Human
aaagauugcugaaaaag

SEQ ID NO: 3825835 - RNA, 15 nt, Human
aaagauuguauugcu

SEQ ID NO: 3825836 - RNA, 17 nt, Human
aaagauuuaagcacaaa

SEQ ID NO: 3825837 - RNA, 15 nt, Human
aaagauuuucagaaa

SEQ ID NO: 3825838 - RNA, 21 nt, Human
aaagauuuucagaaaauauua

SEQ ID NO: 3825839 - RNA, 13 nt, Human
aaagauuuuuuaa

SEQ ID NO: 3825840 - RNA, 21 nt, Human
aaagauuuuuuaauaauuuag

SEQ ID NO: 3825841 - RNA, 19 nt, Human
aaagauuuuuuuuaaucua

SEQ ID NO: 3825842 - RNA, 16 nt, Human
aaagcaaaaaagaaaa

SEQ ID NO: 3825843 - RNA, 16 nt, Human
aaagcaaaaagugaug

SEQ ID NO: 3825844 - RNA, 13 nt, Human
aaagcaaaaaugc

SEQ ID NO: 3825845 - RNA, 19 nt, Human
aaagcaaaaaugcuaauau

SEQ ID NO: 3825846 - RNA, 14 nt, Human
aaagcaaaacaaaa

SEQ ID NO: 3825847 - RNA, 13 nt, Human
aaagcaaaaggca

SEQ ID NO: 3825848 - RNA, 18 nt, Human
aaagcaaaauaaaaacua

SEQ ID NO: 3825849 - RNA, 23 nt, Human
aaagcaaacuuaagaaacacuga

SEQ ID NO: 3825850 - RNA, 17 nt, Human
aaagcaaagcacagaga

SEQ ID NO: 3825851 - RNA, 13 nt, Human
aaagcaaaggaga

SEQ ID NO: 3825852 - RNA, 15 nt, Human
aaagcaacaaagaaa

SEQ ID NO: 3825853 - RNA, 19 nt, Human
aaagcaacugucuauuucu

SEQ ID NO: 3825854 - RNA, 21 nt, Human
aaagcaacuguuaugaaauaa

SEQ ID NO: 3825855 - RNA, 20 nt, Human
aaagcaagcauucagaagaa

SEQ ID NO: 3825856 - RNA, 22 nt, Human
aaagcaagcauucagaagaaaa

SEQ ID NO: 3825857 - RNA, 22 nt, Human
aaagcaauaauggucccaucca

SEQ ID NO: 3825858 - RNA, 23 nt, Human
aaagcaauaauggucccauccag

SEQ ID NO: 3825859 - RNA, 16 nt, Human
aaagcaauagaaacaa

SEQ ID NO: 3825860 - RNA, 12 nt, Human
aaagcaauauug

SEQ ID NO: 3825861 - RNA, 13 nt, Human
aaagcaaugcauu

SEQ ID NO: 3825862 - RNA, 15 nt, Human
aaagcaauuccaacc

SEQ ID NO: 3825863 - RNA, 15 nt, Human
aaagcaauuuuccuu

SEQ ID NO: 3825864 - RNA, 14 nt, Human
aaagcacaguguua

SEQ ID NO: 3825865 - RNA, 17 nt, Human
aaagcaccaaaauaaga

SEQ ID NO: 3825866 - RNA, 18 nt, Human
aaagcaccaaaauaagaa

SEQ ID NO: 3825867 - RNA, 12 nt, Human
aaagcaccugcc

SEQ ID NO: 3825868 - RNA, 19 nt, Human
aaagcacgaaauguuauuu

SEQ ID NO: 3825869 - RNA, 17 nt, Human
aaagcacgacaguggau

SEQ ID NO: 3825870 - RNA, 22 nt, Human
aaagcacuagagaaugcacaga

SEQ ID NO: 3825871 - RNA, 22 nt, Human
aaagcacuccucccugauguac

SEQ ID NO: 3825872 - RNA, 19 nt, Human
aaagcacuuggacucuugc

SEQ ID NO: 3825873 - RNA, 15 nt, Human
aaagcagagauuuuc

SEQ ID NO: 3825874 - RNA, 23 nt, Human
aaagcagaggcuggccucagacu

SEQ ID NO: 3825875 - RNA, 12 nt, Human
aaagcagccacg

SEQ ID NO: 3825876 - RNA, 18 nt, Human
aaagcagcccuuggccag

SEQ ID NO: 3825877 - RNA, 22 nt, Human
aaagcagcguuucuaugacaca

SEQ ID NO: 3825878 - RNA, 18 nt, Human
aaagcagcucaaaggcac

SEQ ID NO: 3825879 - RNA, 15 nt, Human
aaagcagcucucccc

SEQ ID NO: 3825880 - RNA, 17 nt, Human
aaagcagggaauuucua

SEQ ID NO: 3825881 - RNA, 20 nt, Human
aaagcaggggaguaugcaaa

SEQ ID NO: 3825882 - RNA, 21 nt, Human
aaagcaggggaguaugcaaaa

SEQ ID NO: 3825883 - RNA, 21 nt, Human
aaagcaggggcuacaagaggg

SEQ ID NO: 3825884 - RNA, 15 nt, Human
aaagcagguucuugu

SEQ ID NO: 3825885 - RNA, 16 nt, Human
aaagcagguucuuguu

SEQ ID NO: 3825886 - RNA, 21 nt, Human
aaagcagguugauaaaucauu

SEQ ID NO: 3825887 - RNA, 17 nt, Human
aaagcaguaacugacaa

SEQ ID NO: 3825888 - RNA, 16 nt, Human
aaagcaguauuuuucu

SEQ ID NO: 3825889 - RNA, 16 nt, Human
aaagcagugcaugcug

SEQ ID NO: 3825890 - RNA, 17 nt, Human
aaagcagugcaugcugu

SEQ ID NO: 3825891 - RNA, 16 nt, Human
aaagcauaaaaacauu

SEQ ID NO: 3825892 - RNA, 22 nt, Human
aaagcauaaagcucaaaugaaa

SEQ ID NO: 3825893 - RNA, 17 nt, Human
aaagcauacaugcaaaa

SEQ ID NO: 3825894 - RNA, 15 nt, Human
aaagcaucccucacc

SEQ ID NO: 3825895 - RNA, 13 nt, Human
aaagcaugaaugg

SEQ ID NO: 3825896 - RNA, 14 nt, Human
aaagcaugaauggu

SEQ ID NO: 3825897 - RNA, 17 nt, Human
aaagcaugccaauuucu

SEQ ID NO: 3825898 - RNA, 12 nt, Human
aaagcauguaca

SEQ ID NO: 3825899 - RNA, 16 nt, Human
aaagcauguuuugcau

SEQ ID NO: 3825900 - RNA, 22 nt, Human
aaagcauuaauuuuuuuucauu

SEQ ID NO: 3825901 - RNA, 18 nt, Human
aaagcauuccaacaaagg

SEQ ID NO: 3825902 - RNA, 14 nt, Human
aaagcauugcuguu

SEQ ID NO: 3825903 - RNA, 17 nt, Human
aaagcauugcuuuuauu

SEQ ID NO: 3825904 - RNA, 21 nt, Human
aaagcauugcuuuuauuuuga

SEQ ID NO: 3825905 - RNA, 23 nt, Human
aaagcauuuaaccccccuguaca

SEQ ID NO: 3825906 - RNA, 15 nt, Human
aaagcauuugaaugc

SEQ ID NO: 3825907 - RNA, 23 nt, Human
aaagcauuugaaugcauuuuguu

SEQ ID NO: 3825908 - RNA, 21 nt, Human
aaagcauuuuguaauaauaaa

SEQ ID NO: 3825909 - RNA, 13 nt, Human
aaagcauuuuuca

SEQ ID NO: 3825910 - RNA, 15 nt, Human
aaagccaaacauaua

SEQ ID NO: 3825911 - RNA, 15 nt, Human
aaagccaaagcuagg

SEQ ID NO: 3825912 - RNA, 20 nt, Human
aaagccaaaucaaaauaugu

SEQ ID NO: 3825913 - RNA, 23 nt, Human
aaagccaaggagucacugagacc

SEQ ID NO: 3825914 - RNA, 12 nt, Human
aaagccacccca

SEQ ID NO: 3825915 - RNA, 18 nt, Human
aaagccacguuccuuacu

SEQ ID NO: 3825916 - RNA, 19 nt, Human
aaagccagcugccgaccag

SEQ ID NO: 3825917 - RNA, 19 nt, Human
aaagccagggucucucccu

SEQ ID NO: 3825918 - RNA, 22 nt, Human
aaagccagggucucucccucag

SEQ ID NO: 3825919 - RNA, 13 nt, Human
aaagccagucuua

SEQ ID NO: 3825920 - RNA, 16 nt, Human
aaagccagugacucca

SEQ ID NO: 3825921 - RNA, 17 nt, Human
aaagccagugacuccag

SEQ ID NO: 3825922 - RNA, 16 nt, Human
aaagccaucauguaaa

SEQ ID NO: 3825923 - RNA, 14 nt, Human
aaagccauguuuaa

SEQ ID NO: 3825924 - RNA, 18 nt, Human
aaagccauguuuaagauu

SEQ ID NO: 3825925 - RNA, 17 nt, Human
aaagccauguuuauuac

SEQ ID NO: 3825926 - RNA, 17 nt, Human
aaagccauucugauuau

SEQ ID NO: 3825927 - RNA, 18 nt, Human
aaagcccaaagugguaua

SEQ ID NO: 3825928 - RNA, 15 nt, Human
aaagcccaaccucuu

SEQ ID NO: 3825929 - RNA, 20 nt, Human
aaagcccaaccucuuccucc

SEQ ID NO: 3825930 - RNA, 22 nt, Human
aaagcccaaccucuuccuccug

SEQ ID NO: 3825931 - RNA, 13 nt, Human
aaagcccaggagc

SEQ ID NO: 3825932 - RNA, 15 nt, Human
aaagccccaugcugg

SEQ ID NO: 3825933 - RNA, 18 nt, Human
aaagccccaugcuggagc

SEQ ID NO: 3825934 - RNA, 20 nt, Human
aaagccccaugcuggagccu

SEQ ID NO: 3825935 - RNA, 21 nt, Human
aaagcccccagagcccaggcu

SEQ ID NO: 3825936 - RNA, 16 nt, Human
cagaagaauauucagg

SEQ ID NO: 3825937 - RNA, 19 nt, Human
cagaagaauauucaggacu

SEQ ID NO: 3825938 - RNA, 19 nt, Human
cagaagacacugcaaaggc

SEQ ID NO: 3825939 - RNA, 20 nt, Human
cagaagaguugugcacgcag

SEQ ID NO: 3825940 - RNA, 18 nt, Human
cagaagaugaacagacug

SEQ ID NO: 3825941 - RNA, 20 nt, Human
cagaagcaacccaaauguuc

SEQ ID NO: 3825942 - RNA, 22 nt, Human
cagaagcaagggggugauguag

SEQ ID NO: 3825943 - RNA, 14 nt, Human
cagaagcagcucuu

SEQ ID NO: 3825944 - RNA, 15 nt, Human
cagaagcauuuguau

SEQ ID NO: 3825945 - RNA, 23 nt, Human
cagaagccaaucuacaaucucuu

SEQ ID NO: 3825946 - RNA, 16 nt, Human
cagaagccaggagcaa

SEQ ID NO: 3825947 - RNA, 17 nt, Human
cagaagccaggagcaaa

SEQ ID NO: 3825948 - RNA, 15 nt, Human
cagaagccucuggcu

SEQ ID NO: 3825949 - RNA, 16 nt, Human
cagaagccucuggguc

SEQ ID NO: 3825950 - RNA, 15 nt, Human
cagaagccugaggcu

SEQ ID NO: 3825951 - RNA, 12 nt, Human
cagaagccuggg

SEQ ID NO: 3825952 - RNA, 20 nt, Human
cagaagccugggggccuggc

SEQ ID NO: 3825953 - RNA, 21 nt, Human
cagaagccugggggccuggcu

SEQ ID NO: 3825954 - RNA, 24 nt, Human
cagaagccugggggccuggcuggc

SEQ ID NO: 3825955 - RNA, 17 nt, Human
cagaagcucccccagca

SEQ ID NO: 3825956 - RNA, 16 nt, Human
cagaagcuucugccca

SEQ ID NO: 3825957 - RNA, 17 nt, Human
cagaaggaaaaaugugu

SEQ ID NO: 3825958 - RNA, 20 nt, Human
cagaaggaaaaauguguaau

SEQ ID NO: 3825959 - RNA, 16 nt, Human
cagaaggaagacuuca

SEQ ID NO: 3825960 - RNA, 17 nt, Human
cagaaggaagacuucau

SEQ ID NO: 3825961 - RNA, 20 nt, Human
cagaaggaaggcagggagga

SEQ ID NO: 3825962 - RNA, 21 nt, Human
cagaaggaagggcauccuucu

SEQ ID NO: 3825963 - RNA, 14 nt, Human
cagaaggagaagga

SEQ ID NO: 3825964 - RNA, 18 nt, Human
cagaaggagaaggaagga

SEQ ID NO: 3825965 - RNA, 22 nt, Human
cagaaggagacaggcagagcug

SEQ ID NO: 3825966 - RNA, 14 nt, Human
cagaaggaggagga

SEQ ID NO: 3825967 - RNA, 20 nt, Human
cagaaggauuuuuuaaaguu

SEQ ID NO: 3825968 - RNA, 18 nt, Human
cagaaggcaaacccauca

SEQ ID NO: 3825969 - RNA, 18 nt, Human
cagaaggcaaaugacuuu

SEQ ID NO: 3825970 - RNA, 23 nt, Human
cagaaggcauaucagucucugag

SEQ ID NO: 3825971 - RNA, 14 nt, Human
cagaaggccaagaa

SEQ ID NO: 3825972 - RNA, 18 nt, Human
cagaaggccaagaaucaa

SEQ ID NO: 3825973 - RNA, 19 nt, Human
cagaaggcuccugccccca

SEQ ID NO: 3825974 - RNA, 17 nt, Human
cagaaggcucuucugac

SEQ ID NO: 3825975 - RNA, 13 nt, Human
cagaagggaaaca

SEQ ID NO: 3825976 - RNA, 14 nt, Human
cagaagggaaacag

SEQ ID NO: 3825977 - RNA, 19 nt, Human
cagaagggacuucacgaag

SEQ ID NO: 3825978 - RNA, 12 nt, Human
cagaagggagca

SEQ ID NO: 3825979 - RNA, 20 nt, Human
cagaagggagcuagccagag

SEQ ID NO: 3825980 - RNA, 21 nt, Human
cagaagggagcuggcuccagc

SEQ ID NO: 3825981 - RNA, 15 nt, Human
cagaagggaggcugg

SEQ ID NO: 3825982 - RNA, 15 nt, Human
cagaagggagggcag

SEQ ID NO: 3825983 - RNA, 22 nt, Human
cagaagggagggcagagcuggu

SEQ ID NO: 3825984 - RNA, 17 nt, Human
cagaaggggacugccac

SEQ ID NO: 3825985 - RNA, 21 nt, Human
cagaaggggacugccaccucc

SEQ ID NO: 3825986 - RNA, 23 nt, Human
cagaaggggacugccaccucccc

SEQ ID NO: 3825987 - RNA, 15 nt, Human
cagaaggggagggga

SEQ ID NO: 3825988 - RNA, 16 nt, Human
cagaagggggccauga

SEQ ID NO: 3825989 - RNA, 21 nt, Human
cagaaggggguggugucucca

SEQ ID NO: 3825990 - RNA, 14 nt, Human
ccaucucaggccag

SEQ ID NO: 3825991 - RNA, 18 nt, Human
ccaucuccaagaaugcug

SEQ ID NO: 3825992 - RNA, 18 nt, Human
ccaucuccacccccagcu

SEQ ID NO: 3825993 - RNA, 15 nt, Human
ccaucucccacccug

SEQ ID NO: 3825994 - RNA, 16 nt, Human
ccaucucccacccugu

SEQ ID NO: 3825995 - RNA, 15 nt, Human
ccaucuccccucagc

SEQ ID NO: 3825996 - RNA, 16 nt, Human
ccaucuccccucagcu

SEQ ID NO: 3825997 - RNA, 14 nt, Human
ccaucucccugccu

SEQ ID NO: 3825998 - RNA, 12 nt, Human
ccaucucccugg

SEQ ID NO: 3825999 - RNA, 16 nt, Human
ccaucucccuggugcu

SEQ ID NO: 3826000 - RNA, 17 nt, Human
ccaucucccuggugcuu

SEQ ID NO: 3826001 - RNA, 19 nt, Human
ccaucucccuggugcuuau

SEQ ID NO: 3826002 - RNA, 20 nt, Human
ccaucucccuggugcuuaug

SEQ ID NO: 3826003 - RNA, 23 nt, Human
ccaucuccuauaaucugucaaaa

SEQ ID NO: 3826004 - RNA, 16 nt, Human
ccaucuccuugucuuu

SEQ ID NO: 3826005 - RNA, 16 nt, Human
ccaucuccuuucaggg

SEQ ID NO: 3826006 - RNA, 18 nt, Human
ccaucucugauuuucaaa

SEQ ID NO: 3826007 - RNA, 23 nt, Human
ccaucucugauuuucaaagcuuu

SEQ ID NO: 3826008 - RNA, 14 nt, Human
ccaucucugcucca

SEQ ID NO: 3826009 - RNA, 18 nt, Human
ccaucucuggaugccuga

SEQ ID NO: 3826010 - RNA, 17 nt, Human
ccaucugaaagugguac

SEQ ID NO: 3826011 - RNA, 12 nt, Human
ccaucugcaccc

SEQ ID NO: 3826012 - RNA, 20 nt, Human
ccaucugcaccccccugggc

SEQ ID NO: 3826013 - RNA, 14 nt, Human
ccaucugcaccccu

SEQ ID NO: 3826014 - RNA, 22 nt, Human
ccaucugcaccccuucucuccu

SEQ ID NO: 3826015 - RNA, 15 nt, Human
ccaucugcccaggac

SEQ ID NO: 3826016 - RNA, 16 nt, Human
ccaucugcccaggacg

SEQ ID NO: 3826017 - RNA, 17 nt, Human
ccaucugcccaggggug

SEQ ID NO: 3826018 - RNA, 16 nt, Human
ccaucugccccacagu

SEQ ID NO: 3826019 - RNA, 20 nt, Human
ccaucugcccgccugcccac

SEQ ID NO: 3826020 - RNA, 23 nt, Human
ccaucugcccgccugcccaccug

SEQ ID NO: 3826021 - RNA, 20 nt, Human
ccaucugcgugacaauaaaa

SEQ ID NO: 3826022 - RNA, 23 nt, Human
ccaucugcgugacaauaaaacau

SEQ ID NO: 3826023 - RNA, 14 nt, Human
ccaucugcuccugg

SEQ ID NO: 3826024 - RNA, 12 nt, Human
ccaucuggagag

SEQ ID NO: 3826025 - RNA, 16 nt, Human
ccaucuggcagggugg

SEQ ID NO: 3826026 - RNA, 13 nt, Human
ccaucuggccugg

SEQ ID NO: 3826027 - RNA, 18 nt, Human
ccaucuggccuggccugg

SEQ ID NO: 3826028 - RNA, 22 nt, Human
ccaucugggcuccuaaccuucc

SEQ ID NO: 3826029 - RNA, 22 nt, Human
ccaucuggguccuugcaccccu

SEQ ID NO: 3826030 - RNA, 16 nt, Human
ccaucuggucauuugg

SEQ ID NO: 3826031 - RNA, 16 nt, Human
ccaucugguuuucucu

SEQ ID NO: 3826032 - RNA, 16 nt, Human
ccaucuguacuugguc

SEQ ID NO: 3826033 - RNA, 14 nt, Human
ccaucugucccugc

SEQ ID NO: 3826034 - RNA, 15 nt, Human
ccaucugucugccaa

SEQ ID NO: 3826035 - RNA, 13 nt, Human
ccaucugugcauu

SEQ ID NO: 3826036 - RNA, 14 nt, Human
ccaucugugcauuc

SEQ ID NO: 3826037 - RNA, 13 nt, Human
ccaucuucccagc

SEQ ID NO: 3826038 - RNA, 18 nt, Human
ccaucuucgggaccagga

SEQ ID NO: 3826039 - RNA, 20 nt, Human
ccaucuucgggaccaggauu

SEQ ID NO: 3826040 - RNA, 21 nt, Human
ccaucuugcccgcucaggcug

SEQ ID NO: 3826041 - RNA, 20 nt, Human
ccaucuugcuucccuaaucu

SEQ ID NO: 3826042 - RNA, 13 nt, Human
ccaucuugguaaa

SEQ ID NO: 3826043 - RNA, 17 nt, Human
ccaucuugguaaauuuc

SEQ ID NO: 3826044 - RNA, 17 nt, Human
ccaucuuuacucccaag

SEQ ID NO: 3826045 - RNA, 14 nt, Human
ccaucuuucuuugg

SEQ ID NO: 3826046 - RNA, 10 nt, Human
ccaugaaaga

SEQ ID NO: 3826047 - RNA, 22 nt, Human
ccaugaacacacuguguccugg

SEQ ID NO: 3826048 - RNA, 16 nt, Human
ccaugaacagaaaaca

SEQ ID NO: 3826049 - RNA, 15 nt, Human
ccaugaaccaagacc

SEQ ID NO: 3826050 - RNA, 18 nt, Human
ccaugaacuggaggccag

SEQ ID NO: 3826051 - RNA, 13 nt, Human
ccaugaagacagg

SEQ ID NO: 3826052 - RNA, 15 nt, Human
ccaugaagacaggau

SEQ ID NO: 3826053 - RNA, 14 nt, Human
ccaugaagauguag

SEQ ID NO: 3826054 - RNA, 19 nt, Human
ccaugaagccacagcccag

SEQ ID NO: 3826055 - RNA, 12 nt, Human
ccaugaagccuu

SEQ ID NO: 3826056 - RNA, 14 nt, Human
ccaugaagccuuuu

SEQ ID NO: 3826057 - RNA, 16 nt, Human
ccaugaagccuuuuga

SEQ ID NO: 3826058 - RNA, 18 nt, Human
ccaugaagggacccuuug

SEQ ID NO: 3826059 - RNA, 16 nt, Human
ccaugaaucaaagaca

SEQ ID NO: 3826060 - RNA, 17 nt, Human
ccaugaaucaaagacau

SEQ ID NO: 3826061 - RNA, 19 nt, Human
ccaugaauguaucaggaaa

SEQ ID NO: 3826062 - RNA, 20 nt, Human
ccaugacaggccugaagaua

SEQ ID NO: 3826063 - RNA, 23 nt, Human
ccaugaccagaagggaaacaguc

SEQ ID NO: 3826064 - RNA, 14 nt, Human
ccaugaccauacug

SEQ ID NO: 3826065 - RNA, 19 nt, Human
ccaugacccaccccugugc

SEQ ID NO: 3826066 - RNA, 14 nt, Human
ccaugacccaggcu

SEQ ID NO: 3826067 - RNA, 17 nt, Human
ccaugacccaggcuggg

SEQ ID NO: 3826068 - RNA, 15 nt, Human
ccaugacccugccuc

SEQ ID NO: 3826069 - RNA, 16 nt, Human
ccaugacccugccucu

SEQ ID NO: 3826070 - RNA, 19 nt, Human
ccaugacccugccucuccc

SEQ ID NO: 3826071 - RNA, 22 nt, Human
ccaugaccuccagcuuuccugu

SEQ ID NO: 3826072 - RNA, 17 nt, Human
ccaugacugcauuuuac

SEQ ID NO: 3826073 - RNA, 15 nt, Human
ccaugagacccuggu

SEQ ID NO: 3826074 - RNA, 23 nt, Human
ccaugagacccuggugccuggcu

SEQ ID NO: 3826075 - RNA, 15 nt, Human
ccaugagagcgcagc

SEQ ID NO: 3826076 - RNA, 21 nt, Human
ccaugagccucagcauccugg

SEQ ID NO: 3826077 - RNA, 13 nt, Human
ccaugagcuccag

SEQ ID NO: 3826078 - RNA, 12 nt, Human
ccaugagcuccu

SEQ ID NO: 3826079 - RNA, 17 nt, Human
ccaugaggaaggaacag

SEQ ID NO: 3826080 - RNA, 19 nt, Human
ccaugagggagaugccaug

SEQ ID NO: 3826081 - RNA, 16 nt, Human
ccaugugagcugcugc

SEQ ID NO: 3826082 - RNA, 15 nt, Human
ccaugugccucuuug

SEQ ID NO: 3826083 - RNA, 16 nt, Human
ccaugugccucuuugu

SEQ ID NO: 3826084 - RNA, 24 nt, Human
ccauguggaaggcaagccaggcuc

SEQ ID NO: 3826085 - RNA, 17 nt, Human
ccauguggugaugaugu

SEQ ID NO: 3826086 - RNA, 19 nt, Human
ccaugugucacuugugcuu

SEQ ID NO: 3826087 - RNA, 14 nt, Human
ccauguguccuggu

SEQ ID NO: 3826088 - RNA, 19 nt, Human
ccaugugugugcaagugug

SEQ ID NO: 3826089 - RNA, 23 nt, Human
ccauguucuauuucagugccaau

SEQ ID NO: 3826090 - RNA, 16 nt, Human
ccauguucugccccca

SEQ ID NO: 3826091 - RNA, 15 nt, Human
ccauguucugucccu

SEQ ID NO: 3826092 - RNA, 13 nt, Human
ccauguugccccu

SEQ ID NO: 3826093 - RNA, 13 nt, Human
ccauguuggccag

SEQ ID NO: 3826094 - RNA, 15 nt, Human
ccauguuggccaggc

SEQ ID NO: 3826095 - RNA, 18 nt, Human
ccauguuggccaggcugg

SEQ ID NO: 3826096 - RNA, 23 nt, Human
ccauguuggccaggcuggucuca

SEQ ID NO: 3826097 - RNA, 22 nt, Human
ccauguugguugcacuuuguag

SEQ ID NO: 3826098 - RNA, 18 nt, Human
ccauguuguaaugcugca

SEQ ID NO: 3826099 - RNA, 22 nt, Human
ccauguuguaaugcugcacuuc

SEQ ID NO: 3826100 - RNA, 22 nt, Human
ccauguugugccucccugguga

SEQ ID NO: 3826101 - RNA, 14 nt, Human
ccauguuuaagauu

SEQ ID NO: 3826102 - RNA, 17 nt, Human
ccauguuuaagauuuaa

SEQ ID NO: 3826103 - RNA, 14 nt, Human
ccauguuucucugg

SEQ ID NO: 3826104 - RNA, 16 nt, Human
ccauguuugagcucag

SEQ ID NO: 3826105 - RNA, 17 nt, Human
ccauguuugagcucaga

SEQ ID NO: 3826106 - RNA, 13 nt, Human
ccauguuuguaaa

SEQ ID NO: 3826107 - RNA, 18 nt, Human
ccauguuuuguuuacggu

SEQ ID NO: 3826108 - RNA, 15 nt, Human
ccauuaaaacugaag

SEQ ID NO: 3826109 - RNA, 21 nt, Human
ccauuaaaacugaagucugaa

SEQ ID NO: 3826110 - RNA, 23 nt, Human
ccauuaaaacugaagucugaaau

SEQ ID NO: 3826111 - RNA, 16 nt, Human
ccauuaaaacugcuuu

SEQ ID NO: 3826112 - RNA, 18 nt, Human
ccauuaaaauaugcacua

SEQ ID NO: 3826113 - RNA, 12 nt, Human
ccauuaaagaau

SEQ ID NO: 3826114 - RNA, 14 nt, Human
ccauuaaagaauau

SEQ ID NO: 3826115 - RNA, 18 nt, Human
ccauuaaagaauaugaaa

SEQ ID NO: 3826116 - RNA, 15 nt, Human
ccauuaaaguucuca

SEQ ID NO: 3826117 - RNA, 19 nt, Human
ccauuaaaugaauauuuug

SEQ ID NO: 3826118 - RNA, 20 nt, Human
ccauuaaggggaagaaugaa

SEQ ID NO: 3826119 - RNA, 20 nt, Human
ccauuaaguaaacaauaaaa

SEQ ID NO: 3826120 - RNA, 14 nt, Human
ccauuaccaaaaua

SEQ ID NO: 3826121 - RNA, 17 nt, Human
ccauuagccagauuugu

SEQ ID NO: 3826122 - RNA, 19 nt, Human
ccauuagcuuucaauuccg

SEQ ID NO: 3826123 - RNA, 13 nt, Human
ccauuaggccagc

SEQ ID NO: 3826124 - RNA, 14 nt, Human
ccauuaggccagca

SEQ ID NO: 3826125 - RNA, 20 nt, Human
ccauuaggccagcaacgcuu

SEQ ID NO: 3826126 - RNA, 14 nt, Human
ccauuaucaugugu

SEQ ID NO: 3826127 - RNA, 21 nt, Human
ccauuaucccugaaucccccu

SEQ ID NO: 3826128 - RNA, 11 nt, Human
ccauuauucaa

SEQ ID NO: 3826129 - RNA, 17 nt, Human
ccauuauucaaaguugc

SEQ ID NO: 3826130 - RNA, 14 nt, Human
ccauuauuuucugu

SEQ ID NO: 3826131 - RNA, 17 nt, Human
ccauuauuuucugucag

SEQ ID NO: 3826132 - RNA, 18 nt, Human
ccauuauuuuuaggaugu

SEQ ID NO: 3826133 - RNA, 17 nt, Human
ccauucacucuuccaga

SEQ ID NO: 3826134 - RNA, 15 nt, Human
ccauucaggaaccug

SEQ ID NO: 3826135 - RNA, 17 nt, Human
ccauucaggaaccugga

SEQ ID NO: 3826136 - RNA, 21 nt, Human
ccauucaggaaccuggaccaa

SEQ ID NO: 3826137 - RNA, 20 nt, Human
ccauucagugauuacuguca

SEQ ID NO: 3826138 - RNA, 15 nt, Human
ccauuccaaaauauu

SEQ ID NO: 3826139 - RNA, 21 nt, Human
ccauuccaaaauauuaugccc

SEQ ID NO: 3826140 - RNA, 20 nt, Human
ccauuccaggcagccucugu

SEQ ID NO: 3826141 - RNA, 21 nt, Human
ccauuccaggcagccucuguc

SEQ ID NO: 3826142 - RNA, 17 nt, Human
ccauuccauuuaucuuu

SEQ ID NO: 3826143 - RNA, 16 nt, Human
ccauuccccagccucu

SEQ ID NO: 3826144 - RNA, 18 nt, Human
ccauuccccagccucucu

SEQ ID NO: 3826145 - RNA, 12 nt, Human
ccauucccuggg

SEQ ID NO: 3826146 - RNA, 16 nt, Human
ccauuccugaagaacc

SEQ ID NO: 3826147 - RNA, 16 nt, Human
ccauuccuggagcccg

SEQ ID NO: 3826148 - RNA, 17 nt, Human
ccauuccugguacccag

SEQ ID NO: 3826149 - RNA, 13 nt, Human
ccauuccuuccca

SEQ ID NO: 3826150 - RNA, 15 nt, Human
ccauucgugaaaaca

SEQ ID NO: 3826151 - RNA, 14 nt, Human
ccauucuacacaga

SEQ ID NO: 3826152 - RNA, 21 nt, Human
ccagcagucaauuaacaauaa

SEQ ID NO: 3826153 - RNA, 19 nt, Human
ccagcaguucagagcugcc

SEQ ID NO: 3826154 - RNA, 22 nt, Human
ccagcaguugaaugacaacaga

SEQ ID NO: 3826155 - RNA, 23 nt, Human
ccagcauaauacuugcuuuggaa

SEQ ID NO: 3826156 - RNA, 14 nt, Human
ccagcaucaccugc

SEQ ID NO: 3826157 - RNA, 14 nt, Human
ccagcaucacuccc

SEQ ID NO: 3826158 - RNA, 21 nt, Human
ccagcaucccuugaccaggcc

SEQ ID NO: 3826159 - RNA, 18 nt, Human
ccagcaucgcacucuggc

SEQ ID NO: 3826160 - RNA, 14 nt, Human
ccagcaucugggcc

SEQ ID NO: 3826161 - RNA, 16 nt, Human
ccagcauuccagcccc

SEQ ID NO: 3826162 - RNA, 18 nt, Human
ccagcauuccagccccuc

SEQ ID NO: 3826163 - RNA, 19 nt, Human
ccagcauuccagccccucu

SEQ ID NO: 3826164 - RNA, 17 nt, Human
ccagcauucccagguag

SEQ ID NO: 3826165 - RNA, 21 nt, Human
ccagcauucccagguaggcca

SEQ ID NO: 3826166 - RNA, 14 nt, Human
ccagcauucucagg

SEQ ID NO: 3826167 - RNA, 20 nt, Human
ccagcauucucaggcaccag

SEQ ID NO: 3826168 - RNA, 19 nt, Human
ccagcauuuagcuggccac

SEQ ID NO: 3826169 - RNA, 16 nt, Human
ccagcauuucccuucc

SEQ ID NO: 3826170 - RNA, 14 nt, Human
ccagcauuugggua

SEQ ID NO: 3826171 - RNA, 16 nt, Human
ccagccaaacacacag

SEQ ID NO: 3826172 - RNA, 21 nt, Human
ccagccaaacacacagaaggg

SEQ ID NO: 3826173 - RNA, 19 nt, Human
ccagccaaccccuguggag

SEQ ID NO: 3826174 - RNA, 22 nt, Human
ccagccaccccgggcucucugc

SEQ ID NO: 3826175 - RNA, 16 nt, Human
ccagccacuccccagc

SEQ ID NO: 3826176 - RNA, 22 nt, Human
ccagccacuccccagccagccu

SEQ ID NO: 3826177 - RNA, 15 nt, Human
ccagccacucuacca

SEQ ID NO: 3826178 - RNA, 22 nt, Human
ccagccagaacguggcucugcu

SEQ ID NO: 3826179 - RNA, 20 nt, Human
ccagccagaggcaucugagg

SEQ ID NO: 3826180 - RNA, 16 nt, Human
ccagccagcagcagcc

SEQ ID NO: 3826181 - RNA, 19 nt, Human
ccagccagcagcagcccaa

SEQ ID NO: 3826182 - RNA, 19 nt, Human
ccagccagcagccagcucu

SEQ ID NO: 3826183 - RNA, 11 nt, Human
ccagccagcca

SEQ ID NO: 3826184 - RNA, 21 nt, Human
ccagccaggcagguccacaga

SEQ ID NO: 3826185 - RNA, 14 nt, Human
ccagccaggcccag

SEQ ID NO: 3826186 - RNA, 16 nt, Human
ccagccaggcccagcc

SEQ ID NO: 3826187 - RNA, 14 nt, Human
ccagccaggcucug

SEQ ID NO: 3826188 - RNA, 15 nt, Human
ccagccaggcucugu

SEQ ID NO: 3826189 - RNA, 15 nt, Human
ccagccagggcugcu

SEQ ID NO: 3826190 - RNA, 18 nt, Human
ccagccaucaaaaugcuu

SEQ ID NO: 3826191 - RNA, 18 nt, Human
ccagccaucaagagacug

SEQ ID NO: 3826192 - RNA, 15 nt, Human
ccagccaucugccca

SEQ ID NO: 3826193 - RNA, 17 nt, Human
ccagccaucugcccagg

SEQ ID NO: 3826194 - RNA, 14 nt, Human
ccagccaugccagc

SEQ ID NO: 3826195 - RNA, 17 nt, Human
ccagccaugucugcauu

SEQ ID NO: 3826196 - RNA, 18 nt, Human
ccagccaugucugcauuu

SEQ ID NO: 3826197 - RNA, 21 nt, Human
ccagccauuaccauggagaca

SEQ ID NO: 3826198 - RNA, 12 nt, Human
ccagcccaaagg

SEQ ID NO: 3826199 - RNA, 13 nt, Human
ccagcccaagucc

SEQ ID NO: 3826200 - RNA, 14 nt, Human
ccagcccaagucca

SEQ ID NO: 3826201 - RNA, 12 nt, Human
ccagcccaaucc

SEQ ID NO: 3826202 - RNA, 12 nt, Human
ccagcccacauu

SEQ ID NO: 3826203 - RNA, 18 nt, Human
ccagcccaccccauggcc

SEQ ID NO: 3826204 - RNA, 13 nt, Human
ccagcccaccccc

SEQ ID NO: 3826205 - RNA, 18 nt, Human
ccagcccacccccggcag

SEQ ID NO: 3826206 - RNA, 21 nt, Human
ccagcccacccccggcagcag

SEQ ID NO: 3826207 - RNA, 13 nt, Human
ccagcccacccuc

SEQ ID NO: 3826208 - RNA, 13 nt, Human
ccagcccagagac

SEQ ID NO: 3826209 - RNA, 22 nt, Human
ccagcccagagacauacuugaa

SEQ ID NO: 3826210 - RNA, 23 nt, Human
ccagcccagagacauacuugaag

SEQ ID NO: 3826211 - RNA, 13 nt, Human
ccagcccagaggc

SEQ ID NO: 3826212 - RNA, 17 nt, Human
ccagcccagauugucuu

SEQ ID NO: 3826213 - RNA, 18 nt, Human
ccagcccagcccagcugg

SEQ ID NO: 3826214 - RNA, 16 nt, Human
ccagcccagcugcucu

SEQ ID NO: 3826215 - RNA, 13 nt, Human
ccagcccagggcu

SEQ ID NO: 3826216 - RNA, 21 nt, Human
ccagcccagggcuccugcacu

SEQ ID NO: 3826217 - RNA, 12 nt, Human
ccagcccagggu

SEQ ID NO: 3826218 - RNA, 22 nt, Human
ccagcccauccauuaggccagc

SEQ ID NO: 3826219 - RNA, 20 nt, Human
ccagcccaucucggagcauc

SEQ ID NO: 3826220 - RNA, 18 nt, Human
ccagcccaucuugccucc

SEQ ID NO: 3826221 - RNA, 17 nt, Human
ccagcccauucucucuc

SEQ ID NO: 3826222 - RNA, 17 nt, Human
ccagcccauuugggcag

SEQ ID NO: 3826223 - RNA, 22 nt, Human
ccagcccauuugggcagagagg

SEQ ID NO: 3826224 - RNA, 19 nt, Human
ccagccccaaaacucuccu

SEQ ID NO: 3826225 - RNA, 15 nt, Human
ccagccccacacagc

SEQ ID NO: 3826226 - RNA, 20 nt, Human
ccaggcuguaucccaugagc

SEQ ID NO: 3826227 - RNA, 15 nt, Human
ccaggcugugcagcg

SEQ ID NO: 3826228 - RNA, 21 nt, Human
ccaggcuuagucacugagaca

SEQ ID NO: 3826229 - RNA, 18 nt, Human
ccaggcuucugcuggggc

SEQ ID NO: 3826230 - RNA, 17 nt, Human
ccaggcuugccugcagg

SEQ ID NO: 3826231 - RNA, 18 nt, Human
ccaggcuugccugcaggc

SEQ ID NO: 3826232 - RNA, 14 nt, Human
ccagggaagcagca

SEQ ID NO: 3826233 - RNA, 18 nt, Human
ccagggaagcagcagccu

SEQ ID NO: 3826234 - RNA, 18 nt, Human
ccagggaagugcucugau

SEQ ID NO: 3826235 - RNA, 21 nt, Human
ccagggacacacagccuagca

SEQ ID NO: 3826236 - RNA, 21 nt, Human
ccagggacaccagccaggcuc

SEQ ID NO: 3826237 - RNA, 23 nt, Human
ccagggacaccagccaggcucug

SEQ ID NO: 3826238 - RNA, 22 nt, Human
ccagggacagaggccccagccu

SEQ ID NO: 3826239 - RNA, 14 nt, Human
ccagggacagaggg

SEQ ID NO: 3826240 - RNA, 23 nt, Human
ccagggacagaggggguggccuc

SEQ ID NO: 3826241 - RNA, 19 nt, Human
ccagggacagauccagcag

SEQ ID NO: 3826242 - RNA, 14 nt, Human
ccagggaccggcgg

SEQ ID NO: 3826243 - RNA, 13 nt, Human
ccagggagaagcu

SEQ ID NO: 3826244 - RNA, 15 nt, Human
ccagggagaagcucc

SEQ ID NO: 3826245 - RNA, 22 nt, Human
ccagggagaccuggacacaggc

SEQ ID NO: 3826246 - RNA, 14 nt, Human
ccagggagagccca

SEQ ID NO: 3826247 - RNA, 18 nt, Human
ccagggagagcccaggag

SEQ ID NO: 3826248 - RNA, 20 nt, Human
ccagggagagcccaggagcu

SEQ ID NO: 3826249 - RNA, 22 nt, Human
ccagggagagggggcugguggg

SEQ ID NO: 3826250 - RNA, 18 nt, Human
ccagggagccuuugguuc

SEQ ID NO: 3826251 - RNA, 18 nt, Human
ccagggagcggaaagcag

SEQ ID NO: 3826252 - RNA, 20 nt, Human
ccagggagcggaaagcagcu

SEQ ID NO: 3826253 - RNA, 23 nt, Human
ccagggagcggaaagcagcucaa

SEQ ID NO: 3826254 - RNA, 13 nt, Human
ccagggagcugca

SEQ ID NO: 3826255 - RNA, 14 nt, Human
ccagggaggggccg

SEQ ID NO: 3826256 - RNA, 21 nt, Human
ccagggaugauucaagccauu

SEQ ID NO: 3826257 - RNA, 17 nt, Human
ccagggauggggccaca

SEQ ID NO: 3826258 - RNA, 19 nt, Human
ccagggauggggccacagc

SEQ ID NO: 3826259 - RNA, 21 nt, Human
ccagggauggggccacagcca

SEQ ID NO: 3826260 - RNA, 22 nt, Human
ccagggauggggccacagccag

SEQ ID NO: 3826261 - RNA, 22 nt, Human
ccagggcaagcuccgcaggacu

SEQ ID NO: 3826262 - RNA, 15 nt, Human
ccagggcacaggagc

SEQ ID NO: 3826263 - RNA, 17 nt, Human
ccagggcacaggagcua

SEQ ID NO: 3826264 - RNA, 22 nt, Human
ccagggcacaggagcuaccugu

SEQ ID NO: 3826265 - RNA, 15 nt, Human
ccagggcaccaagcc

SEQ ID NO: 3826266 - RNA, 20 nt, Human
ccagggcagccagggagagc

SEQ ID NO: 3826267 - RNA, 17 nt, Human
ccagggcagugcuagug

SEQ ID NO: 3826268 - RNA, 22 nt, Human
ccagggcagugcuagugagcug

SEQ ID NO: 3826269 - RNA, 23 nt, Human
ccagggcagugcuagugagcugg

SEQ ID NO: 3826270 - RNA, 15 nt, Human
ccagggcaucucugg

SEQ ID NO: 3826271 - RNA, 16 nt, Human
ccagggcaucucuggg

SEQ ID NO: 3826272 - RNA, 13 nt, Human
ccagggccaaaag

SEQ ID NO: 3826273 - RNA, 16 nt, Human
ccagggccacgcucca

SEQ ID NO: 3826274 - RNA, 21 nt, Human
ccagggccacgugccaggccc

SEQ ID NO: 3826275 - RNA, 22 nt, Human
ccagggccacgugccaggcccg

SEQ ID NO: 3826276 - RNA, 15 nt, Human
ccagggccagccucu

SEQ ID NO: 3826277 - RNA, 16 nt, Human
ccagggccagggcccu

SEQ ID NO: 3826278 - RNA, 17 nt, Human
ccagggccagggcccug

SEQ ID NO: 3826279 - RNA, 18 nt, Human
ccagggccaugaacuuug

SEQ ID NO: 3826280 - RNA, 16 nt, Human
ccagggccaugucaga

SEQ ID NO: 3826281 - RNA, 16 nt, Human
ccagggcccagagccc

SEQ ID NO: 3826282 - RNA, 22 nt, Human
ccagggcccagagcccagcucc

SEQ ID NO: 3826283 - RNA, 17 nt, Human
ccagggcccaggcaaau

SEQ ID NO: 3826284 - RNA, 15 nt, Human
ccagggcccugagcu

SEQ ID NO: 3826285 - RNA, 14 nt, Human
ccagggcccugcag

SEQ ID NO: 3826286 - RNA, 17 nt, Human
ccagggccugagccugg

SEQ ID NO: 3826287 - RNA, 19 nt, Human
ccagggccugagccuggcc

SEQ ID NO: 3826288 - RNA, 23 nt, Human
ccagggccugcaggaccugccug

SEQ ID NO: 3826289 - RNA, 13 nt, Human
ccagggccugcga

SEQ ID NO: 3826290 - RNA, 14 nt, Human
ccagggccugcgag

SEQ ID NO: 3826291 - RNA, 20 nt, Human
ccagggccuggaagacagag

SEQ ID NO: 3826292 - RNA, 20 nt, Human
ccagggccuuuucuggcacc

SEQ ID NO: 3826293 - RNA, 16 nt, Human
ccagggcuagugacuu

SEQ ID NO: 3826294 - RNA, 13 nt, Human
ccagggcucagcc

SEQ ID NO: 3826295 - RNA, 16 nt, Human
ccagggcucagccugg

SEQ ID NO: 3826296 - RNA, 14 nt, Human
ccagggcuccagcc

SEQ ID NO: 3826297 - RNA, 17 nt, Human
ccagggcuccagccccu

SEQ ID NO: 3826298 - RNA, 13 nt, Human
ccagggcuccugc

SEQ ID NO: 3826299 - RNA, 20 nt, Human
ccagggcuccugcacuuacu

SEQ ID NO: 3826300 - RNA, 17 nt, Human
ccagggcucugccccag

SEQ ID NO: 3826301 - RNA, 19 nt, Human
ccagggcucugccccaguc

SEQ ID NO: 3826302 - RNA, 16 nt, Human
ccagggcugcccugag

SEQ ID NO: 3826303 - RNA, 19 nt, Human
ccagggcugcccugagaag

SEQ ID NO: 3826304 - RNA, 15 nt, Human
ccagggcugggagga

SEQ ID NO: 3826305 - RNA, 19 nt, Human
ccagggcugggaggaagga

SEQ ID NO: 3826306 - RNA, 22 nt, Human
ccagggcuggggcagccucugg

SEQ ID NO: 3826307 - RNA, 19 nt, Human
ccagggcuguaacugccag

SEQ ID NO: 3826308 - RNA, 21 nt, Human
ccagggcuuaccuguacacug

SEQ ID NO: 3826309 - RNA, 16 nt, Human
ccaggggaaccugcca

SEQ ID NO: 3826310 - RNA, 17 nt, Human
ccaggggaaccugccau

SEQ ID NO: 3826311 - RNA, 18 nt, Human
ccaggggaccacaccucc

SEQ ID NO: 3826312 - RNA, 18 nt, Human
ccaggggagagggucugg

SEQ ID NO: 3826313 - RNA, 20 nt, Human
ccaggggagagggucuggag

SEQ ID NO: 3826314 - RNA, 15 nt, Human
ccaggggagcagagg

SEQ ID NO: 3826315 - RNA, 16 nt, Human
ccaggggaguuguguc

SEQ ID NO: 3826316 - RNA, 23 nt, Human
ccaggggcagccccaggccaaag

SEQ ID NO: 3826317 - RNA, 18 nt, Human
ccaggggcaggcacagca

SEQ ID NO: 3826318 - RNA, 21 nt, Human
ccaggggcauguauuggccug

SEQ ID NO: 3826319 - RNA, 22 nt, Human
ccaggggcauguauuggccugg

SEQ ID NO: 3826320 - RNA, 23 nt, Human
ccaggggcauguauuggccugga

SEQ ID NO: 3826321 - RNA, 15 nt, Human
ccaggggccaugaau

SEQ ID NO: 3826322 - RNA, 19 nt, Human
ccaggggcccacagggaac

SEQ ID NO: 3826323 - RNA, 14 nt, Human
ccaggggccccucc

SEQ ID NO: 3826324 - RNA, 17 nt, Human
ccaggggccccuccagc

SEQ ID NO: 3826325 - RNA, 18 nt, Human
ccaggggccccuccagcu

SEQ ID NO: 3826326 - RNA, 20 nt, Human
ccaggggccccuccagcuug

SEQ ID NO: 3826327 - RNA, 23 nt, Human
ccaggggccuuugggugcuguuu

SEQ ID NO: 3826328 - RNA, 22 nt, Human
ccaggggcucccuccgccccca

SEQ ID NO: 3826329 - RNA, 20 nt, Human
ccaggggcugcuuccuccug

SEQ ID NO: 3826330 - RNA, 22 nt, Human
ccaggggcugcuuccuccugga

SEQ ID NO: 3826331 - RNA, 23 nt, Human
ccagggggccagucccugaggca

SEQ ID NO: 3826332 - RNA, 23 nt, Human
ccagggggcuuccugaggggaga

SEQ ID NO: 3826333 - RNA, 23 nt, Human
ccaggggggacaauaugugccaa

SEQ ID NO: 3826334 - RNA, 17 nt, Human
ccaggggggugaggagc

SEQ ID NO: 3826335 - RNA, 14 nt, Human
ccaggggucccagc

SEQ ID NO: 3826336 - RNA, 17 nt, Human
ccaggggucccagccac

SEQ ID NO: 3826337 - RNA, 21 nt, Human
ccaggggucucccuggcuccc

SEQ ID NO: 3826338 - RNA, 20 nt, Human
ccaggggugauuucagagag

SEQ ID NO: 3826339 - RNA, 21 nt, Human
ccaggggugauuucagagagg

SEQ ID NO: 3826340 - RNA, 16 nt, Human
ccaggggugcccccuc

SEQ ID NO: 3826341 - RNA, 17 nt, Human
ccaggggugcccccucc

SEQ ID NO: 3826342 - RNA, 19 nt, Human
ccaggggugcccccuccuc

SEQ ID NO: 3826343 - RNA, 14 nt, Human
ccaggggugggaca

SEQ ID NO: 3826344 - RNA, 23 nt, Human
ccaggggugggacacccugugau

SEQ ID NO: 3826345 - RNA, 13 nt, Human
ccagggguuucuc

SEQ ID NO: 3826346 - RNA, 22 nt, Human
ccaggguagcccgccugccagu

SEQ ID NO: 3826347 - RNA, 21 nt, Human
ccagggucacugaaggccugg

SEQ ID NO: 3826348 - RNA, 10 nt, Human
ccagggucag

SEQ ID NO: 3826349 - RNA, 17 nt, Human
ccagggucagaaacagg

SEQ ID NO: 3826350 - RNA, 18 nt, Human
ccagggucagaaacagga

SEQ ID NO: 3826351 - RNA, 14 nt, Human
ccaggguccuggga

SEQ ID NO: 3826352 - RNA, 14 nt, Human
ccagggucuucccu

SEQ ID NO: 3826353 - RNA, 15 nt, Human
ccagggugagagcug

SEQ ID NO: 3826354 - RNA, 12 nt, Human
cagagagaagcc

SEQ ID NO: 3826355 - RNA, 9 nt, Human
cagagagag

SEQ ID NO: 3826356 - RNA, 19 nt, Human
cagagagagaagugccccu

SEQ ID NO: 3826357 - RNA, 23 nt, Human
cagagagagaagugccccugcug

SEQ ID NO: 3826358 - RNA, 24 nt, Human
cagagagagaagugccccugcugc

SEQ ID NO: 3826359 - RNA, 19 nt, Human
cagagagagauacucuggg

SEQ ID NO: 3826360 - RNA, 22 nt, Human
cagagagaggggagaagccugg

SEQ ID NO: 3826361 - RNA, 17 nt, Human
cagagagcagugcuuuu

SEQ ID NO: 3826362 - RNA, 18 nt, Human
cagagagccauuuuguga

SEQ ID NO: 3826363 - RNA, 19 nt, Human
cagagagccauuuugugaa

SEQ ID NO: 3826364 - RNA, 19 nt, Human
cagagagccuggugcugcu

SEQ ID NO: 3826365 - RNA, 12 nt, Human
cagagagcuggu

SEQ ID NO: 3826366 - RNA, 13 nt, Human
cagagagcuggua

SEQ ID NO: 3826367 - RNA, 19 nt, Human
cagagagcugguaguuagu

SEQ ID NO: 3826368 - RNA, 20 nt, Human
cagagagcuuagccuggagc

SEQ ID NO: 3826369 - RNA, 16 nt, Human
ccagugcacuugcugg

SEQ ID NO: 3826370 - RNA, 20 nt, Human
ccagugcacuugcuggaaga

SEQ ID NO: 3826371 - RNA, 16 nt, Human
ccagugcaggcuggcc

SEQ ID NO: 3826372 - RNA, 18 nt, Human
ccagugcaggcuggccag

SEQ ID NO: 3826373 - RNA, 19 nt, Human
ccagugcaggcuggccagc

SEQ ID NO: 3826374 - RNA, 18 nt, Human
ccagugcaugguggccag

SEQ ID NO: 3826375 - RNA, 12 nt, Human
ccagugccaagg

SEQ ID NO: 3826376 - RNA, 13 nt, Human
ccagugccaagga

SEQ ID NO: 3826377 - RNA, 16 nt, Human
ccagugccaaggaccu

SEQ ID NO: 3826378 - RNA, 23 nt, Human
ccagugcccacaggaucagucug

SEQ ID NO: 3826379 - RNA, 16 nt, Human
ccagugcccccacuga

SEQ ID NO: 3826380 - RNA, 14 nt, Human
ccagugcccugagc

SEQ ID NO: 3826381 - RNA, 15 nt, Human
ccagugcccugagcc

SEQ ID NO: 3826382 - RNA, 17 nt, Human
ccagugcccugagccag

SEQ ID NO: 3826383 - RNA, 21 nt, Human
ccagugcccugagccaggguc

SEQ ID NO: 3826384 - RNA, 17 nt, Human
ccagugcccugauccca

SEQ ID NO: 3826385 - RNA, 11 nt, Human
ccagugccucu

SEQ ID NO: 3826386 - RNA, 16 nt, Human
ccagugccucucccug

SEQ ID NO: 3826387 - RNA, 19 nt, Human
ccagugccucucccugcug

SEQ ID NO: 3826388 - RNA, 21 nt, Human
ccagugccucucccugcugcu

SEQ ID NO: 3826389 - RNA, 19 nt, Human
ccagugccuuaccuccugc

SEQ ID NO: 3826390 - RNA, 14 nt, Human
ccagugcggcaggu

SEQ ID NO: 3826391 - RNA, 15 nt, Human
ccagugcggcagguu

SEQ ID NO: 3826392 - RNA, 12 nt, Human
ccagugcugaau

SEQ ID NO: 3826393 - RNA, 21 nt, Human
ccagugcuguccaugcuucuc

SEQ ID NO: 3826394 - RNA, 14 nt, Human
ccaguggauuccca

SEQ ID NO: 3826395 - RNA, 13 nt, Human
ccaguggcagggc

SEQ ID NO: 3826396 - RNA, 14 nt, Human
ccaguggcagggca

SEQ ID NO: 3826397 - RNA, 17 nt, Human
ccaguggccacucagcu

SEQ ID NO: 3826398 - RNA, 16 nt, Human
ccaguggccucaaccc

SEQ ID NO: 3826399 - RNA, 23 nt, Human
ccaguggccucaacccucccuca

SEQ ID NO: 3826400 - RNA, 15 nt, Human
ccaguggccuggcuc

SEQ ID NO: 3826401 - RNA, 19 nt, Human
ccaguggcugcugcccagg

SEQ ID NO: 3826402 - RNA, 15 nt, Human
ccagugggaggggca

SEQ ID NO: 3826403 - RNA, 16 nt, Human
ccagugggaggggcag

SEQ ID NO: 3826404 - RNA, 20 nt, Human
ccagugggaggugagaccac

SEQ ID NO: 3826405 - RNA, 23 nt, Human
ccagugggaggugagaccaccuc

SEQ ID NO: 3826406 - RNA, 17 nt, Human
ccaguggggccugugga

SEQ ID NO: 3826407 - RNA, 16 nt, Human
ccaguguaauccccca

SEQ ID NO: 3826408 - RNA, 20 nt, Human
ccaguguaaucccccaggag

SEQ ID NO: 3826409 - RNA, 12 nt, Human
ccaguguacaua

SEQ ID NO: 3826410 - RNA, 15 nt, Human
ccaguguagccuugc

SEQ ID NO: 3826411 - RNA, 17 nt, Human
ccaguguccuccccuca

SEQ ID NO: 3826412 - RNA, 19 nt, Human
ccaguguccugagcucagc

SEQ ID NO: 3826413 - RNA, 22 nt, Human
ccaguguccugagcucagcgug

SEQ ID NO: 3826414 - RNA, 14 nt, Human
ccagugucuuccug

SEQ ID NO: 3826415 - RNA, 15 nt, Human
ccagugucuuucuuu

SEQ ID NO: 3826416 - RNA, 19 nt, Human
ccagugugcugaugggcgu

SEQ ID NO: 3826417 - RNA, 20 nt, Human
ccagugugggcuugaccagg

SEQ ID NO: 3826418 - RNA, 22 nt, Human
ccagugugggguucugcuggga

SEQ ID NO: 3826419 - RNA, 18 nt, Human
ccaguguguggcuuucag

SEQ ID NO: 3826420 - RNA, 21 nt, Human
ccaguguguggcuuucagagc

SEQ ID NO: 3826421 - RNA, 20 nt, Human
ccaguguuagggaagggccu

SEQ ID NO: 3826422 - RNA, 18 nt, Human
ccaguguucuaugaacaa

SEQ ID NO: 3826423 - RNA, 23 nt, Human
ccaguguuguuuguaaauaagag

SEQ ID NO: 3826424 - RNA, 19 nt, Human
ccaguguuuuaggagcaug

SEQ ID NO: 3826425 - RNA, 13 nt, Human
ccaguuaaggacc

SEQ ID NO: 3826426 - RNA, 19 nt, Human
ccaguuaaucuugcuuucu

SEQ ID NO: 3826427 - RNA, 17 nt, Human
ccaguuagccucugcag

SEQ ID NO: 3826428 - RNA, 21 nt, Human
ccaguuauggcuauaggugcu

SEQ ID NO: 3826429 - RNA, 20 nt, Human
ccaguuauuuuccgcccuca

SEQ ID NO: 3826430 - RNA, 22 nt, Human
ccaguuccuuucaaugguuugc

SEQ ID NO: 3826431 - RNA, 16 nt, Human
ccaguucugcuccucu

SEQ ID NO: 3826432 - RNA, 18 nt, Human
ccaguugaucaaugaaua

SEQ ID NO: 3826433 - RNA, 18 nt, Human
ccaguugcacucagguga

SEQ ID NO: 3826434 - RNA, 19 nt, Human
ccaguugcagucacucuag

SEQ ID NO: 3826435 - RNA, 19 nt, Human
ccaguuggagcuccagccu

SEQ ID NO: 3826436 - RNA, 22 nt, Human
ccaguuggagcuccagccugac

SEQ ID NO: 3826437 - RNA, 15 nt, Human
ccaguuggaguuuuu

SEQ ID NO: 3826438 - RNA, 23 nt, Human
ccaguuggaguuuuuuguaccaa

SEQ ID NO: 3826439 - RNA, 18 nt, Human
ccaguugggagcacugga

SEQ ID NO: 3826440 - RNA, 20 nt, Human
ccaguugggagcacuggagu

SEQ ID NO: 3826441 - RNA, 18 nt, Human
ccaguuggucccccuucc

SEQ ID NO: 3826442 - RNA, 23 nt, Human
ccaguuggucccccuuccaugga

SEQ ID NO: 3826443 - RNA, 18 nt, Human
ccaguuguauauuauucu

SEQ ID NO: 3826444 - RNA, 21 nt, Human
ccaguugucccgauuguaacu

SEQ ID NO: 3826445 - RNA, 22 nt, Human
ccaguugucccgauuguaacuc

SEQ ID NO: 3826446 - RNA, 21 nt, Human
ccaguuguuagauuaagaaau

SEQ ID NO: 3826447 - RNA, 18 nt, Human
ccaguuuaaccugaugca

SEQ ID NO: 3826448 - RNA, 17 nt, Human
ccaguuucuaaacugga

SEQ ID NO: 3826449 - RNA, 19 nt, Human
ccaguuuuguuuggaccaa

SEQ ID NO: 3826450 - RNA, 20 nt, Human
ccauaaaacauuaagaaaau

SEQ ID NO: 3826451 - RNA, 19 nt, Human
ccauaaagaagauguuuaa

SEQ ID NO: 3826452 - RNA, 17 nt, Human
ccauaaauccaguucua

SEQ ID NO: 3826453 - RNA, 17 nt, Human
ccauaagcuacugccau

SEQ ID NO: 3826454 - RNA, 21 nt, Human
ccauaagcuacugccauccug

SEQ ID NO: 3826455 - RNA, 22 nt, Human
ccauaagguuucguuucuguau

SEQ ID NO: 3826456 - RNA, 21 nt, Human
ccauaaucuggacuccucugu

SEQ ID NO: 3826457 - RNA, 21 nt, Human
ccauaaugcuacugucucacu

SEQ ID NO: 3826458 - RNA, 21 nt, Human
ccauaauuuucuucaugcaau

SEQ ID NO: 3826459 - RNA, 18 nt, Human
ccauacacacgcugccuu

SEQ ID NO: 3826460 - RNA, 20 nt, Human
ccauacacacgcugccuucg

SEQ ID NO: 3826461 - RNA, 17 nt, Human
ccauacacuuuguugca

SEQ ID NO: 3826462 - RNA, 14 nt, Human
ccauaccagcucgc

SEQ ID NO: 3826463 - RNA, 23 nt, Human
ccauaccuuccuucccugggcug

SEQ ID NO: 3826464 - RNA, 17 nt, Human
ccauacucugucucccu

SEQ ID NO: 3826465 - RNA, 21 nt, Human
ccauacuggccucgccuggcc

SEQ ID NO: 3826466 - RNA, 18 nt, Human
ccauagaaacaugacacu

SEQ ID NO: 3826467 - RNA, 20 nt, Human
ccauagaaacaugacacuga

SEQ ID NO: 3826468 - RNA, 16 nt, Human
ccauagaguacacugc

SEQ ID NO: 3826469 - RNA, 14 nt, Human
ccauagcaacagga

SEQ ID NO: 3826470 - RNA, 21 nt, Human
ccauagcaagauugcuuaaaa

SEQ ID NO: 3826471 - RNA, 15 nt, Human
ccauagcuccugcuc

SEQ ID NO: 3826472 - RNA, 18 nt, Human
ccauagcugcugcccuag

SEQ ID NO: 3826473 - RNA, 14 nt, Human
ccauaggcccacac

SEQ ID NO: 3826474 - RNA, 20 nt, Human
ccauaggcccacacacaggu

SEQ ID NO: 3826475 - RNA, 23 nt, Human
ccauaggcccacacacagguggu

SEQ ID NO: 3826476 - RNA, 12 nt, Human
ccauaggcccuu

SEQ ID NO: 3826477 - RNA, 14 nt, Human
ccauaggcccuuuc

SEQ ID NO: 3826478 - RNA, 15 nt, Human
ccauaguaccauuua

SEQ ID NO: 3826479 - RNA, 15 nt, Human
ccauaguauauuaaa

SEQ ID NO: 3826480 - RNA, 15 nt, Human
ccauagucuuaacug

SEQ ID NO: 3826481 - RNA, 18 nt, Human
ccauaguuacuguaaaau

SEQ ID NO: 3826482 - RNA, 15 nt, Human
ccauauaaguuugaa

SEQ ID NO: 3826483 - RNA, 13 nt, Human
ccauauagaaagc

SEQ ID NO: 3826484 - RNA, 14 nt, Human
ccauauauauauau

SEQ ID NO: 3826485 - RNA, 19 nt, Human
ccauauccauagugacuuu

SEQ ID NO: 3826486 - RNA, 23 nt, Human
ccauaucuugcgaauccaagcuc

SEQ ID NO: 3826487 - RNA, 12 nt, Human
ccauaugaauug

SEQ ID NO: 3826488 - RNA, 16 nt, Human
ccauaugcagaaauag

SEQ ID NO: 3826489 - RNA, 21 nt, Human
ccauaugccuuggggaggaca

SEQ ID NO: 3826490 - RNA, 22 nt, Human
ccauaugccuuggggaggacaa

SEQ ID NO: 3826491 - RNA, 21 nt, Human
ccauaugcuaccaccagcugu

SEQ ID NO: 3826492 - RNA, 12 nt, Human
ccauaugcuguu

SEQ ID NO: 3826493 - RNA, 14 nt, Human
ccauauguuacacu

SEQ ID NO: 3826494 - RNA, 22 nt, Human
ccauauuaaguaagucucaagg

SEQ ID NO: 3826495 - RNA, 19 nt, Human
ccauauuagaaaacuuugu

SEQ ID NO: 3826496 - RNA, 22 nt, Human
ccauauucagugcuguggccug

SEQ ID NO: 3826497 - RNA, 18 nt, Human
ccauauugcacaugucuu

SEQ ID NO: 3826498 - RNA, 14 nt, Human
ccauauuggccagu

SEQ ID NO: 3826499 - RNA, 16 nt, Human
ccauauuuaccucagc

SEQ ID NO: 3826500 - RNA, 20 nt, Human
ccauauuuaccucagccugg

SEQ ID NO: 3826501 - RNA, 14 nt, Human
ccauauuuagcagu

SEQ ID NO: 3826502 - RNA, 12 nt, Human
ccauauuuauuc

SEQ ID NO: 3826503 - RNA, 16 nt, Human
ccauauuuguaaaaug

SEQ ID NO: 3826504 - RNA, 20 nt, Human
ccauauuuguaaaaugacaa

SEQ ID NO: 3826505 - RNA, 11 nt, Human
ccauauuuuca

SEQ ID NO: 3826506 - RNA, 16 nt, Human
ccaucaaaaugcuuuu

SEQ ID NO: 3826507 - RNA, 19 nt, Human
ccaucaaauugaucugcag

SEQ ID NO: 3826508 - RNA, 17 nt, Human
ccaucaacaaaaauugu

SEQ ID NO: 3826509 - RNA, 13 nt, Human
ccaucaaccucug

SEQ ID NO: 3826510 - RNA, 13 nt, Human
ccaucaagccacc

SEQ ID NO: 3826511 - RNA, 18 nt, Human
ccaucaaggguacacugc

SEQ ID NO: 3826512 - RNA, 19 nt, Human
ccaucaauaaaaaauuaug

SEQ ID NO: 3826513 - RNA, 20 nt, Human
cagcauucuugucacaauaa

SEQ ID NO: 3826514 - RNA, 19 nt, Human
cagcauugauauuugugca

SEQ ID NO: 3826515 - RNA, 17 nt, Human
cagcauugcugguucua

SEQ ID NO: 3826516 - RNA, 16 nt, Human
cagcauugcuuucuga

SEQ ID NO: 3826517 - RNA, 12 nt, Human
cagcauuucaag

SEQ ID NO: 3826518 - RNA, 12 nt, Human
cagcauuucacu

SEQ ID NO: 3826519 - RNA, 15 nt, Human
cagcauuugauaaug

SEQ ID NO: 3826520 - RNA, 22 nt, Human
cagcauuugauaaugauaaaac

SEQ ID NO: 3826521 - RNA, 16 nt, Human
cagcauuugaucuguu

SEQ ID NO: 3826522 - RNA, 18 nt, Human
cagcauuuuacugauuca

SEQ ID NO: 3826523 - RNA, 18 nt, Human
cagcauuuuuauuucaga

SEQ ID NO: 3826524 - RNA, 23 nt, Human
cagccaaacacacagaaggggac

SEQ ID NO: 3826525 - RNA, 16 nt, Human
cagccaaacccaugag

SEQ ID NO: 3826526 - RNA, 15 nt, Human
cagccaaagccuccu

SEQ ID NO: 3826527 - RNA, 16 nt, Human
cagccaaagccuccuc

SEQ ID NO: 3826528 - RNA, 22 nt, Human
cagccaaauuuaaaacuguugg

SEQ ID NO: 3826529 - RNA, 19 nt, Human
cagccaacacgcaccugcc

SEQ ID NO: 3826530 - RNA, 20 nt, Human
cagccaacacgcaccugccu

SEQ ID NO: 3826531 - RNA, 22 nt, Human
cagccaacacgcaccugccuca

SEQ ID NO: 3826532 - RNA, 23 nt, Human
cagccaacacgcaccugccucag

SEQ ID NO: 3826533 - RNA, 18 nt, Human
cagccaacagcuacaaca

SEQ ID NO: 3826534 - RNA, 12 nt, Human
cagccaaccccu

SEQ ID NO: 3826535 - RNA, 14 nt, Human
cagccaaccccugu

SEQ ID NO: 3826536 - RNA, 18 nt, Human
cagccaaccccuguggag

SEQ ID NO: 3826537 - RNA, 21 nt, Human
cagccaaccccuguggagccc

SEQ ID NO: 3826538 - RNA, 16 nt, Human
cagccaacuagccccu

SEQ ID NO: 3826539 - RNA, 18 nt, Human
cagccaacuagccccugg

SEQ ID NO: 3826540 - RNA, 19 nt, Human
cagccaacuagccccuggg

SEQ ID NO: 3826541 - RNA, 22 nt, Human
cagccaacuagccccuggggug

SEQ ID NO: 3826542 - RNA, 13 nt, Human
cagccaacucauu

SEQ ID NO: 3826543 - RNA, 16 nt, Human
cagccaagauuuuccu

SEQ ID NO: 3826544 - RNA, 20 nt, Human
cagccaagauuuuccucuug

SEQ ID NO: 3826545 - RNA, 11 nt, Human
cagccaagcac

SEQ ID NO: 3826546 - RNA, 17 nt, Human
cagccaagcacaguggu

SEQ ID NO: 3826547 - RNA, 23 nt, Human
cagccaagcacagugguggcagg

SEQ ID NO: 3826548 - RNA, 22 nt, Human
cagccaagucgguuaguggaag

SEQ ID NO: 3826549 - RNA, 20 nt, Human
cagccaagugccaaaugcuc

SEQ ID NO: 3826550 - RNA, 17 nt, Human
cagccaauuauguuaaa

SEQ ID NO: 3826551 - RNA, 17 nt, Human
cagccacacacacagaa

SEQ ID NO: 3826552 - RNA, 18 nt, Human
cagccacacacacagaaa

SEQ ID NO: 3826553 - RNA, 20 nt, Human
cagccacacacacagaaaau

SEQ ID NO: 3826554 - RNA, 12 nt, Human
cagccacacugu

SEQ ID NO: 3826555 - RNA, 18 nt, Human
cagccacacuucucagga

SEQ ID NO: 3826556 - RNA, 15 nt, Human
cagccacauuccuga

SEQ ID NO: 3826557 - RNA, 12 nt, Human
cagccaccagcg

SEQ ID NO: 3826558 - RNA, 22 nt, Human
cagccaccccgggcucucugcu

SEQ ID NO: 3826559 - RNA, 14 nt, Human
cagccacccugagg

SEQ ID NO: 3826560 - RNA, 19 nt, Human
cagccacccugaggagucu

SEQ ID NO: 3826561 - RNA, 22 nt, Human
cagccacccugaggagucugag

SEQ ID NO: 3826562 - RNA, 16 nt, Human
cagccacccugaguug

SEQ ID NO: 3826563 - RNA, 14 nt, Human
cagccacggccagg

SEQ ID NO: 3826564 - RNA, 15 nt, Human
cagccacggccaggc

SEQ ID NO: 3826565 - RNA, 17 nt, Human
cagccacggccaggcca

SEQ ID NO: 3826566 - RNA, 21 nt, Human
cagccacggccaggccagagg

SEQ ID NO: 3826567 - RNA, 22 nt, Human
cagccacggccaggccagaggg

SEQ ID NO: 3826568 - RNA, 23 nt, Human
cagccacggccaggccagaggga

SEQ ID NO: 3826569 - RNA, 23 nt, Human
cagccacucgggaggcugagaca

SEQ ID NO: 3826570 - RNA, 10 nt, Human
cagccacucu

SEQ ID NO: 3826571 - RNA, 21 nt, Human
cagccacuucggccaggucac

SEQ ID NO: 3826572 - RNA, 22 nt, Human
ccauuugaauuuuuuagugacu

SEQ ID NO: 3826573 - RNA, 17 nt, Human
ccauuugauuuuucuaa

SEQ ID NO: 3826574 - RNA, 12 nt, Human
ccauuugcauuu

SEQ ID NO: 3826575 - RNA, 13 nt, Human
ccauuugcuccuu

SEQ ID NO: 3826576 - RNA, 20 nt, Human
ccauuuguaaaacuccggau

SEQ ID NO: 3826577 - RNA, 12 nt, Human
ccauuuguaaua

SEQ ID NO: 3826578 - RNA, 18 nt, Human
ccauuuguaauaaaguau

SEQ ID NO: 3826579 - RNA, 20 nt, Human
ccauuuguaauaaaguauau

SEQ ID NO: 3826580 - RNA, 20 nt, Human
ccauuuguaauuaaauuaug

SEQ ID NO: 3826581 - RNA, 13 nt, Human
ccauuugucccaa

SEQ ID NO: 3826582 - RNA, 17 nt, Human
ccauuugucccaagugc

SEQ ID NO: 3826583 - RNA, 18 nt, Human
ccauuugucucuacuuuu

SEQ ID NO: 3826584 - RNA, 14 nt, Human
ccauuugugccaga

SEQ ID NO: 3826585 - RNA, 16 nt, Human
ccauuugugccagagg

SEQ ID NO: 3826586 - RNA, 21 nt, Human
ccauuuguguacacagucagc

SEQ ID NO: 3826587 - RNA, 14 nt, Human
ccauuuguguuuau

SEQ ID NO: 3826588 - RNA, 17 nt, Human
ccauuuguuaauaucac

SEQ ID NO: 3826589 - RNA, 12 nt, Human
ccauuuguuuau

SEQ ID NO: 3826590 - RNA, 16 nt, Human
ccauuuuaagucccug

SEQ ID NO: 3826591 - RNA, 18 nt, Human
ccauuuuagucacuuuuu

SEQ ID NO: 3826592 - RNA, 22 nt, Human
ccauuuuauaaagugcuugugu

SEQ ID NO: 3826593 - RNA, 11 nt, Human
ccauuuuccug

SEQ ID NO: 3826594 - RNA, 13 nt, Human
ccauuuuccugca

SEQ ID NO: 3826595 - RNA, 16 nt, Human
ccauuuugcccuucca

SEQ ID NO: 3826596 - RNA, 19 nt, Human
ccauuuugcccuuccauag

SEQ ID NO: 3826597 - RNA, 20 nt, Human
ccauuuugcugucccuuuuc

SEQ ID NO: 3826598 - RNA, 22 nt, Human
ccauuuugggguacccacugcu

SEQ ID NO: 3826599 - RNA, 18 nt, Human
ccauuuuggugucuuucu

SEQ ID NO: 3826600 - RNA, 21 nt, Human
ccauuuuguauuuuacuaaua

SEQ ID NO: 3826601 - RNA, 14 nt, Human
ccauuuugugaagc

SEQ ID NO: 3826602 - RNA, 15 nt, Human
ccauuuugugaagcc

SEQ ID NO: 3826603 - RNA, 13 nt, Human
ccauuuugugaau

SEQ ID NO: 3826604 - RNA, 14 nt, Human
ccauuuuuacaagu

SEQ ID NO: 3826605 - RNA, 11 nt, Human
ccauuuuuccu

SEQ ID NO: 3826606 - RNA, 14 nt, Human
cccaaaacaaaguc

SEQ ID NO: 3826607 - RNA, 15 nt, Human
cccaaaaccacagcc

SEQ ID NO: 3826608 - RNA, 16 nt, Human
cccaaaacucuccucu

SEQ ID NO: 3826609 - RNA, 13 nt, Human
cccaaaaggcaga

SEQ ID NO: 3826610 - RNA, 18 nt, Human
cccaaaaggcagaagcaa

SEQ ID NO: 3826611 - RNA, 20 nt, Human
cccaaacaaauaugcaaaag

SEQ ID NO: 3826612 - RNA, 21 nt, Human
cccaaacaccuuccagcuccu

SEQ ID NO: 3826613 - RNA, 17 nt, Human
cccaaaccaccagaagc

SEQ ID NO: 3826614 - RNA, 18 nt, Human
cccaaaccaccagaagcc

SEQ ID NO: 3826615 - RNA, 13 nt, Human
cccaaaccuggag

SEQ ID NO: 3826616 - RNA, 16 nt, Human
cccaaacgcccuuucc

SEQ ID NO: 3826617 - RNA, 12 nt, Human
cccaaacuguga

SEQ ID NO: 3826618 - RNA, 23 nt, Human
cccaaacuguugauuauuagcca

SEQ ID NO: 3826619 - RNA, 21 nt, Human
cccaaagaauguuuauagcaa

SEQ ID NO: 3826620 - RNA, 18 nt, Human
cccaaagagccuggagaa

SEQ ID NO: 3826621 - RNA, 16 nt, Human
cccaaagagcugccua

SEQ ID NO: 3826622 - RNA, 17 nt, Human
cccaaagauagacaggu

SEQ ID NO: 3826623 - RNA, 21 nt, Human
cccaaagauagacagguccug

SEQ ID NO: 3826624 - RNA, 19 nt, Human
cccaaagcagcccuucccc

SEQ ID NO: 3826625 - RNA, 17 nt, Human
cccaaagcuuuccugcc

SEQ ID NO: 3826626 - RNA, 20 nt, Human
cccaaagcuuuccugcccca

SEQ ID NO: 3826627 - RNA, 17 nt, Human
cccaaaggaaaaagcac

SEQ ID NO: 3826628 - RNA, 21 nt, Human
cccaaaggaagcuuucucugc

SEQ ID NO: 3826629 - RNA, 15 nt, Human
cccaaaggacgcacu

SEQ ID NO: 3826630 - RNA, 23 nt, Human
cccaaaggauacuguaacacuuu

SEQ ID NO: 3826631 - RNA, 19 nt, Human
cccaaaggcuuugcccugc

SEQ ID NO: 3826632 - RNA, 20 nt, Human
cccaaaggggacaggccuca

SEQ ID NO: 3826633 - RNA, 22 nt, Human
cccaaaggggacaggccucacc

SEQ ID NO: 3826634 - RNA, 13 nt, Human
cccaaagggugug

SEQ ID NO: 3826635 - RNA, 13 nt, Human
cccaaagugcugg

SEQ ID NO: 3826636 - RNA, 10 nt, Human
cccaaagugg

SEQ ID NO: 3826637 - RNA, 23 nt, Human
cccaaaguuguuguaaccugcug

SEQ ID NO: 3826638 - RNA, 21 nt, Human
cccaaauaacuucaguccugc

SEQ ID NO: 3826639 - RNA, 16 nt, Human
cccaaaucaauacacu

SEQ ID NO: 3826640 - RNA, 14 nt, Human
cccaaaucugccua

SEQ ID NO: 3826641 - RNA, 19 nt, Human
cccaaaugugugcccagcu

SEQ ID NO: 3826642 - RNA, 19 nt, Human
cccaaauuaucaagcuaau

SEQ ID NO: 3826643 - RNA, 21 nt, Human
cccaaauugucaccugcuucu

SEQ ID NO: 3826644 - RNA, 17 nt, Human
cccaacaaaccauccag

SEQ ID NO: 3826645 - RNA, 13 nt, Human
cccaacaccucuu

SEQ ID NO: 3826646 - RNA, 18 nt, Human
cccaacacgcaggagcac

SEQ ID NO: 3826647 - RNA, 14 nt, Human
cccaacacugccag

SEQ ID NO: 3826648 - RNA, 13 nt, Human
cccaacacugugc

SEQ ID NO: 3826649 - RNA, 18 nt, Human
cccaacacugugcccugg

SEQ ID NO: 3826650 - RNA, 21 nt, Human
cccaacacugugcccuggugg

SEQ ID NO: 3826651 - RNA, 22 nt, Human
cccaacacugugcccuggugga

SEQ ID NO: 3826652 - RNA, 23 nt, Human
cccaacagcgacauagcccaucc

SEQ ID NO: 3826653 - RNA, 19 nt, Human
cccaacaggaggacaauuc

SEQ ID NO: 3826654 - RNA, 13 nt, Human
cccaacaguguga

SEQ ID NO: 3826655 - RNA, 14 nt, Human
cccaacccccaccc

SEQ ID NO: 3826656 - RNA, 13 nt, Human
cccaacccccagc

SEQ ID NO: 3826657 - RNA, 15 nt, Human
cccaacccccagcac

SEQ ID NO: 3826658 - RNA, 18 nt, Human
cccccuuucacaggcagc

SEQ ID NO: 3826659 - RNA, 12 nt, Human
cccccuuuccug

SEQ ID NO: 3826660 - RNA, 16 nt, Human
cccccuuugggcccag

SEQ ID NO: 3826661 - RNA, 18 nt, Human
cccccuuugggcccaggg

SEQ ID NO: 3826662 - RNA, 14 nt, Human
ccccgacgccacag

SEQ ID NO: 3826663 - RNA, 13 nt, Human
ccccgacuccagc

SEQ ID NO: 3826664 - RNA, 15 nt, Human
ccccgacuccagcca

SEQ ID NO: 3826665 - RNA, 16 nt, Human
ccccgacuccagccag

SEQ ID NO: 3826666 - RNA, 18 nt, Human
ccccgacuccagccagcg

SEQ ID NO: 3826667 - RNA, 13 nt, Human
ccccgacuggggc

SEQ ID NO: 3826668 - RNA, 16 nt, Human
ccccgacuucauccca

SEQ ID NO: 3826669 - RNA, 14 nt, Human
ccccgacuuuuguu

SEQ ID NO: 3826670 - RNA, 19 nt, Human
ccccgagggaugaugccac

SEQ ID NO: 3826671 - RNA, 20 nt, Human
ccccgagggaugaugccaca

SEQ ID NO: 3826672 - RNA, 19 nt, Human
ccccgagggcugagccugg

SEQ ID NO: 3826673 - RNA, 21 nt, Human
ccccgagggcugagccugguc

SEQ ID NO: 3826674 - RNA, 16 nt, Human
ccccgcaaaacccacu

SEQ ID NO: 3826675 - RNA, 23 nt, Human
ccccgcagaccuccccagccccu

SEQ ID NO: 3826676 - RNA, 17 nt, Human
ccccgcauccccugccu

SEQ ID NO: 3826677 - RNA, 17 nt, Human
ccccgcccagcugcacc

SEQ ID NO: 3826678 - RNA, 16 nt, Human
ccccgcccaggcuggc

SEQ ID NO: 3826679 - RNA, 14 nt, Human
ccccgcccaggcuu

SEQ ID NO: 3826680 - RNA, 16 nt, Human
ccccgccccacauucc

SEQ ID NO: 3826681 - RNA, 18 nt, Human
ccccgcccccugcccucc

SEQ ID NO: 3826682 - RNA, 17 nt, Human
ccccgccuggccaggag

SEQ ID NO: 3826683 - RNA, 16 nt, Human
ccccgcuaaggaagau

SEQ ID NO: 3826684 - RNA, 16 nt, Human
ccccgcucaugggccc

SEQ ID NO: 3826685 - RNA, 23 nt, Human
ccccgcucaugggccccucugac

SEQ ID NO: 3826686 - RNA, 13 nt, Human
ccccgcucugcau

SEQ ID NO: 3826687 - RNA, 14 nt, Human
ccccgcucugcaug

SEQ ID NO: 3826688 - RNA, 23 nt, Human
ccccgcucugcaugcggcccagc

SEQ ID NO: 3826689 - RNA, 22 nt, Human
ccccgcuggaggaugugggcag

SEQ ID NO: 3826690 - RNA, 23 nt, Human
ccccgcuggaggaugugggcagc

SEQ ID NO: 3826691 - RNA, 22 nt, Human
ccccgcuguaagcuccuuugug

SEQ ID NO: 3826692 - RNA, 19 nt, Human
ccccgcuuguccagcgccu

SEQ ID NO: 3826693 - RNA, 21 nt, Human
ccccggcaugagacucagugc

SEQ ID NO: 3826694 - RNA, 23 nt, Human
ccccggcaugagacucagugcag

SEQ ID NO: 3826695 - RNA, 14 nt, Human
ccccggccaccucu

SEQ ID NO: 3826696 - RNA, 18 nt, Human
ccccggccaccugcggug

SEQ ID NO: 3826697 - RNA, 21 nt, Human
ccccggcccugggcucggagg

SEQ ID NO: 3826698 - RNA, 14 nt, Human
ccccggccucagca

SEQ ID NO: 3826699 - RNA, 15 nt, Human
ccccgggcucucugc

SEQ ID NO: 3826700 - RNA, 18 nt, Human
ccccgggcucucugcugu

SEQ ID NO: 3826701 - RNA, 17 nt, Human
ccccggggacccuguga

SEQ ID NO: 3826702 - RNA, 15 nt, Human
ccccggggcuggguu

SEQ ID NO: 3826703 - RNA, 23 nt, Human
ccccggguuuggcgggccaagga

SEQ ID NO: 3826704 - RNA, 16 nt, Human
ccccggucccuugaga

SEQ ID NO: 3826705 - RNA, 18 nt, Human
ccccgguggcggccccag

SEQ ID NO: 3826706 - RNA, 13 nt, Human
ccccgucucaggu

SEQ ID NO: 3826707 - RNA, 20 nt, Human
ccccgucugggguucagccc

SEQ ID NO: 3826708 - RNA, 13 nt, Human
ccccguggggcag

SEQ ID NO: 3826709 - RNA, 17 nt, Human
ccccguguuccccucuu

SEQ ID NO: 3826710 - RNA, 21 nt, Human
ccccuaaaagcacuccugcuu

SEQ ID NO: 3826711 - RNA, 17 nt, Human
ccccuaaaccccugucc

SEQ ID NO: 3826712 - RNA, 23 nt, Human
ccccuaaugacaucaccacaguu

SEQ ID NO: 3826713 - RNA, 20 nt, Human
ccccuaccacugucuucuuc

SEQ ID NO: 3826714 - RNA, 22 nt, Human
ccccuaccccacaccaggccgu

SEQ ID NO: 3826715 - RNA, 18 nt, Human
ccccuacgcgccuugucu

SEQ ID NO: 3826716 - RNA, 16 nt, Human
ccccuagaaacccaag

SEQ ID NO: 3826717 - RNA, 14 nt, Human
ccccuagaguccca

SEQ ID NO: 3826718 - RNA, 12 nt, Human
ccccuagcccag

SEQ ID NO: 3826719 - RNA, 19 nt, Human
ccccuagccgguuccuguc

SEQ ID NO: 3826720 - RNA, 15 nt, Human
ccccuagccugccuc

SEQ ID NO: 3826721 - RNA, 19 nt, Human
ccccuaguaagugccuucc

SEQ ID NO: 3826722 - RNA, 20 nt, Human
ccccuaguaagugccuucca

SEQ ID NO: 3826723 - RNA, 21 nt, Human
ccccucaaaccuccucuucug

SEQ ID NO: 3826724 - RNA, 15 nt, Human
ccccucaacaccucu

SEQ ID NO: 3826725 - RNA, 23 nt, Human
ccccucaaggacaaagucuccag

SEQ ID NO: 3826726 - RNA, 17 nt, Human
ccccucacagccucuga

SEQ ID NO: 3826727 - RNA, 16 nt, Human
ccccucaccaggggca

SEQ ID NO: 3826728 - RNA, 17 nt, Human
ccccucaccaggggcag

SEQ ID NO: 3826729 - RNA, 13 nt, Human
ccccucacccugc

SEQ ID NO: 3826730 - RNA, 15 nt, Human
ccccucaccugggca

SEQ ID NO: 3826731 - RNA, 13 nt, Human
ccccucaccuugc

SEQ ID NO: 3826732 - RNA, 15 nt, Human
ccccucaccuugcaa

SEQ ID NO: 3826733 - RNA, 12 nt, Human
ccccucagcucc

SEQ ID NO: 3826734 - RNA, 18 nt, Human
ccccucagcucggcucag

SEQ ID NO: 3826735 - RNA, 22 nt, Human
ccccucagggucccugguggca

SEQ ID NO: 3826736 - RNA, 23 nt, Human
cccaagguuuaaacuucucugaa

SEQ ID NO: 3826737 - RNA, 23 nt, Human
cccaaguagcugggauuacaggu

SEQ ID NO: 3826738 - RNA, 20 nt, Human
cccaaguccaaauguuuaca

SEQ ID NO: 3826739 - RNA, 21 nt, Human
cccaaguccaggucgggcuca

SEQ ID NO: 3826740 - RNA, 23 nt, Human
cccaagucccuguuuucugagcc

SEQ ID NO: 3826741 - RNA, 13 nt, Human
cccaaguccugaa

SEQ ID NO: 3826742 - RNA, 23 nt, Human
cccaaguccugaagaggcgggcc

SEQ ID NO: 3826743 - RNA, 13 nt, Human
cccaagugagucu

SEQ ID NO: 3826744 - RNA, 19 nt, Human
cccaagugcacuuucuaau

SEQ ID NO: 3826745 - RNA, 16 nt, Human
cccaaguggcagagcu

SEQ ID NO: 3826746 - RNA, 23 nt, Human
cccaagugggggcagagggcaga

SEQ ID NO: 3826747 - RNA, 15 nt, Human
cccaaguuggggguc

SEQ ID NO: 3826748 - RNA, 21 nt, Human
cccaaguuuccauagcaacag

SEQ ID NO: 3826749 - RNA, 22 nt, Human
cccaaguuuuaggacaaacagc

SEQ ID NO: 3826750 - RNA, 23 nt, Human
cccaaguuuuaggacaaacagcu

SEQ ID NO: 3826751 - RNA, 19 nt, Human
cccaaguuuugugaaauuu

SEQ ID NO: 3826752 - RNA, 21 nt, Human
cccaaguuuugugaaauuuuu

SEQ ID NO: 3826753 - RNA, 16 nt, Human
cccaauaccccaugga

SEQ ID NO: 3826754 - RNA, 17 nt, Human
cccaauaccccauggac

SEQ ID NO: 3826755 - RNA, 17 nt, Human
cccaaucagcacugaaa

SEQ ID NO: 3826756 - RNA, 14 nt, Human
cccaauccagugga

SEQ ID NO: 3826757 - RNA, 23 nt, Human
cccaaucccagcuaccucaacca

SEQ ID NO: 3826758 - RNA, 14 nt, Human
cccaaucuccaucu

SEQ ID NO: 3826759 - RNA, 12 nt, Human
cccaaugaauua

SEQ ID NO: 3826760 - RNA, 17 nt, Human
cccaaugagacuugccu

SEQ ID NO: 3826761 - RNA, 18 nt, Human
cccaaugagacuugccuu

SEQ ID NO: 3826762 - RNA, 23 nt, Human
cccaaugcacuuuguucuggcuc

SEQ ID NO: 3826763 - RNA, 16 nt, Human
cccaauguaggagcug

SEQ ID NO: 3826764 - RNA, 15 nt, Human
cccaauuaggaagug

SEQ ID NO: 3826765 - RNA, 21 nt, Human
cccaauucuuacaaacaugug

SEQ ID NO: 3826766 - RNA, 15 nt, Human
cccaauugagaaaaa

SEQ ID NO: 3826767 - RNA, 14 nt, Human
cccaauugcuggag

SEQ ID NO: 3826768 - RNA, 14 nt, Human
cccaauuggaggaa

SEQ ID NO: 3826769 - RNA, 13 nt, Human
cccacaaaaaugu

SEQ ID NO: 3826770 - RNA, 19 nt, Human
cccacaacccaaaagguuu

SEQ ID NO: 3826771 - RNA, 20 nt, Human
cccacaagaaaugaaagcag

SEQ ID NO: 3826772 - RNA, 10 nt, Human
cccacacaca

SEQ ID NO: 3826773 - RNA, 12 nt, Human
cccacacacagg

SEQ ID NO: 3826774 - RNA, 14 nt, Human
cccacacacgccag

SEQ ID NO: 3826775 - RNA, 16 nt, Human
cccacacccaaagcug

SEQ ID NO: 3826776 - RNA, 22 nt, Human
cccacaccucaguucccuuggc

SEQ ID NO: 3826777 - RNA, 24 nt, Human
cccacaccuccacaguucaguggc

SEQ ID NO: 3826778 - RNA, 17 nt, Human
cccacaccuccucucac

SEQ ID NO: 3826779 - RNA, 16 nt, Human
cccacaccucugccag

SEQ ID NO: 3826780 - RNA, 15 nt, Human
cccacaccuggcccu

SEQ ID NO: 3826781 - RNA, 16 nt, Human
cccacaccuggcccug

SEQ ID NO: 3826782 - RNA, 14 nt, Human
cccacacuaaccug

SEQ ID NO: 3826783 - RNA, 14 nt, Human
cccacacucacucc

SEQ ID NO: 3826784 - RNA, 16 nt, Human
cccacacuucccuggc

SEQ ID NO: 3826785 - RNA, 17 nt, Human
cccacacuuguuccagc

SEQ ID NO: 3826786 - RNA, 19 nt, Human
cccacacuuguuccagcuc

SEQ ID NO: 3826787 - RNA, 21 nt, Human
cccacagaaagacugagcuca

SEQ ID NO: 3826788 - RNA, 23 nt, Human
cccacagacucaaaugcucagac

SEQ ID NO: 3826789 - RNA, 19 nt, Human
cccacagcacagcucccug

SEQ ID NO: 3826790 - RNA, 17 nt, Human
cccacagccucugccug

SEQ ID NO: 3826791 - RNA, 18 nt, Human
cccacagccucugccugu

SEQ ID NO: 3826792 - RNA, 19 nt, Human
cccacagcgcuggccggga

SEQ ID NO: 3826793 - RNA, 22 nt, Human
cccacaggaagccugcaguccu

SEQ ID NO: 3826794 - RNA, 19 nt, Human
cccacaggacauuucucua

SEQ ID NO: 3826795 - RNA, 22 nt, Human
cccacaggaggcaagcaagcuc

SEQ ID NO: 3826796 - RNA, 13 nt, Human
cccacaggaucag

SEQ ID NO: 3826797 - RNA, 17 nt, Human
cccacaggaucagucug

SEQ ID NO: 3826798 - RNA, 13 nt, Human
cccacaggcagcu

SEQ ID NO: 3826799 - RNA, 14 nt, Human
cccacaggcagcuu

SEQ ID NO: 3826800 - RNA, 21 nt, Human
cccacagucuccggccucucc

SEQ ID NO: 3826801 - RNA, 19 nt, Human
cccacagugucaggcacug

SEQ ID NO: 3826802 - RNA, 19 nt, Human
cccuccuugcucugcaggc

SEQ ID NO: 3826803 - RNA, 12 nt, Human
cccucgaggcgg

SEQ ID NO: 3826804 - RNA, 23 nt, Human
cccucgaggcggaucuuuggaca

SEQ ID NO: 3826805 - RNA, 13 nt, Human
cccucgcccccgc

SEQ ID NO: 3826806 - RNA, 12 nt, Human
cccucgccugug

SEQ ID NO: 3826807 - RNA, 14 nt, Human
cccucgcugcuucu

SEQ ID NO: 3826808 - RNA, 15 nt, Human
cccucgcugcuucug

SEQ ID NO: 3826809 - RNA, 23 nt, Human
cccucgcuuggacggcugggcac

SEQ ID NO: 3826810 - RNA, 18 nt, Human
cccucggaguucuucuug

SEQ ID NO: 3826811 - RNA, 18 nt, Human
cccucgggcccaccuggc

SEQ ID NO: 3826812 - RNA, 17 nt, Human
cccucgggcgagucacu

SEQ ID NO: 3826813 - RNA, 14 nt, Human
cccucguggccagc

SEQ ID NO: 3826814 - RNA, 16 nt, Human
cccucguggccagccc

SEQ ID NO: 3826815 - RNA, 15 nt, Human
cccucguggccuucc

SEQ ID NO: 3826816 - RNA, 13 nt, Human
cccucucaccaaa

SEQ ID NO: 3826817 - RNA, 21 nt, Human
cccucucagagcuacuugggc

SEQ ID NO: 3826818 - RNA, 18 nt, Human
cccucucagcccucacac

SEQ ID NO: 3826819 - RNA, 13 nt, Human
cccucucagcucc

SEQ ID NO: 3826820 - RNA, 14 nt, Human
cccucucagcucca

SEQ ID NO: 3826821 - RNA, 18 nt, Human
cccucuccauaaccccac

SEQ ID NO: 3826822 - RNA, 20 nt, Human
cccucucccaaaaaacuacu

SEQ ID NO: 3826823 - RNA, 11 nt, Human
cccucucccac

SEQ ID NO: 3826824 - RNA, 13 nt, Human
cccucucccaccc

SEQ ID NO: 3826825 - RNA, 17 nt, Human
cccucucccacccucuu

SEQ ID NO: 3826826 - RNA, 18 nt, Human
cccucuccccaccccuac

SEQ ID NO: 3826827 - RNA, 21 nt, Human
cccucuccccccccccuccaa

SEQ ID NO: 3826828 - RNA, 18 nt, Human
cccucuccccugcccccu

SEQ ID NO: 3826829 - RNA, 22 nt, Human
cccucuccccugcccccugcag

SEQ ID NO: 3826830 - RNA, 14 nt, Human
cccucucccugcau

SEQ ID NO: 3826831 - RNA, 16 nt, Human
cccucucccugcaugg

SEQ ID NO: 3826832 - RNA, 17 nt, Human
cccucucccugcauggc

SEQ ID NO: 3826833 - RNA, 22 nt, Human
cccucucccuugggcucugaug

SEQ ID NO: 3826834 - RNA, 11 nt, Human
cccucuccugc

SEQ ID NO: 3826835 - RNA, 13 nt, Human
cccucuccugccu

SEQ ID NO: 3826836 - RNA, 14 nt, Human
cccucuccugggca

SEQ ID NO: 3826837 - RNA, 20 nt, Human
cccucuccugggcagcugcc

SEQ ID NO: 3826838 - RNA, 22 nt, Human
cccucuccugggcagcugccuc

SEQ ID NO: 3826839 - RNA, 17 nt, Human
cccucuccuuccugugu

SEQ ID NO: 3826840 - RNA, 17 nt, Human
cccucucucuucugcuc

SEQ ID NO: 3826841 - RNA, 19 nt, Human
cccucucucuucugcucca

SEQ ID NO: 3826842 - RNA, 22 nt, Human
cccucucucuucugcuccaccc

SEQ ID NO: 3826843 - RNA, 18 nt, Human
cccucucugaaggaggcc

SEQ ID NO: 3826844 - RNA, 16 nt, Human
cccucucugcucugcg

SEQ ID NO: 3826845 - RNA, 13 nt, Human
cccucucuggaga

SEQ ID NO: 3826846 - RNA, 13 nt, Human
cccucucugggcc

SEQ ID NO: 3826847 - RNA, 13 nt, Human
cccucucuugcac

SEQ ID NO: 3826848 - RNA, 13 nt, Human
cccucugaaauac

SEQ ID NO: 3826849 - RNA, 22 nt, Human
cccucugaaugguccaggguug

SEQ ID NO: 3826850 - RNA, 16 nt, Human
cccucugaccugcacu

SEQ ID NO: 3826851 - RNA, 20 nt, Human
cccucugagaauuccaagga

SEQ ID NO: 3826852 - RNA, 12 nt, Human
cccucugccacc

SEQ ID NO: 3826853 - RNA, 13 nt, Human
cccucugccacca

SEQ ID NO: 3826854 - RNA, 19 nt, Human
cccucugcccagcuugggc

SEQ ID NO: 3826855 - RNA, 23 nt, Human
cccucugcccagcuugggcccag

SEQ ID NO: 3826856 - RNA, 18 nt, Human
cccucugccccauccucc

SEQ ID NO: 3826857 - RNA, 23 nt, Human
cccucugccugucccucucaggc

SEQ ID NO: 3826858 - RNA, 15 nt, Human
cccucugcucagcca

SEQ ID NO: 3826859 - RNA, 23 nt, Human
cccucugcuggccgggcacagcu

SEQ ID NO: 3826860 - RNA, 21 nt, Human
cccucuggagggguguggcuc

SEQ ID NO: 3826861 - RNA, 18 nt, Human
cccucuggaguggccacu

SEQ ID NO: 3826862 - RNA, 13 nt, Human
cccucuggcccug

SEQ ID NO: 3826863 - RNA, 14 nt, Human
cccucuggcccugc

SEQ ID NO: 3826864 - RNA, 16 nt, Human
cccucuggcuccagcu

SEQ ID NO: 3826865 - RNA, 12 nt, Human
cccucugggaac

SEQ ID NO: 3826866 - RNA, 20 nt, Human
cccucugggaaccucccaga

SEQ ID NO: 3826867 - RNA, 11 nt, Human
cccucugggcu

SEQ ID NO: 3826868 - RNA, 16 nt, Human
cccucugggcucugag

SEQ ID NO: 3826869 - RNA, 18 nt, Human
cccucuggucgcuccugc

SEQ ID NO: 3826870 - RNA, 19 nt, Human
cccucuggucgcuccugcc

SEQ ID NO: 3826871 - RNA, 15 nt, Human
cccucuguccugacu

SEQ ID NO: 3826872 - RNA, 18 nt, Human
cccucuguuccuucccug

SEQ ID NO: 3826873 - RNA, 20 nt, Human
cccucuguuucucuuuccuu

SEQ ID NO: 3826874 - RNA, 18 nt, Human
cccucuuauguaccucuu

SEQ ID NO: 3826875 - RNA, 19 nt, Human
cccucuuccuacuggucuc

SEQ ID NO: 3826876 - RNA, 13 nt, Human
cccucuuccucuu

SEQ ID NO: 3826877 - RNA, 18 nt, Human
cccucuuccucuugaccc

SEQ ID NO: 3826878 - RNA, 15 nt, Human
cccucuuccugugau

SEQ ID NO: 3826879 - RNA, 15 nt, Human
cccucuucucaagug

SEQ ID NO: 3826880 - RNA, 13 nt, Human
cccucuugcccau

SEQ ID NO: 3826881 - RNA, 16 nt, Human
cccucuugccccccac

SEQ ID NO: 3826882 - RNA, 15 nt, Human
cccucuuggagaagu

SEQ ID NO: 3826883 - RNA, 18 nt, Human
cccucuuggucuucccag

SEQ ID NO: 3826884 - RNA, 15 nt, Human
cccucuugucucccc

SEQ ID NO: 3826885 - RNA, 18 nt, Human
cccucuugucuccccugu

SEQ ID NO: 3826886 - RNA, 12 nt, Human
cccucuuucccu

SEQ ID NO: 3826887 - RNA, 19 nt, Human
cccucuuucucuuucuucc

SEQ ID NO: 3826888 - RNA, 21 nt, Human
cccucuuucucuuucuuccuu

SEQ ID NO: 3826889 - RNA, 15 nt, Human
cccucuuugcugcag

SEQ ID NO: 3826890 - RNA, 13 nt, Human
cccucuuuucuua

SEQ ID NO: 3826891 - RNA, 23 nt, Human
cccucuuuucuuacuccuccucu

SEQ ID NO: 3826892 - RNA, 21 nt, Human
cccucuuuuguuaaauaauau

SEQ ID NO: 3826893 - RNA, 14 nt, Human
cccugaaaacccag

SEQ ID NO: 3826894 - RNA, 15 nt, Human
cccugaaaacccaga

SEQ ID NO: 3826895 - RNA, 17 nt, Human
cccugaaaacccagaga

SEQ ID NO: 3826896 - RNA, 24 nt, Human
cccugaaaauguuuuucugccagg

SEQ ID NO: 3826897 - RNA, 19 nt, Human
cccugaaacacgaaacuug

SEQ ID NO: 3826898 - RNA, 21 nt, Human
cccugaaaccuaguacugccc

SEQ ID NO: 3826899 - RNA, 14 nt, Human
cccugaaacuuauu

SEQ ID NO: 3826900 - RNA, 22 nt, Human
cccugaaacuuauuuuuuucug

SEQ ID NO: 3826901 - RNA, 23 nt, Human
cccugaaacuuauuuuuuucuga

SEQ ID NO: 3826902 - RNA, 16 nt, Human
cccugaaagcccugag

SEQ ID NO: 3826903 - RNA, 17 nt, Human
cccugaagcugugcgga

SEQ ID NO: 3826904 - RNA, 23 nt, Human
cccugaaggaacauuccuuaguc

SEQ ID NO: 3826905 - RNA, 13 nt, Human
cccugaaggcccc

SEQ ID NO: 3826906 - RNA, 22 nt, Human
cccugaaggccccgcccaggcu

SEQ ID NO: 3826907 - RNA, 20 nt, Human
cccugaaucccccuugccac

SEQ ID NO: 3826908 - RNA, 21 nt, Human
cccugaaucccccuugccacc

SEQ ID NO: 3826909 - RNA, 23 nt, Human
cccugaaucccccuugccacccc

SEQ ID NO: 3826910 - RNA, 14 nt, Human
cccugacaacacuc

SEQ ID NO: 3826911 - RNA, 16 nt, Human
cccugacaacacucau

SEQ ID NO: 3826912 - RNA, 20 nt, Human
cccugacacugcggggcuug

SEQ ID NO: 3826913 - RNA, 13 nt, Human
cccugacagggcc

SEQ ID NO: 3826914 - RNA, 14 nt, Human
cccugaccacucag

SEQ ID NO: 3826915 - RNA, 15 nt, Human
cccugaccacucaga

SEQ ID NO: 3826916 - RNA, 15 nt, Human
cccugacccugugga

SEQ ID NO: 3826917 - RNA, 14 nt, Human
cccugaccucccag

SEQ ID NO: 3826918 - RNA, 17 nt, Human
cccugaccucccagccc

SEQ ID NO: 3826919 - RNA, 21 nt, Human
cccugaccucccagcccuaug

SEQ ID NO: 3826920 - RNA, 19 nt, Human
cccugaccuggcccccuca

SEQ ID NO: 3826921 - RNA, 16 nt, Human
cccugaccugugagcc

SEQ ID NO: 3826922 - RNA, 20 nt, Human
cccugaccugugagcccagc

SEQ ID NO: 3826923 - RNA, 21 nt, Human
cccugacucauucugaaggag

SEQ ID NO: 3826924 - RNA, 13 nt, Human
cccugacugggag

SEQ ID NO: 3826925 - RNA, 14 nt, Human
cccugacuuuucug

SEQ ID NO: 3826926 - RNA, 16 nt, Human
cccugagacaaaugga

SEQ ID NO: 3826927 - RNA, 17 nt, Human
cccugagacaaauggag

SEQ ID NO: 3826928 - RNA, 18 nt, Human
cccugagcaaugucugug

SEQ ID NO: 3826929 - RNA, 21 nt, Human
cccugagccagggucuccaga

SEQ ID NO: 3826930 - RNA, 13 nt, Human
cccugagcccacu

SEQ ID NO: 3826931 - RNA, 16 nt, Human
cccugagcccacugug

SEQ ID NO: 3826932 - RNA, 18 nt, Human
cccugagccccagggugc

SEQ ID NO: 3826933 - RNA, 12 nt, Human
cccugagccccu

SEQ ID NO: 3826934 - RNA, 19 nt, Human
cccugagcgaguggagucu

SEQ ID NO: 3826935 - RNA, 22 nt, Human
cccugagcucgguggacccagg

SEQ ID NO: 3826936 - RNA, 13 nt, Human
cccugagcugagg

SEQ ID NO: 3826937 - RNA, 14 nt, Human
cccugagcugaggc

SEQ ID NO: 3826938 - RNA, 14 nt, Human
cccugaggagccag

SEQ ID NO: 3826939 - RNA, 18 nt, Human
cccugaggagucugaggu

SEQ ID NO: 3826940 - RNA, 22 nt, Human
cccugaggaugggucagagcua

SEQ ID NO: 3826941 - RNA, 16 nt, Human
cccaugaaucaaagac

SEQ ID NO: 3826942 - RNA, 14 nt, Human
cccaugacccaccc

SEQ ID NO: 3826943 - RNA, 16 nt, Human
cccaugacccaccccu

SEQ ID NO: 3826944 - RNA, 14 nt, Human
cccaugaccuccag

SEQ ID NO: 3826945 - RNA, 21 nt, Human
cccaugagacccuggugccug

SEQ ID NO: 3826946 - RNA, 16 nt, Human
cccaugcaagcagagg

SEQ ID NO: 3826947 - RNA, 17 nt, Human
cccaugcaagcagagga

SEQ ID NO: 3826948 - RNA, 17 nt, Human
ccccaggggaaaaugaa

SEQ ID NO: 3826949 - RNA, 18 nt, Human
ccccaggggaaaaugaag

SEQ ID NO: 3826950 - RNA, 22 nt, Human
ccccaggggucccagccacccc

SEQ ID NO: 3826951 - RNA, 18 nt, Human
ccccaggguccugggagg

SEQ ID NO: 3826952 - RNA, 20 nt, Human
ccccaggguccugggaggag

SEQ ID NO: 3826953 - RNA, 20 nt, Human
ccccagguaggggccccucu

SEQ ID NO: 3826954 - RNA, 20 nt, Human
ccccaggucuuccaaguaca

SEQ ID NO: 3826955 - RNA, 21 nt, Human
ccccagguggcugacccaguc

SEQ ID NO: 3826956 - RNA, 20 nt, Human
cccugaggcagguccccaga

SEQ ID NO: 3826957 - RNA, 14 nt, Human
cccugaggcccaga

SEQ ID NO: 3826958 - RNA, 15 nt, Human
cccugaggcccagag

SEQ ID NO: 3826959 - RNA, 20 nt, Human
cccugaggcccagagggccu

SEQ ID NO: 3826960 - RNA, 12 nt, Human
cccugaggccua

SEQ ID NO: 3826961 - RNA, 17 nt, Human
cccugaggggucccuga

SEQ ID NO: 3826962 - RNA, 18 nt, Human
cccugaggucagggagug

SEQ ID NO: 3826963 - RNA, 18 nt, Human
cccugaggugaaagggag

SEQ ID NO: 3826964 - RNA, 15 nt, Human
cccugagucugggca

SEQ ID NO: 3826965 - RNA, 20 nt, Human
cccugaucaagucaccggag

SEQ ID NO: 3826966 - RNA, 16 nt, Human
cccugaucccauuuuc

SEQ ID NO: 3826967 - RNA, 15 nt, Human
cccugaucccuucca

SEQ ID NO: 3826968 - RNA, 15 nt, Human
cccugauccugugaa

SEQ ID NO: 3826969 - RNA, 22 nt, Human
cccugaucugacauccccacuc

SEQ ID NO: 3826970 - RNA, 20 nt, Human
cccugauguguccucaggga

SEQ ID NO: 3826971 - RNA, 18 nt, Human
cccugauugaccugcucc

SEQ ID NO: 3826972 - RNA, 23 nt, Human
cccugauugaccugcuccgcugc

SEQ ID NO: 3826973 - RNA, 16 nt, Human
cccugauuucuugcuu

SEQ ID NO: 3826974 - RNA, 19 nt, Human
cccugcaaaaugagacccu

SEQ ID NO: 3826975 - RNA, 13 nt, Human
cccugcaaacaga

SEQ ID NO: 3826976 - RNA, 17 nt, Human
cccugcaaagcccagcu

SEQ ID NO: 3826977 - RNA, 19 nt, Human
cccugcaaagcccagcuug

SEQ ID NO: 3826978 - RNA, 14 nt, Human
cccugcaaggccca

SEQ ID NO: 3826979 - RNA, 15 nt, Human
cccugcaaggcccac

SEQ ID NO: 3826980 - RNA, 17 nt, Human
cccugcaaggcccacag

SEQ ID NO: 3826981 - RNA, 18 nt, Human
cccugcaaggcccacagg

SEQ ID NO: 3826982 - RNA, 23 nt, Human
cccugcacaaagcccuuccaugu

SEQ ID NO: 3826983 - RNA, 15 nt, Human
cccugcacagcaggc

SEQ ID NO: 3826984 - RNA, 22 nt, Human
cccugcacagugacuucugaga

SEQ ID NO: 3826985 - RNA, 13 nt, Human
cccugcacccucc

SEQ ID NO: 3826986 - RNA, 14 nt, Human
cccugcacccuccu

SEQ ID NO: 3826987 - RNA, 15 nt, Human
cccugcacgucaugg

SEQ ID NO: 3826988 - RNA, 20 nt, Human
cccugcacuaaagccagccu

SEQ ID NO: 3826989 - RNA, 22 nt, Human
cccugcacuggaguccagucuc

SEQ ID NO: 3826990 - RNA, 13 nt, Human
cccugcacugucc

SEQ ID NO: 3826991 - RNA, 15 nt, Human
cccugcacuguccug

SEQ ID NO: 3826992 - RNA, 16 nt, Human
cccugcacuguccugc

SEQ ID NO: 3826993 - RNA, 18 nt, Human
cccugcacuguccugcuc

SEQ ID NO: 3826994 - RNA, 22 nt, Human
cccugcacuguccugcuccaca

SEQ ID NO: 3826995 - RNA, 23 nt, Human
cccugcacuguccugcuccacag

SEQ ID NO: 3826996 - RNA, 12 nt, Human
cccugcacuugc

SEQ ID NO: 3826997 - RNA, 16 nt, Human
cccugcagacccugcc

SEQ ID NO: 3826998 - RNA, 12 nt, Human
cccugcagaggg

SEQ ID NO: 3826999 - RNA, 20 nt, Human
cccugcagaugccacccuag

SEQ ID NO: 3827000 - RNA, 14 nt, Human
cccugcagccagcu

SEQ ID NO: 3827001 - RNA, 15 nt, Human
cccugcagcccuggc

SEQ ID NO: 3827002 - RNA, 17 nt, Human
cccugcagcuaguccua

SEQ ID NO: 3827003 - RNA, 17 nt, Human
cccugcaggaaggagcu

SEQ ID NO: 3827004 - RNA, 18 nt, Human
cccugcaggaaggagcug

SEQ ID NO: 3827005 - RNA, 19 nt, Human
cccugcaggaaggagcugc

SEQ ID NO: 3827006 - RNA, 20 nt, Human
cccugcaggaaggagcugcc

SEQ ID NO: 3827007 - RNA, 18 nt, Human
cccugcaggcugagugca

SEQ ID NO: 3827008 - RNA, 20 nt, Human
cccugcaguguucgcuuggc

SEQ ID NO: 3827009 - RNA, 21 nt, Human
cccugcaguuccccuggaagc

SEQ ID NO: 3827010 - RNA, 16 nt, Human
cccugcaucugaccag

SEQ ID NO: 3827011 - RNA, 16 nt, Human
cccugcauggcugagc

SEQ ID NO: 3827012 - RNA, 14 nt, Human
cccugcaugggcca

SEQ ID NO: 3827013 - RNA, 21 nt, Human
cccugcauucuuucuguauug

SEQ ID NO: 3827014 - RNA, 21 nt, Human
cccugcauuggaacuggaggc

SEQ ID NO: 3827015 - RNA, 14 nt, Human
cccugccacccugg

SEQ ID NO: 3827016 - RNA, 14 nt, Human
cccugccaccuccu

SEQ ID NO: 3827017 - RNA, 20 nt, Human
cccugccaccuccugccuca

SEQ ID NO: 3827018 - RNA, 13 nt, Human
cccugccaccugu

SEQ ID NO: 3827019 - RNA, 20 nt, Human
cccugccacucacuaggccc

SEQ ID NO: 3827020 - RNA, 13 nt, Human
cccugccagaccc

SEQ ID NO: 3827021 - RNA, 16 nt, Human
cccugccagaggggaa

SEQ ID NO: 3827022 - RNA, 14 nt, Human
cccugccagcaccc

SEQ ID NO: 3827023 - RNA, 18 nt, Human
cccugccaggcacaggca

SEQ ID NO: 3827024 - RNA, 21 nt, Human
cccugccaggcacaggcaggg

SEQ ID NO: 3827025 - RNA, 23 nt, Human
cccugccaggcacaggcagggca

SEQ ID NO: 3827026 - RNA, 18 nt, Human
cccugcccaggccggcca

SEQ ID NO: 3827027 - RNA, 13 nt, Human
cccugcccaugcu

SEQ ID NO: 3827028 - RNA, 13 nt, Human
cccugccccaaau

SEQ ID NO: 3827029 - RNA, 19 nt, Human
cccugccccacaccuccuc

SEQ ID NO: 3827030 - RNA, 17 nt, Human
cccugccccagcccaag

SEQ ID NO: 3827031 - RNA, 20 nt, Human
cccugccccagcccaagucc

SEQ ID NO: 3827032 - RNA, 16 nt, Human
cccugcccccacuucc

SEQ ID NO: 3827033 - RNA, 17 nt, Human
cccugcccccacuuccu

SEQ ID NO: 3827034 - RNA, 18 nt, Human
cccugcccccagccccgg

SEQ ID NO: 3827035 - RNA, 18 nt, Human
cccugcccccugcaggaa

SEQ ID NO: 3827036 - RNA, 15 nt, Human
cccugccccgucacc

SEQ ID NO: 3827037 - RNA, 17 nt, Human
cccugccccucccuuca

SEQ ID NO: 3827038 - RNA, 13 nt, Human
cccugccccugcc

SEQ ID NO: 3827039 - RNA, 18 nt, Human
cccugccccugccccguc

SEQ ID NO: 3827040 - RNA, 16 nt, Human
cccugcccguguacau

SEQ ID NO: 3827041 - RNA, 13 nt, Human
cccugcccucauc

SEQ ID NO: 3827042 - RNA, 13 nt, Human
cccugcccucgug

SEQ ID NO: 3827043 - RNA, 16 nt, Human
cccugcccucguggcc

SEQ ID NO: 3827044 - RNA, 18 nt, Human
cccugcccucguggccag

SEQ ID NO: 3827045 - RNA, 19 nt, Human
cccugcccucguggccagc

SEQ ID NO: 3827046 - RNA, 21 nt, Human
cccugcccucguggccagccc

SEQ ID NO: 3827047 - RNA, 22 nt, Human
cccugcccucguggccagcccg

SEQ ID NO: 3827048 - RNA, 15 nt, Human
cccugcccugccacc

SEQ ID NO: 3827049 - RNA, 13 nt, Human
cccugcccugcug

SEQ ID NO: 3827050 - RNA, 11 nt, Human
cccugcccugg

SEQ ID NO: 3827051 - RNA, 12 nt, Human
cccugcccuggu

SEQ ID NO: 3827052 - RNA, 14 nt, Human
cccugcccuggucc

SEQ ID NO: 3827053 - RNA, 22 nt, Human
cccugcccugguuuccugcccu

SEQ ID NO: 3827054 - RNA, 23 nt, Human
cccugcccugguuuccugcccug

SEQ ID NO: 3827055 - RNA, 12 nt, Human
cccugcccugug

SEQ ID NO: 3827056 - RNA, 14 nt, Human
cccugcccuguggg

SEQ ID NO: 3827057 - RNA, 16 nt, Human
cccugcccugugggcc

SEQ ID NO: 3827058 - RNA, 21 nt, Human
cccugcccugugggcccccaa

SEQ ID NO: 3827059 - RNA, 23 nt, Human
cccugcccuuguuuggggcagga

SEQ ID NO: 3827060 - RNA, 13 nt, Human
cccugccgccuca

SEQ ID NO: 3827061 - RNA, 13 nt, Human
cccugccggccgg

SEQ ID NO: 3827062 - RNA, 16 nt, Human
cccugccgucaccacc

SEQ ID NO: 3827063 - RNA, 19 nt, Human
cccugccgucaccaccacc

SEQ ID NO: 3827064 - RNA, 14 nt, Human
cccugccuccaccc

SEQ ID NO: 3827065 - RNA, 15 nt, Human
cccugccuccacccu

SEQ ID NO: 3827066 - RNA, 16 nt, Human
cccugccuccacccuc

SEQ ID NO: 3827067 - RNA, 21 nt, Human
cccugccuccacccucugagc

SEQ ID NO: 3827068 - RNA, 22 nt, Human
cccugccuccacccucugagcu

SEQ ID NO: 3827069 - RNA, 23 nt, Human
cccugccuccuuugugaggaagc

SEQ ID NO: 3827070 - RNA, 14 nt, Human
cccugccucuccca

SEQ ID NO: 3827071 - RNA, 15 nt, Human
cccugccucucccag

SEQ ID NO: 3827072 - RNA, 14 nt, Human
cccugccucucugc

SEQ ID NO: 3827073 - RNA, 21 nt, Human
cccugccugagggccccucug

SEQ ID NO: 3827074 - RNA, 13 nt, Human
cccugccugccau

SEQ ID NO: 3827075 - RNA, 14 nt, Human
cccugccugccaug

SEQ ID NO: 3827076 - RNA, 18 nt, Human
cccugccuggaccagccu

SEQ ID NO: 3827077 - RNA, 12 nt, Human
cccugccuggag

SEQ ID NO: 3827078 - RNA, 15 nt, Human
cccugccuggaggac

SEQ ID NO: 3827079 - RNA, 24 nt, Human
cccugccuggaggaccugagccug

SEQ ID NO: 3827080 - RNA, 13 nt, Human
cccugccuggccc

SEQ ID NO: 3827081 - RNA, 17 nt, Human
cccugccuggcccccaa

SEQ ID NO: 3827082 - RNA, 19 nt, Human
cccugcgaaggggcccugg

SEQ ID NO: 3827083 - RNA, 20 nt, Human
cccugcgaaggggcccuggu

SEQ ID NO: 3827084 - RNA, 14 nt, Human
cccugcgccuuucc

SEQ ID NO: 3827085 - RNA, 19 nt, Human
cccugcgggucacaggagg

SEQ ID NO: 3827086 - RNA, 22 nt, Human
cccugcgggugaacaaagcagc

SEQ ID NO: 3827087 - RNA, 22 nt, Human
cccugcuacugccaaccucgcu

SEQ ID NO: 3827088 - RNA, 16 nt, Human
cccugcucaguaaagc

SEQ ID NO: 3827089 - RNA, 12 nt, Human
cccugcucccuc

SEQ ID NO: 3827090 - RNA, 23 nt, Human
cccugcucccuccgggucuuccu

SEQ ID NO: 3827091 - RNA, 19 nt, Human
cccugcucccucucccccu

SEQ ID NO: 3827092 - RNA, 15 nt, Human
cccugcuccucccug

SEQ ID NO: 3827093 - RNA, 17 nt, Human
cccuuucccaccccaac

SEQ ID NO: 3827094 - RNA, 23 nt, Human
cccuuuccccgacgcccacccaa

SEQ ID NO: 3827095 - RNA, 13 nt, Human
cccuuuccuucca

SEQ ID NO: 3827096 - RNA, 15 nt, Human
cccuuuccuuccauc

SEQ ID NO: 3827097 - RNA, 18 nt, Human
cccuuuccuuccaucccu

SEQ ID NO: 3827098 - RNA, 18 nt, Human
cccuuuccuuccuucccu

SEQ ID NO: 3827099 - RNA, 21 nt, Human
cccuuuccuuccuucccuggc

SEQ ID NO: 3827100 - RNA, 18 nt, Human
cccuuucggauccaggga

SEQ ID NO: 3827101 - RNA, 18 nt, Human
cccuuucuacuuccaaga

SEQ ID NO: 3827102 - RNA, 17 nt, Human
cccuuucuagaccaaua

SEQ ID NO: 3827103 - RNA, 14 nt, Human
cccuuucuggcucu

SEQ ID NO: 3827104 - RNA, 17 nt, Human
cccuuucuucuccccca

SEQ ID NO: 3827105 - RNA, 17 nt, Human
cccuuucuugacaaaac

SEQ ID NO: 3827106 - RNA, 21 nt, Human
cccuuugaagccucagcuacc

SEQ ID NO: 3827107 - RNA, 16 nt, Human
cccuuugaccuuguuu

SEQ ID NO: 3827108 - RNA, 20 nt, Human
cccuuugacgccaucccagc

SEQ ID NO: 3827109 - RNA, 12 nt, Human
cccuuugagugc

SEQ ID NO: 3827110 - RNA, 14 nt, Human
cccuuugagugcag

SEQ ID NO: 3827111 - RNA, 17 nt, Human
cccuuugcccagaaaga

SEQ ID NO: 3827112 - RNA, 23 nt, Human
cccuuuggagaugcugagggugu

SEQ ID NO: 3827113 - RNA, 20 nt, Human
cccuuugggaggcugaggcg

SEQ ID NO: 3827114 - RNA, 15 nt, Human
cccuuugggcccagg

SEQ ID NO: 3827115 - RNA, 18 nt, Human
cccuuugggcccagggac

SEQ ID NO: 3827116 - RNA, 13 nt, Human
cccuuugggcccu

SEQ ID NO: 3827117 - RNA, 20 nt, Human
cccuuugggcccugcaugua

SEQ ID NO: 3827118 - RNA, 17 nt, Human
cccuuuguccuccugcu

SEQ ID NO: 3827119 - RNA, 23 nt, Human
cccuuugugugcucuccauucug

SEQ ID NO: 3827120 - RNA, 19 nt, Human
cccuuuguuucuuguuuau

SEQ ID NO: 3827121 - RNA, 13 nt, Human
cccuuuuauacua

SEQ ID NO: 3827122 - RNA, 12 nt, Human
cccuuuuccccu

SEQ ID NO: 3827123 - RNA, 13 nt, Human
cccuuuuccccua

SEQ ID NO: 3827124 - RNA, 17 nt, Human
cccuuuugcauucuccc

SEQ ID NO: 3827125 - RNA, 20 nt, Human
cccuuuuguugagccaggcc

SEQ ID NO: 3827126 - RNA, 17 nt, Human
cccuuuuucaauaacug

SEQ ID NO: 3827127 - RNA, 15 nt, Human
cccuuuuugaagugu

SEQ ID NO: 3827128 - RNA, 15 nt, Human
cccuuuuuuccuuuc

SEQ ID NO: 3827129 - RNA, 21 nt, Human
cccuuuuuucugccuccuuua

SEQ ID NO: 3827130 - RNA, 17 nt, Human
cccuuuuuuggcugcug

SEQ ID NO: 3827131 - RNA, 22 nt, Human
ccgaaaaauccucuuccucuga

SEQ ID NO: 3827132 - RNA, 22 nt, Human
ccgaaaggucaccucacucagc

SEQ ID NO: 3827133 - RNA, 23 nt, Human
ccgaaauaucuauguuuuaccaa

SEQ ID NO: 3827134 - RNA, 16 nt, Human
ccgaaccuccucugug

SEQ ID NO: 3827135 - RNA, 18 nt, Human
ccgaacugggcauauuuc

SEQ ID NO: 3827136 - RNA, 19 nt, Human
ccgaagaaggguccuuccc

SEQ ID NO: 3827137 - RNA, 17 nt, Human
ccgaagcccaggggccg

SEQ ID NO: 3827138 - RNA, 16 nt, Human
ccgaagcucuggcuga

SEQ ID NO: 3827139 - RNA, 13 nt, Human
ccgaagucuuuug

SEQ ID NO: 3827140 - RNA, 11 nt, Human
ccgaauaaaug

SEQ ID NO: 3827141 - RNA, 13 nt, Human
ccgaaugugucuu

SEQ ID NO: 3827142 - RNA, 15 nt, Human
ccgacaaccgaugcu

SEQ ID NO: 3827143 - RNA, 17 nt, Human
ccgacacgcucccuccc

SEQ ID NO: 3827144 - RNA, 14 nt, Human
ccgacagccuggca

SEQ ID NO: 3827145 - RNA, 14 nt, Human
ccgacaggcccugg

SEQ ID NO: 3827146 - RNA, 15 nt, Human
ccgacaggcccuggc

SEQ ID NO: 3827147 - RNA, 14 nt, Human
ccgacauugucucc

SEQ ID NO: 3827148 - RNA, 15 nt, Human
ccgacauugucuccc

SEQ ID NO: 3827149 - RNA, 15 nt, Human
ccgaccaccugccca

SEQ ID NO: 3827150 - RNA, 18 nt, Human
ccgaccagaggagccuuu

SEQ ID NO: 3827151 - RNA, 16 nt, Human
ccgacccucugggaac

SEQ ID NO: 3827152 - RNA, 17 nt, Human
ccgacccucugggaacc

SEQ ID NO: 3827153 - RNA, 18 nt, Human
ccgacccucugggaaccu

SEQ ID NO: 3827154 - RNA, 16 nt, Human
ccgacccuugccgucu

SEQ ID NO: 3827155 - RNA, 21 nt, Human
ccgaccgaggcuggagcuggc

SEQ ID NO: 3827156 - RNA, 23 nt, Human
ccgaccucguccucccccugcca

SEQ ID NO: 3827157 - RNA, 16 nt, Human
ccgaccuuagauuuag

SEQ ID NO: 3827158 - RNA, 14 nt, Human
ccgacuagacacac

SEQ ID NO: 3827159 - RNA, 20 nt, Human
ccgacuagacacacaaagca

SEQ ID NO: 3827160 - RNA, 16 nt, Human
ccgacuccagccagcg

SEQ ID NO: 3827161 - RNA, 19 nt, Human
ccgacucuggcccuggccc

SEQ ID NO: 3827162 - RNA, 23 nt, Human
ccgacugcacagcggccccugca

SEQ ID NO: 3827163 - RNA, 14 nt, Human
ccgacugcuuugga

SEQ ID NO: 3827164 - RNA, 23 nt, Human
ccgacuugaauuuucccacugca

SEQ ID NO: 3827165 - RNA, 16 nt, Human
ccgacuugcuguuuug

SEQ ID NO: 3827166 - RNA, 22 nt, Human
ccgacuuuguaccccccaaccc

SEQ ID NO: 3827167 - RNA, 22 nt, Human
ccgacuuuuguuuaccagagaa

SEQ ID NO: 3827168 - RNA, 13 nt, Human
ccgagaagcaaga

SEQ ID NO: 3827169 - RNA, 15 nt, Human
cccucccacccaccg

SEQ ID NO: 3827170 - RNA, 16 nt, Human
cccucccacccccagc

SEQ ID NO: 3827171 - RNA, 17 nt, Human
cccucccacccccagcc

SEQ ID NO: 3827172 - RNA, 17 nt, Human
cccucccaccucuguga

SEQ ID NO: 3827173 - RNA, 13 nt, Human
cccucccagcuga

SEQ ID NO: 3827174 - RNA, 20 nt, Human
cccucccaggacucugaccc

SEQ ID NO: 3827175 - RNA, 13 nt, Human
cccucccauuagg

SEQ ID NO: 3827176 - RNA, 22 nt, Human
cccuccccaugcaggugguguc

SEQ ID NO: 3827177 - RNA, 18 nt, Human
cccucccccccaugcacu

SEQ ID NO: 3827178 - RNA, 13 nt, Human
cccucccccugcc

SEQ ID NO: 3827179 - RNA, 13 nt, Human
cccucccccuucu

SEQ ID NO: 3827180 - RNA, 12 nt, Human
cccucccccuug

SEQ ID NO: 3827181 - RNA, 13 nt, Human
cccucccccuugu

SEQ ID NO: 3827182 - RNA, 21 nt, Human
cccuccccggcacccucuggc

SEQ ID NO: 3827183 - RNA, 14 nt, Human
cccuccccucucuu

SEQ ID NO: 3827184 - RNA, 15 nt, Human
cccuccccucucuug

SEQ ID NO: 3827185 - RNA, 13 nt, Human
cccuccccugccc

SEQ ID NO: 3827186 - RNA, 14 nt, Human
cccuccccugcugc

SEQ ID NO: 3827187 - RNA, 14 nt, Human
cccuccccuucucu

SEQ ID NO: 3827188 - RNA, 17 nt, Human
cccucccggcccugccu

SEQ ID NO: 3827189 - RNA, 22 nt, Human
cccucccgucuacucauucccc

SEQ ID NO: 3827190 - RNA, 15 nt, Human
cccucccuaccucaa

SEQ ID NO: 3827191 - RNA, 13 nt, Human
cccucccuccucu

SEQ ID NO: 3827192 - RNA, 14 nt, Human
cccucccugccccu

SEQ ID NO: 3827193 - RNA, 13 nt, Human
cccucccuggagu

SEQ ID NO: 3827194 - RNA, 15 nt, Human
cccucccuggccugu

SEQ ID NO: 3827195 - RNA, 16 nt, Human
cccucccuggcuccca

SEQ ID NO: 3827196 - RNA, 19 nt, Human
cccucccuggcucccauga

SEQ ID NO: 3827197 - RNA, 16 nt, Human
cccucccuggguucag

SEQ ID NO: 3827198 - RNA, 13 nt, Human
cccucccuguccu

SEQ ID NO: 3827199 - RNA, 20 nt, Human
cccucccuguuccccagaga

SEQ ID NO: 3827200 - RNA, 17 nt, Human
cccucccuucucccugg

SEQ ID NO: 3827201 - RNA, 21 nt, Human
cccucccuuggaaaccugccc

SEQ ID NO: 3827202 - RNA, 22 nt, Human
cccucccuuggaaaccugcccu

SEQ ID NO: 3827203 - RNA, 23 nt, Human
cccucccuuggaaaccugcccug

SEQ ID NO: 3827204 - RNA, 13 nt, Human
cccucccuuucuc

SEQ ID NO: 3827205 - RNA, 14 nt, Human
cccuccgcccugcc

SEQ ID NO: 3827206 - RNA, 13 nt, Human
cccuccgccuuca

SEQ ID NO: 3827207 - RNA, 18 nt, Human
cccuccgcggcgggcccu

SEQ ID NO: 3827208 - RNA, 21 nt, Human
cccuccgcggcgggcccugcc

SEQ ID NO: 3827209 - RNA, 19 nt, Human
cccuccggacuggugcccu

SEQ ID NO: 3827210 - RNA, 23 nt, Human
cccuccguggcaucaccuuaggc

SEQ ID NO: 3827211 - RNA, 20 nt, Human
cccuccuaccccucccagcu

SEQ ID NO: 3827212 - RNA, 22 nt, Human
cccuccuaccccucccagcuga

SEQ ID NO: 3827213 - RNA, 20 nt, Human
cccuccuaucaccuccccuc

SEQ ID NO: 3827214 - RNA, 21 nt, Human
cccuccuaucaccuccccucc

SEQ ID NO: 3827215 - RNA, 13 nt, Human
cccuccucacccc

SEQ ID NO: 3827216 - RNA, 12 nt, Human
cccuccucacug

SEQ ID NO: 3827217 - RNA, 15 nt, Human
cccuccucacuggcc

SEQ ID NO: 3827218 - RNA, 16 nt, Human
cccuccucacuggcca

SEQ ID NO: 3827219 - RNA, 21 nt, Human
cccuccucacuggccaucccu

SEQ ID NO: 3827220 - RNA, 15 nt, Human
cccuccuccaggccu

SEQ ID NO: 3827221 - RNA, 20 nt, Human
cccuccucccaugucacugc

SEQ ID NO: 3827222 - RNA, 23 nt, Human
cccuccucccuuuuuccuugucc

SEQ ID NO: 3827223 - RNA, 11 nt, Human
cccuccuccug

SEQ ID NO: 3827224 - RNA, 19 nt, Human
cccuccucuagcugugggg

SEQ ID NO: 3827225 - RNA, 14 nt, Human
cccuccucucccau

SEQ ID NO: 3827226 - RNA, 16 nt, Human
cccuccucucugcccu

SEQ ID NO: 3827227 - RNA, 13 nt, Human
cccuccucugaaa

SEQ ID NO: 3827228 - RNA, 12 nt, Human
cccuccucugcc

SEQ ID NO: 3827229 - RNA, 13 nt, Human
cccuccucugcca

SEQ ID NO: 3827230 - RNA, 23 nt, Human
cccuccugaaccgcacagcucag

SEQ ID NO: 3827231 - RNA, 18 nt, Human
cccuccugccgacuccug

SEQ ID NO: 3827232 - RNA, 19 nt, Human
cccuccugccgacuccugg

SEQ ID NO: 3827233 - RNA, 20 nt, Human
cccuccugccgacuccuggg

SEQ ID NO: 3827234 - RNA, 13 nt, Human
cccuccuggggcc

SEQ ID NO: 3827235 - RNA, 10 nt, Human
cccuccuggu

SEQ ID NO: 3827236 - RNA, 22 nt, Human
cccuccuggugucaccccagag

SEQ ID NO: 3827237 - RNA, 13 nt, Human
cccuccuguaaau

SEQ ID NO: 3827238 - RNA, 13 nt, Human
cccuccuguugca

SEQ ID NO: 3827239 - RNA, 21 nt, Human
ccuacucuucucucugcucug

SEQ ID NO: 3827240 - RNA, 16 nt, Human
ccuacugcccaggcac

SEQ ID NO: 3827241 - RNA, 16 nt, Human
ccuacuggucucucua

SEQ ID NO: 3827242 - RNA, 22 nt, Human
ccuacuguucuaaagcucugac

SEQ ID NO: 3827243 - RNA, 21 nt, Human
ccuacuuccccuuccuaauuc

SEQ ID NO: 3827244 - RNA, 13 nt, Human
ccuacuuccugug

SEQ ID NO: 3827245 - RNA, 17 nt, Human
ccuacuuuuaaagaauu

SEQ ID NO: 3827246 - RNA, 16 nt, Human
ccuacuuuuccuuccc

SEQ ID NO: 3827247 - RNA, 20 nt, Human
ccuagaaacaacacuguagu

SEQ ID NO: 3827248 - RNA, 17 nt, Human
ccuagaaacccaagcuc

SEQ ID NO: 3827249 - RNA, 13 nt, Human
ccuagaagggcua

SEQ ID NO: 3827250 - RNA, 22 nt, Human
ccuagaagggcuagaaccugga

SEQ ID NO: 3827251 - RNA, 18 nt, Human
ccuagaauguuucauuug

SEQ ID NO: 3827252 - RNA, 21 nt, Human
ccuagacucuguaacaucacu

SEQ ID NO: 3827253 - RNA, 20 nt, Human
ccuagacucugucuaccugg

SEQ ID NO: 3827254 - RNA, 12 nt, Human
ccuagacuuuag

SEQ ID NO: 3827255 - RNA, 23 nt, Human
ccuagacuuuaggcuuucagcuu

SEQ ID NO: 3827256 - RNA, 21 nt, Human
ccuagagagugugauguucac

SEQ ID NO: 3827257 - RNA, 16 nt, Human
ccuagagccagaccaa

SEQ ID NO: 3827258 - RNA, 17 nt, Human
ccuagaggcccuuugcu

SEQ ID NO: 3827259 - RNA, 12 nt, Human
ccuagaggccug

SEQ ID NO: 3827260 - RNA, 15 nt, Human
ccuagagggaggggc

SEQ ID NO: 3827261 - RNA, 18 nt, Human
ccuagagggaggggccua

SEQ ID NO: 3827262 - RNA, 18 nt, Human
ccuagaguagaguggagg

SEQ ID NO: 3827263 - RNA, 14 nt, Human
ccuagauaugaaua

SEQ ID NO: 3827264 - RNA, 17 nt, Human
ccuagauccacacacag

SEQ ID NO: 3827265 - RNA, 19 nt, Human
ccuagauccacacacagag

SEQ ID NO: 3827266 - RNA, 21 nt, Human
ccuagauguauaacuaggagc

SEQ ID NO: 3827267 - RNA, 15 nt, Human
ccuagcaagcuggcc

SEQ ID NO: 3827268 - RNA, 13 nt, Human
ccuagcaauucca

SEQ ID NO: 3827269 - RNA, 17 nt, Human
ccuagcacacacuuuug

SEQ ID NO: 3827270 - RNA, 16 nt, Human
ccuagcacagcagcuu

SEQ ID NO: 3827271 - RNA, 16 nt, Human
ccuagcacaugcuuca

SEQ ID NO: 3827272 - RNA, 12 nt, Human
ccuagcagagag

SEQ ID NO: 3827273 - RNA, 20 nt, Human
ccuagcagcaccguucugug

SEQ ID NO: 3827274 - RNA, 21 nt, Human
ccuagcagcaccguucugugc

SEQ ID NO: 3827275 - RNA, 15 nt, Human
ccuagcagcccaccc

SEQ ID NO: 3827276 - RNA, 17 nt, Human
ccuagcagcccacccug

SEQ ID NO: 3827277 - RNA, 15 nt, Human
ccuagccauuccugg

SEQ ID NO: 3827278 - RNA, 23 nt, Human
ccuagcccagcgcucugccucac

SEQ ID NO: 3827279 - RNA, 13 nt, Human
ccuagcccaggag

SEQ ID NO: 3827280 - RNA, 17 nt, Human
ccuagcccaggagagag

SEQ ID NO: 3827281 - RNA, 20 nt, Human
ccuagcccucucacauuuau

SEQ ID NO: 3827282 - RNA, 20 nt, Human
ccuagccgaccucagccuuc

SEQ ID NO: 3827283 - RNA, 20 nt, Human
ccuagccgguuccugucccu

SEQ ID NO: 3827284 - RNA, 19 nt, Human
ccuagccuuagaagucaca

SEQ ID NO: 3827285 - RNA, 10 nt, Human
ccuagccuug

SEQ ID NO: 3827286 - RNA, 15 nt, Human
ccuagccuugcuugu

SEQ ID NO: 3827287 - RNA, 19 nt, Human
ccuagcgaucucuccuggc

SEQ ID NO: 3827288 - RNA, 21 nt, Human
ccuagcgaucucuccuggccu

SEQ ID NO: 3827289 - RNA, 22 nt, Human
ccuagcgaucucuccuggccua

SEQ ID NO: 3827290 - RNA, 20 nt, Human
ccuagcgggauggggcuccc

SEQ ID NO: 3827291 - RNA, 14 nt, Human
ccuagcugaauguu

SEQ ID NO: 3827292 - RNA, 19 nt, Human
ccuagcugaauguuuuucu

SEQ ID NO: 3827293 - RNA, 21 nt, Human
ccuagcugcacagggcagcug

SEQ ID NO: 3827294 - RNA, 23 nt, Human
ccuagcugcacagggcagcuggg

SEQ ID NO: 3827295 - RNA, 15 nt, Human
ccuagcugcuacaaa

SEQ ID NO: 3827296 - RNA, 17 nt, Human
ccuagcugcuacaaaga

SEQ ID NO: 3827297 - RNA, 19 nt, Human
ccuagcuggagaggagccc

SEQ ID NO: 3827298 - RNA, 22 nt, Human
ccuagcuggagaggagcccugc

SEQ ID NO: 3827299 - RNA, 13 nt, Human
ccuagcuggcucu

SEQ ID NO: 3827300 - RNA, 21 nt, Human
ccuagcugugaccucuccccu

SEQ ID NO: 3827301 - RNA, 16 nt, Human
ccuagcugugugaaua

SEQ ID NO: 3827302 - RNA, 15 nt, Human
ccuagcuuagagccu

SEQ ID NO: 3827303 - RNA, 21 nt, Human
ccuagcuugggaggcuucccc

SEQ ID NO: 3827304 - RNA, 17 nt, Human
ccuagcuuuagacccug

SEQ ID NO: 3827305 - RNA, 20 nt, Human
ccuagcuuuagacccugggu

SEQ ID NO: 3827306 - RNA, 22 nt, Human
ccuagcuuuagacccugggugg

SEQ ID NO: 3827307 - RNA, 21 nt, Human
ccuagcuuuauauauggacau

SEQ ID NO: 3827308 - RNA, 22 nt, Human
ccuagcuuuauauauggacaug

SEQ ID NO: 3827309 - RNA, 23 nt, Human
ccuagcuuuauauauggacaugg

SEQ ID NO: 3827310 - RNA, 16 nt, Human
ccuaggaaacucacac

SEQ ID NO: 3827311 - RNA, 22 nt, Human
ccuaggaagccucagauuccuu

SEQ ID NO: 3827312 - RNA, 23 nt, Human
ccuaggacauguucccuucuccu

SEQ ID NO: 3827313 - RNA, 16 nt, Human
ccuaggaccacucagc

SEQ ID NO: 3827314 - RNA, 18 nt, Human
ccuaggaccacucagccc

SEQ ID NO: 3827315 - RNA, 19 nt, Human
ccuaggaccacucagcccc

SEQ ID NO: 3827316 - RNA, 19 nt, Human
ccuaggacccgucuccagc

SEQ ID NO: 3827317 - RNA, 21 nt, Human
ccuaggacccgucuccagcug

SEQ ID NO: 3827318 - RNA, 22 nt, Human
ccuaggacccgucuccagcugc

SEQ ID NO: 3827319 - RNA, 12 nt, Human
ccuaggagacca

SEQ ID NO: 3827320 - RNA, 17 nt, Human
ccuaggagauaucugag

SEQ ID NO: 3827321 - RNA, 23 nt, Human
ccuaggcaggacaugcugaagcc

SEQ ID NO: 3827322 - RNA, 23 nt, Human
ccuaggccacaccaucuccuuuc

SEQ ID NO: 3827323 - RNA, 14 nt, Human
ccuaggccacuccu

SEQ ID NO: 3827324 - RNA, 16 nt, Human
ccuaggccacuccucc

SEQ ID NO: 3827325 - RNA, 17 nt, Human
ccuaggccacuccucca

SEQ ID NO: 3827326 - RNA, 19 nt, Human
ccuaggccacuccuccaaa

SEQ ID NO: 3827327 - RNA, 11 nt, Human
ccuaggccagg

SEQ ID NO: 3827328 - RNA, 12 nt, Human
ccuaggccaggu

SEQ ID NO: 3827329 - RNA, 14 nt, Human
ccuaggccucagcc

SEQ ID NO: 3827330 - RNA, 14 nt, Human
ccuaggcucaugga

SEQ ID NO: 3827331 - RNA, 18 nt, Human
ccuaggcuccaccccauc

SEQ ID NO: 3827332 - RNA, 14 nt, Human
ccuaggcuggaagg

SEQ ID NO: 3827333 - RNA, 14 nt, Human
ccuagggaaaaguu

SEQ ID NO: 3827334 - RNA, 22 nt, Human
ccuagggaagggugguggagcc

SEQ ID NO: 3827335 - RNA, 23 nt, Human
ccuagggaggcauggucugcccu

SEQ ID NO: 3827336 - RNA, 22 nt, Human
ccuagggcauuguaucugucuu

SEQ ID NO: 3827337 - RNA, 12 nt, Human
ccuagggccccc

SEQ ID NO: 3827338 - RNA, 16 nt, Human
ccuagggccuggucca

SEQ ID NO: 3827339 - RNA, 14 nt, Human
ccuagggcugggug

SEQ ID NO: 3827340 - RNA, 13 nt, Human
ccuaggggaauga

SEQ ID NO: 3827341 - RNA, 23 nt, Human
ccuagguagcccccucuucccug

SEQ ID NO: 3827342 - RNA, 18 nt, Human
ccuaggugacagagugag

SEQ ID NO: 3827343 - RNA, 16 nt, Human
ccuagguucccggucc

SEQ ID NO: 3827344 - RNA, 20 nt, Human
ccuagguucccuguucuucc

SEQ ID NO: 3827345 - RNA, 18 nt, Human
ccuaguaagugccuucca

SEQ ID NO: 3827346 - RNA, 19 nt, Human
ccuaguaagugccuuccau

SEQ ID NO: 3827347 - RNA, 14 nt, Human
ccuagucagccaca

SEQ ID NO: 3827348 - RNA, 16 nt, Human
ccuagucagccacaug

SEQ ID NO: 3827349 - RNA, 15 nt, Human
ccuagucccuucccc

SEQ ID NO: 3827350 - RNA, 21 nt, Human
ccuagucccuuccccucccug

SEQ ID NO: 3827351 - RNA, 19 nt, Human
ccuagugaaacuuuucuag

SEQ ID NO: 3827352 - RNA, 22 nt, Human
ccuagugaaggcuucucucugu

SEQ ID NO: 3827353 - RNA, 13 nt, Human
ccuaguuccacca

SEQ ID NO: 3827354 - RNA, 21 nt, Human
ccuaguuccaccaucaagcca

SEQ ID NO: 3827355 - RNA, 17 nt, Human
ccuaguucccucugcuc

SEQ ID NO: 3827356 - RNA, 21 nt, Human
ccuaguucccucugcucagcc

SEQ ID NO: 3827357 - RNA, 18 nt, Human
ccuaguucuagaaaaaca

SEQ ID NO: 3827358 - RNA, 18 nt, Human
ccuaguucuguagaaaug

SEQ ID NO: 3827359 - RNA, 19 nt, Human
ccuaguucuguagaaaugg

SEQ ID NO: 3827360 - RNA, 13 nt, Human
ccuaguucuucau

SEQ ID NO: 3827361 - RNA, 23 nt, Human
ccuaguuggugagaaaccuguau

SEQ ID NO: 3827362 - RNA, 14 nt, Human
ccuaguuucccuga

SEQ ID NO: 3827363 - RNA, 16 nt, Human
ccuaguuuccucuccu

SEQ ID NO: 3827364 - RNA, 20 nt, Human
ccuaguuugggaggagcaga

SEQ ID NO: 3827365 - RNA, 17 nt, Human
ccuaguuugugagaaac

SEQ ID NO: 3827366 - RNA, 16 nt, Human
ccuaguuuucuccucc

SEQ ID NO: 3827367 - RNA, 17 nt, Human
ccuauaaaguaaagcua

SEQ ID NO: 3827368 - RNA, 20 nt, Human
ccuauaacacugugaagagc

SEQ ID NO: 3827369 - RNA, 17 nt, Human
ccuauaacuugaugcau

SEQ ID NO: 3827370 - RNA, 18 nt, Human
ccuauaauccuugauaau

SEQ ID NO: 3827371 - RNA, 14 nt, Human
ccuauaaucuguca

SEQ ID NO: 3827372 - RNA, 15 nt, Human
ccuauaaugugugua

SEQ ID NO: 3827373 - RNA, 17 nt, Human
ccuauaauguguguaug

SEQ ID NO: 3827374 - RNA, 20 nt, Human
cccuucagcccccagccccu

SEQ ID NO: 3827375 - RNA, 17 nt, Human
cccuucaguacccucuc

SEQ ID NO: 3827376 - RNA, 16 nt, Human
cccuucaugcauggaa

SEQ ID NO: 3827377 - RNA, 18 nt, Human
cccuuccaaauaauaaag

SEQ ID NO: 3827378 - RNA, 12 nt, Human
cccuuccacugc

SEQ ID NO: 3827379 - RNA, 13 nt, Human
cccuuccacugcc

SEQ ID NO: 3827380 - RNA, 13 nt, Human
cccuuccagauca

SEQ ID NO: 3827381 - RNA, 23 nt, Human
cccuuccaggccaucagaggccu

SEQ ID NO: 3827382 - RNA, 18 nt, Human
cccuuccaguuuauucca

SEQ ID NO: 3827383 - RNA, 17 nt, Human
ccucacuggcucuccug

SEQ ID NO: 3827384 - RNA, 12 nt, Human
ccucacugggug

SEQ ID NO: 3827385 - RNA, 21 nt, Human
ccucacuuggucugccaggcc

SEQ ID NO: 3827386 - RNA, 23 nt, Human
ccucacuuggucugccaggcccc

SEQ ID NO: 3827387 - RNA, 23 nt, Human
ccucagaacaaagugagacaguc

SEQ ID NO: 3827388 - RNA, 21 nt, Human
ccucagaacccuuggcuugcc

SEQ ID NO: 3827389 - RNA, 23 nt, Human
cccuuuuuacuccccuugagcug

SEQ ID NO: 3827390 - RNA, 16 nt, Human
cccuuuuuuguccccc

SEQ ID NO: 3827391 - RNA, 17 nt, Human
cccuuuuuuguccccca

SEQ ID NO: 3827392 - RNA, 18 nt, Human
cccuuuuuugucccccaa

SEQ ID NO: 3827393 - RNA, 19 nt, Human
cccuuuuuugucccccaac

SEQ ID NO: 3827394 - RNA, 21 nt, Human
cccuuuuuuuccuuuuucuga

SEQ ID NO: 3827395 - RNA, 17 nt, Human
ccgaaaacguggcugcu

SEQ ID NO: 3827396 - RNA, 24 nt, Human
ccgaaacaggcuacucuccucggc

SEQ ID NO: 3827397 - RNA, 17 nt, Human
ccgaaaccaaagaagaa

SEQ ID NO: 3827398 - RNA, 19 nt, Human
ccgaaagggacuuggaagc

SEQ ID NO: 3827399 - RNA, 23 nt, Human
ccgaaaggucaccucacucagca

SEQ ID NO: 3827400 - RNA, 15 nt, Human
ccgaaccuccucugu

SEQ ID NO: 3827401 - RNA, 17 nt, Human
ccgaacuguuguauaaa

SEQ ID NO: 3827402 - RNA, 18 nt, Human
ccgaagaaggguccuucc

SEQ ID NO: 3827403 - RNA, 15 nt, Human
ccgaagcccaggggc

SEQ ID NO: 3827404 - RNA, 21 nt, Human
ccgaagcucuggcugaacccu

SEQ ID NO: 3827405 - RNA, 21 nt, Human
ccgaaguggacuggccccugg

SEQ ID NO: 3827406 - RNA, 17 nt, Human
ccgaauagcugggacua

SEQ ID NO: 3827407 - RNA, 20 nt, Human
ccgaaugugcagguuuguua

SEQ ID NO: 3827408 - RNA, 15 nt, Human
ccgaaugugucuuua

SEQ ID NO: 3827409 - RNA, 20 nt, Human
ccgacaaccgaugcuccagc

SEQ ID NO: 3827410 - RNA, 13 nt, Human
ccgacaagcacag

SEQ ID NO: 3827411 - RNA, 15 nt, Human
ccgacagccuggcac

SEQ ID NO: 3827412 - RNA, 22 nt, Human
ccgacagccuggcacagggcag

SEQ ID NO: 3827413 - RNA, 17 nt, Human
ccgacagcuuuccagua

SEQ ID NO: 3827414 - RNA, 16 nt, Human
ccgaccacaccagagc

SEQ ID NO: 3827415 - RNA, 17 nt, Human
ccgaccacuuccagggg

SEQ ID NO: 3827416 - RNA, 13 nt, Human
ccgaccagacacc

SEQ ID NO: 3827417 - RNA, 17 nt, Human
ccgaccagacaccuuga

SEQ ID NO: 3827418 - RNA, 17 nt, Human
ccgaccagaggagccuu

SEQ ID NO: 3827419 - RNA, 16 nt, Human
ccgaccccaagaguuu

SEQ ID NO: 3827420 - RNA, 13 nt, Human
ccgaccucguccu

SEQ ID NO: 3827421 - RNA, 22 nt, Human
ccgaccucguccucccccugcc

SEQ ID NO: 3827422 - RNA, 22 nt, Human
ccgaccugaggacauggcuucu

SEQ ID NO: 3827423 - RNA, 13 nt, Human
ccgaccuggccgc

SEQ ID NO: 3827424 - RNA, 13 nt, Human
ccgacgcccaccc

SEQ ID NO: 3827425 - RNA, 16 nt, Human
ccgacgcgucuccugu

SEQ ID NO: 3827426 - RNA, 14 nt, Human
ccgacggagccggg

SEQ ID NO: 3827427 - RNA, 14 nt, Human
ccgacgucauguau

SEQ ID NO: 3827428 - RNA, 20 nt, Human
ccgacucacaccacuagccu

SEQ ID NO: 3827429 - RNA, 13 nt, Human
ccgacuccagcca

SEQ ID NO: 3827430 - RNA, 14 nt, Human
ccgacucuggcccu

SEQ ID NO: 3827431 - RNA, 15 nt, Human
ccgacuggggcaggg

SEQ ID NO: 3827432 - RNA, 21 nt, Human
ccgacuugaauuuucccacug

SEQ ID NO: 3827433 - RNA, 23 nt, Human
ccgacuugcuguuuuguucugug

SEQ ID NO: 3827434 - RNA, 13 nt, Human
ccgagagccugcu

SEQ ID NO: 3827435 - RNA, 20 nt, Human
ccgagaguagccgagagccu

SEQ ID NO: 3827436 - RNA, 21 nt, Human
ccgagaguagccgagagccug

SEQ ID NO: 3827437 - RNA, 22 nt, Human
ccgagaguagccgagagccugc

SEQ ID NO: 3827438 - RNA, 19 nt, Human
ccgagaucaguauuuaacu

SEQ ID NO: 3827439 - RNA, 19 nt, Human
ccgagauugcaccacugca

SEQ ID NO: 3827440 - RNA, 16 nt, Human
ccgagcaaccguggcc

SEQ ID NO: 3827441 - RNA, 18 nt, Human
ccgagcaaccguggcccu

SEQ ID NO: 3827442 - RNA, 23 nt, Human
ccgagcaaccguggcccuuccug

SEQ ID NO: 3827443 - RNA, 22 nt, Human
ccgagcaauauuuauggaugca

SEQ ID NO: 3827444 - RNA, 16 nt, Human
ccgagcagcugagcag

SEQ ID NO: 3827445 - RNA, 20 nt, Human
ccgagcagcugagcagggcc

SEQ ID NO: 3827446 - RNA, 16 nt, Human
ccgagccgggccuggg

SEQ ID NO: 3827447 - RNA, 16 nt, Human
ccgagcuccucuucca

SEQ ID NO: 3827448 - RNA, 16 nt, Human
ccgagcugggggccau

SEQ ID NO: 3827449 - RNA, 20 nt, Human
ccgagcuggugcauuacaga

SEQ ID NO: 3827450 - RNA, 19 nt, Human
ccgagcuuugaaaauucag

SEQ ID NO: 3827451 - RNA, 16 nt, Human
ccgaggacccagaccc

SEQ ID NO: 3827452 - RNA, 13 nt, Human
ccgaggacccagg

SEQ ID NO: 3827453 - RNA, 15 nt, Human
ccgaggaggugccug

SEQ ID NO: 3827454 - RNA, 23 nt, Human
ccgaggaggugucucaggcugcc

SEQ ID NO: 3827455 - RNA, 15 nt, Human
ccgaggcagggaagg

SEQ ID NO: 3827456 - RNA, 11 nt, Human
ccgaggcccug

SEQ ID NO: 3827457 - RNA, 12 nt, Human
ccgaggcccugc

SEQ ID NO: 3827458 - RNA, 14 nt, Human
ccgaggccuucucu

SEQ ID NO: 3827459 - RNA, 20 nt, Human
ccgaggcggguggaucacga

SEQ ID NO: 3827460 - RNA, 22 nt, Human
ccgagggaggggaagcuucugu

SEQ ID NO: 3827461 - RNA, 23 nt, Human
ccgagggaggggaagcuucuguc

SEQ ID NO: 3827462 - RNA, 19 nt, Human
ccgagggaugaugccacac

SEQ ID NO: 3827463 - RNA, 20 nt, Human
ccgagggaugaugccacacc

SEQ ID NO: 3827464 - RNA, 16 nt, Human
ccgagggcugagccug

SEQ ID NO: 3827465 - RNA, 13 nt, Human
ccgaggggcggga

SEQ ID NO: 3827466 - RNA, 23 nt, Human
ccgaggggcgggacccaggcacc

SEQ ID NO: 3827467 - RNA, 18 nt, Human
ccgaggggcucaggaaaa

SEQ ID NO: 3827468 - RNA, 23 nt, Human
ccgaggguccuggcuccugaggg

SEQ ID NO: 3827469 - RNA, 17 nt, Human
ccgaggugguuuuaaag

SEQ ID NO: 3827470 - RNA, 17 nt, Human
ccgaguagaaaauguga

SEQ ID NO: 3827471 - RNA, 20 nt, Human
ccgagucauucguucugugg

SEQ ID NO: 3827472 - RNA, 13 nt, Human
ccgagucugggac

SEQ ID NO: 3827473 - RNA, 14 nt, Human
ccgagucugggaca

SEQ ID NO: 3827474 - RNA, 17 nt, Human
ccgagugaacuggucuu

SEQ ID NO: 3827475 - RNA, 23 nt, Human
ccgaguguguuucauccuuccca

SEQ ID NO: 3827476 - RNA, 17 nt, Human
ccgauaucagaauuugu

SEQ ID NO: 3827477 - RNA, 15 nt, Human
ccgaucgccagcaaa

SEQ ID NO: 3827478 - RNA, 17 nt, Human
ccgaugcaaacauugga

SEQ ID NO: 3827479 - RNA, 20 nt, Human
ccgaugcaaacauuggaaga

SEQ ID NO: 3827480 - RNA, 22 nt, Human
ccgaugcuccagccaaccccug

SEQ ID NO: 3827481 - RNA, 11 nt, Human
ccgaugcugcu

SEQ ID NO: 3827482 - RNA, 23 nt, Human
ccgaugcugcuuuccccuguggg

SEQ ID NO: 3827483 - RNA, 20 nt, Human
ccgaugguggguggggcugc

SEQ ID NO: 3827484 - RNA, 16 nt, Human
ccgauucaccugagca

SEQ ID NO: 3827485 - RNA, 21 nt, Human
ccgauucaucucucagaaggg

SEQ ID NO: 3827486 - RNA, 13 nt, Human
ccgauuguaacuc

SEQ ID NO: 3827487 - RNA, 16 nt, Human
ccgauuguaacucaaa

SEQ ID NO: 3827488 - RNA, 14 nt, Human
ccgauuucuguaaa

SEQ ID NO: 3827489 - RNA, 17 nt, Human
ccgcaaaacccacugac

SEQ ID NO: 3827490 - RNA, 15 nt, Human
ccgcaaaccacacug

SEQ ID NO: 3827491 - RNA, 15 nt, Human
ccgcaauacaggaac

SEQ ID NO: 3827492 - RNA, 20 nt, Human
ccgcacacccucacucugcc

SEQ ID NO: 3827493 - RNA, 23 nt, Human
ccgcacacccucacucugccagg

SEQ ID NO: 3827494 - RNA, 13 nt, Human
ccgcacagcagcc

SEQ ID NO: 3827495 - RNA, 15 nt, Human
ccgcacagcagccug

SEQ ID NO: 3827496 - RNA, 22 nt, Human
ccgcacagcagccugcuuccca

SEQ ID NO: 3827497 - RNA, 12 nt, Human
ccgcacagcuca

SEQ ID NO: 3827498 - RNA, 13 nt, Human
ccgcacagcucag

SEQ ID NO: 3827499 - RNA, 13 nt, Human
ccgcaccccagag

SEQ ID NO: 3827500 - RNA, 16 nt, Human
ccgcacccccacccuu

SEQ ID NO: 3827501 - RNA, 14 nt, Human
ccgcacuaggggau

SEQ ID NO: 3827502 - RNA, 14 nt, Human
ccgcacucacccau

SEQ ID NO: 3827503 - RNA, 23 nt, Human
ccgcacugggcuuggggaccaga

SEQ ID NO: 3827504 - RNA, 14 nt, Human
ccgcagaagcccug

SEQ ID NO: 3827505 - RNA, 16 nt, Human
ccgcagaagccucccc

SEQ ID NO: 3827506 - RNA, 18 nt, Human
ccgcagaaggaaggcagg

SEQ ID NO: 3827507 - RNA, 14 nt, Human
ccgcagaccucugg

SEQ ID NO: 3827508 - RNA, 23 nt, Human
ccgcagagaagugacgguuccua

SEQ ID NO: 3827509 - RNA, 21 nt, Human
ccgcagagcgcgccccuagcc

SEQ ID NO: 3827510 - RNA, 22 nt, Human
ccgcagagcgcgccccuagccg

SEQ ID NO: 3827511 - RNA, 14 nt, Human
ccgcagcagcuccc

SEQ ID NO: 3827512 - RNA, 14 nt, Human
ccgcagcucuugcc

SEQ ID NO: 3827513 - RNA, 22 nt, Human
ccgcaggcagacuacacaggau

SEQ ID NO: 3827514 - RNA, 22 nt, Human
ccgcagucgucgcacagucucu

SEQ ID NO: 3827515 - RNA, 17 nt, Human
ccgcagugggagcaaac

SEQ ID NO: 3827516 - RNA, 22 nt, Human
ccgcagugugcacuaaggggcc

SEQ ID NO: 3827517 - RNA, 17 nt, Human
ccgcaguuccugucccu

SEQ ID NO: 3827518 - RNA, 18 nt, Human
ccgcauccccugccucca

SEQ ID NO: 3827519 - RNA, 22 nt, Human
ccgcauccccugccuccauccu

SEQ ID NO: 3827520 - RNA, 14 nt, Human
ccgcaucucacagc

SEQ ID NO: 3827521 - RNA, 15 nt, Human
ccgcaucuucuccau

SEQ ID NO: 3827522 - RNA, 19 nt, Human
ccgcaucuucuccaucugg

SEQ ID NO: 3827523 - RNA, 12 nt, Human
ccgcaugccccc

SEQ ID NO: 3827524 - RNA, 17 nt, Human
ccgccaaggcuggggga

SEQ ID NO: 3827525 - RNA, 14 nt, Human
ccgccacaucccuc

SEQ ID NO: 3827526 - RNA, 19 nt, Human
ccgccagauggggccucug

SEQ ID NO: 3827527 - RNA, 16 nt, Human
ccuagauaugaauaua

SEQ ID NO: 3827528 - RNA, 23 nt, Human
ccuagauggcagucacugaauuc

SEQ ID NO: 3827529 - RNA, 20 nt, Human
ccuagauguauaacuaggag

SEQ ID NO: 3827530 - RNA, 16 nt, Human
ccuagauucagggaaa

SEQ ID NO: 3827531 - RNA, 16 nt, Human
ccuagauuuaauauaa

SEQ ID NO: 3827532 - RNA, 17 nt, Human
ccuagcaagcuggccuc

SEQ ID NO: 3827533 - RNA, 15 nt, Human
ccuagcacagcagcu

SEQ ID NO: 3827534 - RNA, 17 nt, Human
ccuagcacuuugggagg

SEQ ID NO: 3827535 - RNA, 12 nt, Human
ccuagcagcacc

SEQ ID NO: 3827536 - RNA, 20 nt, Human
ccuagcagcccacccugcug

SEQ ID NO: 3827537 - RNA, 13 nt, Human
ccuagcagugaac

SEQ ID NO: 3827538 - RNA, 16 nt, Human
ccuagccauuccuggu

SEQ ID NO: 3827539 - RNA, 21 nt, Human
ccuagccauuccugguaccca

SEQ ID NO: 3827540 - RNA, 13 nt, Human
ccuagccauucug

SEQ ID NO: 3827541 - RNA, 13 nt, Human
ccuagcccacccu

SEQ ID NO: 3827542 - RNA, 14 nt, Human
ccuagcccacccug

SEQ ID NO: 3827543 - RNA, 16 nt, Human
ccuagcccacccugcu

SEQ ID NO: 3827544 - RNA, 17 nt, Human
ccuagcccagcgcucug

SEQ ID NO: 3827545 - RNA, 19 nt, Human
ccuagcccaggagagagaa

SEQ ID NO: 3827546 - RNA, 21 nt, Human
ccuagccccuuagcccccacc

SEQ ID NO: 3827547 - RNA, 16 nt, Human
ccuagcccucucccuc

SEQ ID NO: 3827548 - RNA, 16 nt, Human
ccuagccgaccucagc

SEQ ID NO: 3827549 - RNA, 22 nt, Human
ccuagccgguuccugucccugc

SEQ ID NO: 3827550 - RNA, 20 nt, Human
ccuagccugugccucuggga

SEQ ID NO: 3827551 - RNA, 17 nt, Human
ccuagccuguuucuucc

SEQ ID NO: 3827552 - RNA, 17 nt, Human
ccuagccuugcacuuuc

SEQ ID NO: 3827553 - RNA, 14 nt, Human
ccuagccuugcuug

SEQ ID NO: 3827554 - RNA, 21 nt, Human
ccuagcgcuaucucccugccu

SEQ ID NO: 3827555 - RNA, 15 nt, Human
ccuagcuaauuauuu

SEQ ID NO: 3827556 - RNA, 22 nt, Human
ccuagcugaauguuuuucuaaa

SEQ ID NO: 3827557 - RNA, 19 nt, Human
ccuagcugcacagggcagc

SEQ ID NO: 3827558 - RNA, 14 nt, Human
ccuagcugcuacaa

SEQ ID NO: 3827559 - RNA, 13 nt, Human
ccuagcuguccuu

SEQ ID NO: 3827560 - RNA, 18 nt, Human
ccuagcuguccuuuuucc

SEQ ID NO: 3827561 - RNA, 19 nt, Human
ccuagcuguccuuuuuccu

SEQ ID NO: 3827562 - RNA, 11 nt, Human
ccuagcugugu

SEQ ID NO: 3827563 - RNA, 21 nt, Human
ccuagcuuuagacccugggug

SEQ ID NO: 3827564 - RNA, 17 nt, Human
ccuaggaauucccagcc

SEQ ID NO: 3827565 - RNA, 21 nt, Human
ccuaggaccacucagccccua

SEQ ID NO: 3827566 - RNA, 20 nt, Human
ccuaggagauaucugaggga

SEQ ID NO: 3827567 - RNA, 15 nt, Human
ccuaggaggguccuc

SEQ ID NO: 3827568 - RNA, 16 nt, Human
ccuaggaguauauuuc

SEQ ID NO: 3827569 - RNA, 20 nt, Human
ccuaggauucacaccccacc

SEQ ID NO: 3827570 - RNA, 22 nt, Human
ccuaggauucacaccccaccug

SEQ ID NO: 3827571 - RNA, 23 nt, Human
ccuaggauucacaccccaccugc

SEQ ID NO: 3827572 - RNA, 14 nt, Human
ccuaggauucuaaa

SEQ ID NO: 3827573 - RNA, 13 nt, Human
ccuaggcaggaca

SEQ ID NO: 3827574 - RNA, 18 nt, Human
ccuaggcaggacaugcug

SEQ ID NO: 3827575 - RNA, 22 nt, Human
ccuaggcaguaggccggugugc

SEQ ID NO: 3827576 - RNA, 15 nt, Human
ccuaggccugggcag

SEQ ID NO: 3827577 - RNA, 23 nt, Human
ccuaggccugggcaguggauggc

SEQ ID NO: 3827578 - RNA, 11 nt, Human
ccuaggcugca

SEQ ID NO: 3827579 - RNA, 19 nt, Human
ccuaggcuggaaggaggaa

SEQ ID NO: 3827580 - RNA, 20 nt, Human
ccuagggauguucuggcccu

SEQ ID NO: 3827581 - RNA, 15 nt, Human
ccuagggcugggugu

SEQ ID NO: 3827582 - RNA, 23 nt, Human
ccuaggggaaugagggggcucag

SEQ ID NO: 3827583 - RNA, 18 nt, Human
ccuaggggacacuucccu

SEQ ID NO: 3827584 - RNA, 18 nt, Human
ccuaggggucagggacca

SEQ ID NO: 3827585 - RNA, 20 nt, Human
ccuagguagcccccucuucc

SEQ ID NO: 3827586 - RNA, 22 nt, Human
ccuagguauaauucacauugua

SEQ ID NO: 3827587 - RNA, 13 nt, Human
ccuaggugacaga

SEQ ID NO: 3827588 - RNA, 19 nt, Human
ccuagguucccggucccga

SEQ ID NO: 3827589 - RNA, 18 nt, Human
ccuagguucccuguucuu

SEQ ID NO: 3827590 - RNA, 21 nt, Human
ccuagguucccuguucuuccu

SEQ ID NO: 3827591 - RNA, 22 nt, Human
ccuagguucccuguucuuccuc

SEQ ID NO: 3827592 - RNA, 16 nt, Human
ccuaguaagugccuuc

SEQ ID NO: 3827593 - RNA, 13 nt, Human
ccuaguacugccc

SEQ ID NO: 3827594 - RNA, 16 nt, Human
ccuaguccagugaccu

SEQ ID NO: 3827595 - RNA, 13 nt, Human
ccuagucccuucc

SEQ ID NO: 3827596 - RNA, 19 nt, Human
caguccuuggccugcuaag

SEQ ID NO: 3827597 - RNA, 21 nt, Human
caguccuuuguaaacaguguu

SEQ ID NO: 3827598 - RNA, 21 nt, Human
caguccuuuuacuacagcuau

SEQ ID NO: 3827599 - RNA, 22 nt, Human
cagucgccuuucagcaggcagc

SEQ ID NO: 3827600 - RNA, 14 nt, Human
cagucgcgcugccu

SEQ ID NO: 3827601 - RNA, 19 nt, Human
cagucgggggaacugaggc

SEQ ID NO: 3827602 - RNA, 19 nt, Human
cagucgggggcuggccuag

SEQ ID NO: 3827603 - RNA, 13 nt, Human
cagucgucgcaca

SEQ ID NO: 3827604 - RNA, 21 nt, Human
cagucgugguugggaacacag

SEQ ID NO: 3827605 - RNA, 19 nt, Human
cagucuaaaaugcuucagu

SEQ ID NO: 3827606 - RNA, 13 nt, Human
cagucuaauuuuu

SEQ ID NO: 3827607 - RNA, 17 nt, Human
cagucuaauuuuuauuc

SEQ ID NO: 3827608 - RNA, 18 nt, Human
cagucuaauuuuuauuca

SEQ ID NO: 3827609 - RNA, 21 nt, Human
cagucuacccaccucagccuc

SEQ ID NO: 3827610 - RNA, 19 nt, Human
cagucuacccagagaagcc

SEQ ID NO: 3827611 - RNA, 15 nt, Human
cagucuauccacaga

SEQ ID NO: 3827612 - RNA, 22 nt, Human
cagucuauccacagagaguccc

SEQ ID NO: 3827613 - RNA, 23 nt, Human
cagucucaaaaauacaaaauaaa

SEQ ID NO: 3827614 - RNA, 20 nt, Human
cagucucacauuucucaaca

SEQ ID NO: 3827615 - RNA, 23 nt, Human
cagucucacugugggaaggccag

SEQ ID NO: 3827616 - RNA, 19 nt, Human
cagucucagaaugucauuu

SEQ ID NO: 3827617 - RNA, 15 nt, Human
cagucucaggaaauc

SEQ ID NO: 3827618 - RNA, 14 nt, Human
cagucucaggagca

SEQ ID NO: 3827619 - RNA, 18 nt, Human
cagucucccuucucccau

SEQ ID NO: 3827620 - RNA, 20 nt, Human
cagucuccggccucuccagc

SEQ ID NO: 3827621 - RNA, 21 nt, Human
cagucuccggccucuccagcc

SEQ ID NO: 3827622 - RNA, 13 nt, Human
cagucuccucuuu

SEQ ID NO: 3827623 - RNA, 16 nt, Human
cagucuccucuuuaaa

SEQ ID NO: 3827624 - RNA, 22 nt, Human
cagucuccucuuuaaaacaaaa

SEQ ID NO: 3827625 - RNA, 15 nt, Human
cagucucggguggcu

SEQ ID NO: 3827626 - RNA, 22 nt, Human
cagucucggguggcuagucaga

SEQ ID NO: 3827627 - RNA, 20 nt, Human
cagucucuauaccaauaaag

SEQ ID NO: 3827628 - RNA, 15 nt, Human
cagucucucucuucc

SEQ ID NO: 3827629 - RNA, 17 nt, Human
cagucucucuuaaaguu

SEQ ID NO: 3827630 - RNA, 18 nt, Human
cagucucucuuaaaguug

SEQ ID NO: 3827631 - RNA, 16 nt, Human
cagucucugagggcuu

SEQ ID NO: 3827632 - RNA, 20 nt, Human
cagucucugagggcuuccuu

SEQ ID NO: 3827633 - RNA, 18 nt, Human
cagucucugccuugccuu

SEQ ID NO: 3827634 - RNA, 19 nt, Human
cagucucugccuugccuuu

SEQ ID NO: 3827635 - RNA, 19 nt, Human
cagucucuuuaaucuucag

SEQ ID NO: 3827636 - RNA, 22 nt, Human
cagucucuuuaaucuucaguuu

SEQ ID NO: 3827637 - RNA, 18 nt, Human
cagucugaaugcugccac

SEQ ID NO: 3827638 - RNA, 20 nt, Human
cagucugaaugcugccacaa

SEQ ID NO: 3827639 - RNA, 17 nt, Human
cagucugagagaggcca

SEQ ID NO: 3827640 - RNA, 22 nt, Human
cagucugaucgugacgcugaau

SEQ ID NO: 3827641 - RNA, 15 nt, Human
cagucugaucuguga

SEQ ID NO: 3827642 - RNA, 22 nt, Human
cagucugaugagaacucugagc

SEQ ID NO: 3827643 - RNA, 20 nt, Human
cagucugauucccaagcucu

SEQ ID NO: 3827644 - RNA, 22 nt, Human
cagucugauucccaagcucugc

SEQ ID NO: 3827645 - RNA, 13 nt, Human
cagucugcugccc

SEQ ID NO: 3827646 - RNA, 18 nt, Human
cagucugcugcccuccau

SEQ ID NO: 3827647 - RNA, 18 nt, Human
cagucuggaaugcagugg

SEQ ID NO: 3827648 - RNA, 12 nt, Human
cagucuggaggg

SEQ ID NO: 3827649 - RNA, 20 nt, Human
cagucuggcugagcccugcu

SEQ ID NO: 3827650 - RNA, 21 nt, Human
cagucugucuucuguauauaa

SEQ ID NO: 3827651 - RNA, 11 nt, Human
cagucuuccac

SEQ ID NO: 3827652 - RNA, 16 nt, Human
cagucuuccacaaaga

SEQ ID NO: 3827653 - RNA, 20 nt, Human
cagucuuccacaaagaaaau

SEQ ID NO: 3827654 - RNA, 21 nt, Human
cagucuuccacaaagaaaauu

SEQ ID NO: 3827655 - RNA, 17 nt, Human
cagucuuccaccuggaa

SEQ ID NO: 3827656 - RNA, 18 nt, Human
cagucuuccauuugcaag

SEQ ID NO: 3827657 - RNA, 22 nt, Human
cagucuucccuagggcugggug

SEQ ID NO: 3827658 - RNA, 17 nt, Human
cagucuuccugacacuu

SEQ ID NO: 3827659 - RNA, 21 nt, Human
cagucuuccugacacuuuaau

SEQ ID NO: 3827660 - RNA, 18 nt, Human
cagucuugacgaguguga

SEQ ID NO: 3827661 - RNA, 14 nt, Human
cagucuugcagcag

SEQ ID NO: 3827662 - RNA, 19 nt, Human
cagucuugccuuacacaaa

SEQ ID NO: 3827663 - RNA, 13 nt, Human
cagucuugugcuu

SEQ ID NO: 3827664 - RNA, 18 nt, Human
cagucuuuaaaggcccag

SEQ ID NO: 3827665 - RNA, 23 nt, Human
cagucuuuaaaggcccagccccu

SEQ ID NO: 3827666 - RNA, 22 nt, Human
cagucuuuaaucugagaggcca

SEQ ID NO: 3827667 - RNA, 14 nt, Human
cagucuuuuguccu

SEQ ID NO: 3827668 - RNA, 20 nt, Human
cagucuuuuucuguuguaac

SEQ ID NO: 3827669 - RNA, 22 nt, Human
cagucuuuuuggugaggguaac

SEQ ID NO: 3827670 - RNA, 17 nt, Human
caguggcagggcacagg

SEQ ID NO: 3827671 - RNA, 20 nt, Human
caguggcagggcacagggcc

SEQ ID NO: 3827672 - RNA, 21 nt, Human
caguggcaucaucucagcuca

SEQ ID NO: 3827673 - RNA, 19 nt, Human
caguggcauggcuccaguc

SEQ ID NO: 3827674 - RNA, 14 nt, Human
caguggccuacaaa

SEQ ID NO: 3827675 - RNA, 22 nt, Human
caguggccuacaaaucaguaau

SEQ ID NO: 3827676 - RNA, 20 nt, Human
caguggccucaacccucccu

SEQ ID NO: 3827677 - RNA, 13 nt, Human
caguggccuggcu

SEQ ID NO: 3827678 - RNA, 23 nt, Human
caguggccuggcuccgcugugug

SEQ ID NO: 3827679 - RNA, 18 nt, Human
caguggccuuccccagca

SEQ ID NO: 3827680 - RNA, 22 nt, Human
caguggcgaaaucccugcucac

SEQ ID NO: 3827681 - RNA, 17 nt, Human
caguggcugcugcccag

SEQ ID NO: 3827682 - RNA, 18 nt, Human
caguggcugcugcccagg

SEQ ID NO: 3827683 - RNA, 18 nt, Human
caguggcuggaucuguga

SEQ ID NO: 3827684 - RNA, 20 nt, Human
caguggcuggaucugugagg

SEQ ID NO: 3827685 - RNA, 19 nt, Human
cagugggaacgugacugcc

SEQ ID NO: 3827686 - RNA, 17 nt, Human
cagugggaacucugaca

SEQ ID NO: 3827687 - RNA, 22 nt, Human
cagugggaacucugacaagggc

SEQ ID NO: 3827688 - RNA, 14 nt, Human
cagugggagaaaac

SEQ ID NO: 3827689 - RNA, 17 nt, Human
cagugggagauguuaga

SEQ ID NO: 3827690 - RNA, 23 nt, Human
cagugggagcugccuguucagcu

SEQ ID NO: 3827691 - RNA, 13 nt, Human
cagugggaggcgc

SEQ ID NO: 3827692 - RNA, 15 nt, Human
cagugggaggggcag

SEQ ID NO: 3827693 - RNA, 16 nt, Human
cagugggaggggcagg

SEQ ID NO: 3827694 - RNA, 21 nt, Human
cagugggccuggccagcaggu

SEQ ID NO: 3827695 - RNA, 14 nt, Human
caguggggccugug

SEQ ID NO: 3827696 - RNA, 16 nt, Human
caguggggccugugga

SEQ ID NO: 3827697 - RNA, 16 nt, Human
caguggggcucucuga

SEQ ID NO: 3827698 - RNA, 21 nt, Human
caguggggcucucugaguccu

SEQ ID NO: 3827699 - RNA, 13 nt, Human
caguggggcuggg

SEQ ID NO: 3827700 - RNA, 14 nt, Human
caguggggcugggg

SEQ ID NO: 3827701 - RNA, 20 nt, Human
cagugggucccacuuccccu

SEQ ID NO: 3827702 - RNA, 22 nt, Human
cagugggucccacuuccccucc

SEQ ID NO: 3827703 - RNA, 14 nt, Human
caguggguuaacau

SEQ ID NO: 3827704 - RNA, 15 nt, Human
cagugguaaaaaggc

SEQ ID NO: 3827705 - RNA, 13 nt, Human
cagugguaagcua

SEQ ID NO: 3827706 - RNA, 15 nt, Human
cagugguaagcucug

SEQ ID NO: 3827707 - RNA, 20 nt, Human
cagugguccacaucccggga

SEQ ID NO: 3827708 - RNA, 13 nt, Human
caguggucucaca

SEQ ID NO: 3827709 - RNA, 19 nt, Human
caguggugcgaucucggcu

SEQ ID NO: 3827710 - RNA, 20 nt, Human
caguggugcgaucuggguuc

SEQ ID NO: 3827711 - RNA, 22 nt, Human
cagugguggcaacauucauugc

SEQ ID NO: 3827712 - RNA, 22 nt, Human
caguggugguuuucuguucuuu

SEQ ID NO: 3827713 - RNA, 15 nt, Human
cagugguuuuauacu

SEQ ID NO: 3827714 - RNA, 15 nt, Human
caguguaauccccca

SEQ ID NO: 3827715 - RNA, 15 nt, Human
caguguaauuucuuu

SEQ ID NO: 3827716 - RNA, 15 nt, Human
caguguacagucuug

SEQ ID NO: 3827717 - RNA, 20 nt, Human
caguguacauggaauaacau

SEQ ID NO: 3827718 - RNA, 18 nt, Human
caguguaccauuaaaaua

SEQ ID NO: 3827719 - RNA, 21 nt, Human
caguguaccauuaaaauaugc

SEQ ID NO: 3827720 - RNA, 16 nt, Human
caguguacccccgccc

SEQ ID NO: 3827721 - RNA, 16 nt, Human
caguguagauuuuaua

SEQ ID NO: 3827722 - RNA, 16 nt, Human
caguguaguuaauuua

SEQ ID NO: 3827723 - RNA, 23 nt, Human
caguguauuuguauuuuuuugca

SEQ ID NO: 3827724 - RNA, 17 nt, Human
cagugucaaauaaacac

SEQ ID NO: 3827725 - RNA, 20 nt, Human
cagugucaaguugugcuugu

SEQ ID NO: 3827726 - RNA, 13 nt, Human
cagugucaggcac

SEQ ID NO: 3827727 - RNA, 16 nt, Human
cagugucauuucucau

SEQ ID NO: 3827728 - RNA, 12 nt, Human
cagugucauuug

SEQ ID NO: 3827729 - RNA, 17 nt, Human
cagugucauuugcucug

SEQ ID NO: 3827730 - RNA, 22 nt, Human
caguguccauggacucagaaac

SEQ ID NO: 3827731 - RNA, 16 nt, Human
caguguccccuccacu

SEQ ID NO: 3827732 - RNA, 20 nt, Human
caguguccccuccacuguca

SEQ ID NO: 3827733 - RNA, 21 nt, Human
caguguccccuccacugucac

SEQ ID NO: 3827734 - RNA, 19 nt, Human
caguguccuccccucaagg

SEQ ID NO: 3827735 - RNA, 13 nt, Human
caguguccugagc

SEQ ID NO: 3827736 - RNA, 15 nt, Human
caguguccugagcuc

SEQ ID NO: 3827737 - RNA, 20 nt, Human
caguguccuuggcaggcuga

SEQ ID NO: 3827738 - RNA, 16 nt, Human
cagugucucacacugg

SEQ ID NO: 3827739 - RNA, 18 nt, Human
cagugucuggcugcagag

SEQ ID NO: 3827740 - RNA, 13 nt, Human
cagugucugggcu

SEQ ID NO: 3827741 - RNA, 14 nt, Human
cagugucugggcug

SEQ ID NO: 3827742 - RNA, 22 nt, Human
cagugucuguaucggagacagu

SEQ ID NO: 3827743 - RNA, 24 nt, Human
cagugucuguaucggagacaguga

SEQ ID NO: 3827744 - RNA, 13 nt, Human
cagugucuguccc

SEQ ID NO: 3827745 - RNA, 14 nt, Human
cagugucugucccg

SEQ ID NO: 3827746 - RNA, 16 nt, Human
cagugucugucccggg

SEQ ID NO: 3827747 - RNA, 15 nt, Human
cagugucuuccauaa

SEQ ID NO: 3827748 - RNA, 20 nt, Human
cagugucuuccauaauguau

SEQ ID NO: 3827749 - RNA, 13 nt, Human
cagugucuuccug

SEQ ID NO: 3827750 - RNA, 19 nt, Human
cagugucuuuuuuuguaua

SEQ ID NO: 3827751 - RNA, 21 nt, Human
cagugugaaguacaauaauuc

SEQ ID NO: 3827752 - RNA, 17 nt, Human
cagugugaaguuagaau

SEQ ID NO: 3827753 - RNA, 16 nt, Human
cagugugaggccaggg

SEQ ID NO: 3827754 - RNA, 19 nt, Human
cagugugaucccaagugcc

SEQ ID NO: 3827755 - RNA, 22 nt, Human
cagugugaucccaagugccagu

SEQ ID NO: 3827756 - RNA, 22 nt, Human
cagugugcacgagugggaagga

SEQ ID NO: 3827757 - RNA, 15 nt, Human
cagugugcacuaagg

SEQ ID NO: 3827758 - RNA, 20 nt, Human
cagugugccccccauccugg

SEQ ID NO: 3827759 - RNA, 20 nt, Human
caguguggaggccacuguuu

SEQ ID NO: 3827760 - RNA, 19 nt, Human
caguguggccucuucugag

SEQ ID NO: 3827761 - RNA, 22 nt, Human
ccucaagguuuuagguucuaaa

SEQ ID NO: 3827762 - RNA, 20 nt, Human
ccucaagugauucuccugcc

SEQ ID NO: 3827763 - RNA, 23 nt, Human
ccucaagugauucuccugccuca

SEQ ID NO: 3827764 - RNA, 18 nt, Human
ccucaauaaacauuucau

SEQ ID NO: 3827765 - RNA, 16 nt, Human
ccucaauaagccuugu

SEQ ID NO: 3827766 - RNA, 18 nt, Human
ccucaauaagccuugucg

SEQ ID NO: 3827767 - RNA, 20 nt, Human
ccucaauucccccuggccac

SEQ ID NO: 3827768 - RNA, 12 nt, Human
ccucaauuucaa

SEQ ID NO: 3827769 - RNA, 17 nt, Human
ccucaauuuucacugug

SEQ ID NO: 3827770 - RNA, 21 nt, Human
ccucacaaguggguaccccca

SEQ ID NO: 3827771 - RNA, 22 nt, Human
ccucacacacagacucauauua

SEQ ID NO: 3827772 - RNA, 23 nt, Human
ccucacacacccugaggucaggg

SEQ ID NO: 3827773 - RNA, 11 nt, Human
ccucacacagc

SEQ ID NO: 3827774 - RNA, 14 nt, Human
ccucacacucaccc

SEQ ID NO: 3827775 - RNA, 15 nt, Human
ccucacacuccuuua

SEQ ID NO: 3827776 - RNA, 15 nt, Human
ccucacagcacagag

SEQ ID NO: 3827777 - RNA, 19 nt, Human
ccucacagcacagagaaga

SEQ ID NO: 3827778 - RNA, 12 nt, Human
ccucacagccuc

SEQ ID NO: 3827779 - RNA, 15 nt, Human
ccucacagccucuga

SEQ ID NO: 3827780 - RNA, 22 nt, Human
ccucacagccucugaccccucc

SEQ ID NO: 3827781 - RNA, 13 nt, Human
ccucacagugaac

SEQ ID NO: 3827782 - RNA, 19 nt, Human
ccucacagugacccuuccc

SEQ ID NO: 3827783 - RNA, 24 nt, Human
ccucacagugacccuucccaauca

SEQ ID NO: 3827784 - RNA, 16 nt, Human
ccucacaucuuucaca

SEQ ID NO: 3827785 - RNA, 18 nt, Human
ccucaccagcccuggcaa

SEQ ID NO: 3827786 - RNA, 19 nt, Human
ccucaccaggggcaggcac

SEQ ID NO: 3827787 - RNA, 16 nt, Human
ccucaccaugaugggg

SEQ ID NO: 3827788 - RNA, 21 nt, Human
ccucacccaccccugcacagu

SEQ ID NO: 3827789 - RNA, 21 nt, Human
ccucacccacccuuuuuuaaa

SEQ ID NO: 3827790 - RNA, 23 nt, Human
ccucacccacuuuggccuccguu

SEQ ID NO: 3827791 - RNA, 17 nt, Human
ccucacccccagcuuug

SEQ ID NO: 3827792 - RNA, 19 nt, Human
ccucaccccgaggcccugc

SEQ ID NO: 3827793 - RNA, 16 nt, Human
ccucaccccgucuggg

SEQ ID NO: 3827794 - RNA, 13 nt, Human
ccucaccccugcc

SEQ ID NO: 3827795 - RNA, 20 nt, Human
ccucaccccugguucucauc

SEQ ID NO: 3827796 - RNA, 21 nt, Human
ccucaccccugguucucaucu

SEQ ID NO: 3827797 - RNA, 15 nt, Human
ccucaccccuguccu

SEQ ID NO: 3827798 - RNA, 11 nt, Human
ccucacccugc

SEQ ID NO: 3827799 - RNA, 22 nt, Human
ccucacccugccuuaucuugca

SEQ ID NO: 3827800 - RNA, 18 nt, Human
ccucaccgagugggggca

SEQ ID NO: 3827801 - RNA, 15 nt, Human
ccucaccgcuucccu

SEQ ID NO: 3827802 - RNA, 17 nt, Human
ccucaccgcuucccucc

SEQ ID NO: 3827803 - RNA, 15 nt, Human
ccucaccucaugccc

SEQ ID NO: 3827804 - RNA, 16 nt, Human
ccucaccucaugccca

SEQ ID NO: 3827805 - RNA, 13 nt, Human
ccucaccucuacc

SEQ ID NO: 3827806 - RNA, 17 nt, Human
ccucaccucugccauuu

SEQ ID NO: 3827807 - RNA, 15 nt, Human
ccucaccuguagcag

SEQ ID NO: 3827808 - RNA, 21 nt, Human
ccucaccuugcaacacacaga

SEQ ID NO: 3827809 - RNA, 22 nt, Human
ccucaccuugcaacacacagac

SEQ ID NO: 3827810 - RNA, 19 nt, Human
ccucaccuuuucccgggga

SEQ ID NO: 3827811 - RNA, 14 nt, Human
ccucacuaauuuuu

SEQ ID NO: 3827812 - RNA, 21 nt, Human
ccucacuaggcuucugguuga

SEQ ID NO: 3827813 - RNA, 21 nt, Human
ccucacuaucccggcugcccu

SEQ ID NO: 3827814 - RNA, 17 nt, Human
aaauaauuguuguucug

SEQ ID NO: 3827815 - RNA, 13 nt, Human
aaauaauuuaacu

SEQ ID NO: 3827816 - RNA, 13 nt, Human
ccucgcugcuucu

SEQ ID NO: 3827817 - RNA, 17 nt, Human
ccucgcuggacucucag

SEQ ID NO: 3827818 - RNA, 12 nt, Human
ccucgcuggccc

SEQ ID NO: 3827819 - RNA, 13 nt, Human
ccucgcuggcccc

SEQ ID NO: 3827820 - RNA, 15 nt, Human
ccucgcuggccccca

SEQ ID NO: 3827821 - RNA, 18 nt, Human
ccucgcuggcccccacug

SEQ ID NO: 3827822 - RNA, 20 nt, Human
ccucgcuggcccccacuggc

SEQ ID NO: 3827823 - RNA, 22 nt, Human
ccucgcuggcccccacuggcug

SEQ ID NO: 3827824 - RNA, 21 nt, Human
ccucggaaccgcucaccuaga

SEQ ID NO: 3827825 - RNA, 19 nt, Human
ccucggacuuagcugggag

SEQ ID NO: 3827826 - RNA, 13 nt, Human
ccucggagccuca

SEQ ID NO: 3827827 - RNA, 20 nt, Human
ccucggaucagcugagccuu

SEQ ID NO: 3827828 - RNA, 22 nt, Human
ccucggccucccaaagugcugg

SEQ ID NO: 3827829 - RNA, 16 nt, Human
ccucggccuggcuccu

SEQ ID NO: 3827830 - RNA, 13 nt, Human
ccucggcuccugc

SEQ ID NO: 3827831 - RNA, 14 nt, Human
ccucggcuccugcu

SEQ ID NO: 3827832 - RNA, 15 nt, Human
ccucggcuccuggac

SEQ ID NO: 3827833 - RNA, 14 nt, Human
ccucggcuggcucc

SEQ ID NO: 3827834 - RNA, 15 nt, Human
ccucggcuggcuccc

SEQ ID NO: 3827835 - RNA, 20 nt, Human
ccucggcuuuucucagcugg

SEQ ID NO: 3827836 - RNA, 17 nt, Human
ccucgggaaccucacuc

SEQ ID NO: 3827837 - RNA, 21 nt, Human
ccucgggaaccucacucuugc

SEQ ID NO: 3827838 - RNA, 15 nt, Human
ccucgggcccaccug

SEQ ID NO: 3827839 - RNA, 17 nt, Human
ccucgggcccaccuggc

SEQ ID NO: 3827840 - RNA, 21 nt, Human
ccucgggcccaccuggccacc

SEQ ID NO: 3827841 - RNA, 14 nt, Human
ccucgggcccagcc

SEQ ID NO: 3827842 - RNA, 15 nt, Human
ccucgggcccagccc

SEQ ID NO: 3827843 - RNA, 22 nt, Human
ccucgggcgagucacugccucu

SEQ ID NO: 3827844 - RNA, 16 nt, Human
ccucggggaugugucc

SEQ ID NO: 3827845 - RNA, 16 nt, Human
ccucggugccuuccuc

SEQ ID NO: 3827846 - RNA, 16 nt, Human
ccucguccucccccug

SEQ ID NO: 3827847 - RNA, 17 nt, Human
ccucguccucccccugc

SEQ ID NO: 3827848 - RNA, 20 nt, Human
ccucguccucccccugccag

SEQ ID NO: 3827849 - RNA, 18 nt, Human
ccucgugaaagugcauuu

SEQ ID NO: 3827850 - RNA, 12 nt, Human
ccucgugccagu

SEQ ID NO: 3827851 - RNA, 18 nt, Human
ccucguggacaccugccc

SEQ ID NO: 3827852 - RNA, 20 nt, Human
ccucguggacaccugcccug

SEQ ID NO: 3827853 - RNA, 22 nt, Human
ccucguggccagcccggcuggu

SEQ ID NO: 3827854 - RNA, 18 nt, Human
ccucguggccuuccccag

SEQ ID NO: 3827855 - RNA, 15 nt, Human
ccucgugguccccaa

SEQ ID NO: 3827856 - RNA, 18 nt, Human
ccucgugguccccaacag

SEQ ID NO: 3827857 - RNA, 22 nt, Human
ccucguuagggaagagaaacag

SEQ ID NO: 3827858 - RNA, 14 nt, Human
ccucguuuguguuc

SEQ ID NO: 3827859 - RNA, 16 nt, Human
ccucuaacagcaccaa

SEQ ID NO: 3827860 - RNA, 17 nt, Human
ccucuaacaggggcugg

SEQ ID NO: 3827861 - RNA, 23 nt, Human
ccucuaacaggggcuggugggca

SEQ ID NO: 3827862 - RNA, 13 nt, Human
ccucuaaccccag

SEQ ID NO: 3827863 - RNA, 18 nt, Human
ccucuaaccccaggcccc

SEQ ID NO: 3827864 - RNA, 17 nt, Human
ccucuaacuuggcucac

SEQ ID NO: 3827865 - RNA, 14 nt, Human
ccucuaagccacuc

SEQ ID NO: 3827866 - RNA, 19 nt, Human
ccucuaagguugggcaggg

SEQ ID NO: 3827867 - RNA, 22 nt, Human
ccucuaaugcucacgcucccaa

SEQ ID NO: 3827868 - RNA, 20 nt, Human
ccucuacagagcuucccuga

SEQ ID NO: 3827869 - RNA, 21 nt, Human
ccucuacagagcuucccugac

SEQ ID NO: 3827870 - RNA, 21 nt, Human
ccucuacauggacucagagaa

SEQ ID NO: 3827871 - RNA, 14 nt, Human
ccucuaccaagcug

SEQ ID NO: 3827872 - RNA, 14 nt, Human
ccucuacccaaacc

SEQ ID NO: 3827873 - RNA, 14 nt, Human
ccucuacugggaag

SEQ ID NO: 3827874 - RNA, 14 nt, Human
ccucuacuuuccag

SEQ ID NO: 3827875 - RNA, 16 nt, Human
ccucuagaagccaagg

SEQ ID NO: 3827876 - RNA, 14 nt, Human
ccucuagaggcaag

SEQ ID NO: 3827877 - RNA, 13 nt, Human
ccucuagcccugc

SEQ ID NO: 3827878 - RNA, 17 nt, Human
ccucuagcccugcccgg

SEQ ID NO: 3827879 - RNA, 18 nt, Human
ccucuagcccugcccgga

SEQ ID NO: 3827880 - RNA, 15 nt, Human
ccucuagguccccau

SEQ ID NO: 3827881 - RNA, 13 nt, Human
ccucuagugcccu

SEQ ID NO: 3827882 - RNA, 15 nt, Human
ccucuagugcccucc

SEQ ID NO: 3827883 - RNA, 18 nt, Human
ccucuauacaucucuccc

SEQ ID NO: 3827884 - RNA, 19 nt, Human
ccucuauacaucucucccc

SEQ ID NO: 3827885 - RNA, 20 nt, Human
ccucuauacaucucucccca

SEQ ID NO: 3827886 - RNA, 16 nt, Human
ccucuauauuugcucu

SEQ ID NO: 3827887 - RNA, 17 nt, Human
ccucucaccuguacucu

SEQ ID NO: 3827888 - RNA, 16 nt, Human
ccucucacuaaacuuu

SEQ ID NO: 3827889 - RNA, 12 nt, Human
ccucucacugcc

SEQ ID NO: 3827890 - RNA, 13 nt, Human
ccucucacugucu

SEQ ID NO: 3827891 - RNA, 14 nt, Human
ccucucacugucug

SEQ ID NO: 3827892 - RNA, 14 nt, Human
ccucucacuguguc

SEQ ID NO: 3827893 - RNA, 15 nt, Human
ccucucagagcuacu

SEQ ID NO: 3827894 - RNA, 11 nt, Human
ccucucagccc

SEQ ID NO: 3827895 - RNA, 15 nt, Human
ccucucaggagccau

SEQ ID NO: 3827896 - RNA, 18 nt, Human
ccucucagugcccuccag

SEQ ID NO: 3827897 - RNA, 18 nt, Human
ccucucauuccagaggaa

SEQ ID NO: 3827898 - RNA, 18 nt, Human
ccucucauuuagccuguc

SEQ ID NO: 3827899 - RNA, 20 nt, Human
ccucucauuuagccuguccu

SEQ ID NO: 3827900 - RNA, 14 nt, Human
ccucuccagccuca

SEQ ID NO: 3827901 - RNA, 16 nt, Human
ccucuccagccucagc

SEQ ID NO: 3827902 - RNA, 11 nt, Human
ccucuccaggc

SEQ ID NO: 3827903 - RNA, 14 nt, Human
ccucuccaggcacc

SEQ ID NO: 3827904 - RNA, 17 nt, Human
ccucuccaggcacccuu

SEQ ID NO: 3827905 - RNA, 19 nt, Human
ccucuccaguuugcaccug

SEQ ID NO: 3827906 - RNA, 22 nt, Human
ccucuccauaaccccacccuug

SEQ ID NO: 3827907 - RNA, 15 nt, Human
ccucuccauccugcu

SEQ ID NO: 3827908 - RNA, 16 nt, Human
ccucucccacccucuu

SEQ ID NO: 3827909 - RNA, 13 nt, Human
ccucucccaggcc

SEQ ID NO: 3827910 - RNA, 16 nt, Human
ccucucccaggcccca

SEQ ID NO: 3827911 - RNA, 12 nt, Human
ccucucccaggg

SEQ ID NO: 3827912 - RNA, 12 nt, Human
ccucucccauca

SEQ ID NO: 3827913 - RNA, 13 nt, Human
ccucucccauccc

SEQ ID NO: 3827914 - RNA, 14 nt, Human
ccucucccaucccc

SEQ ID NO: 3827915 - RNA, 15 nt, Human
ccucucccauccccc

SEQ ID NO: 3827916 - RNA, 16 nt, Human
ccucucccaucccccu

SEQ ID NO: 3827917 - RNA, 20 nt, Human
ccucucccaucccccugccc

SEQ ID NO: 3827918 - RNA, 22 nt, Human
ccucucccaucccccugcccuc

SEQ ID NO: 3827919 - RNA, 14 nt, Human
ccucuccccacccc

SEQ ID NO: 3827920 - RNA, 17 nt, Human
ccucuccccagcccaga

SEQ ID NO: 3827921 - RNA, 22 nt, Human
ccucuccccagggaagcagcag

SEQ ID NO: 3827922 - RNA, 19 nt, Human
ccucuccccccccccucca

SEQ ID NO: 3827923 - RNA, 12 nt, Human
ccucucccccuu

SEQ ID NO: 3827924 - RNA, 18 nt, Human
ccucuccccgcaguguuu

SEQ ID NO: 3827925 - RNA, 18 nt, Human
ccucuccccuaccacugu

SEQ ID NO: 3827926 - RNA, 18 nt, Human
ccucuccccucagccucu

SEQ ID NO: 3827927 - RNA, 16 nt, Human
ccucuccccuccagcc

SEQ ID NO: 3827928 - RNA, 20 nt, Human
ccucuccccugcccccugca

SEQ ID NO: 3827929 - RNA, 15 nt, Human
ccucuccccugccug

SEQ ID NO: 3827930 - RNA, 18 nt, Human
ccucuccccugccugccc

SEQ ID NO: 3827931 - RNA, 22 nt, Human
ccucucccgccagacuguuaga

SEQ ID NO: 3827932 - RNA, 19 nt, Human
ccucucccgucagggccca

SEQ ID NO: 3827933 - RNA, 23 nt, Human
ccucucccgucagggcccaaguc

SEQ ID NO: 3827934 - RNA, 12 nt, Human
ccucucccugac

SEQ ID NO: 3827935 - RNA, 15 nt, Human
ccucucccugacccu

SEQ ID NO: 3827936 - RNA, 21 nt, Human
ccucucccugacccuguauau

SEQ ID NO: 3827937 - RNA, 14 nt, Human
ccucucccugcaug

SEQ ID NO: 3827938 - RNA, 14 nt, Human
ccucucccugcugc

SEQ ID NO: 3827939 - RNA, 15 nt, Human
ccucucccugcugcu

SEQ ID NO: 3827940 - RNA, 13 nt, Human
ccucucccuguug

SEQ ID NO: 3827941 - RNA, 10 nt, Human
ccucucccuu

SEQ ID NO: 3827942 - RNA, 17 nt, Human
ccucucccuuacccugg

SEQ ID NO: 3827943 - RNA, 19 nt, Human
ccucucccuugggcucuga

SEQ ID NO: 3827944 - RNA, 22 nt, Human
ccucucccuugggcucugauga

SEQ ID NO: 3827945 - RNA, 15 nt, Human
ccucuccgccccuga

SEQ ID NO: 3827946 - RNA, 14 nt, Human
ccucuccuccacau

SEQ ID NO: 3827947 - RNA, 15 nt, Human
ccucuccugccuacu

SEQ ID NO: 3827948 - RNA, 17 nt, Human
ccucuccugccuacuca

SEQ ID NO: 3827949 - RNA, 14 nt, Human
ccucuccuggagga

SEQ ID NO: 3827950 - RNA, 12 nt, Human
ccucuccugggc

SEQ ID NO: 3827951 - RNA, 15 nt, Human
ccucuccugggcagc

SEQ ID NO: 3827952 - RNA, 16 nt, Human
ccucuccugggcagcu

SEQ ID NO: 3827953 - RNA, 17 nt, Human
ccucuccugggcagcug

SEQ ID NO: 3827954 - RNA, 18 nt, Human
ccucuccugggcagcugc

SEQ ID NO: 3827955 - RNA, 23 nt, Human
ccucuccuucaugacagccucca

SEQ ID NO: 3827956 - RNA, 14 nt, Human
ccucuccuuccuug

SEQ ID NO: 3827957 - RNA, 14 nt, Human
ccucuccuuugaaa

SEQ ID NO: 3827958 - RNA, 14 nt, Human
ccucuccuuuguuc

SEQ ID NO: 3827959 - RNA, 22 nt, Human
ccucucguaagauuuccuucuu

SEQ ID NO: 3827960 - RNA, 13 nt, Human
ccucucuaaccuc

SEQ ID NO: 3827961 - RNA, 20 nt, Human
caucagaagccuauuguaaa

SEQ ID NO: 3827962 - RNA, 14 nt, Human
caucagaaggagaa

SEQ ID NO: 3827963 - RNA, 14 nt, Human
caucagaaguggua

SEQ ID NO: 3827964 - RNA, 19 nt, Human
caucagacugugaacccca

SEQ ID NO: 3827965 - RNA, 11 nt, Human
caucagcaaac

SEQ ID NO: 3827966 - RNA, 18 nt, Human
caucagcacgauuucugu

SEQ ID NO: 3827967 - RNA, 13 nt, Human
caucagcauaccu

SEQ ID NO: 3827968 - RNA, 18 nt, Human
caucagcauaccuuuauu

SEQ ID NO: 3827969 - RNA, 20 nt, Human
caucagcauaccuuuauugu

SEQ ID NO: 3827970 - RNA, 14 nt, Human
caucagccagcugc

SEQ ID NO: 3827971 - RNA, 15 nt, Human
caucagccagcugcc

SEQ ID NO: 3827972 - RNA, 20 nt, Human
caucagcccaaucccugauc

SEQ ID NO: 3827973 - RNA, 20 nt, Human
caucagcuaaacaccacguc

SEQ ID NO: 3827974 - RNA, 19 nt, Human
caucagcugcucagauccc

SEQ ID NO: 3827975 - RNA, 15 nt, Human
caucaggacccugga

SEQ ID NO: 3827976 - RNA, 18 nt, Human
caucaggacccuggaccu

SEQ ID NO: 3827977 - RNA, 19 nt, Human
caucaggagaaaaagccuc

SEQ ID NO: 3827978 - RNA, 13 nt, Human
caucaggccaggc

SEQ ID NO: 3827979 - RNA, 12 nt, Human
caucagggacag

SEQ ID NO: 3827980 - RNA, 11 nt, Human
caucagggccu

SEQ ID NO: 3827981 - RNA, 13 nt, Human
caucagggccugg

SEQ ID NO: 3827982 - RNA, 15 nt, Human
caucagggccugggg

SEQ ID NO: 3827983 - RNA, 21 nt, Human
caucagggccuggggccugag

SEQ ID NO: 3827984 - RNA, 12 nt, Human
ccucucucucug

SEQ ID NO: 3827985 - RNA, 14 nt, Human
ccucucucugacuc

SEQ ID NO: 3827986 - RNA, 20 nt, Human
ccucucucuucugcuccacc

SEQ ID NO: 3827987 - RNA, 16 nt, Human
ccucucugcagguccc

SEQ ID NO: 3827988 - RNA, 19 nt, Human
ccucucugcaggucccuaa

SEQ ID NO: 3827989 - RNA, 20 nt, Human
ccucucugcaggucccuaau

SEQ ID NO: 3827990 - RNA, 23 nt, Human
ccucucugcaggucccuaauaaa

SEQ ID NO: 3827991 - RNA, 12 nt, Human
ccucucugcucu

SEQ ID NO: 3827992 - RNA, 15 nt, Human
ccucucuggccuccc

SEQ ID NO: 3827993 - RNA, 16 nt, Human
ccucucuggccuccca

SEQ ID NO: 3827994 - RNA, 19 nt, Human
ccucucuggccucccaccc

SEQ ID NO: 3827995 - RNA, 22 nt, Human
ccucucuggccucccacccgau

SEQ ID NO: 3827996 - RNA, 12 nt, Human
ccucucuguccc

SEQ ID NO: 3827997 - RNA, 13 nt, Human
ccucucugucccu

SEQ ID NO: 3827998 - RNA, 10 nt, Human
ccucucuguu

SEQ ID NO: 3827999 - RNA, 20 nt, Human
ccucucuuauagaauauuua

SEQ ID NO: 3828000 - RNA, 14 nt, Human
ccucucuuccuauc

SEQ ID NO: 3828001 - RNA, 16 nt, Human
ccucucuuccuauccc

SEQ ID NO: 3828002 - RNA, 11 nt, Human
ccucucuugca

SEQ ID NO: 3828003 - RNA, 13 nt, Human
ccucucuugcacc

SEQ ID NO: 3828004 - RNA, 18 nt, Human
ccucucuugcacccgccu

SEQ ID NO: 3828005 - RNA, 21 nt, Human
ccucucuugcacccgccucuc

SEQ ID NO: 3828006 - RNA, 19 nt, Human
ccucucuugguuuccuucc

SEQ ID NO: 3828007 - RNA, 21 nt, Human
ccucucuuuguucucagcucc

SEQ ID NO: 3828008 - RNA, 12 nt, Human
ccucugaaacag

SEQ ID NO: 3828009 - RNA, 13 nt, Human
ccucugaaacagc

SEQ ID NO: 3828010 - RNA, 16 nt, Human
ccucugaaacagcugc

SEQ ID NO: 3828011 - RNA, 17 nt, Human
ccucugaaacagcugcc

SEQ ID NO: 3828012 - RNA, 12 nt, Human
ccucugaaauac

SEQ ID NO: 3828013 - RNA, 13 nt, Human
ccucugacacaca

SEQ ID NO: 3828014 - RNA, 18 nt, Human
ccucugacacacagcucu

SEQ ID NO: 3828015 - RNA, 20 nt, Human
ccucugacacacagcucugu

SEQ ID NO: 3828016 - RNA, 18 nt, Human
ccucugacagcagcaucu

SEQ ID NO: 3828017 - RNA, 19 nt, Human
ccucugacagcagcaucuc

SEQ ID NO: 3828018 - RNA, 13 nt, Human
ccucugaccaaca

SEQ ID NO: 3828019 - RNA, 20 nt, Human
ccucugaccaacaggcuguu

SEQ ID NO: 3828020 - RNA, 18 nt, Human
ccucugaccccugccugu

SEQ ID NO: 3828021 - RNA, 22 nt, Human
ccucugacccuagcucuuuccu

SEQ ID NO: 3828022 - RNA, 17 nt, Human
ccucugaccugcacugg

SEQ ID NO: 3828023 - RNA, 19 nt, Human
ccucugaccugcaggccaa

SEQ ID NO: 3828024 - RNA, 19 nt, Human
ccucugacguccaccuccu

SEQ ID NO: 3828025 - RNA, 16 nt, Human
ccucugacucagggcu

SEQ ID NO: 3828026 - RNA, 16 nt, Human
ccucugacuuggggac

SEQ ID NO: 3828027 - RNA, 19 nt, Human
ccucugagaauuccaagga

SEQ ID NO: 3828028 - RNA, 14 nt, Human
ccucugagcuuugc

SEQ ID NO: 3828029 - RNA, 19 nt, Human
ccucugaggccagccuggc

SEQ ID NO: 3828030 - RNA, 21 nt, Human
ccucugaggccagccuggccu

SEQ ID NO: 3828031 - RNA, 11 nt, Human
ccucugaggcu

SEQ ID NO: 3828032 - RNA, 22 nt, Human
ccucugagggaaagcccagaaa

SEQ ID NO: 3828033 - RNA, 15 nt, Human
ccucugauacccaga

SEQ ID NO: 3828034 - RNA, 15 nt, Human
ccucugauaccucaa

SEQ ID NO: 3828035 - RNA, 17 nt, Human
ccucugauguauuuugu

SEQ ID NO: 3828036 - RNA, 15 nt, Human
ccucugcacaagcug

SEQ ID NO: 3828037 - RNA, 16 nt, Human
ccucugcacaagcugc

SEQ ID NO: 3828038 - RNA, 17 nt, Human
ccucugcacccagaaca

SEQ ID NO: 3828039 - RNA, 19 nt, Human
ccucugcaccuuugcacgu

SEQ ID NO: 3828040 - RNA, 21 nt, Human
ccucugcacuacugacaugug

SEQ ID NO: 3828041 - RNA, 18 nt, Human
ccucugcacuccccugcu

SEQ ID NO: 3828042 - RNA, 22 nt, Human
ccucugcacuccccugcugggu

SEQ ID NO: 3828043 - RNA, 12 nt, Human
ccucugcagcug

SEQ ID NO: 3828044 - RNA, 15 nt, Human
ccucugcagcugacc

SEQ ID NO: 3828045 - RNA, 16 nt, Human
ccucugcagcugaccu

SEQ ID NO: 3828046 - RNA, 16 nt, Human
ccucugcagucucuau

SEQ ID NO: 3828047 - RNA, 16 nt, Human
ccucugcauaaauauu

SEQ ID NO: 3828048 - RNA, 12 nt, Human
ccucugccaccu

SEQ ID NO: 3828049 - RNA, 15 nt, Human
ccucugccaccuccc

SEQ ID NO: 3828050 - RNA, 11 nt, Human
ccucugccaga

SEQ ID NO: 3828051 - RNA, 18 nt, Human
ccucugcccagcuugggc

SEQ ID NO: 3828052 - RNA, 22 nt, Human
ccucugcccaggcacugcuagg

SEQ ID NO: 3828053 - RNA, 19 nt, Human
ccucugccccauccuccag

SEQ ID NO: 3828054 - RNA, 11 nt, Human
ccucugcccug

SEQ ID NO: 3828055 - RNA, 12 nt, Human
ccucugcccugc

SEQ ID NO: 3828056 - RNA, 14 nt, Human
ccucugcccugcgg

SEQ ID NO: 3828057 - RNA, 19 nt, Human
ccucugcccuuccugcagg

SEQ ID NO: 3828058 - RNA, 13 nt, Human
ccucugccucaau

SEQ ID NO: 3828059 - RNA, 11 nt, Human
ccucugccuga

SEQ ID NO: 3828060 - RNA, 20 nt, Human
ccucugccugaagucacaca

SEQ ID NO: 3828061 - RNA, 21 nt, Human
ccucugccugaagucacacag

SEQ ID NO: 3828062 - RNA, 17 nt, Human
ccucugccugcauucug

SEQ ID NO: 3828063 - RNA, 19 nt, Human
ccucugccugucccucuca

SEQ ID NO: 3828064 - RNA, 19 nt, Human
ccucugccugucuccccca

SEQ ID NO: 3828065 - RNA, 20 nt, Human
ccucugccuuagaggagccc

SEQ ID NO: 3828066 - RNA, 18 nt, Human
ccucugcggaccccagcu

SEQ ID NO: 3828067 - RNA, 15 nt, Human
ccucugcuaaauuga

SEQ ID NO: 3828068 - RNA, 13 nt, Human
ccucugcucaccg

SEQ ID NO: 3828069 - RNA, 20 nt, Human
ccucugcucaccgcccauca

SEQ ID NO: 3828070 - RNA, 21 nt, Human
ccucugcucaccgcccaucag

SEQ ID NO: 3828071 - RNA, 12 nt, Human
ccucugcucagc

SEQ ID NO: 3828072 - RNA, 13 nt, Human
ccucugcucagcc

SEQ ID NO: 3828073 - RNA, 18 nt, Human
ccucugcuccuggagccu

SEQ ID NO: 3828074 - RNA, 20 nt, Human
ccucugcucugaggcuucca

SEQ ID NO: 3828075 - RNA, 22 nt, Human
ccucugcucugaggcuuccaga

SEQ ID NO: 3828076 - RNA, 20 nt, Human
ccucugcugaagacuugccc

SEQ ID NO: 3828077 - RNA, 18 nt, Human
ccucugcugaccugcuga

SEQ ID NO: 3828078 - RNA, 15 nt, Human
ccucugcugauccuc

SEQ ID NO: 3828079 - RNA, 13 nt, Human
ccucugcugcugg

SEQ ID NO: 3828080 - RNA, 18 nt, Human
ccucugcugcuggcuggu

SEQ ID NO: 3828081 - RNA, 20 nt, Human
ccucugcugcugucccuccc

SEQ ID NO: 3828082 - RNA, 21 nt, Human
ccucugcuggcacauuucccc

SEQ ID NO: 3828083 - RNA, 13 nt, Human
ccucugcuuccca

SEQ ID NO: 3828084 - RNA, 15 nt, Human
ccucugcuucccagg

SEQ ID NO: 3828085 - RNA, 17 nt, Human
ccucugcuugccauccc

SEQ ID NO: 3828086 - RNA, 18 nt, Human
ccucuggacuggcuagag

SEQ ID NO: 3828087 - RNA, 14 nt, Human
ccucuggagccagc

SEQ ID NO: 3828088 - RNA, 16 nt, Human
ccucuggaggccucug

SEQ ID NO: 3828089 - RNA, 16 nt, Human
ccucuggauggcacca

SEQ ID NO: 3828090 - RNA, 18 nt, Human
ccucuggauugugggaau

SEQ ID NO: 3828091 - RNA, 17 nt, Human
ccucuggcccugccuuc

SEQ ID NO: 3828092 - RNA, 17 nt, Human
ccucuggccgccuaggc

SEQ ID NO: 3828093 - RNA, 16 nt, Human
ccucuggcuccagcug

SEQ ID NO: 3828094 - RNA, 22 nt, Human
ccucuggcuggcuaacuggaag

SEQ ID NO: 3828095 - RNA, 18 nt, Human
ccucuggcuuggccacag

SEQ ID NO: 3828096 - RNA, 23 nt, Human
ccucuggcuuggccacagccagg

SEQ ID NO: 3828097 - RNA, 12 nt, Human
ccucugggaacc

SEQ ID NO: 3828098 - RNA, 14 nt, Human
ccucugggaaccuc

SEQ ID NO: 3828099 - RNA, 17 nt, Human
ccucugggaaccuccca

SEQ ID NO: 3828100 - RNA, 11 nt, Human
ccucugggccc

SEQ ID NO: 3828101 - RNA, 15 nt, Human
ccucugggccuccuc

SEQ ID NO: 3828102 - RNA, 14 nt, Human
ccucugggcucuga

SEQ ID NO: 3828103 - RNA, 16 nt, Human
ccucugggcucugagu

SEQ ID NO: 3828104 - RNA, 11 nt, Human
ccucugggcuu

SEQ ID NO: 3828105 - RNA, 19 nt, Human
ccucugggggguggccagg

SEQ ID NO: 3828106 - RNA, 17 nt, Human
ccucugggucagugguc

SEQ ID NO: 3828107 - RNA, 16 nt, Human
ccucugguagacacag

SEQ ID NO: 3828108 - RNA, 19 nt, Human
ccugccuggaccagccucu

SEQ ID NO: 3828109 - RNA, 13 nt, Human
ccugccuggagga

SEQ ID NO: 3828110 - RNA, 20 nt, Human
ccugccuggaggaccugagc

SEQ ID NO: 3828111 - RNA, 14 nt, Human
ccugccuggcaggc

SEQ ID NO: 3828112 - RNA, 11 nt, Human
ccugccuggcc

SEQ ID NO: 3828113 - RNA, 12 nt, Human
ccugccuggcca

SEQ ID NO: 3828114 - RNA, 12 nt, Human
ccugccuggccc

SEQ ID NO: 3828115 - RNA, 14 nt, Human
ccugccuggccggc

SEQ ID NO: 3828116 - RNA, 16 nt, Human
ccugccuggccggcca

SEQ ID NO: 3828117 - RNA, 18 nt, Human
ccugccuggccggccagc

SEQ ID NO: 3828118 - RNA, 23 nt, Human
ccugccuggccggccagccagcc

SEQ ID NO: 3828119 - RNA, 14 nt, Human
ccugccuggucucc

SEQ ID NO: 3828120 - RNA, 13 nt, Human
ccugccugucucc

SEQ ID NO: 3828121 - RNA, 15 nt, Human
ccugccugucuccuu

SEQ ID NO: 3828122 - RNA, 13 nt, Human
ccugccugucugu

SEQ ID NO: 3828123 - RNA, 14 nt, Human
ccugccuguggcca

SEQ ID NO: 3828124 - RNA, 18 nt, Human
ccugccuguugggccagg

SEQ ID NO: 3828125 - RNA, 17 nt, Human
ccugccuuaggccuacc

SEQ ID NO: 3828126 - RNA, 22 nt, Human
ccugccuuccuccugggcccuc

SEQ ID NO: 3828127 - RNA, 15 nt, Human
ccugccuucuguccu

SEQ ID NO: 3828128 - RNA, 19 nt, Human
ccugccuugaaaaagacau

SEQ ID NO: 3828129 - RNA, 16 nt, Human
ccugccuugaagccac

SEQ ID NO: 3828130 - RNA, 18 nt, Human
ccugccuuugggagcagg

SEQ ID NO: 3828131 - RNA, 11 nt, Human
ccugccuuuua

SEQ ID NO: 3828132 - RNA, 15 nt, Human
ccugcgaaggggccc

SEQ ID NO: 3828133 - RNA, 17 nt, Human
ccugcgaaggggcccug

SEQ ID NO: 3828134 - RNA, 14 nt, Human
ccugcgacccuggg

SEQ ID NO: 3828135 - RNA, 20 nt, Human
ccugcgccaccgcccagaga

SEQ ID NO: 3828136 - RNA, 16 nt, Human
ccugcgccaguccugc

SEQ ID NO: 3828137 - RNA, 22 nt, Human
ccugcgcccaccccgcucugca

SEQ ID NO: 3828138 - RNA, 18 nt, Human
ccugcgcccaguccuucc

SEQ ID NO: 3828139 - RNA, 20 nt, Human
ccugcgcccaguccuuccac

SEQ ID NO: 3828140 - RNA, 15 nt, Human
ccugcgccugcugca

SEQ ID NO: 3828141 - RNA, 18 nt, Human
ccugcgccugcugcaugc

SEQ ID NO: 3828142 - RNA, 23 nt, Human
caucagggccuggggccugagag

SEQ ID NO: 3828143 - RNA, 17 nt, Human
caucagggggaagaagc

SEQ ID NO: 3828144 - RNA, 12 nt, Human
caucagugccaa

SEQ ID NO: 3828145 - RNA, 15 nt, Human
caucagugccccguc

SEQ ID NO: 3828146 - RNA, 18 nt, Human
caucaguggcauggcucc

SEQ ID NO: 3828147 - RNA, 15 nt, Human
caucaguguuaaaaa

SEQ ID NO: 3828148 - RNA, 22 nt, Human
caucaguguuaaaaaauuuuug

SEQ ID NO: 3828149 - RNA, 15 nt, Human
caucaguuagagcug

SEQ ID NO: 3828150 - RNA, 18 nt, Human
caucaguuagagcugaca

SEQ ID NO: 3828151 - RNA, 19 nt, Human
caucaguuccuuugugugu

SEQ ID NO: 3828152 - RNA, 13 nt, Human
caucauaaaauaa

SEQ ID NO: 3828153 - RNA, 22 nt, Human
caucauaaaauaaaguauauau

SEQ ID NO: 3828154 - RNA, 13 nt, Human
caucauagaaacu

SEQ ID NO: 3828155 - RNA, 22 nt, Human
caucauaggaagggaccaaggc

SEQ ID NO: 3828156 - RNA, 14 nt, Human
caucauauuauaca

SEQ ID NO: 3828157 - RNA, 13 nt, Human
caucaucaaggca

SEQ ID NO: 3828158 - RNA, 21 nt, Human
caucaucaaggcacugccuga

SEQ ID NO: 3828159 - RNA, 12 nt, Human
caucaucagagc

SEQ ID NO: 3828160 - RNA, 16 nt, Human
caucaucagggccugg

SEQ ID NO: 3828161 - RNA, 17 nt, Human
caucaucaguggagcca

SEQ ID NO: 3828162 - RNA, 17 nt, Human
caucauccagauguggc

SEQ ID NO: 3828163 - RNA, 11 nt, Human
caucaucccuu

SEQ ID NO: 3828164 - RNA, 13 nt, Human
caucauccucugg

SEQ ID NO: 3828165 - RNA, 15 nt, Human
caucauccucuggcu

SEQ ID NO: 3828166 - RNA, 15 nt, Human
caucaucucagcuca

SEQ ID NO: 3828167 - RNA, 13 nt, Human
caucaucuccugc

SEQ ID NO: 3828168 - RNA, 20 nt, Human
caucaucuccugccuuccuc

SEQ ID NO: 3828169 - RNA, 21 nt, Human
caucaucuccugccuuccucc

SEQ ID NO: 3828170 - RNA, 14 nt, Human
caucaugaguucug

SEQ ID NO: 3828171 - RNA, 22 nt, Human
caucaugcuggaaccugcaaaa

SEQ ID NO: 3828172 - RNA, 21 nt, Human
caucaugcuuacaaaaaagaa

SEQ ID NO: 3828173 - RNA, 21 nt, Human
caucauguccccaaaccugca

SEQ ID NO: 3828174 - RNA, 15 nt, Human
caucauuaaauuuuu

SEQ ID NO: 3828175 - RNA, 14 nt, Human
caucauuagaacaa

SEQ ID NO: 3828176 - RNA, 19 nt, Human
caucauuauuuauguauug

SEQ ID NO: 3828177 - RNA, 21 nt, Human
caucauuauuugcagagacag

SEQ ID NO: 3828178 - RNA, 16 nt, Human
caucauucacuucacu

SEQ ID NO: 3828179 - RNA, 20 nt, Human
caucauucccucucaucuca

SEQ ID NO: 3828180 - RNA, 20 nt, Human
caucauuccuuuuuauuuau

SEQ ID NO: 3828181 - RNA, 22 nt, Human
caucauuccuuuuuauuuauau

SEQ ID NO: 3828182 - RNA, 17 nt, Human
caucauucucugucuca

SEQ ID NO: 3828183 - RNA, 14 nt, Human
caucauugaaaucu

SEQ ID NO: 3828184 - RNA, 13 nt, Human
caucauugcagau

SEQ ID NO: 3828185 - RNA, 13 nt, Human
caucauuguauau

SEQ ID NO: 3828186 - RNA, 17 nt, Human
caucauuguuucugcau

SEQ ID NO: 3828187 - RNA, 20 nt, Human
caucauuucuuuuugggaga

SEQ ID NO: 3828188 - RNA, 20 nt, Human
caucauuuuccauauccugg

SEQ ID NO: 3828189 - RNA, 17 nt, Human
caucauuuuuguaucua

SEQ ID NO: 3828190 - RNA, 23 nt, Human
cauccaaaaucuugaucaguuaa

SEQ ID NO: 3828191 - RNA, 17 nt, Human
cauccaaagcagacagc

SEQ ID NO: 3828192 - RNA, 18 nt, Human
cauccaaagcagacagcu

SEQ ID NO: 3828193 - RNA, 18 nt, Human
cauccaaauaagaaaccu

SEQ ID NO: 3828194 - RNA, 16 nt, Human
cauccaaccccccacc

SEQ ID NO: 3828195 - RNA, 16 nt, Human
cauccaaccuucccaa

SEQ ID NO: 3828196 - RNA, 14 nt, Human
cauccaacuccagc

SEQ ID NO: 3828197 - RNA, 18 nt, Human
cauccaacuccagcaacu

SEQ ID NO: 3828198 - RNA, 15 nt, Human
cauccaacuccagga

SEQ ID NO: 3828199 - RNA, 14 nt, Human
cauccaacuuaugu

SEQ ID NO: 3828200 - RNA, 22 nt, Human
cauccaaggagaaacagagaca

SEQ ID NO: 3828201 - RNA, 23 nt, Human
cauccaaggagaaacagagacag

SEQ ID NO: 3828202 - RNA, 20 nt, Human
cauccaaggcacugucacua

SEQ ID NO: 3828203 - RNA, 21 nt, Human
cauccaaggccagguucuccg

SEQ ID NO: 3828204 - RNA, 21 nt, Human
cauccaauaggaaugcuaaca

SEQ ID NO: 3828205 - RNA, 16 nt, Human
cauccaauccucacug

SEQ ID NO: 3828206 - RNA, 18 nt, Human
cauccaauccucacuggg

SEQ ID NO: 3828207 - RNA, 20 nt, Human
cauccacauacccugaccug

SEQ ID NO: 3828208 - RNA, 17 nt, Human
cauccacauuguuuuaa

SEQ ID NO: 3828209 - RNA, 18 nt, Human
cauccaccgcugcuccac

SEQ ID NO: 3828210 - RNA, 12 nt, Human
cauccaccuccu

SEQ ID NO: 3828211 - RNA, 13 nt, Human
cauccaccuccuu

SEQ ID NO: 3828212 - RNA, 20 nt, Human
cauccacuagugcaaaucau

SEQ ID NO: 3828213 - RNA, 21 nt, Human
cauccacuagugcaaaucaua

SEQ ID NO: 3828214 - RNA, 17 nt, Human
cauccacucuacccucc

SEQ ID NO: 3828215 - RNA, 16 nt, Human
cauccagacaucauga

SEQ ID NO: 3828216 - RNA, 16 nt, Human
cauccagauguggcua

SEQ ID NO: 3828217 - RNA, 12 nt, Human
cauccagcaaga

SEQ ID NO: 3828218 - RNA, 15 nt, Human
cauccagcagucucu

SEQ ID NO: 3828219 - RNA, 19 nt, Human
cauccagcagucucugccu

SEQ ID NO: 3828220 - RNA, 14 nt, Human
cauccagucuauuc

SEQ ID NO: 3828221 - RNA, 22 nt, Human
cauccagugucucacagcccug

SEQ ID NO: 3828222 - RNA, 18 nt, Human
cauccauaguaacugaca

SEQ ID NO: 3828223 - RNA, 19 nt, Human
cauccauaguaacugacau

SEQ ID NO: 3828224 - RNA, 16 nt, Human
cauccauaguaguaug

SEQ ID NO: 3828225 - RNA, 13 nt, Human
cauccaucaucau

SEQ ID NO: 3828226 - RNA, 23 nt, Human
cauccaugccucagaagugcauc

SEQ ID NO: 3828227 - RNA, 15 nt, Human
cauccauggccagca

SEQ ID NO: 3828228 - RNA, 18 nt, Human
cauccauggccagcagca

SEQ ID NO: 3828229 - RNA, 22 nt, Human
cauccauggccagcagcaccug

SEQ ID NO: 3828230 - RNA, 22 nt, Human
cauccauggccgggcuuggugg

SEQ ID NO: 3828231 - RNA, 19 nt, Human
cauccauggggucucucac

SEQ ID NO: 3828232 - RNA, 18 nt, Human
cauccauguccuaugugu

SEQ ID NO: 3828233 - RNA, 20 nt, Human
cauccauguccuauguguga

SEQ ID NO: 3828234 - RNA, 18 nt, Human
cauccauguguggacuca

SEQ ID NO: 3828235 - RNA, 14 nt, Human
cauccauuccucag

SEQ ID NO: 3828236 - RNA, 19 nt, Human
cauccauuccucagggaca

SEQ ID NO: 3828237 - RNA, 21 nt, Human
cauccauucucacagguccca

SEQ ID NO: 3828238 - RNA, 17 nt, Human
caucccaaccagugcca

SEQ ID NO: 3828239 - RNA, 20 nt, Human
caucccaaccagugccaagg

SEQ ID NO: 3828240 - RNA, 13 nt, Human
caucccaacuguc

SEQ ID NO: 3828241 - RNA, 14 nt, Human
caucccacacccug

SEQ ID NO: 3828242 - RNA, 14 nt, Human
caucccagccccaa

SEQ ID NO: 3828243 - RNA, 13 nt, Human
caucccaggggac

SEQ ID NO: 3828244 - RNA, 14 nt, Human
caucccaggggacc

SEQ ID NO: 3828245 - RNA, 23 nt, Human
caucccaguggccucaacccucc

SEQ ID NO: 3828246 - RNA, 19 nt, Human
caucccauaugccugggca

SEQ ID NO: 3828247 - RNA, 12 nt, Human
caucccauccca

SEQ ID NO: 3828248 - RNA, 21 nt, Human
caucccaucuaagcugcagcu

SEQ ID NO: 3828249 - RNA, 12 nt, Human
caucccaugcug

SEQ ID NO: 3828250 - RNA, 15 nt, Human
caucccauguauuua

SEQ ID NO: 3828251 - RNA, 13 nt, Human
caucccauugccc

SEQ ID NO: 3828252 - RNA, 17 nt, Human
caucccauugcccuggu

SEQ ID NO: 3828253 - RNA, 21 nt, Human
cauccccaaaacaaagucuuu

SEQ ID NO: 3828254 - RNA, 15 nt, Human
caugaagccuuuuga

SEQ ID NO: 3828255 - RNA, 14 nt, Human
caugaagguaaaua

SEQ ID NO: 3828256 - RNA, 16 nt, Human
caugaagguaaauaaa

SEQ ID NO: 3828257 - RNA, 18 nt, Human
caugaagguuucugaaaa

SEQ ID NO: 3828258 - RNA, 23 nt, Human
caugaaguaauaugcacacauuu

SEQ ID NO: 3828259 - RNA, 18 nt, Human
caugaaguuuccuuggcu

SEQ ID NO: 3828260 - RNA, 22 nt, Human
caugaaguuuccuuggcuggug

SEQ ID NO: 3828261 - RNA, 21 nt, Human
caugaaucccacccacaugug

SEQ ID NO: 3828262 - RNA, 18 nt, Human
caugaaucgcuucucuuu

SEQ ID NO: 3828263 - RNA, 19 nt, Human
caugaaucugcacaucugu

SEQ ID NO: 3828264 - RNA, 13 nt, Human
caugaaugcuuuu

SEQ ID NO: 3828265 - RNA, 16 nt, Human
caugaauguaaauuug

SEQ ID NO: 3828266 - RNA, 20 nt, Human
caugaauucuuaugcuuaua

SEQ ID NO: 3828267 - RNA, 14 nt, Human
caugaauuugugaa

SEQ ID NO: 3828268 - RNA, 15 nt, Human
caugaauuuuaaaau

SEQ ID NO: 3828269 - RNA, 14 nt, Human
caugaauuuuaaag

SEQ ID NO: 3828270 - RNA, 15 nt, Human
caugaauuuuaaagu

SEQ ID NO: 3828271 - RNA, 16 nt, Human
caugaauuuuaaagua

SEQ ID NO: 3828272 - RNA, 17 nt, Human
caugaauuuuaaaguau

SEQ ID NO: 3828273 - RNA, 21 nt, Human
caugaauuuuaaaguaugcau

SEQ ID NO: 3828274 - RNA, 20 nt, Human
caugaauuuuagcuuuugug

SEQ ID NO: 3828275 - RNA, 21 nt, Human
caugaauuuuuuucaucuucu

SEQ ID NO: 3828276 - RNA, 14 nt, Human
caugacaagcccca

SEQ ID NO: 3828277 - RNA, 16 nt, Human
caugacaagccccagg

SEQ ID NO: 3828278 - RNA, 22 nt, Human
caugacacagcuuuaucaccag

SEQ ID NO: 3828279 - RNA, 23 nt, Human
caugacacagcuuuaucaccaga

SEQ ID NO: 3828280 - RNA, 23 nt, Human
caugacacccgugagcgccugug

SEQ ID NO: 3828281 - RNA, 17 nt, Human
caugacacgaauauugc

SEQ ID NO: 3828282 - RNA, 21 nt, Human
caugacacgaauauugcugau

SEQ ID NO: 3828283 - RNA, 12 nt, Human
caugacacugac

SEQ ID NO: 3828284 - RNA, 14 nt, Human
caugacagccucca

SEQ ID NO: 3828285 - RNA, 18 nt, Human
caugacaggccugaagau

SEQ ID NO: 3828286 - RNA, 12 nt, Human
caugacauguua

SEQ ID NO: 3828287 - RNA, 16 nt, Human
caugacauguuauaua

SEQ ID NO: 3828288 - RNA, 17 nt, Human
caugacauguuauauau

SEQ ID NO: 3828289 - RNA, 20 nt, Human
caugacauuuaccagcaacu

SEQ ID NO: 3828290 - RNA, 12 nt, Human
caugacccaccc

SEQ ID NO: 3828291 - RNA, 14 nt, Human
caugacccaccccu

SEQ ID NO: 3828292 - RNA, 16 nt, Human
caugacccaccccugu

SEQ ID NO: 3828293 - RNA, 18 nt, Human
caugacccaccccugugc

SEQ ID NO: 3828294 - RNA, 19 nt, Human
caugacccaccccugugcu

SEQ ID NO: 3828295 - RNA, 16 nt, Human
caugacccaggcuggg

SEQ ID NO: 3828296 - RNA, 17 nt, Human
caugacccaggcugggc

SEQ ID NO: 3828297 - RNA, 18 nt, Human
caugaccuaguuuuccau

SEQ ID NO: 3828298 - RNA, 13 nt, Human
caugaccuccagc

SEQ ID NO: 3828299 - RNA, 20 nt, Human
caugaccuccagcuuuccug

SEQ ID NO: 3828300 - RNA, 23 nt, Human
caugaccugaucacuagccuguc

SEQ ID NO: 3828301 - RNA, 18 nt, Human
caugaccugugaccagca

SEQ ID NO: 3828302 - RNA, 21 nt, Human
caugaccuuacauuuccuggg

SEQ ID NO: 3828303 - RNA, 18 nt, Human
caugaccuuauccuuccu

SEQ ID NO: 3828304 - RNA, 19 nt, Human
caugacgacaaagcugcua

SEQ ID NO: 3828305 - RNA, 20 nt, Human
caugacgcaaagagagauuu

SEQ ID NO: 3828306 - RNA, 23 nt, Human
caugacucguauaugucucaggu

SEQ ID NO: 3828307 - RNA, 16 nt, Human
caugacugcauuuuac

SEQ ID NO: 3828308 - RNA, 18 nt, Human
caugacugcuugcccuaa

SEQ ID NO: 3828309 - RNA, 21 nt, Human
caugacugcuugcccuaagca

SEQ ID NO: 3828310 - RNA, 15 nt, Human
caugagaacagacug

SEQ ID NO: 3828311 - RNA, 20 nt, Human
caugagaacagacuggccug

SEQ ID NO: 3828312 - RNA, 22 nt, Human
caugagaagagggccuguggga

SEQ ID NO: 3828313 - RNA, 22 nt, Human
caugagaauguuuuagcacagc

SEQ ID NO: 3828314 - RNA, 23 nt, Human
caugagacccuggugccuggcuc

SEQ ID NO: 3828315 - RNA, 18 nt, Human
caugagacuauguaaaaa

SEQ ID NO: 3828316 - RNA, 23 nt, Human
caugagagaauuguaucauuuga

SEQ ID NO: 3828317 - RNA, 20 nt, Human
caugagaggaggcagcagga

SEQ ID NO: 3828318 - RNA, 21 nt, Human
caugagcaucaggccaggccc

SEQ ID NO: 3828319 - RNA, 22 nt, Human
caugagcaucaggccaggcccu

SEQ ID NO: 3828320 - RNA, 19 nt, Human
caugagccgcccaaggccu

SEQ ID NO: 3828321 - RNA, 22 nt, Human
caugagccgcccaaggccuucc

SEQ ID NO: 3828322 - RNA, 21 nt, Human
caugagccucagcauccuggc

SEQ ID NO: 3828323 - RNA, 14 nt, Human
caugagccugcugg

SEQ ID NO: 3828324 - RNA, 20 nt, Human
caugagccugcuggaagccc

SEQ ID NO: 3828325 - RNA, 19 nt, Human
caugagcuacgccugccuc

SEQ ID NO: 3828326 - RNA, 20 nt, Human
caugagcuacgccugccucc

SEQ ID NO: 3828327 - RNA, 22 nt, Human
caugagcuauuuccauuccaga

SEQ ID NO: 3828328 - RNA, 23 nt, Human
caugagcuauuuccauuccagaa

SEQ ID NO: 3828329 - RNA, 23 nt, Human
caugagcuccuuaaggcucuuuu

SEQ ID NO: 3828330 - RNA, 17 nt, Human
caugaggaacaaggcaa

SEQ ID NO: 3828331 - RNA, 21 nt, Human
caugaggaacaaggcaaggcu

SEQ ID NO: 3828332 - RNA, 22 nt, Human
caugaggaacuguagaugaugu

SEQ ID NO: 3828333 - RNA, 15 nt, Human
caugaggaaggaaca

SEQ ID NO: 3828334 - RNA, 23 nt, Human
caugaggaggggccccccugccc

SEQ ID NO: 3828335 - RNA, 20 nt, Human
caugaggagggugggggagg

SEQ ID NO: 3828336 - RNA, 23 nt, Human
caugaggcaaugucaggaacaga

SEQ ID NO: 3828337 - RNA, 13 nt, Human
caugaggggagag

SEQ ID NO: 3828338 - RNA, 14 nt, Human
caugaggggagagg

SEQ ID NO: 3828339 - RNA, 15 nt, Human
caugaggggagagga

SEQ ID NO: 3828340 - RNA, 18 nt, Human
caugaggggagaggagac

SEQ ID NO: 3828341 - RNA, 20 nt, Human
caugaggggcccgagcagaa

SEQ ID NO: 3828342 - RNA, 15 nt, Human
caugagggguuccuc

SEQ ID NO: 3828343 - RNA, 18 nt, Human
caugagggguuccucccc

SEQ ID NO: 3828344 - RNA, 15 nt, Human
caugagguucucucu

SEQ ID NO: 3828345 - RNA, 21 nt, Human
caugaguaaaauagauuuuau

SEQ ID NO: 3828346 - RNA, 13 nt, Human
ccugccuggagcg

SEQ ID NO: 3828347 - RNA, 17 nt, Human
ccugccuggaggaccug

SEQ ID NO: 3828348 - RNA, 14 nt, Human
ccugccuggccagg

SEQ ID NO: 3828349 - RNA, 22 nt, Human
ccugccuggccaggcagaucug

SEQ ID NO: 3828350 - RNA, 13 nt, Human
ccugccuggcccc

SEQ ID NO: 3828351 - RNA, 15 nt, Human
ccugccuggccccca

SEQ ID NO: 3828352 - RNA, 17 nt, Human
ccugccuggcccccugu

SEQ ID NO: 3828353 - RNA, 12 nt, Human
ccugccuggccg

SEQ ID NO: 3828354 - RNA, 16 nt, Human
ccugccuguagcccac

SEQ ID NO: 3828355 - RNA, 14 nt, Human
ccugccugucuccu

SEQ ID NO: 3828356 - RNA, 13 nt, Human
ccugccugucugc

SEQ ID NO: 3828357 - RNA, 14 nt, Human
ccugccugucugcc

SEQ ID NO: 3828358 - RNA, 15 nt, Human
ccugccugucugccc

SEQ ID NO: 3828359 - RNA, 17 nt, Human
ccugccugucugucucu

SEQ ID NO: 3828360 - RNA, 18 nt, Human
ccugccugucugucucuc

SEQ ID NO: 3828361 - RNA, 12 nt, Human
ccugccuguggc

SEQ ID NO: 3828362 - RNA, 19 nt, Human
ccugccuguugggccagga

SEQ ID NO: 3828363 - RNA, 14 nt, Human
ccugccuuaaguga

SEQ ID NO: 3828364 - RNA, 20 nt, Human
ccugccuuagagccaggcac

SEQ ID NO: 3828365 - RNA, 21 nt, Human
ccugccuuagagccaggcaca

SEQ ID NO: 3828366 - RNA, 16 nt, Human
ccugccuuaucuugca

SEQ ID NO: 3828367 - RNA, 16 nt, Human
ccugccuuccuccugg

SEQ ID NO: 3828368 - RNA, 14 nt, Human
ccugccuucguuaa

SEQ ID NO: 3828369 - RNA, 16 nt, Human
ccugccuucuguccug

SEQ ID NO: 3828370 - RNA, 18 nt, Human
ccugccuucuucggggaa

SEQ ID NO: 3828371 - RNA, 17 nt, Human
ccugccuugaagccacu

SEQ ID NO: 3828372 - RNA, 21 nt, Human
ccugccuugaagccacugaag

SEQ ID NO: 3828373 - RNA, 19 nt, Human
ccugccuuggccucccaag

SEQ ID NO: 3828374 - RNA, 16 nt, Human
ccugccuuuccaucca

SEQ ID NO: 3828375 - RNA, 20 nt, Human
ccugccuuuuaguuccugug

SEQ ID NO: 3828376 - RNA, 20 nt, Human
ccugcgaaggggcccugguc

SEQ ID NO: 3828377 - RNA, 15 nt, Human
ccugcgacccugggg

SEQ ID NO: 3828378 - RNA, 16 nt, Human
ccugcgacccuggggg

SEQ ID NO: 3828379 - RNA, 13 nt, Human
ccugcgagggcag

SEQ ID NO: 3828380 - RNA, 18 nt, Human
ccugcgauuuugccugug

SEQ ID NO: 3828381 - RNA, 19 nt, Human
ccugcgcccaccccgcucu

SEQ ID NO: 3828382 - RNA, 21 nt, Human
ccugcgcccaccccgcucugc

SEQ ID NO: 3828383 - RNA, 22 nt, Human
ccugcgcccaguccuuccaccu

SEQ ID NO: 3828384 - RNA, 13 nt, Human
ccugcgccugcug

SEQ ID NO: 3828385 - RNA, 15 nt, Human
ccugcgccugugaug

SEQ ID NO: 3828386 - RNA, 14 nt, Human
ccugcgcgcaugug

SEQ ID NO: 3828387 - RNA, 16 nt, Human
ccugcggagugaagag

SEQ ID NO: 3828388 - RNA, 17 nt, Human
ccugcggccugcuggag

SEQ ID NO: 3828389 - RNA, 20 nt, Human
ccugcggcugcugugugccu

SEQ ID NO: 3828390 - RNA, 22 nt, Human
ccugcgggcugccccgcuuugc

SEQ ID NO: 3828391 - RNA, 24 nt, Human
ccugcgggugaacaaagcagccac

SEQ ID NO: 3828392 - RNA, 15 nt, Human
ccugcguccuccuca

SEQ ID NO: 3828393 - RNA, 16 nt, Human
ccugcguccuccucac

SEQ ID NO: 3828394 - RNA, 18 nt, Human
ccugcguccuccucaccu

SEQ ID NO: 3828395 - RNA, 20 nt, Human
ccugcguccuccucaccuca

SEQ ID NO: 3828396 - RNA, 23 nt, Human
ccugcgucucauacucaccucac

SEQ ID NO: 3828397 - RNA, 11 nt, Human
ccuguggcucu

SEQ ID NO: 3828398 - RNA, 13 nt, Human
ccuguggcugucg

SEQ ID NO: 3828399 - RNA, 13 nt, Human
ccuguggcugugg

SEQ ID NO: 3828400 - RNA, 13 nt, Human
ccugugggagccu

SEQ ID NO: 3828401 - RNA, 15 nt, Human
ccugugggagccucg

SEQ ID NO: 3828402 - RNA, 18 nt, Human
ccuguggggaucucaggg

SEQ ID NO: 3828403 - RNA, 20 nt, Human
ccuguggggaucucaggggc

SEQ ID NO: 3828404 - RNA, 23 nt, Human
ccugugggggaagagcacagccc

SEQ ID NO: 3828405 - RNA, 22 nt, Human
ccugugggggguaaucccugcu

SEQ ID NO: 3828406 - RNA, 23 nt, Human
ccuguggggucaacccuucugga

SEQ ID NO: 3828407 - RNA, 17 nt, Human
ccuguggguguagccag

SEQ ID NO: 3828408 - RNA, 18 nt, Human
ccuguggguguagccagg

SEQ ID NO: 3828409 - RNA, 15 nt, Human
ccugugguucugaga

SEQ ID NO: 3828410 - RNA, 17 nt, Human
ccuguguaacagcuccu

SEQ ID NO: 3828411 - RNA, 18 nt, Human
ccuguguaacagcuccuu

SEQ ID NO: 3828412 - RNA, 14 nt, Human
ccuguguacugugu

SEQ ID NO: 3828413 - RNA, 13 nt, Human
ccuguguagcugu

SEQ ID NO: 3828414 - RNA, 14 nt, Human
ccuguguagcugug

SEQ ID NO: 3828415 - RNA, 21 nt, Human
ccuguguagcugugaccugcu

SEQ ID NO: 3828416 - RNA, 17 nt, Human
ccuguguauacagcccu

SEQ ID NO: 3828417 - RNA, 17 nt, Human
ccuguguccaccugugg

SEQ ID NO: 3828418 - RNA, 18 nt, Human
ccuguguccaccuguggg

SEQ ID NO: 3828419 - RNA, 13 nt, Human
ccuguguccaugc

SEQ ID NO: 3828420 - RNA, 11 nt, Human
ccuguguccca

SEQ ID NO: 3828421 - RNA, 13 nt, Human
ccuguguccugaa

SEQ ID NO: 3828422 - RNA, 20 nt, Human
ccugugucugcgaaguccua

SEQ ID NO: 3828423 - RNA, 22 nt, Human
ccugugugauugacagcuuugc

SEQ ID NO: 3828424 - RNA, 13 nt, Human
ccugugugcaggu

SEQ ID NO: 3828425 - RNA, 14 nt, Human
ccuguguggacagg

SEQ ID NO: 3828426 - RNA, 12 nt, Human
ccuguguggaga

SEQ ID NO: 3828427 - RNA, 19 nt, Human
ccugugugguuuaguguaa

SEQ ID NO: 3828428 - RNA, 21 nt, Human
ccugugugguuuaguguaaaa

SEQ ID NO: 3828429 - RNA, 18 nt, Human
ccuguguguacucugucc

SEQ ID NO: 3828430 - RNA, 20 nt, Human
ccuguguguacucuguccag

SEQ ID NO: 3828431 - RNA, 21 nt, Human
ccugugugugcgccuacagga

SEQ ID NO: 3828432 - RNA, 16 nt, Human
ccuguguguuaagcuc

SEQ ID NO: 3828433 - RNA, 17 nt, Human
ccuguguguuaagcucu

SEQ ID NO: 3828434 - RNA, 14 nt, Human
ccuguguuaauuua

SEQ ID NO: 3828435 - RNA, 20 nt, Human
ccuguguucuuccuggccgc

SEQ ID NO: 3828436 - RNA, 14 nt, Human
ccuguguuucuugc

SEQ ID NO: 3828437 - RNA, 21 nt, Human
ccuguuaaaagaugaaaauau

SEQ ID NO: 3828438 - RNA, 17 nt, Human
ccuguuaccuacuuuga

SEQ ID NO: 3828439 - RNA, 23 nt, Human
ccuguuacuugaaauaccaguga

SEQ ID NO: 3828440 - RNA, 16 nt, Human
ccuguuagcagacagg

SEQ ID NO: 3828441 - RNA, 18 nt, Human
ccuguuagcuguuauuuc

SEQ ID NO: 3828442 - RNA, 19 nt, Human
ccuguuaggagaagcugca

SEQ ID NO: 3828443 - RNA, 14 nt, Human
ccuguucagcucca

SEQ ID NO: 3828444 - RNA, 20 nt, Human
ccuguucagcuccagcucac

SEQ ID NO: 3828445 - RNA, 21 nt, Human
ccuguucagcuccagcucacc

SEQ ID NO: 3828446 - RNA, 23 nt, Human
ccuguucagcuccagcucaccag

SEQ ID NO: 3828447 - RNA, 15 nt, Human
ccuguucaguuacag

SEQ ID NO: 3828448 - RNA, 17 nt, Human
ccuguucaguuacagaa

SEQ ID NO: 3828449 - RNA, 20 nt, Human
ccuguucaguuacagaaagu

SEQ ID NO: 3828450 - RNA, 16 nt, Human
ccuguucauuguaagc

SEQ ID NO: 3828451 - RNA, 18 nt, Human
ccuguucccaugagauga

SEQ ID NO: 3828452 - RNA, 15 nt, Human
ccuguuccccagaga

SEQ ID NO: 3828453 - RNA, 22 nt, Human
ccuguuccccucacuggaugaa

SEQ ID NO: 3828454 - RNA, 14 nt, Human
ccuguuccugcugc

SEQ ID NO: 3828455 - RNA, 14 nt, Human
ccuguuccuggagg

SEQ ID NO: 3828456 - RNA, 12 nt, Human
ccuguucuaagg

SEQ ID NO: 3828457 - RNA, 16 nt, Human
ccuguucugcuuuccu

SEQ ID NO: 3828458 - RNA, 19 nt, Human
ccuguucugggugcagcug

SEQ ID NO: 3828459 - RNA, 14 nt, Human
ccuguucuuccucc

SEQ ID NO: 3828460 - RNA, 16 nt, Human
ccuguucuuccuccag

SEQ ID NO: 3828461 - RNA, 20 nt, Human
ccuguucuuccuccagcugc

SEQ ID NO: 3828462 - RNA, 12 nt, Human
ccuguugaaaag

SEQ ID NO: 3828463 - RNA, 23 nt, Human
ccuguugaauuuuguucucuggg

SEQ ID NO: 3828464 - RNA, 17 nt, Human
ccuguugacacaggucu

SEQ ID NO: 3828465 - RNA, 22 nt, Human
ccuguugacacaggucuuuccu

SEQ ID NO: 3828466 - RNA, 17 nt, Human
ccuguugagcaucacag

SEQ ID NO: 3828467 - RNA, 14 nt, Human
ccuguugcacccag

SEQ ID NO: 3828468 - RNA, 22 nt, Human
ccuguugcacccagcccugguc

SEQ ID NO: 3828469 - RNA, 12 nt, Human
ccuguugcuaag

SEQ ID NO: 3828470 - RNA, 14 nt, Human
ccuguugcuaagcc

SEQ ID NO: 3828471 - RNA, 22 nt, Human
ccuguugcuguguuuaauuuga

SEQ ID NO: 3828472 - RNA, 16 nt, Human
ccuguugcuuacaauu

SEQ ID NO: 3828473 - RNA, 12 nt, Human
ccuguugggaga

SEQ ID NO: 3828474 - RNA, 15 nt, Human
ccuguugugccacag

SEQ ID NO: 3828475 - RNA, 12 nt, Human
ccuguuuaagag

SEQ ID NO: 3828476 - RNA, 14 nt, Human
ccuguuuaauauuu

SEQ ID NO: 3828477 - RNA, 19 nt, Human
ccuguuuauucccaucuuu

SEQ ID NO: 3828478 - RNA, 17 nt, Human
ccuguuucccaggccca

SEQ ID NO: 3828479 - RNA, 13 nt, Human
ccuguuucucugc

SEQ ID NO: 3828480 - RNA, 16 nt, Human
ccuguuucugaaaaga

SEQ ID NO: 3828481 - RNA, 13 nt, Human
ccuguuucuuccu

SEQ ID NO: 3828482 - RNA, 21 nt, Human
ccuguuuggccucucuauccu

SEQ ID NO: 3828483 - RNA, 23 nt, Human
ccuguuugggaagagcuuagaaa

SEQ ID NO: 3828484 - RNA, 14 nt, Human
ccuguuuguuucug

SEQ ID NO: 3828485 - RNA, 20 nt, Human
ccuguuuuagaagguucucu

SEQ ID NO: 3828486 - RNA, 17 nt, Human
ccuguuuuguuggaagg

SEQ ID NO: 3828487 - RNA, 16 nt, Human
ccuguuuuuuuuucau

SEQ ID NO: 3828488 - RNA, 15 nt, Human
ccuuaaaaccaaaga

SEQ ID NO: 3828489 - RNA, 16 nt, Human
ccuuaaaaccaaagag

SEQ ID NO: 3828490 - RNA, 17 nt, Human
ccuuaaaaccaaagagg

SEQ ID NO: 3828491 - RNA, 14 nt, Human
ccuuaaaagccauc

SEQ ID NO: 3828492 - RNA, 15 nt, Human
ccuuaaaauuugaaa

SEQ ID NO: 3828493 - RNA, 17 nt, Human
ccuuaaaauuugaaaca

SEQ ID NO: 3828494 - RNA, 17 nt, Human
ccuuaaagaguguggca

SEQ ID NO: 3828495 - RNA, 12 nt, Human
ccuuaaaggaag

SEQ ID NO: 3828496 - RNA, 22 nt, Human
ccuuaaagucaguaacuuaccc

SEQ ID NO: 3828497 - RNA, 21 nt, Human
ccuuaaauuaaacaauuuauu

SEQ ID NO: 3828498 - RNA, 13 nt, Human
ccuuaaauuuaau

SEQ ID NO: 3828499 - RNA, 17 nt, Human
ccuuaacaguuguauuu

SEQ ID NO: 3828500 - RNA, 13 nt, Human
ccuuaacccaagg

SEQ ID NO: 3828501 - RNA, 17 nt, Human
ccuuaacccaaggagca

SEQ ID NO: 3828502 - RNA, 14 nt, Human
ccuuaacuggagcc

SEQ ID NO: 3828503 - RNA, 17 nt, Human
ccuuaacuggagcccca

SEQ ID NO: 3828504 - RNA, 22 nt, Human
ccuuaagaccuacuguucuaaa

SEQ ID NO: 3828505 - RNA, 23 nt, Human
ccuuaagaccuacuguucuaaag

SEQ ID NO: 3828506 - RNA, 20 nt, Human
ccuuaaggacaaaaaugaac

SEQ ID NO: 3828507 - RNA, 16 nt, Human
ccuuaaguaucagaaa

SEQ ID NO: 3828508 - RNA, 11 nt, Human
ccuuaauauuu

SEQ ID NO: 3828509 - RNA, 12 nt, Human
ccuuaauauuuc

SEQ ID NO: 3828510 - RNA, 15 nt, Human
ccuuaauuacuuaaa

SEQ ID NO: 3828511 - RNA, 16 nt, Human
ccuuaauuuauuauua

SEQ ID NO: 3828512 - RNA, 18 nt, Human
ccuuaauuuccuuuuuga

SEQ ID NO: 3828513 - RNA, 22 nt, Human
caugaguagauaauuucagggu

SEQ ID NO: 3828514 - RNA, 12 nt, Human
caugagucccag

SEQ ID NO: 3828515 - RNA, 18 nt, Human
caugagucccagugggag

SEQ ID NO: 3828516 - RNA, 19 nt, Human
caugagucccagugggagg

SEQ ID NO: 3828517 - RNA, 21 nt, Human
caugaguccuugaaaauauuu

SEQ ID NO: 3828518 - RNA, 18 nt, Human
caugaguuacugugcauu

SEQ ID NO: 3828519 - RNA, 15 nt, Human
caugaguucugcuga

SEQ ID NO: 3828520 - RNA, 19 nt, Human
caugaguuggcugggaaua

SEQ ID NO: 3828521 - RNA, 23 nt, Human
caugaguuggggucuggcagccu

SEQ ID NO: 3828522 - RNA, 22 nt, Human
caugaguuugcccugguuucac

SEQ ID NO: 3828523 - RNA, 16 nt, Human
caugauaauucagcag

SEQ ID NO: 3828524 - RNA, 17 nt, Human
caugauacucauuucuu

SEQ ID NO: 3828525 - RNA, 20 nt, Human
caugauauuuuguuuuuccc

SEQ ID NO: 3828526 - RNA, 21 nt, Human
caugauauuuuguuuuucccc

SEQ ID NO: 3828527 - RNA, 17 nt, Human
caugaucacuuaucagu

SEQ ID NO: 3828528 - RNA, 20 nt, Human
caugauccaagcaagacuga

SEQ ID NO: 3828529 - RNA, 13 nt, Human
caugaucucccug

SEQ ID NO: 3828530 - RNA, 19 nt, Human
caugaucucccugccgccu

SEQ ID NO: 3828531 - RNA, 21 nt, Human
caugaucucccugccgccuca

SEQ ID NO: 3828532 - RNA, 15 nt, Human
caugaucucggcuua

SEQ ID NO: 3828533 - RNA, 14 nt, Human
caugaugauaguug

SEQ ID NO: 3828534 - RNA, 19 nt, Human
caugaugauaguugaaugu

SEQ ID NO: 3828535 - RNA, 16 nt, Human
caugaugauuucagaa

SEQ ID NO: 3828536 - RNA, 20 nt, Human
caugaugccucugucuucug

SEQ ID NO: 3828537 - RNA, 15 nt, Human
caugaugcgggccag

SEQ ID NO: 3828538 - RNA, 14 nt, Human
caugaugcuagcca

SEQ ID NO: 3828539 - RNA, 17 nt, Human
caugaugcucuuuccca

SEQ ID NO: 3828540 - RNA, 16 nt, Human
caugaugcugggauuu

SEQ ID NO: 3828541 - RNA, 19 nt, Human
caugauggagcgcaccugc

SEQ ID NO: 3828542 - RNA, 19 nt, Human
caugauggcaacagaucug

SEQ ID NO: 3828543 - RNA, 19 nt, Human
ccuguggggauuucuccca

SEQ ID NO: 3828544 - RNA, 23 nt, Human
ccuguggguguagccagguaugg

SEQ ID NO: 3828545 - RNA, 16 nt, Human
ccugugguuaacaucu

SEQ ID NO: 3828546 - RNA, 21 nt, Human
ccugugguuuccaaggagcug

SEQ ID NO: 3828547 - RNA, 16 nt, Human
ccuguguaacagcucc

SEQ ID NO: 3828548 - RNA, 22 nt, Human
ccuguguaacagcuccuuggga

SEQ ID NO: 3828549 - RNA, 21 nt, Human
ccuguguaaucauuucuuggg

SEQ ID NO: 3828550 - RNA, 12 nt, Human
ccuguguacagg

SEQ ID NO: 3828551 - RNA, 17 nt, Human
ccuguguagcugugacc

SEQ ID NO: 3828552 - RNA, 20 nt, Human
ccuguguagcugugaccugc

SEQ ID NO: 3828553 - RNA, 15 nt, Human
ccugugucaauccag

SEQ ID NO: 3828554 - RNA, 16 nt, Human
ccugugucaauccaga

SEQ ID NO: 3828555 - RNA, 19 nt, Human
ccuguguccaccugugggu

SEQ ID NO: 3828556 - RNA, 18 nt, Human
ccugugucccaugaccca

SEQ ID NO: 3828557 - RNA, 20 nt, Human
ccugugucccaugacccacc

SEQ ID NO: 3828558 - RNA, 23 nt, Human
ccugugucccaugacccaccccu

SEQ ID NO: 3828559 - RNA, 17 nt, Human
ccugugucuugcaaugg

SEQ ID NO: 3828560 - RNA, 19 nt, Human
ccugugucuugcaauggca

SEQ ID NO: 3828561 - RNA, 22 nt, Human
ccugugucuugcaauggcagcc

SEQ ID NO: 3828562 - RNA, 22 nt, Human
ccugugucuuuaaaugcugcuu

SEQ ID NO: 3828563 - RNA, 14 nt, Human
ccugugugauugac

SEQ ID NO: 3828564 - RNA, 19 nt, Human
ccugugugauugacagcuu

SEQ ID NO: 3828565 - RNA, 12 nt, Human
ccugugugcagg

SEQ ID NO: 3828566 - RNA, 17 nt, Human
ccuguguggacaggacu

SEQ ID NO: 3828567 - RNA, 15 nt, Human
ccuuggccuggagca

SEQ ID NO: 3828568 - RNA, 13 nt, Human
ccuuggccugggc

SEQ ID NO: 3828569 - RNA, 22 nt, Human
ccuuggcucaaguccucuuuuc

SEQ ID NO: 3828570 - RNA, 18 nt, Human
ccuuggcucaauccucua

SEQ ID NO: 3828571 - RNA, 22 nt, Human
ccuuggcucaauccucuaagcu

SEQ ID NO: 3828572 - RNA, 12 nt, Human
ccuuggcucaga

SEQ ID NO: 3828573 - RNA, 12 nt, Human
ccuuggcugcag

SEQ ID NO: 3828574 - RNA, 21 nt, Human
ccuuggcuguuggcagugagu

SEQ ID NO: 3828575 - RNA, 13 nt, Human
ccuuggcuugccc

SEQ ID NO: 3828576 - RNA, 15 nt, Human
ccuuggcuugcccac

SEQ ID NO: 3828577 - RNA, 22 nt, Human
ccuuggcuuggcccuggcagcc

SEQ ID NO: 3828578 - RNA, 16 nt, Human
ccuugggaggaagcag

SEQ ID NO: 3828579 - RNA, 23 nt, Human
ccuugggaggaagcagaauaaag

SEQ ID NO: 3828580 - RNA, 22 nt, Human
ccuugggccagaaguaccagac

SEQ ID NO: 3828581 - RNA, 18 nt, Human
ccuugggcggcugagagc

SEQ ID NO: 3828582 - RNA, 15 nt, Human
ccuugggcucugaug

SEQ ID NO: 3828583 - RNA, 15 nt, Human
ccuugggcucugcug

SEQ ID NO: 3828584 - RNA, 16 nt, Human
ccuugggcucugcuga

SEQ ID NO: 3828585 - RNA, 15 nt, Human
ccuugggcugcuccu

SEQ ID NO: 3828586 - RNA, 17 nt, Human
ccuugggcugcuccuca

SEQ ID NO: 3828587 - RNA, 19 nt, Human
ccuuggggacaaccuuggc

SEQ ID NO: 3828588 - RNA, 22 nt, Human
ccuuggggaggacaaaacuucu

SEQ ID NO: 3828589 - RNA, 15 nt, Human
ccuugggggcuccca

SEQ ID NO: 3828590 - RNA, 11 nt, Human
ccuuggggguc

SEQ ID NO: 3828591 - RNA, 22 nt, Human
ccuuggggguccuccuccaggg

SEQ ID NO: 3828592 - RNA, 22 nt, Human
ccuuggggucagguugacagga

SEQ ID NO: 3828593 - RNA, 20 nt, Human
ccuuggguuagaccuacagg

SEQ ID NO: 3828594 - RNA, 20 nt, Human
ccuuggugauuccgcaguga

SEQ ID NO: 3828595 - RNA, 18 nt, Human
ccuugguguccaccuggc

SEQ ID NO: 3828596 - RNA, 20 nt, Human
ccuugguguccaccuggccc

SEQ ID NO: 3828597 - RNA, 21 nt, Human
ccuugguguccaccuggcccc

SEQ ID NO: 3828598 - RNA, 17 nt, Human
ccuugguucccuugugu

SEQ ID NO: 3828599 - RNA, 13 nt, Human
ccuugguuccuaa

SEQ ID NO: 3828600 - RNA, 13 nt, Human
ccuugguuggaag

SEQ ID NO: 3828601 - RNA, 21 nt, Human
ccuuguaauguaacugcucuu

SEQ ID NO: 3828602 - RNA, 16 nt, Human
ccuuguaauucuaaau

SEQ ID NO: 3828603 - RNA, 20 nt, Human
ccuuguauccccugcaggcu

SEQ ID NO: 3828604 - RNA, 16 nt, Human
ccuuguauuuaaauau

SEQ ID NO: 3828605 - RNA, 15 nt, Human
ccuugucacgccaga

SEQ ID NO: 3828606 - RNA, 18 nt, Human
ccuugucacgccagacuu

SEQ ID NO: 3828607 - RNA, 16 nt, Human
ccuugucacugguaga

SEQ ID NO: 3828608 - RNA, 14 nt, Human
ccuuguccccacac

SEQ ID NO: 3828609 - RNA, 19 nt, Human
ccuuguccccacacuccua

SEQ ID NO: 3828610 - RNA, 14 nt, Human
ccuuguccccugcc

SEQ ID NO: 3828611 - RNA, 12 nt, Human
ccuugucucugg

SEQ ID NO: 3828612 - RNA, 23 nt, Human
ccuugugaugucauacagagaag

SEQ ID NO: 3828613 - RNA, 12 nt, Human
ccuugugccaga

SEQ ID NO: 3828614 - RNA, 14 nt, Human
ccuugugccugggg

SEQ ID NO: 3828615 - RNA, 13 nt, Human
ccuugugcugggg

SEQ ID NO: 3828616 - RNA, 13 nt, Human
ccuuguggcagag

SEQ ID NO: 3828617 - RNA, 22 nt, Human
ccuuguggccugggccuccuca

SEQ ID NO: 3828618 - RNA, 20 nt, Human
ccuugugggugugagcagca

SEQ ID NO: 3828619 - RNA, 11 nt, Human
ccuuguggucc

SEQ ID NO: 3828620 - RNA, 19 nt, Human
ccuuguggucccaccccac

SEQ ID NO: 3828621 - RNA, 23 nt, Human
ccuugugucuacagagaaccugg

SEQ ID NO: 3828622 - RNA, 20 nt, Human
ccuuguguuuuguuuugauu

SEQ ID NO: 3828623 - RNA, 21 nt, Human
ccuuguuccuagaguagagug

SEQ ID NO: 3828624 - RNA, 21 nt, Human
ccuuguucugauaaugaaaau

SEQ ID NO: 3828625 - RNA, 20 nt, Human
ccuuguucuuuggaaauaca

SEQ ID NO: 3828626 - RNA, 22 nt, Human
ccuuguuugauuuuagcugcag

SEQ ID NO: 3828627 - RNA, 20 nt, Human
ccuuguuuugaaaaccuaaa

SEQ ID NO: 3828628 - RNA, 15 nt, Human
ccuuuaaaaaagaaa

SEQ ID NO: 3828629 - RNA, 12 nt, Human
ccuuuaaaauuu

SEQ ID NO: 3828630 - RNA, 21 nt, Human
ccuuuaaaauuuuuuuagaaa

SEQ ID NO: 3828631 - RNA, 18 nt, Human
ccuuuaaaguaugaaucu

SEQ ID NO: 3828632 - RNA, 20 nt, Human
ccuuuaaucagguccugcuc

SEQ ID NO: 3828633 - RNA, 19 nt, Human
ccuuuaauuaagacugaaa

SEQ ID NO: 3828634 - RNA, 16 nt, Human
ccuuuacaaaagaaau

SEQ ID NO: 3828635 - RNA, 19 nt, Human
ccuuuacacucaggcuuuc

SEQ ID NO: 3828636 - RNA, 22 nt, Human
ccuuuacccucuuugcugcaga

SEQ ID NO: 3828637 - RNA, 14 nt, Human
ccuuuacggacacc

SEQ ID NO: 3828638 - RNA, 19 nt, Human
ccuuuacggacacccccuc

SEQ ID NO: 3828639 - RNA, 18 nt, Human
ccuuuacuugucuuucug

SEQ ID NO: 3828640 - RNA, 19 nt, Human
ccuuuagauagcagccugg

SEQ ID NO: 3828641 - RNA, 16 nt, Human
ccuuuagaucucugaa

SEQ ID NO: 3828642 - RNA, 17 nt, Human
ccuuuagaucucugaag

SEQ ID NO: 3828643 - RNA, 20 nt, Human
ccuuuagcacguuuaaaguu

SEQ ID NO: 3828644 - RNA, 19 nt, Human
ccuuuagccaaacccuugu

SEQ ID NO: 3828645 - RNA, 19 nt, Human
ccuuuaggguucugccucu

SEQ ID NO: 3828646 - RNA, 18 nt, Human
ccuuuaguaccugaaaag

SEQ ID NO: 3828647 - RNA, 18 nt, Human
ccuuuagugguggccauu

SEQ ID NO: 3828648 - RNA, 19 nt, Human
ccuuuauauuuagugaacu

SEQ ID NO: 3828649 - RNA, 14 nt, Human
ccuuuaugugaauu

SEQ ID NO: 3828650 - RNA, 17 nt, Human
ccuuuaugugaauuuuu

SEQ ID NO: 3828651 - RNA, 23 nt, Human
ccuuuauguggaaaacagaacau

SEQ ID NO: 3828652 - RNA, 23 nt, Human
ccuuuauuacccccuccuucaga

SEQ ID NO: 3828653 - RNA, 19 nt, Human
ccuuuauuuccacugugca

SEQ ID NO: 3828654 - RNA, 23 nt, Human
ccuuuauuuguuaauaguuccug

SEQ ID NO: 3828655 - RNA, 14 nt, Human
ccuuucaaauuuag

SEQ ID NO: 3828656 - RNA, 16 nt, Human
ccuuucaaauuuagaa

SEQ ID NO: 3828657 - RNA, 17 nt, Human
ccuuucaauaggaaaaa

SEQ ID NO: 3828658 - RNA, 18 nt, Human
ccuuucaauaggaaaaac

SEQ ID NO: 3828659 - RNA, 21 nt, Human
ccuuucacaaaauuuuauucc

SEQ ID NO: 3828660 - RNA, 15 nt, Human
ccuuucacaaccuuc

SEQ ID NO: 3828661 - RNA, 21 nt, Human
ccuuucacagagcagagucug

SEQ ID NO: 3828662 - RNA, 14 nt, Human
ccuuucacaggcag

SEQ ID NO: 3828663 - RNA, 22 nt, Human
ccuuucacuucuuucccuuccu

SEQ ID NO: 3828664 - RNA, 17 nt, Human
ccuuucagaugucuucu

SEQ ID NO: 3828665 - RNA, 19 nt, Human
ccuuucagaugucuucugc

SEQ ID NO: 3828666 - RNA, 21 nt, Human
ccuuucagaugucuucugccu

SEQ ID NO: 3828667 - RNA, 22 nt, Human
ccuuucagaugucuucugccug

SEQ ID NO: 3828668 - RNA, 22 nt, Human
ccuuucagcccacgucacgugu

SEQ ID NO: 3828669 - RNA, 18 nt, Human
ccuuucauuuacuguggc

SEQ ID NO: 3828670 - RNA, 19 nt, Human
ccuuucauuuacuguggcu

SEQ ID NO: 3828671 - RNA, 15 nt, Human
ccuuuccaaaauuuu

SEQ ID NO: 3828672 - RNA, 20 nt, Human
ccuuuccaguggccuggcuc

SEQ ID NO: 3828673 - RNA, 11 nt, Human
ccuuuccauaa

SEQ ID NO: 3828674 - RNA, 18 nt, Human
ccuuuccauccauggcca

SEQ ID NO: 3828675 - RNA, 12 nt, Human
ccuuuccccagc

SEQ ID NO: 3828676 - RNA, 22 nt, Human
ccuuuccccagcaucacucccc

SEQ ID NO: 3828677 - RNA, 13 nt, Human
ccuuuccccagcc

SEQ ID NO: 3828678 - RNA, 15 nt, Human
ccuuuccccuuccuu

SEQ ID NO: 3828679 - RNA, 16 nt, Human
ccuuuccccuuccuuu

SEQ ID NO: 3828680 - RNA, 14 nt, Human
ccuuucccgggcug

SEQ ID NO: 3828681 - RNA, 18 nt, Human
ccuuucccgggcugucca

SEQ ID NO: 3828682 - RNA, 20 nt, Human
ccuuucccuccacuccuucc

SEQ ID NO: 3828683 - RNA, 14 nt, Human
ccuuucccucgcua

SEQ ID NO: 3828684 - RNA, 12 nt, Human
ccuuucccuucu

SEQ ID NO: 3828685 - RNA, 13 nt, Human
ccuuucccuuggu

SEQ ID NO: 3828686 - RNA, 20 nt, Human
ccuuucccuuguagcuccuc

SEQ ID NO: 3828687 - RNA, 14 nt, Human
cauuaguuuugaag

SEQ ID NO: 3828688 - RNA, 15 nt, Human
cauuaguuuugaaga

SEQ ID NO: 3828689 - RNA, 13 nt, Human
cauuauaaacgug

SEQ ID NO: 3828690 - RNA, 14 nt, Human
cauuauaaugaauu

SEQ ID NO: 3828691 - RNA, 19 nt, Human
cauuauagauuuucauguu

SEQ ID NO: 3828692 - RNA, 20 nt, Human
cauuauauagcaguaaaaaa

SEQ ID NO: 3828693 - RNA, 13 nt, Human
cauuauauugcaa

SEQ ID NO: 3828694 - RNA, 16 nt, Human
cauuauauugcaauga

SEQ ID NO: 3828695 - RNA, 19 nt, Human
cauuaucacuuuaaagccc

SEQ ID NO: 3828696 - RNA, 16 nt, Human
cauuaucauguguaau

SEQ ID NO: 3828697 - RNA, 14 nt, Human
cauuaucccugaau

SEQ ID NO: 3828698 - RNA, 22 nt, Human
cauuaucgccuuuugacagcug

SEQ ID NO: 3828699 - RNA, 16 nt, Human
cauuaucgggagcagu

SEQ ID NO: 3828700 - RNA, 23 nt, Human
cauuaucuagauacuguaucaug

SEQ ID NO: 3828701 - RNA, 22 nt, Human
cauuaucuugucacuguaguuu

SEQ ID NO: 3828702 - RNA, 23 nt, Human
cauuaugaugugggucaaggaau

SEQ ID NO: 3828703 - RNA, 19 nt, Human
cauuauguccacuguguau

SEQ ID NO: 3828704 - RNA, 21 nt, Human
cauuaugugguuuuagauuuu

SEQ ID NO: 3828705 - RNA, 11 nt, Human
cauuaugugug

SEQ ID NO: 3828706 - RNA, 13 nt, Human
cauuaugugugca

SEQ ID NO: 3828707 - RNA, 17 nt, Human
cauuaugugugcaugug

SEQ ID NO: 3828708 - RNA, 20 nt, Human
cauuaugugugcaugugugu

SEQ ID NO: 3828709 - RNA, 21 nt, Human
cauuaugugugcaugugugua

SEQ ID NO: 3828710 - RNA, 22 nt, Human
cauuaugugugcauguguguau

SEQ ID NO: 3828711 - RNA, 23 nt, Human
cauuaugugugcauguguguaua

SEQ ID NO: 3828712 - RNA, 21 nt, Human
cauuauuaaguaacuuauuua

SEQ ID NO: 3828713 - RNA, 23 nt, Human
cauuauuacuuuugcuguaaugu

SEQ ID NO: 3828714 - RNA, 18 nt, Human
cauuauucaaaguugccu

SEQ ID NO: 3828715 - RNA, 22 nt, Human
cauuauucaaaguugccuaaau

SEQ ID NO: 3828716 - RNA, 20 nt, Human
cauuauucauuuagugaguu

SEQ ID NO: 3828717 - RNA, 12 nt, Human
cauuauucucuu

SEQ ID NO: 3828718 - RNA, 16 nt, Human
cauuauugcuuauugc

SEQ ID NO: 3828719 - RNA, 12 nt, Human
cauuauuggaau

SEQ ID NO: 3828720 - RNA, 23 nt, Human
cauuauuggaauuaaccuggugc

SEQ ID NO: 3828721 - RNA, 16 nt, Human
cauuauuuauguauug

SEQ ID NO: 3828722 - RNA, 18 nt, Human
cauuauuuauuaaauuuu

SEQ ID NO: 3828723 - RNA, 20 nt, Human
cauuauuucuaguccaaaau

SEQ ID NO: 3828724 - RNA, 14 nt, Human
cauuauuugagaag

SEQ ID NO: 3828725 - RNA, 22 nt, Human
cauuauuugagaagcugcucaa

SEQ ID NO: 3828726 - RNA, 19 nt, Human
cauuauuugcauguuaccu

SEQ ID NO: 3828727 - RNA, 14 nt, Human
cauuauuugucaaa

SEQ ID NO: 3828728 - RNA, 15 nt, Human
cauuauuugucaaau

SEQ ID NO: 3828729 - RNA, 14 nt, Human
cauuauuuucuguc

SEQ ID NO: 3828730 - RNA, 16 nt, Human
cauuauuuucugucag

SEQ ID NO: 3828731 - RNA, 13 nt, Human
ccuuauccucccu

SEQ ID NO: 3828732 - RNA, 18 nt, Human
ccuuauccucugaucucc

SEQ ID NO: 3828733 - RNA, 16 nt, Human
ccuuaucgaaacucau

SEQ ID NO: 3828734 - RNA, 15 nt, Human
ccuuaucuagcugca

SEQ ID NO: 3828735 - RNA, 15 nt, Human
ccuuaucugugcuca

SEQ ID NO: 3828736 - RNA, 19 nt, Human
ccuuaugacuugcuacuuu

SEQ ID NO: 3828737 - RNA, 16 nt, Human
ccuuauggaacacucu

SEQ ID NO: 3828738 - RNA, 22 nt, Human
ccuuauggaacacucugagacu

SEQ ID NO: 3828739 - RNA, 15 nt, Human
ccuuauuguaccucu

SEQ ID NO: 3828740 - RNA, 16 nt, Human
ccuuauuguaccucuc

SEQ ID NO: 3828741 - RNA, 14 nt, Human
ccuuauuuucaaga

SEQ ID NO: 3828742 - RNA, 18 nt, Human
ccuuauuuucaagaaacu

SEQ ID NO: 3828743 - RNA, 20 nt, Human
ccuucaaaacuauagcuugc

SEQ ID NO: 3828744 - RNA, 15 nt, Human
ccuucaaagcaaaug

SEQ ID NO: 3828745 - RNA, 13 nt, Human
ccuucaaagcuga

SEQ ID NO: 3828746 - RNA, 22 nt, Human
ccuucaaagucucaaugaaaua

SEQ ID NO: 3828747 - RNA, 14 nt, Human
ccuucaacccgaga

SEQ ID NO: 3828748 - RNA, 17 nt, Human
ccuucaacguuucuuca

SEQ ID NO: 3828749 - RNA, 19 nt, Human
ccuucaacguuucuucacu

SEQ ID NO: 3828750 - RNA, 24 nt, Human
ccuucaacugaaaagacucagugu

SEQ ID NO: 3828751 - RNA, 18 nt, Human
ccuucaagaccuucacca

SEQ ID NO: 3828752 - RNA, 22 nt, Human
ccuucaagaccuucaccaaaca

SEQ ID NO: 3828753 - RNA, 23 nt, Human
ccuucaagccagcaacacagagc

SEQ ID NO: 3828754 - RNA, 15 nt, Human
ccuucaagcucugag

SEQ ID NO: 3828755 - RNA, 18 nt, Human
ccuucaagcucugaggga

SEQ ID NO: 3828756 - RNA, 15 nt, Human
ccuucaagcugcuuu

SEQ ID NO: 3828757 - RNA, 17 nt, Human
ccuucaaguuagcucag

SEQ ID NO: 3828758 - RNA, 16 nt, Human
ccuucaauuccugggc

SEQ ID NO: 3828759 - RNA, 17 nt, Human
ccuucacagaugggugc

SEQ ID NO: 3828760 - RNA, 12 nt, Human
ccuucacagugu

SEQ ID NO: 3828761 - RNA, 18 nt, Human
ccuucacauuuuuuaugg

SEQ ID NO: 3828762 - RNA, 18 nt, Human
ccuucaccuuugucccca

SEQ ID NO: 3828763 - RNA, 21 nt, Human
ccuucaccuuuguccccaccg

SEQ ID NO: 3828764 - RNA, 14 nt, Human
ccuucacugccuuu

SEQ ID NO: 3828765 - RNA, 18 nt, Human
ccuucacugccuuugcuc

SEQ ID NO: 3828766 - RNA, 18 nt, Human
ccuucagaaccauccaua

SEQ ID NO: 3828767 - RNA, 20 nt, Human
ccuucagacacccucaaccu

SEQ ID NO: 3828768 - RNA, 21 nt, Human
ccuucagacuuugcuucccau

SEQ ID NO: 3828769 - RNA, 16 nt, Human
ccuucagagagcagug

SEQ ID NO: 3828770 - RNA, 19 nt, Human
ccuucagagagcagugcuu

SEQ ID NO: 3828771 - RNA, 22 nt, Human
ccuucagagagcagugcuuuug

SEQ ID NO: 3828772 - RNA, 16 nt, Human
ccuucagauggaaacu

SEQ ID NO: 3828773 - RNA, 21 nt, Human
ccuucagcauccucaguuccu

SEQ ID NO: 3828774 - RNA, 13 nt, Human
ccuucagccccca

SEQ ID NO: 3828775 - RNA, 18 nt, Human
ccuucagcccccagcccc

SEQ ID NO: 3828776 - RNA, 14 nt, Human
ccuucagcccucac

SEQ ID NO: 3828777 - RNA, 13 nt, Human
ccuucagccuuaa

SEQ ID NO: 3828778 - RNA, 18 nt, Human
ccuucagggugaugccag

SEQ ID NO: 3828779 - RNA, 16 nt, Human
ccuucaguaaccccca

SEQ ID NO: 3828780 - RNA, 19 nt, Human
ccuucaguacccucucagc

SEQ ID NO: 3828781 - RNA, 10 nt, Human
ccuucagugc

SEQ ID NO: 3828782 - RNA, 14 nt, Human
ccuucagugccaaa

SEQ ID NO: 3828783 - RNA, 19 nt, Human
ccuucauacuugaacguuu

SEQ ID NO: 3828784 - RNA, 20 nt, Human
ccuucauacuugaacguuuu

SEQ ID NO: 3828785 - RNA, 21 nt, Human
ccuucaucaugaguucugcug

SEQ ID NO: 3828786 - RNA, 22 nt, Human
ccuucaucaugaguucugcuga

SEQ ID NO: 3828787 - RNA, 20 nt, Human
ccuucaucuggauuccagag

SEQ ID NO: 3828788 - RNA, 21 nt, Human
ccuucauuaccuuuuuugaua

SEQ ID NO: 3828789 - RNA, 20 nt, Human
ccuucauugccuuaacugga

SEQ ID NO: 3828790 - RNA, 19 nt, Human
ccuucauuuggcauucccc

SEQ ID NO: 3828791 - RNA, 17 nt, Human
ccuuccaaaaauuauua

SEQ ID NO: 3828792 - RNA, 20 nt, Human
ccuuccaaauaauaaagucu

SEQ ID NO: 3828793 - RNA, 17 nt, Human
ccuuccaacugcugccc

SEQ ID NO: 3828794 - RNA, 17 nt, Human
ccuuccaaugucuggag

SEQ ID NO: 3828795 - RNA, 21 nt, Human
ccuuccaaugucuggagacca

SEQ ID NO: 3828796 - RNA, 13 nt, Human
ccuuccacccagg

SEQ ID NO: 3828797 - RNA, 15 nt, Human
ccuuccacccagggg

SEQ ID NO: 3828798 - RNA, 16 nt, Human
ccuuccaccucccucc

SEQ ID NO: 3828799 - RNA, 17 nt, Human
ccuuccaccucugggag

SEQ ID NO: 3828800 - RNA, 16 nt, Human
ccuuccaccugcucug

SEQ ID NO: 3828801 - RNA, 19 nt, Human
ccuuccacgcugucuccag

SEQ ID NO: 3828802 - RNA, 20 nt, Human
ccuuccacgcugucuccaga

SEQ ID NO: 3828803 - RNA, 20 nt, Human
ccuuccacggauccauguag

SEQ ID NO: 3828804 - RNA, 21 nt, Human
ccuuccacggauccauguagc

SEQ ID NO: 3828805 - RNA, 22 nt, Human
ccuuccagacauacgaaacaca

SEQ ID NO: 3828806 - RNA, 13 nt, Human
ccuuccagcccag

SEQ ID NO: 3828807 - RNA, 13 nt, Human
ccuuccagcuccu

SEQ ID NO: 3828808 - RNA, 17 nt, Human
ccuuccagcuccuguaa

SEQ ID NO: 3828809 - RNA, 12 nt, Human
ccuuccagcugc

SEQ ID NO: 3828810 - RNA, 15 nt, Human
ccuuccagcugcugu

SEQ ID NO: 3828811 - RNA, 13 nt, Human
ccuuccaggcccc

SEQ ID NO: 3828812 - RNA, 12 nt, Human
ccuuccauaauu

SEQ ID NO: 3828813 - RNA, 23 nt, Human
ccuuccauagccuaaucccuggg

SEQ ID NO: 3828814 - RNA, 15 nt, Human
ccuuccaucccagag

SEQ ID NO: 3828815 - RNA, 19 nt, Human
ccuuccaucccuacccccu

SEQ ID NO: 3828816 - RNA, 23 nt, Human
ccuuccaugucgccucugcauuc

SEQ ID NO: 3828817 - RNA, 19 nt, Human
ccuuccaugucggccucua

SEQ ID NO: 3828818 - RNA, 20 nt, Human
ccuuccaugucggccucuaa

SEQ ID NO: 3828819 - RNA, 21 nt, Human
ccuucccaaaggacuccaccc

SEQ ID NO: 3828820 - RNA, 20 nt, Human
ccuucccaaguaagaggcug

SEQ ID NO: 3828821 - RNA, 21 nt, Human
ccuucccaaguaagaggcugg

SEQ ID NO: 3828822 - RNA, 14 nt, Human
ccuucccaccucuc

SEQ ID NO: 3828823 - RNA, 18 nt, Human
ccuucccacucuucucau

SEQ ID NO: 3828824 - RNA, 13 nt, Human
ccuucccagcugc

SEQ ID NO: 3828825 - RNA, 21 nt, Human
ccuucccaugacccaggcugg

SEQ ID NO: 3828826 - RNA, 13 nt, Human
ccuucccauggag

SEQ ID NO: 3828827 - RNA, 12 nt, Human
ccuuccccacug

SEQ ID NO: 3828828 - RNA, 20 nt, Human
ccuuccccacugccugccca

SEQ ID NO: 3828829 - RNA, 15 nt, Human
ccuuccccagccucu

SEQ ID NO: 3828830 - RNA, 21 nt, Human
ccuuccccaugcuuccuugcc

SEQ ID NO: 3828831 - RNA, 23 nt, Human
cauuuggaguguuccccuuccac

SEQ ID NO: 3828832 - RNA, 23 nt, Human
cauuuggauuggggucccucuaa

SEQ ID NO: 3828833 - RNA, 20 nt, Human
cauuuggcaaugccaucauc

SEQ ID NO: 3828834 - RNA, 15 nt, Human
cauuuggguccagga

SEQ ID NO: 3828835 - RNA, 23 nt, Human
cauuugggugguaagagaauguu

SEQ ID NO: 3828836 - RNA, 13 nt, Human
cauuuggugcuug

SEQ ID NO: 3828837 - RNA, 16 nt, Human
cauuugguucauuaau

SEQ ID NO: 3828838 - RNA, 16 nt, Human
cauuugguuggcacua

SEQ ID NO: 3828839 - RNA, 15 nt, Human
cauuuguaaauauua

SEQ ID NO: 3828840 - RNA, 20 nt, Human
cauuuguauaaaauaauuuu

SEQ ID NO: 3828841 - RNA, 19 nt, Human
cauuuguaugucaaagcuu

SEQ ID NO: 3828842 - RNA, 15 nt, Human
cauuuguauguugug

SEQ ID NO: 3828843 - RNA, 23 nt, Human
cauuuguauguugugaagauguu

SEQ ID NO: 3828844 - RNA, 14 nt, Human
cauuuguauuuugu

SEQ ID NO: 3828845 - RNA, 17 nt, Human
cauuugucacacacuuu

SEQ ID NO: 3828846 - RNA, 14 nt, Human
cauuugucauuuuc

SEQ ID NO: 3828847 - RNA, 14 nt, Human
cauuugucccaagu

SEQ ID NO: 3828848 - RNA, 19 nt, Human
cauuugucccaagugccaa

SEQ ID NO: 3828849 - RNA, 22 nt, Human
cauuugucuauucuccagcuga

SEQ ID NO: 3828850 - RNA, 11 nt, Human
cauuugugagg

SEQ ID NO: 3828851 - RNA, 19 nt, Human
cauuugugauauauguauu

SEQ ID NO: 3828852 - RNA, 15 nt, Human
cauuugugccagagg

SEQ ID NO: 3828853 - RNA, 16 nt, Human
cauuugugccagagga

SEQ ID NO: 3828854 - RNA, 22 nt, Human
cauuuguggugauauagaauua

SEQ ID NO: 3828855 - RNA, 13 nt, Human
cauuugugugugu

SEQ ID NO: 3828856 - RNA, 22 nt, Human
cauuuguuaaaauuaucaauau

SEQ ID NO: 3828857 - RNA, 13 nt, Human
cauuuguuaauau

SEQ ID NO: 3828858 - RNA, 19 nt, Human
cauuuguuauucuuaagac

SEQ ID NO: 3828859 - RNA, 20 nt, Human
cauuuguugugaugucuuuu

SEQ ID NO: 3828860 - RNA, 19 nt, Human
cauuuguuuauguaauuuc

SEQ ID NO: 3828861 - RNA, 21 nt, Human
cauuuguuucuuucucugagg

SEQ ID NO: 3828862 - RNA, 20 nt, Human
cauuuguuugaacugauaaa

SEQ ID NO: 3828863 - RNA, 18 nt, Human
cauuuguuugguuauagu

SEQ ID NO: 3828864 - RNA, 19 nt, Human
cauuuguuuuguuuacaga

SEQ ID NO: 3828865 - RNA, 16 nt, Human
cauuuguuuuucucac

SEQ ID NO: 3828866 - RNA, 21 nt, Human
cauuuuaaaaacauagaaaaa

SEQ ID NO: 3828867 - RNA, 12 nt, Human
cauuuuaaacaa

SEQ ID NO: 3828868 - RNA, 17 nt, Human
cauuuuaaacaaaauag

SEQ ID NO: 3828869 - RNA, 23 nt, Human
cauuuuaaacaaaauagaaaguu

SEQ ID NO: 3828870 - RNA, 12 nt, Human
cauuuuaaaugg

SEQ ID NO: 3828871 - RNA, 13 nt, Human
cauuuuaacaaga

SEQ ID NO: 3828872 - RNA, 14 nt, Human
cauuuuaacaagaa

SEQ ID NO: 3828873 - RNA, 15 nt, Human
cauuuuaacaagaag

SEQ ID NO: 3828874 - RNA, 16 nt, Human
cauuuuaacaagaaga

SEQ ID NO: 3828875 - RNA, 17 nt, Human
cauuuuaacaagaagau

SEQ ID NO: 3828876 - RNA, 18 nt, Human
cauuuuaacccuauuuua

SEQ ID NO: 3828877 - RNA, 16 nt, Human
cauuuuaacuuuauca

SEQ ID NO: 3828878 - RNA, 22 nt, Human
cauuuuaaggaaaacuaccugu

SEQ ID NO: 3828879 - RNA, 13 nt, Human
cauuuuaauguaa

SEQ ID NO: 3828880 - RNA, 17 nt, Human
cauuuuaauuauuauuc

SEQ ID NO: 3828881 - RNA, 18 nt, Human
cauuuuaauuuuaaagug

SEQ ID NO: 3828882 - RNA, 17 nt, Human
cauuuuacuuuuuccug

SEQ ID NO: 3828883 - RNA, 20 nt, Human
cauuuuacuuuuuccuggcu

SEQ ID NO: 3828884 - RNA, 14 nt, Human
cauuuuaggaaagg

SEQ ID NO: 3828885 - RNA, 16 nt, Human
cauuuuagucacuuuu

SEQ ID NO: 3828886 - RNA, 13 nt, Human
cauuuuauaaauc

SEQ ID NO: 3828887 - RNA, 19 nt, Human
cauuuuauauugaaaaaaa

SEQ ID NO: 3828888 - RNA, 22 nt, Human
cauuuuauuaagcuuuuuggaa

SEQ ID NO: 3828889 - RNA, 23 nt, Human
cauuuuauuaagcuuuuuggaau

SEQ ID NO: 3828890 - RNA, 17 nt, Human
cauuuucaccccacccu

SEQ ID NO: 3828891 - RNA, 15 nt, Human
cauuuucauuagcaa

SEQ ID NO: 3828892 - RNA, 17 nt, Human
cauuuucauuagcaaaa

SEQ ID NO: 3828893 - RNA, 21 nt, Human
cauuuuccauauccuggugcc

SEQ ID NO: 3828894 - RNA, 21 nt, Human
cauuuucccccacuacugcag

SEQ ID NO: 3828895 - RNA, 14 nt, Human
cauuuuccccccac

SEQ ID NO: 3828896 - RNA, 15 nt, Human
cauuuuccccccacu

SEQ ID NO: 3828897 - RNA, 22 nt, Human
cauuuuccccccacucucccca

SEQ ID NO: 3828898 - RNA, 18 nt, Human
cauuuuccuacaggcagu

SEQ ID NO: 3828899 - RNA, 22 nt, Human
cauuuuccuacaggcagucucu

SEQ ID NO: 3828900 - RNA, 18 nt, Human
cauuuucuauaacagaua

SEQ ID NO: 3828901 - RNA, 17 nt, Human
cauuuucucccuggauu

SEQ ID NO: 3828902 - RNA, 12 nt, Human
cauuuucucuaa

SEQ ID NO: 3828903 - RNA, 14 nt, Human
cauuuucucuuaga

SEQ ID NO: 3828904 - RNA, 15 nt, Human
cauuuucucuuagaa

SEQ ID NO: 3828905 - RNA, 16 nt, Human
cauuuucugcaucucc

SEQ ID NO: 3828906 - RNA, 22 nt, Human
cauuuucuggccaguguuuaaa

SEQ ID NO: 3828907 - RNA, 18 nt, Human
cauuuucuuuucacuucg

SEQ ID NO: 3828908 - RNA, 19 nt, Human
cauuuugaaagucuguccu

SEQ ID NO: 3828909 - RNA, 21 nt, Human
cauuuugaaagucuguccuug

SEQ ID NO: 3828910 - RNA, 23 nt, Human
cauuuugaaucacaugaauuauu

SEQ ID NO: 3828911 - RNA, 17 nt, Human
cauuuugagugacucga

SEQ ID NO: 3828912 - RNA, 20 nt, Human
cauuuugagugacucgaggg

SEQ ID NO: 3828913 - RNA, 12 nt, Human
cauuuugcaaaa

SEQ ID NO: 3828914 - RNA, 13 nt, Human
cauuuugcauuca

SEQ ID NO: 3828915 - RNA, 20 nt, Human
cauuuugccaaaauuauuaa

SEQ ID NO: 3828916 - RNA, 21 nt, Human
cauuuugcuaaaugugaauga

SEQ ID NO: 3828917 - RNA, 15 nt, Human
cauuuugcuauugua

SEQ ID NO: 3828918 - RNA, 12 nt, Human
cauuuugcuuua

SEQ ID NO: 3828919 - RNA, 18 nt, Human
cauuuuggaaguuuucag

SEQ ID NO: 3828920 - RNA, 22 nt, Human
cauuuugguaagagacagaaug

SEQ ID NO: 3828921 - RNA, 15 nt, Human
cauuuuggugagaaa

SEQ ID NO: 3828922 - RNA, 20 nt, Human
cauuuuguauaauuguaucg

SEQ ID NO: 3828923 - RNA, 15 nt, Human
cauuuugugaagccc

SEQ ID NO: 3828924 - RNA, 13 nt, Human
cauuuugugaaug

SEQ ID NO: 3828925 - RNA, 18 nt, Human
cauuuuguguugaagagc

SEQ ID NO: 3828926 - RNA, 21 nt, Human
cauuuuguguugaagagcagc

SEQ ID NO: 3828927 - RNA, 15 nt, Human
cauuuuguucuuaca

SEQ ID NO: 3828928 - RNA, 18 nt, Human
cauuuuguucuuacacau

SEQ ID NO: 3828929 - RNA, 21 nt, Human
cauuuuguucuuacacauaca

SEQ ID NO: 3828930 - RNA, 14 nt, Human
cauuuuguuguaaa

SEQ ID NO: 3828931 - RNA, 20 nt, Human
cauuuuguuguaaaaagaaa

SEQ ID NO: 3828932 - RNA, 23 nt, Human
cauuuuguuguaaaaagaaaaac

SEQ ID NO: 3828933 - RNA, 22 nt, Human
cauuuuguuugguauuguauuu

SEQ ID NO: 3828934 - RNA, 13 nt, Human
cauuuuuaaaugu

SEQ ID NO: 3828935 - RNA, 15 nt, Human
ccuuugcagggcagc

SEQ ID NO: 3828936 - RNA, 17 nt, Human
ccuuugcagggcagccc

SEQ ID NO: 3828937 - RNA, 18 nt, Human
ccuuugcagggcagcccc

SEQ ID NO: 3828938 - RNA, 16 nt, Human
ccuuugcccagaaaga

SEQ ID NO: 3828939 - RNA, 16 nt, Human
ccuuugcgccugugac

SEQ ID NO: 3828940 - RNA, 23 nt, Human
ccuuugcgcuccuggcccagccu

SEQ ID NO: 3828941 - RNA, 14 nt, Human
ccuuugcucuugca

SEQ ID NO: 3828942 - RNA, 13 nt, Human
ccuuugcucuuuc

SEQ ID NO: 3828943 - RNA, 14 nt, Human
ccuuugcugacccu

SEQ ID NO: 3828944 - RNA, 21 nt, Human
ccuuugcugacccuccccaaa

SEQ ID NO: 3828945 - RNA, 16 nt, Human
ccuuugcugcauggca

SEQ ID NO: 3828946 - RNA, 21 nt, Human
ccuuuggaaagcucugaccac

SEQ ID NO: 3828947 - RNA, 15 nt, Human
ccuuuggcagaguuc

SEQ ID NO: 3828948 - RNA, 19 nt, Human
ccuuuggcaggugcagccc

SEQ ID NO: 3828949 - RNA, 15 nt, Human
ccuuuggccauucca

SEQ ID NO: 3828950 - RNA, 12 nt, Human
ccuuuggcucug

SEQ ID NO: 3828951 - RNA, 15 nt, Human
ccuuuggcucuggag

SEQ ID NO: 3828952 - RNA, 14 nt, Human
ccuuugggagcagg

SEQ ID NO: 3828953 - RNA, 19 nt, Human
ccuuugggaggcugaggcg

SEQ ID NO: 3828954 - RNA, 22 nt, Human
ccuuugggcuucagcugccagu

SEQ ID NO: 3828955 - RNA, 11 nt, Human
ccuuugggggu

SEQ ID NO: 3828956 - RNA, 21 nt, Human
ccuuugggugcuguuuugcca

SEQ ID NO: 3828957 - RNA, 16 nt, Human
ccuuugguuuuuuucu

SEQ ID NO: 3828958 - RNA, 12 nt, Human
ccuuuguaaguu

SEQ ID NO: 3828959 - RNA, 16 nt, Human
ccuuuguacagcccag

SEQ ID NO: 3828960 - RNA, 17 nt, Human
ccuuuguacagcccaga

SEQ ID NO: 3828961 - RNA, 20 nt, Human
ccuuuguauucucuccugua

SEQ ID NO: 3828962 - RNA, 14 nt, Human
ccuuuguauucugu

SEQ ID NO: 3828963 - RNA, 19 nt, Human
ccuuugucaucauuguaua

SEQ ID NO: 3828964 - RNA, 16 nt, Human
ccuuuguccccaccgc

SEQ ID NO: 3828965 - RNA, 22 nt, Human
ccuuuguccccaccgcagacag

SEQ ID NO: 3828966 - RNA, 23 nt, Human
ccuuuguccccaccgcagacagg

SEQ ID NO: 3828967 - RNA, 13 nt, Human
ccuuuguccuccu

SEQ ID NO: 3828968 - RNA, 14 nt, Human
ccuuugucuuguca

SEQ ID NO: 3828969 - RNA, 16 nt, Human
ccuuugugagucaaua

SEQ ID NO: 3828970 - RNA, 14 nt, Human
ccuuugugcccuau

SEQ ID NO: 3828971 - RNA, 12 nt, Human
ccuuugugcugu

SEQ ID NO: 3828972 - RNA, 20 nt, Human
ccuuugugugcucuccauuc

SEQ ID NO: 3828973 - RNA, 15 nt, Human
ccuuuguucccggcu

SEQ ID NO: 3828974 - RNA, 13 nt, Human
ccuuuguucuggg

SEQ ID NO: 3828975 - RNA, 15 nt, Human
ccuuuguucuggggg

SEQ ID NO: 3828976 - RNA, 16 nt, Human
ccaaauugugcuucuc

SEQ ID NO: 3828977 - RNA, 18 nt, Human
ccaaauuuaagacucucg

SEQ ID NO: 3828978 - RNA, 14 nt, Human
ccaaauuuaucaaa

SEQ ID NO: 3828979 - RNA, 23 nt, Human
ccaaauuucauaccuaucaucuu

SEQ ID NO: 3828980 - RNA, 23 nt, Human
ccaaauuuuaauuuuugcuuuua

SEQ ID NO: 3828981 - RNA, 21 nt, Human
ccaaauuuuggccaaaguguu

SEQ ID NO: 3828982 - RNA, 12 nt, Human
ccaacaaaccau

SEQ ID NO: 3828983 - RNA, 19 nt, Human
ccaacaaagaacacuaacu

SEQ ID NO: 3828984 - RNA, 13 nt, Human
ccaacaaagcugu

SEQ ID NO: 3828985 - RNA, 21 nt, Human
ccaacaaaggguuuuaaugua

SEQ ID NO: 3828986 - RNA, 22 nt, Human
ccaacaaaggguuuuaauguag

SEQ ID NO: 3828987 - RNA, 21 nt, Human
ccaacaagaagggacugagag

SEQ ID NO: 3828988 - RNA, 15 nt, Human
ccaacaagaaugcau

SEQ ID NO: 3828989 - RNA, 16 nt, Human
ccaacaagaaugcauu

SEQ ID NO: 3828990 - RNA, 14 nt, Human
ccaacaagcagcug

SEQ ID NO: 3828991 - RNA, 18 nt, Human
ccaacaagccagaaucag

SEQ ID NO: 3828992 - RNA, 15 nt, Human
ccaacaagggcagug

SEQ ID NO: 3828993 - RNA, 15 nt, Human
ccaacaccacagaaa

SEQ ID NO: 3828994 - RNA, 17 nt, Human
ccaacaccacagacaca

SEQ ID NO: 3828995 - RNA, 18 nt, Human
ccaacaccacagacacac

SEQ ID NO: 3828996 - RNA, 13 nt, Human
ccaacaccagccc

SEQ ID NO: 3828997 - RNA, 15 nt, Human
ccaacaccagccccu

SEQ ID NO: 3828998 - RNA, 18 nt, Human
ccaacaccaucacagcuu

SEQ ID NO: 3828999 - RNA, 21 nt, Human
ccaacaccaucacagcuuguu

SEQ ID NO: 3829000 - RNA, 20 nt, Human
ccaacacccugucuaaaaaa

SEQ ID NO: 3829001 - RNA, 14 nt, Human
ccaacacgagcagg

SEQ ID NO: 3829002 - RNA, 17 nt, Human
ccaacacgcaccugccu

SEQ ID NO: 3829003 - RNA, 20 nt, Human
ccaacacgcaccugccucag

SEQ ID NO: 3829004 - RNA, 13 nt, Human
ccaacacgcagga

SEQ ID NO: 3829005 - RNA, 13 nt, Human
ccaacacugccag

SEQ ID NO: 3829006 - RNA, 16 nt, Human
ccaacacugccagcau

SEQ ID NO: 3829007 - RNA, 23 nt, Human
ccaacagcgacauagcccauccc

SEQ ID NO: 3829008 - RNA, 18 nt, Human
ccaacagcuacaacagcc

SEQ ID NO: 3829009 - RNA, 18 nt, Human
ccaacagcuggacccuga

SEQ ID NO: 3829010 - RNA, 20 nt, Human
ccaacaggaggacaauucau

SEQ ID NO: 3829011 - RNA, 17 nt, Human
ccaacaggggcuccaug

SEQ ID NO: 3829012 - RNA, 20 nt, Human
ccaacagguagcauagcucu

SEQ ID NO: 3829013 - RNA, 19 nt, Human
ccaacagguggcaggacca

SEQ ID NO: 3829014 - RNA, 16 nt, Human
ccaacagugugaaguu

SEQ ID NO: 3829015 - RNA, 19 nt, Human
ccaacauacucccaucugu

SEQ ID NO: 3829016 - RNA, 21 nt, Human
ccaacauacucccaucuguga

SEQ ID NO: 3829017 - RNA, 22 nt, Human
ccaacauacucccaucugugaa

SEQ ID NO: 3829018 - RNA, 13 nt, Human
ccaacauauaaaa

SEQ ID NO: 3829019 - RNA, 13 nt, Human
ccaacaucaacau

SEQ ID NO: 3829020 - RNA, 13 nt, Human
ccaacauccacuc

SEQ ID NO: 3829021 - RNA, 14 nt, Human
ccaacauccacucu

SEQ ID NO: 3829022 - RNA, 17 nt, Human
ccaacauccacucucuc

SEQ ID NO: 3829023 - RNA, 18 nt, Human
ccaacaucuacaaaacau

SEQ ID NO: 3829024 - RNA, 22 nt, Human
ccaacauggagaaacccugucu

SEQ ID NO: 3829025 - RNA, 23 nt, Human
ccaaccaacuugguucugcuuca

SEQ ID NO: 3829026 - RNA, 20 nt, Human
ccaaccaaguggcucccaca

SEQ ID NO: 3829027 - RNA, 17 nt, Human
ccaaccagugccaagga

SEQ ID NO: 3829028 - RNA, 13 nt, Human
ccaaccauuuccu

SEQ ID NO: 3829029 - RNA, 17 nt, Human
ccaaccauuuccucaga

SEQ ID NO: 3829030 - RNA, 17 nt, Human
ccaacccaaaccuggag

SEQ ID NO: 3829031 - RNA, 12 nt, Human
ccaacccagccg

SEQ ID NO: 3829032 - RNA, 21 nt, Human
ccaacccagccgcugcccggc

SEQ ID NO: 3829033 - RNA, 14 nt, Human
ccaaccccaacucc

SEQ ID NO: 3829034 - RNA, 13 nt, Human
ccaacccccaccc

SEQ ID NO: 3829035 - RNA, 17 nt, Human
ccaaccccucgcccagu

SEQ ID NO: 3829036 - RNA, 18 nt, Human
ccaaccccucgcccaguc

SEQ ID NO: 3829037 - RNA, 18 nt, Human
ccaaccccugaggaagau

SEQ ID NO: 3829038 - RNA, 22 nt, Human
ccaacccuagguucccuguucu

SEQ ID NO: 3829039 - RNA, 23 nt, Human
ccaacccuaucuccugacagaag

SEQ ID NO: 3829040 - RNA, 14 nt, Human
ccaacccucagggc

SEQ ID NO: 3829041 - RNA, 15 nt, Human
ccaacccugccccug

SEQ ID NO: 3829042 - RNA, 16 nt, Human
ccaacccugccccugc

SEQ ID NO: 3829043 - RNA, 17 nt, Human
ccaacccuggcuugggg

SEQ ID NO: 3829044 - RNA, 13 nt, Human
ccaacccugucug

SEQ ID NO: 3829045 - RNA, 14 nt, Human
ccaacccugucugu

SEQ ID NO: 3829046 - RNA, 16 nt, Human
ccaacccuguuuccug

SEQ ID NO: 3829047 - RNA, 14 nt, Human
ccaacccuucuuca

SEQ ID NO: 3829048 - RNA, 13 nt, Human
ccaaccgacaggc

SEQ ID NO: 3829049 - RNA, 16 nt, Human
ccaaccgugucugucu

SEQ ID NO: 3829050 - RNA, 18 nt, Human
ccaaccuaaccccuuucc

SEQ ID NO: 3829051 - RNA, 14 nt, Human
ccaaccuaaccugu

SEQ ID NO: 3829052 - RNA, 17 nt, Human
ccaaccuaaccuguguc

SEQ ID NO: 3829053 - RNA, 21 nt, Human
ccaaccuauuuugaaguacca

SEQ ID NO: 3829054 - RNA, 11 nt, Human
ccaaccucagc

SEQ ID NO: 3829055 - RNA, 14 nt, Human
ccaaccucagggcu

SEQ ID NO: 3829056 - RNA, 13 nt, Human
ccaaccucuggag

SEQ ID NO: 3829057 - RNA, 14 nt, Human
ccaaccucuggagc

SEQ ID NO: 3829058 - RNA, 15 nt, Human
ccaaccucuuccucc

SEQ ID NO: 3829059 - RNA, 17 nt, Human
ccaaccugcucuccucu

SEQ ID NO: 3829060 - RNA, 18 nt, Human
ccaaccugcucuccucuu

SEQ ID NO: 3829061 - RNA, 14 nt, Human
ccaaccuggggggc

SEQ ID NO: 3829062 - RNA, 21 nt, Human
ccaacggagagcgccugcccc

SEQ ID NO: 3829063 - RNA, 15 nt, Human
ccaacggccccagcu

SEQ ID NO: 3829064 - RNA, 20 nt, Human
ccaacggcccugcagccagc

SEQ ID NO: 3829065 - RNA, 13 nt, Human
ccaacgucugugc

SEQ ID NO: 3829066 - RNA, 16 nt, Human
ccaacgucugugccau

SEQ ID NO: 3829067 - RNA, 15 nt, Human
ccaacguggggcagc

SEQ ID NO: 3829068 - RNA, 19 nt, Human
ccaacuaaugccuuacucu

SEQ ID NO: 3829069 - RNA, 16 nt, Human
ccaacuacaaccaagc

SEQ ID NO: 3829070 - RNA, 17 nt, Human
ccaacuacuaucucaga

SEQ ID NO: 3829071 - RNA, 17 nt, Human
ccaacuagacauucugu

SEQ ID NO: 3829072 - RNA, 16 nt, Human
ccaacuauuuauugac

SEQ ID NO: 3829073 - RNA, 16 nt, Human
ccaacucaccccagcc

SEQ ID NO: 3829074 - RNA, 16 nt, Human
ccaacuccaacaucca

SEQ ID NO: 3829075 - RNA, 21 nt, Human
ccaacuccagaaagugacaag

SEQ ID NO: 3829076 - RNA, 12 nt, Human
ccaacuccagga

SEQ ID NO: 3829077 - RNA, 22 nt, Human
ccaacuccgugugguaagcaac

SEQ ID NO: 3829078 - RNA, 20 nt, Human
ccaacuccugauucauguug

SEQ ID NO: 3829079 - RNA, 22 nt, Human
ccaacuccuggaagcugugucc

SEQ ID NO: 3829080 - RNA, 12 nt, Human
ccaacuccuucc

SEQ ID NO: 3829081 - RNA, 14 nt, Human
ccaacuccuuccag

SEQ ID NO: 3829082 - RNA, 15 nt, Human
ccaacucgggcuccc

SEQ ID NO: 3829083 - RNA, 14 nt, Human
ccaacucuagcugg

SEQ ID NO: 3829084 - RNA, 14 nt, Human
ccaacucugagccc

SEQ ID NO: 3829085 - RNA, 16 nt, Human
ccaacucugagcccau

SEQ ID NO: 3829086 - RNA, 12 nt, Human
ccaacugaaggc

SEQ ID NO: 3829087 - RNA, 12 nt, Human
ccaacugcugcu

SEQ ID NO: 3829088 - RNA, 16 nt, Human
ccaacuggaagcacag

SEQ ID NO: 3829089 - RNA, 16 nt, Human
ccaacugggcccaaga

SEQ ID NO: 3829090 - RNA, 20 nt, Human
ccaacuguguuguauuaaca

SEQ ID NO: 3829091 - RNA, 20 nt, Human
ccaacuucucuugcuuucua

SEQ ID NO: 3829092 - RNA, 13 nt, Human
ccaacuugccuuu

SEQ ID NO: 3829093 - RNA, 17 nt, Human
ccaacuuguaaauacac

SEQ ID NO: 3829094 - RNA, 23 nt, Human
ccaacuuguauuaaagacagagg

SEQ ID NO: 3829095 - RNA, 22 nt, Human
ccaacuuuguggaugucuuccu

SEQ ID NO: 3829096 - RNA, 14 nt, Human
ccaacuuuucuauu

SEQ ID NO: 3829097 - RNA, 22 nt, Human
ccaagaaagaugaauacauuuu

SEQ ID NO: 3829098 - RNA, 22 nt, Human
ccaagaaagauguauauaggug

SEQ ID NO: 3829099 - RNA, 18 nt, Human
ccaagaaaggaaaccuuu

SEQ ID NO: 3829100 - RNA, 13 nt, Human
ccaagaacugaaa

SEQ ID NO: 3829101 - RNA, 17 nt, Human
ccaagaacugaaaacau

SEQ ID NO: 3829102 - RNA, 21 nt, Human
ccaagaacugaaaacauaaaa

SEQ ID NO: 3829103 - RNA, 14 nt, Human
ccaagaagcccagg

SEQ ID NO: 3829104 - RNA, 20 nt, Human
ccaagaagcccaggaaaggc

SEQ ID NO: 3829105 - RNA, 14 nt, Human
ccaagaaggcuggg

SEQ ID NO: 3829106 - RNA, 13 nt, Human
ccaagaagggcua

SEQ ID NO: 3829107 - RNA, 22 nt, Human
ccaagaagggcuagaaccugga

SEQ ID NO: 3829108 - RNA, 14 nt, Human
cggcccgccucucc

SEQ ID NO: 3829109 - RNA, 16 nt, Human
cggcccguggcuguug

SEQ ID NO: 3829110 - RNA, 12 nt, Human
cggcccuaaggg

SEQ ID NO: 3829111 - RNA, 20 nt, Human
cggcccuaccagcgcccgcu

SEQ ID NO: 3829112 - RNA, 18 nt, Human
cggcccuagcccagcgcu

SEQ ID NO: 3829113 - RNA, 16 nt, Human
cggcccuccagagccc

SEQ ID NO: 3829114 - RNA, 22 nt, Human
cggcccuccuacccugcgccca

SEQ ID NO: 3829115 - RNA, 12 nt, Human
cggcccuggggc

SEQ ID NO: 3829116 - RNA, 15 nt, Human
cggcccugugugcag

SEQ ID NO: 3829117 - RNA, 13 nt, Human
cggccgcauuccc

SEQ ID NO: 3829118 - RNA, 13 nt, Human
cggccgcuccagg

SEQ ID NO: 3829119 - RNA, 14 nt, Human
cggccgcuccaggg

SEQ ID NO: 3829120 - RNA, 16 nt, Human
cggccggccagccccu

SEQ ID NO: 3829121 - RNA, 12 nt, Human
cggccuccaucc

SEQ ID NO: 3829122 - RNA, 17 nt, Human
ccacauuggaagagcag

SEQ ID NO: 3829123 - RNA, 14 nt, Human
ccacauuguuuuaa

SEQ ID NO: 3829124 - RNA, 16 nt, Human
ccacauuguuuuaaaa

SEQ ID NO: 3829125 - RNA, 19 nt, Human
ccacauuuagucucuuuau

SEQ ID NO: 3829126 - RNA, 22 nt, Human
ccacauuuggaauacuuuuugu

SEQ ID NO: 3829127 - RNA, 23 nt, Human
ccacauuugguucuaagaaaccc

SEQ ID NO: 3829128 - RNA, 17 nt, Human
ccacauuugugccgaca

SEQ ID NO: 3829129 - RNA, 16 nt, Human
ccacauuuuauauuua

SEQ ID NO: 3829130 - RNA, 16 nt, Human
ccacauuuucagccaa

SEQ ID NO: 3829131 - RNA, 13 nt, Human
ccaccaaagcugc

SEQ ID NO: 3829132 - RNA, 21 nt, Human
ccaccaaagcugcccacuguu

SEQ ID NO: 3829133 - RNA, 21 nt, Human
ccaccaacccaucagaaggag

SEQ ID NO: 3829134 - RNA, 14 nt, Human
ccaccaacucuugc

SEQ ID NO: 3829135 - RNA, 16 nt, Human
ccaccaacuggcccuc

SEQ ID NO: 3829136 - RNA, 21 nt, Human
ccaccaagccuggucagccca

SEQ ID NO: 3829137 - RNA, 22 nt, Human
ccaccaagccuggucagcccaa

SEQ ID NO: 3829138 - RNA, 13 nt, Human
ccaccaagccuug

SEQ ID NO: 3829139 - RNA, 17 nt, Human
ccaccacacccagccca

SEQ ID NO: 3829140 - RNA, 15 nt, Human
ccaccacaccuggcu

SEQ ID NO: 3829141 - RNA, 20 nt, Human
ccaccacaguccccagagug

SEQ ID NO: 3829142 - RNA, 15 nt, Human
ccaccaccacuggcc

SEQ ID NO: 3829143 - RNA, 16 nt, Human
ccaccaccacuggcca

SEQ ID NO: 3829144 - RNA, 12 nt, Human
ccaccaccuagg

SEQ ID NO: 3829145 - RNA, 18 nt, Human
ccaccaccuaggccacuc

SEQ ID NO: 3829146 - RNA, 15 nt, Human
ccaccaccucugugg

SEQ ID NO: 3829147 - RNA, 15 nt, Human
ccaccacgcccggcu

SEQ ID NO: 3829148 - RNA, 19 nt, Human
ccaccacggccacuggcca

SEQ ID NO: 3829149 - RNA, 20 nt, Human
ccaccacuaggacucugagg

SEQ ID NO: 3829150 - RNA, 13 nt, Human
ccaccacuauaaa

SEQ ID NO: 3829151 - RNA, 15 nt, Human
ccaccacuggccacc

SEQ ID NO: 3829152 - RNA, 21 nt, Human
ccaccacuggccaccaggcug

SEQ ID NO: 3829153 - RNA, 14 nt, Human
ccaccagaagccca

SEQ ID NO: 3829154 - RNA, 21 nt, Human
ccaccagagaccguccucacc

SEQ ID NO: 3829155 - RNA, 12 nt, Human
ccaccagagcug

SEQ ID NO: 3829156 - RNA, 18 nt, Human
ccaccagauagcagaggg

SEQ ID NO: 3829157 - RNA, 12 nt, Human
ccaccagaugcu

SEQ ID NO: 3829158 - RNA, 11 nt, Human
ccaccagccug

SEQ ID NO: 3829159 - RNA, 14 nt, Human
ccaccagccugcac

SEQ ID NO: 3829160 - RNA, 14 nt, Human
ccaccaggaaccuc

SEQ ID NO: 3829161 - RNA, 14 nt, Human
ccaccaggaucagc

SEQ ID NO: 3829162 - RNA, 18 nt, Human
ccaccaggaucccagggg

SEQ ID NO: 3829163 - RNA, 21 nt, Human
ccaccaggccaccuccccagc

SEQ ID NO: 3829164 - RNA, 22 nt, Human
ccaccaggcugcucagggcugg

SEQ ID NO: 3829165 - RNA, 20 nt, Human
ccaccaggcuggcgcagcca

SEQ ID NO: 3829166 - RNA, 18 nt, Human
ccaccaggucucccggga

SEQ ID NO: 3829167 - RNA, 14 nt, Human
ccaccagucacugu

SEQ ID NO: 3829168 - RNA, 14 nt, Human
ccaccagucauuuu

SEQ ID NO: 3829169 - RNA, 18 nt, Human
ccaccagucugacuguuu

SEQ ID NO: 3829170 - RNA, 15 nt, Human
cuaaauuuaaugcug

SEQ ID NO: 3829171 - RNA, 16 nt, Human
cuaaauuuaaugcugc

SEQ ID NO: 3829172 - RNA, 16 nt, Human
cuaaauuuauuaaaua

SEQ ID NO: 3829173 - RNA, 17 nt, Human
cuaaauuuauuaaauaa

SEQ ID NO: 3829174 - RNA, 19 nt, Human
cuaaauuugauacuuauau

SEQ ID NO: 3829175 - RNA, 20 nt, Human
cuaaauuuggggacagauuc

SEQ ID NO: 3829176 - RNA, 23 nt, Human
cuaaauuuggggacagauucagu

SEQ ID NO: 3829177 - RNA, 16 nt, Human
cuaaauuuuccugucc

SEQ ID NO: 3829178 - RNA, 22 nt, Human
cuaacaagucauagguuaauau

SEQ ID NO: 3829179 - RNA, 22 nt, Human
cuaacaaucagcuccuuccugg

SEQ ID NO: 3829180 - RNA, 15 nt, Human
cuaacaaugacauuu

SEQ ID NO: 3829181 - RNA, 13 nt, Human
cuaacacaaggac

SEQ ID NO: 3829182 - RNA, 17 nt, Human
cuaacacacacagaaaa

SEQ ID NO: 3829183 - RNA, 17 nt, Human
cuaacacagcaugugua

SEQ ID NO: 3829184 - RNA, 15 nt, Human
cuaacaccagacaga

SEQ ID NO: 3829185 - RNA, 23 nt, Human
cuaacacggugcucauuuuuucu

SEQ ID NO: 3829186 - RNA, 18 nt, Human
cuaacacgugaugugaua

SEQ ID NO: 3829187 - RNA, 16 nt, Human
cuaacacuauuuuaug

SEQ ID NO: 3829188 - RNA, 22 nt, Human
cuaacacucagaagccuggggg

SEQ ID NO: 3829189 - RNA, 23 nt, Human
cuaacacucagaagccugggggc

SEQ ID NO: 3829190 - RNA, 17 nt, Human
cuaacacuggccccuag

SEQ ID NO: 3829191 - RNA, 17 nt, Human
cuaacagauaagcaaga

SEQ ID NO: 3829192 - RNA, 18 nt, Human
cuaacagauaagcaagag

SEQ ID NO: 3829193 - RNA, 20 nt, Human
cuaacagcaacacaaagcuu

SEQ ID NO: 3829194 - RNA, 21 nt, Human
cuaacagcaguuucagguaga

SEQ ID NO: 3829195 - RNA, 21 nt, Human
cuaacagcccuccucugcacu

SEQ ID NO: 3829196 - RNA, 22 nt, Human
cuaacagcccuccucugcacuc

SEQ ID NO: 3829197 - RNA, 17 nt, Human
cuaacagggaaggcagg

SEQ ID NO: 3829198 - RNA, 21 nt, Human
cuaacagggaaggcaggcagg

SEQ ID NO: 3829199 - RNA, 20 nt, Human
cuaacagugaaguuuuacug

SEQ ID NO: 3829200 - RNA, 19 nt, Human
cuaacaguucacuugcagu

SEQ ID NO: 3829201 - RNA, 16 nt, Human
cuaacaugaagaccuu

SEQ ID NO: 3829202 - RNA, 15 nt, Human
cuaacauggaaguac

SEQ ID NO: 3829203 - RNA, 12 nt, Human
cuaacauuauau

SEQ ID NO: 3829204 - RNA, 16 nt, Human
cuaacauuauauugca

SEQ ID NO: 3829205 - RNA, 14 nt, Human
cuaaccaaaugcau

SEQ ID NO: 3829206 - RNA, 14 nt, Human
cuaaccacagcucc

SEQ ID NO: 3829207 - RNA, 15 nt, Human
cuaaccacagcuccu

SEQ ID NO: 3829208 - RNA, 21 nt, Human
cuaaccacgucugucuucaca

SEQ ID NO: 3829209 - RNA, 18 nt, Human
cuaaccagagcaagcuuu

SEQ ID NO: 3829210 - RNA, 18 nt, Human
cuaaccauguguuauguu

SEQ ID NO: 3829211 - RNA, 19 nt, Human
cuaacccagguauccaaaa

SEQ ID NO: 3829212 - RNA, 18 nt, Human
cuaaccccaacgcacagg

SEQ ID NO: 3829213 - RNA, 16 nt, Human
cuaaccccaggccccg

SEQ ID NO: 3829214 - RNA, 16 nt, Human
cuaaccccgggcgggu

SEQ ID NO: 3829215 - RNA, 19 nt, Human
cuaaccccuuccagaucac

SEQ ID NO: 3829216 - RNA, 14 nt, Human
cuaaccccuuuccu

SEQ ID NO: 3829217 - RNA, 14 nt, Human
cuaaccuaagcaaa

SEQ ID NO: 3829218 - RNA, 22 nt, Human
cuaaccuaagcaaaaccacuga

SEQ ID NO: 3829219 - RNA, 22 nt, Human
cuaaccucaagugauccuccca

SEQ ID NO: 3829220 - RNA, 12 nt, Human
cuaaccucaucu

SEQ ID NO: 3829221 - RNA, 12 nt, Human
cuaaccuccuuu

SEQ ID NO: 3829222 - RNA, 13 nt, Human
cuaaccuccuuua

SEQ ID NO: 3829223 - RNA, 17 nt, Human
cuaaccucgggccugcu

SEQ ID NO: 3829224 - RNA, 19 nt, Human
cuaaccucuuuucugcauc

SEQ ID NO: 3829225 - RNA, 12 nt, Human
cuaaccugccga

SEQ ID NO: 3829226 - RNA, 14 nt, Human
cuaaccugugucug

SEQ ID NO: 3829227 - RNA, 16 nt, Human
cuaaccuugaaugcug

SEQ ID NO: 3829228 - RNA, 21 nt, Human
cuaaccuugaaugcugccagu

SEQ ID NO: 3829229 - RNA, 20 nt, Human
cuaaccuugccugguacagu

SEQ ID NO: 3829230 - RNA, 21 nt, Human
cuaaccuuuacaugaggacuc

SEQ ID NO: 3829231 - RNA, 17 nt, Human
cuaacgccugagcccag

SEQ ID NO: 3829232 - RNA, 18 nt, Human
cuaacgccugagcccagg

SEQ ID NO: 3829233 - RNA, 22 nt, Human
cuaacggucuguucuguuucaa

SEQ ID NO: 3829234 - RNA, 19 nt, Human
cuaacuaaacucucuuugg

SEQ ID NO: 3829235 - RNA, 19 nt, Human
cuaacuacaaagguuuaaa

SEQ ID NO: 3829236 - RNA, 21 nt, Human
cuaacuagacaccaaaguucu

SEQ ID NO: 3829237 - RNA, 20 nt, Human
cuaacuagagcagcccugga

SEQ ID NO: 3829238 - RNA, 16 nt, Human
cuaacucaaauacaca

SEQ ID NO: 3829239 - RNA, 21 nt, Human
cuaacucaccagccccacugc

SEQ ID NO: 3829240 - RNA, 19 nt, Human
cuaacucagaaacaucagu

SEQ ID NO: 3829241 - RNA, 17 nt, Human
cuaacucagaauuauuu

SEQ ID NO: 3829242 - RNA, 16 nt, Human
cuaacucugauguaaa

SEQ ID NO: 3829243 - RNA, 17 nt, Human
cuaacugaacuuugaag

SEQ ID NO: 3829244 - RNA, 14 nt, Human
cuaacuguaaauca

SEQ ID NO: 3829245 - RNA, 17 nt, Human
cuaacuguaaaucaugu

SEQ ID NO: 3829246 - RNA, 18 nt, Human
cuaacuuaagaaauaaau

SEQ ID NO: 3829247 - RNA, 16 nt, Human
cuaacuucaccauauu

SEQ ID NO: 3829248 - RNA, 16 nt, Human
cuaacuucuaaaacug

SEQ ID NO: 3829249 - RNA, 17 nt, Human
cuaacuucuaaaacugu

SEQ ID NO: 3829250 - RNA, 17 nt, Human
cuaacuugcuuaaaugu

SEQ ID NO: 3829251 - RNA, 19 nt, Human
cuaacuugcuuaaauguga

SEQ ID NO: 3829252 - RNA, 13 nt, Human
cuaacuuggguua

SEQ ID NO: 3829253 - RNA, 22 nt, Human
cuaagaaaagauacgacuuuau

SEQ ID NO: 3829254 - RNA, 17 nt, Human
cuaagaaaagccuaauc

SEQ ID NO: 3829255 - RNA, 14 nt, Human
cuaagaaacauugg

SEQ ID NO: 3829256 - RNA, 18 nt, Human
cuaagaaacauuggaagc

SEQ ID NO: 3829257 - RNA, 19 nt, Human
cuaagaaacauuuauauug

SEQ ID NO: 3829258 - RNA, 17 nt, Human
cuaagaaacuuuuguaa

SEQ ID NO: 3829259 - RNA, 18 nt, Human
cuaagaaacuuuuguaaa

SEQ ID NO: 3829260 - RNA, 19 nt, Human
cuaagaaauaucugugaaa

SEQ ID NO: 3829261 - RNA, 16 nt, Human
cuaagaaauaugugag

SEQ ID NO: 3829262 - RNA, 21 nt, Human
cuaagaaauaugugagauuuu

SEQ ID NO: 3829263 - RNA, 16 nt, Human
cuaagaaauugaauac

SEQ ID NO: 3829264 - RNA, 16 nt, Human
cuaagaaccuggaacu

SEQ ID NO: 3829265 - RNA, 14 nt, Human
cuaagaagcuucua

SEQ ID NO: 3829266 - RNA, 17 nt, Human
cuaagaagcuucuaaua

SEQ ID NO: 3829267 - RNA, 20 nt, Human
cuacucaaguagcauuuacu

SEQ ID NO: 3829268 - RNA, 13 nt, Human
cuacucacacagg

SEQ ID NO: 3829269 - RNA, 14 nt, Human
cuacucacacaggc

SEQ ID NO: 3829270 - RNA, 22 nt, Human
cuacucacacaggcauuuccug

SEQ ID NO: 3829271 - RNA, 18 nt, Human
cuacucacagucucuuua

SEQ ID NO: 3829272 - RNA, 23 nt, Human
cuacucaccuugaacaccacgcu

SEQ ID NO: 3829273 - RNA, 16 nt, Human
cuacucacucaaguuc

SEQ ID NO: 3829274 - RNA, 22 nt, Human
cuacucacucaaguucaaggac

SEQ ID NO: 3829275 - RNA, 13 nt, Human
cuacucagaagcc

SEQ ID NO: 3829276 - RNA, 17 nt, Human
cuacucagaagccugag

SEQ ID NO: 3829277 - RNA, 19 nt, Human
cuacucagaagccugaggc

SEQ ID NO: 3829278 - RNA, 16 nt, Human
cuacucagcagcccuc

SEQ ID NO: 3829279 - RNA, 16 nt, Human
cuacucaggaggcuga

SEQ ID NO: 3829280 - RNA, 20 nt, Human
cuacucauacuuaagcaaaa

SEQ ID NO: 3829281 - RNA, 16 nt, Human
cuacucauuccccggg

SEQ ID NO: 3829282 - RNA, 16 nt, Human
cuacuccggagacagg

SEQ ID NO: 3829283 - RNA, 15 nt, Human
cuacuccuaccucag

SEQ ID NO: 3829284 - RNA, 16 nt, Human
cuacuccuaccucagc

SEQ ID NO: 3829285 - RNA, 12 nt, Human
cuacuccugacu

SEQ ID NO: 3829286 - RNA, 16 nt, Human
cuacuccugucuucug

SEQ ID NO: 3829287 - RNA, 15 nt, Human
cuacucgaguuacag

SEQ ID NO: 3829288 - RNA, 19 nt, Human
cuacucgaguuacagacaa

SEQ ID NO: 3829289 - RNA, 20 nt, Human
cuacucgcuugcuagaagua

SEQ ID NO: 3829290 - RNA, 17 nt, Human
cuacucgggaggcugag

SEQ ID NO: 3829291 - RNA, 21 nt, Human
cuacucucacacugguucuca

SEQ ID NO: 3829292 - RNA, 23 nt, Human
cuacucuccccacgagggcuggc

SEQ ID NO: 3829293 - RNA, 22 nt, Human
cuacucuggagguuuguuuaga

SEQ ID NO: 3829294 - RNA, 18 nt, Human
cuacucugugccagagcc

SEQ ID NO: 3829295 - RNA, 16 nt, Human
cuacucuguuccuuca

SEQ ID NO: 3829296 - RNA, 22 nt, Human
cuacucuguuccuucacauccu

SEQ ID NO: 3829297 - RNA, 21 nt, Human
cuacucuuaaguuucucagcu

SEQ ID NO: 3829298 - RNA, 11 nt, Human
cuacucuucuc

SEQ ID NO: 3829299 - RNA, 17 nt, Human
cuacucuucucucugcu

SEQ ID NO: 3829300 - RNA, 18 nt, Human
cuacucuucucucugcuc

SEQ ID NO: 3829301 - RNA, 19 nt, Human
cuacucuucucucugcucu

SEQ ID NO: 3829302 - RNA, 12 nt, Human
cuacucuuugau

SEQ ID NO: 3829303 - RNA, 14 nt, Human
cuacucuuugauuu

SEQ ID NO: 3829304 - RNA, 20 nt, Human
cuacugaaacagauuucaua

SEQ ID NO: 3829305 - RNA, 19 nt, Human
cuacugacauaucuacacu

SEQ ID NO: 3829306 - RNA, 22 nt, Human
cuacugacggaguccuguguuu

SEQ ID NO: 3829307 - RNA, 17 nt, Human
cuacugacuuucucagc

SEQ ID NO: 3829308 - RNA, 20 nt, Human
cuacugaggauauggacacu

SEQ ID NO: 3829309 - RNA, 14 nt, Human
cuacugauuccgca

SEQ ID NO: 3829310 - RNA, 16 nt, Human
cuacugauuuccuuug

SEQ ID NO: 3829311 - RNA, 14 nt, Human
cuacugcaccauuu

SEQ ID NO: 3829312 - RNA, 18 nt, Human
cuacugcacuccagccug

SEQ ID NO: 3829313 - RNA, 21 nt, Human
cuacugcacuccagccugggg

SEQ ID NO: 3829314 - RNA, 13 nt, Human
cuacugcagcacc

SEQ ID NO: 3829315 - RNA, 19 nt, Human
cuacugcagcaccuccagg

SEQ ID NO: 3829316 - RNA, 22 nt, Human
cuacugcagcaccuccaggccu

SEQ ID NO: 3829317 - RNA, 17 nt, Human
cuacugcagcuuuacau

SEQ ID NO: 3829318 - RNA, 16 nt, Human
cuacugcauuuaggga

SEQ ID NO: 3829319 - RNA, 17 nt, Human
cuacugcauuuagggag

SEQ ID NO: 3829320 - RNA, 19 nt, Human
cuacugccaaccucgcucc

SEQ ID NO: 3829321 - RNA, 16 nt, Human
cuacugccauccuggc

SEQ ID NO: 3829322 - RNA, 18 nt, Human
cuacugccauccuggccc

SEQ ID NO: 3829323 - RNA, 19 nt, Human
cuacugccauccuggccca

SEQ ID NO: 3829324 - RNA, 20 nt, Human
cuacugccauccuggcccag

SEQ ID NO: 3829325 - RNA, 22 nt, Human
cuacugccauccuggcccaggg

SEQ ID NO: 3829326 - RNA, 11 nt, Human
cuacugccuuu

SEQ ID NO: 3829327 - RNA, 15 nt, Human
cuacugccuuuagaa

SEQ ID NO: 3829328 - RNA, 16 nt, Human
cuacugccuuuagaaa

SEQ ID NO: 3829329 - RNA, 20 nt, Human
cuacugcugugaacccuggg

SEQ ID NO: 3829330 - RNA, 12 nt, Human
cuacugcuucua

SEQ ID NO: 3829331 - RNA, 22 nt, Human
cuacugcuucuaccaacuggaa

SEQ ID NO: 3829332 - RNA, 21 nt, Human
cuacuggcagcugauacguuu

SEQ ID NO: 3829333 - RNA, 22 nt, Human
cuacuggggaaacuggccaugg

SEQ ID NO: 3829334 - RNA, 14 nt, Human
cuacugggugucau

SEQ ID NO: 3829335 - RNA, 22 nt, Human
cuacuguaauaaagaugauugu

SEQ ID NO: 3829336 - RNA, 16 nt, Human
cuacuguaauuuguga

SEQ ID NO: 3829337 - RNA, 17 nt, Human
cuacuguaauuugugau

SEQ ID NO: 3829338 - RNA, 13 nt, Human
cuacuguacauaa

SEQ ID NO: 3829339 - RNA, 20 nt, Human
cuacuguacauaaacaauga

SEQ ID NO: 3829340 - RNA, 17 nt, Human
cuacugucaaaugaugu

SEQ ID NO: 3829341 - RNA, 20 nt, Human
cuacuguccuacccacccuc

SEQ ID NO: 3829342 - RNA, 22 nt, Human
cuacugucuuuggaaaaauguu

SEQ ID NO: 3829343 - RNA, 14 nt, Human
cuacuguggaaaaa

SEQ ID NO: 3829344 - RNA, 20 nt, Human
cuacuguggaaaaauauuua

SEQ ID NO: 3829345 - RNA, 19 nt, Human
cuacugugugugugaauga

SEQ ID NO: 3829346 - RNA, 16 nt, Human
cuacuguguuaugcaa

SEQ ID NO: 3829347 - RNA, 12 nt, Human
cuacuguguucc

SEQ ID NO: 3829348 - RNA, 13 nt, Human
cuacuguguuccu

SEQ ID NO: 3829349 - RNA, 19 nt, Human
cuacuguguuccuggcaau

SEQ ID NO: 3829350 - RNA, 12 nt, Human
cuacuguucuaa

SEQ ID NO: 3829351 - RNA, 18 nt, Human
cuacuguucuaaagcucu

SEQ ID NO: 3829352 - RNA, 22 nt, Human
cuacuguucuaaagcucugaca

SEQ ID NO: 3829353 - RNA, 15 nt, Human
cuacuuaauuccuuu

SEQ ID NO: 3829354 - RNA, 17 nt, Human
cuacuuacccagguggg

SEQ ID NO: 3829355 - RNA, 22 nt, Human
cuacuuagcaugucccuaccga

SEQ ID NO: 3829356 - RNA, 22 nt, Human
cuacuuauuguagcauccugga

SEQ ID NO: 3829357 - RNA, 19 nt, Human
cuacuucaggaacaccccc

SEQ ID NO: 3829358 - RNA, 23 nt, Human
cuacuuccccauggcccugagcg

SEQ ID NO: 3829359 - RNA, 15 nt, Human
cuacuuccugcacug

SEQ ID NO: 3829360 - RNA, 19 nt, Human
cuacuucucucuguauuuu

SEQ ID NO: 3829361 - RNA, 22 nt, Human
cuacuucuuugcuuugcccagc

SEQ ID NO: 3829362 - RNA, 18 nt, Human
cuacuugauuuuauugua

SEQ ID NO: 3829363 - RNA, 19 nt, Human
cuacuugcucuggaccugc

SEQ ID NO: 3829364 - RNA, 18 nt, Human
cuacuugggaggcugaga

SEQ ID NO: 3829365 - RNA, 15 nt, Human
cuacuugguuugugu

SEQ ID NO: 3829366 - RNA, 21 nt, Human
cuacuuuaauaaaugguuauu

SEQ ID NO: 3829367 - RNA, 18 nt, Human
cuacuuuauaacuaacau

SEQ ID NO: 3829368 - RNA, 19 nt, Human
cuacuuuauaacuaacaug

SEQ ID NO: 3829369 - RNA, 18 nt, Human
cuacuuugacuuuuugca

SEQ ID NO: 3829370 - RNA, 20 nt, Human
cuacuuugacuuuuugcauu

SEQ ID NO: 3829371 - RNA, 20 nt, Human
cuacuuuguuaggauuuuca

SEQ ID NO: 3829372 - RNA, 18 nt, Human
cuacuuuugcaugaaaau

SEQ ID NO: 3829373 - RNA, 14 nt, Human
cuagaaaaacaggc

SEQ ID NO: 3829374 - RNA, 15 nt, Human
cuagaaaaacaggca

SEQ ID NO: 3829375 - RNA, 16 nt, Human
cuagaaaacauuuuuu

SEQ ID NO: 3829376 - RNA, 14 nt, Human
cuagaaacaacacu

SEQ ID NO: 3829377 - RNA, 18 nt, Human
cuagaaacaacacuguag

SEQ ID NO: 3829378 - RNA, 16 nt, Human
cuagaaacagaucuug

SEQ ID NO: 3829379 - RNA, 23 nt, Human
cguguguggguggauauaaauau

SEQ ID NO: 3829380 - RNA, 11 nt, Human
cgugugugugu

SEQ ID NO: 3829381 - RNA, 16 nt, Human
cguguguguugucuga

SEQ ID NO: 3829382 - RNA, 21 nt, Human
cguguguuuuucuauuaaaag

SEQ ID NO: 3829383 - RNA, 23 nt, Human
cguguguuuuucuauuaaaagac

SEQ ID NO: 3829384 - RNA, 19 nt, Human
cguguuaugacuccagaau

SEQ ID NO: 3829385 - RNA, 21 nt, Human
cguguuauuuuaaucucagaa

SEQ ID NO: 3829386 - RNA, 19 nt, Human
cguguuccccucuugucuc

SEQ ID NO: 3829387 - RNA, 20 nt, Human
cguguuccccucuugucucc

SEQ ID NO: 3829388 - RNA, 22 nt, Human
cguguugccuugaaccacuucc

SEQ ID NO: 3829389 - RNA, 17 nt, Human
cguguuugucucuucug

SEQ ID NO: 3829390 - RNA, 21 nt, Human
cguguuuuauuccuguauguu

SEQ ID NO: 3829391 - RNA, 14 nt, Human
cguuaaaaacagau

SEQ ID NO: 3829392 - RNA, 19 nt, Human
cguuaacuguguauguaca

SEQ ID NO: 3829393 - RNA, 19 nt, Human
cguuacucagggcuccucc

SEQ ID NO: 3829394 - RNA, 16 nt, Human
cguuagaccgcucucu

SEQ ID NO: 3829395 - RNA, 13 nt, Human
cguuagcuccugu

SEQ ID NO: 3829396 - RNA, 17 nt, Human
cguuagcuccuguggcc

SEQ ID NO: 3829397 - RNA, 13 nt, Human
cguuagcuuuuuc

SEQ ID NO: 3829398 - RNA, 11 nt, Human
cguuauauuaa

SEQ ID NO: 3829399 - RNA, 14 nt, Human
cguuauuauaauug

SEQ ID NO: 3829400 - RNA, 19 nt, Human
cguucaacuuuuccuuuga

SEQ ID NO: 3829401 - RNA, 20 nt, Human
cguucaccccuccacccuug

SEQ ID NO: 3829402 - RNA, 13 nt, Human
cguucacuccaau

SEQ ID NO: 3829403 - RNA, 21 nt, Human
cguucaugggggagggggcag

SEQ ID NO: 3829404 - RNA, 11 nt, Human
cguucauuugu

SEQ ID NO: 3829405 - RNA, 12 nt, Human
cguucauuugug

SEQ ID NO: 3829406 - RNA, 19 nt, Human
cguuccacaguugccacca

SEQ ID NO: 3829407 - RNA, 20 nt, Human
cguuccacaguugccaccac

SEQ ID NO: 3829408 - RNA, 17 nt, Human
cguuccuauugucauua

SEQ ID NO: 3829409 - RNA, 22 nt, Human
cguuccugacaucacagcagcc

SEQ ID NO: 3829410 - RNA, 21 nt, Human
cguucgcagagcuuuucagau

SEQ ID NO: 3829411 - RNA, 22 nt, Human
ccagaggcaccucaagaagaag

SEQ ID NO: 3829412 - RNA, 18 nt, Human
ccagaggcccccagccca

SEQ ID NO: 3829413 - RNA, 22 nt, Human
ccagaggcccccagcccagggc

SEQ ID NO: 3829414 - RNA, 11 nt, Human
ccagaggcucg

SEQ ID NO: 3829415 - RNA, 15 nt, Human
ccagaggcuggguuc

SEQ ID NO: 3829416 - RNA, 16 nt, Human
ccagaggcuggguuca

SEQ ID NO: 3829417 - RNA, 16 nt, Human
ccagagggagugacag

SEQ ID NO: 3829418 - RNA, 19 nt, Human
ccagagggagugacagagg

SEQ ID NO: 3829419 - RNA, 21 nt, Human
ccagagggagugacagaggca

SEQ ID NO: 3829420 - RNA, 22 nt, Human
ccagagggagugacagaggcag

SEQ ID NO: 3829421 - RNA, 13 nt, Human
ccagagggcccag

SEQ ID NO: 3829422 - RNA, 15 nt, Human
ccagagggcccaggc

SEQ ID NO: 3829423 - RNA, 23 nt, Human
ccagaggggaaggaggguacagc

SEQ ID NO: 3829424 - RNA, 18 nt, Human
ccagaggggccugccacc

SEQ ID NO: 3829425 - RNA, 17 nt, Human
ccagagggucugggggc

SEQ ID NO: 3829426 - RNA, 18 nt, Human
ccagagggucugggggca

SEQ ID NO: 3829427 - RNA, 18 nt, Human
ccagagguaacagaacag

SEQ ID NO: 3829428 - RNA, 19 nt, Human
ccagagguccagcccaucu

SEQ ID NO: 3829429 - RNA, 14 nt, Human
ccagaggugggcag

SEQ ID NO: 3829430 - RNA, 19 nt, Human
ccagaguccccccacuccc

SEQ ID NO: 3829431 - RNA, 16 nt, Human
ccagagucccugccug

SEQ ID NO: 3829432 - RNA, 16 nt, Human
ccagaguccuuuccaa

SEQ ID NO: 3829433 - RNA, 21 nt, Human
ccagaguccuuuccaaggcuu

SEQ ID NO: 3829434 - RNA, 14 nt, Human
ccagaguggccugg

SEQ ID NO: 3829435 - RNA, 23 nt, Human
ccagaguggccuggccaggagcu

SEQ ID NO: 3829436 - RNA, 18 nt, Human
ccagagugugggaaggga

SEQ ID NO: 3829437 - RNA, 21 nt, Human
ccagagugugggaagggagag

SEQ ID NO: 3829438 - RNA, 17 nt, Human
ccagaguuccugcggag

SEQ ID NO: 3829439 - RNA, 16 nt, Human
ccagauaccagccccu

SEQ ID NO: 3829440 - RNA, 20 nt, Human
ccagauaccagccccuguau

SEQ ID NO: 3829441 - RNA, 21 nt, Human
ccagauacuucccauuuugga

SEQ ID NO: 3829442 - RNA, 18 nt, Human
ccagauaucaucuaccua

SEQ ID NO: 3829443 - RNA, 15 nt, Human
ccagaucacugccac

SEQ ID NO: 3829444 - RNA, 16 nt, Human
ccagaucacugccaca

SEQ ID NO: 3829445 - RNA, 14 nt, Human
ccagauccagccug

SEQ ID NO: 3829446 - RNA, 15 nt, Human
ccagauccagccugg

SEQ ID NO: 3829447 - RNA, 22 nt, Human
ccagaucccaggccccuggagg

SEQ ID NO: 3829448 - RNA, 12 nt, Human
ccagauccuggg

SEQ ID NO: 3829449 - RNA, 19 nt, Human
ccagaucggaucuguugca

SEQ ID NO: 3829450 - RNA, 13 nt, Human
ccagaucuggucc

SEQ ID NO: 3829451 - RNA, 19 nt, Human
ccagaugaugggggagggg

SEQ ID NO: 3829452 - RNA, 18 nt, Human
ccagaugcacaucccugg

SEQ ID NO: 3829453 - RNA, 13 nt, Human
ccagaugcaccag

SEQ ID NO: 3829454 - RNA, 14 nt, Human
ccagaugcaccagc

SEQ ID NO: 3829455 - RNA, 23 nt, Human
ccagaugcaccagcccuuagcag

SEQ ID NO: 3829456 - RNA, 14 nt, Human
ccagaugcagggca

SEQ ID NO: 3829457 - RNA, 23 nt, Human
ccagaugcugauguucaguguaa

SEQ ID NO: 3829458 - RNA, 14 nt, Human
ccagaugcuuuccu

SEQ ID NO: 3829459 - RNA, 17 nt, Human
ccagauggacuccagcc

SEQ ID NO: 3829460 - RNA, 23 nt, Human
ccagauggcccggaugcugcuuc

SEQ ID NO: 3829461 - RNA, 20 nt, Human
ccagaugggggaaagcacag

SEQ ID NO: 3829462 - RNA, 17 nt, Human
ccagauggucauccaga

SEQ ID NO: 3829463 - RNA, 14 nt, Human
ccagauggugggau

SEQ ID NO: 3829464 - RNA, 21 nt, Human
ccagaugugaugcuugauauu

SEQ ID NO: 3829465 - RNA, 13 nt, Human
ccagauguggcua

SEQ ID NO: 3829466 - RNA, 23 nt, Human
ccagauguuuccagacuuccuug

SEQ ID NO: 3829467 - RNA, 19 nt, Human
ccagauguuuuacgucugg

SEQ ID NO: 3829468 - RNA, 21 nt, Human
ccagauguuuuacgucuggga

SEQ ID NO: 3829469 - RNA, 21 nt, Human
ccagauugcaacaggcugggc

SEQ ID NO: 3829470 - RNA, 22 nt, Human
ccagauugcaacaggcugggcu

SEQ ID NO: 3829471 - RNA, 20 nt, Human
ccagauuggcucacacugag

SEQ ID NO: 3829472 - RNA, 22 nt, Human
ccagauuggcucacacugagaa

SEQ ID NO: 3829473 - RNA, 19 nt, Human
ccagauuuacacugggaga

SEQ ID NO: 3829474 - RNA, 21 nt, Human
ccagauuugcuaauuuauccu

SEQ ID NO: 3829475 - RNA, 12 nt, Human
ccagauuugucu

SEQ ID NO: 3829476 - RNA, 15 nt, Human
ccagauuugucuuuu

SEQ ID NO: 3829477 - RNA, 15 nt, Human
ccagauuuugcugua

SEQ ID NO: 3829478 - RNA, 21 nt, Human
ccagcaaagccccaugcugga

SEQ ID NO: 3829479 - RNA, 15 nt, Human
ccagcaaagccccca

SEQ ID NO: 3829480 - RNA, 19 nt, Human
ccagcaaagcccccagagc

SEQ ID NO: 3829481 - RNA, 14 nt, Human
ccagcaacacagcc

SEQ ID NO: 3829482 - RNA, 17 nt, Human
ccagcaacacagccugg

SEQ ID NO: 3829483 - RNA, 20 nt, Human
ccagcaacacagccugggcc

SEQ ID NO: 3829484 - RNA, 15 nt, Human
ccagcaacugaauaa

SEQ ID NO: 3829485 - RNA, 23 nt, Human
ccagcaacuucuucuccaucccu

SEQ ID NO: 3829486 - RNA, 18 nt, Human
ccagcaacuugucuuuuu

SEQ ID NO: 3829487 - RNA, 19 nt, Human
ccagcaagaauaaaaaaga

SEQ ID NO: 3829488 - RNA, 21 nt, Human
ccagcaagaauaaaaaagaaa

SEQ ID NO: 3829489 - RNA, 20 nt, Human
ccagcaagcggggauguccc

SEQ ID NO: 3829490 - RNA, 22 nt, Human
ccagcaagcggggaugucccug

SEQ ID NO: 3829491 - RNA, 21 nt, Human
ccagcaauacagugcucgcca

SEQ ID NO: 3829492 - RNA, 12 nt, Human
ccagcaaugaca

SEQ ID NO: 3829493 - RNA, 18 nt, Human
ccagcaaugauguccaga

SEQ ID NO: 3829494 - RNA, 23 nt, Human
ccagcaauuacaacggagucaaa

SEQ ID NO: 3829495 - RNA, 15 nt, Human
ccagcaauuaugaaa

SEQ ID NO: 3829496 - RNA, 20 nt, Human
ccagcaauucuccugccuca

SEQ ID NO: 3829497 - RNA, 21 nt, Human
ccagcaauucuccugccucag

SEQ ID NO: 3829498 - RNA, 13 nt, Human
ccagcacaaacac

SEQ ID NO: 3829499 - RNA, 13 nt, Human
ccagcacagcuug

SEQ ID NO: 3829500 - RNA, 17 nt, Human
ccagcacagcuugaccu

SEQ ID NO: 3829501 - RNA, 19 nt, Human
ccagcaccaacaccacggu

SEQ ID NO: 3829502 - RNA, 22 nt, Human
ccagcaccauccgccagggccc

SEQ ID NO: 3829503 - RNA, 18 nt, Human
ccagcaccaucucuccuc

SEQ ID NO: 3829504 - RNA, 13 nt, Human
ccagcacccccac

SEQ ID NO: 3829505 - RNA, 15 nt, Human
ccagcacccccacgc

SEQ ID NO: 3829506 - RNA, 16 nt, Human
ccagcacccccacgcc

SEQ ID NO: 3829507 - RNA, 20 nt, Human
ccagcacccccacgcccuca

SEQ ID NO: 3829508 - RNA, 17 nt, Human
ccagcaccugccuccuc

SEQ ID NO: 3829509 - RNA, 15 nt, Human
ccagcaccuggcauc

SEQ ID NO: 3829510 - RNA, 15 nt, Human
ccagcaccuugugcc

SEQ ID NO: 3829511 - RNA, 16 nt, Human
ccagcaccuugugccu

SEQ ID NO: 3829512 - RNA, 18 nt, Human
ccagcaccuugugccugg

SEQ ID NO: 3829513 - RNA, 12 nt, Human
ccagcacuaacg

SEQ ID NO: 3829514 - RNA, 13 nt, Human
ccagcacugagga

SEQ ID NO: 3829515 - RNA, 14 nt, Human
ccagcacugaggaa

SEQ ID NO: 3829516 - RNA, 15 nt, Human
ccagcacugaggaag

SEQ ID NO: 3829517 - RNA, 14 nt, Human
ccagcacugcccaa

SEQ ID NO: 3829518 - RNA, 15 nt, Human
ccagcacugcuugag

SEQ ID NO: 3829519 - RNA, 15 nt, Human
ccagcacugucucag

SEQ ID NO: 3829520 - RNA, 21 nt, Human
ccagcacuuggagaggcugag

SEQ ID NO: 3829521 - RNA, 16 nt, Human
ccagcacuuguccagc

SEQ ID NO: 3829522 - RNA, 21 nt, Human
ccagcacuuugggaggccaag

SEQ ID NO: 3829523 - RNA, 20 nt, Human
ccagcacuuugggaggccga

SEQ ID NO: 3829524 - RNA, 21 nt, Human
ccagcacuuugggaggcugag

SEQ ID NO: 3829525 - RNA, 23 nt, Human
ccagcacuuugggaggcugaggc

SEQ ID NO: 3829526 - RNA, 12 nt, Human
ccagcagaaaug

SEQ ID NO: 3829527 - RNA, 22 nt, Human
ccagcagaaaugccuuacccuc

SEQ ID NO: 3829528 - RNA, 22 nt, Human
ccagcagaagacaaaaagacaa

SEQ ID NO: 3829529 - RNA, 19 nt, Human
ccagcagacagagccagga

SEQ ID NO: 3829530 - RNA, 12 nt, Human
ccagcagacauu

SEQ ID NO: 3829531 - RNA, 13 nt, Human
ccagcagacauug

SEQ ID NO: 3829532 - RNA, 15 nt, Human
ccagcagacauuguc

SEQ ID NO: 3829533 - RNA, 17 nt, Human
ccagcagacauugucag

SEQ ID NO: 3829534 - RNA, 14 nt, Human
ccagcagagcaccu

SEQ ID NO: 3829535 - RNA, 18 nt, Human
ccagcagauuuccagccu

SEQ ID NO: 3829536 - RNA, 14 nt, Human
ccagcagcagcagg

SEQ ID NO: 3829537 - RNA, 15 nt, Human
ccagcagcagcaggu

SEQ ID NO: 3829538 - RNA, 20 nt, Human
ccagcagccagcucucagcc

SEQ ID NO: 3829539 - RNA, 12 nt, Human
ccagcagcccua

SEQ ID NO: 3829540 - RNA, 11 nt, Human
ccagcagccug

SEQ ID NO: 3829541 - RNA, 14 nt, Human
ccagcagccuggac

SEQ ID NO: 3829542 - RNA, 19 nt, Human
ccagcagcgccuuucccaa

SEQ ID NO: 3829543 - RNA, 20 nt, Human
ccagcagcugccaggagcac

SEQ ID NO: 3829544 - RNA, 23 nt, Human
ccagcagcugccaggagcacggc

SEQ ID NO: 3829545 - RNA, 13 nt, Human
ccagcaggaggga

SEQ ID NO: 3829546 - RNA, 16 nt, Human
ccagcaggagggacag

SEQ ID NO: 3829547 - RNA, 14 nt, Human
cuaagaaccccucu

SEQ ID NO: 3829548 - RNA, 14 nt, Human
cuaagaaccuggaa

SEQ ID NO: 3829549 - RNA, 23 nt, Human
cuaagaagaaaauugcugugccu

SEQ ID NO: 3829550 - RNA, 21 nt, Human
cuaagaagcuucuaauaaauu

SEQ ID NO: 3829551 - RNA, 15 nt, Human
cuaagacacaaaugc

SEQ ID NO: 3829552 - RNA, 22 nt, Human
cuaagacuauauauauaaaugu

SEQ ID NO: 3829553 - RNA, 17 nt, Human
cuaagacucaaauguuc

SEQ ID NO: 3829554 - RNA, 19 nt, Human
cuaagacucaaauguucua

SEQ ID NO: 3829555 - RNA, 19 nt, Human
cucaaagguuuggaaggag

SEQ ID NO: 3829556 - RNA, 23 nt, Human
cucaaagguuuggaaggagcaga

SEQ ID NO: 3829557 - RNA, 14 nt, Human
cucaaagucugcaa

SEQ ID NO: 3829558 - RNA, 23 nt, Human
cucaaagugacuauucaguuuuc

SEQ ID NO: 3829559 - RNA, 12 nt, Human
cucaaaguuuug

SEQ ID NO: 3829560 - RNA, 17 nt, Human
cucaaaguuuugaaaag

SEQ ID NO: 3829561 - RNA, 19 nt, Human
cucaaaguuuugaaaagcu

SEQ ID NO: 3829562 - RNA, 23 nt, Human
cucaaaguuuugaaaagcuauua

SEQ ID NO: 3829563 - RNA, 14 nt, Human
cucaaauaaaauaa

SEQ ID NO: 3829564 - RNA, 12 nt, Human
cucaaauaacua

SEQ ID NO: 3829565 - RNA, 14 nt, Human
cucaaauccaggac

SEQ ID NO: 3829566 - RNA, 20 nt, Human
cucaaauccaggacccugcc

SEQ ID NO: 3829567 - RNA, 23 nt, Human
cucaaauccaggacccugccagg

SEQ ID NO: 3829568 - RNA, 13 nt, Human
cucaaaucuguua

SEQ ID NO: 3829569 - RNA, 17 nt, Human
cucaaaugaugggaagu

SEQ ID NO: 3829570 - RNA, 15 nt, Human
cucaaauggggccag

SEQ ID NO: 3829571 - RNA, 16 nt, Human
cucaaauggggccaga

SEQ ID NO: 3829572 - RNA, 19 nt, Human
cucaaauggggccagaucc

SEQ ID NO: 3829573 - RNA, 15 nt, Human
cucaaauguucuaag

SEQ ID NO: 3829574 - RNA, 16 nt, Human
cucaaauguucuaagu

SEQ ID NO: 3829575 - RNA, 17 nt, Human
cucaaauguucuaaguu

SEQ ID NO: 3829576 - RNA, 22 nt, Human
cucaaauguucuaaguuucuaa

SEQ ID NO: 3829577 - RNA, 15 nt, Human
cucaaauuucuaaau

SEQ ID NO: 3829578 - RNA, 12 nt, Human
cucaaauuugga

SEQ ID NO: 3829579 - RNA, 19 nt, Human
cucaacaaagcacaguguu

SEQ ID NO: 3829580 - RNA, 12 nt, Human
cucaacaagaaa

SEQ ID NO: 3829581 - RNA, 19 nt, Human
cucaacaagggagagaccu

SEQ ID NO: 3829582 - RNA, 14 nt, Human
cucaacaauaaaac

SEQ ID NO: 3829583 - RNA, 19 nt, Human
cucaacaccaugauuccuu

SEQ ID NO: 3829584 - RNA, 22 nt, Human
cucaacaccaugauuccuuuaa

SEQ ID NO: 3829585 - RNA, 16 nt, Human
cucaacaggccucagg

SEQ ID NO: 3829586 - RNA, 18 nt, Human
cucaacaggccucagggc

SEQ ID NO: 3829587 - RNA, 18 nt, Human
cucaacaugagucaagag

SEQ ID NO: 3829588 - RNA, 20 nt, Human
cucaacaugagucaagagca

SEQ ID NO: 3829589 - RNA, 22 nt, Human
cucaacaugucuccuacugagg

SEQ ID NO: 3829590 - RNA, 16 nt, Human
cucaacauguuacuga

SEQ ID NO: 3829591 - RNA, 18 nt, Human
cucaaccaccuuucagau

SEQ ID NO: 3829592 - RNA, 21 nt, Human
cucaaccccaccauaugaauu

SEQ ID NO: 3829593 - RNA, 19 nt, Human
cucaacccccauuucuauu

SEQ ID NO: 3829594 - RNA, 21 nt, Human
cucaaccccuccccuccaucc

SEQ ID NO: 3829595 - RNA, 22 nt, Human
cucaacccucccucagccccuc

SEQ ID NO: 3829596 - RNA, 13 nt, Human
cucaacccucuca

SEQ ID NO: 3829597 - RNA, 23 nt, Human
cucaaccuaccaccccuuccugu

SEQ ID NO: 3829598 - RNA, 13 nt, Human
cucaaccuccugg

SEQ ID NO: 3829599 - RNA, 17 nt, Human
cucaaccuccugggcua

SEQ ID NO: 3829600 - RNA, 18 nt, Human
cucaaccucuucuggcuc

SEQ ID NO: 3829601 - RNA, 20 nt, Human
cucaaccucuucuggcucaa

SEQ ID NO: 3829602 - RNA, 21 nt, Human
cuagaauauccuacuucucca

SEQ ID NO: 3829603 - RNA, 20 nt, Human
cuagaaucuggagagcuaga

SEQ ID NO: 3829604 - RNA, 17 nt, Human
cuagaauguuucauuug

SEQ ID NO: 3829605 - RNA, 16 nt, Human
cuagaauucccucucu

SEQ ID NO: 3829606 - RNA, 16 nt, Human
cuagaauucuagugcu

SEQ ID NO: 3829607 - RNA, 18 nt, Human
cuagaauucuagugcugc

SEQ ID NO: 3829608 - RNA, 19 nt, Human
cuagaauucuagugcugcu

SEQ ID NO: 3829609 - RNA, 20 nt, Human
cuagaauucuagugcugcug

SEQ ID NO: 3829610 - RNA, 20 nt, Human
cuagaauucuguauuggaua

SEQ ID NO: 3829611 - RNA, 19 nt, Human
cuagaauugaguguuuaaa

SEQ ID NO: 3829612 - RNA, 22 nt, Human
cuagaauuuauucaauuccucu

SEQ ID NO: 3829613 - RNA, 17 nt, Human
cuagaauuucauuuauu

SEQ ID NO: 3829614 - RNA, 23 nt, Human
cuagacaagauauuguacauaaa

SEQ ID NO: 3829615 - RNA, 16 nt, Human
cuagacaccaaaguuc

SEQ ID NO: 3829616 - RNA, 13 nt, Human
cuagacacugcca

SEQ ID NO: 3829617 - RNA, 13 nt, Human
cuagacauuacca

SEQ ID NO: 3829618 - RNA, 16 nt, Human
cuagacauucugucgc

SEQ ID NO: 3829619 - RNA, 20 nt, Human
cuagaccagcagacagagcc

SEQ ID NO: 3829620 - RNA, 22 nt, Human
cuagaccagcagacagagccag

SEQ ID NO: 3829621 - RNA, 14 nt, Human
cuagacuauaaaug

SEQ ID NO: 3829622 - RNA, 23 nt, Human
cuagacuggugacugauucuuca

SEQ ID NO: 3829623 - RNA, 13 nt, Human
cuagacuggugcu

SEQ ID NO: 3829624 - RNA, 17 nt, Human
cuagacuggugcuaaug

SEQ ID NO: 3829625 - RNA, 16 nt, Human
cuagacuuuaggcuuu

SEQ ID NO: 3829626 - RNA, 16 nt, Human
cuagagaacagguggu

SEQ ID NO: 3829627 - RNA, 17 nt, Human
cuagagaacgcagcccu

SEQ ID NO: 3829628 - RNA, 17 nt, Human
cuagagaagacaggcug

SEQ ID NO: 3829629 - RNA, 14 nt, Human
cuagagaagauaau

SEQ ID NO: 3829630 - RNA, 15 nt, Human
cuagagaagauaauu

SEQ ID NO: 3829631 - RNA, 16 nt, Human
cuagagaagauaauug

SEQ ID NO: 3829632 - RNA, 18 nt, Human
cuagagaagauaauuguu

SEQ ID NO: 3829633 - RNA, 20 nt, Human
cuagagaagauaauuguuga

SEQ ID NO: 3829634 - RNA, 21 nt, Human
cuagagaaguggacuggagga

SEQ ID NO: 3829635 - RNA, 22 nt, Human
cuagagaaguggacuggaggag

SEQ ID NO: 3829636 - RNA, 12 nt, Human
cuagagagggag

SEQ ID NO: 3829637 - RNA, 23 nt, Human
cuagagagggaggcaagcccugu

SEQ ID NO: 3829638 - RNA, 22 nt, Human
cuagagaucugguuuugcuauu

SEQ ID NO: 3829639 - RNA, 18 nt, Human
cuagagcacugccaccag

SEQ ID NO: 3829640 - RNA, 20 nt, Human
cuagagcagacuacagcugg

SEQ ID NO: 3829641 - RNA, 22 nt, Human
cuagagcagcccaaauuuuucu

SEQ ID NO: 3829642 - RNA, 17 nt, Human
cuagagcagcccuggag

SEQ ID NO: 3829643 - RNA, 14 nt, Human
cuagagccagacca

SEQ ID NO: 3829644 - RNA, 15 nt, Human
cuagagcuccucccu

SEQ ID NO: 3829645 - RNA, 19 nt, Human
cuagagcuccucccucuca

SEQ ID NO: 3829646 - RNA, 14 nt, Human
cuagaggcagggag

SEQ ID NO: 3829647 - RNA, 19 nt, Human
cuagaggcagggaggggac

SEQ ID NO: 3829648 - RNA, 22 nt, Human
cuagaggccagccccacccagg

SEQ ID NO: 3829649 - RNA, 12 nt, Human
cuagaggccuga

SEQ ID NO: 3829650 - RNA, 23 nt, Human
cuagaggccugacugccaagcca

SEQ ID NO: 3829651 - RNA, 13 nt, Human
cuagaggccugag

SEQ ID NO: 3829652 - RNA, 16 nt, Human
cuagaggccugaggau

SEQ ID NO: 3829653 - RNA, 19 nt, Human
cuagaggcuuccuucauuu

SEQ ID NO: 3829654 - RNA, 14 nt, Human
cuagagggaccucu

SEQ ID NO: 3829655 - RNA, 19 nt, Human
cuagagggaggggccuagg

SEQ ID NO: 3829656 - RNA, 16 nt, Human
cuagaggguuccugua

SEQ ID NO: 3829657 - RNA, 17 nt, Human
cuagagguucaaagaua

SEQ ID NO: 3829658 - RNA, 16 nt, Human
cuagaguagagguaua

SEQ ID NO: 3829659 - RNA, 20 nt, Human
cuagaguagagguauaauug

SEQ ID NO: 3829660 - RNA, 21 nt, Human
cuagaguagagguauaauugu

SEQ ID NO: 3829661 - RNA, 17 nt, Human
cuagaguagaguggagg

SEQ ID NO: 3829662 - RNA, 20 nt, Human
cuagaguccaagguuuaaag

SEQ ID NO: 3829663 - RNA, 16 nt, Human
cuagagucugaacagc

SEQ ID NO: 3829664 - RNA, 16 nt, Human
cuagagugagggccug

SEQ ID NO: 3829665 - RNA, 19 nt, Human
cuagaguuuagcuggaaaa

SEQ ID NO: 3829666 - RNA, 13 nt, Human
cuagauaaaaaga

SEQ ID NO: 3829667 - RNA, 23 nt, Human
cuagauaaaaagauggccuuugc

SEQ ID NO: 3829668 - RNA, 17 nt, Human
cuagauacaauaaauug

SEQ ID NO: 3829669 - RNA, 23 nt, Human
cuagauacaauaaauugcuaaug

SEQ ID NO: 3829670 - RNA, 22 nt, Human
cuagauaugaauauauggcauu

SEQ ID NO: 3829671 - RNA, 15 nt, Human
cuagaucagaacagg

SEQ ID NO: 3829672 - RNA, 15 nt, Human
cuagaucauaaggcu

SEQ ID NO: 3829673 - RNA, 22 nt, Human
cuagaucauaaggcuucaaaau

SEQ ID NO: 3829674 - RNA, 21 nt, Human
cuagaucauuuguucugggag

SEQ ID NO: 3829675 - RNA, 17 nt, Human
cuagauccacacacaga

SEQ ID NO: 3829676 - RNA, 16 nt, Human
cuagauccuaaggguc

SEQ ID NO: 3829677 - RNA, 20 nt, Human
cuagaugauuuuuugaaagu

SEQ ID NO: 3829678 - RNA, 14 nt, Human
cuagauggcuccuc

SEQ ID NO: 3829679 - RNA, 15 nt, Human
cuagauggcuccucu

SEQ ID NO: 3829680 - RNA, 18 nt, Human
cuagauggcuccucucag

SEQ ID NO: 3829681 - RNA, 15 nt, Human
cuagauggugcugag

SEQ ID NO: 3829682 - RNA, 20 nt, Human
cuagauguaguauuuuuugu

SEQ ID NO: 3829683 - RNA, 13 nt, Human
cuagaugucuuua

SEQ ID NO: 3829684 - RNA, 18 nt, Human
cuagauuauaucaaagua

SEQ ID NO: 3829685 - RNA, 21 nt, Human
cuagauuauaucaaaguauuu

SEQ ID NO: 3829686 - RNA, 12 nt, Human
cuagauucaaag

SEQ ID NO: 3829687 - RNA, 15 nt, Human
cuagauucaaagguu

SEQ ID NO: 3829688 - RNA, 23 nt, Human
cuagauuccauugguccaagauu

SEQ ID NO: 3829689 - RNA, 20 nt, Human
cuagauucuacauauucuuu

SEQ ID NO: 3829690 - RNA, 22 nt, Human
cuagauuggaguggggaagugu

SEQ ID NO: 3829691 - RNA, 12 nt, Human
cuagauuuuguu

SEQ ID NO: 3829692 - RNA, 18 nt, Human
cuagauuuuguuuugcuu

SEQ ID NO: 3829693 - RNA, 21 nt, Human
cuagauuuuguuuugcuuuuu

SEQ ID NO: 3829694 - RNA, 14 nt, Human
cuagcaagcuggcc

SEQ ID NO: 3829695 - RNA, 15 nt, Human
cuagcaagugagaga

SEQ ID NO: 3829696 - RNA, 18 nt, Human
cuagcaagugagagagau

SEQ ID NO: 3829697 - RNA, 22 nt, Human
cuagcaaucacaacacuggcug

SEQ ID NO: 3829698 - RNA, 14 nt, Human
cuagcacagauggc

SEQ ID NO: 3829699 - RNA, 14 nt, Human
cuaggccagagccc

SEQ ID NO: 3829700 - RNA, 15 nt, Human
cuaggccagagccca

SEQ ID NO: 3829701 - RNA, 11 nt, Human
cuaggccaggu

SEQ ID NO: 3829702 - RNA, 22 nt, Human
cuaggccaggugcaaccaggga

SEQ ID NO: 3829703 - RNA, 13 nt, Human
cuaggcccccacu

SEQ ID NO: 3829704 - RNA, 15 nt, Human
cuaggcccccacuug

SEQ ID NO: 3829705 - RNA, 16 nt, Human
cuaggcccccacuugc

SEQ ID NO: 3829706 - RNA, 16 nt, Human
cuaggccucaacuccu

SEQ ID NO: 3829707 - RNA, 21 nt, Human
cuaggccucaacuccucccau

SEQ ID NO: 3829708 - RNA, 15 nt, Human
cuaggccucuccagu

SEQ ID NO: 3829709 - RNA, 19 nt, Human
cuaggccuggcauggcacc

SEQ ID NO: 3829710 - RNA, 15 nt, Human
cuaggccuggccaga

SEQ ID NO: 3829711 - RNA, 14 nt, Human
cuaggccuggggac

SEQ ID NO: 3829712 - RNA, 21 nt, Human
cuaggccuugcggcuccucag

SEQ ID NO: 3829713 - RNA, 15 nt, Human
cuaggcgagugccag

SEQ ID NO: 3829714 - RNA, 17 nt, Human
cuaggcgagugccagga

SEQ ID NO: 3829715 - RNA, 20 nt, Human
cuaggcgagugccaggacuc

SEQ ID NO: 3829716 - RNA, 18 nt, Human
cuaggcuacaauuuucuc

SEQ ID NO: 3829717 - RNA, 15 nt, Human
cuaggcucagagaug

SEQ ID NO: 3829718 - RNA, 13 nt, Human
cuaggcuccaccc

SEQ ID NO: 3829719 - RNA, 12 nt, Human
cuaggcuccuuc

SEQ ID NO: 3829720 - RNA, 21 nt, Human
cuaggcucgccuucccuccug

SEQ ID NO: 3829721 - RNA, 14 nt, Human
cuaggcucugccuu

SEQ ID NO: 3829722 - RNA, 15 nt, Human
cuaggcucugccuuc

SEQ ID NO: 3829723 - RNA, 15 nt, Human
cuaggcucugucugg

SEQ ID NO: 3829724 - RNA, 15 nt, Human
cuaggcuggaaggag

SEQ ID NO: 3829725 - RNA, 16 nt, Human
cuaggcuggaaggagg

SEQ ID NO: 3829726 - RNA, 15 nt, Human
cuaggcuggagccca

SEQ ID NO: 3829727 - RNA, 12 nt, Human
cuaggcugggug

SEQ ID NO: 3829728 - RNA, 19 nt, Human
cuagggaaaaaccagcgug

SEQ ID NO: 3829729 - RNA, 21 nt, Human
cuagggaaaaaccagcgugug

SEQ ID NO: 3829730 - RNA, 14 nt, Human
cuagggaaggccac

SEQ ID NO: 3829731 - RNA, 17 nt, Human
cuagggaaggccaccug

SEQ ID NO: 3829732 - RNA, 19 nt, Human
cuagggaaggccaccugca

SEQ ID NO: 3829733 - RNA, 20 nt, Human
cuagggaaggccaccugcag

SEQ ID NO: 3829734 - RNA, 16 nt, Human
cuagggaccccuccuc

SEQ ID NO: 3829735 - RNA, 20 nt, Human
cuagggaccccuccucccuu

SEQ ID NO: 3829736 - RNA, 14 nt, Human
cuagggagagaccc

SEQ ID NO: 3829737 - RNA, 17 nt, Human
cuagggagccauuugag

SEQ ID NO: 3829738 - RNA, 21 nt, Human
cuagggaggaccuuaucugug

SEQ ID NO: 3829739 - RNA, 23 nt, Human
cuagggaggcauggucugcccuc

SEQ ID NO: 3829740 - RNA, 21 nt, Human
cuagggagggggaaagaagga

SEQ ID NO: 3829741 - RNA, 16 nt, Human
cuagggaguggucuuu

SEQ ID NO: 3829742 - RNA, 23 nt, Human
cuagggaucccucaucugucccu

SEQ ID NO: 3829743 - RNA, 17 nt, Human
cuagggauucaggcugc

SEQ ID NO: 3829744 - RNA, 18 nt, Human
cuagggauucaggcugcu

SEQ ID NO: 3829745 - RNA, 20 nt, Human
cuagggauucaggcugcuug

SEQ ID NO: 3829746 - RNA, 15 nt, Human
cuagggcugggaaac

SEQ ID NO: 3829747 - RNA, 16 nt, Human
cuagggcugggaaaca

SEQ ID NO: 3829748 - RNA, 18 nt, Human
cuaggggaaugagggggc

SEQ ID NO: 3829749 - RNA, 12 nt, Human
cuaggggagcag

SEQ ID NO: 3829750 - RNA, 23 nt, Human
cuagggggagccccuucugcuca

SEQ ID NO: 3829751 - RNA, 17 nt, Human
cuaggguacauggugcu

SEQ ID NO: 3829752 - RNA, 14 nt, Human
cuaggguccugggg

SEQ ID NO: 3829753 - RNA, 13 nt, Human
cuaggguggcccu

SEQ ID NO: 3829754 - RNA, 15 nt, Human
cuaggguggggagag

SEQ ID NO: 3829755 - RNA, 22 nt, Human
cuagguaaauuacaguuccuag

SEQ ID NO: 3829756 - RNA, 15 nt, Human
cuagguaauuuuuac

SEQ ID NO: 3829757 - RNA, 20 nt, Human
cuagguaauuuuuacagaau

SEQ ID NO: 3829758 - RNA, 14 nt, Human
cuagguacuucagg

SEQ ID NO: 3829759 - RNA, 16 nt, Human
cuagguagagucugag

SEQ ID NO: 3829760 - RNA, 19 nt, Human
cuaggucaaggccuguccc

SEQ ID NO: 3829761 - RNA, 20 nt, Human
cuaggucaaggccugucccu

SEQ ID NO: 3829762 - RNA, 19 nt, Human
cuaggucaguacccaccug

SEQ ID NO: 3829763 - RNA, 20 nt, Human
cuaggucaguacccaccuga

SEQ ID NO: 3829764 - RNA, 14 nt, Human
cuaggucauaaaga

SEQ ID NO: 3829765 - RNA, 23 nt, Human
cuaggucucggacuaagccuacc

SEQ ID NO: 3829766 - RNA, 22 nt, Human
cucacccagugcccucuccccu

SEQ ID NO: 3829767 - RNA, 12 nt, Human
cucaccccagcc

SEQ ID NO: 3829768 - RNA, 14 nt, Human
cucaccccagcccc

SEQ ID NO: 3829769 - RNA, 15 nt, Human
cucaccccagcccca

SEQ ID NO: 3829770 - RNA, 17 nt, Human
cucacccccaaggggca

SEQ ID NO: 3829771 - RNA, 21 nt, Human
cucacccccaaggggcagucu

SEQ ID NO: 3829772 - RNA, 16 nt, Human
cucaccccccacacuc

SEQ ID NO: 3829773 - RNA, 14 nt, Human
cucacccccuccca

SEQ ID NO: 3829774 - RNA, 21 nt, Human
cucacccccucccacccccag

SEQ ID NO: 3829775 - RNA, 23 nt, Human
cucacccccucccacccccagcc

SEQ ID NO: 3829776 - RNA, 15 nt, Human
cucacccccuucucc

SEQ ID NO: 3829777 - RNA, 20 nt, Human
cucaccccgaggcccugcau

SEQ ID NO: 3829778 - RNA, 21 nt, Human
cucaccccgaggcccugcaug

SEQ ID NO: 3829779 - RNA, 22 nt, Human
cucaccccgaggcccugcaugg

SEQ ID NO: 3829780 - RNA, 17 nt, Human
cucaccccugguucuca

SEQ ID NO: 3829781 - RNA, 19 nt, Human
cucaccccugguucucauc

SEQ ID NO: 3829782 - RNA, 21 nt, Human
cucaccccuguccucacugcu

SEQ ID NO: 3829783 - RNA, 14 nt, Human
cucacccugagccc

SEQ ID NO: 3829784 - RNA, 14 nt, Human
cucacccugccuua

SEQ ID NO: 3829785 - RNA, 15 nt, Human
cucacccugcuacac

SEQ ID NO: 3829786 - RNA, 15 nt, Human
cucacccuggaggca

SEQ ID NO: 3829787 - RNA, 21 nt, Human
cucaccgcagucgucgcacag

SEQ ID NO: 3829788 - RNA, 16 nt, Human
cucaccgcccaucagg

SEQ ID NO: 3829789 - RNA, 13 nt, Human
cucaccggcucuc

SEQ ID NO: 3829790 - RNA, 21 nt, Human
cucaccggcucucaccuggcc

SEQ ID NO: 3829791 - RNA, 21 nt, Human
cucaccguggcuaagaguguc

SEQ ID NO: 3829792 - RNA, 23 nt, Human
cucaccuaauguuuaugagccag

SEQ ID NO: 3829793 - RNA, 12 nt, Human
cucaccuagagc

SEQ ID NO: 3829794 - RNA, 13 nt, Human
cucaccuagagcc

SEQ ID NO: 3829795 - RNA, 13 nt, Human
cucaccuccugcu

SEQ ID NO: 3829796 - RNA, 14 nt, Human
cucaccuccugcug

SEQ ID NO: 3829797 - RNA, 13 nt, Human
cucaccucuaccc

SEQ ID NO: 3829798 - RNA, 18 nt, Human
cucaccucuacccaaacc

SEQ ID NO: 3829799 - RNA, 13 nt, Human
cucaccucucccu

SEQ ID NO: 3829800 - RNA, 12 nt, Human
cucaccucugcc

SEQ ID NO: 3829801 - RNA, 19 nt, Human
cucaccucugccucaaugu

SEQ ID NO: 3829802 - RNA, 14 nt, Human
cucaccucuggacu

SEQ ID NO: 3829803 - RNA, 15 nt, Human
cucaccucuggacug

SEQ ID NO: 3829804 - RNA, 22 nt, Human
cucaccucuggacuggcuagag

SEQ ID NO: 3829805 - RNA, 17 nt, Human
cucaccugcacuaacag

SEQ ID NO: 3829806 - RNA, 13 nt, Human
cucaccugccccu

SEQ ID NO: 3829807 - RNA, 12 nt, Human
cucaccuggacu

SEQ ID NO: 3829808 - RNA, 17 nt, Human
cucaccuggggcugcug

SEQ ID NO: 3829809 - RNA, 20 nt, Human
cucaccuguugcuuacaauu

SEQ ID NO: 3829810 - RNA, 21 nt, Human
cucaccuguugcuuacaauuu

SEQ ID NO: 3829811 - RNA, 22 nt, Human
cucaccuguugcuuacaauuuu

SEQ ID NO: 3829812 - RNA, 21 nt, Human
cucaccuucugaguacagagu

SEQ ID NO: 3829813 - RNA, 22 nt, Human
cucaccuugaacaccacgcuug

SEQ ID NO: 3829814 - RNA, 22 nt, Human
cucaccuugcaacacacagaca

SEQ ID NO: 3829815 - RNA, 16 nt, Human
cucaccuuggcaccag

SEQ ID NO: 3829816 - RNA, 17 nt, Human
cucaccuuucccaucuu

SEQ ID NO: 3829817 - RNA, 14 nt, Human
cucaccuuuguuuu

SEQ ID NO: 3829818 - RNA, 22 nt, Human
cucaccuuuguuuuuuguugga

SEQ ID NO: 3829819 - RNA, 19 nt, Human
cucacgccuguaaucccag

SEQ ID NO: 3829820 - RNA, 20 nt, Human
cucacgcucccaacacaagg

SEQ ID NO: 3829821 - RNA, 14 nt, Human
cucacgcugggucc

SEQ ID NO: 3829822 - RNA, 13 nt, Human
cucacgcuucaca

SEQ ID NO: 3829823 - RNA, 15 nt, Human
cucacgcuucacagu

SEQ ID NO: 3829824 - RNA, 19 nt, Human
cucacgggcaguagcugug

SEQ ID NO: 3829825 - RNA, 13 nt, Human
cucacuaauuuuu

SEQ ID NO: 3829826 - RNA, 12 nt, Human
cucacuaccucc

SEQ ID NO: 3829827 - RNA, 20 nt, Human
cucacuaccuccucagggau

SEQ ID NO: 3829828 - RNA, 15 nt, Human
cucacuaggccccca

SEQ ID NO: 3829829 - RNA, 22 nt, Human
cucacuaggcccccacuugccu

SEQ ID NO: 3829830 - RNA, 21 nt, Human
cucacuaucccggcugcccuu

SEQ ID NO: 3829831 - RNA, 17 nt, Human
cucacuauccuacccca

SEQ ID NO: 3829832 - RNA, 17 nt, Human
cucacuauggugccaau

SEQ ID NO: 3829833 - RNA, 23 nt, Human
cucacuauggugccaauggaacc

SEQ ID NO: 3829834 - RNA, 16 nt, Human
cucacuauguugccca

SEQ ID NO: 3829835 - RNA, 17 nt, Human
cucacuauguugcccag

SEQ ID NO: 3829836 - RNA, 22 nt, Human
cucacuauguugcccaggcagg

SEQ ID NO: 3829837 - RNA, 23 nt, Human
cucacuauguugcccaggcaggu

SEQ ID NO: 3829838 - RNA, 21 nt, Human
cucacucaaguucaaggacca

SEQ ID NO: 3829839 - RNA, 14 nt, Human
cucacucaccuuca

SEQ ID NO: 3829840 - RNA, 14 nt, Human
cucacucagcacuu

SEQ ID NO: 3829841 - RNA, 16 nt, Human
cucacuccaccaccca

SEQ ID NO: 3829842 - RNA, 20 nt, Human
cucacuccaccacccaaaag

SEQ ID NO: 3829843 - RNA, 18 nt, Human
cucacuccccacauccca

SEQ ID NO: 3829844 - RNA, 16 nt, Human
cucauuggaaauuuag

SEQ ID NO: 3829845 - RNA, 13 nt, Human
cucauuggacccu

SEQ ID NO: 3829846 - RNA, 15 nt, Human
cucauuguaaacaaa

SEQ ID NO: 3829847 - RNA, 22 nt, Human
cucauuuaagggaaaaauauau

SEQ ID NO: 3829848 - RNA, 13 nt, Human
cucauuuaauccu

SEQ ID NO: 3829849 - RNA, 11 nt, Human
cucauuuacug

SEQ ID NO: 3829850 - RNA, 17 nt, Human
cucauuucaccccuccc

SEQ ID NO: 3829851 - RNA, 19 nt, Human
cucauuucaccccucccuu

SEQ ID NO: 3829852 - RNA, 22 nt, Human
cucauuucaccccucccuuucu

SEQ ID NO: 3829853 - RNA, 12 nt, Human
cucauuucagga

SEQ ID NO: 3829854 - RNA, 16 nt, Human
cucauuucaggagcag

SEQ ID NO: 3829855 - RNA, 21 nt, Human
cucauuucaggagcagccuca

SEQ ID NO: 3829856 - RNA, 13 nt, Human
cucauuuccaagc

SEQ ID NO: 3829857 - RNA, 21 nt, Human
cucauuuccaagcaaguauua

SEQ ID NO: 3829858 - RNA, 17 nt, Human
cucauuugggguagcua

SEQ ID NO: 3829859 - RNA, 22 nt, Human
cucauuugguuugauuuucccu

SEQ ID NO: 3829860 - RNA, 21 nt, Human
cucauuugucacacacuuugg

SEQ ID NO: 3829861 - RNA, 15 nt, Human
cucauuuguuuuucu

SEQ ID NO: 3829862 - RNA, 13 nt, Human
cucauuuuaaugu

SEQ ID NO: 3829863 - RNA, 21 nt, Human
cucauuuuaauguaaagauuu

SEQ ID NO: 3829864 - RNA, 23 nt, Human
cucauuuuuauaaugucccuuca

SEQ ID NO: 3829865 - RNA, 23 nt, Human
cucauuuuugccauacaucaguu

SEQ ID NO: 3829866 - RNA, 13 nt, Human
cucauuuuuuaaa

SEQ ID NO: 3829867 - RNA, 18 nt, Human
cucauuuuuuuaauuuau

SEQ ID NO: 3829868 - RNA, 21 nt, Human
cuccaaaaaaaaaaaaaauac

SEQ ID NO: 3829869 - RNA, 16 nt, Human
cuccaaaaaucugccu

SEQ ID NO: 3829870 - RNA, 15 nt, Human
cuccaaaagcacuua

SEQ ID NO: 3829871 - RNA, 16 nt, Human
cuccaaaagcacuuac

SEQ ID NO: 3829872 - RNA, 16 nt, Human
cuccaaaaugugccua

SEQ ID NO: 3829873 - RNA, 13 nt, Human
cuccaaaccacuu

SEQ ID NO: 3829874 - RNA, 22 nt, Human
cuccaaaccacuuuuugcagcu

SEQ ID NO: 3829875 - RNA, 15 nt, Human
cuccaaacccucgag

SEQ ID NO: 3829876 - RNA, 17 nt, Human
cuccaaacccucgaggc

SEQ ID NO: 3829877 - RNA, 21 nt, Human
cuccaaacccucgaggcggau

SEQ ID NO: 3829878 - RNA, 22 nt, Human
cuccaaaccuccuguuagcugu

SEQ ID NO: 3829879 - RNA, 15 nt, Human
cuccaaaccuucaca

SEQ ID NO: 3829880 - RNA, 21 nt, Human
cuccaaaccuucacacacaga

SEQ ID NO: 3829881 - RNA, 18 nt, Human
cuccaaacugaagcagcc

SEQ ID NO: 3829882 - RNA, 22 nt, Human
cuccaaacugaagcagccucuc

SEQ ID NO: 3829883 - RNA, 11 nt, Human
cuccaaagcuu

SEQ ID NO: 3829884 - RNA, 17 nt, Human
cuccaaagucauaauug

SEQ ID NO: 3829885 - RNA, 23 nt, Human
cuccaaagucauaauugcauuga

SEQ ID NO: 3829886 - RNA, 23 nt, Human
cuccaaaucucaaugaagccagc

SEQ ID NO: 3829887 - RNA, 22 nt, Human
cuccaaauggagaagcugcagg

SEQ ID NO: 3829888 - RNA, 20 nt, Human
cuccaacacaaggcuccaag

SEQ ID NO: 3829889 - RNA, 21 nt, Human
cuccaacacaaggcuccaaga

SEQ ID NO: 3829890 - RNA, 16 nt, Human
cuccaacaccaagcac

SEQ ID NO: 3829891 - RNA, 23 nt, Human
cuccaacaccaagcacagcagcc

SEQ ID NO: 3829892 - RNA, 21 nt, Human
cuccaacaccaccucuccaga

SEQ ID NO: 3829893 - RNA, 15 nt, Human
cuccaaccccccagc

SEQ ID NO: 3829894 - RNA, 15 nt, Human
cuccaaccccucgcc

SEQ ID NO: 3829895 - RNA, 18 nt, Human
cuccaacccuagcaaaag

SEQ ID NO: 3829896 - RNA, 12 nt, Human
cuccaacccugc

SEQ ID NO: 3829897 - RNA, 22 nt, Human
cuccaacccugccgucaccacc

SEQ ID NO: 3829898 - RNA, 19 nt, Human
cuccaaccuaaccuguguc

SEQ ID NO: 3829899 - RNA, 16 nt, Human
cuccaacucagaaggg

SEQ ID NO: 3829900 - RNA, 12 nt, Human
cuccaacuccaa

SEQ ID NO: 3829901 - RNA, 15 nt, Human
cuccaagaaugcuga

SEQ ID NO: 3829902 - RNA, 16 nt, Human
cuccaagaaugcugaa

SEQ ID NO: 3829903 - RNA, 14 nt, Human
cuccaagaauuucu

SEQ ID NO: 3829904 - RNA, 16 nt, Human
cuccaagaccuucucc

SEQ ID NO: 3829905 - RNA, 18 nt, Human
cuccaagaccuucuccuu

SEQ ID NO: 3829906 - RNA, 20 nt, Human
cuccaagagcuacauaauuu

SEQ ID NO: 3829907 - RNA, 13 nt, Human
cuccaagauucua

SEQ ID NO: 3829908 - RNA, 15 nt, Human
cuccaagauucuaga

SEQ ID NO: 3829909 - RNA, 17 nt, Human
cuccaagauucuagaug

SEQ ID NO: 3829910 - RNA, 13 nt, Human
cuccaagcagcuu

SEQ ID NO: 3829911 - RNA, 13 nt, Human
cuccaagcaggac

SEQ ID NO: 3829912 - RNA, 13 nt, Human
cuccaagccagcg

SEQ ID NO: 3829913 - RNA, 23 nt, Human
cuccaagcccaguucagcuuggg

SEQ ID NO: 3829914 - RNA, 19 nt, Human
cuccaagcuccaucuccac

SEQ ID NO: 3829915 - RNA, 13 nt, Human
cuccaagcuccca

SEQ ID NO: 3829916 - RNA, 15 nt, Human
cuccaagcucccagg

SEQ ID NO: 3829917 - RNA, 12 nt, Human
cuccaaggacca

SEQ ID NO: 3829918 - RNA, 15 nt, Human
cuccaaggaccaggu

SEQ ID NO: 3829919 - RNA, 19 nt, Human
cuccaaggaggggcuguaa

SEQ ID NO: 3829920 - RNA, 20 nt, Human
cuccaaggaggggcuguaaa

SEQ ID NO: 3829921 - RNA, 19 nt, Human
cuccaagggcuucugcacc

SEQ ID NO: 3829922 - RNA, 20 nt, Human
cuccaagggcuucugcaccc

SEQ ID NO: 3829923 - RNA, 22 nt, Human
cuccaaguccacaguggaacca

SEQ ID NO: 3829924 - RNA, 23 nt, Human
cuccaaguccacaguggaaccag

SEQ ID NO: 3829925 - RNA, 14 nt, Human
cuccaagugccaga

SEQ ID NO: 3829926 - RNA, 16 nt, Human
cuccaagugccagagg

SEQ ID NO: 3829927 - RNA, 15 nt, Human
cuccaauccugcccc

SEQ ID NO: 3829928 - RNA, 19 nt, Human
cuccaaugucugcugagga

SEQ ID NO: 3829929 - RNA, 22 nt, Human
cuccaauuaaggauuuuaugcu

SEQ ID NO: 3829930 - RNA, 19 nt, Human
cuccaauuuuuuuuuccuu

SEQ ID NO: 3829931 - RNA, 15 nt, Human
cuccacacaagggaa

SEQ ID NO: 3829932 - RNA, 21 nt, Human
cuccacacaagggaaggacag

SEQ ID NO: 3829933 - RNA, 21 nt, Human
cuccacacacacaaaaaaaga

SEQ ID NO: 3829934 - RNA, 13 nt, Human
cuccacacccgcg

SEQ ID NO: 3829935 - RNA, 19 nt, Human
cuccacacccgcgccccgc

SEQ ID NO: 3829936 - RNA, 20 nt, Human
cuccacacccucucccagga

SEQ ID NO: 3829937 - RNA, 12 nt, Human
cuccacaccugc

SEQ ID NO: 3829938 - RNA, 14 nt, Human
cuccacacugcaca

SEQ ID NO: 3829939 - RNA, 15 nt, Human
cuccacacugcacaa

SEQ ID NO: 3829940 - RNA, 16 nt, Human
cuccacagcaacccca

SEQ ID NO: 3829941 - RNA, 23 nt, Human
cuccacagccaucccagccuugg

SEQ ID NO: 3829942 - RNA, 13 nt, Human
cuccacagcgagg

SEQ ID NO: 3829943 - RNA, 16 nt, Human
cuccacagcgagggca

SEQ ID NO: 3829944 - RNA, 21 nt, Human
cuccacagcgagggcagcugc

SEQ ID NO: 3829945 - RNA, 12 nt, Human
cuccacagggcc

SEQ ID NO: 3829946 - RNA, 17 nt, Human
cuccacauccuccacgu

SEQ ID NO: 3829947 - RNA, 22 nt, Human
cuccacauccuuucuaaacaag

SEQ ID NO: 3829948 - RNA, 14 nt, Human
cuccacaucugccu

SEQ ID NO: 3829949 - RNA, 23 nt, Human
cuccaccaagccuggucagccca

SEQ ID NO: 3829950 - RNA, 13 nt, Human
cuccaccaccgcc

SEQ ID NO: 3829951 - RNA, 14 nt, Human
cuccaccaccgccc

SEQ ID NO: 3829952 - RNA, 19 nt, Human
cuccaccaccgcccgucug

SEQ ID NO: 3829953 - RNA, 13 nt, Human
cuccaccaggaac

SEQ ID NO: 3829954 - RNA, 14 nt, Human
cuccaccccacuca

SEQ ID NO: 3829955 - RNA, 18 nt, Human
cuccaccccacucacaga

SEQ ID NO: 3829956 - RNA, 13 nt, Human
cuccaccccagga

SEQ ID NO: 3829957 - RNA, 17 nt, Human
cuccacccccagcugcu

SEQ ID NO: 3829958 - RNA, 18 nt, Human
cuccacccccagcugcuu

SEQ ID NO: 3829959 - RNA, 14 nt, Human
cuccacccucugag

SEQ ID NO: 3829960 - RNA, 15 nt, Human
cuccacccuggccga

SEQ ID NO: 3829961 - RNA, 23 nt, Human
cuccacccugucccccagcucug

SEQ ID NO: 3829962 - RNA, 21 nt, Human
cuccacccuuggccugucuca

SEQ ID NO: 3829963 - RNA, 16 nt, Human
cuccaccgccauggcu

SEQ ID NO: 3829964 - RNA, 20 nt, Human
cuccaccgccauggcuucca

SEQ ID NO: 3829965 - RNA, 14 nt, Human
cuccaccgcugccu

SEQ ID NO: 3829966 - RNA, 12 nt, Human
cuccaccuacca

SEQ ID NO: 3829967 - RNA, 16 nt, Human
cuccaccucagccuug

SEQ ID NO: 3829968 - RNA, 18 nt, Human
cuccaccucagccuugga

SEQ ID NO: 3829969 - RNA, 23 nt, Human
cuccaccucccugcaauaaaaug

SEQ ID NO: 3829970 - RNA, 13 nt, Human
cuccaccugccag

SEQ ID NO: 3829971 - RNA, 14 nt, Human
cuccaccugccagg

SEQ ID NO: 3829972 - RNA, 15 nt, Human
cuccaccugccaggg

SEQ ID NO: 3829973 - RNA, 18 nt, Human
cuccaccugcucccaggc

SEQ ID NO: 3829974 - RNA, 12 nt, Human
cuccaccuuccc

SEQ ID NO: 3829975 - RNA, 23 nt, Human
cuccacgauccugccacccugua

SEQ ID NO: 3829976 - RNA, 16 nt, Human
cuccacguucaccccu

SEQ ID NO: 3829977 - RNA, 21 nt, Human
ccauagaugggucuggcugag

SEQ ID NO: 3829978 - RNA, 18 nt, Human
ccauagcaagauugcuua

SEQ ID NO: 3829979 - RNA, 18 nt, Human
ccauaggcccacacacag

SEQ ID NO: 3829980 - RNA, 15 nt, Human
ccauagguagaaugu

SEQ ID NO: 3829981 - RNA, 14 nt, Human
ccauaguaguauga

SEQ ID NO: 3829982 - RNA, 17 nt, Human
ccauaguauauuaaaaa

SEQ ID NO: 3829983 - RNA, 16 nt, Human
ccauagucaaagagag

SEQ ID NO: 3829984 - RNA, 18 nt, Human
ccauagucuuaacugguc

SEQ ID NO: 3829985 - RNA, 14 nt, Human
ccauagugacuuuu

SEQ ID NO: 3829986 - RNA, 19 nt, Human
ccauaguuaaagaagacau

SEQ ID NO: 3829987 - RNA, 16 nt, Human
ccauauaaguuugaag

SEQ ID NO: 3829988 - RNA, 14 nt, Human
ccauauacuuuaaa

SEQ ID NO: 3829989 - RNA, 21 nt, Human
ccauauauaacagauacauuu

SEQ ID NO: 3829990 - RNA, 15 nt, Human
ccauauauccuuuuc

SEQ ID NO: 3829991 - RNA, 21 nt, Human
ccauaucaaaagacacagggg

SEQ ID NO: 3829992 - RNA, 21 nt, Human
ccauaucacacacauugcugu

SEQ ID NO: 3829993 - RNA, 18 nt, Human
ccauauccccucuccccc

SEQ ID NO: 3829994 - RNA, 12 nt, Human
ccauauccuggu

SEQ ID NO: 3829995 - RNA, 14 nt, Human
ccauaucuugcgaa

SEQ ID NO: 3829996 - RNA, 21 nt, Human
ccauaucuugcgaauccaagc

SEQ ID NO: 3829997 - RNA, 15 nt, Human
ccauaugaauaacau

SEQ ID NO: 3829998 - RNA, 14 nt, Human
ccauaugaauugua

SEQ ID NO: 3829999 - RNA, 15 nt, Human
ccauaugaucuguuu

SEQ ID NO: 3830000 - RNA, 13 nt, Human
ccauauggauauu

SEQ ID NO: 3830001 - RNA, 22 nt, Human
ccauauggauuuucuauuguua

SEQ ID NO: 3830002 - RNA, 20 nt, Human
ccauauuaaauuuuuuguug

SEQ ID NO: 3830003 - RNA, 22 nt, Human
ccauauuaaauuuuuuguugac

SEQ ID NO: 3830004 - RNA, 19 nt, Human
ccauauuaccacagacaua

SEQ ID NO: 3830005 - RNA, 20 nt, Human
ccauauuagaaaacuuuguu

SEQ ID NO: 3830006 - RNA, 18 nt, Human
ccauauucuguuggccag

SEQ ID NO: 3830007 - RNA, 19 nt, Human
ccauauucuguuggccagu

SEQ ID NO: 3830008 - RNA, 23 nt, Human
ccauauucuguuggccaguguga

SEQ ID NO: 3830009 - RNA, 22 nt, Human
ccauauuggcauggauuucugu

SEQ ID NO: 3830010 - RNA, 14 nt, Human
ccauauuguaaaac

SEQ ID NO: 3830011 - RNA, 18 nt, Human
ccauauuguaaaacaggu

SEQ ID NO: 3830012 - RNA, 21 nt, Human
ccauauugugcuucacaguag

SEQ ID NO: 3830013 - RNA, 15 nt, Human
ccauauuuaccucag

SEQ ID NO: 3830014 - RNA, 17 nt, Human
ccauauuuaccucagcc

SEQ ID NO: 3830015 - RNA, 21 nt, Human
ccauauuuaccucagccuggg

SEQ ID NO: 3830016 - RNA, 18 nt, Human
ccauauuuacuaccuuau

SEQ ID NO: 3830017 - RNA, 14 nt, Human
ccauauuuggaaga

SEQ ID NO: 3830018 - RNA, 13 nt, Human
ccauauuuguaaa

SEQ ID NO: 3830019 - RNA, 14 nt, Human
ccauauuuguaaaa

SEQ ID NO: 3830020 - RNA, 19 nt, Human
ccauauuuguaaaaugaca

SEQ ID NO: 3830021 - RNA, 16 nt, Human
ccaucaagccaccaac

SEQ ID NO: 3830022 - RNA, 16 nt, Human
ccaucaaguugugcca

SEQ ID NO: 3830023 - RNA, 16 nt, Human
ccaucacaauacagau

SEQ ID NO: 3830024 - RNA, 17 nt, Human
ccaucacaauacagaua

SEQ ID NO: 3830025 - RNA, 15 nt, Human
ccaucacagcuuguu

SEQ ID NO: 3830026 - RNA, 13 nt, Human
ccaucacaggguu

SEQ ID NO: 3830027 - RNA, 13 nt, Human
ccaucaccagaca

SEQ ID NO: 3830028 - RNA, 13 nt, Human
ccaucacccucuu

SEQ ID NO: 3830029 - RNA, 18 nt, Human
ccaucacccucuuccugu

SEQ ID NO: 3830030 - RNA, 16 nt, Human
ccaucaccucagaugg

SEQ ID NO: 3830031 - RNA, 19 nt, Human
ccaucaccuuagaccacca

SEQ ID NO: 3830032 - RNA, 19 nt, Human
ccaucacgcggccgagaca

SEQ ID NO: 3830033 - RNA, 18 nt, Human
ccaucacugcgccacugc

SEQ ID NO: 3830034 - RNA, 18 nt, Human
ccaucagaaacacccuca

SEQ ID NO: 3830035 - RNA, 20 nt, Human
ccaucagaaacacccucaca

SEQ ID NO: 3830036 - RNA, 22 nt, Human
ccaucagaaacacccucacacu

SEQ ID NO: 3830037 - RNA, 12 nt, Human
ccaucagaggcc

SEQ ID NO: 3830038 - RNA, 12 nt, Human
ccaucagcccaa

SEQ ID NO: 3830039 - RNA, 19 nt, Human
ccaucaggguucucuuagc

SEQ ID NO: 3830040 - RNA, 20 nt, Human
ccaucaggguucucuuagca

SEQ ID NO: 3830041 - RNA, 17 nt, Human
ccaucagguuccauccc

SEQ ID NO: 3830042 - RNA, 12 nt, Human
ccaucagugcuc

SEQ ID NO: 3830043 - RNA, 17 nt, Human
ccaucagugcucccuca

SEQ ID NO: 3830044 - RNA, 14 nt, Human
ccaucaucccagcu

SEQ ID NO: 3830045 - RNA, 16 nt, Human
ccaucaugcccggucc

SEQ ID NO: 3830046 - RNA, 16 nt, Human
ccaucaugucuggcua

SEQ ID NO: 3830047 - RNA, 19 nt, Human
ccaucauuacccuucccug

SEQ ID NO: 3830048 - RNA, 12 nt, Human
ccaucauugaaa

SEQ ID NO: 3830049 - RNA, 17 nt, Human
ccauccacaugggagcc

SEQ ID NO: 3830050 - RNA, 16 nt, Human
ccauccacucuacccu

SEQ ID NO: 3830051 - RNA, 19 nt, Human
ccauccacucuacccuccc

SEQ ID NO: 3830052 - RNA, 16 nt, Human
ccauccagcuugccag

SEQ ID NO: 3830053 - RNA, 12 nt, Human
ccauccaggcag

SEQ ID NO: 3830054 - RNA, 13 nt, Human
ccauccaggcagu

SEQ ID NO: 3830055 - RNA, 21 nt, Human
ccauccagggaugccaucugu

SEQ ID NO: 3830056 - RNA, 18 nt, Human
ccauccagugacaaacca

SEQ ID NO: 3830057 - RNA, 17 nt, Human
ccauccauggccagcag

SEQ ID NO: 3830058 - RNA, 23 nt, Human
ccaucccaaacccuucagugcca

SEQ ID NO: 3830059 - RNA, 16 nt, Human
ccaucccacacccugg

SEQ ID NO: 3830060 - RNA, 21 nt, Human
ccaucccagagggugggcuuc

SEQ ID NO: 3830061 - RNA, 14 nt, Human
ccaucccagcccca

SEQ ID NO: 3830062 - RNA, 15 nt, Human
ccaucccagccuugg

SEQ ID NO: 3830063 - RNA, 22 nt, Human
ccaucccaggacaccacaccca

SEQ ID NO: 3830064 - RNA, 21 nt, Human
ccaucccauaugccugggcag

SEQ ID NO: 3830065 - RNA, 13 nt, Human
ccauccccagcga

SEQ ID NO: 3830066 - RNA, 17 nt, Human
ccauccccauccuccag

SEQ ID NO: 3830067 - RNA, 14 nt, Human
ccauccccgcagug

SEQ ID NO: 3830068 - RNA, 17 nt, Human
ccauccccgcagugugc

SEQ ID NO: 3830069 - RNA, 13 nt, Human
ccauccccuggac

SEQ ID NO: 3830070 - RNA, 15 nt, Human
ccauccccuggacug

SEQ ID NO: 3830071 - RNA, 22 nt, Human
ccauccccuguagagugggagc

SEQ ID NO: 3830072 - RNA, 14 nt, Human
ccaucccucccucc

SEQ ID NO: 3830073 - RNA, 15 nt, Human
ccaucccugaaggcc

SEQ ID NO: 3830074 - RNA, 14 nt, Human
ccaucccugccugg

SEQ ID NO: 3830075 - RNA, 23 nt, Human
ccauccgguuugccauguugcca

SEQ ID NO: 3830076 - RNA, 21 nt, Human
ccauccuaaucauccaaugcu

SEQ ID NO: 3830077 - RNA, 20 nt, Human
ccauccuaccaaugcaugca

SEQ ID NO: 3830078 - RNA, 16 nt, Human
ccauccuaggcugaca

SEQ ID NO: 3830079 - RNA, 16 nt, Human
ccauccuccagcaggg

SEQ ID NO: 3830080 - RNA, 13 nt, Human
ccauccuccagcu

SEQ ID NO: 3830081 - RNA, 21 nt, Human
ccauccuccccuucccugcaa

SEQ ID NO: 3830082 - RNA, 14 nt, Human
ccauccuccuggga

SEQ ID NO: 3830083 - RNA, 19 nt, Human
ccauccucuguacagagcc

SEQ ID NO: 3830084 - RNA, 12 nt, Human
ccauccugacca

SEQ ID NO: 3830085 - RNA, 15 nt, Human
ccauccugaggcucc

SEQ ID NO: 3830086 - RNA, 15 nt, Human
ccauccugcagccuc

SEQ ID NO: 3830087 - RNA, 21 nt, Human
ccauccugcagccuccuccug

SEQ ID NO: 3830088 - RNA, 17 nt, Human
ccauccuggcccagggc

SEQ ID NO: 3830089 - RNA, 18 nt, Human
ccauccuggcccagggca

SEQ ID NO: 3830090 - RNA, 19 nt, Human
ccauccugggacggcggca

SEQ ID NO: 3830091 - RNA, 14 nt, Human
ccauccugucccac

SEQ ID NO: 3830092 - RNA, 22 nt, Human
ccauccuguguguuaagcucug

SEQ ID NO: 3830093 - RNA, 16 nt, Human
ccauccuuucugccuc

SEQ ID NO: 3830094 - RNA, 17 nt, Human
ccauccuuucugccucu

SEQ ID NO: 3830095 - RNA, 19 nt, Human
ccaucgccagcugaugacu

SEQ ID NO: 3830096 - RNA, 16 nt, Human
ccaucgguccugucuc

SEQ ID NO: 3830097 - RNA, 18 nt, Human
ccaucgguccugucuccc

SEQ ID NO: 3830098 - RNA, 21 nt, Human
ccaucguugcccccauuucug

SEQ ID NO: 3830099 - RNA, 15 nt, Human
ccaucuaaaaauaua

SEQ ID NO: 3830100 - RNA, 15 nt, Human
ccaucuaaacugccc

SEQ ID NO: 3830101 - RNA, 17 nt, Human
ccaucuaagcugcagcu

SEQ ID NO: 3830102 - RNA, 20 nt, Human
ccaucuaagcugcagcuucc

SEQ ID NO: 3830103 - RNA, 21 nt, Human
ccaucuaagcugcagcuuccu

SEQ ID NO: 3830104 - RNA, 15 nt, Human
ccaucuacccuccga

SEQ ID NO: 3830105 - RNA, 21 nt, Human
ccaucuagacuagcaaucucu

SEQ ID NO: 3830106 - RNA, 17 nt, Human
ccaucuaguacuugaaa

SEQ ID NO: 3830107 - RNA, 14 nt, Human
ccaucucacacaug

SEQ ID NO: 3830108 - RNA, 20 nt, Human
ccaucucaggccaccugccc

SEQ ID NO: 3830109 - RNA, 22 nt, Human
ccaucucaggccaccugccccc

SEQ ID NO: 3830110 - RNA, 20 nt, Human
ccaucucaugaggggagagg

SEQ ID NO: 3830111 - RNA, 21 nt, Human
ccaucucaugccccuggcugg

SEQ ID NO: 3830112 - RNA, 20 nt, Human
ccaucucauguaucaucugg

SEQ ID NO: 3830113 - RNA, 22 nt, Human
ccaucuccaagaaugcugaaac

SEQ ID NO: 3830114 - RNA, 17 nt, Human
ccaucucccacccugua

SEQ ID NO: 3830115 - RNA, 17 nt, Human
ccaucuccccucagcuc

SEQ ID NO: 3830116 - RNA, 22 nt, Human
ccaucuccuauaaucugucaaa

SEQ ID NO: 3830117 - RNA, 21 nt, Human
ccaucucggagcaucccggag

SEQ ID NO: 3830118 - RNA, 23 nt, Human
ccaucucucccuccccugccauu

SEQ ID NO: 3830119 - RNA, 15 nt, Human
ccaucucuccuccuu

SEQ ID NO: 3830120 - RNA, 14 nt, Human
ccaucucucuggcc

SEQ ID NO: 3830121 - RNA, 19 nt, Human
ccaucucugaacuucagcu

SEQ ID NO: 3830122 - RNA, 13 nt, Human
ccaucucugcucc

SEQ ID NO: 3830123 - RNA, 15 nt, Human
ccaucucuggaugcc

SEQ ID NO: 3830124 - RNA, 22 nt, Human
ccaucucuggaugccugauugc

SEQ ID NO: 3830125 - RNA, 21 nt, Human
ccaucucuuccuacccaacca

SEQ ID NO: 3830126 - RNA, 15 nt, Human
ccaucucuuccuuga

SEQ ID NO: 3830127 - RNA, 14 nt, Human
cucacccccagcuu

SEQ ID NO: 3830128 - RNA, 18 nt, Human
cucacccccagcuuugcu

SEQ ID NO: 3830129 - RNA, 22 nt, Human
cucacccccucccacccccagc

SEQ ID NO: 3830130 - RNA, 15 nt, Human
cucacccccuccuuc

SEQ ID NO: 3830131 - RNA, 21 nt, Human
cucacccccucgggucuccuc

SEQ ID NO: 3830132 - RNA, 16 nt, Human
cucacccccuucucca

SEQ ID NO: 3830133 - RNA, 21 nt, Human
cucacccccuucuccauccac

SEQ ID NO: 3830134 - RNA, 20 nt, Human
cucccuggcugcccuggccc

SEQ ID NO: 3830135 - RNA, 13 nt, Human
cucccuggcuucu

SEQ ID NO: 3830136 - RNA, 19 nt, Human
cucccuggcuucugugggg

SEQ ID NO: 3830137 - RNA, 11 nt, Human
cucccuggguu

SEQ ID NO: 3830138 - RNA, 13 nt, Human
cucccuguaacuu

SEQ ID NO: 3830139 - RNA, 15 nt, Human
cucccuguaacuuga

SEQ ID NO: 3830140 - RNA, 21 nt, Human
cucccuguaggaagucauccu

SEQ ID NO: 3830141 - RNA, 22 nt, Human
cucccuguaggguccaaccaga

SEQ ID NO: 3830142 - RNA, 16 nt, Human
cucccuguccuccucg

SEQ ID NO: 3830143 - RNA, 18 nt, Human
cucccuguccuccucgga

SEQ ID NO: 3830144 - RNA, 15 nt, Human
cucccugugccccca

SEQ ID NO: 3830145 - RNA, 24 nt, Human
cucccuguuauuuucaaguagcug

SEQ ID NO: 3830146 - RNA, 18 nt, Human
cucccuguuccccagaga

SEQ ID NO: 3830147 - RNA, 19 nt, Human
cucccuguugaagcucugg

SEQ ID NO: 3830148 - RNA, 21 nt, Human
cucccuguugacgaagucucu

SEQ ID NO: 3830149 - RNA, 12 nt, Human
cucccuguuuga

SEQ ID NO: 3830150 - RNA, 11 nt, Human
cucccuuaccc

SEQ ID NO: 3830151 - RNA, 12 nt, Human
cucccuucaacc

SEQ ID NO: 3830152 - RNA, 18 nt, Human
cucccuucaaccauuccc

SEQ ID NO: 3830153 - RNA, 21 nt, Human
cucccuucaaccauuccccau

SEQ ID NO: 3830154 - RNA, 14 nt, Human
cucccuucccaccu

SEQ ID NO: 3830155 - RNA, 23 nt, Human
cucccuucccaccucucucacuc

SEQ ID NO: 3830156 - RNA, 15 nt, Human
cucccuucccuccuc

SEQ ID NO: 3830157 - RNA, 23 nt, Human
cucccuuccgacccucugggaac

SEQ ID NO: 3830158 - RNA, 13 nt, Human
cucccuuccucuu

SEQ ID NO: 3830159 - RNA, 12 nt, Human
cucccuuccuuu

SEQ ID NO: 3830160 - RNA, 17 nt, Human
cucccuucuaccugcca

SEQ ID NO: 3830161 - RNA, 16 nt, Human
cucccuucucuucaca

SEQ ID NO: 3830162 - RNA, 17 nt, Human
cucccuugaccugcuga

SEQ ID NO: 3830163 - RNA, 22 nt, Human
cucccuugccuuucgaggccug

SEQ ID NO: 3830164 - RNA, 23 nt, Human
cucccuugccuuucgaggccuga

SEQ ID NO: 3830165 - RNA, 12 nt, Human
cucccuugcugg

SEQ ID NO: 3830166 - RNA, 15 nt, Human
cucccuugcuggccc

SEQ ID NO: 3830167 - RNA, 22 nt, Human
cucccuugcuggccccagcccu

SEQ ID NO: 3830168 - RNA, 23 nt, Human
cucccuugcuggccccagcccug

SEQ ID NO: 3830169 - RNA, 18 nt, Human
cucccuuggaaaccugcc

SEQ ID NO: 3830170 - RNA, 20 nt, Human
cucccuuggaaaccugcccu

SEQ ID NO: 3830171 - RNA, 22 nt, Human
cucccuuggaaaccugcccugc

SEQ ID NO: 3830172 - RNA, 20 nt, Human
cucccuuggauuguccccga

SEQ ID NO: 3830173 - RNA, 13 nt, Human
cucccuugggcuc

SEQ ID NO: 3830174 - RNA, 19 nt, Human
cucccuugggcucugauga

SEQ ID NO: 3830175 - RNA, 22 nt, Human
cucccuuggggccuaugcagag

SEQ ID NO: 3830176 - RNA, 17 nt, Human
cucccuuggguucugau

SEQ ID NO: 3830177 - RNA, 12 nt, Human
cucccuuucaac

SEQ ID NO: 3830178 - RNA, 14 nt, Human
cucccuuucccuuc

SEQ ID NO: 3830179 - RNA, 12 nt, Human
cucccuuucucc

SEQ ID NO: 3830180 - RNA, 23 nt, Human
cucccuuucuccccugcccccag

SEQ ID NO: 3830181 - RNA, 16 nt, Human
cucccuuuuuccuugu

SEQ ID NO: 3830182 - RNA, 16 nt, Human
cucagugccaacugug

SEQ ID NO: 3830183 - RNA, 19 nt, Human
cucaguggacuuuccaccc

SEQ ID NO: 3830184 - RNA, 21 nt, Human
cucaguggcuucaucugucaa

SEQ ID NO: 3830185 - RNA, 12 nt, Human
cucaguguauuu

SEQ ID NO: 3830186 - RNA, 17 nt, Human
cucaguguauuuguauu

SEQ ID NO: 3830187 - RNA, 22 nt, Human
cucagugucauuuaugaaaaga

SEQ ID NO: 3830188 - RNA, 20 nt, Human
cucagugucuggcugcagag

SEQ ID NO: 3830189 - RNA, 19 nt, Human
cucaguguugguauauuuu

SEQ ID NO: 3830190 - RNA, 21 nt, Human
cucaguguugguauauuuuau

SEQ ID NO: 3830191 - RNA, 22 nt, Human
cucaguguugguauauuuuaua

SEQ ID NO: 3830192 - RNA, 17 nt, Human
cucaguguuuuggacuc

SEQ ID NO: 3830193 - RNA, 23 nt, Human
cucaguguuuuggacuccaucuc

SEQ ID NO: 3830194 - RNA, 15 nt, Human
cucaguucagaauca

SEQ ID NO: 3830195 - RNA, 18 nt, Human
cucaguucauccauucua

SEQ ID NO: 3830196 - RNA, 19 nt, Human
cucaguucccuuggccuca

SEQ ID NO: 3830197 - RNA, 21 nt, Human
cucaguucccuuggccucaga

SEQ ID NO: 3830198 - RNA, 22 nt, Human
cucaguucccuuggccucagaa

SEQ ID NO: 3830199 - RNA, 20 nt, Human
cucaguuccgauuucccagg

SEQ ID NO: 3830200 - RNA, 21 nt, Human
cucaguuccugcagcagagcc

SEQ ID NO: 3830201 - RNA, 19 nt, Human
cucaguucuagucucucug

SEQ ID NO: 3830202 - RNA, 16 nt, Human
cucaguucucuucacu

SEQ ID NO: 3830203 - RNA, 17 nt, Human
cucaguucuugccacuu

SEQ ID NO: 3830204 - RNA, 16 nt, Human
cucaguugauuuucug

SEQ ID NO: 3830205 - RNA, 20 nt, Human
cucaguugauuuucuggauu

SEQ ID NO: 3830206 - RNA, 13 nt, Human
cucaguugcagcc

SEQ ID NO: 3830207 - RNA, 21 nt, Human
cucaguuggaaauaauaaaag

SEQ ID NO: 3830208 - RNA, 14 nt, Human
cucaguuguagaau

SEQ ID NO: 3830209 - RNA, 18 nt, Human
cucaguuuaauccuucua

SEQ ID NO: 3830210 - RNA, 15 nt, Human
cucaguuucuugcuu

SEQ ID NO: 3830211 - RNA, 15 nt, Human
cucaguuuuuuuccu

SEQ ID NO: 3830212 - RNA, 17 nt, Human
cucauaaaaagcaaaac

SEQ ID NO: 3830213 - RNA, 21 nt, Human
cucauaaaaagccugcaauuu

SEQ ID NO: 3830214 - RNA, 20 nt, Human
cucauaagcuacugaugaga

SEQ ID NO: 3830215 - RNA, 14 nt, Human
cucauaaugugaag

SEQ ID NO: 3830216 - RNA, 12 nt, Human
cucauaauuccu

SEQ ID NO: 3830217 - RNA, 21 nt, Human
cucauaauuccuacagcacua

SEQ ID NO: 3830218 - RNA, 22 nt, Human
cucauaauuuauacaggucaua

SEQ ID NO: 3830219 - RNA, 19 nt, Human
cucauacccacccccaccc

SEQ ID NO: 3830220 - RNA, 17 nt, Human
cucauacccucccuccc

SEQ ID NO: 3830221 - RNA, 14 nt, Human
cucauaccucugac

SEQ ID NO: 3830222 - RNA, 15 nt, Human
cucauaccucugacc

SEQ ID NO: 3830223 - RNA, 21 nt, Human
cucauaccucugaccaacagg

SEQ ID NO: 3830224 - RNA, 17 nt, Human
cucauacguccaccaug

SEQ ID NO: 3830225 - RNA, 18 nt, Human
cucauagacacugaucug

SEQ ID NO: 3830226 - RNA, 15 nt, Human
cucauagcacuuccc

SEQ ID NO: 3830227 - RNA, 13 nt, Human
cucauagcccuca

SEQ ID NO: 3830228 - RNA, 20 nt, Human
cucauaguaugguggcuggg

SEQ ID NO: 3830229 - RNA, 13 nt, Human
cucauauaagaca

SEQ ID NO: 3830230 - RNA, 20 nt, Human
cucauauccccuauuuaaca

SEQ ID NO: 3830231 - RNA, 18 nt, Human
cucauauggcccaguguc

SEQ ID NO: 3830232 - RNA, 20 nt, Human
cucauauggucuaccaguuu

SEQ ID NO: 3830233 - RNA, 15 nt, Human
cucauauuccugcag

SEQ ID NO: 3830234 - RNA, 20 nt, Human
cucauauuccugcagccugg

SEQ ID NO: 3830235 - RNA, 13 nt, Human
cucauauugugau

SEQ ID NO: 3830236 - RNA, 19 nt, Human
cucauauugugauucugcc

SEQ ID NO: 3830237 - RNA, 21 nt, Human
cucauauugugauucugccuu

SEQ ID NO: 3830238 - RNA, 13 nt, Human
cucauauuuaaag

SEQ ID NO: 3830239 - RNA, 16 nt, Human
cucauauuuuguauau

SEQ ID NO: 3830240 - RNA, 15 nt, Human
cucaucaacaaagaa

SEQ ID NO: 3830241 - RNA, 17 nt, Human
cucaucaaucaaauaag

SEQ ID NO: 3830242 - RNA, 15 nt, Human
cucaucacacacaug

SEQ ID NO: 3830243 - RNA, 22 nt, Human
cucaucaccaacgucugugcca

SEQ ID NO: 3830244 - RNA, 20 nt, Human
cucaucaggaugaacccagg

SEQ ID NO: 3830245 - RNA, 15 nt, Human
cucaucauaaaauaa

SEQ ID NO: 3830246 - RNA, 18 nt, Human
cucaucaucaacccuaaa

SEQ ID NO: 3830247 - RNA, 18 nt, Human
cucaucauucucugucuc

SEQ ID NO: 3830248 - RNA, 14 nt, Human
cucaucauuugugg

SEQ ID NO: 3830249 - RNA, 15 nt, Human
cucauccaccccauc

SEQ ID NO: 3830250 - RNA, 16 nt, Human
cucauccaccccaucc

SEQ ID NO: 3830251 - RNA, 19 nt, Human
cucauccaccccaucccuc

SEQ ID NO: 3830252 - RNA, 16 nt, Human
cucauccaucaucaug

SEQ ID NO: 3830253 - RNA, 19 nt, Human
cucauccaucaucaugugu

SEQ ID NO: 3830254 - RNA, 13 nt, Human
cucauccccaggg

SEQ ID NO: 3830255 - RNA, 23 nt, Human
cucauccccaggggucccagcca

SEQ ID NO: 3830256 - RNA, 23 nt, Human
cucauccuccaguaccuugcuuc

SEQ ID NO: 3830257 - RNA, 15 nt, Human
cucauccuccuggaa

SEQ ID NO: 3830258 - RNA, 12 nt, Human
cucauccuccuu

SEQ ID NO: 3830259 - RNA, 13 nt, Human
cucauccuccuuc

SEQ ID NO: 3830260 - RNA, 17 nt, Human
cucaucgccagacaacu

SEQ ID NO: 3830261 - RNA, 21 nt, Human
cucaucuagguaaauuacagu

SEQ ID NO: 3830262 - RNA, 14 nt, Human
cucaucuaucucaa

SEQ ID NO: 3830263 - RNA, 15 nt, Human
cucaucuaugaggaa

SEQ ID NO: 3830264 - RNA, 20 nt, Human
cucaucuaugaggaaagguu

SEQ ID NO: 3830265 - RNA, 17 nt, Human
cucaucucaguccucaa

SEQ ID NO: 3830266 - RNA, 18 nt, Human
cucaucucagugaagaau

SEQ ID NO: 3830267 - RNA, 20 nt, Human
cucaucucuaacagcucagg

SEQ ID NO: 3830268 - RNA, 16 nt, Human
cucaucucucugccca

SEQ ID NO: 3830269 - RNA, 17 nt, Human
cucaucucucugcccaa

SEQ ID NO: 3830270 - RNA, 17 nt, Human
cucaucucuuagcuccc

SEQ ID NO: 3830271 - RNA, 12 nt, Human
cucaucucuucu

SEQ ID NO: 3830272 - RNA, 13 nt, Human
cucaucugaggca

SEQ ID NO: 3830273 - RNA, 20 nt, Human
cucaucugcacccuucuuuu

SEQ ID NO: 3830274 - RNA, 20 nt, Human
cucaucugcugguccguggg

SEQ ID NO: 3830275 - RNA, 17 nt, Human
cucaucuggaguucuca

SEQ ID NO: 3830276 - RNA, 21 nt, Human
cucaucuggaguucucaaaga

SEQ ID NO: 3830277 - RNA, 20 nt, Human
cucaucuggggagcaggcag

SEQ ID NO: 3830278 - RNA, 20 nt, Human
cuccaaggccaggccuuggg

SEQ ID NO: 3830279 - RNA, 22 nt, Human
cuccaagggcuucugcacccuc

SEQ ID NO: 3830280 - RNA, 20 nt, Human
cuccaaggggaaucagaacu

SEQ ID NO: 3830281 - RNA, 15 nt, Human
cuccaagucucagug

SEQ ID NO: 3830282 - RNA, 16 nt, Human
cuccaagucucagugg

SEQ ID NO: 3830283 - RNA, 17 nt, Human
cuccaagucucaguggc

SEQ ID NO: 3830284 - RNA, 21 nt, Human
cuccaagugccagaggugggc

SEQ ID NO: 3830285 - RNA, 22 nt, Human
cuccaagugccagaggugggca

SEQ ID NO: 3830286 - RNA, 17 nt, Human
cuccaauaucagugcuc

SEQ ID NO: 3830287 - RNA, 23 nt, Human
cuccaauuuuuuaagugaaaaua

SEQ ID NO: 3830288 - RNA, 18 nt, Human
cuccaauuuuuuuuuccu

SEQ ID NO: 3830289 - RNA, 17 nt, Human
cuccacaaccucuuccc

SEQ ID NO: 3830290 - RNA, 22 nt, Human
cuccacaaccucuuccccccaa

SEQ ID NO: 3830291 - RNA, 20 nt, Human
cuccacacaagggaaggaca

SEQ ID NO: 3830292 - RNA, 15 nt, Human
cuccacacacacaaa

SEQ ID NO: 3830293 - RNA, 21 nt, Human
cuccacacacagcugggcugu

SEQ ID NO: 3830294 - RNA, 23 nt, Human
cuccacacacagcugggcugugg

SEQ ID NO: 3830295 - RNA, 14 nt, Human
cuccacagccgcag

SEQ ID NO: 3830296 - RNA, 19 nt, Human
cuccacagcgagggcagcu

SEQ ID NO: 3830297 - RNA, 23 nt, Human
cuccacagcgagggcagcugcua

SEQ ID NO: 3830298 - RNA, 17 nt, Human
cuccacaguucaguggc

SEQ ID NO: 3830299 - RNA, 21 nt, Human
cuccacaguucgaccugcggc

SEQ ID NO: 3830300 - RNA, 13 nt, Human
cuccacauuuguu

SEQ ID NO: 3830301 - RNA, 15 nt, Human
cuccacauuuguuuu

SEQ ID NO: 3830302 - RNA, 23 nt, Human
cuccaccaccacuggccaccagg

SEQ ID NO: 3830303 - RNA, 12 nt, Human
cuccaccaccgc

SEQ ID NO: 3830304 - RNA, 20 nt, Human
cuccaccaccgcccgucugu

SEQ ID NO: 3830305 - RNA, 22 nt, Human
cuccaccagcaucaccugccug

SEQ ID NO: 3830306 - RNA, 23 nt, Human
cuccaccagcaucaccugccugu

SEQ ID NO: 3830307 - RNA, 14 nt, Human
cuccaccaggaacc

SEQ ID NO: 3830308 - RNA, 15 nt, Human
cuccaccaggaaccu

SEQ ID NO: 3830309 - RNA, 16 nt, Human
cuccaccagucauuuu

SEQ ID NO: 3830310 - RNA, 16 nt, Human
cuccaccaucgucuuc

SEQ ID NO: 3830311 - RNA, 22 nt, Human
cuccaccaucgucuucuuggcc

SEQ ID NO: 3830312 - RNA, 22 nt, Human
cuccaccccaggacgccacuca

SEQ ID NO: 3830313 - RNA, 13 nt, Human
cuccacccccagc

SEQ ID NO: 3830314 - RNA, 22 nt, Human
cuccaccccccagaaccugucc

SEQ ID NO: 3830315 - RNA, 23 nt, Human
cuccaccccccagaaccuguccu

SEQ ID NO: 3830316 - RNA, 15 nt, Human
cuccacccuccaccu

SEQ ID NO: 3830317 - RNA, 13 nt, Human
cuccacccucuga

SEQ ID NO: 3830318 - RNA, 13 nt, Human
cuccacccugcuc

SEQ ID NO: 3830319 - RNA, 15 nt, Human
cuccacccugucccc

SEQ ID NO: 3830320 - RNA, 12 nt, Human
cuccacccuugg

SEQ ID NO: 3830321 - RNA, 13 nt, Human
cuccacccuuggc

SEQ ID NO: 3830322 - RNA, 14 nt, Human
cuccacccuuggcc

SEQ ID NO: 3830323 - RNA, 19 nt, Human
cuccaccgcugccuaagug

SEQ ID NO: 3830324 - RNA, 15 nt, Human
cuccaccuagacugu

SEQ ID NO: 3830325 - RNA, 15 nt, Human
cuccaccuaguggcu

SEQ ID NO: 3830326 - RNA, 13 nt, Human
cuccaccucagcc

SEQ ID NO: 3830327 - RNA, 15 nt, Human
cuccaccucccugca

SEQ ID NO: 3830328 - RNA, 17 nt, Human
cuccaccucccugcaau

SEQ ID NO: 3830329 - RNA, 12 nt, Human
cuccaccugcca

SEQ ID NO: 3830330 - RNA, 17 nt, Human
cuccaccugccagggac

SEQ ID NO: 3830331 - RNA, 18 nt, Human
cuccaccugccagggaca

SEQ ID NO: 3830332 - RNA, 21 nt, Human
cuccaccugccagggacagag

SEQ ID NO: 3830333 - RNA, 17 nt, Human
cuccaccugcucccagg

SEQ ID NO: 3830334 - RNA, 22 nt, Human
cuccaccugcucccaggccagu

SEQ ID NO: 3830335 - RNA, 13 nt, Human
cuccaccugcucu

SEQ ID NO: 3830336 - RNA, 15 nt, Human
cuccaccuugcgggg

SEQ ID NO: 3830337 - RNA, 20 nt, Human
cuccacguucaccccuccac

SEQ ID NO: 3830338 - RNA, 18 nt, Human
cuccacguucugcucauc

SEQ ID NO: 3830339 - RNA, 20 nt, Human
cuccacguucugcucaucau

SEQ ID NO: 3830340 - RNA, 13 nt, Human
cuccacucccacu

SEQ ID NO: 3830341 - RNA, 12 nt, Human
cuccacuccuuc

SEQ ID NO: 3830342 - RNA, 15 nt, Human
cuccacuccuuccug

SEQ ID NO: 3830343 - RNA, 16 nt, Human
cuccacucucccccac

SEQ ID NO: 3830344 - RNA, 14 nt, Human
cuccacucuccucu

SEQ ID NO: 3830345 - RNA, 21 nt, Human
cuccacucuccucuuccaggc

SEQ ID NO: 3830346 - RNA, 14 nt, Human
cuccacucucuacc

SEQ ID NO: 3830347 - RNA, 16 nt, Human
cccaccuccccuuggg

SEQ ID NO: 3830348 - RNA, 21 nt, Human
cccaccucccucaaccucauc

SEQ ID NO: 3830349 - RNA, 15 nt, Human
cccaccucccugccc

SEQ ID NO: 3830350 - RNA, 17 nt, Human
cccaccucccugcccag

SEQ ID NO: 3830351 - RNA, 15 nt, Human
cccaccuccugacac

SEQ ID NO: 3830352 - RNA, 13 nt, Human
cccaccucucuca

SEQ ID NO: 3830353 - RNA, 14 nt, Human
cccaccucucucac

SEQ ID NO: 3830354 - RNA, 21 nt, Human
cccaccucucucacuccuuga

SEQ ID NO: 3830355 - RNA, 20 nt, Human
cccaccucugugaccucagg

SEQ ID NO: 3830356 - RNA, 15 nt, Human
cccaccugagcuuug

SEQ ID NO: 3830357 - RNA, 14 nt, Human
cccaccugcagggc

SEQ ID NO: 3830358 - RNA, 12 nt, Human
cccaccugccug

SEQ ID NO: 3830359 - RNA, 14 nt, Human
cccaccugccuggc

SEQ ID NO: 3830360 - RNA, 17 nt, Human
cccaccugccuggccgg

SEQ ID NO: 3830361 - RNA, 18 nt, Human
cccaccugccuggccggc

SEQ ID NO: 3830362 - RNA, 20 nt, Human
cccaccugccuggccggcca

SEQ ID NO: 3830363 - RNA, 21 nt, Human
cccaccugccuggccggccag

SEQ ID NO: 3830364 - RNA, 12 nt, Human
cccaccugcgcu

SEQ ID NO: 3830365 - RNA, 19 nt, Human
cccaccugcugagagaccc

SEQ ID NO: 3830366 - RNA, 13 nt, Human
cccaccuggccac

SEQ ID NO: 3830367 - RNA, 15 nt, Human
cccaccuggccaccu

SEQ ID NO: 3830368 - RNA, 12 nt, Human
cccaccuggccc

SEQ ID NO: 3830369 - RNA, 18 nt, Human
cccaccuggcccucucug

SEQ ID NO: 3830370 - RNA, 14 nt, Human
cccaccuggcucug

SEQ ID NO: 3830371 - RNA, 20 nt, Human
cccaccuucaauuccugggc

SEQ ID NO: 3830372 - RNA, 19 nt, Human
cccaccuuggcugcaggga

SEQ ID NO: 3830373 - RNA, 20 nt, Human
cccaccuuggcugcagggag

SEQ ID NO: 3830374 - RNA, 18 nt, Human
cccaccuuguuggagccu

SEQ ID NO: 3830375 - RNA, 19 nt, Human
cccaccuuguuggagccug

SEQ ID NO: 3830376 - RNA, 12 nt, Human
cccaccuuuggu

SEQ ID NO: 3830377 - RNA, 18 nt, Human
cccacgaaacugcccugg

SEQ ID NO: 3830378 - RNA, 14 nt, Human
cccacgagggcugg

SEQ ID NO: 3830379 - RNA, 15 nt, Human
cccacgagggcuggc

SEQ ID NO: 3830380 - RNA, 18 nt, Human
cccacgauuuucuccagc

SEQ ID NO: 3830381 - RNA, 19 nt, Human
cccacgauuuucuccagcu

SEQ ID NO: 3830382 - RNA, 21 nt, Human
cccacgauuuucuccagcuca

SEQ ID NO: 3830383 - RNA, 14 nt, Human
cccacgccacagcc

SEQ ID NO: 3830384 - RNA, 15 nt, Human
cccacgccacagccc

SEQ ID NO: 3830385 - RNA, 17 nt, Human
cccacgccacagcccuu

SEQ ID NO: 3830386 - RNA, 14 nt, Human
cccacgcugacuac

SEQ ID NO: 3830387 - RNA, 19 nt, Human
cccacgcugacuacagggc

SEQ ID NO: 3830388 - RNA, 21 nt, Human
cccacgcugacuacagggccg

SEQ ID NO: 3830389 - RNA, 19 nt, Human
cccacgcuggagugcagug

SEQ ID NO: 3830390 - RNA, 21 nt, Human
cccacgcuggagugcagugag

SEQ ID NO: 3830391 - RNA, 14 nt, Human
cccacggccgcucc

SEQ ID NO: 3830392 - RNA, 21 nt, Human
cccacggccgcuccaggggug

SEQ ID NO: 3830393 - RNA, 15 nt, Human
cccacggcuaagagg

SEQ ID NO: 3830394 - RNA, 18 nt, Human
cccacggcuaagaggcug

SEQ ID NO: 3830395 - RNA, 17 nt, Human
cccacgggaccuggggc

SEQ ID NO: 3830396 - RNA, 17 nt, Human
cccacgucacguguagu

SEQ ID NO: 3830397 - RNA, 19 nt, Human
cccacguccugucagugcc

SEQ ID NO: 3830398 - RNA, 15 nt, Human
cccacguucucacac

SEQ ID NO: 3830399 - RNA, 19 nt, Human
cccacucaagccaagcagc

SEQ ID NO: 3830400 - RNA, 14 nt, Human
cccacucacagaga

SEQ ID NO: 3830401 - RNA, 14 nt, Human
cccacuccaucugg

SEQ ID NO: 3830402 - RNA, 18 nt, Human
cccacuccaucugguaga

SEQ ID NO: 3830403 - RNA, 16 nt, Human
cccacucccaggacca

SEQ ID NO: 3830404 - RNA, 14 nt, Human
cccacuccggcccu

SEQ ID NO: 3830405 - RNA, 21 nt, Human
cccacuccggcccuccagagc

SEQ ID NO: 3830406 - RNA, 23 nt, Human
cccacuccucugcugaccugcug

SEQ ID NO: 3830407 - RNA, 12 nt, Human
cccacucucaga

SEQ ID NO: 3830408 - RNA, 15 nt, Human
cccacucucagaggc

SEQ ID NO: 3830409 - RNA, 12 nt, Human
cccacucugugc

SEQ ID NO: 3830410 - RNA, 16 nt, Human
cccacugacagccucc

SEQ ID NO: 3830411 - RNA, 14 nt, Human
cccacugaccagaa

SEQ ID NO: 3830412 - RNA, 18 nt, Human
cccacugcaauccugucu

SEQ ID NO: 3830413 - RNA, 12 nt, Human
cccacugcaccc

SEQ ID NO: 3830414 - RNA, 16 nt, Human
cccacugcacccccuc

SEQ ID NO: 3830415 - RNA, 19 nt, Human
cccacugcacccccuccug

SEQ ID NO: 3830416 - RNA, 12 nt, Human
cccacugcccac

SEQ ID NO: 3830417 - RNA, 13 nt, Human
cccacugccugcc

SEQ ID NO: 3830418 - RNA, 15 nt, Human
cccacugccugccca

SEQ ID NO: 3830419 - RNA, 12 nt, Human
cccacugcucug

SEQ ID NO: 3830420 - RNA, 12 nt, Human
cccacugcuuuu

SEQ ID NO: 3830421 - RNA, 19 nt, Human
cccacugcuuuuggucugu

SEQ ID NO: 3830422 - RNA, 23 nt, Human
cccacugcuuuuggucuguguga

SEQ ID NO: 3830423 - RNA, 12 nt, Human
cccacuggagca

SEQ ID NO: 3830424 - RNA, 14 nt, Human
cccagucccagcag

SEQ ID NO: 3830425 - RNA, 20 nt, Human
cccaguccccaccccugccc

SEQ ID NO: 3830426 - RNA, 21 nt, Human
cccaguccccaccccugcccc

SEQ ID NO: 3830427 - RNA, 14 nt, Human
cccagucccugggg

SEQ ID NO: 3830428 - RNA, 15 nt, Human
cccaguccugcccgc

SEQ ID NO: 3830429 - RNA, 15 nt, Human
cccaguccuggccug

SEQ ID NO: 3830430 - RNA, 17 nt, Human
cccaguccuggccuggc

SEQ ID NO: 3830431 - RNA, 16 nt, Human
cccagucuacccagag

SEQ ID NO: 3830432 - RNA, 20 nt, Human
cccagucucuggcaguucug

SEQ ID NO: 3830433 - RNA, 12 nt, Human
cccagugacacu

SEQ ID NO: 3830434 - RNA, 22 nt, Human
cccagugacacuucagagagcu

SEQ ID NO: 3830435 - RNA, 19 nt, Human
cccagugagauuacagagg

SEQ ID NO: 3830436 - RNA, 17 nt, Human
cccagugagcauccacg

SEQ ID NO: 3830437 - RNA, 23 nt, Human
cccagugagucucuggggcaggc

SEQ ID NO: 3830438 - RNA, 17 nt, Human
cccagugcaaaugcaug

SEQ ID NO: 3830439 - RNA, 16 nt, Human
cccagugcacuugcug

SEQ ID NO: 3830440 - RNA, 12 nt, Human
cccagugcagaa

SEQ ID NO: 3830441 - RNA, 17 nt, Human
cccagugcagaauguaa

SEQ ID NO: 3830442 - RNA, 18 nt, Human
cccagugcaugguggcca

SEQ ID NO: 3830443 - RNA, 20 nt, Human
cccagugcaugguggccaga

SEQ ID NO: 3830444 - RNA, 22 nt, Human
cccagugccaagcacagugccu

SEQ ID NO: 3830445 - RNA, 14 nt, Human
cccagugcccccac

SEQ ID NO: 3830446 - RNA, 23 nt, Human
cccagugcccuggggcugaucuc

SEQ ID NO: 3830447 - RNA, 18 nt, Human
cccagugccgagaaggaa

SEQ ID NO: 3830448 - RNA, 14 nt, Human
cccaguggcagggc

SEQ ID NO: 3830449 - RNA, 15 nt, Human
cccaguggcagggca

SEQ ID NO: 3830450 - RNA, 17 nt, Human
cccaguggcagggcaca

SEQ ID NO: 3830451 - RNA, 16 nt, Human
cccaguggccacucag

SEQ ID NO: 3830452 - RNA, 17 nt, Human
cccaguggccacucagc

SEQ ID NO: 3830453 - RNA, 12 nt, Human
cccagugggagg

SEQ ID NO: 3830454 - RNA, 19 nt, Human
cccagugggaggggcaggc

SEQ ID NO: 3830455 - RNA, 21 nt, Human
cccagugggaggggcaggcug

SEQ ID NO: 3830456 - RNA, 16 nt, Human
cccagugucuuccugu

SEQ ID NO: 3830457 - RNA, 20 nt, Human
cccagugucuuccugugggg

SEQ ID NO: 3830458 - RNA, 16 nt, Human
cccaguguuuuaggag

SEQ ID NO: 3830459 - RNA, 17 nt, Human
cccaguguuuuaggagc

SEQ ID NO: 3830460 - RNA, 20 nt, Human
cccaguucgccuggagcccu

SEQ ID NO: 3830461 - RNA, 16 nt, Human
cccaguucucuaggga

SEQ ID NO: 3830462 - RNA, 15 nt, Human
cccaguugccaucug

SEQ ID NO: 3830463 - RNA, 17 nt, Human
cccaguugccaucugcg

SEQ ID NO: 3830464 - RNA, 14 nt, Human
cccaguuucugccu

SEQ ID NO: 3830465 - RNA, 16 nt, Human
cccaguuucugccucu

SEQ ID NO: 3830466 - RNA, 22 nt, Human
cccaguuugcagaaaagcaccu

SEQ ID NO: 3830467 - RNA, 23 nt, Human
cccaguuugcagaaaagcaccug

SEQ ID NO: 3830468 - RNA, 19 nt, Human
cccauaauuuucuucaugc

SEQ ID NO: 3830469 - RNA, 23 nt, Human
cccauaauuuuuuuuuuccuuuu

SEQ ID NO: 3830470 - RNA, 16 nt, Human
cccauacucagccugc

SEQ ID NO: 3830471 - RNA, 19 nt, Human
cccauagaaacaugacacu

SEQ ID NO: 3830472 - RNA, 22 nt, Human
cccauagaaacaugacacugac

SEQ ID NO: 3830473 - RNA, 20 nt, Human
cccauagcagccaguucaaa

SEQ ID NO: 3830474 - RNA, 13 nt, Human
cccauagcuucca

SEQ ID NO: 3830475 - RNA, 16 nt, Human
cccauagcuuccauga

SEQ ID NO: 3830476 - RNA, 15 nt, Human
cccauaggcccacac

SEQ ID NO: 3830477 - RNA, 18 nt, Human
cccauaggcccacacaca

SEQ ID NO: 3830478 - RNA, 14 nt, Human
cccauauccugccu

SEQ ID NO: 3830479 - RNA, 19 nt, Human
cccauauuuuacuuggaaa

SEQ ID NO: 3830480 - RNA, 20 nt, Human
cccaucaccuacucacacag

SEQ ID NO: 3830481 - RNA, 22 nt, Human
cccaucaccuacucacacaggc

SEQ ID NO: 3830482 - RNA, 16 nt, Human
cccaucacgccugugc

SEQ ID NO: 3830483 - RNA, 15 nt, Human
cccaucacugcgcca

SEQ ID NO: 3830484 - RNA, 22 nt, Human
cccaucacugcgccacugcucc

SEQ ID NO: 3830485 - RNA, 20 nt, Human
cccaucacuggagcaccagg

SEQ ID NO: 3830486 - RNA, 14 nt, Human
cccaucagaaggag

SEQ ID NO: 3830487 - RNA, 22 nt, Human
cccaucagugcucccucacaug

SEQ ID NO: 3830488 - RNA, 23 nt, Human
cccaucagugcucccucacaugu

SEQ ID NO: 3830489 - RNA, 13 nt, Human
cccaucaguguac

SEQ ID NO: 3830490 - RNA, 21 nt, Human
cccaucaguguacccccgccc

SEQ ID NO: 3830491 - RNA, 14 nt, Human
cccaucaucccagc

SEQ ID NO: 3830492 - RNA, 16 nt, Human
cccaucauccucuggc

SEQ ID NO: 3830493 - RNA, 12 nt, Human
cccaucauucau

SEQ ID NO: 3830494 - RNA, 13 nt, Human
cccauccaggcag

SEQ ID NO: 3830495 - RNA, 19 nt, Human
cccauccauuaggccagca

SEQ ID NO: 3830496 - RNA, 19 nt, Human
cccauccccauccuccagc

SEQ ID NO: 3830497 - RNA, 14 nt, Human
cccauccccccuca

SEQ ID NO: 3830498 - RNA, 16 nt, Human
cccauccccccucacc

SEQ ID NO: 3830499 - RNA, 20 nt, Human
cccauccccccucaccaggg

SEQ ID NO: 3830500 - RNA, 16 nt, Human
cccauccccgcagugu

SEQ ID NO: 3830501 - RNA, 18 nt, Human
cccaucccugccugguca

SEQ ID NO: 3830502 - RNA, 20 nt, Human
cccauccuaccaaugcaugc

SEQ ID NO: 3830503 - RNA, 21 nt, Human
cccauccuaccaaugcaugca

SEQ ID NO: 3830504 - RNA, 12 nt, Human
cccauccuaccc

SEQ ID NO: 3830505 - RNA, 23 nt, Human
cccauccuacccucgggcccacc

SEQ ID NO: 3830506 - RNA, 15 nt, Human
cccauccuccagcuu

SEQ ID NO: 3830507 - RNA, 13 nt, Human
cccauccuccagg

SEQ ID NO: 3830508 - RNA, 22 nt, Human
cccauccuccccuucccugcaa

SEQ ID NO: 3830509 - RNA, 14 nt, Human
cccauccucuguac

SEQ ID NO: 3830510 - RNA, 22 nt, Human
cccauccucuguacagagccca

SEQ ID NO: 3830511 - RNA, 15 nt, Human
cccauccuggcccau

SEQ ID NO: 3830512 - RNA, 17 nt, Human
cccauccuggcccauca

SEQ ID NO: 3830513 - RNA, 19 nt, Human
cccaucgucucggccuuca

SEQ ID NO: 3830514 - RNA, 22 nt, Human
cccaucgucucggccuucacaa

SEQ ID NO: 3830515 - RNA, 16 nt, Human
cccaucuaagcugcag

SEQ ID NO: 3830516 - RNA, 23 nt, Human
cccaucucaggccagagccaagg

SEQ ID NO: 3830517 - RNA, 12 nt, Human
cccaucucccug

SEQ ID NO: 3830518 - RNA, 17 nt, Human
cccaucucccugccugg

SEQ ID NO: 3830519 - RNA, 17 nt, Human
cccaucucccugcuuug

SEQ ID NO: 3830520 - RNA, 20 nt, Human
cccaucucgcucccucccag

SEQ ID NO: 3830521 - RNA, 21 nt, Human
cccaucucgcucccucccagg

SEQ ID NO: 3830522 - RNA, 23 nt, Human
cccaucucgcucccucccaggac

SEQ ID NO: 3830523 - RNA, 13 nt, Human
cccaucucggagc

SEQ ID NO: 3830524 - RNA, 13 nt, Human
cccaucucucccu

SEQ ID NO: 3830525 - RNA, 13 nt, Human
cccaucugcaccc

SEQ ID NO: 3830526 - RNA, 22 nt, Human
cccaucugcaccccccugggcu

SEQ ID NO: 3830527 - RNA, 18 nt, Human
cccaucugcauucccagc

SEQ ID NO: 3830528 - RNA, 13 nt, Human
cccaucugcccag

SEQ ID NO: 3830529 - RNA, 15 nt, Human
cccaucugcccagga

SEQ ID NO: 3830530 - RNA, 16 nt, Human
cccaucugcccaggac

SEQ ID NO: 3830531 - RNA, 20 nt, Human
cccaucugccccacagucuc

SEQ ID NO: 3830532 - RNA, 21 nt, Human
cccaucugcgggggcagugcu

SEQ ID NO: 3830533 - RNA, 22 nt, Human
cccaucugcgggggcagugcuc

SEQ ID NO: 3830534 - RNA, 23 nt, Human
cccaucugggaguccccuuuucu

SEQ ID NO: 3830535 - RNA, 18 nt, Human
cccaucuggguccuugca

SEQ ID NO: 3830536 - RNA, 16 nt, Human
cccaucuggucauuug

SEQ ID NO: 3830537 - RNA, 13 nt, Human
cccaucuucaccc

SEQ ID NO: 3830538 - RNA, 20 nt, Human
cccaugaacacacugugucc

SEQ ID NO: 3830539 - RNA, 19 nt, Human
cccaugaagacaggacagu

SEQ ID NO: 3830540 - RNA, 11 nt, Human
cccaugaagcc

SEQ ID NO: 3830541 - RNA, 17 nt, Human
cccaugaagccuuuuga

SEQ ID NO: 3830542 - RNA, 23 nt, Human
cccaugacaauguuguagugucc

SEQ ID NO: 3830543 - RNA, 23 nt, Human
cccaugacccaccccugugcucc

SEQ ID NO: 3830544 - RNA, 17 nt, Human
cccaugacccaggcugg

SEQ ID NO: 3830545 - RNA, 19 nt, Human
cccaugacccaggcugggc

SEQ ID NO: 3830546 - RNA, 19 nt, Human
cccaugagagcgcagcccg

SEQ ID NO: 3830547 - RNA, 14 nt, Human
cccaugagccucag

SEQ ID NO: 3830548 - RNA, 20 nt, Human
cccaugagggagaugccaug

SEQ ID NO: 3830549 - RNA, 21 nt, Human
cccaugagggagaugccauga

SEQ ID NO: 3830550 - RNA, 16 nt, Human
cccaugauuucaugua

SEQ ID NO: 3830551 - RNA, 17 nt, Human
cccaugauuucauguac

SEQ ID NO: 3830552 - RNA, 16 nt, Human
cccaugcacugugaag

SEQ ID NO: 3830553 - RNA, 17 nt, Human
cccaugccacguuccac

SEQ ID NO: 3830554 - RNA, 20 nt, Human
cucuccccagguccagcucu

SEQ ID NO: 3830555 - RNA, 15 nt, Human
cucuccccaugaugu

SEQ ID NO: 3830556 - RNA, 16 nt, Human
cucuccccaugauguu

SEQ ID NO: 3830557 - RNA, 23 nt, Human
cucuccccccccccuccaauccu

SEQ ID NO: 3830558 - RNA, 22 nt, Human
cucuccccgcaguguuugugug

SEQ ID NO: 3830559 - RNA, 12 nt, Human
cucuccccugcc

SEQ ID NO: 3830560 - RNA, 17 nt, Human
cucuccccugcccugcu

SEQ ID NO: 3830561 - RNA, 18 nt, Human
cucuccccugcccugcug

SEQ ID NO: 3830562 - RNA, 14 nt, Human
cucuccccugccug

SEQ ID NO: 3830563 - RNA, 16 nt, Human
cucuccccugccugcc

SEQ ID NO: 3830564 - RNA, 21 nt, Human
cucuccccuggaacugucucu

SEQ ID NO: 3830565 - RNA, 15 nt, Human
cucucccgucagggc

SEQ ID NO: 3830566 - RNA, 13 nt, Human
cucucccugaccc

SEQ ID NO: 3830567 - RNA, 14 nt, Human
cucucccugcaugg

SEQ ID NO: 3830568 - RNA, 17 nt, Human
ccccaccccugccccca

SEQ ID NO: 3830569 - RNA, 19 nt, Human
cucugacaagggcugaccu

SEQ ID NO: 3830570 - RNA, 16 nt, Human
cucugacacacagcuc

SEQ ID NO: 3830571 - RNA, 17 nt, Human
cucugacacacagcucu

SEQ ID NO: 3830572 - RNA, 18 nt, Human
cucugacacacagcucug

SEQ ID NO: 3830573 - RNA, 18 nt, Human
cucugaccccuccucacu

SEQ ID NO: 3830574 - RNA, 23 nt, Human
cucugaccgaaacagcgcugggu

SEQ ID NO: 3830575 - RNA, 15 nt, Human
cucugaccugcacug

SEQ ID NO: 3830576 - RNA, 16 nt, Human
cucugaccugcaggcc

SEQ ID NO: 3830577 - RNA, 13 nt, Human
cucugacucccaa

SEQ ID NO: 3830578 - RNA, 23 nt, Human
cucugacucccaaagagcugccu

SEQ ID NO: 3830579 - RNA, 13 nt, Human
cucugacuucugc

SEQ ID NO: 3830580 - RNA, 16 nt, Human
cucugagaagcucuga

SEQ ID NO: 3830581 - RNA, 18 nt, Human
cucugagaauuccaagga

SEQ ID NO: 3830582 - RNA, 23 nt, Human
cucugagacucgcgacaaugcaa

SEQ ID NO: 3830583 - RNA, 18 nt, Human
cucugagaggcccuggau

SEQ ID NO: 3830584 - RNA, 13 nt, Human
cucugagagucua

SEQ ID NO: 3830585 - RNA, 16 nt, Human
cucugagagucuagau

SEQ ID NO: 3830586 - RNA, 22 nt, Human
cucugagcccauguucugcccc

SEQ ID NO: 3830587 - RNA, 13 nt, Human
cucugagcgccuc

SEQ ID NO: 3830588 - RNA, 15 nt, Human
cucugagcgggaggc

SEQ ID NO: 3830589 - RNA, 11 nt, Human
cucugagcugu

SEQ ID NO: 3830590 - RNA, 13 nt, Human
cucugagcuguca

SEQ ID NO: 3830591 - RNA, 13 nt, Human
cucugagcuuugc

SEQ ID NO: 3830592 - RNA, 13 nt, Human
cucugaggaagcu

SEQ ID NO: 3830593 - RNA, 16 nt, Human
cucugaggacacuaac

SEQ ID NO: 3830594 - RNA, 16 nt, Human
cucugaggccagccug

SEQ ID NO: 3830595 - RNA, 17 nt, Human
cucugaggccagccugg

SEQ ID NO: 3830596 - RNA, 18 nt, Human
cucugaggccagccuggc

SEQ ID NO: 3830597 - RNA, 21 nt, Human
cucugaggccagccuggccuc

SEQ ID NO: 3830598 - RNA, 12 nt, Human
cucugaggcgcc

SEQ ID NO: 3830599 - RNA, 21 nt, Human
cucugaggcgccccaacccgu

SEQ ID NO: 3830600 - RNA, 19 nt, Human
cucugaggcucuuucuggg

SEQ ID NO: 3830601 - RNA, 19 nt, Human
cucugaggcuuccagagag

SEQ ID NO: 3830602 - RNA, 19 nt, Human
cucugagggaaagcccaga

SEQ ID NO: 3830603 - RNA, 12 nt, Human
cucugagggcuu

SEQ ID NO: 3830604 - RNA, 13 nt, Human
cucugagggcuuc

SEQ ID NO: 3830605 - RNA, 17 nt, Human
cucugagggcuuccuuu

SEQ ID NO: 3830606 - RNA, 21 nt, Human
cucugaggggcuaccaggaaa

SEQ ID NO: 3830607 - RNA, 17 nt, Human
cucugaguaucuccucg

SEQ ID NO: 3830608 - RNA, 15 nt, Human
cucugaguccuggcc

SEQ ID NO: 3830609 - RNA, 18 nt, Human
cucugaguccuggcccaa

SEQ ID NO: 3830610 - RNA, 23 nt, Human
cucugaguuccggcaccaguagc

SEQ ID NO: 3830611 - RNA, 14 nt, Human
cucugauaagagaa

SEQ ID NO: 3830612 - RNA, 14 nt, Human
cucugauacuuuuu

SEQ ID NO: 3830613 - RNA, 15 nt, Human
cucugauaggccaag

SEQ ID NO: 3830614 - RNA, 19 nt, Human
cucugauauuccaugaaug

SEQ ID NO: 3830615 - RNA, 15 nt, Human
cucugaucaaguauu

SEQ ID NO: 3830616 - RNA, 12 nt, Human
cucugaucccuc

SEQ ID NO: 3830617 - RNA, 22 nt, Human
cucugaucccucuacagagcuu

SEQ ID NO: 3830618 - RNA, 15 nt, Human
cucugaucuccaugg

SEQ ID NO: 3830619 - RNA, 18 nt, Human
cucugaugcagcuuauac

SEQ ID NO: 3830620 - RNA, 15 nt, Human
cucugaugcaucaga

SEQ ID NO: 3830621 - RNA, 15 nt, Human
cucugauguaaauga

SEQ ID NO: 3830622 - RNA, 18 nt, Human
cucugauuuauuuuguau

SEQ ID NO: 3830623 - RNA, 20 nt, Human
cucugauuuucaaagcuuuu

SEQ ID NO: 3830624 - RNA, 17 nt, Human
cucugcaaaaggagaga

SEQ ID NO: 3830625 - RNA, 18 nt, Human
cucugcaaaaggagagac

SEQ ID NO: 3830626 - RNA, 20 nt, Human
cucugcaaacugccuucuuc

SEQ ID NO: 3830627 - RNA, 23 nt, Human
cucugcaauuccccucugcugcu

SEQ ID NO: 3830628 - RNA, 16 nt, Human
cucugcacaagcugca

SEQ ID NO: 3830629 - RNA, 20 nt, Human
cucugcacaagcugcacccu

SEQ ID NO: 3830630 - RNA, 14 nt, Human
cucugcacccagaa

SEQ ID NO: 3830631 - RNA, 15 nt, Human
cucugcacccagaac

SEQ ID NO: 3830632 - RNA, 16 nt, Human
cucugcacccagaaca

SEQ ID NO: 3830633 - RNA, 17 nt, Human
cucugcacccagaacag

SEQ ID NO: 3830634 - RNA, 16 nt, Human
cucugcacccccauau

SEQ ID NO: 3830635 - RNA, 15 nt, Human
cucugcacuacuccu

SEQ ID NO: 3830636 - RNA, 20 nt, Human
cucugcacuacugacaugug

SEQ ID NO: 3830637 - RNA, 22 nt, Human
cucugcacuacugacauguggg

SEQ ID NO: 3830638 - RNA, 15 nt, Human
cucugcacuccccug

SEQ ID NO: 3830639 - RNA, 16 nt, Human
cucugcacuccccugc

SEQ ID NO: 3830640 - RNA, 17 nt, Human
cucugcacuccccugcu

SEQ ID NO: 3830641 - RNA, 18 nt, Human
cucugcacuccccugcug

SEQ ID NO: 3830642 - RNA, 20 nt, Human
cucugcacuccccugcuggg

SEQ ID NO: 3830643 - RNA, 18 nt, Human
cucugcagaaacuacuga

SEQ ID NO: 3830644 - RNA, 17 nt, Human
cucugcagacuucccag

SEQ ID NO: 3830645 - RNA, 17 nt, Human
cucugcagccagcccag

SEQ ID NO: 3830646 - RNA, 14 nt, Human
cucugcagccucag

SEQ ID NO: 3830647 - RNA, 11 nt, Human
cucugcagcug

SEQ ID NO: 3830648 - RNA, 12 nt, Human
cucugcagcuga

SEQ ID NO: 3830649 - RNA, 20 nt, Human
cucugcaggaaauggcugug

SEQ ID NO: 3830650 - RNA, 15 nt, Human
cucugcaggcaccuu

SEQ ID NO: 3830651 - RNA, 19 nt, Human
cucugcagggccgccaggg

SEQ ID NO: 3830652 - RNA, 17 nt, Human
cucugcaggucccuaau

SEQ ID NO: 3830653 - RNA, 18 nt, Human
cucugcaggucccuaaua

SEQ ID NO: 3830654 - RNA, 19 nt, Human
cucugcaggucccuaauaa

SEQ ID NO: 3830655 - RNA, 22 nt, Human
cucugcaggucccuaauaaagc

SEQ ID NO: 3830656 - RNA, 18 nt, Human
cucugcauccucuggagc

SEQ ID NO: 3830657 - RNA, 17 nt, Human
cucugcaucuacuccca

SEQ ID NO: 3830658 - RNA, 20 nt, Human
cucugcaugcggcccagccc

SEQ ID NO: 3830659 - RNA, 23 nt, Human
cucugcaugcggcccagcccggc

SEQ ID NO: 3830660 - RNA, 17 nt, Human
cucugcauuuaaaaaaa

SEQ ID NO: 3830661 - RNA, 19 nt, Human
cucugccaaaggaugugau

SEQ ID NO: 3830662 - RNA, 10 nt, Human
cucugccacc

SEQ ID NO: 3830663 - RNA, 11 nt, Human
cucugccacca

SEQ ID NO: 3830664 - RNA, 16 nt, Human
cucugccaccagagac

SEQ ID NO: 3830665 - RNA, 23 nt, Human
cucugccaccagagaccguccuc

SEQ ID NO: 3830666 - RNA, 17 nt, Human
cucugccacccuaccug

SEQ ID NO: 3830667 - RNA, 18 nt, Human
cucugccaccuccccuau

SEQ ID NO: 3830668 - RNA, 15 nt, Human
cucugccagcaaaga

SEQ ID NO: 3830669 - RNA, 13 nt, Human
cucugccaguccu

SEQ ID NO: 3830670 - RNA, 15 nt, Human
cucugccaguccugu

SEQ ID NO: 3830671 - RNA, 17 nt, Human
cucugcccagagcuggg

SEQ ID NO: 3830672 - RNA, 14 nt, Human
cucugcccagcuug

SEQ ID NO: 3830673 - RNA, 15 nt, Human
cucugcccagcuugg

SEQ ID NO: 3830674 - RNA, 17 nt, Human
cucugcccagcuugggc

SEQ ID NO: 3830675 - RNA, 18 nt, Human
cucugcccagcuugggcc

SEQ ID NO: 3830676 - RNA, 14 nt, Human
cucugcccagcuuu

SEQ ID NO: 3830677 - RNA, 16 nt, Human
cucugccccagaggcc

SEQ ID NO: 3830678 - RNA, 13 nt, Human
cucugccccagcu

SEQ ID NO: 3830679 - RNA, 16 nt, Human
cucugccccagcucug

SEQ ID NO: 3830680 - RNA, 17 nt, Human
cucugccccagcucugg

SEQ ID NO: 3830681 - RNA, 19 nt, Human
cucugccccagcucuggcu

SEQ ID NO: 3830682 - RNA, 13 nt, Human
cucugccccaguc

SEQ ID NO: 3830683 - RNA, 19 nt, Human
cucugccccucccccagcc

SEQ ID NO: 3830684 - RNA, 22 nt, Human
cucugcccuaaugcgcaggcug

SEQ ID NO: 3830685 - RNA, 22 nt, Human
cucugcccucauuacugggccu

SEQ ID NO: 3830686 - RNA, 14 nt, Human
cucugcccuccaag

SEQ ID NO: 3830687 - RNA, 16 nt, Human
cucugcccuccaagac

SEQ ID NO: 3830688 - RNA, 20 nt, Human
cucugcccucccuccuuccu

SEQ ID NO: 3830689 - RNA, 21 nt, Human
cucugcccuuguucccuaggg

SEQ ID NO: 3830690 - RNA, 18 nt, Human
cucugccgcaauacagga

SEQ ID NO: 3830691 - RNA, 15 nt, Human
cucugccgcuaccuc

SEQ ID NO: 3830692 - RNA, 21 nt, Human
cucugccgcuaccucccuccc

SEQ ID NO: 3830693 - RNA, 14 nt, Human
cucugccggcucuu

SEQ ID NO: 3830694 - RNA, 14 nt, Human
cucugccucccauc

SEQ ID NO: 3830695 - RNA, 17 nt, Human
cucugccucccaucacc

SEQ ID NO: 3830696 - RNA, 14 nt, Human
cucugccucccuca

SEQ ID NO: 3830697 - RNA, 16 nt, Human
cucugccuccuggguu

SEQ ID NO: 3830698 - RNA, 19 nt, Human
cucugccucugacacacag

SEQ ID NO: 3830699 - RNA, 17 nt, Human
cucugccucugccugca

SEQ ID NO: 3830700 - RNA, 22 nt, Human
cucugccugaagucacacagug

SEQ ID NO: 3830701 - RNA, 16 nt, Human
cucugccugcauucug

SEQ ID NO: 3830702 - RNA, 22 nt, Human
cucugccugcauucugccgugu

SEQ ID NO: 3830703 - RNA, 11 nt, Human
cucugccugcc

SEQ ID NO: 3830704 - RNA, 15 nt, Human
cucugccugccccgc

SEQ ID NO: 3830705 - RNA, 16 nt, Human
cucugccugucccucu

SEQ ID NO: 3830706 - RNA, 18 nt, Human
cucugccugucccucuca

SEQ ID NO: 3830707 - RNA, 20 nt, Human
cucugccuucgaggucagag

SEQ ID NO: 3830708 - RNA, 13 nt, Human
cucugccuugccu

SEQ ID NO: 3830709 - RNA, 15 nt, Human
cucugccuugccuuu

SEQ ID NO: 3830710 - RNA, 23 nt, Human
cucugccuugccuuuagccccuc

SEQ ID NO: 3830711 - RNA, 15 nt, Human
cucugcggaccccag

SEQ ID NO: 3830712 - RNA, 18 nt, Human
cucugcggagcacacugg

SEQ ID NO: 3830713 - RNA, 22 nt, Human
cucugcgucgguccuggugccc

SEQ ID NO: 3830714 - RNA, 22 nt, Human
ccccuguggaugcugcugcccc

SEQ ID NO: 3830715 - RNA, 12 nt, Human
ccccugugggga

SEQ ID NO: 3830716 - RNA, 20 nt, Human
ccccuguuucaaucacuguc

SEQ ID NO: 3830717 - RNA, 14 nt, Human
ccccuuaccacugc

SEQ ID NO: 3830718 - RNA, 13 nt, Human
ccccuuagacaga

SEQ ID NO: 3830719 - RNA, 17 nt, Human
ccccuuagacagaggcc

SEQ ID NO: 3830720 - RNA, 10 nt, Human
ccccuuagau

SEQ ID NO: 3830721 - RNA, 20 nt, Human
ccccuuagccaguuguauau

SEQ ID NO: 3830722 - RNA, 14 nt, Human
ccccuuauccagga

SEQ ID NO: 3830723 - RNA, 15 nt, Human
ccccuuauccucccu

SEQ ID NO: 3830724 - RNA, 14 nt, Human
ccccuucacaaagc

SEQ ID NO: 3830725 - RNA, 17 nt, Human
ccccuuccaaauaauaa

SEQ ID NO: 3830726 - RNA, 14 nt, Human
ccccuuccaugugg

SEQ ID NO: 3830727 - RNA, 15 nt, Human
ccccuuccccacugc

SEQ ID NO: 3830728 - RNA, 20 nt, Human
ccccuuccuaauuccacagc

SEQ ID NO: 3830729 - RNA, 22 nt, Human
ccccuuccuaauuccacagcug

SEQ ID NO: 3830730 - RNA, 14 nt, Human
ccccuuccugggca

SEQ ID NO: 3830731 - RNA, 13 nt, Human
ccccuuccuuuua

SEQ ID NO: 3830732 - RNA, 17 nt, Human
ccccuucgcuccugugu

SEQ ID NO: 3830733 - RNA, 13 nt, Human
ccccuucucccac

SEQ ID NO: 3830734 - RNA, 16 nt, Human
ccccuucucugcucca

SEQ ID NO: 3830735 - RNA, 16 nt, Human
ccccuucugacccaug

SEQ ID NO: 3830736 - RNA, 19 nt, Human
ccccuucugcucagcucug

SEQ ID NO: 3830737 - RNA, 22 nt, Human
ccccuucugggcaucuguucug

SEQ ID NO: 3830738 - RNA, 22 nt, Human
ccccuugaaggagaaucaucag

SEQ ID NO: 3830739 - RNA, 19 nt, Human
ccccuugccagcugcugag

SEQ ID NO: 3830740 - RNA, 21 nt, Human
ccccuugcccagggcucagcc

SEQ ID NO: 3830741 - RNA, 17 nt, Human
ccccuugcccuugcccu

SEQ ID NO: 3830742 - RNA, 21 nt, Human
ccccuugcccuugcccugacc

SEQ ID NO: 3830743 - RNA, 23 nt, Human
ccccuugcccuugcccugaccuc

SEQ ID NO: 3830744 - RNA, 24 nt, Human
ccccuugcccuugcccugaccucc

SEQ ID NO: 3830745 - RNA, 16 nt, Human
ccccuugccugugcca

SEQ ID NO: 3830746 - RNA, 19 nt, Human
ccccuugggcccacaccuc

SEQ ID NO: 3830747 - RNA, 24 nt, Human
ccccuuucagaugucuucugccug

SEQ ID NO: 3830748 - RNA, 10 nt, Human
ccccuuuccu

SEQ ID NO: 3830749 - RNA, 13 nt, Human
ccccuuucuuccu

SEQ ID NO: 3830750 - RNA, 15 nt, Human
ccccuuucuuccuca

SEQ ID NO: 3830751 - RNA, 20 nt, Human
ccccuuugaugauuaauuca

SEQ ID NO: 3830752 - RNA, 15 nt, Human
ccccuuugggcccug

SEQ ID NO: 3830753 - RNA, 18 nt, Human
ccccuuugggcccugcau

SEQ ID NO: 3830754 - RNA, 12 nt, Human
ccccuuugugcu

SEQ ID NO: 3830755 - RNA, 14 nt, Human
ccccuuuucugcau

SEQ ID NO: 3830756 - RNA, 16 nt, Human
ccccuuuucugcauuu

SEQ ID NO: 3830757 - RNA, 23 nt, Human
ccccuuuucuuuucuacccuagc

SEQ ID NO: 3830758 - RNA, 18 nt, Human
ccccuuuuuuuccuuuuu

SEQ ID NO: 3830759 - RNA, 21 nt, Human
cccgaaagaggcacccuucca

SEQ ID NO: 3830760 - RNA, 17 nt, Human
cccgaaaggucaccuca

SEQ ID NO: 3830761 - RNA, 20 nt, Human
cccgaaaggucaccucacuc

SEQ ID NO: 3830762 - RNA, 15 nt, Human
cccgaagggccccca

SEQ ID NO: 3830763 - RNA, 14 nt, Human
cccgaauagcuggg

SEQ ID NO: 3830764 - RNA, 22 nt, Human
cccgaauagcugggacuacagg

SEQ ID NO: 3830765 - RNA, 20 nt, Human
cccgacauggacccggagcu

SEQ ID NO: 3830766 - RNA, 18 nt, Human
cccgacgccacagcccag

SEQ ID NO: 3830767 - RNA, 23 nt, Human
cccgacgccacagcccagccacg

SEQ ID NO: 3830768 - RNA, 15 nt, Human
cccgacuccagccag

SEQ ID NO: 3830769 - RNA, 13 nt, Human
cccgacuugcugu

SEQ ID NO: 3830770 - RNA, 20 nt, Human
cccgagaaaacaaacccagg

SEQ ID NO: 3830771 - RNA, 18 nt, Human
cccgagacggcacugaga

SEQ ID NO: 3830772 - RNA, 16 nt, Human
cccgagcagcugagca

SEQ ID NO: 3830773 - RNA, 13 nt, Human
cccgagccuggcu

SEQ ID NO: 3830774 - RNA, 14 nt, Human
cccgagcugucccc

SEQ ID NO: 3830775 - RNA, 18 nt, Human
cccgaggacccagaccca

SEQ ID NO: 3830776 - RNA, 19 nt, Human
cccgaggccgcgugcguga

SEQ ID NO: 3830777 - RNA, 14 nt, Human
cccgaggcugccca

SEQ ID NO: 3830778 - RNA, 23 nt, Human
cccgagggaggggaagcuucugu

SEQ ID NO: 3830779 - RNA, 22 nt, Human
cccgagggaugaugccacacca

SEQ ID NO: 3830780 - RNA, 19 nt, Human
cccgaggguugauuaaggc

SEQ ID NO: 3830781 - RNA, 19 nt, Human
cucuccccccccccuccaa

SEQ ID NO: 3830782 - RNA, 18 nt, Human
cucuccccucaaagucug

SEQ ID NO: 3830783 - RNA, 13 nt, Human
cucuccccuccag

SEQ ID NO: 3830784 - RNA, 15 nt, Human
cucuccccuccagcc

SEQ ID NO: 3830785 - RNA, 18 nt, Human
cucuccccuccagccuuu

SEQ ID NO: 3830786 - RNA, 17 nt, Human
cucuccccugaccugug

SEQ ID NO: 3830787 - RNA, 17 nt, Human
cucucccgguucuucca

SEQ ID NO: 3830788 - RNA, 19 nt, Human
cucucccgguucuuccagu

SEQ ID NO: 3830789 - RNA, 21 nt, Human
cucucccgucagggcccaagu

SEQ ID NO: 3830790 - RNA, 17 nt, Human
cucucccuccccugcca

SEQ ID NO: 3830791 - RNA, 23 nt, Human
cucucccucuaggcucugccuuc

SEQ ID NO: 3830792 - RNA, 12 nt, Human
cucucccucugg

SEQ ID NO: 3830793 - RNA, 19 nt, Human
cucucccucuggcccugcc

SEQ ID NO: 3830794 - RNA, 16 nt, Human
cucucccucuucucaa

SEQ ID NO: 3830795 - RNA, 13 nt, Human
cucucccugcugc

SEQ ID NO: 3830796 - RNA, 14 nt, Human
cucucccuucccuc

SEQ ID NO: 3830797 - RNA, 16 nt, Human
cucucccuucccuccu

SEQ ID NO: 3830798 - RNA, 18 nt, Human
cucucccuugggcucuga

SEQ ID NO: 3830799 - RNA, 21 nt, Human
cucuccgaccagacaccuuga

SEQ ID NO: 3830800 - RNA, 24 nt, Human
cucuccgacucacaccacuagccu

SEQ ID NO: 3830801 - RNA, 15 nt, Human
cucuccggucucucu

SEQ ID NO: 3830802 - RNA, 17 nt, Human
cucuccuacucggcucu

SEQ ID NO: 3830803 - RNA, 18 nt, Human
cucuccuacucggcucug

SEQ ID NO: 3830804 - RNA, 21 nt, Human
cucuccuagagacagaagcag

SEQ ID NO: 3830805 - RNA, 22 nt, Human
cucuccuaggcauucuggaccu

SEQ ID NO: 3830806 - RNA, 20 nt, Human
cucuccucauguucugcuuu

SEQ ID NO: 3830807 - RNA, 12 nt, Human
cucuccuccaga

SEQ ID NO: 3830808 - RNA, 20 nt, Human
cucuccuccuuuucacaguu

SEQ ID NO: 3830809 - RNA, 15 nt, Human
cucuccucugccuca

SEQ ID NO: 3830810 - RNA, 15 nt, Human
cucuccucugcugcu

SEQ ID NO: 3830811 - RNA, 12 nt, Human
cucuccucuucu

SEQ ID NO: 3830812 - RNA, 15 nt, Human
cucuccucuugccac

SEQ ID NO: 3830813 - RNA, 19 nt, Human
cucuccucuugccacugcc

SEQ ID NO: 3830814 - RNA, 21 nt, Human
cucuccugacuuuuaauguca

SEQ ID NO: 3830815 - RNA, 12 nt, Human
cucuccugccac

SEQ ID NO: 3830816 - RNA, 13 nt, Human
cucuccuggagga

SEQ ID NO: 3830817 - RNA, 20 nt, Human
cucuccuggccuauccgcug

SEQ ID NO: 3830818 - RNA, 15 nt, Human
cucuccugggcagcu

SEQ ID NO: 3830819 - RNA, 20 nt, Human
cucuccugggcagcugccuc

SEQ ID NO: 3830820 - RNA, 23 nt, Human
cucuccugggccccucccuaccu

SEQ ID NO: 3830821 - RNA, 13 nt, Human
cucuccuguaccu

SEQ ID NO: 3830822 - RNA, 12 nt, Human
cucuccugucca

SEQ ID NO: 3830823 - RNA, 21 nt, Human
cucuccuguccaaccuaaccc

SEQ ID NO: 3830824 - RNA, 15 nt, Human
cucuccugucucccu

SEQ ID NO: 3830825 - RNA, 18 nt, Human
cucuccuuaaaugcuucu

SEQ ID NO: 3830826 - RNA, 14 nt, Human
cucuccuuccugug

SEQ ID NO: 3830827 - RNA, 14 nt, Human
cucuccuugagugu

SEQ ID NO: 3830828 - RNA, 16 nt, Human
cucuccuuucuuucua

SEQ ID NO: 3830829 - RNA, 18 nt, Human
cucuccuuuguauauuau

SEQ ID NO: 3830830 - RNA, 22 nt, Human
cucuccuuuguauauuauuucu

SEQ ID NO: 3830831 - RNA, 10 nt, Human
cucuccuuuu

SEQ ID NO: 3830832 - RNA, 11 nt, Human
cucuccuuuuc

SEQ ID NO: 3830833 - RNA, 18 nt, Human
cucuccuuuucuuuuguu

SEQ ID NO: 3830834 - RNA, 19 nt, Human
cucuccuuuucuuuuguua

SEQ ID NO: 3830835 - RNA, 15 nt, Human
cucucgcacaccucu

SEQ ID NO: 3830836 - RNA, 18 nt, Human
cucucgcaccuuuccaaa

SEQ ID NO: 3830837 - RNA, 15 nt, Human
cucucgcaucuuccc

SEQ ID NO: 3830838 - RNA, 16 nt, Human
cucucgcaucuuccca

SEQ ID NO: 3830839 - RNA, 15 nt, Human
cucucgcggccucuu

SEQ ID NO: 3830840 - RNA, 12 nt, Human
cucucggaacug

SEQ ID NO: 3830841 - RNA, 21 nt, Human
cucucggaacugcaugcugcu

SEQ ID NO: 3830842 - RNA, 22 nt, Human
cucucggaaggcuggcugggca

SEQ ID NO: 3830843 - RNA, 19 nt, Human
cucucggaguaucugggaa

SEQ ID NO: 3830844 - RNA, 20 nt, Human
cucucggaguaucugggaac

SEQ ID NO: 3830845 - RNA, 14 nt, Human
cucucggcucccca

SEQ ID NO: 3830846 - RNA, 19 nt, Human
cucucggguugugugucug

SEQ ID NO: 3830847 - RNA, 16 nt, Human
cucucguaacugguuu

SEQ ID NO: 3830848 - RNA, 18 nt, Human
cucucuaaccuccuuuac

SEQ ID NO: 3830849 - RNA, 19 nt, Human
cucucuacagagaggaaau

SEQ ID NO: 3830850 - RNA, 15 nt, Human
cucucuacagugcca

SEQ ID NO: 3830851 - RNA, 17 nt, Human
cucucuacccagcccau

SEQ ID NO: 3830852 - RNA, 22 nt, Human
cucucuacccagcccaucuugc

SEQ ID NO: 3830853 - RNA, 20 nt, Human
cucucuacuccuaccucagc

SEQ ID NO: 3830854 - RNA, 22 nt, Human
cucucuagcacaauuugcacua

SEQ ID NO: 3830855 - RNA, 14 nt, Human
cucucuaggccucu

SEQ ID NO: 3830856 - RNA, 19 nt, Human
cucucuaggccucuccagu

SEQ ID NO: 3830857 - RNA, 20 nt, Human
cucucuauuaccacugaaga

SEQ ID NO: 3830858 - RNA, 14 nt, Human
cucucucacuccuu

SEQ ID NO: 3830859 - RNA, 11 nt, Human
cccggcacccc

SEQ ID NO: 3830860 - RNA, 15 nt, Human
cccggcacccccugc

SEQ ID NO: 3830861 - RNA, 16 nt, Human
cccggcacccccugca

SEQ ID NO: 3830862 - RNA, 18 nt, Human
cccggcacccccugcagc

SEQ ID NO: 3830863 - RNA, 12 nt, Human
cccggcaggccc

SEQ ID NO: 3830864 - RNA, 12 nt, Human
cccggccaccuc

SEQ ID NO: 3830865 - RNA, 12 nt, Human
cccggcccccug

SEQ ID NO: 3830866 - RNA, 18 nt, Human
cccggccccggccccagc

SEQ ID NO: 3830867 - RNA, 15 nt, Human
cccggccccugcugg

SEQ ID NO: 3830868 - RNA, 16 nt, Human
cccggcccugccugcu

SEQ ID NO: 3830869 - RNA, 16 nt, Human
cccggccgccccuccu

SEQ ID NO: 3830870 - RNA, 17 nt, Human
cccggccgcuccaccag

SEQ ID NO: 3830871 - RNA, 17 nt, Human
cccggccugcucccagc

SEQ ID NO: 3830872 - RNA, 21 nt, Human
cccggccugcucccagcagcc

SEQ ID NO: 3830873 - RNA, 14 nt, Human
cccggcgcccucug

SEQ ID NO: 3830874 - RNA, 19 nt, Human
cccggcgcccucuguccug

SEQ ID NO: 3830875 - RNA, 20 nt, Human
cccggcgcccucuguccuga

SEQ ID NO: 3830876 - RNA, 12 nt, Human
cccggcuccagg

SEQ ID NO: 3830877 - RNA, 14 nt, Human
cccggcuccaggcu

SEQ ID NO: 3830878 - RNA, 17 nt, Human
cccggcucccaccgagg

SEQ ID NO: 3830879 - RNA, 15 nt, Human
cccggcuccugguca

SEQ ID NO: 3830880 - RNA, 22 nt, Human
cccggcucugugggugaugggg

SEQ ID NO: 3830881 - RNA, 16 nt, Human
cccggcugcagaggcc

SEQ ID NO: 3830882 - RNA, 12 nt, Human
cccggcugcgga

SEQ ID NO: 3830883 - RNA, 23 nt, Human
cccggcugguuuuguaagaugcu

SEQ ID NO: 3830884 - RNA, 12 nt, Human
cccgggaagcaa

SEQ ID NO: 3830885 - RNA, 21 nt, Human
cccgggaagggggcugggaca

SEQ ID NO: 3830886 - RNA, 14 nt, Human
cccgggagcggagg

SEQ ID NO: 3830887 - RNA, 14 nt, Human
cccgggagcucagg

SEQ ID NO: 3830888 - RNA, 23 nt, Human
cccgggagggcggcacaggucgg

SEQ ID NO: 3830889 - RNA, 21 nt, Human
cccgggcaagacuuuucuuug

SEQ ID NO: 3830890 - RNA, 15 nt, Human
cccgggccagggcug

SEQ ID NO: 3830891 - RNA, 13 nt, Human
cccgggcccagag

SEQ ID NO: 3830892 - RNA, 20 nt, Human
cccgggcccguugaggauga

SEQ ID NO: 3830893 - RNA, 22 nt, Human
cccgggcccguugaggaugagg

SEQ ID NO: 3830894 - RNA, 19 nt, Human
cccgggcgcggccagcccc

SEQ ID NO: 3830895 - RNA, 21 nt, Human
cccgggcucagggaccacagc

SEQ ID NO: 3830896 - RNA, 12 nt, Human
cccgggcucugc

SEQ ID NO: 3830897 - RNA, 15 nt, Human
cccgggcucugccuc

SEQ ID NO: 3830898 - RNA, 21 nt, Human
cccggggacccugugacaugg

SEQ ID NO: 3830899 - RNA, 12 nt, Human
cccggggcagca

SEQ ID NO: 3830900 - RNA, 12 nt, Human
cccggggcagcu

SEQ ID NO: 3830901 - RNA, 14 nt, Human
cccggggcagcugc

SEQ ID NO: 3830902 - RNA, 21 nt, Human
cccggggcagcugccagagaa

SEQ ID NO: 3830903 - RNA, 16 nt, Human
cccggggccagcacuu

SEQ ID NO: 3830904 - RNA, 13 nt, Human
cccggggcccagg

SEQ ID NO: 3830905 - RNA, 14 nt, Human
cccggggcccaggg

SEQ ID NO: 3830906 - RNA, 16 nt, Human
cccggggcccagggca

SEQ ID NO: 3830907 - RNA, 15 nt, Human
cccggggcccagggg

SEQ ID NO: 3830908 - RNA, 19 nt, Human
cccgggggugggggguggg

SEQ ID NO: 3830909 - RNA, 17 nt, Human
cccgggguccuguggca

SEQ ID NO: 3830910 - RNA, 21 nt, Human
cccggggugcccacaggccgc

SEQ ID NO: 3830911 - RNA, 18 nt, Human
cccggguugggucaccag

SEQ ID NO: 3830912 - RNA, 17 nt, Human
cccggucccgaguacag

SEQ ID NO: 3830913 - RNA, 22 nt, Human
cccggucccuugagaccucagc

SEQ ID NO: 3830914 - RNA, 18 nt, Human
cccgguggcggccccagc

SEQ ID NO: 3830915 - RNA, 22 nt, Human
cccgucagggcccaagucccug

SEQ ID NO: 3830916 - RNA, 18 nt, Human
cccguccacggcucuagg

SEQ ID NO: 3830917 - RNA, 14 nt, Human
cccguccugccugu

SEQ ID NO: 3830918 - RNA, 16 nt, Human
cccguccugccugugg

SEQ ID NO: 3830919 - RNA, 16 nt, Human
cccgucucucucccau

SEQ ID NO: 3830920 - RNA, 19 nt, Human
cccgucucucucccaugga

SEQ ID NO: 3830921 - RNA, 17 nt, Human
cccgucuggcccaccag

SEQ ID NO: 3830922 - RNA, 12 nt, Human
cccgucuucagc

SEQ ID NO: 3830923 - RNA, 15 nt, Human
cccgugaccugguca

SEQ ID NO: 3830924 - RNA, 16 nt, Human
cccgugaccuggucag

SEQ ID NO: 3830925 - RNA, 16 nt, Human
cccgugcaaaacaugc

SEQ ID NO: 3830926 - RNA, 22 nt, Human
cccguggccccagccuggccca

SEQ ID NO: 3830927 - RNA, 14 nt, Human
cccgugggcucccg

SEQ ID NO: 3830928 - RNA, 21 nt, Human
cccguggggccggggcuucug

SEQ ID NO: 3830929 - RNA, 14 nt, Human
cccguguggccccu

SEQ ID NO: 3830930 - RNA, 23 nt, Human
cccguguuccccucuugucuccc

SEQ ID NO: 3830931 - RNA, 16 nt, Human
cccguuacagcucccc

SEQ ID NO: 3830932 - RNA, 19 nt, Human
cccguugucucccuggccc

SEQ ID NO: 3830933 - RNA, 20 nt, Human
cccguugucucccuggcccu

SEQ ID NO: 3830934 - RNA, 17 nt, Human
cccuaaaguguauuuuu

SEQ ID NO: 3830935 - RNA, 22 nt, Human
cccuaaaguguauuuuuuuacu

SEQ ID NO: 3830936 - RNA, 15 nt, Human
cccuaaccaaguucc

SEQ ID NO: 3830937 - RNA, 17 nt, Human
cccuaaccccuuccaga

SEQ ID NO: 3830938 - RNA, 21 nt, Human
cccuaaccccuuccagaucac

SEQ ID NO: 3830939 - RNA, 12 nt, Human
cccuaagagacu

SEQ ID NO: 3830940 - RNA, 20 nt, Human
cccuaagcagaaagugccuu

SEQ ID NO: 3830941 - RNA, 21 nt, Human
cccuaagcagaaagugccuuu

SEQ ID NO: 3830942 - RNA, 12 nt, Human
cugaagccucug

SEQ ID NO: 3830943 - RNA, 14 nt, Human
cugaagccucuggg

SEQ ID NO: 3830944 - RNA, 19 nt, Human
cugaagccuuucuuuugga

SEQ ID NO: 3830945 - RNA, 22 nt, Human
cugaagcuaucguaaaauuaag

SEQ ID NO: 3830946 - RNA, 14 nt, Human
cugaagcugccugc

SEQ ID NO: 3830947 - RNA, 15 nt, Human
cugaagcugccugcu

SEQ ID NO: 3830948 - RNA, 16 nt, Human
cugaagcugccugcuu

SEQ ID NO: 3830949 - RNA, 21 nt, Human
cugaagcuuauuaaugcuaag

SEQ ID NO: 3830950 - RNA, 15 nt, Human
cugaagcuugacucc

SEQ ID NO: 3830951 - RNA, 20 nt, Human
cugaagcuugacucccaagu

SEQ ID NO: 3830952 - RNA, 14 nt, Human
cugaagcuuuacca

SEQ ID NO: 3830953 - RNA, 14 nt, Human
cugaaggaaaaaca

SEQ ID NO: 3830954 - RNA, 18 nt, Human
cugaaggaaaaacacaag

SEQ ID NO: 3830955 - RNA, 22 nt, Human
cugaaggaaaaacacaagcaaa

SEQ ID NO: 3830956 - RNA, 22 nt, Human
cugaaggaauaaauugcuccuu

SEQ ID NO: 3830957 - RNA, 20 nt, Human
cugaaggacacuuccugccu

SEQ ID NO: 3830958 - RNA, 19 nt, Human
cugaaggacauugcggaca

SEQ ID NO: 3830959 - RNA, 14 nt, Human
cugaaggacuguga

SEQ ID NO: 3830960 - RNA, 20 nt, Human
cugaaggagauuuuccuucc

SEQ ID NO: 3830961 - RNA, 12 nt, Human
cugaaggagccc

SEQ ID NO: 3830962 - RNA, 21 nt, Human
cugaaggagccccauuccugg

SEQ ID NO: 3830963 - RNA, 17 nt, Human
cugaaggaggccaccuc

SEQ ID NO: 3830964 - RNA, 13 nt, Human
cugaaggccccgc

SEQ ID NO: 3830965 - RNA, 19 nt, Human
cugaaggccugagguuacu

SEQ ID NO: 3830966 - RNA, 13 nt, Human
cugaaggccuggc

SEQ ID NO: 3830967 - RNA, 21 nt, Human
cugaaggccuggcccacagca

SEQ ID NO: 3830968 - RNA, 17 nt, Human
cugaaggcuaaaaagca

SEQ ID NO: 3830969 - RNA, 13 nt, Human
cugaaggcuuuca

SEQ ID NO: 3830970 - RNA, 20 nt, Human
cugaaggcuuucagggccuc

SEQ ID NO: 3830971 - RNA, 14 nt, Human
cugaaggcuuugug

SEQ ID NO: 3830972 - RNA, 11 nt, Human
cugaagggagg

SEQ ID NO: 3830973 - RNA, 18 nt, Human
cugaagggcauucuuucc

SEQ ID NO: 3830974 - RNA, 20 nt, Human
cugaagggguuuucuugaua

SEQ ID NO: 3830975 - RNA, 19 nt, Human
cugaagguaaaauugaaag

SEQ ID NO: 3830976 - RNA, 17 nt, Human
cugaagguuguggccuu

SEQ ID NO: 3830977 - RNA, 16 nt, Human
cugaaguacuaacaca

SEQ ID NO: 3830978 - RNA, 15 nt, Human
cugaagucacacagu

SEQ ID NO: 3830979 - RNA, 19 nt, Human
cugaagucacaucacagga

SEQ ID NO: 3830980 - RNA, 21 nt, Human
cugaagucacaucacaggaca

SEQ ID NO: 3830981 - RNA, 22 nt, Human
cugaagucacaucacaggacac

SEQ ID NO: 3830982 - RNA, 13 nt, Human
cugaagucacugc

SEQ ID NO: 3830983 - RNA, 22 nt, Human
cugaagucacugcacagugcau

SEQ ID NO: 3830984 - RNA, 14 nt, Human
cugaagucagaucu

SEQ ID NO: 3830985 - RNA, 16 nt, Human
cugaagucagaucugc

SEQ ID NO: 3830986 - RNA, 21 nt, Human
cugaagucagaucugccuaag

SEQ ID NO: 3830987 - RNA, 14 nt, Human
cugaagucaguucu

SEQ ID NO: 3830988 - RNA, 14 nt, Human
cugaagucuguauu

SEQ ID NO: 3830989 - RNA, 16 nt, Human
cugaagugcauccaaa

SEQ ID NO: 3830990 - RNA, 17 nt, Human
cugaagugcauccaaag

SEQ ID NO: 3830991 - RNA, 19 nt, Human
cugaagugcauccaaaggu

SEQ ID NO: 3830992 - RNA, 21 nt, Human
cugaaguguuucacgagagcc

SEQ ID NO: 3830993 - RNA, 20 nt, Human
cugaaguuauauuuccuaua

SEQ ID NO: 3830994 - RNA, 17 nt, Human
cugaaguucagcugcau

SEQ ID NO: 3830995 - RNA, 18 nt, Human
cugaaguugcagauguua

SEQ ID NO: 3830996 - RNA, 13 nt, Human
cugaaguuugaua

SEQ ID NO: 3830997 - RNA, 22 nt, Human
cugaaguuugauaaauaguguu

SEQ ID NO: 3830998 - RNA, 13 nt, Human
cugaauaaagcaa

SEQ ID NO: 3830999 - RNA, 18 nt, Human
cugaauaaaguguaacaa

SEQ ID NO: 3831000 - RNA, 12 nt, Human
cugaauaaaugg

SEQ ID NO: 3831001 - RNA, 14 nt, Human
cugaauaaauggua

SEQ ID NO: 3831002 - RNA, 17 nt, Human
cugaauaaaugguagua

SEQ ID NO: 3831003 - RNA, 20 nt, Human
cugaauaacauuuguguggu

SEQ ID NO: 3831004 - RNA, 11 nt, Human
cugaauaauaa

SEQ ID NO: 3831005 - RNA, 23 nt, Human
cugagcccgggcugccugggcug

SEQ ID NO: 3831006 - RNA, 19 nt, Human
cugagcccgguaagagcaa

SEQ ID NO: 3831007 - RNA, 20 nt, Human
cugagcccgguaagagcaaa

SEQ ID NO: 3831008 - RNA, 18 nt, Human
cugagcccuacucccugc

SEQ ID NO: 3831009 - RNA, 21 nt, Human
cugagcccuacucccugcaga

SEQ ID NO: 3831010 - RNA, 14 nt, Human
cugagcccuggcag

SEQ ID NO: 3831011 - RNA, 16 nt, Human
cugagccgcagagaag

SEQ ID NO: 3831012 - RNA, 18 nt, Human
cugagccggccccaggcu

SEQ ID NO: 3831013 - RNA, 23 nt, Human
cugagccggccccaggcucgugg

SEQ ID NO: 3831014 - RNA, 17 nt, Human
cugagccuacagaugaa

SEQ ID NO: 3831015 - RNA, 21 nt, Human
cugagccucucaccuguacuc

SEQ ID NO: 3831016 - RNA, 15 nt, Human
cugagccugcaggga

SEQ ID NO: 3831017 - RNA, 13 nt, Human
cugagccugccga

SEQ ID NO: 3831018 - RNA, 15 nt, Human
cugagccugccgagc

SEQ ID NO: 3831019 - RNA, 19 nt, Human
cugagccugccgagcaacc

SEQ ID NO: 3831020 - RNA, 14 nt, Human
cugagccuggccag

SEQ ID NO: 3831021 - RNA, 15 nt, Human
cugagccuggccagc

SEQ ID NO: 3831022 - RNA, 22 nt, Human
cugagccuggcccauagaaaca

SEQ ID NO: 3831023 - RNA, 14 nt, Human
cugagccuggcugg

SEQ ID NO: 3831024 - RNA, 13 nt, Human
cugagccuucuga

SEQ ID NO: 3831025 - RNA, 15 nt, Human
cugagccuucugagc

SEQ ID NO: 3831026 - RNA, 15 nt, Human
cugagccuuguaauu

SEQ ID NO: 3831027 - RNA, 13 nt, Human
cugagcgccucca

SEQ ID NO: 3831028 - RNA, 22 nt, Human
cugagcgccuccauccaaggcc

SEQ ID NO: 3831029 - RNA, 21 nt, Human
cugagcgccuggauuucuggu

SEQ ID NO: 3831030 - RNA, 22 nt, Human
cugagcgccuggguccagggga

SEQ ID NO: 3831031 - RNA, 14 nt, Human
cugagcgcuccugc

SEQ ID NO: 3831032 - RNA, 13 nt, Human
cugagcgggaggc

SEQ ID NO: 3831033 - RNA, 15 nt, Human
cugagcgggaggcag

SEQ ID NO: 3831034 - RNA, 18 nt, Human
cugagcguccagaaaugg

SEQ ID NO: 3831035 - RNA, 13 nt, Human
cugagcuauuuca

SEQ ID NO: 3831036 - RNA, 17 nt, Human
cugagcucagcguggag

SEQ ID NO: 3831037 - RNA, 17 nt, Human
cugagcuccagcuccuu

SEQ ID NO: 3831038 - RNA, 22 nt, Human
cugagcuccaugugcccccucu

SEQ ID NO: 3831039 - RNA, 16 nt, Human
cugagcuccucugggc

SEQ ID NO: 3831040 - RNA, 17 nt, Human
cugagcuccucugggca

SEQ ID NO: 3831041 - RNA, 20 nt, Human
cugagcuccucugggcagga

SEQ ID NO: 3831042 - RNA, 12 nt, Human
cugagcuccugu

SEQ ID NO: 3831043 - RNA, 17 nt, Human
cugagcuccuguccccu

SEQ ID NO: 3831044 - RNA, 17 nt, Human
cugagcucgguggaccc

SEQ ID NO: 3831045 - RNA, 18 nt, Human
cugagcucgguggaccca

SEQ ID NO: 3831046 - RNA, 15 nt, Human
cugagcucugagagg

SEQ ID NO: 3831047 - RNA, 14 nt, Human
cugagcugagccag

SEQ ID NO: 3831048 - RNA, 18 nt, Human
cugagcugaggcagcagu

SEQ ID NO: 3831049 - RNA, 13 nt, Human
cugagcugccagu

SEQ ID NO: 3831050 - RNA, 14 nt, Human
cugagcugccagug

SEQ ID NO: 3831051 - RNA, 22 nt, Human
cugagcugcccacagcaggcca

SEQ ID NO: 3831052 - RNA, 17 nt, Human
cugagcuggccucucac

SEQ ID NO: 3831053 - RNA, 13 nt, Human
cugagcugugcag

SEQ ID NO: 3831054 - RNA, 20 nt, Human
cugagcuuggaagcuucugg

SEQ ID NO: 3831055 - RNA, 11 nt, Human
cugagcuuuau

SEQ ID NO: 3831056 - RNA, 15 nt, Human
cugagcuuucugcua

SEQ ID NO: 3831057 - RNA, 21 nt, Human
cugagcuuuggacacacacag

SEQ ID NO: 3831058 - RNA, 22 nt, Human
cugagcuuuggacgcacacagc

SEQ ID NO: 3831059 - RNA, 17 nt, Human
cugaggaaaggccagcu

SEQ ID NO: 3831060 - RNA, 21 nt, Human
cugaggaaauugcuuuguauu

SEQ ID NO: 3831061 - RNA, 23 nt, Human
cugaggaagaacggggcucuucu

SEQ ID NO: 3831062 - RNA, 21 nt, Human
cugaggaagacaagugaugcu

SEQ ID NO: 3831063 - RNA, 18 nt, Human
cugaggaagaugggggca

SEQ ID NO: 3831064 - RNA, 20 nt, Human
cugaggaaucaacagggcag

SEQ ID NO: 3831065 - RNA, 23 nt, Human
cugaggaauccagacccggcugc

SEQ ID NO: 3831066 - RNA, 16 nt, Human
cugaggaauuuucuuu

SEQ ID NO: 3831067 - RNA, 11 nt, Human
cugaggacaag

SEQ ID NO: 3831068 - RNA, 23 nt, Human
cugaggacaagagaaaaaagcca

SEQ ID NO: 3831069 - RNA, 17 nt, Human
cugaggacagcuguccu

SEQ ID NO: 3831070 - RNA, 17 nt, Human
cugaggacauuccaaga

SEQ ID NO: 3831071 - RNA, 14 nt, Human
cugaggaccagcca

SEQ ID NO: 3831072 - RNA, 14 nt, Human
cugaggacugauuu

SEQ ID NO: 3831073 - RNA, 22 nt, Human
cugaggacugauuucagaguga

SEQ ID NO: 3831074 - RNA, 23 nt, Human
cugaggagcagcaggagggggga

SEQ ID NO: 3831075 - RNA, 13 nt, Human
cugaggaggggag

SEQ ID NO: 3831076 - RNA, 17 nt, Human
cugaggaucagaguaau

SEQ ID NO: 3831077 - RNA, 18 nt, Human
cugaggaugagcuggaag

SEQ ID NO: 3831078 - RNA, 18 nt, Human
cugaggauuucaagccug

SEQ ID NO: 3831079 - RNA, 13 nt, Human
cugaggcacgagc

SEQ ID NO: 3831080 - RNA, 13 nt, Human
cugaggcagacag

SEQ ID NO: 3831081 - RNA, 15 nt, Human
cugaggcagacagca

SEQ ID NO: 3831082 - RNA, 15 nt, Human
cugaggcagcagugu

SEQ ID NO: 3831083 - RNA, 17 nt, Human
cugaggcagcaguguga

SEQ ID NO: 3831084 - RNA, 22 nt, Human
cugaggcagcagugugaggcca

SEQ ID NO: 3831085 - RNA, 14 nt, Human
cugaggcagguccc

SEQ ID NO: 3831086 - RNA, 24 nt, Human
cugaggccacacucagcacaaggc

SEQ ID NO: 3831087 - RNA, 17 nt, Human
cugaggccacccagagg

SEQ ID NO: 3831088 - RNA, 13 nt, Human
cugaggccagccu

SEQ ID NO: 3831089 - RNA, 17 nt, Human
cugaggccagccuggcc

SEQ ID NO: 3831090 - RNA, 23 nt, Human
cugaggccagccuggccuccugc

SEQ ID NO: 3831091 - RNA, 16 nt, Human
cugaggcccagagggc

SEQ ID NO: 3831092 - RNA, 21 nt, Human
cugaggcccagagggccugca

SEQ ID NO: 3831093 - RNA, 14 nt, Human
cugaggcccuucuc

SEQ ID NO: 3831094 - RNA, 20 nt, Human
cugaggcccuucucuccagc

SEQ ID NO: 3831095 - RNA, 23 nt, Human
cugaggccuaaaaguaaacauua

SEQ ID NO: 3831096 - RNA, 15 nt, Human
cugaggccuagacuc

SEQ ID NO: 3831097 - RNA, 19 nt, Human
cugaggccugagacccagg

SEQ ID NO: 3831098 - RNA, 17 nt, Human
cugaggccugagcgcuc

SEQ ID NO: 3831099 - RNA, 18 nt, Human
cugaggccugagcgcucc

SEQ ID NO: 3831100 - RNA, 19 nt, Human
cugaggccuggacuuuccu

SEQ ID NO: 3831101 - RNA, 15 nt, Human
cugaggccugggccg

SEQ ID NO: 3831102 - RNA, 23 nt, Human
cugaggccugggccgcugccacg

SEQ ID NO: 3831103 - RNA, 18 nt, Human
cugaggcggguggaucac

SEQ ID NO: 3831104 - RNA, 21 nt, Human
cugaggcuccacuuggucugu

SEQ ID NO: 3831105 - RNA, 20 nt, Human
cugaggcuccugugcuacuu

SEQ ID NO: 3831106 - RNA, 15 nt, Human
cugaggcucuuucug

SEQ ID NO: 3831107 - RNA, 18 nt, Human
cugaggcucuuucugggc

SEQ ID NO: 3831108 - RNA, 14 nt, Human
cugaggcuguagga

SEQ ID NO: 3831109 - RNA, 13 nt, Human
cugaggcuguggu

SEQ ID NO: 3831110 - RNA, 17 nt, Human
cugaggcuuuggauuug

SEQ ID NO: 3831111 - RNA, 19 nt, Human
cugagggaaagcccagaaa

SEQ ID NO: 3831112 - RNA, 23 nt, Human
cugagggaaagcccagaaaagga

SEQ ID NO: 3831113 - RNA, 16 nt, Human
cugagggaaagugcau

SEQ ID NO: 3831114 - RNA, 18 nt, Human
cugagggaaauguuuugu

SEQ ID NO: 3831115 - RNA, 12 nt, Human
cugagggaccaa

SEQ ID NO: 3831116 - RNA, 18 nt, Human
cugagggaccaacugggc

SEQ ID NO: 3831117 - RNA, 20 nt, Human
cugagggaccaacugggccc

SEQ ID NO: 3831118 - RNA, 15 nt, Human
cugagggaccagcca

SEQ ID NO: 3831119 - RNA, 14 nt, Human
cugagggacucuga

SEQ ID NO: 3831120 - RNA, 16 nt, Human
cugagggacucugaag

SEQ ID NO: 3831121 - RNA, 21 nt, Human
cugagggacucugaagccucu

SEQ ID NO: 3831122 - RNA, 22 nt, Human
cugagggaggaccuggggcaca

SEQ ID NO: 3831123 - RNA, 16 nt, Human
cugagggaggaggcca

SEQ ID NO: 3831124 - RNA, 23 nt, Human
cugagggcagaaagguucugccc

SEQ ID NO: 3831125 - RNA, 19 nt, Human
cugagggcaguucgcagcc

SEQ ID NO: 3831126 - RNA, 14 nt, Human
cugagggccacacu

SEQ ID NO: 3831127 - RNA, 13 nt, Human
cugagggccccuc

SEQ ID NO: 3831128 - RNA, 15 nt, Human
cugagggccccucug

SEQ ID NO: 3831129 - RNA, 16 nt, Human
cugagggccccucugc

SEQ ID NO: 3831130 - RNA, 17 nt, Human
cugagggccccucugcc

SEQ ID NO: 3831131 - RNA, 16 nt, Human
cugagggcuuccuuug

SEQ ID NO: 3831132 - RNA, 14 nt, Human
cugagggcuuguag

SEQ ID NO: 3831133 - RNA, 14 nt, Human
cugaggggagacag

SEQ ID NO: 3831134 - RNA, 15 nt, Human
cugaggggagacaga

SEQ ID NO: 3831135 - RNA, 17 nt, Human
cugaggggagacagagc

SEQ ID NO: 3831136 - RNA, 18 nt, Human
cugaggggagacagagca

SEQ ID NO: 3831137 - RNA, 22 nt, Human
cugaggggcaacgaagaaaaaa

SEQ ID NO: 3831138 - RNA, 16 nt, Human
cugaggggcagccugc

SEQ ID NO: 3831139 - RNA, 17 nt, Human
cugaggggcagccugcc

SEQ ID NO: 3831140 - RNA, 16 nt, Human
cugaggggcaucugcc

SEQ ID NO: 3831141 - RNA, 14 nt, Human
cugaggggccucuu

SEQ ID NO: 3831142 - RNA, 17 nt, Human
cugaggggcuaccagga

SEQ ID NO: 3831143 - RNA, 20 nt, Human
cugaggggcuaccaggaaag

SEQ ID NO: 3831144 - RNA, 14 nt, Human
cugaggguccagaa

SEQ ID NO: 3831145 - RNA, 17 nt, Human
cugaggguccagaagga

SEQ ID NO: 3831146 - RNA, 18 nt, Human
cugaggguccccaccugg

SEQ ID NO: 3831147 - RNA, 21 nt, Human
cugaggguccccaccugggac

SEQ ID NO: 3831148 - RNA, 20 nt, Human
cugaggguggagacuaagcc

SEQ ID NO: 3831149 - RNA, 16 nt, Human
cugaagaggcgggcca

SEQ ID NO: 3831150 - RNA, 14 nt, Human
cugacucucaaauc

SEQ ID NO: 3831151 - RNA, 15 nt, Human
cugacucugaaaucu

SEQ ID NO: 3831152 - RNA, 14 nt, Human
cugacucugccccc

SEQ ID NO: 3831153 - RNA, 19 nt, Human
cugacucugcccccugcug

SEQ ID NO: 3831154 - RNA, 21 nt, Human
cugacugaaaguagggggcuu

SEQ ID NO: 3831155 - RNA, 14 nt, Human
cugacugcccagca

SEQ ID NO: 3831156 - RNA, 21 nt, Human
cugacugcucagaacuugcug

SEQ ID NO: 3831157 - RNA, 15 nt, Human
cugacugggccaggg

SEQ ID NO: 3831158 - RNA, 21 nt, Human
cugacuguccucuccccucca

SEQ ID NO: 3831159 - RNA, 18 nt, Human
cugacuuaagcaaaagaa

SEQ ID NO: 3831160 - RNA, 12 nt, Human
cugacuuagaau

SEQ ID NO: 3831161 - RNA, 22 nt, Human
cugacuuagaaucccuguguua

SEQ ID NO: 3831162 - RNA, 20 nt, Human
cugacuucaggggcugcccg

SEQ ID NO: 3831163 - RNA, 21 nt, Human
cugacuucaggggcugcccgc

SEQ ID NO: 3831164 - RNA, 22 nt, Human
cugacuucaggggcugcccgcu

SEQ ID NO: 3831165 - RNA, 20 nt, Human
cugacuucauggaauggaca

SEQ ID NO: 3831166 - RNA, 16 nt, Human
cccucuugucuccccu

SEQ ID NO: 3831167 - RNA, 15 nt, Human
cccucuuguuuuguu

SEQ ID NO: 3831168 - RNA, 20 nt, Human
cccucuuguuuuguuugucu

SEQ ID NO: 3831169 - RNA, 22 nt, Human
cccucuuguuuuguuugucucu

SEQ ID NO: 3831170 - RNA, 20 nt, Human
cccucuuucccucccuuccu

SEQ ID NO: 3831171 - RNA, 14 nt, Human
cccucuuucucuuu

SEQ ID NO: 3831172 - RNA, 19 nt, Human
cccucuuuggcuccccugu

SEQ ID NO: 3831173 - RNA, 20 nt, Human
cccucuuuggcuccccugua

SEQ ID NO: 3831174 - RNA, 17 nt, Human
cccugaaaaccucacau

SEQ ID NO: 3831175 - RNA, 23 nt, Human
cccugaaaauguuuuucugccag

SEQ ID NO: 3831176 - RNA, 12 nt, Human
cccugaaacacg

SEQ ID NO: 3831177 - RNA, 13 nt, Human
cccugaaaugugu

SEQ ID NO: 3831178 - RNA, 18 nt, Human
cccugaaccaucccugau

SEQ ID NO: 3831179 - RNA, 11 nt, Human
cccugaagcca

SEQ ID NO: 3831180 - RNA, 14 nt, Human
cccugaagccagcc

SEQ ID NO: 3831181 - RNA, 15 nt, Human
cccugaagccagccu

SEQ ID NO: 3831182 - RNA, 18 nt, Human
cccugaagccagccuucu

SEQ ID NO: 3831183 - RNA, 17 nt, Human
cccugaaggggccauga

SEQ ID NO: 3831184 - RNA, 20 nt, Human
cccugaaugguuccaugccu

SEQ ID NO: 3831185 - RNA, 16 nt, Human
cccugacagggccagu

SEQ ID NO: 3831186 - RNA, 20 nt, Human
cccugacagucccuccucuc

SEQ ID NO: 3831187 - RNA, 17 nt, Human
cccugaccacucagaga

SEQ ID NO: 3831188 - RNA, 19 nt, Human
cccugaccacucagagaca

SEQ ID NO: 3831189 - RNA, 22 nt, Human
cccugaccacucagagacaugc

SEQ ID NO: 3831190 - RNA, 23 nt, Human
cccugaccacucagagacaugca

SEQ ID NO: 3831191 - RNA, 20 nt, Human
cccugaccagcucccccucc

SEQ ID NO: 3831192 - RNA, 19 nt, Human
cccugacccuguggaagca

SEQ ID NO: 3831193 - RNA, 15 nt, Human
cccugaccucacugu

SEQ ID NO: 3831194 - RNA, 15 nt, Human
cccugaccucccagc

SEQ ID NO: 3831195 - RNA, 19 nt, Human
cccugacucauucugaagg

SEQ ID NO: 3831196 - RNA, 14 nt, Human
cccugacuggugcu

SEQ ID NO: 3831197 - RNA, 20 nt, Human
cccugagaagcugcuccagg

SEQ ID NO: 3831198 - RNA, 14 nt, Human
cccugagauccccu

SEQ ID NO: 3831199 - RNA, 17 nt, Human
cccugagauccccugag

SEQ ID NO: 3831200 - RNA, 14 nt, Human
cccugagcccacug

SEQ ID NO: 3831201 - RNA, 17 nt, Human
cccugagccccuuccuu

SEQ ID NO: 3831202 - RNA, 12 nt, Human
cccugagcgccu

SEQ ID NO: 3831203 - RNA, 20 nt, Human
cccugagcuagaacccucug

SEQ ID NO: 3831204 - RNA, 12 nt, Human
cccugagcucgg

SEQ ID NO: 3831205 - RNA, 16 nt, Human
cccugagcugaggcag

SEQ ID NO: 3831206 - RNA, 19 nt, Human
cccugagcugaggcagcag

SEQ ID NO: 3831207 - RNA, 21 nt, Human
cccugagcugaggcagcagug

SEQ ID NO: 3831208 - RNA, 19 nt, Human
cccugaggagccaggccgg

SEQ ID NO: 3831209 - RNA, 13 nt, Human
cccugaggagucu

SEQ ID NO: 3831210 - RNA, 15 nt, Human
cccugaggagucuga

SEQ ID NO: 3831211 - RNA, 18 nt, Human
cccugaggcaggucccca

SEQ ID NO: 3831212 - RNA, 21 nt, Human
cccugaggcagguccccagac

SEQ ID NO: 3831213 - RNA, 13 nt, Human
cccugaggcccag

SEQ ID NO: 3831214 - RNA, 18 nt, Human
cccugaggcccagagggc

SEQ ID NO: 3831215 - RNA, 19 nt, Human
cccugaggcccagagggcc

SEQ ID NO: 3831216 - RNA, 16 nt, Human
cccugaggccuagacu

SEQ ID NO: 3831217 - RNA, 19 nt, Human
cccugaggugugggggcug

SEQ ID NO: 3831218 - RNA, 16 nt, Human
cccugagucaccagga

SEQ ID NO: 3831219 - RNA, 16 nt, Human
cccugagucugggcag

SEQ ID NO: 3831220 - RNA, 19 nt, Human
cccugaguggaucuccaag

SEQ ID NO: 3831221 - RNA, 21 nt, Human
cccugaguggaucuccaagga

SEQ ID NO: 3831222 - RNA, 22 nt, Human
cccugaguggaucuccaaggac

SEQ ID NO: 3831223 - RNA, 20 nt, Human
cccugaguucauccaggccc

SEQ ID NO: 3831224 - RNA, 16 nt, Human
cccugaucccuuccac

SEQ ID NO: 3831225 - RNA, 16 nt, Human
cccugauugaccugcu

SEQ ID NO: 3831226 - RNA, 22 nt, Human
cccugauugaccugcuccgcug

SEQ ID NO: 3831227 - RNA, 15 nt, Human
cccugcaaagcccag

SEQ ID NO: 3831228 - RNA, 16 nt, Human
cccugcaaaggacugu

SEQ ID NO: 3831229 - RNA, 13 nt, Human
cccugcaaccuga

SEQ ID NO: 3831230 - RNA, 16 nt, Human
cccugcaaccugauug

SEQ ID NO: 3831231 - RNA, 16 nt, Human
cccugcaaggcccaca

SEQ ID NO: 3831232 - RNA, 21 nt, Human
cccugcaaggcccacaggagg

SEQ ID NO: 3831233 - RNA, 14 nt, Human
cccugcaauaaaau

SEQ ID NO: 3831234 - RNA, 20 nt, Human
cccugcacagcaggcugcca

SEQ ID NO: 3831235 - RNA, 21 nt, Human
cccugcacagcaggcugccag

SEQ ID NO: 3831236 - RNA, 13 nt, Human
cccugcacaguug

SEQ ID NO: 3831237 - RNA, 23 nt, Human
cccugcaccaugcugcuggggaa

SEQ ID NO: 3831238 - RNA, 16 nt, Human
cccugcacuguaaaau

SEQ ID NO: 3831239 - RNA, 17 nt, Human
cccugcacuguccugcu

SEQ ID NO: 3831240 - RNA, 19 nt, Human
cccugcacuguccugcucc

SEQ ID NO: 3831241 - RNA, 20 nt, Human
cccugcacuguccugcucca

SEQ ID NO: 3831242 - RNA, 21 nt, Human
cccugcacuguccugcuccac

SEQ ID NO: 3831243 - RNA, 23 nt, Human
cccugcagaaccggagagccagc

SEQ ID NO: 3831244 - RNA, 14 nt, Human
cccugcagacccug

SEQ ID NO: 3831245 - RNA, 18 nt, Human
cccugcagagggcacaga

SEQ ID NO: 3831246 - RNA, 20 nt, Human
cccugcagagggcacagaaa

SEQ ID NO: 3831247 - RNA, 14 nt, Human
cccugcagcacgga

SEQ ID NO: 3831248 - RNA, 18 nt, Human
cccugcagcccuggccca

SEQ ID NO: 3831249 - RNA, 19 nt, Human
cccugcagcuuguagccag

SEQ ID NO: 3831250 - RNA, 21 nt, Human
cccugcagcuuguagccagcc

SEQ ID NO: 3831251 - RNA, 23 nt, Human
cccugcaggaaggagcugccugg

SEQ ID NO: 3831252 - RNA, 13 nt, Human
cccugcaguguuc

SEQ ID NO: 3831253 - RNA, 13 nt, Human
cccugcauccccu

SEQ ID NO: 3831254 - RNA, 18 nt, Human
cccugcaucugaccagca

SEQ ID NO: 3831255 - RNA, 21 nt, Human
cccugcaucugaccagcagcg

SEQ ID NO: 3831256 - RNA, 21 nt, Human
cccugcauggcugagcugccc

SEQ ID NO: 3831257 - RNA, 22 nt, Human
cccugcauuggaacuggaggca

SEQ ID NO: 3831258 - RNA, 16 nt, Human
cccugccaaacugaag

SEQ ID NO: 3831259 - RNA, 14 nt, Human
cccugccaccaggc

SEQ ID NO: 3831260 - RNA, 15 nt, Human
cccugccaccaggcc

SEQ ID NO: 3831261 - RNA, 12 nt, Human
cccugccacccu

SEQ ID NO: 3831262 - RNA, 17 nt, Human
cccugccaccucccuga

SEQ ID NO: 3831263 - RNA, 17 nt, Human
cccugccaccuccugcc

SEQ ID NO: 3831264 - RNA, 15 nt, Human
cccugccaccugucu

SEQ ID NO: 3831265 - RNA, 19 nt, Human
cccugccacucacuaggcc

SEQ ID NO: 3831266 - RNA, 21 nt, Human
cccugccagacccccuggaga

SEQ ID NO: 3831267 - RNA, 17 nt, Human
cccugccagcaccccca

SEQ ID NO: 3831268 - RNA, 15 nt, Human
cccugccaggcacag

SEQ ID NO: 3831269 - RNA, 17 nt, Human
cccugccaggcacaggc

SEQ ID NO: 3831270 - RNA, 12 nt, Human
cccugccagggc

SEQ ID NO: 3831271 - RNA, 15 nt, Human
cccugccagugccuu

SEQ ID NO: 3831272 - RNA, 18 nt, Human
cccugccaucuucccagc

SEQ ID NO: 3831273 - RNA, 20 nt, Human
cccugcccacaccuccuggg

SEQ ID NO: 3831274 - RNA, 13 nt, Human
cccugcccaccug

SEQ ID NO: 3831275 - RNA, 14 nt, Human
cccugcccaccugg

SEQ ID NO: 3831276 - RNA, 18 nt, Human
cccugcccaccuggccuc

SEQ ID NO: 3831277 - RNA, 20 nt, Human
cccugcccaccuggccucug

SEQ ID NO: 3831278 - RNA, 22 nt, Human
cccugcccaccuggccucugca

SEQ ID NO: 3831279 - RNA, 20 nt, Human
cccugcccagaucagccaga

SEQ ID NO: 3831280 - RNA, 15 nt, Human
cccugcccaggccgg

SEQ ID NO: 3831281 - RNA, 12 nt, Human
cccugcccaugu

SEQ ID NO: 3831282 - RNA, 16 nt, Human
cccugccccagcaaga

SEQ ID NO: 3831283 - RNA, 19 nt, Human
cccugccccagcccaaguc

SEQ ID NO: 3831284 - RNA, 20 nt, Human
cccugcccccaaauaagaag

SEQ ID NO: 3831285 - RNA, 14 nt, Human
cccugcccccacca

SEQ ID NO: 3831286 - RNA, 16 nt, Human
cccugcccccaggacu

SEQ ID NO: 3831287 - RNA, 17 nt, Human
cccugcccccaggacug

SEQ ID NO: 3831288 - RNA, 22 nt, Human
cccugcccccaggacugggcca

SEQ ID NO: 3831289 - RNA, 12 nt, Human
cccugcccccca

SEQ ID NO: 3831290 - RNA, 14 nt, Human
cccugccccccagc

SEQ ID NO: 3831291 - RNA, 19 nt, Human
cccugccccccagccucug

SEQ ID NO: 3831292 - RNA, 21 nt, Human
cccugccccccagccucuggc

SEQ ID NO: 3831293 - RNA, 15 nt, Human
cccugcccccugcag

SEQ ID NO: 3831294 - RNA, 22 nt, Human
cugcaaccuccgccucuugggu

SEQ ID NO: 3831295 - RNA, 14 nt, Human
cugcaaccugauug

SEQ ID NO: 3831296 - RNA, 23 nt, Human
cugcaacucaaggacuuugcagc

SEQ ID NO: 3831297 - RNA, 18 nt, Human
cugcaacuuguaaaugug

SEQ ID NO: 3831298 - RNA, 19 nt, Human
cugcaacuuuaagcagcuc

SEQ ID NO: 3831299 - RNA, 20 nt, Human
cugcaacuuuaagcagcucu

SEQ ID NO: 3831300 - RNA, 21 nt, Human
cugcaacuuuaagcagcucuu

SEQ ID NO: 3831301 - RNA, 13 nt, Human
cugcaagagccuu

SEQ ID NO: 3831302 - RNA, 19 nt, Human
cugcaagauucugaaacau

SEQ ID NO: 3831303 - RNA, 18 nt, Human
cugcaagcagggcucugc

SEQ ID NO: 3831304 - RNA, 19 nt, Human
cugcaagccgacuacaccu

SEQ ID NO: 3831305 - RNA, 13 nt, Human
cugcaagccugcg

SEQ ID NO: 3831306 - RNA, 14 nt, Human
cugcaagccugcgu

SEQ ID NO: 3831307 - RNA, 13 nt, Human
cugcaagccuguc

SEQ ID NO: 3831308 - RNA, 13 nt, Human
cugcaaggcccac

SEQ ID NO: 3831309 - RNA, 14 nt, Human
cugcaaggcccaca

SEQ ID NO: 3831310 - RNA, 20 nt, Human
cugcaaggcccacaggaggc

SEQ ID NO: 3831311 - RNA, 18 nt, Human
cugcaaggccuuucugug

SEQ ID NO: 3831312 - RNA, 20 nt, Human
cugcaaggccuuucugugug

SEQ ID NO: 3831313 - RNA, 16 nt, Human
cugcaagggcucccca

SEQ ID NO: 3831314 - RNA, 17 nt, Human
cugcaagggcuccccac

SEQ ID NO: 3831315 - RNA, 17 nt, Human
cugcaagguacucuggu

SEQ ID NO: 3831316 - RNA, 18 nt, Human
cugcaagguuuaggcugg

SEQ ID NO: 3831317 - RNA, 16 nt, Human
cugcaagucacaaagg

SEQ ID NO: 3831318 - RNA, 17 nt, Human
cugcaagucacaaagga

SEQ ID NO: 3831319 - RNA, 13 nt, Human
cugcaagucagag

SEQ ID NO: 3831320 - RNA, 19 nt, Human
cugcaaguccuuuuguaaa

SEQ ID NO: 3831321 - RNA, 15 nt, Human
cugacuucuaaguaa

SEQ ID NO: 3831322 - RNA, 11 nt, Human
cugacuucugc

SEQ ID NO: 3831323 - RNA, 19 nt, Human
cugacuucugccuggagac

SEQ ID NO: 3831324 - RNA, 12 nt, Human
cugacuuggcug

SEQ ID NO: 3831325 - RNA, 22 nt, Human
cugacuuggcuggugugguaca

SEQ ID NO: 3831326 - RNA, 20 nt, Human
cugacuuggggagauggagu

SEQ ID NO: 3831327 - RNA, 22 nt, Human
cugacuuggggagauggaguuc

SEQ ID NO: 3831328 - RNA, 13 nt, Human
cugacuuggggga

SEQ ID NO: 3831329 - RNA, 17 nt, Human
cugacuuguuugucuuc

SEQ ID NO: 3831330 - RNA, 22 nt, Human
cugacuuucauuucuugaggua

SEQ ID NO: 3831331 - RNA, 14 nt, Human
cugacuuugcuugc

SEQ ID NO: 3831332 - RNA, 16 nt, Human
cugacuuugcuugcuu

SEQ ID NO: 3831333 - RNA, 12 nt, Human
cugagaaaacaa

SEQ ID NO: 3831334 - RNA, 21 nt, Human
cugagaaaagcuuugaacccu

SEQ ID NO: 3831335 - RNA, 15 nt, Human
cugagaaagacuauu

SEQ ID NO: 3831336 - RNA, 16 nt, Human
cugagaaagcucaaag

SEQ ID NO: 3831337 - RNA, 11 nt, Human
cugagaacacu

SEQ ID NO: 3831338 - RNA, 15 nt, Human
cugagaacacuguga

SEQ ID NO: 3831339 - RNA, 22 nt, Human
cugagaacacugugaaaacauu

SEQ ID NO: 3831340 - RNA, 23 nt, Human
cugagaacccugcguggggacag

SEQ ID NO: 3831341 - RNA, 22 nt, Human
cugagaaccguagaugauuuca

SEQ ID NO: 3831342 - RNA, 13 nt, Human
cugagaaccuggc

SEQ ID NO: 3831343 - RNA, 14 nt, Human
cugagaaccuggcc

SEQ ID NO: 3831344 - RNA, 17 nt, Human
cugagaaccuggccuuc

SEQ ID NO: 3831345 - RNA, 14 nt, Human
cugagaacuccuga

SEQ ID NO: 3831346 - RNA, 15 nt, Human
cugagaacuccugac

SEQ ID NO: 3831347 - RNA, 21 nt, Human
cugagaagaggagcccucauc

SEQ ID NO: 3831348 - RNA, 13 nt, Human
cugagaagcucug

SEQ ID NO: 3831349 - RNA, 18 nt, Human
cugagaagcugcuccagg

SEQ ID NO: 3831350 - RNA, 21 nt, Human
cugagaagcugcuccaggccu

SEQ ID NO: 3831351 - RNA, 23 nt, Human
cugagaagcugcuccaggccugc

SEQ ID NO: 3831352 - RNA, 18 nt, Human
cugagaagucaaacauuu

SEQ ID NO: 3831353 - RNA, 23 nt, Human
cugagaauagaaggaaacuagcu

SEQ ID NO: 3831354 - RNA, 24 nt, Human
cugagaauagaaggaaacuagcuu

SEQ ID NO: 3831355 - RNA, 19 nt, Human
cugagaauguaagaacuac

SEQ ID NO: 3831356 - RNA, 17 nt, Human
cugagacaaucauguac

SEQ ID NO: 3831357 - RNA, 15 nt, Human
cugagacaaugccuu

SEQ ID NO: 3831358 - RNA, 14 nt, Human
cugagacagcccgg

SEQ ID NO: 3831359 - RNA, 16 nt, Human
cugagacagcccgggc

SEQ ID NO: 3831360 - RNA, 17 nt, Human
cugagacagcccgggcu

SEQ ID NO: 3831361 - RNA, 19 nt, Human
cugagacagcccgggcucu

SEQ ID NO: 3831362 - RNA, 20 nt, Human
cugagacagcccgggcucug

SEQ ID NO: 3831363 - RNA, 15 nt, Human
cugagacaggagaau

SEQ ID NO: 3831364 - RNA, 21 nt, Human
cugagaccaaggcuuucucua

SEQ ID NO: 3831365 - RNA, 19 nt, Human
cugagaccaguugggagca

SEQ ID NO: 3831366 - RNA, 16 nt, Human
cugagaccauuuaaca

SEQ ID NO: 3831367 - RNA, 22 nt, Human
cugagaccauuuaacaugcaac

SEQ ID NO: 3831368 - RNA, 17 nt, Human
cugagaccccuggccuc

SEQ ID NO: 3831369 - RNA, 21 nt, Human
cugagaccccuggccuccggc

SEQ ID NO: 3831370 - RNA, 20 nt, Human
cugagaccugacaagcacug

SEQ ID NO: 3831371 - RNA, 20 nt, Human
cugagacucacaggaaggag

SEQ ID NO: 3831372 - RNA, 20 nt, Human
cugagacucagacaggaaag

SEQ ID NO: 3831373 - RNA, 23 nt, Human
cugagacuccggggagcgcccgc

SEQ ID NO: 3831374 - RNA, 17 nt, Human
cugagacucgcgacaau

SEQ ID NO: 3831375 - RNA, 21 nt, Human
cugagacucucuuaggagcag

SEQ ID NO: 3831376 - RNA, 13 nt, Human
cugagagacuuuu

SEQ ID NO: 3831377 - RNA, 12 nt, Human
cugagagccagg

SEQ ID NO: 3831378 - RNA, 21 nt, Human
cugagaggacagagagaaaua

SEQ ID NO: 3831379 - RNA, 13 nt, Human
cugagaggcaggc

SEQ ID NO: 3831380 - RNA, 17 nt, Human
cugagagggcucgaggg

SEQ ID NO: 3831381 - RNA, 19 nt, Human
cugagaguauuuaggcaga

SEQ ID NO: 3831382 - RNA, 22 nt, Human
cugagagucagcucucugcccu

SEQ ID NO: 3831383 - RNA, 17 nt, Human
cugagagucuagauucu

SEQ ID NO: 3831384 - RNA, 14 nt, Human
cugagaguuuaguu

SEQ ID NO: 3831385 - RNA, 16 nt, Human
cugagauaugaacaua

SEQ ID NO: 3831386 - RNA, 21 nt, Human
cugagauaugaacauauuguu

SEQ ID NO: 3831387 - RNA, 17 nt, Human
cugagauccccugagcc

SEQ ID NO: 3831388 - RNA, 13 nt, Human
cugagauccugga

SEQ ID NO: 3831389 - RNA, 21 nt, Human
cugagauccuggacugagggg

SEQ ID NO: 3831390 - RNA, 14 nt, Human
cugagaucgugcca

SEQ ID NO: 3831391 - RNA, 19 nt, Human
cugagaucgugccacugca

SEQ ID NO: 3831392 - RNA, 16 nt, Human
cugagaucucugcagg

SEQ ID NO: 3831393 - RNA, 21 nt, Human
cugagaugagaggggagagcu

SEQ ID NO: 3831394 - RNA, 15 nt, Human
cugagauggaaaagu

SEQ ID NO: 3831395 - RNA, 23 nt, Human
cugagauggaacccuuuuggccc

SEQ ID NO: 3831396 - RNA, 17 nt, Human
cugagauggcccucugg

SEQ ID NO: 3831397 - RNA, 18 nt, Human
cugagauggcccucuggu

SEQ ID NO: 3831398 - RNA, 20 nt, Human
cugagauggcucccaggggc

SEQ ID NO: 3831399 - RNA, 21 nt, Human
cugagauggcucccaggggcu

SEQ ID NO: 3831400 - RNA, 21 nt, Human
cugagaugugaacacaucagc

SEQ ID NO: 3831401 - RNA, 18 nt, Human
cugagauucaauauugaa

SEQ ID NO: 3831402 - RNA, 19 nt, Human
cugagauuuauuaaagaaa

SEQ ID NO: 3831403 - RNA, 18 nt, Human
cugagauuucaucugcuc

SEQ ID NO: 3831404 - RNA, 16 nt, Human
cugagcaacagaguga

SEQ ID NO: 3831405 - RNA, 23 nt, Human
cugagcaacgcuauuccagcugu

SEQ ID NO: 3831406 - RNA, 20 nt, Human
cugagcaacucuugauuauc

SEQ ID NO: 3831407 - RNA, 12 nt, Human
cugagcaagagc

SEQ ID NO: 3831408 - RNA, 16 nt, Human
cugagcaaugucugug

SEQ ID NO: 3831409 - RNA, 17 nt, Human
cugagcaaugucugugc

SEQ ID NO: 3831410 - RNA, 17 nt, Human
cugagcacacuuuagug

SEQ ID NO: 3831411 - RNA, 11 nt, Human
cugagcacaga

SEQ ID NO: 3831412 - RNA, 17 nt, Human
cugagcacccucuggau

SEQ ID NO: 3831413 - RNA, 23 nt, Human
cugagcaccgugucaagcugcuc

SEQ ID NO: 3831414 - RNA, 16 nt, Human
cugagcaccucccagc

SEQ ID NO: 3831415 - RNA, 18 nt, Human
cugagcaccucccagccc

SEQ ID NO: 3831416 - RNA, 21 nt, Human
cugagcaccucccagccccug

SEQ ID NO: 3831417 - RNA, 22 nt, Human
cugagcaccucccagccccugc

SEQ ID NO: 3831418 - RNA, 16 nt, Human
cugagcaccugcuuca

SEQ ID NO: 3831419 - RNA, 13 nt, Human
cugagcacuguuu

SEQ ID NO: 3831420 - RNA, 14 nt, Human
cugagcacuguuuu

SEQ ID NO: 3831421 - RNA, 21 nt, Human
cugagcacuguuuucuagugu

SEQ ID NO: 3831422 - RNA, 13 nt, Human
cugagcaggccac

SEQ ID NO: 3831423 - RNA, 15 nt, Human
cugagcaggccacac

SEQ ID NO: 3831424 - RNA, 23 nt, Human
cugagcagggccggggaacuggc

SEQ ID NO: 3831425 - RNA, 15 nt, Human
cugagcaguccuugg

SEQ ID NO: 3831426 - RNA, 21 nt, Human
cugagcaguccuuggccugcu

SEQ ID NO: 3831427 - RNA, 15 nt, Human
cugagccaaagagaa

SEQ ID NO: 3831428 - RNA, 19 nt, Human
cugagccacagcagcauuu

SEQ ID NO: 3831429 - RNA, 15 nt, Human
cugagccaccugccc

SEQ ID NO: 3831430 - RNA, 18 nt, Human
cugagccagauuucacuc

SEQ ID NO: 3831431 - RNA, 11 nt, Human
cugagccaggc

SEQ ID NO: 3831432 - RNA, 12 nt, Human
cugagccaggcu

SEQ ID NO: 3831433 - RNA, 14 nt, Human
cugagccaggcuag

SEQ ID NO: 3831434 - RNA, 19 nt, Human
cugagccagucccaggggc

SEQ ID NO: 3831435 - RNA, 22 nt, Human
cugagccagugucaggaggaag

SEQ ID NO: 3831436 - RNA, 22 nt, Human
cugagccaguucaguaccugga

SEQ ID NO: 3831437 - RNA, 16 nt, Human
cugagcccagggaggc

SEQ ID NO: 3831438 - RNA, 15 nt, Human
ccgagagccugcucc

SEQ ID NO: 3831439 - RNA, 21 nt, Human
ccgagaggugggccagucugu

SEQ ID NO: 3831440 - RNA, 20 nt, Human
ccgagaguccaucagccucc

SEQ ID NO: 3831441 - RNA, 18 nt, Human
ccgagauagccaaggcca

SEQ ID NO: 3831442 - RNA, 19 nt, Human
ccgagauagccaaggccaa

SEQ ID NO: 3831443 - RNA, 22 nt, Human
ccgagauagccaaggccaaagg

SEQ ID NO: 3831444 - RNA, 21 nt, Human
ccgagaucacgccacugcacu

SEQ ID NO: 3831445 - RNA, 15 nt, Human
ccgagauugcaccac

SEQ ID NO: 3831446 - RNA, 15 nt, Human
ccgagcaaagaucaa

SEQ ID NO: 3831447 - RNA, 21 nt, Human
ccgagcaaagaucaaaauaaa

SEQ ID NO: 3831448 - RNA, 18 nt, Human
ccgagcaaagucuaaagu

SEQ ID NO: 3831449 - RNA, 20 nt, Human
ccgagcaaagucuaaaguuu

SEQ ID NO: 3831450 - RNA, 18 nt, Human
ccgagcagcugagcaggg

SEQ ID NO: 3831451 - RNA, 21 nt, Human
ccgagcagcugagcagggccg

SEQ ID NO: 3831452 - RNA, 17 nt, Human
ccgagcuccucuuccau

SEQ ID NO: 3831453 - RNA, 18 nt, Human
ccgagcuccucuuccaug

SEQ ID NO: 3831454 - RNA, 23 nt, Human
ccgagcucguguauccuggggcu

SEQ ID NO: 3831455 - RNA, 11 nt, Human
ccgagcugggg

SEQ ID NO: 3831456 - RNA, 16 nt, Human
ccgagcuggugcauua

SEQ ID NO: 3831457 - RNA, 13 nt, Human
ccgagcugucccc

SEQ ID NO: 3831458 - RNA, 14 nt, Human
ccgagcuguuuaug

SEQ ID NO: 3831459 - RNA, 21 nt, Human
ccgaggaaacgaaacccacuc

SEQ ID NO: 3831460 - RNA, 14 nt, Human
ccgaggaaacucag

SEQ ID NO: 3831461 - RNA, 15 nt, Human
ccgaggacccagacc

SEQ ID NO: 3831462 - RNA, 17 nt, Human
ccgaggacccagaccca

SEQ ID NO: 3831463 - RNA, 18 nt, Human
ccgaggacccagacccag

SEQ ID NO: 3831464 - RNA, 17 nt, Human
ccgaggacccaggaaag

SEQ ID NO: 3831465 - RNA, 17 nt, Human
ccgaggagggagagucu

SEQ ID NO: 3831466 - RNA, 19 nt, Human
ccgaggcaccaguguccuc

SEQ ID NO: 3831467 - RNA, 14 nt, Human
ccgaggcaggcaga

SEQ ID NO: 3831468 - RNA, 15 nt, Human
ccgaggcaggcagau

SEQ ID NO: 3831469 - RNA, 14 nt, Human
ccgaggcaggguca

SEQ ID NO: 3831470 - RNA, 13 nt, Human
ccgaggcccugca

SEQ ID NO: 3831471 - RNA, 14 nt, Human
ccgaggcccugcau

SEQ ID NO: 3831472 - RNA, 12 nt, Human
ccgaggcugaga

SEQ ID NO: 3831473 - RNA, 14 nt, Human
ccgaggcuggagcu

SEQ ID NO: 3831474 - RNA, 16 nt, Human
ccgagggcgaccccgu

SEQ ID NO: 3831475 - RNA, 13 nt, Human
ccgagggcugagc

SEQ ID NO: 3831476 - RNA, 14 nt, Human
ccgaggggccuuug

SEQ ID NO: 3831477 - RNA, 16 nt, Human
ccgaggggcucaggaa

SEQ ID NO: 3831478 - RNA, 16 nt, Human
ccgagggggcugcucc

SEQ ID NO: 3831479 - RNA, 18 nt, Human
ccgagggggcugcuccca

SEQ ID NO: 3831480 - RNA, 19 nt, Human
ccgagggggcugcucccac

SEQ ID NO: 3831481 - RNA, 16 nt, Human
ccgaggguccuggcuc

SEQ ID NO: 3831482 - RNA, 21 nt, Human
ccgaggguugauuaaggcagu

SEQ ID NO: 3831483 - RNA, 22 nt, Human
ccgaggguugauuaaggcagua

SEQ ID NO: 3831484 - RNA, 16 nt, Human
ccgaguagcugggacu

SEQ ID NO: 3831485 - RNA, 14 nt, Human
ccgagucucuucuc

SEQ ID NO: 3831486 - RNA, 22 nt, Human
ccgagucucuucuccacuggau

SEQ ID NO: 3831487 - RNA, 14 nt, Human
ccgagucugucucu

SEQ ID NO: 3831488 - RNA, 22 nt, Human
ccgaguguguuucauccuuccc

SEQ ID NO: 3831489 - RNA, 20 nt, Human
ccgauccuccccuggacucc

SEQ ID NO: 3831490 - RNA, 14 nt, Human
ccgauccuuccucc

SEQ ID NO: 3831491 - RNA, 16 nt, Human
ccgaugcccagagaca

SEQ ID NO: 3831492 - RNA, 13 nt, Human
ccgaugcugcuuu

SEQ ID NO: 3831493 - RNA, 17 nt, Human
ccgaugcugcuuucccc

SEQ ID NO: 3831494 - RNA, 19 nt, Human
ccgauguuauuagauguua

SEQ ID NO: 3831495 - RNA, 13 nt, Human
ccgauuucuguaa

SEQ ID NO: 3831496 - RNA, 16 nt, Human
ccgauuucuguaaacu

SEQ ID NO: 3831497 - RNA, 12 nt, Human
ccgauuuuucca

SEQ ID NO: 3831498 - RNA, 21 nt, Human
ccgcaaaccacacuggacucc

SEQ ID NO: 3831499 - RNA, 21 nt, Human
ccgcacacccucacucugcca

SEQ ID NO: 3831500 - RNA, 12 nt, Human
ccgcacagcagc

SEQ ID NO: 3831501 - RNA, 14 nt, Human
ccgcacagcagccu

SEQ ID NO: 3831502 - RNA, 14 nt, Human
ccgcacagcucagg

SEQ ID NO: 3831503 - RNA, 16 nt, Human
ccgcacagcucaggag

SEQ ID NO: 3831504 - RNA, 18 nt, Human
ccgcacagcucaggaggc

SEQ ID NO: 3831505 - RNA, 15 nt, Human
ccgcacccccacccu

SEQ ID NO: 3831506 - RNA, 13 nt, Human
ccgcaccccccaa

SEQ ID NO: 3831507 - RNA, 19 nt, Human
ccgcaccuaaagcagccag

SEQ ID NO: 3831508 - RNA, 14 nt, Human
ccgcaccuguacag

SEQ ID NO: 3831509 - RNA, 22 nt, Human
ccgcaccuguacaguggaaccg

SEQ ID NO: 3831510 - RNA, 14 nt, Human
ccgcacugggcuug

SEQ ID NO: 3831511 - RNA, 21 nt, Human
ccgcacuuuccacuucuuccu

SEQ ID NO: 3831512 - RNA, 13 nt, Human
ccgcagaaggaag

SEQ ID NO: 3831513 - RNA, 14 nt, Human
ccgcagacaccuug

SEQ ID NO: 3831514 - RNA, 16 nt, Human
ccgcagacaccuugga

SEQ ID NO: 3831515 - RNA, 13 nt, Human
ccgcagaccuccc

SEQ ID NO: 3831516 - RNA, 15 nt, Human
ccgcagaccucccca

SEQ ID NO: 3831517 - RNA, 16 nt, Human
ccgcagaccuccccag

SEQ ID NO: 3831518 - RNA, 19 nt, Human
ccgcagaccuccccagccc

SEQ ID NO: 3831519 - RNA, 20 nt, Human
ccgcagaccuccccagcccc

SEQ ID NO: 3831520 - RNA, 21 nt, Human
ccgcagcccccacccccaagg

SEQ ID NO: 3831521 - RNA, 20 nt, Human
ccgcagcucuugcccuuccc

SEQ ID NO: 3831522 - RNA, 14 nt, Human
ccgcaggaagcugc

SEQ ID NO: 3831523 - RNA, 15 nt, Human
ccgcaggaagcugcu

SEQ ID NO: 3831524 - RNA, 23 nt, Human
ccgcaggauuugggcucuuggaa

SEQ ID NO: 3831525 - RNA, 23 nt, Human
ccgcagugugcacuaaggggccc

SEQ ID NO: 3831526 - RNA, 13 nt, Human
ccgcauccccugc

SEQ ID NO: 3831527 - RNA, 16 nt, Human
ccgcauccuagucucu

SEQ ID NO: 3831528 - RNA, 22 nt, Human
ccgcaucuucuccaucuggcag

SEQ ID NO: 3831529 - RNA, 14 nt, Human
ccgcaugcagcagc

SEQ ID NO: 3831530 - RNA, 23 nt, Human
cugccaucucaccuccugcuggg

SEQ ID NO: 3831531 - RNA, 22 nt, Human
cugccaucuuaguuuggauucu

SEQ ID NO: 3831532 - RNA, 23 nt, Human
cugccaucuuaguuuggauucuu

SEQ ID NO: 3831533 - RNA, 17 nt, Human
cugccaugcagggccuc

SEQ ID NO: 3831534 - RNA, 14 nt, Human
cugccaugccagcu

SEQ ID NO: 3831535 - RNA, 15 nt, Human
cugccaugccagcuu

SEQ ID NO: 3831536 - RNA, 17 nt, Human
cugccaugccagcuuau

SEQ ID NO: 3831537 - RNA, 19 nt, Human
cugccaugccagcuuaucu

SEQ ID NO: 3831538 - RNA, 22 nt, Human
cugccaugccaggaaccugucc

SEQ ID NO: 3831539 - RNA, 23 nt, Human
cugccaugccaggaaccuguccu

SEQ ID NO: 3831540 - RNA, 21 nt, Human
cugccauggaggcacacagcu

SEQ ID NO: 3831541 - RNA, 23 nt, Human
cugccauggaggcacacagcugc

SEQ ID NO: 3831542 - RNA, 14 nt, Human
cugccauggcgugu

SEQ ID NO: 3831543 - RNA, 23 nt, Human
cugccauguaccuccccugccuu

SEQ ID NO: 3831544 - RNA, 19 nt, Human
cugccauguacuaguuuua

SEQ ID NO: 3831545 - RNA, 22 nt, Human
cugccauguugccccuuucucu

SEQ ID NO: 3831546 - RNA, 15 nt, Human
cugccauuaaagaau

SEQ ID NO: 3831547 - RNA, 17 nt, Human
cugccauuaaagaauau

SEQ ID NO: 3831548 - RNA, 22 nt, Human
cugccauuacagagguauuaaa

SEQ ID NO: 3831549 - RNA, 21 nt, Human
cugccauuauuuucugucaga

SEQ ID NO: 3831550 - RNA, 13 nt, Human
cugccauuuaaaa

SEQ ID NO: 3831551 - RNA, 16 nt, Human
cugccauuucugagau

SEQ ID NO: 3831552 - RNA, 19 nt, Human
cugccauuugcacccuccg

SEQ ID NO: 3831553 - RNA, 17 nt, Human
cugcccaacccuucccu

SEQ ID NO: 3831554 - RNA, 17 nt, Human
cugcccaaccugcucuc

SEQ ID NO: 3831555 - RNA, 19 nt, Human
cugcccaaccugcucuccu

SEQ ID NO: 3831556 - RNA, 21 nt, Human
cugcccaauuuugcagggagc

SEQ ID NO: 3831557 - RNA, 16 nt, Human
cugcccacaccuccug

SEQ ID NO: 3831558 - RNA, 17 nt, Human
cugcccacaccuccugg

SEQ ID NO: 3831559 - RNA, 17 nt, Human
cugcccacauuggaccc

SEQ ID NO: 3831560 - RNA, 19 nt, Human
cugcccacccccucaagcc

SEQ ID NO: 3831561 - RNA, 11 nt, Human
cugcccaccug

SEQ ID NO: 3831562 - RNA, 19 nt, Human
cugcccaccugccuggccg

SEQ ID NO: 3831563 - RNA, 14 nt, Human
cugcccaccuggcc

SEQ ID NO: 3831564 - RNA, 19 nt, Human
cugcccaccuggccucugc

SEQ ID NO: 3831565 - RNA, 22 nt, Human
cugcccaccuggccucugcacu

SEQ ID NO: 3831566 - RNA, 16 nt, Human
cugcccacucccugca

SEQ ID NO: 3831567 - RNA, 13 nt, Human
cugcccacuguuu

SEQ ID NO: 3831568 - RNA, 22 nt, Human
cugcccacuguuucucuugagc

SEQ ID NO: 3831569 - RNA, 21 nt, Human
cugcccagaauucccagcugu

SEQ ID NO: 3831570 - RNA, 21 nt, Human
cugcccagaccccucuggcca

SEQ ID NO: 3831571 - RNA, 18 nt, Human
cugcccagagcuggguga

SEQ ID NO: 3831572 - RNA, 17 nt, Human
cugcccagcccccuggu

SEQ ID NO: 3831573 - RNA, 13 nt, Human
cugcccagcuugg

SEQ ID NO: 3831574 - RNA, 15 nt, Human
cugcccagcuugggc

SEQ ID NO: 3831575 - RNA, 21 nt, Human
cugcccagcuugggcccagcu

SEQ ID NO: 3831576 - RNA, 20 nt, Human
cugcccagcuuuucauugcu

SEQ ID NO: 3831577 - RNA, 23 nt, Human
cugcccaggaccaucuucccgag

SEQ ID NO: 3831578 - RNA, 21 nt, Human
cugcccaggacggggccggcc

SEQ ID NO: 3831579 - RNA, 11 nt, Human
cugcccaggag

SEQ ID NO: 3831580 - RNA, 21 nt, Human
cugcccaggagagccagcccu

SEQ ID NO: 3831581 - RNA, 16 nt, Human
cugcccaggcacugca

SEQ ID NO: 3831582 - RNA, 20 nt, Human
cugcccaggccccugccacc

SEQ ID NO: 3831583 - RNA, 14 nt, Human
ccggcgucagccuc

SEQ ID NO: 3831584 - RNA, 21 nt, Human
ccggcgucagccuccagccuc

SEQ ID NO: 3831585 - RNA, 22 nt, Human
ccggcgucagccuccagccucu

SEQ ID NO: 3831586 - RNA, 15 nt, Human
ccggcuaauuuuugu

SEQ ID NO: 3831587 - RNA, 18 nt, Human
ccggcuaauuuuuguaau

SEQ ID NO: 3831588 - RNA, 16 nt, Human
ccggcuccaggcuccu

SEQ ID NO: 3831589 - RNA, 15 nt, Human
ccggcucccagccuc

SEQ ID NO: 3831590 - RNA, 14 nt, Human
ccggcuccugguca

SEQ ID NO: 3831591 - RNA, 17 nt, Human
ccggcuccuggucaccu

SEQ ID NO: 3831592 - RNA, 16 nt, Human
ccggcuccugugcuuu

SEQ ID NO: 3831593 - RNA, 23 nt, Human
ccggcucgagcaguccugccuca

SEQ ID NO: 3831594 - RNA, 17 nt, Human
ccggcucuacgggggcc

SEQ ID NO: 3831595 - RNA, 12 nt, Human
ccggcucugugg

SEQ ID NO: 3831596 - RNA, 17 nt, Human
ccggcucuuuccuugcu

SEQ ID NO: 3831597 - RNA, 13 nt, Human
ccggcuggccugg

SEQ ID NO: 3831598 - RNA, 17 nt, Human
ccggcugugcucagaga

SEQ ID NO: 3831599 - RNA, 16 nt, Human
ccggcugugcugggag

SEQ ID NO: 3831600 - RNA, 19 nt, Human
ccggcuuuguggcacuggg

SEQ ID NO: 3831601 - RNA, 17 nt, Human
ccgggaaccuccccagc

SEQ ID NO: 3831602 - RNA, 19 nt, Human
ccgggaaccuccccagccu

SEQ ID NO: 3831603 - RNA, 14 nt, Human
ccgggaagcaaaug

SEQ ID NO: 3831604 - RNA, 17 nt, Human
ccgggaagggggcuggg

SEQ ID NO: 3831605 - RNA, 20 nt, Human
ccgggaagggggcugggaca

SEQ ID NO: 3831606 - RNA, 21 nt, Human
ccgggaccacccugagccggc

SEQ ID NO: 3831607 - RNA, 17 nt, Human
ccgggacccccaggaca

SEQ ID NO: 3831608 - RNA, 17 nt, Human
ccgggaccuggugcugc

SEQ ID NO: 3831609 - RNA, 21 nt, Human
ccgggacguggcaccuccucg

SEQ ID NO: 3831610 - RNA, 12 nt, Human
ccgggacuccag

SEQ ID NO: 3831611 - RNA, 12 nt, Human
ccgggagagggg

SEQ ID NO: 3831612 - RNA, 15 nt, Human
ccgggagcugcugcc

SEQ ID NO: 3831613 - RNA, 15 nt, Human
ccgggaggggcccgc

SEQ ID NO: 3831614 - RNA, 13 nt, Human
ccgggcagagcac

SEQ ID NO: 3831615 - RNA, 20 nt, Human
ccgggcagagcacagcgggg

SEQ ID NO: 3831616 - RNA, 12 nt, Human
ccgggcagaggg

SEQ ID NO: 3831617 - RNA, 13 nt, Human
ccgggccacagag

SEQ ID NO: 3831618 - RNA, 18 nt, Human
ccgggccacuccuuccug

SEQ ID NO: 3831619 - RNA, 13 nt, Human
ccgggcccagagg

SEQ ID NO: 3831620 - RNA, 16 nt, Human
ccgggcccagaggagc

SEQ ID NO: 3831621 - RNA, 13 nt, Human
ccgggccccacag

SEQ ID NO: 3831622 - RNA, 13 nt, Human
ccgggcccucccu

SEQ ID NO: 3831623 - RNA, 14 nt, Human
ccgggcgcgguggc

SEQ ID NO: 3831624 - RNA, 20 nt, Human
ccgggcgcgguggcucacgc

SEQ ID NO: 3831625 - RNA, 21 nt, Human
ccgggcucagggaccacagca

SEQ ID NO: 3831626 - RNA, 14 nt, Human
ccgggcucucugcu

SEQ ID NO: 3831627 - RNA, 13 nt, Human
ccgggcucugccu

SEQ ID NO: 3831628 - RNA, 21 nt, Human
ccgggcugccugggcuguugg

SEQ ID NO: 3831629 - RNA, 15 nt, Human
ccggggaaaggcaag

SEQ ID NO: 3831630 - RNA, 15 nt, Human
ccggggaacuggcca

SEQ ID NO: 3831631 - RNA, 18 nt, Human
ccggggaacuggccaagc

SEQ ID NO: 3831632 - RNA, 19 nt, Human
ccggggaacuggccaagcu

SEQ ID NO: 3831633 - RNA, 15 nt, Human
ccggggacagaggcc

SEQ ID NO: 3831634 - RNA, 15 nt, Human
ccggggagcgcccgc

SEQ ID NO: 3831635 - RNA, 20 nt, Human
ccggggccugggcaggaggg

SEQ ID NO: 3831636 - RNA, 19 nt, Human
ccggggccuuaucgggcuc

SEQ ID NO: 3831637 - RNA, 19 nt, Human
ccggggcuggcggcuacuc

SEQ ID NO: 3831638 - RNA, 15 nt, Human
ccggggcuggguugg

SEQ ID NO: 3831639 - RNA, 21 nt, Human
ccgggguccuguggcaggcag

SEQ ID NO: 3831640 - RNA, 23 nt, Human
ccgggguccuguggcaggcagcg

SEQ ID NO: 3831641 - RNA, 20 nt, Human
ccggggugcccacaggccgc

SEQ ID NO: 3831642 - RNA, 18 nt, Human
ccggguccuuggcccccu

SEQ ID NO: 3831643 - RNA, 21 nt, Human
ccgggucuuccuacucuucuc

SEQ ID NO: 3831644 - RNA, 16 nt, Human
ccgggucuugauucag

SEQ ID NO: 3831645 - RNA, 20 nt, Human
ccggguucuagucuccuuug

SEQ ID NO: 3831646 - RNA, 22 nt, Human
ccggguuuggcgggccaaggac

SEQ ID NO: 3831647 - RNA, 15 nt, Human
ccgguaacuguccug

SEQ ID NO: 3831648 - RNA, 19 nt, Human
ccgguaagagcaaaagaau

SEQ ID NO: 3831649 - RNA, 17 nt, Human
ccgguagggaggcagcc

SEQ ID NO: 3831650 - RNA, 19 nt, Human
ccggucaccuagcaagcug

SEQ ID NO: 3831651 - RNA, 21 nt, Human
ccgguccagcuggccuggaca

SEQ ID NO: 3831652 - RNA, 18 nt, Human
ccggucccaccccucccu

SEQ ID NO: 3831653 - RNA, 23 nt, Human
ccggucccaccccucccucuguc

SEQ ID NO: 3831654 - RNA, 20 nt, Human
ccggucccuugagaccucag

SEQ ID NO: 3831655 - RNA, 23 nt, Human
ccggucccuugagaccucagcca

SEQ ID NO: 3831656 - RNA, 22 nt, Human
ccggucgcccuuugcugcaugg

SEQ ID NO: 3831657 - RNA, 23 nt, Human
ccggucgcccuuugcugcauggc

SEQ ID NO: 3831658 - RNA, 21 nt, Human
ccggucgggggggacccucca

SEQ ID NO: 3831659 - RNA, 16 nt, Human
ccggucugcaagucag

SEQ ID NO: 3831660 - RNA, 19 nt, Human
ccggucuuugauccgcagc

SEQ ID NO: 3831661 - RNA, 18 nt, Human
ccggugaccucuagcccu

SEQ ID NO: 3831662 - RNA, 17 nt, Human
ccggugggggggcagag

SEQ ID NO: 3831663 - RNA, 13 nt, Human
ccgguguucuaag

SEQ ID NO: 3831664 - RNA, 14 nt, Human
ccgguugcuucugg

SEQ ID NO: 3831665 - RNA, 16 nt, Human
ccgguugcuucuggga

SEQ ID NO: 3831666 - RNA, 12 nt, Human
ccguaaaaacug

SEQ ID NO: 3831667 - RNA, 19 nt, Human
ccguaauaacacccuuccu

SEQ ID NO: 3831668 - RNA, 12 nt, Human
ccguaauuuaac

SEQ ID NO: 3831669 - RNA, 12 nt, Human
ccguaccccacc

SEQ ID NO: 3831670 - RNA, 13 nt, Human
ccguaccccaccc

SEQ ID NO: 3831671 - RNA, 15 nt, Human
ccguaccccacccuc

SEQ ID NO: 3831672 - RNA, 17 nt, Human
ccguaccccacccucag

SEQ ID NO: 3831673 - RNA, 18 nt, Human
ccguaccccacccucagc

SEQ ID NO: 3831674 - RNA, 23 nt, Human
ccguacgacucuuuuccaaacac

SEQ ID NO: 3831675 - RNA, 16 nt, Human
ccguagguuauuuuca

SEQ ID NO: 3831676 - RNA, 22 nt, Human
ccgucaaaacagauuguuugca

SEQ ID NO: 3831677 - RNA, 14 nt, Human
ccgucaacguugua

SEQ ID NO: 3831678 - RNA, 23 nt, Human
ccgucaagagugaauucccucac

SEQ ID NO: 3831679 - RNA, 12 nt, Human
ccgucacagccu

SEQ ID NO: 3831680 - RNA, 13 nt, Human
ccgucacagccuc

SEQ ID NO: 3831681 - RNA, 13 nt, Human
ccgucacauccca

SEQ ID NO: 3831682 - RNA, 13 nt, Human
ccgucaccaccac

SEQ ID NO: 3831683 - RNA, 15 nt, Human
ccgucaccaccaccc

SEQ ID NO: 3831684 - RNA, 17 nt, Human
ccgucaccaccaccccu

SEQ ID NO: 3831685 - RNA, 21 nt, Human
ccgucaccacgacuggccagg

SEQ ID NO: 3831686 - RNA, 12 nt, Human
ccgucagugcug

SEQ ID NO: 3831687 - RNA, 17 nt, Human
ccgucauguuccucaaa

SEQ ID NO: 3831688 - RNA, 18 nt, Human
ccgucccauauccugccu

SEQ ID NO: 3831689 - RNA, 18 nt, Human
ccguccccuagaguccca

SEQ ID NO: 3831690 - RNA, 17 nt, Human
ccguccccucccaggga

SEQ ID NO: 3831691 - RNA, 11 nt, Human
ccguccucacc

SEQ ID NO: 3831692 - RNA, 16 nt, Human
ccguccucaccccugu

SEQ ID NO: 3831693 - RNA, 23 nt, Human
ccguccucaccccuguccucacu

SEQ ID NO: 3831694 - RNA, 14 nt, Human
ccguccugccugug

SEQ ID NO: 3831695 - RNA, 14 nt, Human
cugcagcuggacag

SEQ ID NO: 3831696 - RNA, 18 nt, Human
cugcagcuggacagaggg

SEQ ID NO: 3831697 - RNA, 23 nt, Human
cugcagcuguuuuaguuaaauuu

SEQ ID NO: 3831698 - RNA, 19 nt, Human
cugcagcuuguagccagcc

SEQ ID NO: 3831699 - RNA, 21 nt, Human
cugcagcuuguagccagccgg

SEQ ID NO: 3831700 - RNA, 15 nt, Human
cugcaggaaggagcu

SEQ ID NO: 3831701 - RNA, 17 nt, Human
cugcaggaaggagcugc

SEQ ID NO: 3831702 - RNA, 21 nt, Human
cugcaggaaggagcugccugg

SEQ ID NO: 3831703 - RNA, 23 nt, Human
cugcaggaaggagcugccuggac

SEQ ID NO: 3831704 - RNA, 15 nt, Human
cugcaggaaucaaaa

SEQ ID NO: 3831705 - RNA, 20 nt, Human
cugcaggaaucaaaaauuga

SEQ ID NO: 3831706 - RNA, 22 nt, Human
cugcaggaaucaaaaauugaag

SEQ ID NO: 3831707 - RNA, 16 nt, Human
cugcaggaccugccug

SEQ ID NO: 3831708 - RNA, 23 nt, Human
cugcaggacuugagaagaccuca

SEQ ID NO: 3831709 - RNA, 20 nt, Human
cugcaggaugauuguacaga

SEQ ID NO: 3831710 - RNA, 20 nt, Human
cugcaggauugauuaugcag

SEQ ID NO: 3831711 - RNA, 12 nt, Human
cugcaggcaccu

SEQ ID NO: 3831712 - RNA, 14 nt, Human
cugcaggcagacac

SEQ ID NO: 3831713 - RNA, 15 nt, Human
cugcaggcagacacg

SEQ ID NO: 3831714 - RNA, 17 nt, Human
cugcaggcagacacgga

SEQ ID NO: 3831715 - RNA, 13 nt, Human
cugcaggcagcca

SEQ ID NO: 3831716 - RNA, 15 nt, Human
cugcaggcagccagg

SEQ ID NO: 3831717 - RNA, 21 nt, Human
cugcaggccaagagcagaggc

SEQ ID NO: 3831718 - RNA, 22 nt, Human
cugcaggccaagagcagaggca

SEQ ID NO: 3831719 - RNA, 24 nt, Human
cugcaggccaagagcagaggcagc

SEQ ID NO: 3831720 - RNA, 23 nt, Human
cugcaggccaggccagcugccuc

SEQ ID NO: 3831721 - RNA, 11 nt, Human
cugcaggcccc

SEQ ID NO: 3831722 - RNA, 14 nt, Human
cugcaggccccgcu

SEQ ID NO: 3831723 - RNA, 14 nt, Human
cugcaggcccuggc

SEQ ID NO: 3831724 - RNA, 16 nt, Human
cugcaggcccuggccu

SEQ ID NO: 3831725 - RNA, 19 nt, Human
cugcaggcccuggccuccc

SEQ ID NO: 3831726 - RNA, 15 nt, Human
cugcaggcugagcca

SEQ ID NO: 3831727 - RNA, 14 nt, Human
cugcaggcugagug

SEQ ID NO: 3831728 - RNA, 20 nt, Human
ccuauuuuugacauggaaau

SEQ ID NO: 3831729 - RNA, 20 nt, Human
ccuauuuuuuuucuguuaua

SEQ ID NO: 3831730 - RNA, 14 nt, Human
ccucaaaacaaagg

SEQ ID NO: 3831731 - RNA, 15 nt, Human
ccucaaaacuggagu

SEQ ID NO: 3831732 - RNA, 17 nt, Human
ccucaaaacuggagucc

SEQ ID NO: 3831733 - RNA, 15 nt, Human
ccucaaaccuccucu

SEQ ID NO: 3831734 - RNA, 14 nt, Human
ccucaaagaaagug

SEQ ID NO: 3831735 - RNA, 20 nt, Human
ccucaaagcuuccauuccac

SEQ ID NO: 3831736 - RNA, 24 nt, Human
ccucaaagcuuggauuaaauacau

SEQ ID NO: 3831737 - RNA, 18 nt, Human
ccucaaauaaaaagugcu

SEQ ID NO: 3831738 - RNA, 14 nt, Human
ccucaaauccagga

SEQ ID NO: 3831739 - RNA, 18 nt, Human
ccucaaauccaggacccu

SEQ ID NO: 3831740 - RNA, 24 nt, Human
ccucaaauccaggacccugccagg

SEQ ID NO: 3831741 - RNA, 19 nt, Human
ccucaaaugacccaaagac

SEQ ID NO: 3831742 - RNA, 14 nt, Human
ccucaaaugagaaa

SEQ ID NO: 3831743 - RNA, 19 nt, Human
ccucaaaugggucuggggg

SEQ ID NO: 3831744 - RNA, 15 nt, Human
ccucaaauuuuuuga

SEQ ID NO: 3831745 - RNA, 17 nt, Human
ccucaaauuuuuugacu

SEQ ID NO: 3831746 - RNA, 17 nt, Human
ccucaacaagggagaga

SEQ ID NO: 3831747 - RNA, 17 nt, Human
ccucaacaguguuuuca

SEQ ID NO: 3831748 - RNA, 23 nt, Human
ccucaacccucccucagccccuc

SEQ ID NO: 3831749 - RNA, 18 nt, Human
cugcccuggcugcugccc

SEQ ID NO: 3831750 - RNA, 11 nt, Human
cugcccuggga

SEQ ID NO: 3831751 - RNA, 22 nt, Human
cugcccugggaggcagugaugg

SEQ ID NO: 3831752 - RNA, 24 nt, Human
cugcccugggauguccacagaugc

SEQ ID NO: 3831753 - RNA, 20 nt, Human
cugcccugguccagggaagc

SEQ ID NO: 3831754 - RNA, 14 nt, Human
cugcccuggugcug

SEQ ID NO: 3831755 - RNA, 19 nt, Human
cugcccuggugcugccaca

SEQ ID NO: 3831756 - RNA, 17 nt, Human
cugcccugguggcccuc

SEQ ID NO: 3831757 - RNA, 21 nt, Human
cugcccugguuuccugcccug

SEQ ID NO: 3831758 - RNA, 13 nt, Human
cugcccuguaccc

SEQ ID NO: 3831759 - RNA, 21 nt, Human
cugcccuguaccccagcacuu

SEQ ID NO: 3831760 - RNA, 24 nt, Human
cugcccugugaguacuacaguccu

SEQ ID NO: 3831761 - RNA, 11 nt, Human
cugcccugugg

SEQ ID NO: 3831762 - RNA, 14 nt, Human
cugcccugugggcc

SEQ ID NO: 3831763 - RNA, 15 nt, Human
cugcccugugggccc

SEQ ID NO: 3831764 - RNA, 18 nt, Human
cugcccugugggccccca

SEQ ID NO: 3831765 - RNA, 13 nt, Human
cugcccuguguac

SEQ ID NO: 3831766 - RNA, 22 nt, Human
cugcccuguguacuucccgggc

SEQ ID NO: 3831767 - RNA, 19 nt, Human
cugcccuguuguguauaga

SEQ ID NO: 3831768 - RNA, 23 nt, Human
cugcccuuaccugccaggaagcc

SEQ ID NO: 3831769 - RNA, 16 nt, Human
cugcccuucaccccag

SEQ ID NO: 3831770 - RNA, 14 nt, Human
cugcccuuccucag

SEQ ID NO: 3831771 - RNA, 15 nt, Human
cugcccuuccucagu

SEQ ID NO: 3831772 - RNA, 15 nt, Human
cugcccuuccugcag

SEQ ID NO: 3831773 - RNA, 14 nt, Human
cugcccuucuuccc

SEQ ID NO: 3831774 - RNA, 18 nt, Human
cugcccuucuuccccuuc

SEQ ID NO: 3831775 - RNA, 13 nt, Human
cugcccuugggcc

SEQ ID NO: 3831776 - RNA, 17 nt, Human
cugcccuugucccacuc

SEQ ID NO: 3831777 - RNA, 12 nt, Human
cugcccuuguuu

SEQ ID NO: 3831778 - RNA, 14 nt, Human
cugcccuuuguccu

SEQ ID NO: 3831779 - RNA, 18 nt, Human
cugcccuuuuuucugccu

SEQ ID NO: 3831780 - RNA, 20 nt, Human
cugccgacacgcucccuccc

SEQ ID NO: 3831781 - RNA, 13 nt, Human
cugccgaccagag

SEQ ID NO: 3831782 - RNA, 15 nt, Human
cugccgaccucgucc

SEQ ID NO: 3831783 - RNA, 17 nt, Human
cugccgaccucguccuc

SEQ ID NO: 3831784 - RNA, 15 nt, Human
cugccgacuccuggg

SEQ ID NO: 3831785 - RNA, 22 nt, Human
cugccgagaguccaucagccuc

SEQ ID NO: 3831786 - RNA, 17 nt, Human
cugccgcaacaguuuuu

SEQ ID NO: 3831787 - RNA, 19 nt, Human
cugccgcaauacaggaacc

SEQ ID NO: 3831788 - RNA, 15 nt, Human
cugccgcaccccaga

SEQ ID NO: 3831789 - RNA, 13 nt, Human
cugccgcagcccu

SEQ ID NO: 3831790 - RNA, 18 nt, Human
cugccgcagcccugcaga

SEQ ID NO: 3831791 - RNA, 22 nt, Human
cugccgcagcccugcagagggc

SEQ ID NO: 3831792 - RNA, 22 nt, Human
cugccgcccgagguggcugccu

SEQ ID NO: 3831793 - RNA, 14 nt, Human
cugccgccucccag

SEQ ID NO: 3831794 - RNA, 15 nt, Human
cugccggagaggaag

SEQ ID NO: 3831795 - RNA, 16 nt, Human
cugccggagaggaaga

SEQ ID NO: 3831796 - RNA, 14 nt, Human
cugccggcgguggc

SEQ ID NO: 3831797 - RNA, 14 nt, Human
cugccggcucuggc

SEQ ID NO: 3831798 - RNA, 14 nt, Human
cugccggcucuuuc

SEQ ID NO: 3831799 - RNA, 15 nt, Human
cugccgggcugaggg

SEQ ID NO: 3831800 - RNA, 17 nt, Human
cugccggggcagccccc

SEQ ID NO: 3831801 - RNA, 23 nt, Human
cugccggguucuagucuccuuug

SEQ ID NO: 3831802 - RNA, 16 nt, Human
cugccgucaccaccac

SEQ ID NO: 3831803 - RNA, 22 nt, Human
cugccgucaccaccaccccuac

SEQ ID NO: 3831804 - RNA, 21 nt, Human
cugccguccccuagaguccca

SEQ ID NO: 3831805 - RNA, 14 nt, Human
cugccgucucugga

SEQ ID NO: 3831806 - RNA, 20 nt, Human
cugccgugcauuagcacaga

SEQ ID NO: 3831807 - RNA, 15 nt, Human
cugccgugccgccug

SEQ ID NO: 3831808 - RNA, 13 nt, Human
cugccguggggcc

SEQ ID NO: 3831809 - RNA, 15 nt, Human
cugccuaagaggcaa

SEQ ID NO: 3831810 - RNA, 14 nt, Human
cugccuaaggacuu

SEQ ID NO: 3831811 - RNA, 15 nt, Human
cugccuaagugcagc

SEQ ID NO: 3831812 - RNA, 15 nt, Human
cugccuaaguggcug

SEQ ID NO: 3831813 - RNA, 15 nt, Human
cugccuaauuacgau

SEQ ID NO: 3831814 - RNA, 23 nt, Human
cugccuaauuacgauaaggaaga

SEQ ID NO: 3831815 - RNA, 23 nt, Human
cugccuacagaacuucagaaaga

SEQ ID NO: 3831816 - RNA, 14 nt, Human
cugccuacucacga

SEQ ID NO: 3831817 - RNA, 15 nt, Human
cugccuagaaacaac

SEQ ID NO: 3831818 - RNA, 20 nt, Human
cugccuagaaacaacacugu

SEQ ID NO: 3831819 - RNA, 21 nt, Human
cugccuagaaacaacacugua

SEQ ID NO: 3831820 - RNA, 23 nt, Human
cugccuagauucagggaaagugg

SEQ ID NO: 3831821 - RNA, 19 nt, Human
cugccuagcaagcuggccu

SEQ ID NO: 3831822 - RNA, 20 nt, Human
cugccuagcaagcuggccuc

SEQ ID NO: 3831823 - RNA, 20 nt, Human
cugccuagcacucacaugcu

SEQ ID NO: 3831824 - RNA, 23 nt, Human
cugccuagcacucacaugcugga

SEQ ID NO: 3831825 - RNA, 17 nt, Human
cugccuagcugccuagc

SEQ ID NO: 3831826 - RNA, 21 nt, Human
cugccuagcugccuagcaagc

SEQ ID NO: 3831827 - RNA, 23 nt, Human
cugccuauuaucugucagcugca

SEQ ID NO: 3831828 - RNA, 22 nt, Human
cugccuauugcagcugggagaa

SEQ ID NO: 3831829 - RNA, 14 nt, Human
cugccucacuuccu

SEQ ID NO: 3831830 - RNA, 15 nt, Human
cugccucagccuccc

SEQ ID NO: 3831831 - RNA, 18 nt, Human
cugccucagccucccgag

SEQ ID NO: 3831832 - RNA, 10 nt, Human
cugccucagg

SEQ ID NO: 3831833 - RNA, 23 nt, Human
cugccucaggaggcaggaccuuc

SEQ ID NO: 3831834 - RNA, 17 nt, Human
cugccucaggccucugu

SEQ ID NO: 3831835 - RNA, 12 nt, Human
cugccucauuua

SEQ ID NO: 3831836 - RNA, 12 nt, Human
cugccuccaccc

SEQ ID NO: 3831837 - RNA, 15 nt, Human
cugccuccacccucu

SEQ ID NO: 3831838 - RNA, 17 nt, Human
cugccuccacccucuga

SEQ ID NO: 3831839 - RNA, 17 nt, Human
cugccuccacucccacu

SEQ ID NO: 3831840 - RNA, 19 nt, Human
cugccuccacucccacuuc

SEQ ID NO: 3831841 - RNA, 22 nt, Human
cugccuccagaauggucuuucu

SEQ ID NO: 3831842 - RNA, 13 nt, Human
cugccuccaggaa

SEQ ID NO: 3831843 - RNA, 15 nt, Human
cugccuccagggcug

SEQ ID NO: 3831844 - RNA, 19 nt, Human
cugccuccagggcuggacu

SEQ ID NO: 3831845 - RNA, 21 nt, Human
cugccucccaacaguggggaa

SEQ ID NO: 3831846 - RNA, 11 nt, Human
cugccucccau

SEQ ID NO: 3831847 - RNA, 16 nt, Human
cugccucccauucuga

SEQ ID NO: 3831848 - RNA, 16 nt, Human
cugccuccccaacccu

SEQ ID NO: 3831849 - RNA, 22 nt, Human
cugccuccccaacccugccccu

SEQ ID NO: 3831850 - RNA, 13 nt, Human
cugccuccccucc

SEQ ID NO: 3831851 - RNA, 18 nt, Human
cugccucccucacccuga

SEQ ID NO: 3831852 - RNA, 19 nt, Human
cugccucccucacccugag

SEQ ID NO: 3831853 - RNA, 20 nt, Human
cugccucccucacccugagc

SEQ ID NO: 3831854 - RNA, 15 nt, Human
cugccucccuucaug

SEQ ID NO: 3831855 - RNA, 11 nt, Human
cugccuccucg

SEQ ID NO: 3831856 - RNA, 15 nt, Human
cugccuccucuucaa

SEQ ID NO: 3831857 - RNA, 18 nt, Human
cugccucgaaacacagaa

SEQ ID NO: 3831858 - RNA, 15 nt, Human
cugccucgaacuggc

SEQ ID NO: 3831859 - RNA, 17 nt, Human
cugccucgaacuggcug

SEQ ID NO: 3831860 - RNA, 18 nt, Human
cugccucgaacuggcugc

SEQ ID NO: 3831861 - RNA, 20 nt, Human
cugccucggauccccuuccu

SEQ ID NO: 3831862 - RNA, 22 nt, Human
cugccucuacugggaaggcuac

SEQ ID NO: 3831863 - RNA, 16 nt, Human
cugccucucacacaca

SEQ ID NO: 3831864 - RNA, 22 nt, Human
cugccucucacagcugaguugu

SEQ ID NO: 3831865 - RNA, 14 nt, Human
cugccucuccaggc

SEQ ID NO: 3831866 - RNA, 14 nt, Human
cugccucucccagg

SEQ ID NO: 3831867 - RNA, 15 nt, Human
cugccucucccaggc

SEQ ID NO: 3831868 - RNA, 19 nt, Human
cugccucucccaggcaggg

SEQ ID NO: 3831869 - RNA, 18 nt, Human
cugccucucccuggcccu

SEQ ID NO: 3831870 - RNA, 19 nt, Human
cugccucucccuggcccuc

SEQ ID NO: 3831871 - RNA, 14 nt, Human
cugccucuccgccc

SEQ ID NO: 3831872 - RNA, 22 nt, Human
cugccucuccgccccugagccc

SEQ ID NO: 3831873 - RNA, 13 nt, Human
cuggagaacuaga

SEQ ID NO: 3831874 - RNA, 14 nt, Human
cuggagaacuagag

SEQ ID NO: 3831875 - RNA, 12 nt, Human
cuggagaagaga

SEQ ID NO: 3831876 - RNA, 14 nt, Human
cuggagaagagagg

SEQ ID NO: 3831877 - RNA, 16 nt, Human
cuggagaagagaggag

SEQ ID NO: 3831878 - RNA, 20 nt, Human
cuggagaagagaggagagga

SEQ ID NO: 3831879 - RNA, 13 nt, Human
cuggagaagcuga

SEQ ID NO: 3831880 - RNA, 15 nt, Human
cuggagaagcugaug

SEQ ID NO: 3831881 - RNA, 19 nt, Human
cuggagaagcugaugcuuu

SEQ ID NO: 3831882 - RNA, 13 nt, Human
cuggagaauaauu

SEQ ID NO: 3831883 - RNA, 17 nt, Human
cuggagaauaauucuuu

SEQ ID NO: 3831884 - RNA, 19 nt, Human
cuggagaauaauucuuuga

SEQ ID NO: 3831885 - RNA, 21 nt, Human
cuggagacaaugcagaugcca

SEQ ID NO: 3831886 - RNA, 11 nt, Human
cuggagacagc

SEQ ID NO: 3831887 - RNA, 13 nt, Human
cuggagacagccc

SEQ ID NO: 3831888 - RNA, 16 nt, Human
cuggagacagccccag

SEQ ID NO: 3831889 - RNA, 17 nt, Human
cuggagacagccccaga

SEQ ID NO: 3831890 - RNA, 18 nt, Human
cuggagaccagggagccu

SEQ ID NO: 3831891 - RNA, 18 nt, Human
cuggagaccaugcagagc

SEQ ID NO: 3831892 - RNA, 23 nt, Human
cuggagacccaccccaccugcag

SEQ ID NO: 3831893 - RNA, 21 nt, Human
cuggagacgggugggcggcug

SEQ ID NO: 3831894 - RNA, 20 nt, Human
cuggagacguggaaccucug

SEQ ID NO: 3831895 - RNA, 22 nt, Human
cuggagacguggaaccucuguc

SEQ ID NO: 3831896 - RNA, 18 nt, Human
cuggagacuccuaggcag

SEQ ID NO: 3831897 - RNA, 19 nt, Human
cuggagacuccuaggcagg

SEQ ID NO: 3831898 - RNA, 20 nt, Human
cuggagacuccuaggcagga

SEQ ID NO: 3831899 - RNA, 14 nt, Human
cuggagagaaacaa

SEQ ID NO: 3831900 - RNA, 14 nt, Human
cuggagagaacagg

SEQ ID NO: 3831901 - RNA, 13 nt, Human
cuggagagcaaca

SEQ ID NO: 3831902 - RNA, 19 nt, Human
cuggagagcuagaaccugg

SEQ ID NO: 3831903 - RNA, 20 nt, Human
cuggagagcuagaaccugga

SEQ ID NO: 3831904 - RNA, 23 nt, Human
cuggagaggagggaugcugccug

SEQ ID NO: 3831905 - RNA, 12 nt, Human
cuggagagguua

SEQ ID NO: 3831906 - RNA, 16 nt, Human
cuggagauacuggugg

SEQ ID NO: 3831907 - RNA, 14 nt, Human
cuggagauccuccu

SEQ ID NO: 3831908 - RNA, 20 nt, Human
cuggagaugaggccagacca

SEQ ID NO: 3831909 - RNA, 19 nt, Human
cuggagcacaaagacccug

SEQ ID NO: 3831910 - RNA, 23 nt, Human
cuggagcacaauaaauggcugua

SEQ ID NO: 3831911 - RNA, 15 nt, Human
cuggagcaccaggca

SEQ ID NO: 3831912 - RNA, 16 nt, Human
cuggagcacugggcuc

SEQ ID NO: 3831913 - RNA, 17 nt, Human
cuggagcacugggcucc

SEQ ID NO: 3831914 - RNA, 19 nt, Human
cuggagcacugggcucccg

SEQ ID NO: 3831915 - RNA, 20 nt, Human
cugccugcaauauuugaauu

SEQ ID NO: 3831916 - RNA, 15 nt, Human
cugccugccagcugc

SEQ ID NO: 3831917 - RNA, 21 nt, Human
cugccugccagcugcacugau

SEQ ID NO: 3831918 - RNA, 12 nt, Human
cugccugccaug

SEQ ID NO: 3831919 - RNA, 22 nt, Human
cugccugccauguaccuccccu

SEQ ID NO: 3831920 - RNA, 16 nt, Human
cugccugcccacacag

SEQ ID NO: 3831921 - RNA, 15 nt, Human
cugccugcccacccg

SEQ ID NO: 3831922 - RNA, 14 nt, Human
cugccugcccaggc

SEQ ID NO: 3831923 - RNA, 15 nt, Human
cugccugcccaggcc

SEQ ID NO: 3831924 - RNA, 16 nt, Human
cugccugcccaggccc

SEQ ID NO: 3831925 - RNA, 21 nt, Human
cugccugccccgcccccaguc

SEQ ID NO: 3831926 - RNA, 22 nt, Human
cugccugccccgcccccagucc

SEQ ID NO: 3831927 - RNA, 18 nt, Human
cugccugcccgcacagca

SEQ ID NO: 3831928 - RNA, 20 nt, Human
cugccugcccgcacagcagc

SEQ ID NO: 3831929 - RNA, 11 nt, Human
cugccugcccu

SEQ ID NO: 3831930 - RNA, 17 nt, Human
cugccugcccuuugucc

SEQ ID NO: 3831931 - RNA, 15 nt, Human
cugccugccugucug

SEQ ID NO: 3831932 - RNA, 18 nt, Human
cugccugccuuaagugag

SEQ ID NO: 3831933 - RNA, 14 nt, Human
cugccugcucccau

SEQ ID NO: 3831934 - RNA, 15 nt, Human
cugccugcucccauc

SEQ ID NO: 3831935 - RNA, 12 nt, Human
cugccugcuugg

SEQ ID NO: 3831936 - RNA, 12 nt, Human
cugccugcuuug

SEQ ID NO: 3831937 - RNA, 20 nt, Human
cugccugcuuuucacugcug

SEQ ID NO: 3831938 - RNA, 11 nt, Human
cugccuggacc

SEQ ID NO: 3831939 - RNA, 12 nt, Human
cugccuggaccc

SEQ ID NO: 3831940 - RNA, 13 nt, Human
cugccuggacccg

SEQ ID NO: 3831941 - RNA, 13 nt, Human
cugccuggagccc

SEQ ID NO: 3831942 - RNA, 16 nt, Human
cugccuggagccccac

SEQ ID NO: 3831943 - RNA, 11 nt, Human
cugccuggagg

SEQ ID NO: 3831944 - RNA, 18 nt, Human
cugccuggaggaccugag

SEQ ID NO: 3831945 - RNA, 19 nt, Human
cugccuggaggaccugagc

SEQ ID NO: 3831946 - RNA, 12 nt, Human
cugccuggcagg

SEQ ID NO: 3831947 - RNA, 17 nt, Human
cugccuggccaggcaga

SEQ ID NO: 3831948 - RNA, 21 nt, Human
cugccuggccaggcagaucug

SEQ ID NO: 3831949 - RNA, 23 nt, Human
cugccuggcccccaaccucaggg

SEQ ID NO: 3831950 - RNA, 18 nt, Human
cugccuggccggccagcc

SEQ ID NO: 3831951 - RNA, 19 nt, Human
cugccuggccggccagcca

SEQ ID NO: 3831952 - RNA, 21 nt, Human
cugccugggaucccucauccu

SEQ ID NO: 3831953 - RNA, 22 nt, Human
cugccugggaucccucauccuc

SEQ ID NO: 3831954 - RNA, 23 nt, Human
cugccugggcugaccccgguggc

SEQ ID NO: 3831955 - RNA, 17 nt, Human
cugccugggcuguuggc

SEQ ID NO: 3831956 - RNA, 18 nt, Human
cugccugggcuguuggca

SEQ ID NO: 3831957 - RNA, 24 nt, Human
cugccugggcuguuggcacucaca

SEQ ID NO: 3831958 - RNA, 19 nt, Human
cugccuggggcgggccccu

SEQ ID NO: 3831959 - RNA, 16 nt, Human
cugccugguccucaca

SEQ ID NO: 3831960 - RNA, 23 nt, Human
cugccugguccucacacucaccc

SEQ ID NO: 3831961 - RNA, 15 nt, Human
cugccuggucuccug

SEQ ID NO: 3831962 - RNA, 21 nt, Human
cugccuggucuccugccccca

SEQ ID NO: 3831963 - RNA, 20 nt, Human
cugccuguagcccacucugc

SEQ ID NO: 3831964 - RNA, 23 nt, Human
cugccuguagcccacucugcucg

SEQ ID NO: 3831965 - RNA, 13 nt, Human
cugccuguaguua

SEQ ID NO: 3831966 - RNA, 19 nt, Human
cugccuguaguuaggaaau

SEQ ID NO: 3831967 - RNA, 15 nt, Human
cugccuguccccaug

SEQ ID NO: 3831968 - RNA, 24 nt, Human
cugccugucccuaccccauggugc

SEQ ID NO: 3831969 - RNA, 13 nt, Human
cugccugucuccu

SEQ ID NO: 3831970 - RNA, 11 nt, Human
cugccugucug

SEQ ID NO: 3831971 - RNA, 12 nt, Human
cugccugucugc

SEQ ID NO: 3831972 - RNA, 13 nt, Human
cugccugucuguc

SEQ ID NO: 3831973 - RNA, 16 nt, Human
cugccugugagccagu

SEQ ID NO: 3831974 - RNA, 12 nt, Human
cugccugugcug

SEQ ID NO: 3831975 - RNA, 23 nt, Human
cugccuguggccaugacccugcc

SEQ ID NO: 3831976 - RNA, 12 nt, Human
cugccuguggcg

SEQ ID NO: 3831977 - RNA, 21 nt, Human
cugccuguuauaacucugcac

SEQ ID NO: 3831978 - RNA, 22 nt, Human
cugccuguuauaacucugcacu

SEQ ID NO: 3831979 - RNA, 18 nt, Human
cugccuguucagcuccag

SEQ ID NO: 3831980 - RNA, 19 nt, Human
cugccuguucccauucuug

SEQ ID NO: 3831981 - RNA, 21 nt, Human
cugccuguugcgugacacucu

SEQ ID NO: 3831982 - RNA, 23 nt, Human
cugccuguugcgugacacucucc

SEQ ID NO: 3831983 - RNA, 19 nt, Human
cugccuguugggccaggag

SEQ ID NO: 3831984 - RNA, 17 nt, Human
cugccuuaaaaccaaag

SEQ ID NO: 3831985 - RNA, 16 nt, Human
cugccuuaagugagga

SEQ ID NO: 3831986 - RNA, 23 nt, Human
cugccuuagaggagcccacggcu

SEQ ID NO: 3831987 - RNA, 14 nt, Human
cugccuuagcuuca

SEQ ID NO: 3831988 - RNA, 15 nt, Human
cugccuuagcuucag

SEQ ID NO: 3831989 - RNA, 19 nt, Human
cugccuuaggccuaccuga

SEQ ID NO: 3831990 - RNA, 16 nt, Human
cugccuuagucucagu

SEQ ID NO: 3831991 - RNA, 20 nt, Human
cugccuuagucucaguuugu

SEQ ID NO: 3831992 - RNA, 17 nt, Human
cugccuuaucuugcacc

SEQ ID NO: 3831993 - RNA, 18 nt, Human
cugccuuauucagggaag

SEQ ID NO: 3831994 - RNA, 20 nt, Human
cugccuuauucagggaagga

SEQ ID NO: 3831995 - RNA, 18 nt, Human
cugccuucccaugaaucu

SEQ ID NO: 3831996 - RNA, 11 nt, Human
cugccuucccu

SEQ ID NO: 3831997 - RNA, 14 nt, Human
cugccuuccuccug

SEQ ID NO: 3831998 - RNA, 15 nt, Human
cugccuuccuccugg

SEQ ID NO: 3831999 - RNA, 20 nt, Human
cugccuucgaggucagagga

SEQ ID NO: 3832000 - RNA, 17 nt, Human
cugccuucgcuucuugc

SEQ ID NO: 3832001 - RNA, 21 nt, Human
cugccuucgcuucuugccucu

SEQ ID NO: 3832002 - RNA, 18 nt, Human
cugccuucgguacccacc

SEQ ID NO: 3832003 - RNA, 20 nt, Human
cugccuucgguacccaccac

SEQ ID NO: 3832004 - RNA, 19 nt, Human
cugccuucguuaacugugu

SEQ ID NO: 3832005 - RNA, 18 nt, Human
cugccuucugacggcccu

SEQ ID NO: 3832006 - RNA, 19 nt, Human
cugccuucugacggcccug

SEQ ID NO: 3832007 - RNA, 20 nt, Human
cugccuucuggauucuuggc

SEQ ID NO: 3832008 - RNA, 12 nt, Human
cugccuucuguc

SEQ ID NO: 3832009 - RNA, 13 nt, Human
cugccuucugucc

SEQ ID NO: 3832010 - RNA, 21 nt, Human
cugccuucuucuuuuugcugu

SEQ ID NO: 3832011 - RNA, 22 nt, Human
cugccuucuucuuuuugcuguu

SEQ ID NO: 3832012 - RNA, 19 nt, Human
cugccuugaaccugugagu

SEQ ID NO: 3832013 - RNA, 18 nt, Human
cugccuugcccacuccug

SEQ ID NO: 3832014 - RNA, 21 nt, Human
cugccuugcuguuggucaugu

SEQ ID NO: 3832015 - RNA, 18 nt, Human
cugccuuggcucagacau

SEQ ID NO: 3832016 - RNA, 20 nt, Human
cugccuuggggucagguuga

SEQ ID NO: 3832017 - RNA, 14 nt, Human
cugccuuguguaca

SEQ ID NO: 3832018 - RNA, 17 nt, Human
ccucgggucuccucacu

SEQ ID NO: 3832019 - RNA, 15 nt, Human
ccucgguacucccau

SEQ ID NO: 3832020 - RNA, 18 nt, Human
ccucgguguggagaagcg

SEQ ID NO: 3832021 - RNA, 13 nt, Human
ccucgugccaguc

SEQ ID NO: 3832022 - RNA, 14 nt, Human
ccucgugccagucg

SEQ ID NO: 3832023 - RNA, 13 nt, Human
ccucgugcuuuaa

SEQ ID NO: 3832024 - RNA, 16 nt, Human
ccucguggacaccugc

SEQ ID NO: 3832025 - RNA, 13 nt, Human
ccucguggccagc

SEQ ID NO: 3832026 - RNA, 15 nt, Human
ccucguggccagccc

SEQ ID NO: 3832027 - RNA, 22 nt, Human
ccucguggccuuccccagccuc

SEQ ID NO: 3832028 - RNA, 19 nt, Human
ccucguuccuuucuccugu

SEQ ID NO: 3832029 - RNA, 15 nt, Human
ccucguucucccugg

SEQ ID NO: 3832030 - RNA, 17 nt, Human
ccucguucucccuggga

SEQ ID NO: 3832031 - RNA, 15 nt, Human
ccucguuuguguucu

SEQ ID NO: 3832032 - RNA, 23 nt, Human
ccucuaaagcaauaaugguccca

SEQ ID NO: 3832033 - RNA, 15 nt, Human
ccucuaaccccaggc

SEQ ID NO: 3832034 - RNA, 21 nt, Human
ccucuaaccccaggccccgag

SEQ ID NO: 3832035 - RNA, 21 nt, Human
ccucuaacuuggcucacacuc

SEQ ID NO: 3832036 - RNA, 15 nt, Human
ccucuaaugcucacg

SEQ ID NO: 3832037 - RNA, 18 nt, Human
ccucuaaugcucacgcuc

SEQ ID NO: 3832038 - RNA, 24 nt, Human
ccucuacagagcuucccugacuca

SEQ ID NO: 3832039 - RNA, 16 nt, Human
ccucuacugggaaggc

SEQ ID NO: 3832040 - RNA, 17 nt, Human
ccucuacugggaaggcu

SEQ ID NO: 3832041 - RNA, 14 nt, Human
ccucuacugggagc

SEQ ID NO: 3832042 - RNA, 20 nt, Human
ccucuacuuaaugagauagu

SEQ ID NO: 3832043 - RNA, 16 nt, Human
ccucuacuuuccaggc

SEQ ID NO: 3832044 - RNA, 18 nt, Human
ccucuagaagccaaggga

SEQ ID NO: 3832045 - RNA, 15 nt, Human
ccucuagagcagacu

SEQ ID NO: 3832046 - RNA, 11 nt, Human
ccucuagcuga

SEQ ID NO: 3832047 - RNA, 22 nt, Human
ccucuagcugugggggugaggg

SEQ ID NO: 3832048 - RNA, 13 nt, Human
ccucuaggcucug

SEQ ID NO: 3832049 - RNA, 12 nt, Human
ccucuagggacc

SEQ ID NO: 3832050 - RNA, 18 nt, Human
ccucuagggaccccuccu

SEQ ID NO: 3832051 - RNA, 19 nt, Human
ccucuagggaccccuccuc

SEQ ID NO: 3832052 - RNA, 20 nt, Human
ccucuagggaccccuccucc

SEQ ID NO: 3832053 - RNA, 14 nt, Human
ccucuagugcccuc

SEQ ID NO: 3832054 - RNA, 15 nt, Human
ccucuauacaucucu

SEQ ID NO: 3832055 - RNA, 16 nt, Human
ccucuauacaucucuc

SEQ ID NO: 3832056 - RNA, 17 nt, Human
ccucuauacaucucucc

SEQ ID NO: 3832057 - RNA, 19 nt, Human
ccucuaugaacuauggacg

SEQ ID NO: 3832058 - RNA, 14 nt, Human
ccucuauugaugua

SEQ ID NO: 3832059 - RNA, 17 nt, Human
ccucuauuuauguuugc

SEQ ID NO: 3832060 - RNA, 15 nt, Human
ccucucaacacccag

SEQ ID NO: 3832061 - RNA, 18 nt, Human
ccucucaauauucaauaa

SEQ ID NO: 3832062 - RNA, 20 nt, Human
ccucucaauauucaauaaag

SEQ ID NO: 3832063 - RNA, 22 nt, Human
ccucucaauauucaauaaagcu

SEQ ID NO: 3832064 - RNA, 14 nt, Human
ccucucacacacau

SEQ ID NO: 3832065 - RNA, 13 nt, Human
ccucucaccucag

SEQ ID NO: 3832066 - RNA, 14 nt, Human
ccucucaccucagc

SEQ ID NO: 3832067 - RNA, 14 nt, Human
ccucucaccucugu

SEQ ID NO: 3832068 - RNA, 14 nt, Human
ccucucacucccca

SEQ ID NO: 3832069 - RNA, 12 nt, Human
ccucucacuguc

SEQ ID NO: 3832070 - RNA, 15 nt, Human
ccucucacugucuga

SEQ ID NO: 3832071 - RNA, 13 nt, Human
ccucucagcccuc

SEQ ID NO: 3832072 - RNA, 14 nt, Human
ccucucagcccuca

SEQ ID NO: 3832073 - RNA, 16 nt, Human
ccucucagcuccaggu

SEQ ID NO: 3832074 - RNA, 18 nt, Human
ccucucaggauccaagcu

SEQ ID NO: 3832075 - RNA, 20 nt, Human
ccucucaggcaugccugugu

SEQ ID NO: 3832076 - RNA, 23 nt, Human
ccucucaggccggcagccccagc

SEQ ID NO: 3832077 - RNA, 14 nt, Human
ccucucagugcccu

SEQ ID NO: 3832078 - RNA, 21 nt, Human
ccucuccaagggcuucugcac

SEQ ID NO: 3832079 - RNA, 22 nt, Human
ccucuccaagggcuucugcacc

SEQ ID NO: 3832080 - RNA, 23 nt, Human
ccucuccaagggcuucugcaccc

SEQ ID NO: 3832081 - RNA, 22 nt, Human
ccucuccaccaucgucuucuug

SEQ ID NO: 3832082 - RNA, 17 nt, Human
ccucuccacccucccag

SEQ ID NO: 3832083 - RNA, 17 nt, Human
ccucuccaccuaguggc

SEQ ID NO: 3832084 - RNA, 18 nt, Human
ccucuccacucaugugac

SEQ ID NO: 3832085 - RNA, 23 nt, Human
ccucuccacucaugugacucuuu

SEQ ID NO: 3832086 - RNA, 22 nt, Human
ccucuccagcaggcccauggga

SEQ ID NO: 3832087 - RNA, 17 nt, Human
ccucuccagccucagcc

SEQ ID NO: 3832088 - RNA, 17 nt, Human
ccucuccaggcauuuag

SEQ ID NO: 3832089 - RNA, 19 nt, Human
ccucuccaucuucagcuuc

SEQ ID NO: 3832090 - RNA, 13 nt, Human
ccucuccauuugc

SEQ ID NO: 3832091 - RNA, 20 nt, Human
ccucuccauuugcucuucag

SEQ ID NO: 3832092 - RNA, 13 nt, Human
ccucucccacccu

SEQ ID NO: 3832093 - RNA, 20 nt, Human
ccucucccacccucuuccua

SEQ ID NO: 3832094 - RNA, 15 nt, Human
ccucucccacgggac

SEQ ID NO: 3832095 - RNA, 11 nt, Human
ccucucccagg

SEQ ID NO: 3832096 - RNA, 14 nt, Human
ccucucccaggcag

SEQ ID NO: 3832097 - RNA, 22 nt, Human
ccucucccaggcaggggcccgc

SEQ ID NO: 3832098 - RNA, 14 nt, Human
ccucucccaggccc

SEQ ID NO: 3832099 - RNA, 17 nt, Human
ccucucccaggccccau

SEQ ID NO: 3832100 - RNA, 23 nt, Human
ccucucccaggccccaugaccuc

SEQ ID NO: 3832101 - RNA, 21 nt, Human
ccucucccaucccccugcccu

SEQ ID NO: 3832102 - RNA, 14 nt, Human
ccucuccccaagac

SEQ ID NO: 3832103 - RNA, 15 nt, Human
ccucuccccaccccu

SEQ ID NO: 3832104 - RNA, 20 nt, Human
ccucuccccagcaagugaga

SEQ ID NO: 3832105 - RNA, 19 nt, Human
ccucuccccagcccagaga

SEQ ID NO: 3832106 - RNA, 21 nt, Human
ccucuccccagcccagagaca

SEQ ID NO: 3832107 - RNA, 23 nt, Human
ccucuccccagguccagcucugg

SEQ ID NO: 3832108 - RNA, 19 nt, Human
ccucuccccauucggugug

SEQ ID NO: 3832109 - RNA, 15 nt, Human
ccucuccccucagcc

SEQ ID NO: 3832110 - RNA, 15 nt, Human
ccucuccccuccagc

SEQ ID NO: 3832111 - RNA, 16 nt, Human
ccucuccccugauuac

SEQ ID NO: 3832112 - RNA, 13 nt, Human
ccucuccccugcc

SEQ ID NO: 3832113 - RNA, 21 nt, Human
ccucuccccugcccccugcag

SEQ ID NO: 3832114 - RNA, 22 nt, Human
ccucucccgucagggcccaagu

SEQ ID NO: 3832115 - RNA, 11 nt, Human
ccucucccuca

SEQ ID NO: 3832116 - RNA, 18 nt, Human
ccucucccuccuccagga

SEQ ID NO: 3832117 - RNA, 23 nt, Human
ccucucccuccuccaggaagccu

SEQ ID NO: 3832118 - RNA, 18 nt, Human
ccucucccucugguccca

SEQ ID NO: 3832119 - RNA, 16 nt, Human
ccucucccugcauggc

SEQ ID NO: 3832120 - RNA, 19 nt, Human
ccucucccugcugcuccua

SEQ ID NO: 3832121 - RNA, 20 nt, Human
cuggaggacuagaaccugga

SEQ ID NO: 3832122 - RNA, 14 nt, Human
cuggaggagagaag

SEQ ID NO: 3832123 - RNA, 17 nt, Human
cuggaggagagaagaau

SEQ ID NO: 3832124 - RNA, 14 nt, Human
cuggaggagcccag

SEQ ID NO: 3832125 - RNA, 16 nt, Human
cuggaggagcccaggc

SEQ ID NO: 3832126 - RNA, 19 nt, Human
cuggaggagcccaggccag

SEQ ID NO: 3832127 - RNA, 21 nt, Human
cuggaggagcccaggccagga

SEQ ID NO: 3832128 - RNA, 17 nt, Human
cuggaggagcugggccc

SEQ ID NO: 3832129 - RNA, 14 nt, Human
cuggaggaggagca

SEQ ID NO: 3832130 - RNA, 16 nt, Human
cuggaggcaccuggug

SEQ ID NO: 3832131 - RNA, 20 nt, Human
cuggaggcagggccuugccc

SEQ ID NO: 3832132 - RNA, 23 nt, Human
cuggaggcagggccuugcccaga

SEQ ID NO: 3832133 - RNA, 18 nt, Human
cuggaggcaggggcuucc

SEQ ID NO: 3832134 - RNA, 20 nt, Human
cuggaggcaggggcuuccug

SEQ ID NO: 3832135 - RNA, 22 nt, Human
cuggaggcaggggcuuccuggu

SEQ ID NO: 3832136 - RNA, 14 nt, Human
cuggaggcccaguu

SEQ ID NO: 3832137 - RNA, 17 nt, Human
cuggaggccccuggagc

SEQ ID NO: 3832138 - RNA, 14 nt, Human
cuggaggccucagg

SEQ ID NO: 3832139 - RNA, 19 nt, Human
cuggaggccucaggugcug

SEQ ID NO: 3832140 - RNA, 13 nt, Human
cuggaggccucug

SEQ ID NO: 3832141 - RNA, 15 nt, Human
cuggaggccucuggg

SEQ ID NO: 3832142 - RNA, 17 nt, Human
cuggaggccucugggcc

SEQ ID NO: 3832143 - RNA, 22 nt, Human
cuggaggccucugggccuccuc

SEQ ID NO: 3832144 - RNA, 16 nt, Human
cuggaggccuuccagc

SEQ ID NO: 3832145 - RNA, 21 nt, Human
cuggaggccuuccagcugcug

SEQ ID NO: 3832146 - RNA, 19 nt, Human
cuggaggcggugcggcagg

SEQ ID NO: 3832147 - RNA, 15 nt, Human
cuggaggcucaaauu

SEQ ID NO: 3832148 - RNA, 16 nt, Human
cuggaggcugccuccc

SEQ ID NO: 3832149 - RNA, 18 nt, Human
cuggaggcugccucccaa

SEQ ID NO: 3832150 - RNA, 17 nt, Human
cuggagggaagagugga

SEQ ID NO: 3832151 - RNA, 22 nt, Human
cuggagggaagaguggaggugg

SEQ ID NO: 3832152 - RNA, 22 nt, Human
cuggagggaaugaaccuggagg

SEQ ID NO: 3832153 - RNA, 20 nt, Human
cuggagggcuagaaccuaga

SEQ ID NO: 3832154 - RNA, 19 nt, Human
cuggagggcuagaaucugg

SEQ ID NO: 3832155 - RNA, 20 nt, Human
cuggagggcuagaaucugga

SEQ ID NO: 3832156 - RNA, 16 nt, Human
cuggaggggacgcugg

SEQ ID NO: 3832157 - RNA, 16 nt, Human
cuggaggggagcucug

SEQ ID NO: 3832158 - RNA, 22 nt, Human
cuggaggggcauggccagcagc

SEQ ID NO: 3832159 - RNA, 23 nt, Human
cuggaggggcauggccagcagcu

SEQ ID NO: 3832160 - RNA, 12 nt, Human
cuggaggggccc

SEQ ID NO: 3832161 - RNA, 17 nt, Human
cuggaggggccccugcu

SEQ ID NO: 3832162 - RNA, 22 nt, Human
cuggagggggaauggcagcagg

SEQ ID NO: 3832163 - RNA, 13 nt, Human
cugggcagaaggc

SEQ ID NO: 3832164 - RNA, 14 nt, Human
cugggcagaaggcc

SEQ ID NO: 3832165 - RNA, 17 nt, Human
cugggcagaaggccaag

SEQ ID NO: 3832166 - RNA, 17 nt, Human
cugggcagcauagcaag

SEQ ID NO: 3832167 - RNA, 15 nt, Human
cugggcagccaggcu

SEQ ID NO: 3832168 - RNA, 22 nt, Human
cugggcagcccgcuaggcucgc

SEQ ID NO: 3832169 - RNA, 20 nt, Human
cugggcagcuaccauuuccc

SEQ ID NO: 3832170 - RNA, 20 nt, Human
cugggcagcugccuccccuc

SEQ ID NO: 3832171 - RNA, 15 nt, Human
cugggcauccucagg

SEQ ID NO: 3832172 - RNA, 22 nt, Human
cugggcaugagggguuccuccc

SEQ ID NO: 3832173 - RNA, 13 nt, Human
cugggcauugcuu

SEQ ID NO: 3832174 - RNA, 16 nt, Human
cugggcauugcuuucc

SEQ ID NO: 3832175 - RNA, 17 nt, Human
cugggcauugcuuucca

SEQ ID NO: 3832176 - RNA, 23 nt, Human
cugggccaauucaauacaaacaa

SEQ ID NO: 3832177 - RNA, 12 nt, Human
cugggccagaau

SEQ ID NO: 3832178 - RNA, 13 nt, Human
cugggccaggguc

SEQ ID NO: 3832179 - RNA, 17 nt, Human
cugggccagggucugug

SEQ ID NO: 3832180 - RNA, 22 nt, Human
cugggccagggucugugugaau

SEQ ID NO: 3832181 - RNA, 17 nt, Human
cugggccauguccaaag

SEQ ID NO: 3832182 - RNA, 22 nt, Human
cugggccauguccaaagaggcu

SEQ ID NO: 3832183 - RNA, 23 nt, Human
cugggccauguccaaagaggcug

SEQ ID NO: 3832184 - RNA, 22 nt, Human
cugggccauucuccacagcaac

SEQ ID NO: 3832185 - RNA, 17 nt, Human
cugggcccaacccuguc

SEQ ID NO: 3832186 - RNA, 15 nt, Human
cugggcccacauccg

SEQ ID NO: 3832187 - RNA, 18 nt, Human
cugggcccacccaagcag

SEQ ID NO: 3832188 - RNA, 23 nt, Human
cugggcccacccaagcaggaggc

SEQ ID NO: 3832189 - RNA, 23 nt, Human
cugggcccagaagguugugauga

SEQ ID NO: 3832190 - RNA, 12 nt, Human
cugggcccagag

SEQ ID NO: 3832191 - RNA, 14 nt, Human
cugggcccaucucc

SEQ ID NO: 3832192 - RNA, 18 nt, Human
cugggcccaucucccugc

SEQ ID NO: 3832193 - RNA, 21 nt, Human
cugggcccaucucccugcuuu

SEQ ID NO: 3832194 - RNA, 13 nt, Human
cugggcccaugaa

SEQ ID NO: 3832195 - RNA, 13 nt, Human
cugggccccagcc

SEQ ID NO: 3832196 - RNA, 19 nt, Human
cugggccccagcccacccu

SEQ ID NO: 3832197 - RNA, 20 nt, Human
cugggccccagcccacccuc

SEQ ID NO: 3832198 - RNA, 21 nt, Human
cugggccccagcccacccucc

SEQ ID NO: 3832199 - RNA, 19 nt, Human
cugggccccaguuguauuu

SEQ ID NO: 3832200 - RNA, 20 nt, Human
cugggccccucaucugcuca

SEQ ID NO: 3832201 - RNA, 21 nt, Human
cugggccccucaucugcucag

SEQ ID NO: 3832202 - RNA, 12 nt, Human
cugggccccugc

SEQ ID NO: 3832203 - RNA, 11 nt, Human
cugggcccucu

SEQ ID NO: 3832204 - RNA, 18 nt, Human
cugggcccucucugcucu

SEQ ID NO: 3832205 - RNA, 22 nt, Human
cugggcccugacauuggagccu

SEQ ID NO: 3832206 - RNA, 13 nt, Human
cugggcccugagu

SEQ ID NO: 3832207 - RNA, 11 nt, Human
cugggcccugg

SEQ ID NO: 3832208 - RNA, 12 nt, Human
cugggcccuggg

SEQ ID NO: 3832209 - RNA, 14 nt, Human
cugggcccugggcu

SEQ ID NO: 3832210 - RNA, 22 nt, Human
cugggcccuggggccuguacug

SEQ ID NO: 3832211 - RNA, 15 nt, Human
cugggccgcugccac

SEQ ID NO: 3832212 - RNA, 19 nt, Human
cugggccuauggagagccc

SEQ ID NO: 3832213 - RNA, 20 nt, Human
cugggccuauggagagcccu

SEQ ID NO: 3832214 - RNA, 16 nt, Human
cugggccuccucuaac

SEQ ID NO: 3832215 - RNA, 24 nt, Human
cugggccuccucuaacaggggcug

SEQ ID NO: 3832216 - RNA, 19 nt, Human
cugggccucggaccccacu

SEQ ID NO: 3832217 - RNA, 20 nt, Human
cugggccugaccaaacagcc

SEQ ID NO: 3832218 - RNA, 13 nt, Human
cugggccugcugc

SEQ ID NO: 3832219 - RNA, 14 nt, Human
cugggccugcugcu

SEQ ID NO: 3832220 - RNA, 18 nt, Human
cugggccuggcagcucag

SEQ ID NO: 3832221 - RNA, 14 nt, Human
cugggccuggcucc

SEQ ID NO: 3832222 - RNA, 23 nt, Human
cugggccuggcucccucacucuc

SEQ ID NO: 3832223 - RNA, 16 nt, Human
cugggccugggcuagg

SEQ ID NO: 3832224 - RNA, 19 nt, Human
cugggccuggucucacccu

SEQ ID NO: 3832225 - RNA, 17 nt, Human
cugggccuguugcccuu

SEQ ID NO: 3832226 - RNA, 16 nt, Human
cugggccuuggccugg

SEQ ID NO: 3832227 - RNA, 17 nt, Human
cugggccuuggccugga

SEQ ID NO: 3832228 - RNA, 15 nt, Human
cugggcgcccuggaa

SEQ ID NO: 3832229 - RNA, 14 nt, Human
cugggcggcugugc

SEQ ID NO: 3832230 - RNA, 20 nt, Human
cugggcuagguagaaaaagg

SEQ ID NO: 3832231 - RNA, 16 nt, Human
cugggcuauggacaca

SEQ ID NO: 3832232 - RNA, 17 nt, Human
cugggcuauggacacag

SEQ ID NO: 3832233 - RNA, 17 nt, Human
cugggcucaagcagucu

SEQ ID NO: 3832234 - RNA, 21 nt, Human
cugggcucccgggccccacag

SEQ ID NO: 3832235 - RNA, 19 nt, Human
cugggcucccguguaucug

SEQ ID NO: 3832236 - RNA, 21 nt, Human
cugggcuccuaaccuuccugu

SEQ ID NO: 3832237 - RNA, 17 nt, Human
cugggcuccuccagggu

SEQ ID NO: 3832238 - RNA, 15 nt, Human
cugggcuccuggacc

SEQ ID NO: 3832239 - RNA, 13 nt, Human
cugggcucggagg

SEQ ID NO: 3832240 - RNA, 15 nt, Human
cugggcucggaggcu

SEQ ID NO: 3832241 - RNA, 18 nt, Human
cugggcucggaggcugcc

SEQ ID NO: 3832242 - RNA, 17 nt, Human
cugggcucuccaccuca

SEQ ID NO: 3832243 - RNA, 20 nt, Human
cugggcucuccaccucagcc

SEQ ID NO: 3832244 - RNA, 19 nt, Human
cugggcucucgcggccucu

SEQ ID NO: 3832245 - RNA, 23 nt, Human
cugggcucugcaauuccccucug

SEQ ID NO: 3832246 - RNA, 13 nt, Human
cugggcucugcca

SEQ ID NO: 3832247 - RNA, 17 nt, Human
cugggcucugccacccu

SEQ ID NO: 3832248 - RNA, 21 nt, Human
cugggcucugccacccuaccu

SEQ ID NO: 3832249 - RNA, 17 nt, Human
cugggcucugccccagc

SEQ ID NO: 3832250 - RNA, 16 nt, Human
cugggcucugggagca

SEQ ID NO: 3832251 - RNA, 12 nt, Human
cugggcucuguc

SEQ ID NO: 3832252 - RNA, 18 nt, Human
cugggcucugugggcugc

SEQ ID NO: 3832253 - RNA, 20 nt, Human
cugggcugacugggccaggg

SEQ ID NO: 3832254 - RNA, 12 nt, Human
cugggcugagcc

SEQ ID NO: 3832255 - RNA, 14 nt, Human
cugggcugagcccc

SEQ ID NO: 3832256 - RNA, 17 nt, Human
cugggcugagccccuac

SEQ ID NO: 3832257 - RNA, 18 nt, Human
cugggcugagggagccug

SEQ ID NO: 3832258 - RNA, 19 nt, Human
cugggcugcuacccagaaa

SEQ ID NO: 3832259 - RNA, 17 nt, Human
cugggcuggaugagcuc

SEQ ID NO: 3832260 - RNA, 19 nt, Human
cugggcuggaugagcuccc

SEQ ID NO: 3832261 - RNA, 12 nt, Human
cugggcugggca

SEQ ID NO: 3832262 - RNA, 18 nt, Human
cugggcuggggccugaug

SEQ ID NO: 3832263 - RNA, 22 nt, Human
cugggcuguaacguggcacugg

SEQ ID NO: 3832264 - RNA, 13 nt, Human
cugggcuguuggc

SEQ ID NO: 3832265 - RNA, 12 nt, Human
cugggcuguugu

SEQ ID NO: 3832266 - RNA, 14 nt, Human
cugggcuguuguuc

SEQ ID NO: 3832267 - RNA, 17 nt, Human
cugggcuucaguggcag

SEQ ID NO: 3832268 - RNA, 19 nt, Human
cugggcuucaguggcagcu

SEQ ID NO: 3832269 - RNA, 22 nt, Human
cugggcuucaguggcagcugcu

SEQ ID NO: 3832270 - RNA, 23 nt, Human
cugggcuucaguggcagcugcuu

SEQ ID NO: 3832271 - RNA, 15 nt, Human
cugggcuucaucugg

SEQ ID NO: 3832272 - RNA, 17 nt, Human
cugggcuuccuggagca

SEQ ID NO: 3832273 - RNA, 22 nt, Human
cugggcuuggggaccagagcug

SEQ ID NO: 3832274 - RNA, 20 nt, Human
cugggcuuuuguuuugcuuu

SEQ ID NO: 3832275 - RNA, 22 nt, Human
cuggggaaacuggccauggccu

SEQ ID NO: 3832276 - RNA, 20 nt, Human
cuggggaaagacacugccug

SEQ ID NO: 3832277 - RNA, 23 nt, Human
cuggggaaagacacugccugggc

SEQ ID NO: 3832278 - RNA, 17 nt, Human
cuggggaaauaacagcu

SEQ ID NO: 3832279 - RNA, 19 nt, Human
cuggggaaauaacagcugu

SEQ ID NO: 3832280 - RNA, 14 nt, Human
cuggggaacauuuc

SEQ ID NO: 3832281 - RNA, 16 nt, Human
cuggggaaccugaccc

SEQ ID NO: 3832282 - RNA, 18 nt, Human
cuggggaacguucucuuu

SEQ ID NO: 3832283 - RNA, 15 nt, Human
cuggggaagacagug

SEQ ID NO: 3832284 - RNA, 17 nt, Human
cuggggaagacaguggc

SEQ ID NO: 3832285 - RNA, 17 nt, Human
cuggggaaggagccagu

SEQ ID NO: 3832286 - RNA, 16 nt, Human
cuggggacagcaaggg

SEQ ID NO: 3832287 - RNA, 12 nt, Human
cuggggacaggu

SEQ ID NO: 3832288 - RNA, 22 nt, Human
cuggggaccugguacccuccug

SEQ ID NO: 3832289 - RNA, 14 nt, Human
cuggccuccugccu

SEQ ID NO: 3832290 - RNA, 15 nt, Human
cuggccuccugccuc

SEQ ID NO: 3832291 - RNA, 14 nt, Human
cuggccucucuagc

SEQ ID NO: 3832292 - RNA, 18 nt, Human
cuggccucucuagcacaa

SEQ ID NO: 3832293 - RNA, 18 nt, Human
cuggccucugcacucccc

SEQ ID NO: 3832294 - RNA, 20 nt, Human
cuggccucugugccuucuuu

SEQ ID NO: 3832295 - RNA, 19 nt, Human
cuggccugagagucagcuc

SEQ ID NO: 3832296 - RNA, 20 nt, Human
cuggccugagagucagcucu

SEQ ID NO: 3832297 - RNA, 12 nt, Human
cuggccugagga

SEQ ID NO: 3832298 - RNA, 19 nt, Human
cuggccugcacggugggcc

SEQ ID NO: 3832299 - RNA, 18 nt, Human
cuggccuggacuguuuuc

SEQ ID NO: 3832300 - RNA, 15 nt, Human
cuggccuggaucucc

SEQ ID NO: 3832301 - RNA, 21 nt, Human
cuggccuggaucuccccacuc

SEQ ID NO: 3832302 - RNA, 22 nt, Human
cuggccuggaucuccccacucu

SEQ ID NO: 3832303 - RNA, 11 nt, Human
cuggccuggcc

SEQ ID NO: 3832304 - RNA, 13 nt, Human
cuggccuggccag

SEQ ID NO: 3832305 - RNA, 17 nt, Human
cuggccuggccagugcc

SEQ ID NO: 3832306 - RNA, 13 nt, Human
cuggccuggcccc

SEQ ID NO: 3832307 - RNA, 17 nt, Human
cuggccuggccccucag

SEQ ID NO: 3832308 - RNA, 17 nt, Human
ccugcccccacuuccug

SEQ ID NO: 3832309 - RNA, 14 nt, Human
ccugcccccaggac

SEQ ID NO: 3832310 - RNA, 17 nt, Human
ccugccccccagccucu

SEQ ID NO: 3832311 - RNA, 19 nt, Human
ccugcccccgcauccccug

SEQ ID NO: 3832312 - RNA, 13 nt, Human
ccugcccccuggu

SEQ ID NO: 3832313 - RNA, 16 nt, Human
ccugcccccuucuccc

SEQ ID NO: 3832314 - RNA, 19 nt, Human
ccugcccccuucucccaca

SEQ ID NO: 3832315 - RNA, 23 nt, Human
ccugcccccuucucccacacugc

SEQ ID NO: 3832316 - RNA, 16 nt, Human
ccugccccgcccagcu

SEQ ID NO: 3832317 - RNA, 18 nt, Human
ccugccccgcccccaguc

SEQ ID NO: 3832318 - RNA, 18 nt, Human
ccugccccggagcuggag

SEQ ID NO: 3832319 - RNA, 14 nt, Human
ccugccccucccag

SEQ ID NO: 3832320 - RNA, 16 nt, Human
ccugccccucccuuca

SEQ ID NO: 3832321 - RNA, 22 nt, Human
ccugccccuccucucccucauc

SEQ ID NO: 3832322 - RNA, 14 nt, Human
ccugccccucuuuc

SEQ ID NO: 3832323 - RNA, 17 nt, Human
ccugccccugagcccau

SEQ ID NO: 3832324 - RNA, 16 nt, Human
ccugccccugcuacug

SEQ ID NO: 3832325 - RNA, 20 nt, Human
ccugcccggauggagcgggg

SEQ ID NO: 3832326 - RNA, 10 nt, Human
ccugcccggg

SEQ ID NO: 3832327 - RNA, 22 nt, Human
ccugcccgggcgcggccagccc

SEQ ID NO: 3832328 - RNA, 20 nt, Human
ccugcccguaaacacgccug

SEQ ID NO: 3832329 - RNA, 21 nt, Human
ccugcccguaaacacgccugc

SEQ ID NO: 3832330 - RNA, 19 nt, Human
ccugcccgucucucuccca

SEQ ID NO: 3832331 - RNA, 15 nt, Human
ccugcccguguacau

SEQ ID NO: 3832332 - RNA, 17 nt, Human
ccugcccguguacauag

SEQ ID NO: 3832333 - RNA, 14 nt, Human
ccugcccguucuug

SEQ ID NO: 3832334 - RNA, 23 nt, Human
ccugcccuacagaggucucugcc

SEQ ID NO: 3832335 - RNA, 19 nt, Human
ccugcccuagagcacacug

SEQ ID NO: 3832336 - RNA, 24 nt, Human
ccugcccuagagcacacuguagca

SEQ ID NO: 3832337 - RNA, 14 nt, Human
ccugcccuagcucc

SEQ ID NO: 3832338 - RNA, 16 nt, Human
ccugcccuagcuccac

SEQ ID NO: 3832339 - RNA, 14 nt, Human
ccugcccucaaggg

SEQ ID NO: 3832340 - RNA, 16 nt, Human
ccugcccuccccagag

SEQ ID NO: 3832341 - RNA, 19 nt, Human
ccugcccuccccagagcac

SEQ ID NO: 3832342 - RNA, 20 nt, Human
ccugcccuccccagagcacu

SEQ ID NO: 3832343 - RNA, 13 nt, Human
ccugcccuccccu

SEQ ID NO: 3832344 - RNA, 11 nt, Human
ccugcccugcc

SEQ ID NO: 3832345 - RNA, 17 nt, Human
ccugcccugccaccugu

SEQ ID NO: 3832346 - RNA, 18 nt, Human
ccugcccugccaccuguc

SEQ ID NO: 3832347 - RNA, 21 nt, Human
ccugcccugccaccugucugu

SEQ ID NO: 3832348 - RNA, 15 nt, Human
ccugcccugccugag

SEQ ID NO: 3832349 - RNA, 13 nt, Human
ccugcccugcugc

SEQ ID NO: 3832350 - RNA, 10 nt, Human
ccugcccugg

SEQ ID NO: 3832351 - RNA, 17 nt, Human
cuguacugauucaauuu

SEQ ID NO: 3832352 - RNA, 20 nt, Human
cuguacugauuuuuguaaga

SEQ ID NO: 3832353 - RNA, 22 nt, Human
cuguacugauuuuuguaagaca

SEQ ID NO: 3832354 - RNA, 13 nt, Human
cuguacugccugc

SEQ ID NO: 3832355 - RNA, 14 nt, Human
cuguacugcucagg

SEQ ID NO: 3832356 - RNA, 15 nt, Human
cuguacuggagagca

SEQ ID NO: 3832357 - RNA, 19 nt, Human
cuguacuguuacugggccc

SEQ ID NO: 3832358 - RNA, 22 nt, Human
cuguacuguuacugggcccuga

SEQ ID NO: 3832359 - RNA, 14 nt, Human
cuguacuucacugu

SEQ ID NO: 3832360 - RNA, 17 nt, Human
cuguacuucacugucag

SEQ ID NO: 3832361 - RNA, 19 nt, Human
cuguacuugcucuugaugc

SEQ ID NO: 3832362 - RNA, 22 nt, Human
cuguacuugcucuugaugccug

SEQ ID NO: 3832363 - RNA, 21 nt, Human
cuguacuuugauucacauguu

SEQ ID NO: 3832364 - RNA, 24 nt, Human
cuguacuuugauucacauguuuuc

SEQ ID NO: 3832365 - RNA, 19 nt, Human
cuguacuuuucccauuugu

SEQ ID NO: 3832366 - RNA, 15 nt, Human
cuguacuuuuuggca

SEQ ID NO: 3832367 - RNA, 23 nt, Human
cuguagaaaaaaaaauucacaug

SEQ ID NO: 3832368 - RNA, 19 nt, Human
cuguagaaaugguuguauu

SEQ ID NO: 3832369 - RNA, 18 nt, Human
cuguagaacucaaccucu

SEQ ID NO: 3832370 - RNA, 15 nt, Human
cuguagacaucuguc

SEQ ID NO: 3832371 - RNA, 17 nt, Human
cuguagacaucuguccu

SEQ ID NO: 3832372 - RNA, 18 nt, Human
cuguagacggcucaguau

SEQ ID NO: 3832373 - RNA, 16 nt, Human
cuguagagggcccugg

SEQ ID NO: 3832374 - RNA, 15 nt, Human
cuguagaguugcuga

SEQ ID NO: 3832375 - RNA, 17 nt, Human
cuguagauaauuaacca

SEQ ID NO: 3832376 - RNA, 20 nt, Human
cuguagauauguauucuuuu

SEQ ID NO: 3832377 - RNA, 19 nt, Human
cuguagauugcuucuguag

SEQ ID NO: 3832378 - RNA, 12 nt, Human
cuguagcaucuu

SEQ ID NO: 3832379 - RNA, 15 nt, Human
cuguagcaucuucug

SEQ ID NO: 3832380 - RNA, 17 nt, Human
cuguagcauuacagugg

SEQ ID NO: 3832381 - RNA, 18 nt, Human
cuguagcauuacaguggg

SEQ ID NO: 3832382 - RNA, 15 nt, Human
cuguagccagcaccu

SEQ ID NO: 3832383 - RNA, 21 nt, Human
cuguagccccagugacagcua

SEQ ID NO: 3832384 - RNA, 21 nt, Human
cuguagccuauuuuuuuagau

SEQ ID NO: 3832385 - RNA, 15 nt, Human
cuguagccucagaug

SEQ ID NO: 3832386 - RNA, 15 nt, Human
cuguagcucuaaaau

SEQ ID NO: 3832387 - RNA, 14 nt, Human
cuguagcugccaug

SEQ ID NO: 3832388 - RNA, 18 nt, Human
cuguagcuuguucccugu

SEQ ID NO: 3832389 - RNA, 18 nt, Human
cuguaggaagguacugua

SEQ ID NO: 3832390 - RNA, 19 nt, Human
cuguaggaagguacuguau

SEQ ID NO: 3832391 - RNA, 21 nt, Human
cuguaggaagguuaauguuca

SEQ ID NO: 3832392 - RNA, 18 nt, Human
cuguaggaguucuauuuu

SEQ ID NO: 3832393 - RNA, 21 nt, Human
cuguagggcuggaccuauguc

SEQ ID NO: 3832394 - RNA, 24 nt, Human
cuguaggguaauuaguaacaugug

SEQ ID NO: 3832395 - RNA, 17 nt, Human
cuguaguaaauaaugcu

SEQ ID NO: 3832396 - RNA, 18 nt, Human
cuguaguagcccuuucug

SEQ ID NO: 3832397 - RNA, 16 nt, Human
cuguagucauuuacua

SEQ ID NO: 3832398 - RNA, 15 nt, Human
cuguagucccagcca

SEQ ID NO: 3832399 - RNA, 23 nt, Human
cuguagucccagccacucgggag

SEQ ID NO: 3832400 - RNA, 14 nt, Human
cuguagucccagcu

SEQ ID NO: 3832401 - RNA, 15 nt, Human
cuguagucccagcua

SEQ ID NO: 3832402 - RNA, 22 nt, Human
cuguaguccuagccacucagga

SEQ ID NO: 3832403 - RNA, 15 nt, Human
cuguagucucaggac

SEQ ID NO: 3832404 - RNA, 14 nt, Human
cuguaguuaggaaa

SEQ ID NO: 3832405 - RNA, 15 nt, Human
cuguaguuaggaaau

SEQ ID NO: 3832406 - RNA, 17 nt, Human
cuguaguuaggaaauaa

SEQ ID NO: 3832407 - RNA, 22 nt, Human
cuguaguuaggaaauaaaaccu

SEQ ID NO: 3832408 - RNA, 12 nt, Human
cuguaguuuuau

SEQ ID NO: 3832409 - RNA, 21 nt, Human
cuguaguuuuaucacauguau

SEQ ID NO: 3832410 - RNA, 22 nt, Human
cuguaguuuuaucacauguaug

SEQ ID NO: 3832411 - RNA, 23 nt, Human
cuguaguuuuaucacauguaugu

SEQ ID NO: 3832412 - RNA, 17 nt, Human
cuguaguuuuauuuuau

SEQ ID NO: 3832413 - RNA, 18 nt, Human
cuguaguuuuauuuuaug

SEQ ID NO: 3832414 - RNA, 11 nt, Human
cuguauaaaau

SEQ ID NO: 3832415 - RNA, 21 nt, Human
cuguauaaacauuaaaugucu

SEQ ID NO: 3832416 - RNA, 21 nt, Human
cuguauaaaggugugcugugu

SEQ ID NO: 3832417 - RNA, 19 nt, Human
cuguauaaauaggagagga

SEQ ID NO: 3832418 - RNA, 15 nt, Human
cuguauaaaugucuu

SEQ ID NO: 3832419 - RNA, 16 nt, Human
cuguauaacccuguua

SEQ ID NO: 3832420 - RNA, 18 nt, Human
cuguauaacccuguuaca

SEQ ID NO: 3832421 - RNA, 19 nt, Human
cuguauaagcacugaaaaa

SEQ ID NO: 3832422 - RNA, 21 nt, Human
cuguauaagcacugaaaaaca

SEQ ID NO: 3832423 - RNA, 14 nt, Human
cuguauaaguaaga

SEQ ID NO: 3832424 - RNA, 17 nt, Human
cuguauaaguaagaaaa

SEQ ID NO: 3832425 - RNA, 13 nt, Human
cuguauacagugc

SEQ ID NO: 3832426 - RNA, 12 nt, Human
cuguauacuuua

SEQ ID NO: 3832427 - RNA, 20 nt, Human
cuguauagacaguuuguaaa

SEQ ID NO: 3832428 - RNA, 15 nt, Human
cuguauagauuagag

SEQ ID NO: 3832429 - RNA, 20 nt, Human
cuguauagcugcuuccagug

SEQ ID NO: 3832430 - RNA, 16 nt, Human
cuguauauaaaggaaa

SEQ ID NO: 3832431 - RNA, 15 nt, Human
cuguauauaaauggg

SEQ ID NO: 3832432 - RNA, 16 nt, Human
cuguauauaaauggga

SEQ ID NO: 3832433 - RNA, 23 nt, Human
cuguauauacaauaacauaauuu

SEQ ID NO: 3832434 - RNA, 14 nt, Human
cuguauauucagga

SEQ ID NO: 3832435 - RNA, 16 nt, Human
cuguauauuuguaaag

SEQ ID NO: 3832436 - RNA, 20 nt, Human
cuguauauuuguaaagcuau

SEQ ID NO: 3832437 - RNA, 21 nt, Human
cuguauauuuguaugauauuu

SEQ ID NO: 3832438 - RNA, 22 nt, Human
cuguauauuugugauagcacuu

SEQ ID NO: 3832439 - RNA, 23 nt, Human
cuguauauuugugauagcacuuu

SEQ ID NO: 3832440 - RNA, 14 nt, Human
cuguaucacucugu

SEQ ID NO: 3832441 - RNA, 16 nt, Human
cuguaucaggacccag

SEQ ID NO: 3832442 - RNA, 20 nt, Human
cuguaucaguggauuuccca

SEQ ID NO: 3832443 - RNA, 15 nt, Human
cuguaucccaugagc

SEQ ID NO: 3832444 - RNA, 16 nt, Human
cuguaucccaugagcc

SEQ ID NO: 3832445 - RNA, 20 nt, Human
cuguaucccaugagccucag

SEQ ID NO: 3832446 - RNA, 21 nt, Human
cuguaucccaugagccucagc

SEQ ID NO: 3832447 - RNA, 17 nt, Human
cuguaucuguagugaga

SEQ ID NO: 3832448 - RNA, 22 nt, Human
cuguaucuugggggacagggcu

SEQ ID NO: 3832449 - RNA, 18 nt, Human
cuguaucuuguuuuucca

SEQ ID NO: 3832450 - RNA, 13 nt, Human
cuguaugaucaaa

SEQ ID NO: 3832451 - RNA, 17 nt, Human
cuguaugaucaaauguu

SEQ ID NO: 3832452 - RNA, 22 nt, Human
cuguggggacuccggcugugcu

SEQ ID NO: 3832453 - RNA, 17 nt, Human
cuguggggaucucaggg

SEQ ID NO: 3832454 - RNA, 19 nt, Human
cuguggggauuucucccag

SEQ ID NO: 3832455 - RNA, 19 nt, Human
cuguggggccuugguuccc

SEQ ID NO: 3832456 - RNA, 19 nt, Human
cugugggggugugcccccu

SEQ ID NO: 3832457 - RNA, 23 nt, Human
cuguggggugugcacaucucugc

SEQ ID NO: 3832458 - RNA, 15 nt, Human
cuguggguaguauga

SEQ ID NO: 3832459 - RNA, 23 nt, Human
cugugguaaaugccacacaccuu

SEQ ID NO: 3832460 - RNA, 23 nt, Human
cugugguaguacuccugcaaaau

SEQ ID NO: 3832461 - RNA, 13 nt, Human
cuguggugacuuu

SEQ ID NO: 3832462 - RNA, 15 nt, Human
cuguggugacuuugg

SEQ ID NO: 3832463 - RNA, 19 nt, Human
cuguggugagguugggcag

SEQ ID NO: 3832464 - RNA, 22 nt, Human
cuguggugcaaaagcagaaaau

SEQ ID NO: 3832465 - RNA, 22 nt, Human
cugugguucugagauggcuccc

SEQ ID NO: 3832466 - RNA, 23 nt, Human
cugugguucugagauggcuccca

SEQ ID NO: 3832467 - RNA, 18 nt, Human
cugugguuggcugggaaa

SEQ ID NO: 3832468 - RNA, 18 nt, Human
cugugguuucauguuagu

SEQ ID NO: 3832469 - RNA, 21 nt, Human
cugugguuuuccccucccugg

SEQ ID NO: 3832470 - RNA, 21 nt, Human
cugugguuuucuuuugccaug

SEQ ID NO: 3832471 - RNA, 17 nt, Human
cuguguaaaaagagagc

SEQ ID NO: 3832472 - RNA, 15 nt, Human
cuguguaaaauguaa

SEQ ID NO: 3832473 - RNA, 11 nt, Human
cuguguaaagu

SEQ ID NO: 3832474 - RNA, 13 nt, Human
cuguguaaaguua

SEQ ID NO: 3832475 - RNA, 14 nt, Human
cuguguaacagcuc

SEQ ID NO: 3832476 - RNA, 22 nt, Human
cuguguaacagcuccuugggag

SEQ ID NO: 3832477 - RNA, 22 nt, Human
cuguguaaccauuuuauaaagu

SEQ ID NO: 3832478 - RNA, 15 nt, Human
cuguguaacugccca

SEQ ID NO: 3832479 - RNA, 13 nt, Human
cuguguaagauuu

SEQ ID NO: 3832480 - RNA, 18 nt, Human
cuguguaauuagugccac

SEQ ID NO: 3832481 - RNA, 23 nt, Human
cuguguacauaacucuguaaaaa

SEQ ID NO: 3832482 - RNA, 22 nt, Human
cuguguacauaacugaaaaugu

SEQ ID NO: 3832483 - RNA, 13 nt, Human
cuguguacugugu

SEQ ID NO: 3832484 - RNA, 16 nt, Human
cuguguacuucccggg

SEQ ID NO: 3832485 - RNA, 18 nt, Human
cuguguagcugugaccug

SEQ ID NO: 3832486 - RNA, 20 nt, Human
cuguguagcugugaccugcu

SEQ ID NO: 3832487 - RNA, 12 nt, Human
cuguguauauuu

SEQ ID NO: 3832488 - RNA, 16 nt, Human
cuguguauauuugauu

SEQ ID NO: 3832489 - RNA, 13 nt, Human
cuguguauguaca

SEQ ID NO: 3832490 - RNA, 19 nt, Human
cuguguauuccaagacaug

SEQ ID NO: 3832491 - RNA, 22 nt, Human
cuguguauuuaauuguaaacug

SEQ ID NO: 3832492 - RNA, 23 nt, Human
cuguguauuuaauuguaaacugu

SEQ ID NO: 3832493 - RNA, 14 nt, Human
cuguguauuugcuu

SEQ ID NO: 3832494 - RNA, 15 nt, Human
cuguguauuugcuuu

SEQ ID NO: 3832495 - RNA, 16 nt, Human
cuguguauuuucaguc

SEQ ID NO: 3832496 - RNA, 19 nt, Human
cuguguauuuuuuaaagcu

SEQ ID NO: 3832497 - RNA, 19 nt, Human
cugugucaauccagauggu

SEQ ID NO: 3832498 - RNA, 15 nt, Human
cugugucacuggcug

SEQ ID NO: 3832499 - RNA, 16 nt, Human
cugugucacuggcugc

SEQ ID NO: 3832500 - RNA, 18 nt, Human
cugugucacuggcugccu

SEQ ID NO: 3832501 - RNA, 17 nt, Human
cugugucagcauagaag

SEQ ID NO: 3832502 - RNA, 19 nt, Human
cugugucagguggggcagc

SEQ ID NO: 3832503 - RNA, 21 nt, Human
cuguguccaaaaccgccagcu

SEQ ID NO: 3832504 - RNA, 22 nt, Human
cuguguccaaaaccgccagcuc

SEQ ID NO: 3832505 - RNA, 14 nt, Human
cuguguccaacucc

SEQ ID NO: 3832506 - RNA, 17 nt, Human
cuguguccaacuccagu

SEQ ID NO: 3832507 - RNA, 15 nt, Human
cugugucccaugacc

SEQ ID NO: 3832508 - RNA, 20 nt, Human
cugugucccaugacccaccc

SEQ ID NO: 3832509 - RNA, 20 nt, Human
cugugucccucucucuggaa

SEQ ID NO: 3832510 - RNA, 17 nt, Human
cuguguccuggugcucu

SEQ ID NO: 3832511 - RNA, 23 nt, Human
cuguguccuggugcucucugcca

SEQ ID NO: 3832512 - RNA, 16 nt, Human
cuguguccuucccugc

SEQ ID NO: 3832513 - RNA, 16 nt, Human
cuguguccuugcaccu

SEQ ID NO: 3832514 - RNA, 11 nt, Human
cugugucuaaa

SEQ ID NO: 3832515 - RNA, 19 nt, Human
cugugucuaagauucuaga

SEQ ID NO: 3832516 - RNA, 15 nt, Human
cugugucugaguggc

SEQ ID NO: 3832517 - RNA, 13 nt, Human
cugugucuguguu

SEQ ID NO: 3832518 - RNA, 14 nt, Human
cugugucuugcaau

SEQ ID NO: 3832519 - RNA, 22 nt, Human
cugugucuugcaauggcagccu

SEQ ID NO: 3832520 - RNA, 20 nt, Human
cugugucuuuaaaugcugcu

SEQ ID NO: 3832521 - RNA, 20 nt, Human
cugugucuuucacagcuccu

SEQ ID NO: 3832522 - RNA, 19 nt, Human
cugugugaauaccugcuca

SEQ ID NO: 3832523 - RNA, 21 nt, Human
cugugugauugacagcuuugc

SEQ ID NO: 3832524 - RNA, 18 nt, Human
cugugugcagucucucuu

SEQ ID NO: 3832525 - RNA, 14 nt, Human
cugugugccuucgc

SEQ ID NO: 3832526 - RNA, 16 nt, Human
cuguguggagagggaa

SEQ ID NO: 3832527 - RNA, 17 nt, Human
cugugugggacuguaca

SEQ ID NO: 3832528 - RNA, 21 nt, Human
cugugugggacuguacacacu

SEQ ID NO: 3832529 - RNA, 22 nt, Human
cuguguggugucgcgccuucuc

SEQ ID NO: 3832530 - RNA, 20 nt, Human
cugugugguuuaguguaaaa

SEQ ID NO: 3832531 - RNA, 14 nt, Human
cugugugucaguuu

SEQ ID NO: 3832532 - RNA, 18 nt, Human
cugugugucccaggcagg

SEQ ID NO: 3832533 - RNA, 20 nt, Human
cugugugucccaggcaggga

SEQ ID NO: 3832534 - RNA, 16 nt, Human
cugugugugaccccuc

SEQ ID NO: 3832535 - RNA, 17 nt, Human
cugugugugaccccucc

SEQ ID NO: 3832536 - RNA, 21 nt, Human
cugugugugaccccuccuggg

SEQ ID NO: 3832537 - RNA, 13 nt, Human
cugugugugcccu

SEQ ID NO: 3832538 - RNA, 20 nt, Human
cugugugugcccucugggcu

SEQ ID NO: 3832539 - RNA, 14 nt, Human
cugugugugcccug

SEQ ID NO: 3832540 - RNA, 15 nt, Human
cugugugugcccugu

SEQ ID NO: 3832541 - RNA, 12 nt, Human
cuguguguguga

SEQ ID NO: 3832542 - RNA, 21 nt, Human
cuguguguguguauguggggg

SEQ ID NO: 3832543 - RNA, 16 nt, Human
cuguguguuaguuccc

SEQ ID NO: 3832544 - RNA, 21 nt, Human
cuguguguuaguucccaacau

SEQ ID NO: 3832545 - RNA, 12 nt, Human
cuguguguuccu

SEQ ID NO: 3832546 - RNA, 13 nt, Human
cuguguguugcca

SEQ ID NO: 3832547 - RNA, 16 nt, Human
cuguguguuuucauaa

SEQ ID NO: 3832548 - RNA, 15 nt, Human
cuguguuaauuuaag

SEQ ID NO: 3832549 - RNA, 21 nt, Human
cuguguuauuauagagcagaa

SEQ ID NO: 3832550 - RNA, 20 nt, Human
cuguguucgacucagccuca

SEQ ID NO: 3832551 - RNA, 22 nt, Human
cuguguucgacucagccucagg

SEQ ID NO: 3832552 - RNA, 22 nt, Human
cuguguucuugccacugcacuc

SEQ ID NO: 3832553 - RNA, 13 nt, Human
cuguguugccaag

SEQ ID NO: 3832554 - RNA, 17 nt, Human
cuguguugccaagcucc

SEQ ID NO: 3832555 - RNA, 21 nt, Human
cuguguugccaagcuccaagc

SEQ ID NO: 3832556 - RNA, 13 nt, Human
cuguguugccaca

SEQ ID NO: 3832557 - RNA, 22 nt, Human
cuguguugccacaguagaacug

SEQ ID NO: 3832558 - RNA, 14 nt, Human
cuguguugccaugu

SEQ ID NO: 3832559 - RNA, 18 nt, Human
cuguguugcgugucgugg

SEQ ID NO: 3832560 - RNA, 15 nt, Human
cugucuaaaguguau

SEQ ID NO: 3832561 - RNA, 16 nt, Human
cugucuaaccugugac

SEQ ID NO: 3832562 - RNA, 17 nt, Human
cugucuaaccugugacc

SEQ ID NO: 3832563 - RNA, 13 nt, Human
cugucuaccaucu

SEQ ID NO: 3832564 - RNA, 17 nt, Human
cugucuagagagggagg

SEQ ID NO: 3832565 - RNA, 23 nt, Human
cugucuagcacuuccuugccagu

SEQ ID NO: 3832566 - RNA, 19 nt, Human
cugucuagucucuccugua

SEQ ID NO: 3832567 - RNA, 18 nt, Human
cugucuauuucugcugaa

SEQ ID NO: 3832568 - RNA, 22 nt, Human
cugucucaaaaaaagaaaaaga

SEQ ID NO: 3832569 - RNA, 20 nt, Human
cugucucaagagggcacugg

SEQ ID NO: 3832570 - RNA, 14 nt, Human
cugucucagacuuu

SEQ ID NO: 3832571 - RNA, 20 nt, Human
cugucucagacuuuuguaca

SEQ ID NO: 3832572 - RNA, 16 nt, Human
cugucucagccuccca

SEQ ID NO: 3832573 - RNA, 13 nt, Human
cugucucagggug

SEQ ID NO: 3832574 - RNA, 12 nt, Human
cugucucaucca

SEQ ID NO: 3832575 - RNA, 15 nt, Human
cugucucauccauca

SEQ ID NO: 3832576 - RNA, 16 nt, Human
cugucucauccaucau

SEQ ID NO: 3832577 - RNA, 13 nt, Human
cugucucaucccc

SEQ ID NO: 3832578 - RNA, 16 nt, Human
cugucucauccccagg

SEQ ID NO: 3832579 - RNA, 19 nt, Human
cugucucauccccaggggu

SEQ ID NO: 3832580 - RNA, 16 nt, Human
cugucucauccuccug

SEQ ID NO: 3832581 - RNA, 18 nt, Human
cugucucauccuccugga

SEQ ID NO: 3832582 - RNA, 22 nt, Human
cugucucauccuccuggaaccu

SEQ ID NO: 3832583 - RNA, 14 nt, Human
cugucuccacugug

SEQ ID NO: 3832584 - RNA, 13 nt, Human
cugucuccagacc

SEQ ID NO: 3832585 - RNA, 19 nt, Human
cugucuccagacccccacc

SEQ ID NO: 3832586 - RNA, 15 nt, Human
cugucuccagcuucc

SEQ ID NO: 3832587 - RNA, 20 nt, Human
cugucuccauggcccugcaa

SEQ ID NO: 3832588 - RNA, 13 nt, Human
cugucuccuagga

SEQ ID NO: 3832589 - RNA, 20 nt, Human
cugucuccuuaacacugagc

SEQ ID NO: 3832590 - RNA, 15 nt, Human
cugucucgagcgccc

SEQ ID NO: 3832591 - RNA, 16 nt, Human
cugucucuaacuuauu

SEQ ID NO: 3832592 - RNA, 18 nt, Human
cugucucuacuaaaaaua

SEQ ID NO: 3832593 - RNA, 15 nt, Human
cugucucuagccacu

SEQ ID NO: 3832594 - RNA, 20 nt, Human
cugucucuagccacuuuggu

SEQ ID NO: 3832595 - RNA, 17 nt, Human
cugucucucaugaaccu

SEQ ID NO: 3832596 - RNA, 13 nt, Human
cugugcagggagg

SEQ ID NO: 3832597 - RNA, 22 nt, Human
cugugcagggaggagguggcag

SEQ ID NO: 3832598 - RNA, 18 nt, Human
cugugcagucacuggagg

SEQ ID NO: 3832599 - RNA, 21 nt, Human
cugugcaucuagccucaagcu

SEQ ID NO: 3832600 - RNA, 14 nt, Human
cugugccagagccu

SEQ ID NO: 3832601 - RNA, 17 nt, Human
cugugccagagccuggg

SEQ ID NO: 3832602 - RNA, 18 nt, Human
cugugccagagccugggg

SEQ ID NO: 3832603 - RNA, 16 nt, Human
cugugccagcccagag

SEQ ID NO: 3832604 - RNA, 22 nt, Human
cugugcccacaucccaggcuuc

SEQ ID NO: 3832605 - RNA, 23 nt, Human
cugugcccacaucccaggcuuca

SEQ ID NO: 3832606 - RNA, 12 nt, Human
cugugcccagcu

SEQ ID NO: 3832607 - RNA, 15 nt, Human
cugugcccaugggca

SEQ ID NO: 3832608 - RNA, 18 nt, Human
cugugcccaugggcacug

SEQ ID NO: 3832609 - RNA, 17 nt, Human
cugugccccaugccugu

SEQ ID NO: 3832610 - RNA, 21 nt, Human
cugugccccuuccgccacugg

SEQ ID NO: 3832611 - RNA, 22 nt, Human
cugugccccuuccgccacuggg

SEQ ID NO: 3832612 - RNA, 17 nt, Human
cugugcccuccugaccc

SEQ ID NO: 3832613 - RNA, 17 nt, Human
cugugcccuuauucagg

SEQ ID NO: 3832614 - RNA, 16 nt, Human
cugugccuccaucagc

SEQ ID NO: 3832615 - RNA, 14 nt, Human
cugugccucccaaa

SEQ ID NO: 3832616 - RNA, 13 nt, Human
cugugccuccuca

SEQ ID NO: 3832617 - RNA, 16 nt, Human
cugugccuccucaccc

SEQ ID NO: 3832618 - RNA, 22 nt, Human
cugugccucgcuccccacucug

SEQ ID NO: 3832619 - RNA, 13 nt, Human
cugugccucggcu

SEQ ID NO: 3832620 - RNA, 22 nt, Human
cugugccucggcuuuucucagc

SEQ ID NO: 3832621 - RNA, 17 nt, Human
cugugccugaccuugag

SEQ ID NO: 3832622 - RNA, 20 nt, Human
cugugccuggagcuccuggg

SEQ ID NO: 3832623 - RNA, 21 nt, Human
cugugccuuugaguuuccuca

SEQ ID NO: 3832624 - RNA, 16 nt, Human
cugugccuuuugccau

SEQ ID NO: 3832625 - RNA, 20 nt, Human
cugugcgcauaggccugcuu

SEQ ID NO: 3832626 - RNA, 14 nt, Human
cugugcgcccaggg

SEQ ID NO: 3832627 - RNA, 17 nt, Human
cugugcgcccagggcug

SEQ ID NO: 3832628 - RNA, 14 nt, Human
cugugcgcugacaa

SEQ ID NO: 3832629 - RNA, 19 nt, Human
cugugcgucuugguguaau

SEQ ID NO: 3832630 - RNA, 14 nt, Human
cugugcgugaaaca

SEQ ID NO: 3832631 - RNA, 22 nt, Human
cugugcguggggcucccgccuc

SEQ ID NO: 3832632 - RNA, 13 nt, Human
cugugcuaugaau

SEQ ID NO: 3832633 - RNA, 15 nt, Human
cugugcucagagacc

SEQ ID NO: 3832634 - RNA, 13 nt, Human
cugugcucagccc

SEQ ID NO: 3832635 - RNA, 17 nt, Human
cugugcucaggacucag

SEQ ID NO: 3832636 - RNA, 18 nt, Human
cugugcucaggacucaga

SEQ ID NO: 3832637 - RNA, 19 nt, Human
cugugcucaggacucagaa

SEQ ID NO: 3832638 - RNA, 22 nt, Human
cugugcucccugguucugauga

SEQ ID NO: 3832639 - RNA, 20 nt, Human
cugugcuccgugccuccacc

SEQ ID NO: 3832640 - RNA, 18 nt, Human
cugugcucuggacaggca

SEQ ID NO: 3832641 - RNA, 19 nt, Human
cugugcucuggacaggcau

SEQ ID NO: 3832642 - RNA, 14 nt, Human
cugugcugaaugcu

SEQ ID NO: 3832643 - RNA, 21 nt, Human
cugugcugacauggcucugga

SEQ ID NO: 3832644 - RNA, 13 nt, Human
cugugcugacccu

SEQ ID NO: 3832645 - RNA, 18 nt, Human
cugugcugacccuccugu

SEQ ID NO: 3832646 - RNA, 22 nt, Human
cugugcugagucugaaggcugg

SEQ ID NO: 3832647 - RNA, 22 nt, Human
cugugcugcccgucuucagccu

SEQ ID NO: 3832648 - RNA, 17 nt, Human
cugugcugcccugaaga

SEQ ID NO: 3832649 - RNA, 18 nt, Human
cugugcugcccugaagaa

SEQ ID NO: 3832650 - RNA, 19 nt, Human
cugugcugcccugcccacc

SEQ ID NO: 3832651 - RNA, 13 nt, Human
cugugcuggccag

SEQ ID NO: 3832652 - RNA, 13 nt, Human
cugugcuggggga

SEQ ID NO: 3832653 - RNA, 23 nt, Human
cugugcugggggaaugagcccag

SEQ ID NO: 3832654 - RNA, 17 nt, Human
cugugcugguguccuga

SEQ ID NO: 3832655 - RNA, 18 nt, Human
cugugcugugugugacgu

SEQ ID NO: 3832656 - RNA, 13 nt, Human
cugugcuguuguu

SEQ ID NO: 3832657 - RNA, 21 nt, Human
cugugcuguuguuaugaugug

SEQ ID NO: 3832658 - RNA, 16 nt, Human
cugugcuuaugguacc

SEQ ID NO: 3832659 - RNA, 17 nt, Human
cugugcuugaaggcccu

SEQ ID NO: 3832660 - RNA, 15 nt, Human
cugugcuuuccagcu

SEQ ID NO: 3832661 - RNA, 14 nt, Human
cugugcuuucccug

SEQ ID NO: 3832662 - RNA, 22 nt, Human
cugugcuuucuauuguacagaa

SEQ ID NO: 3832663 - RNA, 18 nt, Human
cugugcuuugacucaccu

SEQ ID NO: 3832664 - RNA, 21 nt, Human
cugugcuuugacucaccuguu

SEQ ID NO: 3832665 - RNA, 17 nt, Human
cugugcuuuuaaaugca

SEQ ID NO: 3832666 - RNA, 14 nt, Human
cuguggaaaaauau

SEQ ID NO: 3832667 - RNA, 19 nt, Human
cuguggaaaaauauuuaag

SEQ ID NO: 3832668 - RNA, 22 nt, Human
cuguggaaaagaaacacgcacu

SEQ ID NO: 3832669 - RNA, 17 nt, Human
cuguggaaaguguaaag

SEQ ID NO: 3832670 - RNA, 16 nt, Human
cuguggaacccagcag

SEQ ID NO: 3832671 - RNA, 23 nt, Human
cuguggaacccagcaguucuguu

SEQ ID NO: 3832672 - RNA, 19 nt, Human
cuguggaaggcagagaaau

SEQ ID NO: 3832673 - RNA, 14 nt, Human
cuguggaagggacu

SEQ ID NO: 3832674 - RNA, 16 nt, Human
cuguggaagggacuag

SEQ ID NO: 3832675 - RNA, 19 nt, Human
cuguggaaugagugugcau

SEQ ID NO: 3832676 - RNA, 21 nt, Human
cuguggacugaccuuguaaaa

SEQ ID NO: 3832677 - RNA, 22 nt, Human
cuguggacugaccuuguaaaag

SEQ ID NO: 3832678 - RNA, 19 nt, Human
cuguggagacugcuccuga

SEQ ID NO: 3832679 - RNA, 22 nt, Human
cuguggagcccgcacccccacc

SEQ ID NO: 3832680 - RNA, 17 nt, Human
cuguggagcucagcccc

SEQ ID NO: 3832681 - RNA, 15 nt, Human
cuguggaggaaggau

SEQ ID NO: 3832682 - RNA, 16 nt, Human
cuguggaggaaggauu

SEQ ID NO: 3832683 - RNA, 17 nt, Human
cuguggaggaaggauug

SEQ ID NO: 3832684 - RNA, 19 nt, Human
cuguggaggaaggauugua

SEQ ID NO: 3832685 - RNA, 20 nt, Human
cuguggauacccuuacccuu

SEQ ID NO: 3832686 - RNA, 24 nt, Human
cuguggaucaaauccagccugcug

SEQ ID NO: 3832687 - RNA, 14 nt, Human
cuguggaugcugcu

SEQ ID NO: 3832688 - RNA, 16 nt, Human
cuguggaugcugcugc

SEQ ID NO: 3832689 - RNA, 19 nt, Human
cuguggaugcugcugcccc

SEQ ID NO: 3832690 - RNA, 16 nt, Human
cuguggcacuugccug

SEQ ID NO: 3832691 - RNA, 17 nt, Human
cuguggcacuugccugg

SEQ ID NO: 3832692 - RNA, 22 nt, Human
cuguggcagaguuacaguucug

SEQ ID NO: 3832693 - RNA, 23 nt, Human
cuguggcagaguuacaguucugu

SEQ ID NO: 3832694 - RNA, 13 nt, Human
cuguggcaggcag

SEQ ID NO: 3832695 - RNA, 15 nt, Human
cuguggcaguaaaga

SEQ ID NO: 3832696 - RNA, 16 nt, Human
cuguggcauugaaaug

SEQ ID NO: 3832697 - RNA, 18 nt, Human
cuguggccaaguucuuag

SEQ ID NO: 3832698 - RNA, 22 nt, Human
cuguggccagcuuguuauuuau

SEQ ID NO: 3832699 - RNA, 22 nt, Human
cuguggccaugacccugccucu

SEQ ID NO: 3832700 - RNA, 22 nt, Human
cuguggccaugguccccaagac

SEQ ID NO: 3832701 - RNA, 18 nt, Human
cuguggccccacccuggg

SEQ ID NO: 3832702 - RNA, 14 nt, Human
cuguggcccugucc

SEQ ID NO: 3832703 - RNA, 19 nt, Human
cuguggccguuaucuggaa

SEQ ID NO: 3832704 - RNA, 21 nt, Human
cuguggccguuaucuggaagu

SEQ ID NO: 3832705 - RNA, 18 nt, Human
cuguggccuaaccugccg

SEQ ID NO: 3832706 - RNA, 20 nt, Human
cuguggccugugucccauga

SEQ ID NO: 3832707 - RNA, 13 nt, Human
cuguggccuuguu

SEQ ID NO: 3832708 - RNA, 22 nt, Human
cuguggcgagccauuuguccca

SEQ ID NO: 3832709 - RNA, 19 nt, Human
cuguggcgccgucuccagg

SEQ ID NO: 3832710 - RNA, 20 nt, Human
cuguggcgccgucuccaggg

SEQ ID NO: 3832711 - RNA, 15 nt, Human
cuguggcggugccug

SEQ ID NO: 3832712 - RNA, 16 nt, Human
cuguggcuccaggcca

SEQ ID NO: 3832713 - RNA, 14 nt, Human
cuguggcugcgcuu

SEQ ID NO: 3832714 - RNA, 17 nt, Human
cuguggcugcuagcacu

SEQ ID NO: 3832715 - RNA, 12 nt, Human
cuguggcuggug

SEQ ID NO: 3832716 - RNA, 15 nt, Human
cuguggcugucugga

SEQ ID NO: 3832717 - RNA, 14 nt, Human
cugugggaaauggu

SEQ ID NO: 3832718 - RNA, 13 nt, Human
cugugggaaauua

SEQ ID NO: 3832719 - RNA, 20 nt, Human
cugugggaacgagaggggaa

SEQ ID NO: 3832720 - RNA, 21 nt, Human
cugugggaacgagaggggaag

SEQ ID NO: 3832721 - RNA, 15 nt, Human
cugugggaccccagg

SEQ ID NO: 3832722 - RNA, 14 nt, Human
cugugggagccucg

SEQ ID NO: 3832723 - RNA, 15 nt, Human
cugugggagccucgc

SEQ ID NO: 3832724 - RNA, 14 nt, Human
cugugggagccugc

SEQ ID NO: 3832725 - RNA, 18 nt, Human
cugugggcaaaagagugu

SEQ ID NO: 3832726 - RNA, 14 nt, Human
aaauuuuucauauu

SEQ ID NO: 3832727 - RNA, 13 nt, Human
aaauuuuugaaaa

SEQ ID NO: 3832728 - RNA, 15 nt, Human
aaauuuuuggauuga

SEQ ID NO: 3832729 - RNA, 17 nt, Human
aaauuuuuggauugaca

SEQ ID NO: 3832730 - RNA, 21 nt, Human
aaauuuuuggauugacaguaa

SEQ ID NO: 3832731 - RNA, 14 nt, Human
aaauuuuuguaaau

SEQ ID NO: 3832732 - RNA, 16 nt, Human
aaauuuuuuaaaagag

SEQ ID NO: 3832733 - RNA, 18 nt, Human
aaauuuuuuaaaagagac

SEQ ID NO: 3832734 - RNA, 20 nt, Human
aaauuuuuucucuaggaaau

SEQ ID NO: 3832735 - RNA, 13 nt, Human
aaauuuuuugacu

SEQ ID NO: 3832736 - RNA, 11 nt, Human
aaauuuuuugu

SEQ ID NO: 3832737 - RNA, 15 nt, Human
aaauuuuuuguugac

SEQ ID NO: 3832738 - RNA, 23 nt, Human
aaauuuuuuuggucuuuuuguaa

SEQ ID NO: 3832739 - RNA, 16 nt, Human
aaauuuuuuuuacauu

SEQ ID NO: 3832740 - RNA, 13 nt, Human
ccuuccuggacag

SEQ ID NO: 3832741 - RNA, 22 nt, Human
ccuuccuggacagcugugccuc

SEQ ID NO: 3832742 - RNA, 16 nt, Human
ccuuccuggccugaga

SEQ ID NO: 3832743 - RNA, 21 nt, Human
ccuuccugggcacacgcugcu

SEQ ID NO: 3832744 - RNA, 22 nt, Human
ccuuccugggcacacgcugcuc

SEQ ID NO: 3832745 - RNA, 23 nt, Human
ccuuccugggcacacgcugcucu

SEQ ID NO: 3832746 - RNA, 19 nt, Human
ccuuccuggggcaucuggc

SEQ ID NO: 3832747 - RNA, 12 nt, Human
ccuuccuguccg

SEQ ID NO: 3832748 - RNA, 16 nt, Human
ccuuccuguccgcccu

SEQ ID NO: 3832749 - RNA, 17 nt, Human
ccuuccuguucugaacu

SEQ ID NO: 3832750 - RNA, 19 nt, Human
ccuuccuguuuuucacauu

SEQ ID NO: 3832751 - RNA, 13 nt, Human
ccuuccuucccac

SEQ ID NO: 3832752 - RNA, 14 nt, Human
ccuuccuugcuaau

SEQ ID NO: 3832753 - RNA, 12 nt, Human
ccuuccuuucuc

SEQ ID NO: 3832754 - RNA, 16 nt, Human
ccuuccuuucuccagg

SEQ ID NO: 3832755 - RNA, 15 nt, Human
ccuuccuuuucccug

SEQ ID NO: 3832756 - RNA, 17 nt, Human
ccuuccuuuucccugcu

SEQ ID NO: 3832757 - RNA, 15 nt, Human
ccuucgacagcauuu

SEQ ID NO: 3832758 - RNA, 15 nt, Human
ccuucgauacaccgg

SEQ ID NO: 3832759 - RNA, 20 nt, Human
ccuucgauacaccgggccug

SEQ ID NO: 3832760 - RNA, 20 nt, Human
ccuucgcuucuugccucugu

SEQ ID NO: 3832761 - RNA, 23 nt, Human
ccuucgcuucuugccucugugcu

SEQ ID NO: 3832762 - RNA, 19 nt, Human
ccuucggccuccauccuga

SEQ ID NO: 3832763 - RNA, 22 nt, Human
ccuucguaucccgagucuggga

SEQ ID NO: 3832764 - RNA, 16 nt, Human
ccuucgucuuucccau

SEQ ID NO: 3832765 - RNA, 22 nt, Human
ccuucgugaacauccccuccca

SEQ ID NO: 3832766 - RNA, 21 nt, Human
ccuucuacacucuccugggcc

SEQ ID NO: 3832767 - RNA, 14 nt, Human
ccuucuacugagcc

SEQ ID NO: 3832768 - RNA, 14 nt, Human
ccuucuacugcuuc

SEQ ID NO: 3832769 - RNA, 15 nt, Human
ccuucuaguuuccca

SEQ ID NO: 3832770 - RNA, 16 nt, Human
ccuucuaguuucccac

SEQ ID NO: 3832771 - RNA, 19 nt, Human
ccuucuauacccacccaga

SEQ ID NO: 3832772 - RNA, 15 nt, Human
ccuucuauuggucuc

SEQ ID NO: 3832773 - RNA, 15 nt, Human
ccuucuauuuggggc

SEQ ID NO: 3832774 - RNA, 22 nt, Human
ccuucuauuuggggcuugauga

SEQ ID NO: 3832775 - RNA, 11 nt, Human
ccuucucacca

SEQ ID NO: 3832776 - RNA, 12 nt, Human
ccuucucaccag

SEQ ID NO: 3832777 - RNA, 15 nt, Human
ccuucucaccagcug

SEQ ID NO: 3832778 - RNA, 16 nt, Human
ccuucucaccagcugc

SEQ ID NO: 3832779 - RNA, 18 nt, Human
ccuucucaccagcugcaa

SEQ ID NO: 3832780 - RNA, 19 nt, Human
ccuucucaccagcugcaaa

SEQ ID NO: 3832781 - RNA, 22 nt, Human
cuuaaacagggcaucuccagga

SEQ ID NO: 3832782 - RNA, 14 nt, Human
cuuaaaccugggag

SEQ ID NO: 3832783 - RNA, 15 nt, Human
cuuaaacuaaaugug

SEQ ID NO: 3832784 - RNA, 14 nt, Human
cuuaaacuugugaa

SEQ ID NO: 3832785 - RNA, 18 nt, Human
cuuaaagaaaacccaccc

SEQ ID NO: 3832786 - RNA, 22 nt, Human
cuuaaagaaacagcuuucaagu

SEQ ID NO: 3832787 - RNA, 23 nt, Human
cuuaaagaaacagcuuucaagug

SEQ ID NO: 3832788 - RNA, 17 nt, Human
cuuaaagaauucaaauu

SEQ ID NO: 3832789 - RNA, 14 nt, Human
cuuaaagucaguaa

SEQ ID NO: 3832790 - RNA, 13 nt, Human
cuuaaaguugaau

SEQ ID NO: 3832791 - RNA, 20 nt, Human
cuuaaaguugguauuaauaa

SEQ ID NO: 3832792 - RNA, 22 nt, Human
cuuaaaguugguauuaauaaaa

SEQ ID NO: 3832793 - RNA, 13 nt, Human
cuuaaauaagaaa

SEQ ID NO: 3832794 - RNA, 21 nt, Human
cuuaaauaauaaacaguggaa

SEQ ID NO: 3832795 - RNA, 21 nt, Human
cuuaaauaaugcuucagauau

SEQ ID NO: 3832796 - RNA, 13 nt, Human
cuuaaauaaugug

SEQ ID NO: 3832797 - RNA, 14 nt, Human
cuuaaauaauguga

SEQ ID NO: 3832798 - RNA, 15 nt, Human
cuuaaauauaguucc

SEQ ID NO: 3832799 - RNA, 22 nt, Human
cuuaaauauaguuccuaagaag

SEQ ID NO: 3832800 - RNA, 16 nt, Human
cuuaaauaucuuuuau

SEQ ID NO: 3832801 - RNA, 22 nt, Human
cuuaaauaucuuuuauguuuga

SEQ ID NO: 3832802 - RNA, 19 nt, Human
cuuaaaucuuaauguuccu

SEQ ID NO: 3832803 - RNA, 22 nt, Human
cuuaaaugcaaccauuugaaac

SEQ ID NO: 3832804 - RNA, 16 nt, Human
cuuaaaugugaauuac

SEQ ID NO: 3832805 - RNA, 17 nt, Human
cuuaaaugugaauuacu

SEQ ID NO: 3832806 - RNA, 16 nt, Human
cuuaaauguuauguau

SEQ ID NO: 3832807 - RNA, 17 nt, Human
cuuaaauguuauguaua

SEQ ID NO: 3832808 - RNA, 16 nt, Human
cuuaaauguuauuauc

SEQ ID NO: 3832809 - RNA, 19 nt, Human
cuuaaauuaaacaauuuau

SEQ ID NO: 3832810 - RNA, 21 nt, Human
cuuaaauuaaacaauuuauuu

SEQ ID NO: 3832811 - RNA, 22 nt, Human
cuuaaauuccucaacaguguuu

SEQ ID NO: 3832812 - RNA, 12 nt, Human
cuuaaauuuaau

SEQ ID NO: 3832813 - RNA, 16 nt, Human
cuuaaauuuaauacca

SEQ ID NO: 3832814 - RNA, 19 nt, Human
cuuaaauuucuuaugugac

SEQ ID NO: 3832815 - RNA, 22 nt, Human
cuuaaauuucuuaugugacauu

SEQ ID NO: 3832816 - RNA, 21 nt, Human
cuuaaauuugauuuacauaua

SEQ ID NO: 3832817 - RNA, 23 nt, Human
cuuaaauuuuaacuaaauuuuaa

SEQ ID NO: 3832818 - RNA, 18 nt, Human
cuuaaauuuuaauuuauu

SEQ ID NO: 3832819 - RNA, 19 nt, Human
cuuaacaaacccucguuuc

SEQ ID NO: 3832820 - RNA, 23 nt, Human
cuuaacaauuucuguccuucaga

SEQ ID NO: 3832821 - RNA, 20 nt, Human
cuuaacacuaccaauuuccc

SEQ ID NO: 3832822 - RNA, 19 nt, Human
cuuaacagggaacgugauu

SEQ ID NO: 3832823 - RNA, 20 nt, Human
cuuaacauagccaaaaugug

SEQ ID NO: 3832824 - RNA, 15 nt, Human
cuuaacauauuuacu

SEQ ID NO: 3832825 - RNA, 11 nt, Human
cuuaacaugcu

SEQ ID NO: 3832826 - RNA, 22 nt, Human
cuuaacaugcuguguaagcugu

SEQ ID NO: 3832827 - RNA, 16 nt, Human
cuuaacauuccuaaaa

SEQ ID NO: 3832828 - RNA, 19 nt, Human
cuuaacauuccuaaaaugc

SEQ ID NO: 3832829 - RNA, 23 nt, Human
cuuaaccaguuguggugugagua

SEQ ID NO: 3832830 - RNA, 14 nt, Human
cuuaacccaaggag

SEQ ID NO: 3832831 - RNA, 17 nt, Human
cuuaacccaaggagcac

SEQ ID NO: 3832832 - RNA, 15 nt, Human
cuuaacccagugucc

SEQ ID NO: 3832833 - RNA, 16 nt, Human
cuuaaccgcaucagaa

SEQ ID NO: 3832834 - RNA, 16 nt, Human
cuuaacggaccaaagc

SEQ ID NO: 3832835 - RNA, 11 nt, Human
cuuaacuauuc

SEQ ID NO: 3832836 - RNA, 11 nt, Human
cuuaacucuuu

SEQ ID NO: 3832837 - RNA, 21 nt, Human
cuuaacucuuugccuuugcca

SEQ ID NO: 3832838 - RNA, 12 nt, Human
cuuaacugaaau

SEQ ID NO: 3832839 - RNA, 17 nt, Human
cuuaacuguauagcucu

SEQ ID NO: 3832840 - RNA, 11 nt, Human
cuuaagaaaaa

SEQ ID NO: 3832841 - RNA, 12 nt, Human
cuuaagaaauaa

SEQ ID NO: 3832842 - RNA, 15 nt, Human
cuuaagaaauaaauc

SEQ ID NO: 3832843 - RNA, 11 nt, Human
cuuaagaacac

SEQ ID NO: 3832844 - RNA, 18 nt, Human
cuuaagaauuuugagcag

SEQ ID NO: 3832845 - RNA, 15 nt, Human
cuuaagacagcaugu

SEQ ID NO: 3832846 - RNA, 19 nt, Human
cuuaagacagcauguguua

SEQ ID NO: 3832847 - RNA, 23 nt, Human
cuuaagaccuacuguucuaaagc

SEQ ID NO: 3832848 - RNA, 15 nt, Human
cuuaagacuuaauga

SEQ ID NO: 3832849 - RNA, 17 nt, Human
cuuaagacuuaaugaga

SEQ ID NO: 3832850 - RNA, 16 nt, Human
cuuaagagaaauggca

SEQ ID NO: 3832851 - RNA, 23 nt, Human
cuuaagagaauauuuuaaguauu

SEQ ID NO: 3832852 - RNA, 18 nt, Human
cuuaagcagaagcauuaa

SEQ ID NO: 3832853 - RNA, 15 nt, Human
cuuaagcaucuggcu

SEQ ID NO: 3832854 - RNA, 23 nt, Human
cuuaagcaucuggcucuaauuca

SEQ ID NO: 3832855 - RNA, 14 nt, Human
cuuaagccacugcc

SEQ ID NO: 3832856 - RNA, 17 nt, Human
cuuaagccacugccucu

SEQ ID NO: 3832857 - RNA, 20 nt, Human
cuuaagccaucuugguaaau

SEQ ID NO: 3832858 - RNA, 14 nt, Human
cuuaagcccuggcc

SEQ ID NO: 3832859 - RNA, 20 nt, Human
cuuaagccuuuugcucacaa

SEQ ID NO: 3832860 - RNA, 23 nt, Human
cuuaagcuaggauguugcucaga

SEQ ID NO: 3832861 - RNA, 13 nt, Human
cuuaagcugcagg

SEQ ID NO: 3832862 - RNA, 14 nt, Human
cuuaagcugcagga

SEQ ID NO: 3832863 - RNA, 22 nt, Human
cuuaagcugcaggauucucacc

SEQ ID NO: 3832864 - RNA, 15 nt, Human
cuuaaggcucuuuug

SEQ ID NO: 3832865 - RNA, 17 nt, Human
cuuaaggugaggccugu

SEQ ID NO: 3832866 - RNA, 22 nt, Human
cuuaaggugaggccugucugug

SEQ ID NO: 3832867 - RNA, 23 nt, Human
cuuaaggugaggccugucuguga

SEQ ID NO: 3832868 - RNA, 17 nt, Human
cuuaagguguagccaca

SEQ ID NO: 3832869 - RNA, 19 nt, Human
cuuaaguaaucaucuaagu

SEQ ID NO: 3832870 - RNA, 14 nt, Human
cuuaaguaucagaa

SEQ ID NO: 3832871 - RNA, 20 nt, Human
cuuaagucacccuagcccuc

SEQ ID NO: 3832872 - RNA, 18 nt, Human
cuuaagucagaacagcag

SEQ ID NO: 3832873 - RNA, 16 nt, Human
cuuaagugcugcaauu

SEQ ID NO: 3832874 - RNA, 14 nt, Human
cuuaauaaaaauga

SEQ ID NO: 3832875 - RNA, 17 nt, Human
cuuaauaaaaaugacag

SEQ ID NO: 3832876 - RNA, 20 nt, Human
cuuaauaaaaaugacagacu

SEQ ID NO: 3832877 - RNA, 12 nt, Human
cuuaauaaauuc

SEQ ID NO: 3832878 - RNA, 17 nt, Human
cuuaauaaauucagaua

SEQ ID NO: 3832879 - RNA, 15 nt, Human
cuuaauaacugugua

SEQ ID NO: 3832880 - RNA, 19 nt, Human
cuuaauaacuguguacugu

SEQ ID NO: 3832881 - RNA, 20 nt, Human
cuuaauaacuguguacuguu

SEQ ID NO: 3832882 - RNA, 14 nt, Human
cuuaauaaucaaga

SEQ ID NO: 3832883 - RNA, 15 nt, Human
cuuaauaaucaagag

SEQ ID NO: 3832884 - RNA, 21 nt, Human
cuuaauaccugggugauuaca

SEQ ID NO: 3832885 - RNA, 21 nt, Human
cuuauccacgagagcgcagca

SEQ ID NO: 3832886 - RNA, 12 nt, Human
cuuauccaggac

SEQ ID NO: 3832887 - RNA, 13 nt, Human
cuuauccaggacu

SEQ ID NO: 3832888 - RNA, 21 nt, Human
cuuauccauaaaaaaaaauag

SEQ ID NO: 3832889 - RNA, 19 nt, Human
cuuaucccugcccauuuca

SEQ ID NO: 3832890 - RNA, 12 nt, Human
cuuauccucccu

SEQ ID NO: 3832891 - RNA, 16 nt, Human
cuuauccucccuguaa

SEQ ID NO: 3832892 - RNA, 16 nt, Human
cuuauccucugaucuc

SEQ ID NO: 3832893 - RNA, 22 nt, Human
cuuauccuucaucuuuuaaaga

SEQ ID NO: 3832894 - RNA, 21 nt, Human
cuuauccuuccacggacucaa

SEQ ID NO: 3832895 - RNA, 13 nt, Human
cuuauccuuccuc

SEQ ID NO: 3832896 - RNA, 15 nt, Human
cuuaucgaaacucau

SEQ ID NO: 3832897 - RNA, 23 nt, Human
cuuaucuaaucaugaaacucccu

SEQ ID NO: 3832898 - RNA, 18 nt, Human
cuuaucuacuuccaaacu

SEQ ID NO: 3832899 - RNA, 19 nt, Human
cuuaucucagucaugcaua

SEQ ID NO: 3832900 - RNA, 21 nt, Human
cuuaucucagucaugcauaaa

SEQ ID NO: 3832901 - RNA, 13 nt, Human
cuuaucucucugu

SEQ ID NO: 3832902 - RNA, 14 nt, Human
cuuaucucucugug

SEQ ID NO: 3832903 - RNA, 12 nt, Human
cuuaucucuuuu

SEQ ID NO: 3832904 - RNA, 21 nt, Human
cuuaucugagcugagccaggc

SEQ ID NO: 3832905 - RNA, 19 nt, Human
cuuaucugugcgugaaaca

SEQ ID NO: 3832906 - RNA, 16 nt, Human
cuuaucugugcucagg

SEQ ID NO: 3832907 - RNA, 22 nt, Human
cuuaucugugcucaggacucag

SEQ ID NO: 3832908 - RNA, 18 nt, Human
cuuaugaaaagaauuguu

SEQ ID NO: 3832909 - RNA, 18 nt, Human
cuuaugaauauuuauaac

SEQ ID NO: 3832910 - RNA, 22 nt, Human
cuuaugacaucacuuguacaaa

SEQ ID NO: 3832911 - RNA, 14 nt, Human
cuuaugacuaugua

SEQ ID NO: 3832912 - RNA, 15 nt, Human
cuuaugaggagggga

SEQ ID NO: 3832913 - RNA, 23 nt, Human
cuuaugauagcaaauggccucau

SEQ ID NO: 3832914 - RNA, 14 nt, Human
cuuaugccacggga

SEQ ID NO: 3832915 - RNA, 15 nt, Human
cuuaugcucuuaauu

SEQ ID NO: 3832916 - RNA, 15 nt, Human
cuuaugcugauuuau

SEQ ID NO: 3832917 - RNA, 16 nt, Human
cuuauggaacacucug

SEQ ID NO: 3832918 - RNA, 19 nt, Human
cuuauggaauugauuugca

SEQ ID NO: 3832919 - RNA, 21 nt, Human
cuuauggaauugauuugcauu

SEQ ID NO: 3832920 - RNA, 16 nt, Human
cuuauggaugucccca

SEQ ID NO: 3832921 - RNA, 17 nt, Human
cuuauggauguccccag

SEQ ID NO: 3832922 - RNA, 18 nt, Human
cuuauggauucauuuaua

SEQ ID NO: 3832923 - RNA, 14 nt, Human
cuuaugggcugggu

SEQ ID NO: 3832924 - RNA, 21 nt, Human
cuuauggguagggcucugaca

SEQ ID NO: 3832925 - RNA, 21 nt, Human
cuuaugggucccccucagcaa

SEQ ID NO: 3832926 - RNA, 13 nt, Human
cuuaugguaccag

SEQ ID NO: 3832927 - RNA, 18 nt, Human
cuuauguagauauuuggc

SEQ ID NO: 3832928 - RNA, 19 nt, Human
cuuauguagauauuuggcu

SEQ ID NO: 3832929 - RNA, 14 nt, Human
cuuauguugaaaaa

SEQ ID NO: 3832930 - RNA, 13 nt, Human
cuuauuaaaguuu

SEQ ID NO: 3832931 - RNA, 19 nt, Human
cuuauuaaauggaaacuga

SEQ ID NO: 3832932 - RNA, 13 nt, Human
cuuauuacaauuu

SEQ ID NO: 3832933 - RNA, 17 nt, Human
cuuauuagaacaggcaa

SEQ ID NO: 3832934 - RNA, 17 nt, Human
cuuauuagagugucuuu

SEQ ID NO: 3832935 - RNA, 20 nt, Human
cuuauuauguagguaagacu

SEQ ID NO: 3832936 - RNA, 15 nt, Human
cuuauucccuuccug

SEQ ID NO: 3832937 - RNA, 15 nt, Human
cuuauucucaaagca

SEQ ID NO: 3832938 - RNA, 12 nt, Human
cuuauucuguag

SEQ ID NO: 3832939 - RNA, 13 nt, Human
cuuauugaauaua

SEQ ID NO: 3832940 - RNA, 23 nt, Human
cuuauugauauucuaagaaauau

SEQ ID NO: 3832941 - RNA, 18 nt, Human
cuuauugcccacgcugga

SEQ ID NO: 3832942 - RNA, 17 nt, Human
cuuauugcgcugcuacc

SEQ ID NO: 3832943 - RNA, 17 nt, Human
cuuauuggaacucugcu

SEQ ID NO: 3832944 - RNA, 18 nt, Human
cuuauuggcagcucuacu

SEQ ID NO: 3832945 - RNA, 15 nt, Human
cuuauuguaccucuc

SEQ ID NO: 3832946 - RNA, 12 nt, Human
cuuauuguucca

SEQ ID NO: 3832947 - RNA, 19 nt, Human
cuuauuuaaauagaugaca

SEQ ID NO: 3832948 - RNA, 20 nt, Human
cuuauuuaaguaacuuuaaa

SEQ ID NO: 3832949 - RNA, 17 nt, Human
cuuauuuaaugaaagac

SEQ ID NO: 3832950 - RNA, 16 nt, Human
cuucaggcaauucucc

SEQ ID NO: 3832951 - RNA, 23 nt, Human
cuucaggcaauucuccugccuuu

SEQ ID NO: 3832952 - RNA, 21 nt, Human
cuucaggcccccgccuuggcc

SEQ ID NO: 3832953 - RNA, 22 nt, Human
cuucaggcccccgccuuggccu

SEQ ID NO: 3832954 - RNA, 22 nt, Human
cuucaggcucuucuccuuucac

SEQ ID NO: 3832955 - RNA, 17 nt, Human
cuucagggagucagcug

SEQ ID NO: 3832956 - RNA, 20 nt, Human
cuucagggagucagcuguuu

SEQ ID NO: 3832957 - RNA, 15 nt, Human
cuucagggcaggugg

SEQ ID NO: 3832958 - RNA, 15 nt, Human
cuucaggggcugccc

SEQ ID NO: 3832959 - RNA, 19 nt, Human
cuucaggggcugcccgcuc

SEQ ID NO: 3832960 - RNA, 22 nt, Human
cuucaggggcugcccgcuccca

SEQ ID NO: 3832961 - RNA, 14 nt, Human
cuucagggggccag

SEQ ID NO: 3832962 - RNA, 18 nt, Human
cuucaggucaggaguucg

SEQ ID NO: 3832963 - RNA, 18 nt, Human
cuucagguccaggcugug

SEQ ID NO: 3832964 - RNA, 18 nt, Human
cuucagguugguuuaauc

SEQ ID NO: 3832965 - RNA, 19 nt, Human
cuucaguacccucucagcu

SEQ ID NO: 3832966 - RNA, 23 nt, Human
cuucaguacccucucagcuccag

SEQ ID NO: 3832967 - RNA, 14 nt, Human
cuucaguauguugu

SEQ ID NO: 3832968 - RNA, 18 nt, Human
cuucaguauguugucaaa

SEQ ID NO: 3832969 - RNA, 23 nt, Human
cuucaguauguugucaaagagag

SEQ ID NO: 3832970 - RNA, 15 nt, Human
cuucaguccugcucc

SEQ ID NO: 3832971 - RNA, 19 nt, Human
cuucaguccugcuccagaa

SEQ ID NO: 3832972 - RNA, 21 nt, Human
cuucagucucuauaccaauaa

SEQ ID NO: 3832973 - RNA, 14 nt, Human
cuucagugccaaaa

SEQ ID NO: 3832974 - RNA, 15 nt, Human
cuucagugcccacca

SEQ ID NO: 3832975 - RNA, 20 nt, Human
cuucaguguauggaaauaaa

SEQ ID NO: 3832976 - RNA, 17 nt, Human
cuucaguuaagccuuug

SEQ ID NO: 3832977 - RNA, 14 nt, Human
cuucaguugcuugu

SEQ ID NO: 3832978 - RNA, 23 nt, Human
cuucaguugcuugucuucuggua

SEQ ID NO: 3832979 - RNA, 20 nt, Human
cuucaguugguguguuuuug

SEQ ID NO: 3832980 - RNA, 20 nt, Human
cuucaguugguugugucuuu

SEQ ID NO: 3832981 - RNA, 21 nt, Human
cuucaguugguugugucuuuu

SEQ ID NO: 3832982 - RNA, 22 nt, Human
cuucaguugguugugucuuuuu

SEQ ID NO: 3832983 - RNA, 15 nt, Human
cuucaguugucucug

SEQ ID NO: 3832984 - RNA, 23 nt, Human
cuucaguugucucugaugcagcu

SEQ ID NO: 3832985 - RNA, 17 nt, Human
cuucaguuguuuucccg

SEQ ID NO: 3832986 - RNA, 17 nt, Human
cuucaguuugcagagua

SEQ ID NO: 3832987 - RNA, 12 nt, Human
cuucauacaggg

SEQ ID NO: 3832988 - RNA, 13 nt, Human
cuucauacaggga

SEQ ID NO: 3832989 - RNA, 22 nt, Human
cuucauacagggaugguguuca

SEQ ID NO: 3832990 - RNA, 13 nt, Human
cuucauacuugaa

SEQ ID NO: 3832991 - RNA, 16 nt, Human
cuucauagaauacuca

SEQ ID NO: 3832992 - RNA, 18 nt, Human
cuucauagcagauuuuaa

SEQ ID NO: 3832993 - RNA, 18 nt, Human
cuucauaucauccacaca

SEQ ID NO: 3832994 - RNA, 20 nt, Human
cuucauaugaaaggugccau

SEQ ID NO: 3832995 - RNA, 14 nt, Human
cuucauauucagcu

SEQ ID NO: 3832996 - RNA, 16 nt, Human
cuucauccccucagaa

SEQ ID NO: 3832997 - RNA, 14 nt, Human
cuucaucccuuucc

SEQ ID NO: 3832998 - RNA, 20 nt, Human
cuucauccuuagcaacagcc

SEQ ID NO: 3832999 - RNA, 19 nt, Human
cuucaucguggggcucuca

SEQ ID NO: 3833000 - RNA, 18 nt, Human
cuucaucugacuaugaca

SEQ ID NO: 3833001 - RNA, 19 nt, Human
cuucaucugacuaugacau

SEQ ID NO: 3833002 - RNA, 14 nt, Human
cuucaucugcccaa

SEQ ID NO: 3833003 - RNA, 12 nt, Human
cuucaucuggaa

SEQ ID NO: 3833004 - RNA, 14 nt, Human
cuucaucuggaagu

SEQ ID NO: 3833005 - RNA, 23 nt, Human
cuucaucuggcaacaucuuuauc

SEQ ID NO: 3833006 - RNA, 20 nt, Human
cuucaucuggcugccuuugc

SEQ ID NO: 3833007 - RNA, 15 nt, Human
cuucaucuuccugug

SEQ ID NO: 3833008 - RNA, 19 nt, Human
cuucaucuuccuguguccu

SEQ ID NO: 3833009 - RNA, 20 nt, Human
cuucaucuuccuguguccug

SEQ ID NO: 3833010 - RNA, 21 nt, Human
cuucaucuuccuguguccuga

SEQ ID NO: 3833011 - RNA, 15 nt, Human
cuucaucuucucagc

SEQ ID NO: 3833012 - RNA, 19 nt, Human
cuucaugaaaauccuacca

SEQ ID NO: 3833013 - RNA, 17 nt, Human
cuucaugaaaugcuaug

SEQ ID NO: 3833014 - RNA, 12 nt, Human
cuucaugcaaug

SEQ ID NO: 3833015 - RNA, 13 nt, Human
cuucaugcaauga

SEQ ID NO: 3833016 - RNA, 21 nt, Human
cuucaugcauggaaauucccu

SEQ ID NO: 3833017 - RNA, 23 nt, Human
cuucaugcauggaaauucccuuc

SEQ ID NO: 3833018 - RNA, 14 nt, Human
cuucaugccuuugu

SEQ ID NO: 3833019 - RNA, 14 nt, Human
cuucauggaacuca

SEQ ID NO: 3833020 - RNA, 17 nt, Human
cuucauguaaaguguca

SEQ ID NO: 3833021 - RNA, 12 nt, Human
cuucauguaaau

SEQ ID NO: 3833022 - RNA, 16 nt, Human
cuucauguaauuuuau

SEQ ID NO: 3833023 - RNA, 23 nt, Human
cuucaugucaacuucuggcuccu

SEQ ID NO: 3833024 - RNA, 16 nt, Human
cuucaugugucccaga

SEQ ID NO: 3833025 - RNA, 17 nt, Human
cuucaugugucccagaa

SEQ ID NO: 3833026 - RNA, 15 nt, Human
cuucauguucccacu

SEQ ID NO: 3833027 - RNA, 16 nt, Human
cuucauuaauaauaaa

SEQ ID NO: 3833028 - RNA, 20 nt, Human
cuucauuaccuuuuuugaua

SEQ ID NO: 3833029 - RNA, 11 nt, Human
cgagggcuggc

SEQ ID NO: 3833030 - RNA, 17 nt, Human
cgagggcuggcuggccu

SEQ ID NO: 3833031 - RNA, 18 nt, Human
cgaggggaggguggcagg

SEQ ID NO: 3833032 - RNA, 17 nt, Human
cgaggggcgggacccag

SEQ ID NO: 3833033 - RNA, 17 nt, Human
cgaggggcucaggaaaa

SEQ ID NO: 3833034 - RNA, 23 nt, Human
cgagggggcugcucccaccuggc

SEQ ID NO: 3833035 - RNA, 19 nt, Human
cgaggggugucuugggcag

SEQ ID NO: 3833036 - RNA, 14 nt, Human
cgaggguccuggcu

SEQ ID NO: 3833037 - RNA, 20 nt, Human
cgagguagaguuugaaggag

SEQ ID NO: 3833038 - RNA, 15 nt, Human
cgaggucaacagaga

SEQ ID NO: 3833039 - RNA, 21 nt, Human
cgaggucaacagagaaggcag

SEQ ID NO: 3833040 - RNA, 13 nt, Human
cgaggucaggaga

SEQ ID NO: 3833041 - RNA, 22 nt, Human
cgaggucgggcagcacaagugu

SEQ ID NO: 3833042 - RNA, 20 nt, Human
cgagguggaucacagaggcu

SEQ ID NO: 3833043 - RNA, 15 nt, Human
cgagguggcugccug

SEQ ID NO: 3833044 - RNA, 13 nt, Human
cgaguacuguggg

SEQ ID NO: 3833045 - RNA, 16 nt, Human
cgaguagcugggacua

SEQ ID NO: 3833046 - RNA, 21 nt, Human
cgaguauguguuugugugugu

SEQ ID NO: 3833047 - RNA, 14 nt, Human
cgagucaaaguuga

SEQ ID NO: 3833048 - RNA, 16 nt, Human
cgagucaauccccuca

SEQ ID NO: 3833049 - RNA, 20 nt, Human
cgagucaauccccucauuca

SEQ ID NO: 3833050 - RNA, 16 nt, Human
cgagucaccuuccagg

SEQ ID NO: 3833051 - RNA, 13 nt, Human
cgaguccaagcug

SEQ ID NO: 3833052 - RNA, 16 nt, Human
cgagucucuucuccac

SEQ ID NO: 3833053 - RNA, 16 nt, Human
cgagucugggacacaa

SEQ ID NO: 3833054 - RNA, 21 nt, Human
cgagugcuaaguguaggauau

SEQ ID NO: 3833055 - RNA, 17 nt, Human
cgaguggauagaugccc

SEQ ID NO: 3833056 - RNA, 20 nt, Human
cgaguggauuguaggugcaa

SEQ ID NO: 3833057 - RNA, 22 nt, Human
cgaguuguggaaagccucugcu

SEQ ID NO: 3833058 - RNA, 16 nt, Human
cgauaaggaagaaaca

SEQ ID NO: 3833059 - RNA, 23 nt, Human
cgauacccaggaccaagccacag

SEQ ID NO: 3833060 - RNA, 13 nt, Human
cgauauacagaug

SEQ ID NO: 3833061 - RNA, 15 nt, Human
cgauauacagaugaa

SEQ ID NO: 3833062 - RNA, 18 nt, Human
cgauauacagaugaaaau

SEQ ID NO: 3833063 - RNA, 22 nt, Human
cgauauuuuuaaagaucuguaa

SEQ ID NO: 3833064 - RNA, 15 nt, Human
cgaucacaaaugacu

SEQ ID NO: 3833065 - RNA, 17 nt, Human
cgaucacaaaugacuuu

SEQ ID NO: 3833066 - RNA, 21 nt, Human
cgaucacaaaugacuuuauua

SEQ ID NO: 3833067 - RNA, 18 nt, Human
cgaucacaacgugcauug

SEQ ID NO: 3833068 - RNA, 22 nt, Human
cgaucacaacgugcauugugcu

SEQ ID NO: 3833069 - RNA, 18 nt, Human
cgaucaggcacaggucag

SEQ ID NO: 3833070 - RNA, 19 nt, Human
cgaucauggcucacugcag

SEQ ID NO: 3833071 - RNA, 21 nt, Human
cgaucauggcucacugcagcc

SEQ ID NO: 3833072 - RNA, 20 nt, Human
cgauccaccugucucagccu

SEQ ID NO: 3833073 - RNA, 19 nt, Human
cgaucgcggcggagcuggc

SEQ ID NO: 3833074 - RNA, 19 nt, Human
cgaucuggguucacugcaa

SEQ ID NO: 3833075 - RNA, 21 nt, Human
cgaugaauuuggagacucugu

SEQ ID NO: 3833076 - RNA, 23 nt, Human
cgaugaauuuggagacucugugg

SEQ ID NO: 3833077 - RNA, 21 nt, Human
cgaugaugcuuguaacaagaa

SEQ ID NO: 3833078 - RNA, 22 nt, Human
cgaugaugcuuguaacaagaaa

SEQ ID NO: 3833079 - RNA, 19 nt, Human
cgaugcaaacauuggaaga

SEQ ID NO: 3833080 - RNA, 15 nt, Human
cgaugcaaugaacac

SEQ ID NO: 3833081 - RNA, 15 nt, Human
cgaugcagacagggg

SEQ ID NO: 3833082 - RNA, 12 nt, Human
cgaugcccagag

SEQ ID NO: 3833083 - RNA, 14 nt, Human
cgaugcuccagcca

SEQ ID NO: 3833084 - RNA, 22 nt, Human
cgaugcuccagccaaccccugu

SEQ ID NO: 3833085 - RNA, 12 nt, Human
cgaugcugcuuu

SEQ ID NO: 3833086 - RNA, 21 nt, Human
cgaugcuuuaccaaacagcaa

SEQ ID NO: 3833087 - RNA, 22 nt, Human
cgaugggagggauggcccuucc

SEQ ID NO: 3833088 - RNA, 18 nt, Human
cgauguaggcauucugga

SEQ ID NO: 3833089 - RNA, 20 nt, Human
cgauguaugcagcuaucugg

SEQ ID NO: 3833090 - RNA, 23 nt, Human
cgauguggaaaaaugagagaagg

SEQ ID NO: 3833091 - RNA, 20 nt, Human
cgauguggaacugcugccac

SEQ ID NO: 3833092 - RNA, 21 nt, Human
cgauguggaacugcugccacu

SEQ ID NO: 3833093 - RNA, 23 nt, Human
cgauguggaccucuacuuuccag

SEQ ID NO: 3833094 - RNA, 15 nt, Human
cgauguggcccuggc

SEQ ID NO: 3833095 - RNA, 16 nt, Human
cgauguggcccuggcc

SEQ ID NO: 3833096 - RNA, 22 nt, Human
cgauguggcccuggccugcugg

SEQ ID NO: 3833097 - RNA, 17 nt, Human
cgauguggucacagcug

SEQ ID NO: 3833098 - RNA, 18 nt, Human
cgauguggucacagcugu

SEQ ID NO: 3833099 - RNA, 19 nt, Human
cgauguggucacagcugua

SEQ ID NO: 3833100 - RNA, 11 nt, Human
cgauuagacug

SEQ ID NO: 3833101 - RNA, 18 nt, Human
cgauuagacuggacagcu

SEQ ID NO: 3833102 - RNA, 21 nt, Human
cgauucccucucccaggcccc

SEQ ID NO: 3833103 - RNA, 21 nt, Human
cgauucuucugcuucagccuc

SEQ ID NO: 3833104 - RNA, 23 nt, Human
cgauugcaggagucccugccauc

SEQ ID NO: 3833105 - RNA, 13 nt, Human
cgauuggcuuuaa

SEQ ID NO: 3833106 - RNA, 15 nt, Human
cgauuggcuuuaaac

SEQ ID NO: 3833107 - RNA, 12 nt, Human
cgauuguaacuc

SEQ ID NO: 3833108 - RNA, 17 nt, Human
cgauuuucuccagcuca

SEQ ID NO: 3833109 - RNA, 15 nt, Human
cgcaaaccacacugg

SEQ ID NO: 3833110 - RNA, 16 nt, Human
cgcaaaccacacugga

SEQ ID NO: 3833111 - RNA, 19 nt, Human
cgcaaagggcugaaagcca

SEQ ID NO: 3833112 - RNA, 22 nt, Human
cgcaacccgugccaaguccagg

SEQ ID NO: 3833113 - RNA, 20 nt, Human
cgcaagauagauuuggaaua

SEQ ID NO: 3833114 - RNA, 21 nt, Human
cgcaagcaccauccccuccgg

SEQ ID NO: 3833115 - RNA, 14 nt, Human
cgcaagucugcagc

SEQ ID NO: 3833116 - RNA, 21 nt, Human
cgcacaaggcugaccaagaga

SEQ ID NO: 3833117 - RNA, 22 nt, Human
cgcacaauaguaaccuggguaa

SEQ ID NO: 3833118 - RNA, 10 nt, Human
cgcacacaca

SEQ ID NO: 3833119 - RNA, 13 nt, Human
cgcacacacacac

SEQ ID NO: 3833120 - RNA, 20 nt, Human
cgcacacccucacucugcca

SEQ ID NO: 3833121 - RNA, 13 nt, Human
cgcacagagcugg

SEQ ID NO: 3833122 - RNA, 10 nt, Human
cgcacagcag

SEQ ID NO: 3833123 - RNA, 12 nt, Human
cgcacagcagcc

SEQ ID NO: 3833124 - RNA, 13 nt, Human
cgcacagcaguuc

SEQ ID NO: 3833125 - RNA, 19 nt, Human
cgcacagcaugagaggcuc

SEQ ID NO: 3833126 - RNA, 14 nt, Human
cgcaccccagagug

SEQ ID NO: 3833127 - RNA, 14 nt, Human
cgcacccccacccu

SEQ ID NO: 3833128 - RNA, 15 nt, Human
cgcacccccacccuu

SEQ ID NO: 3833129 - RNA, 14 nt, Human
cgcaccccccuguu

SEQ ID NO: 3833130 - RNA, 18 nt, Human
cgcaccccccuguucuaa

SEQ ID NO: 3833131 - RNA, 16 nt, Human
cgcaccuaccaucagg

SEQ ID NO: 3833132 - RNA, 16 nt, Human
cgcaccucccauccua

SEQ ID NO: 3833133 - RNA, 16 nt, Human
cgcaccugcccccugg

SEQ ID NO: 3833134 - RNA, 14 nt, Human
cgcaccugccucag

SEQ ID NO: 3833135 - RNA, 13 nt, Human
cgcaccuguacag

SEQ ID NO: 3833136 - RNA, 22 nt, Human
cgcacuacaugugguuuauaga

SEQ ID NO: 3833137 - RNA, 15 nt, Human
cgcacuuuccacuuc

SEQ ID NO: 3833138 - RNA, 20 nt, Human
cgcacuuuccacuucuuccu

SEQ ID NO: 3833139 - RNA, 23 nt, Human
cgcagaacgaaccuuggccuggg

SEQ ID NO: 3833140 - RNA, 12 nt, Human
cgcagaaggaag

SEQ ID NO: 3833141 - RNA, 14 nt, Human
cgcagacaggacca

SEQ ID NO: 3833142 - RNA, 15 nt, Human
cgcagacaggaccag

SEQ ID NO: 3833143 - RNA, 16 nt, Human
cgcagaccuccccagc

SEQ ID NO: 3833144 - RNA, 22 nt, Human
cgcagagaagugacgguuccua

SEQ ID NO: 3833145 - RNA, 16 nt, Human
cgcagagcuuuucaga

SEQ ID NO: 3833146 - RNA, 16 nt, Human
cgcagcaggaggccag

SEQ ID NO: 3833147 - RNA, 22 nt, Human
cgcagcaggggccagacccugc

SEQ ID NO: 3833148 - RNA, 20 nt, Human
cgcagcauauucaggaagcu

SEQ ID NO: 3833149 - RNA, 12 nt, Human
cgcagccaaggc

SEQ ID NO: 3833150 - RNA, 13 nt, Human
cgcagccaaggcc

SEQ ID NO: 3833151 - RNA, 17 nt, Human
cgcagccacccugagga

SEQ ID NO: 3833152 - RNA, 13 nt, Human
cgcagccaggaca

SEQ ID NO: 3833153 - RNA, 14 nt, Human
cgcagccaggacac

SEQ ID NO: 3833154 - RNA, 17 nt, Human
cgcagcccuagagccug

SEQ ID NO: 3833155 - RNA, 22 nt, Human
cgcagcccuagagccugccugg

SEQ ID NO: 3833156 - RNA, 18 nt, Human
cgcagcccugcagagggc

SEQ ID NO: 3833157 - RNA, 15 nt, Human
cgcagcccugcuuug

SEQ ID NO: 3833158 - RNA, 16 nt, Human
cgcagccucccucuga

SEQ ID NO: 3833159 - RNA, 12 nt, Human
cgcagcugaagu

SEQ ID NO: 3833160 - RNA, 15 nt, Human
cuugaacaccacgcu

SEQ ID NO: 3833161 - RNA, 14 nt, Human
cuugaaccacuucc

SEQ ID NO: 3833162 - RNA, 14 nt, Human
cuugaaccauaaaa

SEQ ID NO: 3833163 - RNA, 15 nt, Human
cuugaacccaggaga

SEQ ID NO: 3833164 - RNA, 19 nt, Human
cuugaaccugggaggugga

SEQ ID NO: 3833165 - RNA, 18 nt, Human
cuugaacguuuucuaauu

SEQ ID NO: 3833166 - RNA, 22 nt, Human
cuugaacguuuucuaauugcuu

SEQ ID NO: 3833167 - RNA, 17 nt, Human
cuugaacuccuggccuc

SEQ ID NO: 3833168 - RNA, 16 nt, Human
cuugaacuggguacuu

SEQ ID NO: 3833169 - RNA, 23 nt, Human
cuugaacuuuccuggaugucuga

SEQ ID NO: 3833170 - RNA, 15 nt, Human
cuugaacuuugaccu

SEQ ID NO: 3833171 - RNA, 17 nt, Human
cuugaacuuugaccucu

SEQ ID NO: 3833172 - RNA, 17 nt, Human
cuugaagaacugcaggc

SEQ ID NO: 3833173 - RNA, 18 nt, Human
cuugaagaacugcaggcc

SEQ ID NO: 3833174 - RNA, 16 nt, Human
cuucuaccugcccuca

SEQ ID NO: 3833175 - RNA, 18 nt, Human
cuucuaccugcccucaag

SEQ ID NO: 3833176 - RNA, 19 nt, Human
cuucuacucacuuuuccca

SEQ ID NO: 3833177 - RNA, 18 nt, Human
cuucuacugagccuucag

SEQ ID NO: 3833178 - RNA, 22 nt, Human
cuucuacuuacacaucuuccac

SEQ ID NO: 3833179 - RNA, 13 nt, Human
cuucuagaaccag

SEQ ID NO: 3833180 - RNA, 13 nt, Human
cuucuagaguuuu

SEQ ID NO: 3833181 - RNA, 21 nt, Human
cuucuaggguuauugcauuug

SEQ ID NO: 3833182 - RNA, 20 nt, Human
cuucuagguggcaaggcugu

SEQ ID NO: 3833183 - RNA, 22 nt, Human
cuucuagguggcaaggcugugc

SEQ ID NO: 3833184 - RNA, 16 nt, Human
cuucuaguucugccag

SEQ ID NO: 3833185 - RNA, 15 nt, Human
cuucuauacccaccc

SEQ ID NO: 3833186 - RNA, 17 nt, Human
cuucuaugaaagacuca

SEQ ID NO: 3833187 - RNA, 23 nt, Human
cuucuauggacugguuguugcca

SEQ ID NO: 3833188 - RNA, 18 nt, Human
cuucuauuagccagucuu

SEQ ID NO: 3833189 - RNA, 16 nt, Human
cuucuauugccucuga

SEQ ID NO: 3833190 - RNA, 13 nt, Human
cuucuauuuuauu

SEQ ID NO: 3833191 - RNA, 15 nt, Human
cuucuauuuuguaaa

SEQ ID NO: 3833192 - RNA, 17 nt, Human
cuucucaagugccuuaa

SEQ ID NO: 3833193 - RNA, 14 nt, Human
cuucucaaguucua

SEQ ID NO: 3833194 - RNA, 16 nt, Human
cuucucaaguucuaag

SEQ ID NO: 3833195 - RNA, 21 nt, Human
cuucucacauggaaugagggu

SEQ ID NO: 3833196 - RNA, 12 nt, Human
cuucucaccagc

SEQ ID NO: 3833197 - RNA, 20 nt, Human
cuucucaccagcugcaaagu

SEQ ID NO: 3833198 - RNA, 16 nt, Human
cuucucacucccuucu

SEQ ID NO: 3833199 - RNA, 13 nt, Human
cuucucagaagca

SEQ ID NO: 3833200 - RNA, 16 nt, Human
cuucucagaagcacag

SEQ ID NO: 3833201 - RNA, 22 nt, Human
cuucucagaagcacagaauauu

SEQ ID NO: 3833202 - RNA, 13 nt, Human
cuucucagaaucu

SEQ ID NO: 3833203 - RNA, 16 nt, Human
cuucucagaguggugg

SEQ ID NO: 3833204 - RNA, 19 nt, Human
cuucucagauuucugagga

SEQ ID NO: 3833205 - RNA, 12 nt, Human
cuucucagccac

SEQ ID NO: 3833206 - RNA, 16 nt, Human
cuucucagccugguac

SEQ ID NO: 3833207 - RNA, 19 nt, Human
cuucucaggacacaggccu

SEQ ID NO: 3833208 - RNA, 23 nt, Human
cuucucaggacacaggccugugu

SEQ ID NO: 3833209 - RNA, 16 nt, Human
cuucucaggcucugcc

SEQ ID NO: 3833210 - RNA, 19 nt, Human
cuucucaggcucugcccug

SEQ ID NO: 3833211 - RNA, 20 nt, Human
cuucucaggcucugcccugc

SEQ ID NO: 3833212 - RNA, 21 nt, Human
cuucucaggcucugcccugcc

SEQ ID NO: 3833213 - RNA, 22 nt, Human
cuucucaggcucugcccugccc

SEQ ID NO: 3833214 - RNA, 13 nt, Human
cuucucauagcau

SEQ ID NO: 3833215 - RNA, 19 nt, Human
cuucucauagguguccagc

SEQ ID NO: 3833216 - RNA, 15 nt, Human
cuucucaucacacac

SEQ ID NO: 3833217 - RNA, 16 nt, Human
cuucucaucacacaca

SEQ ID NO: 3833218 - RNA, 17 nt, Human
cuucucaucacacacau

SEQ ID NO: 3833219 - RNA, 15 nt, Human
cuucucauccugcag

SEQ ID NO: 3833220 - RNA, 12 nt, Human
cuucucaucugu

SEQ ID NO: 3833221 - RNA, 20 nt, Human
cuucucauuccaacagugag

SEQ ID NO: 3833222 - RNA, 21 nt, Human
cuucucauuccaacagugagu

SEQ ID NO: 3833223 - RNA, 18 nt, Human
cuucucauuucaccccuc

SEQ ID NO: 3833224 - RNA, 22 nt, Human
cuucucauuucaccccucccuu

SEQ ID NO: 3833225 - RNA, 22 nt, Human
cuucuccaaaaaucugccuggg

SEQ ID NO: 3833226 - RNA, 14 nt, Human
cuucuccacuggau

SEQ ID NO: 3833227 - RNA, 20 nt, Human
cuucuccaggucucacgggc

SEQ ID NO: 3833228 - RNA, 17 nt, Human
cuucuccauggcccugc

SEQ ID NO: 3833229 - RNA, 12 nt, Human
cuucucccacuc

SEQ ID NO: 3833230 - RNA, 13 nt, Human
cuucucccacucu

SEQ ID NO: 3833231 - RNA, 15 nt, Human
cuucucccacucucc

SEQ ID NO: 3833232 - RNA, 18 nt, Human
cuucucccacuuggccaa

SEQ ID NO: 3833233 - RNA, 20 nt, Human
cuucucccagaaucccagcc

SEQ ID NO: 3833234 - RNA, 23 nt, Human
cuucucccagaaucccagccggc

SEQ ID NO: 3833235 - RNA, 14 nt, Human
cuucucccaggcaa

SEQ ID NO: 3833236 - RNA, 20 nt, Human
cuucucccaggcaaggcugu

SEQ ID NO: 3833237 - RNA, 20 nt, Human
cuucucccaucucuuccuug

SEQ ID NO: 3833238 - RNA, 21 nt, Human
cuucucccccacccccuaggg

SEQ ID NO: 3833239 - RNA, 14 nt, Human
cuucuccccugcac

SEQ ID NO: 3833240 - RNA, 19 nt, Human
cuucuccccuuccauuucu

SEQ ID NO: 3833241 - RNA, 19 nt, Human
cuucucccuagcuccuccc

SEQ ID NO: 3833242 - RNA, 22 nt, Human
cuucucccucauuucaggagca

SEQ ID NO: 3833243 - RNA, 11 nt, Human
cuucucccugg

SEQ ID NO: 3833244 - RNA, 12 nt, Human
cuucucccugga

SEQ ID NO: 3833245 - RNA, 13 nt, Human
cuucucccuggaa

SEQ ID NO: 3833246 - RNA, 16 nt, Human
cuucucccuggaauga

SEQ ID NO: 3833247 - RNA, 13 nt, Human
cuucucccuggau

SEQ ID NO: 3833248 - RNA, 14 nt, Human
cuucuccgccagcc

SEQ ID NO: 3833249 - RNA, 15 nt, Human
cuucuccgccagccu

SEQ ID NO: 3833250 - RNA, 24 nt, Human
cuucuccgccagccuccucuggac

SEQ ID NO: 3833251 - RNA, 13 nt, Human
cuucuccguccuc

SEQ ID NO: 3833252 - RNA, 15 nt, Human
cuucuccuaugugua

SEQ ID NO: 3833253 - RNA, 16 nt, Human
cuucuccucuccuagc

SEQ ID NO: 3833254 - RNA, 15 nt, Human
cuucuccucuuguaa

SEQ ID NO: 3833255 - RNA, 20 nt, Human
cuucuccugaaguucagcca

SEQ ID NO: 3833256 - RNA, 20 nt, Human
cuucuccuuagaaguggaag

SEQ ID NO: 3833257 - RNA, 19 nt, Human
cuucuccuucaccuuuguc

SEQ ID NO: 3833258 - RNA, 22 nt, Human
cuucuccuucaccuuugucccc

SEQ ID NO: 3833259 - RNA, 20 nt, Human
cuucuccuugauaacagcua

SEQ ID NO: 3833260 - RNA, 20 nt, Human
cuucucuaaaugaggggccu

SEQ ID NO: 3833261 - RNA, 23 nt, Human
cuucucuaauucuuccuuuguaa

SEQ ID NO: 3833262 - RNA, 16 nt, Human
cuucucucaccuccua

SEQ ID NO: 3833263 - RNA, 12 nt, Human
cuucucucagac

SEQ ID NO: 3833264 - RNA, 21 nt, Human
cuucucucagaccgucuuccu

SEQ ID NO: 3833265 - RNA, 20 nt, Human
cuucucucagacuuacuuua

SEQ ID NO: 3833266 - RNA, 17 nt, Human
cuucucuccagccccug

SEQ ID NO: 3833267 - RNA, 19 nt, Human
cuucucuccagccccugga

SEQ ID NO: 3833268 - RNA, 18 nt, Human
cuucucuccagcugacua

SEQ ID NO: 3833269 - RNA, 13 nt, Human
cuucucucucacc

SEQ ID NO: 3833270 - RNA, 15 nt, Human
cuucucucucaccag

SEQ ID NO: 3833271 - RNA, 23 nt, Human
cuucucucucucucaaaauuaua

SEQ ID NO: 3833272 - RNA, 12 nt, Human
cuucucugaagg

SEQ ID NO: 3833273 - RNA, 15 nt, Human
cuucucugacuucug

SEQ ID NO: 3833274 - RNA, 17 nt, Human
cuucucugacuucugcc

SEQ ID NO: 3833275 - RNA, 22 nt, Human
cuucucugcuccaccacauccu

SEQ ID NO: 3833276 - RNA, 21 nt, Human
cuucucuggagccaaguccag

SEQ ID NO: 3833277 - RNA, 13 nt, Human
cuucucugugacc

SEQ ID NO: 3833278 - RNA, 16 nt, Human
cuucucuuguuaggua

SEQ ID NO: 3833279 - RNA, 22 nt, Human
cuucugaacuuggcgcugcccc

SEQ ID NO: 3833280 - RNA, 22 nt, Human
cuucugaauaaagcaauuagca

SEQ ID NO: 3833281 - RNA, 18 nt, Human
cuucugaauauuuuaucu

SEQ ID NO: 3833282 - RNA, 14 nt, Human
cuucugacagccuc

SEQ ID NO: 3833283 - RNA, 14 nt, Human
cuucugaccacacu

SEQ ID NO: 3833284 - RNA, 18 nt, Human
cuucugaccacacuuccu

SEQ ID NO: 3833285 - RNA, 23 nt, Human
cuucugaccacacuuccugucca

SEQ ID NO: 3833286 - RNA, 18 nt, Human
cuucugaccacagcauca

SEQ ID NO: 3833287 - RNA, 21 nt, Human
cuucugacccaugcugcccug

SEQ ID NO: 3833288 - RNA, 22 nt, Human
cuucugacccaugcugcccugu

SEQ ID NO: 3833289 - RNA, 14 nt, Human
cuucugaccucagc

SEQ ID NO: 3833290 - RNA, 18 nt, Human
cuucugacggcccugcaa

SEQ ID NO: 3833291 - RNA, 19 nt, Human
cuucugacgugccuuuugc

SEQ ID NO: 3833292 - RNA, 15 nt, Human
cuucugacucuuccc

SEQ ID NO: 3833293 - RNA, 17 nt, Human
cuucugacucuucccca

SEQ ID NO: 3833294 - RNA, 21 nt, Human
cuucugacugcugauucuccc

SEQ ID NO: 3833295 - RNA, 18 nt, Human
cuucugacuuaagugugc

SEQ ID NO: 3833296 - RNA, 22 nt, Human
cuucugagacgucaugaggaga

SEQ ID NO: 3833297 - RNA, 23 nt, Human
cuucugagcuccuguccccugcu

SEQ ID NO: 3833298 - RNA, 20 nt, Human
cuucugaggacauuccaaga

SEQ ID NO: 3833299 - RNA, 16 nt, Human
cuucugcacccuccac

SEQ ID NO: 3833300 - RNA, 19 nt, Human
cuucugcacccuccacccu

SEQ ID NO: 3833301 - RNA, 20 nt, Human
cuucugcacccuccacccug

SEQ ID NO: 3833302 - RNA, 14 nt, Human
cuucugccacuucc

SEQ ID NO: 3833303 - RNA, 18 nt, Human
cuucugccacuucccagg

SEQ ID NO: 3833304 - RNA, 20 nt, Human
cuucugccacuucccaggua

SEQ ID NO: 3833305 - RNA, 23 nt, Human
cuucugcccaauuggaggaaagc

SEQ ID NO: 3833306 - RNA, 22 nt, Human
cuucugcccauccugucuguuc

SEQ ID NO: 3833307 - RNA, 15 nt, Human
cuucugcccccugca

SEQ ID NO: 3833308 - RNA, 16 nt, Human
cuucugcccccugcag

SEQ ID NO: 3833309 - RNA, 19 nt, Human
cuucugccggcccuggggc

SEQ ID NO: 3833310 - RNA, 12 nt, Human
cuucugccugca

SEQ ID NO: 3833311 - RNA, 13 nt, Human
cuucugccuggag

SEQ ID NO: 3833312 - RNA, 19 nt, Human
cuucugccuuagucucagu

SEQ ID NO: 3833313 - RNA, 20 nt, Human
cuucugccuuagucucaguu

SEQ ID NO: 3833314 - RNA, 15 nt, Human
cgcaggaacucccag

SEQ ID NO: 3833315 - RNA, 24 nt, Human
cgcaggaagacccaacacauggga

SEQ ID NO: 3833316 - RNA, 18 nt, Human
cgcaggagcacacccagc

SEQ ID NO: 3833317 - RNA, 23 nt, Human
cgcaggagcacacccagccccca

SEQ ID NO: 3833318 - RNA, 18 nt, Human
cuuguggggacccaggcu

SEQ ID NO: 3833319 - RNA, 17 nt, Human
cuuguggggccugggag

SEQ ID NO: 3833320 - RNA, 18 nt, Human
cuuguggggccugggagg

SEQ ID NO: 3833321 - RNA, 14 nt, Human
cuuguggguccaug

SEQ ID NO: 3833322 - RNA, 15 nt, Human
cuuguggucccaccc

SEQ ID NO: 3833323 - RNA, 23 nt, Human
cuugugguuauaacuuaaugaaa

SEQ ID NO: 3833324 - RNA, 18 nt, Human
cuuguguaauuuauguga

SEQ ID NO: 3833325 - RNA, 15 nt, Human
cuuguguauccauua

SEQ ID NO: 3833326 - RNA, 15 nt, Human
cuugugucucugugc

SEQ ID NO: 3833327 - RNA, 17 nt, Human
cuugugucucugugcuu

SEQ ID NO: 3833328 - RNA, 21 nt, Human
cuugugucucugugcuuuuaa

SEQ ID NO: 3833329 - RNA, 14 nt, Human
cuugugucuguaca

SEQ ID NO: 3833330 - RNA, 15 nt, Human
cuugugucuguacac

SEQ ID NO: 3833331 - RNA, 14 nt, Human
cuugugugcaaaag

SEQ ID NO: 3833332 - RNA, 22 nt, Human
cuuguguguaugcacaugaacu

SEQ ID NO: 3833333 - RNA, 13 nt, Human
cuuguguguuuca

SEQ ID NO: 3833334 - RNA, 15 nt, Human
cuuguguuuuaaaau

SEQ ID NO: 3833335 - RNA, 15 nt, Human
cuuguguuuuugucu

SEQ ID NO: 3833336 - RNA, 16 nt, Human
cuuguuaagauaguua

SEQ ID NO: 3833337 - RNA, 18 nt, Human
cuuguuaaugcuuucuga

SEQ ID NO: 3833338 - RNA, 17 nt, Human
cuuguuacuucugaggu

SEQ ID NO: 3833339 - RNA, 16 nt, Human
cuuguuagaaaacaaa

SEQ ID NO: 3833340 - RNA, 23 nt, Human
cuuguuagaaaacaaaauuuuau

SEQ ID NO: 3833341 - RNA, 16 nt, Human
cuuguuagaucuaguu

SEQ ID NO: 3833342 - RNA, 20 nt, Human
cuuguuauauuaagcagaaa

SEQ ID NO: 3833343 - RNA, 16 nt, Human
cuuguuauucaacagc

SEQ ID NO: 3833344 - RNA, 13 nt, Human
cuuguuauuguga

SEQ ID NO: 3833345 - RNA, 14 nt, Human
cuuguuauugugaa

SEQ ID NO: 3833346 - RNA, 17 nt, Human
cuuguuauugugaauga

SEQ ID NO: 3833347 - RNA, 13 nt, Human
cuuguuauuuaua

SEQ ID NO: 3833348 - RNA, 16 nt, Human
cuuguuccaaggccag

SEQ ID NO: 3833349 - RNA, 21 nt, Human
cuuguuccaaugccacauacu

SEQ ID NO: 3833350 - RNA, 12 nt, Human
cuuguuccuaga

SEQ ID NO: 3833351 - RNA, 21 nt, Human
cuuguucgugggucaucggga

SEQ ID NO: 3833352 - RNA, 21 nt, Human
cuuguucucuaaguuccacug

SEQ ID NO: 3833353 - RNA, 19 nt, Human
cuuguucugagauucaaua

SEQ ID NO: 3833354 - RNA, 13 nt, Human
cuuguucugucac

SEQ ID NO: 3833355 - RNA, 17 nt, Human
cuuguucugucacucag

SEQ ID NO: 3833356 - RNA, 15 nt, Human
cuuguucuguuuugu

SEQ ID NO: 3833357 - RNA, 15 nt, Human
cuuguugaauuuauu

SEQ ID NO: 3833358 - RNA, 18 nt, Human
cuuguugagccgugggca

SEQ ID NO: 3833359 - RNA, 21 nt, Human
cuuguugaggguauguuuuau

SEQ ID NO: 3833360 - RNA, 22 nt, Human
cuuguugaggguauguuuuaua

SEQ ID NO: 3833361 - RNA, 13 nt, Human
cuuguugcuuugu

SEQ ID NO: 3833362 - RNA, 18 nt, Human
cuuguugcuuuguugcac

SEQ ID NO: 3833363 - RNA, 15 nt, Human
cuuguuggagccugc

SEQ ID NO: 3833364 - RNA, 19 nt, Human
cuuguuggagccugcaggg

SEQ ID NO: 3833365 - RNA, 23 nt, Human
cuuguuggcguaggcuacagaga

SEQ ID NO: 3833366 - RNA, 21 nt, Human
cuuguugggauuccugaccca

SEQ ID NO: 3833367 - RNA, 16 nt, Human
cuuguuguaaagcaau

SEQ ID NO: 3833368 - RNA, 15 nt, Human
cuuguuguuuaaugu

SEQ ID NO: 3833369 - RNA, 21 nt, Human
cuuguuguuuguaacaagaaa

SEQ ID NO: 3833370 - RNA, 19 nt, Human
cuuguuuacagcacuacuc

SEQ ID NO: 3833371 - RNA, 17 nt, Human
cuuguuuacaugcuuau

SEQ ID NO: 3833372 - RNA, 13 nt, Human
cuugcucuggacc

SEQ ID NO: 3833373 - RNA, 17 nt, Human
cuugcucuugaugccug

SEQ ID NO: 3833374 - RNA, 18 nt, Human
cuugcucuugaugccugg

SEQ ID NO: 3833375 - RNA, 22 nt, Human
cuugcucuuucuacucugaacu

SEQ ID NO: 3833376 - RNA, 15 nt, Human
cuugcugccuucugg

SEQ ID NO: 3833377 - RNA, 12 nt, Human
cuugcugcuaga

SEQ ID NO: 3833378 - RNA, 18 nt, Human
cuugcugcuagaacuuuu

SEQ ID NO: 3833379 - RNA, 21 nt, Human
cuugcuggccccagcccugcu

SEQ ID NO: 3833380 - RNA, 21 nt, Human
cuugcuggcuacgccucuucu

SEQ ID NO: 3833381 - RNA, 13 nt, Human
cuugcuguaugcu

SEQ ID NO: 3833382 - RNA, 17 nt, Human
cuugcuguccuaggcca

SEQ ID NO: 3833383 - RNA, 14 nt, Human
cuugcugucucugc

SEQ ID NO: 3833384 - RNA, 15 nt, Human
cuugcugucucugcu

SEQ ID NO: 3833385 - RNA, 21 nt, Human
cuugcugucucugcucgcccu

SEQ ID NO: 3833386 - RNA, 19 nt, Human
cuugcuguugacauauuua

SEQ ID NO: 3833387 - RNA, 21 nt, Human
cuugcuguugacauauuuaau

SEQ ID NO: 3833388 - RNA, 13 nt, Human
cuugcuuaaauuu

SEQ ID NO: 3833389 - RNA, 23 nt, Human
cuugcuuaaauuucuuaugugac

SEQ ID NO: 3833390 - RNA, 17 nt, Human
cuugcuucccuaaucua

SEQ ID NO: 3833391 - RNA, 18 nt, Human
cuugcuucuuucuagaaa

SEQ ID NO: 3833392 - RNA, 12 nt, Human
cuugcuugccug

SEQ ID NO: 3833393 - RNA, 17 nt, Human
cuugcuugccugcaggg

SEQ ID NO: 3833394 - RNA, 13 nt, Human
cuugcuugcuuuu

SEQ ID NO: 3833395 - RNA, 16 nt, Human
cuugcuuguaccucug

SEQ ID NO: 3833396 - RNA, 18 nt, Human
cuugcuuucuuuuuuaaa

SEQ ID NO: 3833397 - RNA, 20 nt, Human
cuugcuuugauuuacagcaa

SEQ ID NO: 3833398 - RNA, 17 nt, Human
cuugcuuuguguucuuu

SEQ ID NO: 3833399 - RNA, 19 nt, Human
cuugcuuuguguucuuugu

SEQ ID NO: 3833400 - RNA, 15 nt, Human
cuugcuuuuaaaauc

SEQ ID NO: 3833401 - RNA, 18 nt, Human
cuugcuuuucccucuuuu

SEQ ID NO: 3833402 - RNA, 21 nt, Human
cuugcuuuucccucuuuucuu

SEQ ID NO: 3833403 - RNA, 15 nt, Human
cuuggaaaccugccc

SEQ ID NO: 3833404 - RNA, 21 nt, Human
cuuggaaagaaacaaccguug

SEQ ID NO: 3833405 - RNA, 19 nt, Human
cuuggaaauauuaaaagaa

SEQ ID NO: 3833406 - RNA, 20 nt, Human
cuuggaaaucaaauguaaag

SEQ ID NO: 3833407 - RNA, 16 nt, Human
cuuggaaaugggagac

SEQ ID NO: 3833408 - RNA, 19 nt, Human
cuuggaaauuccuguacug

SEQ ID NO: 3833409 - RNA, 20 nt, Human
cuuggaaauuccuguacugu

SEQ ID NO: 3833410 - RNA, 15 nt, Human
cuuggaagcuucugg

SEQ ID NO: 3833411 - RNA, 22 nt, Human
cuuggaaguacaugaauacaaa

SEQ ID NO: 3833412 - RNA, 18 nt, Human
cuuggaauaucugcugua

SEQ ID NO: 3833413 - RNA, 17 nt, Human
cuuggaauuccauuuga

SEQ ID NO: 3833414 - RNA, 18 nt, Human
cuuggacauuuuaugucu

SEQ ID NO: 3833415 - RNA, 16 nt, Human
cuuggaccucugcucu

SEQ ID NO: 3833416 - RNA, 14 nt, Human
cuuggacuauuaua

SEQ ID NO: 3833417 - RNA, 14 nt, Human
cuuggacucuugcu

SEQ ID NO: 3833418 - RNA, 16 nt, Human
cuuggagagacacagc

SEQ ID NO: 3833419 - RNA, 21 nt, Human
cuuggagccggacuuucggag

SEQ ID NO: 3833420 - RNA, 16 nt, Human
cuuggagccugcagag

SEQ ID NO: 3833421 - RNA, 17 nt, Human
cuuggagcguggacugg

SEQ ID NO: 3833422 - RNA, 14 nt, Human
cuuggagcucugag

SEQ ID NO: 3833423 - RNA, 23 nt, Human
cuuggagcugugaguucucccug

SEQ ID NO: 3833424 - RNA, 15 nt, Human
cuuggaggcugucuu

SEQ ID NO: 3833425 - RNA, 14 nt, Human
cuuggagggaagcc

SEQ ID NO: 3833426 - RNA, 23 nt, Human
cuuggagggcaugaagacagaua

SEQ ID NO: 3833427 - RNA, 19 nt, Human
cuuggagggcccacuugua

SEQ ID NO: 3833428 - RNA, 21 nt, Human
cuuggagggucccaagcuggg

SEQ ID NO: 3833429 - RNA, 24 nt, Human
cuuggaggguugguccucuugccu

SEQ ID NO: 3833430 - RNA, 22 nt, Human
cuuggaguauuggggucugacc

SEQ ID NO: 3833431 - RNA, 23 nt, Human
cuuggauaccuagaccguuauaa

SEQ ID NO: 3833432 - RNA, 18 nt, Human
cuuggauguaccugcccc

SEQ ID NO: 3833433 - RNA, 17 nt, Human
cuuggauucuuuccauu

SEQ ID NO: 3833434 - RNA, 15 nt, Human
cuuggauuguccccg

SEQ ID NO: 3833435 - RNA, 23 nt, Human
cuuggauuguccccgacccuugc

SEQ ID NO: 3833436 - RNA, 16 nt, Human
cuuggcaaaagccuug

SEQ ID NO: 3833437 - RNA, 20 nt, Human
cuuggcaaaagccuugugua

SEQ ID NO: 3833438 - RNA, 21 nt, Human
cuuggcaaaagccuuguguau

SEQ ID NO: 3833439 - RNA, 22 nt, Human
cuuggcaauaaauuuugaaaag

SEQ ID NO: 3833440 - RNA, 23 nt, Human
cuuggcaauaaauuuugaaaagu

SEQ ID NO: 3833441 - RNA, 18 nt, Human
cuuggcaauauuccuuag

SEQ ID NO: 3833442 - RNA, 12 nt, Human
cuuggcaccaaa

SEQ ID NO: 3833443 - RNA, 19 nt, Human
cuuggcaccaaagaugcag

SEQ ID NO: 3833444 - RNA, 16 nt, Human
cuuggcaccagacacc

SEQ ID NO: 3833445 - RNA, 19 nt, Human
cuuggcaccagacacccag

SEQ ID NO: 3833446 - RNA, 18 nt, Human
cuuggcacuuauugaaua

SEQ ID NO: 3833447 - RNA, 20 nt, Human
cuuggcagcaccugucuccu

SEQ ID NO: 3833448 - RNA, 14 nt, Human
cuuggcagccuacu

SEQ ID NO: 3833449 - RNA, 13 nt, Human
cuuggcagccuug

SEQ ID NO: 3833450 - RNA, 22 nt, Human
cuuggcaucacagggcagagcc

SEQ ID NO: 3833451 - RNA, 16 nt, Human
cuuggcaugccuucca

SEQ ID NO: 3833452 - RNA, 14 nt, Human
cuuggcauuccgca

SEQ ID NO: 3833453 - RNA, 22 nt, Human
cuuggcauuccgcaucccuacc

SEQ ID NO: 3833454 - RNA, 18 nt, Human
cuuggccacagccagggg

SEQ ID NO: 3833455 - RNA, 18 nt, Human
cuuggccaguuaucccuu

SEQ ID NO: 3833456 - RNA, 18 nt, Human
cuuggccaugcagaaagc

SEQ ID NO: 3833457 - RNA, 11 nt, Human
cuuggcccagg

SEQ ID NO: 3833458 - RNA, 13 nt, Human
cuuggcccuggca

SEQ ID NO: 3833459 - RNA, 16 nt, Human
cuuggcccuggcagcc

SEQ ID NO: 3833460 - RNA, 15 nt, Human
cuuggcccuuuccuu

SEQ ID NO: 3833461 - RNA, 20 nt, Human
cuuggcccuuuccuuccaga

SEQ ID NO: 3833462 - RNA, 18 nt, Human
cuuguaaauagcucaggu

SEQ ID NO: 3833463 - RNA, 13 nt, Human
cuuguaaauauaa

SEQ ID NO: 3833464 - RNA, 21 nt, Human
cuuguaacuccaccaacccau

SEQ ID NO: 3833465 - RNA, 17 nt, Human
cuuguaauauuuuguau

SEQ ID NO: 3833466 - RNA, 20 nt, Human
cuuguaauauuuuguauuau

SEQ ID NO: 3833467 - RNA, 15 nt, Human
cuuguaauguaacug

SEQ ID NO: 3833468 - RNA, 11 nt, Human
cuuguaauuau

SEQ ID NO: 3833469 - RNA, 14 nt, Human
cuuguaauuaugga

SEQ ID NO: 3833470 - RNA, 23 nt, Human
cuuguaauucuaaaugaauguuu

SEQ ID NO: 3833471 - RNA, 22 nt, Human
cuuguaauuuuacacgcuuuug

SEQ ID NO: 3833472 - RNA, 22 nt, Human
cuuguacauaaugcgugcauac

SEQ ID NO: 3833473 - RNA, 14 nt, Human
cuuguacaugugua

SEQ ID NO: 3833474 - RNA, 20 nt, Human
cuuguacauguguagccugu

SEQ ID NO: 3833475 - RNA, 22 nt, Human
cuuguacccccagguggaaggc

SEQ ID NO: 3833476 - RNA, 18 nt, Human
cuuguaccucuggcugac

SEQ ID NO: 3833477 - RNA, 20 nt, Human
cuuguaccucuggcugacua

SEQ ID NO: 3833478 - RNA, 17 nt, Human
cuuguacuuuauuuucu

SEQ ID NO: 3833479 - RNA, 19 nt, Human
cuuguagaacucacucugg

SEQ ID NO: 3833480 - RNA, 20 nt, Human
cuuguagaacucacucuggg

SEQ ID NO: 3833481 - RNA, 17 nt, Human
cuuguagaauuguuaua

SEQ ID NO: 3833482 - RNA, 14 nt, Human
cuuguagauuugau

SEQ ID NO: 3833483 - RNA, 15 nt, Human
cuuguagauuugauu

SEQ ID NO: 3833484 - RNA, 14 nt, Human
cuuguagccagccg

SEQ ID NO: 3833485 - RNA, 22 nt, Human
cuuguagcgacuaaacuagauu

SEQ ID NO: 3833486 - RNA, 23 nt, Human
cuuguagcuccuccccuggaggg

SEQ ID NO: 3833487 - RNA, 13 nt, Human
cuuguagcuguaa

SEQ ID NO: 3833488 - RNA, 16 nt, Human
cuuguagcuguaaaac

SEQ ID NO: 3833489 - RNA, 13 nt, Human
cuuguaguucuuu

SEQ ID NO: 3833490 - RNA, 20 nt, Human
cuuguaguucuuuaaacugu

SEQ ID NO: 3833491 - RNA, 22 nt, Human
cuuguaguuuagugugguuuuc

SEQ ID NO: 3833492 - RNA, 14 nt, Human
cuuguauaaaugua

SEQ ID NO: 3833493 - RNA, 15 nt, Human
cuuguauaaauguau

SEQ ID NO: 3833494 - RNA, 14 nt, Human
cuuguauaaauuau

SEQ ID NO: 3833495 - RNA, 20 nt, Human
cuuguauauacgcaucuaua

SEQ ID NO: 3833496 - RNA, 15 nt, Human
cuuguauauucuauu

SEQ ID NO: 3833497 - RNA, 19 nt, Human
cuuguauauuuguacaaaa

SEQ ID NO: 3833498 - RNA, 23 nt, Human
cuuguauauuuuaagaaauaaca

SEQ ID NO: 3833499 - RNA, 19 nt, Human
cuuguaucaacacuguuac

SEQ ID NO: 3833500 - RNA, 15 nt, Human
cuuguauccaggccu

SEQ ID NO: 3833501 - RNA, 17 nt, Human
cuuguauccaggccugg

SEQ ID NO: 3833502 - RNA, 18 nt, Human
cuuguauccccugcaggc

SEQ ID NO: 3833503 - RNA, 13 nt, Human
cuuguauuaaacu

SEQ ID NO: 3833504 - RNA, 16 nt, Human
cuuguauuccaagcau

SEQ ID NO: 3833505 - RNA, 18 nt, Human
cuugucaagccugugcaa

SEQ ID NO: 3833506 - RNA, 15 nt, Human
cuugucaauauuuaa

SEQ ID NO: 3833507 - RNA, 23 nt, Human
cuugucacgccagacuucccacg

SEQ ID NO: 3833508 - RNA, 20 nt, Human
cuugucacugacacaaagga

SEQ ID NO: 3833509 - RNA, 23 nt, Human
cuugucacugguagaccaaaaua

SEQ ID NO: 3833510 - RNA, 11 nt, Human
cuugucacuug

SEQ ID NO: 3833511 - RNA, 15 nt, Human
cuugucagacauaaa

SEQ ID NO: 3833512 - RNA, 17 nt, Human
cuugucagacauaaagc

SEQ ID NO: 3833513 - RNA, 19 nt, Human
cuugucagacauaaagcca

SEQ ID NO: 3833514 - RNA, 20 nt, Human
cuugucagacauaaagccau

SEQ ID NO: 3833515 - RNA, 20 nt, Human
cuugucaggaguguguguga

SEQ ID NO: 3833516 - RNA, 13 nt, Human
cuugucaugugua

SEQ ID NO: 3833517 - RNA, 22 nt, Human
cuugucauuguuauauaaucau

SEQ ID NO: 3833518 - RNA, 15 nt, Human
cuugucauuuugguc

SEQ ID NO: 3833519 - RNA, 20 nt, Human
cuuguccaacccgaggcccg

SEQ ID NO: 3833520 - RNA, 13 nt, Human
cuuguccagcuga

SEQ ID NO: 3833521 - RNA, 16 nt, Human
cuugucccacucaagc

SEQ ID NO: 3833522 - RNA, 15 nt, Human
cuugucccagaggcu

SEQ ID NO: 3833523 - RNA, 19 nt, Human
cuugucccagaggcugccc

SEQ ID NO: 3833524 - RNA, 20 nt, Human
cuuguccccacacuccuaca

SEQ ID NO: 3833525 - RNA, 17 nt, Human
cuuguccccugccugug

SEQ ID NO: 3833526 - RNA, 15 nt, Human
cuugucccugcccag

SEQ ID NO: 3833527 - RNA, 17 nt, Human
cuuguccuagcacagau

SEQ ID NO: 3833528 - RNA, 15 nt, Human
cuuguccucagccag

SEQ ID NO: 3833529 - RNA, 14 nt, Human
cuuguccuuucccu

SEQ ID NO: 3833530 - RNA, 23 nt, Human
cuuguccuuuuguaccauggugu

SEQ ID NO: 3833531 - RNA, 20 nt, Human
cuugucggccccaccagugc

SEQ ID NO: 3833532 - RNA, 21 nt, Human
cuugucggccccaccagugcc

SEQ ID NO: 3833533 - RNA, 17 nt, Human
cuugucucaaugcucau

SEQ ID NO: 3833534 - RNA, 18 nt, Human
cuugucucaaugcucaua

SEQ ID NO: 3833535 - RNA, 23 nt, Human
cuugucucaaugcucauaacgga

SEQ ID NO: 3833536 - RNA, 15 nt, Human
cuuuaggcauuaaau

SEQ ID NO: 3833537 - RNA, 23 nt, Human
cuuuaggcauuaaauuuuagcaa

SEQ ID NO: 3833538 - RNA, 17 nt, Human
cuuuaggcuuucagcuu

SEQ ID NO: 3833539 - RNA, 23 nt, Human
cuuuagggacucaauuucucccc

SEQ ID NO: 3833540 - RNA, 16 nt, Human
cuuuagggcagcuugc

SEQ ID NO: 3833541 - RNA, 16 nt, Human
cuuuaggucuuuguaa

SEQ ID NO: 3833542 - RNA, 18 nt, Human
cuuuagguuuuuuuaaug

SEQ ID NO: 3833543 - RNA, 20 nt, Human
cuuuagguuuuuuuaaugau

SEQ ID NO: 3833544 - RNA, 17 nt, Human
cuuuaguaccugaaaag

SEQ ID NO: 3833545 - RNA, 17 nt, Human
cuuuaguaucaguguuu

SEQ ID NO: 3833546 - RNA, 22 nt, Human
cuuuaguaugacgcugauacau

SEQ ID NO: 3833547 - RNA, 15 nt, Human
cuuuaguguauuuau

SEQ ID NO: 3833548 - RNA, 13 nt, Human
cuuuaguuuuugu

SEQ ID NO: 3833549 - RNA, 12 nt, Human
cuuuauaaacuu

SEQ ID NO: 3833550 - RNA, 13 nt, Human
cuuuauaaauaaa

SEQ ID NO: 3833551 - RNA, 20 nt, Human
cuuuauaagucauuguaugu

SEQ ID NO: 3833552 - RNA, 13 nt, Human
cuuuauaauucua

SEQ ID NO: 3833553 - RNA, 14 nt, Human
cuuuauacagcugu

SEQ ID NO: 3833554 - RNA, 21 nt, Human
cuuuauagugcacaaaaugaa

SEQ ID NO: 3833555 - RNA, 23 nt, Human
cuuuauauacaauaauggaaaaa

SEQ ID NO: 3833556 - RNA, 15 nt, Human
cuuuauauauggaca

SEQ ID NO: 3833557 - RNA, 13 nt, Human
cuuuauauuuagu

SEQ ID NO: 3833558 - RNA, 22 nt, Human
cuuuaucaaagggugaaaauua

SEQ ID NO: 3833559 - RNA, 18 nt, Human
cuuuaucacuuuuugaac

SEQ ID NO: 3833560 - RNA, 14 nt, Human
cuuuauccucuuua

SEQ ID NO: 3833561 - RNA, 21 nt, Human
cuuuaucuaauaccucugugu

SEQ ID NO: 3833562 - RNA, 22 nt, Human
cuuuaucuaauaccucugugug

SEQ ID NO: 3833563 - RNA, 21 nt, Human
cuuuaucuaccaacuuucaag

SEQ ID NO: 3833564 - RNA, 20 nt, Human
cuuuaugauaauagauucuc

SEQ ID NO: 3833565 - RNA, 19 nt, Human
cuuuaugccggaugugcuu

SEQ ID NO: 3833566 - RNA, 12 nt, Human
cuuuaugcugaa

SEQ ID NO: 3833567 - RNA, 23 nt, Human
cuuuauggcagacauugugcuag

SEQ ID NO: 3833568 - RNA, 16 nt, Human
cuuuaugguaaagaug

SEQ ID NO: 3833569 - RNA, 22 nt, Human
cuuuaugguccuaaaagcaaaa

SEQ ID NO: 3833570 - RNA, 20 nt, Human
cuuuauguaguuuuuauaug

SEQ ID NO: 3833571 - RNA, 12 nt, Human
cuuuaugucuuu

SEQ ID NO: 3833572 - RNA, 13 nt, Human
cuuuaugugaauu

SEQ ID NO: 3833573 - RNA, 18 nt, Human
cuuuauguggaaaacaga

SEQ ID NO: 3833574 - RNA, 22 nt, Human
cuuuauguugcggugagaacuc

SEQ ID NO: 3833575 - RNA, 20 nt, Human
cuuuauguuuuugaggcuuu

SEQ ID NO: 3833576 - RNA, 18 nt, Human
cuuuauuaaaaucuuaaa

SEQ ID NO: 3833577 - RNA, 21 nt, Human
cuuuauuaaauacaaaacuuc

SEQ ID NO: 3833578 - RNA, 17 nt, Human
cuuuauuaaauguagaa

SEQ ID NO: 3833579 - RNA, 12 nt, Human
cuuuauuauuua

SEQ ID NO: 3833580 - RNA, 23 nt, Human
cuuuauuccagaaugcuguacau

SEQ ID NO: 3833581 - RNA, 18 nt, Human
cuuuauuccuucauuuca

SEQ ID NO: 3833582 - RNA, 20 nt, Human
cuuuauucuggcagaggagg

SEQ ID NO: 3833583 - RNA, 20 nt, Human
cuuuauucuugaaagaagaa

SEQ ID NO: 3833584 - RNA, 21 nt, Human
cuuuauugaaaaaauaaaaaa

SEQ ID NO: 3833585 - RNA, 21 nt, Human
cuuuauugccaaaacccagcu

SEQ ID NO: 3833586 - RNA, 23 nt, Human
cuuuauugccaaaacccagcugc

SEQ ID NO: 3833587 - RNA, 14 nt, Human
cuuuauugcuuuuu

SEQ ID NO: 3833588 - RNA, 18 nt, Human
cuuuauugcuuuuuugua

SEQ ID NO: 3833589 - RNA, 18 nt, Human
cuuuauuggcugagauau

SEQ ID NO: 3833590 - RNA, 23 nt, Human
cuuuauuguguuugucauuagcc

SEQ ID NO: 3833591 - RNA, 22 nt, Human
cuuuauuuacuucguuuugguu

SEQ ID NO: 3833592 - RNA, 12 nt, Human
cuuuauuuccaa

SEQ ID NO: 3833593 - RNA, 14 nt, Human
cuuuauuuguaaau

SEQ ID NO: 3833594 - RNA, 16 nt, Human
cuuuauuuguaaauuu

SEQ ID NO: 3833595 - RNA, 23 nt, Human
cuuuauuuguguucuuuuuuccc

SEQ ID NO: 3833596 - RNA, 20 nt, Human
cuuuauuuuauauaauaaag

SEQ ID NO: 3833597 - RNA, 23 nt, Human
cuuuauuuuauauaauaaaguau

SEQ ID NO: 3833598 - RNA, 21 nt, Human
cuuuauuuucuauaauuuaaa

SEQ ID NO: 3833599 - RNA, 13 nt, Human
cuuuauuuucugg

SEQ ID NO: 3833600 - RNA, 17 nt, Human
cuuuauuuugagaugua

SEQ ID NO: 3833601 - RNA, 19 nt, Human
cuuuauuuugagauguaaa

SEQ ID NO: 3833602 - RNA, 14 nt, Human
cuuuauuuugugua

SEQ ID NO: 3833603 - RNA, 19 nt, Human
cuuuauuuuguguuuagga

SEQ ID NO: 3833604 - RNA, 18 nt, Human
cuuuauuuuuuaaguauu

SEQ ID NO: 3833605 - RNA, 14 nt, Human
cggggaggccaagu

SEQ ID NO: 3833606 - RNA, 19 nt, Human
cggggaggccaagugcagg

SEQ ID NO: 3833607 - RNA, 23 nt, Human
cggggauguguccugacacugca

SEQ ID NO: 3833608 - RNA, 15 nt, Human
cggggcacugcaggg

SEQ ID NO: 3833609 - RNA, 19 nt, Human
cggggcagcccccucacag

SEQ ID NO: 3833610 - RNA, 17 nt, Human
cggggcaucuggccugg

SEQ ID NO: 3833611 - RNA, 16 nt, Human
cggggcaugcuggggc

SEQ ID NO: 3833612 - RNA, 14 nt, Human
cggggccagcuccg

SEQ ID NO: 3833613 - RNA, 21 nt, Human
cggggcccagggcaagcuccg

SEQ ID NO: 3833614 - RNA, 17 nt, Human
cggggccugggcaggag

SEQ ID NO: 3833615 - RNA, 17 nt, Human
cggggcguuucuuugcc

SEQ ID NO: 3833616 - RNA, 15 nt, Human
cggggcucaggaggg

SEQ ID NO: 3833617 - RNA, 10 nt, Human
cggggcuggg

SEQ ID NO: 3833618 - RNA, 13 nt, Human
cggggcugggaag

SEQ ID NO: 3833619 - RNA, 23 nt, Human
cgggggcaggggaggccaucugg

SEQ ID NO: 3833620 - RNA, 16 nt, Human
cgggggcaggugcugg

SEQ ID NO: 3833621 - RNA, 21 nt, Human
cgggggcagucugagagaggc

SEQ ID NO: 3833622 - RNA, 14 nt, Human
cgggggcuggggca

SEQ ID NO: 3833623 - RNA, 13 nt, Human
cggggggaggguu

SEQ ID NO: 3833624 - RNA, 21 nt, Human
cggggguggcggcggccccua

SEQ ID NO: 3833625 - RNA, 19 nt, Human
cggggguuccguguccacc

SEQ ID NO: 3833626 - RNA, 22 nt, Human
cggggguuccguguccaccccc

SEQ ID NO: 3833627 - RNA, 16 nt, Human
cgggguccuguggcag

SEQ ID NO: 3833628 - RNA, 19 nt, Human
cgggguccuguggcaggca

SEQ ID NO: 3833629 - RNA, 22 nt, Human
cggggugagggggggcucccug

SEQ ID NO: 3833630 - RNA, 22 nt, Human
cggggugaguccauucucccag

SEQ ID NO: 3833631 - RNA, 17 nt, Human
cggggugcacaggaggg

SEQ ID NO: 3833632 - RNA, 14 nt, Human
cgggguggccacag

SEQ ID NO: 3833633 - RNA, 19 nt, Human
cggggugucugucuuccuu

SEQ ID NO: 3833634 - RNA, 19 nt, Human
cgggucacaggagggaggg

SEQ ID NO: 3833635 - RNA, 15 nt, Human
cgggucaucuguacc

SEQ ID NO: 3833636 - RNA, 17 nt, Human
cgggucugcucccaagg

SEQ ID NO: 3833637 - RNA, 14 nt, Human
cgggugcagcaucu

SEQ ID NO: 3833638 - RNA, 16 nt, Human
cgggugccagaagcua

SEQ ID NO: 3833639 - RNA, 21 nt, Human
cggguggggaaaggagguggg

SEQ ID NO: 3833640 - RNA, 20 nt, Human
cggguggggcuuggggcuca

SEQ ID NO: 3833641 - RNA, 16 nt, Human
cggguuccgcaggcag

SEQ ID NO: 3833642 - RNA, 16 nt, Human
cggguugugugucugu

SEQ ID NO: 3833643 - RNA, 19 nt, Human
cggguuuggcgggccaagg

SEQ ID NO: 3833644 - RNA, 14 nt, Human
cgguaccaaugcag

SEQ ID NO: 3833645 - RNA, 19 nt, Human
cgguaccaaugcagaacuc

SEQ ID NO: 3833646 - RNA, 15 nt, Human
cgguagccagcacac

SEQ ID NO: 3833647 - RNA, 21 nt, Human
cgguagccagcacacagggca

SEQ ID NO: 3833648 - RNA, 15 nt, Human
cgguagcugugcgug

SEQ ID NO: 3833649 - RNA, 19 nt, Human
cgguagggaggcagccucc

SEQ ID NO: 3833650 - RNA, 18 nt, Human
cgguagguucagccaagg

SEQ ID NO: 3833651 - RNA, 14 nt, Human
cgguauuaugcuuc

SEQ ID NO: 3833652 - RNA, 14 nt, Human
cggucaaggccagc

SEQ ID NO: 3833653 - RNA, 21 nt, Human
cggucagguuuaacauuugcc

SEQ ID NO: 3833654 - RNA, 14 nt, Human
cgguccacccagga

SEQ ID NO: 3833655 - RNA, 16 nt, Human
cgguccacccaggagc

SEQ ID NO: 3833656 - RNA, 11 nt, Human
cgguccagcug

SEQ ID NO: 3833657 - RNA, 14 nt, Human
cgguccagcuggcc

SEQ ID NO: 3833658 - RNA, 15 nt, Human
cgguccagcuggccu

SEQ ID NO: 3833659 - RNA, 14 nt, Human
cggucccacacugg

SEQ ID NO: 3833660 - RNA, 13 nt, Human
cggucccagcucc

SEQ ID NO: 3833661 - RNA, 22 nt, Human
cggucccuugagaccucagcca

SEQ ID NO: 3833662 - RNA, 15 nt, Human
cgguccugucucccc

SEQ ID NO: 3833663 - RNA, 21 nt, Human
cggucuaaagugagcucuaug

SEQ ID NO: 3833664 - RNA, 16 nt, Human
cggucugcaagucaga

SEQ ID NO: 3833665 - RNA, 21 nt, Human
cggucuucaacauccugccag

SEQ ID NO: 3833666 - RNA, 20 nt, Human
cggugaauggcuuuguauag

SEQ ID NO: 3833667 - RNA, 19 nt, Human
cggugaccucuagcccugc

SEQ ID NO: 3833668 - RNA, 17 nt, Human
cggugagcuacaaaugc

SEQ ID NO: 3833669 - RNA, 19 nt, Human
cggugccaugucugcagug

SEQ ID NO: 3833670 - RNA, 20 nt, Human
cggugcccaagccagaggcu

SEQ ID NO: 3833671 - RNA, 23 nt, Human
cggugccuuuauuuccacugugc

SEQ ID NO: 3833672 - RNA, 15 nt, Human
cggugcuccaggcag

SEQ ID NO: 3833673 - RNA, 16 nt, Human
cggugcuccaggcagg

SEQ ID NO: 3833674 - RNA, 16 nt, Human
cggugcuguccucagg

SEQ ID NO: 3833675 - RNA, 15 nt, Human
cgguggaggccaggg

SEQ ID NO: 3833676 - RNA, 17 nt, Human
cgguggcggccccagca

SEQ ID NO: 3833677 - RNA, 22 nt, Human
cgguggcuaaaggucccaaggc

SEQ ID NO: 3833678 - RNA, 21 nt, Human
cgguggcuagucaagcuccuc

SEQ ID NO: 3833679 - RNA, 20 nt, Human
cgguggcucaggccuauaac

SEQ ID NO: 3833680 - RNA, 14 nt, Human
cgguggcugggcag

SEQ ID NO: 3833681 - RNA, 12 nt, Human
cggugggccugg

SEQ ID NO: 3833682 - RNA, 13 nt, Human
cggugggccuugc

SEQ ID NO: 3833683 - RNA, 19 nt, Human
cgguggggguagggggcug

SEQ ID NO: 3833684 - RNA, 15 nt, Human
cgguguccccaccau

SEQ ID NO: 3833685 - RNA, 16 nt, Human
cgguguccccaccauc

SEQ ID NO: 3833686 - RNA, 21 nt, Human
cggugucccccagcagccugg

SEQ ID NO: 3833687 - RNA, 16 nt, Human
cggugugcaccagggu

SEQ ID NO: 3833688 - RNA, 15 nt, Human
cggugugccugcagc

SEQ ID NO: 3833689 - RNA, 20 nt, Human
cggugugggggccccgucuc

SEQ ID NO: 3833690 - RNA, 17 nt, Human
cuugucucagauuuuau

SEQ ID NO: 3833691 - RNA, 18 nt, Human
cuugucucagauuuuauu

SEQ ID NO: 3833692 - RNA, 21 nt, Human
cuugucucagauuuuauuaug

SEQ ID NO: 3833693 - RNA, 20 nt, Human
cuugucucccagcucagggc

SEQ ID NO: 3833694 - RNA, 12 nt, Human
cuugucugagau

SEQ ID NO: 3833695 - RNA, 23 nt, Human
cuugucugauuggcucacccaag

SEQ ID NO: 3833696 - RNA, 13 nt, Human
cuugucuguagau

SEQ ID NO: 3833697 - RNA, 18 nt, Human
cuugucuuaaauaaaaga

SEQ ID NO: 3833698 - RNA, 20 nt, Human
cuugucuuauucccuuccug

SEQ ID NO: 3833699 - RNA, 17 nt, Human
cuugucuuccuauuuca

SEQ ID NO: 3833700 - RNA, 23 nt, Human
cuugucuucugguacuuucuguu

SEQ ID NO: 3833701 - RNA, 14 nt, Human
cuugucuuguucac

SEQ ID NO: 3833702 - RNA, 13 nt, Human
cuugucuuuauuu

SEQ ID NO: 3833703 - RNA, 19 nt, Human
cuugucuuuggacccugag

SEQ ID NO: 3833704 - RNA, 22 nt, Human
cuugucuuuggacccugaggcc

SEQ ID NO: 3833705 - RNA, 15 nt, Human
cuugugaaaauaauu

SEQ ID NO: 3833706 - RNA, 13 nt, Human
cuugugaaaaugu

SEQ ID NO: 3833707 - RNA, 18 nt, Human
cuugugaaaauguguucu

SEQ ID NO: 3833708 - RNA, 16 nt, Human
cuugugaaacacagcu

SEQ ID NO: 3833709 - RNA, 18 nt, Human
cuugugaaacacagcugu

SEQ ID NO: 3833710 - RNA, 19 nt, Human
cuugugaaacacagcuguu

SEQ ID NO: 3833711 - RNA, 20 nt, Human
cuugugaaacacagcuguuc

SEQ ID NO: 3833712 - RNA, 10 nt, Human
cuugugaagg

SEQ ID NO: 3833713 - RNA, 16 nt, Human
cuugugaaggccauga

SEQ ID NO: 3833714 - RNA, 16 nt, Human
cuugugaaugcuucuc

SEQ ID NO: 3833715 - RNA, 20 nt, Human
cuugugacagauuauacaga

SEQ ID NO: 3833716 - RNA, 21 nt, Human
cuugugacauauuaugucuuc

SEQ ID NO: 3833717 - RNA, 15 nt, Human
cuugugacuagugcu

SEQ ID NO: 3833718 - RNA, 18 nt, Human
cuugugacuagugcugaa

SEQ ID NO: 3833719 - RNA, 12 nt, Human
cuugugacuuuu

SEQ ID NO: 3833720 - RNA, 22 nt, Human
cuugugacuuuugcuuuaauuc

SEQ ID NO: 3833721 - RNA, 16 nt, Human
cuugugaggaaaguca

SEQ ID NO: 3833722 - RNA, 19 nt, Human
cuugugaggaaagucauug

SEQ ID NO: 3833723 - RNA, 17 nt, Human
cuugugauuauuuauua

SEQ ID NO: 3833724 - RNA, 22 nt, Human
cuugugauuucuuuaaaagaau

SEQ ID NO: 3833725 - RNA, 15 nt, Human
cuugugcacaggcag

SEQ ID NO: 3833726 - RNA, 16 nt, Human
cuugugcacaggcaga

SEQ ID NO: 3833727 - RNA, 20 nt, Human
cuugugcacccucuauccca

SEQ ID NO: 3833728 - RNA, 15 nt, Human
cuugugcaguguuga

SEQ ID NO: 3833729 - RNA, 11 nt, Human
cuugugccaua

SEQ ID NO: 3833730 - RNA, 17 nt, Human
cuugugcccucccuguc

SEQ ID NO: 3833731 - RNA, 20 nt, Human
cuugugcccucccuguccuu

SEQ ID NO: 3833732 - RNA, 14 nt, Human
cuuguggacacagc

SEQ ID NO: 3833733 - RNA, 16 nt, Human
cuuguggacuaaaaga

SEQ ID NO: 3833734 - RNA, 17 nt, Human
cuuguggacuaaaagau

SEQ ID NO: 3833735 - RNA, 22 nt, Human
cuuguggauguuuuaauuccau

SEQ ID NO: 3833736 - RNA, 13 nt, Human
cuuguggcagagg

SEQ ID NO: 3833737 - RNA, 18 nt, Human
cuuguggcccucucccuu

SEQ ID NO: 3833738 - RNA, 14 nt, Human
cuuguggccuggga

SEQ ID NO: 3833739 - RNA, 22 nt, Human
cuuguggcuccacacacacaaa

SEQ ID NO: 3833740 - RNA, 15 nt, Human
cuuguggcuuugcaa

SEQ ID NO: 3833741 - RNA, 21 nt, Human
cuugugggccugggcuccugg

SEQ ID NO: 3833742 - RNA, 23 nt, Human
cuugugggccugggcuccuggac

SEQ ID NO: 3833743 - RNA, 17 nt, Human
cuuguggggacccaggc

SEQ ID NO: 3833744 - RNA, 20 nt, Human
cuuguggggacccaggcucc

SEQ ID NO: 3833745 - RNA, 12 nt, Human
cuuguggggccu

SEQ ID NO: 3833746 - RNA, 15 nt, Human
cuuguggggccuggg

SEQ ID NO: 3833747 - RNA, 22 nt, Human
cuugugguuauaacuuaaugaa

SEQ ID NO: 3833748 - RNA, 12 nt, Human
cuuguguaaaua

SEQ ID NO: 3833749 - RNA, 16 nt, Human
cuuguguaaauacaau

SEQ ID NO: 3833750 - RNA, 20 nt, Human
cuuuugguguguuggacaga

SEQ ID NO: 3833751 - RNA, 21 nt, Human
cuuuugguuaugaauacuuug

SEQ ID NO: 3833752 - RNA, 12 nt, Human
cuuuuguaaaga

SEQ ID NO: 3833753 - RNA, 15 nt, Human
cuuuuguaaagaaau

SEQ ID NO: 3833754 - RNA, 12 nt, Human
cuuuuguaauaa

SEQ ID NO: 3833755 - RNA, 12 nt, Human
cuuuuguaauuu

SEQ ID NO: 3833756 - RNA, 13 nt, Human
cuuuuguacaucu

SEQ ID NO: 3833757 - RNA, 14 nt, Human
cuuuuguacaucug

SEQ ID NO: 3833758 - RNA, 14 nt, Human
cuuuuguauaguug

SEQ ID NO: 3833759 - RNA, 16 nt, Human
cuuuuguauguaaaug

SEQ ID NO: 3833760 - RNA, 13 nt, Human
cuuuuguauuaag

SEQ ID NO: 3833761 - RNA, 11 nt, Human
cuuuugucuac

SEQ ID NO: 3833762 - RNA, 18 nt, Human
cuuuugucuaugggacuc

SEQ ID NO: 3833763 - RNA, 14 nt, Human
cuuuugugaacuuu

SEQ ID NO: 3833764 - RNA, 21 nt, Human
cuuuugugauggagugcuguu

SEQ ID NO: 3833765 - RNA, 18 nt, Human
cuuuugugccuggcuucu

SEQ ID NO: 3833766 - RNA, 19 nt, Human
cuuuugugggggacuguaa

SEQ ID NO: 3833767 - RNA, 14 nt, Human
cuuuuguguacagu

SEQ ID NO: 3833768 - RNA, 19 nt, Human
cuuuugugugaauugacua

SEQ ID NO: 3833769 - RNA, 15 nt, Human
cuuuuguuaaauaau

SEQ ID NO: 3833770 - RNA, 18 nt, Human
cuuuuguuacucuuggga

SEQ ID NO: 3833771 - RNA, 18 nt, Human
cuuuuguuacuguucuug

SEQ ID NO: 3833772 - RNA, 22 nt, Human
cuuuuguuacuguucuugcugc

SEQ ID NO: 3833773 - RNA, 18 nt, Human
cuuuuguucauuucaucc

SEQ ID NO: 3833774 - RNA, 14 nt, Human
cuuuuguucccauc

SEQ ID NO: 3833775 - RNA, 13 nt, Human
cuuuuguucgcau

SEQ ID NO: 3833776 - RNA, 13 nt, Human
cuuuuguuuauuu

SEQ ID NO: 3833777 - RNA, 15 nt, Human
cuuuuguuuccuuuu

SEQ ID NO: 3833778 - RNA, 20 nt, Human
cuuuuguuuccuuuuuuccc

SEQ ID NO: 3833779 - RNA, 18 nt, Human
cuuuuguuugguaaaugu

SEQ ID NO: 3833780 - RNA, 14 nt, Human
cuuuuguuuugcuu

SEQ ID NO: 3833781 - RNA, 21 nt, Human
cuuuuguuuuuugaaguguug

SEQ ID NO: 3833782 - RNA, 13 nt, Human
cuuuuuaaaaaua

SEQ ID NO: 3833783 - RNA, 19 nt, Human
cuuuuuaaaaauagacacu

SEQ ID NO: 3833784 - RNA, 14 nt, Human
cuuuuuaaagcuua

SEQ ID NO: 3833785 - RNA, 19 nt, Human
cuuuuuaaaguguuucugu

SEQ ID NO: 3833786 - RNA, 18 nt, Human
cuuuuuaaaguucaaacu

SEQ ID NO: 3833787 - RNA, 20 nt, Human
cuuuuuaaauguaaagauau

SEQ ID NO: 3833788 - RNA, 21 nt, Human
cuuuuuaaauguaaagauauu

SEQ ID NO: 3833789 - RNA, 19 nt, Human
cuuuuuaaguaauguggaa

SEQ ID NO: 3833790 - RNA, 14 nt, Human
cuuuuuaauaaaaa

SEQ ID NO: 3833791 - RNA, 20 nt, Human
cuuuuuaauaaaaaggcacc

SEQ ID NO: 3833792 - RNA, 15 nt, Human
cuuuuuaauaugcuu

SEQ ID NO: 3833793 - RNA, 22 nt, Human
cuuuuuaauauugauaugcuua

SEQ ID NO: 3833794 - RNA, 16 nt, Human
cuuuuuaaucaugaau

SEQ ID NO: 3833795 - RNA, 14 nt, Human
cuuuuuaauuguug

SEQ ID NO: 3833796 - RNA, 16 nt, Human
cuuuuuaauuguuguu

SEQ ID NO: 3833797 - RNA, 11 nt, Human
cuuuuuacaua

SEQ ID NO: 3833798 - RNA, 22 nt, Human
cuuuuuacccauuuguucauau

SEQ ID NO: 3833799 - RNA, 15 nt, Human
cuuuuuaccuuucau

SEQ ID NO: 3833800 - RNA, 16 nt, Human
cuuuuuaccuuucaua

SEQ ID NO: 3833801 - RNA, 21 nt, Human
cuuuuuagaugugcugcuuug

SEQ ID NO: 3833802 - RNA, 19 nt, Human
cuuuuuagggccaggcagg

SEQ ID NO: 3833803 - RNA, 16 nt, Human
cuuuuuauaacuuuuu

SEQ ID NO: 3833804 - RNA, 14 nt, Human
cuuuuuauauauau

SEQ ID NO: 3833805 - RNA, 20 nt, Human
cuuuuuauauauauauauaa

SEQ ID NO: 3833806 - RNA, 22 nt, Human
cuuuuuauauucucagcagagu

SEQ ID NO: 3833807 - RNA, 23 nt, Human
cuuuuuaugcuauuucuguauau

SEQ ID NO: 3833808 - RNA, 17 nt, Human
cuuuuuauggccuguga

SEQ ID NO: 3833809 - RNA, 13 nt, Human
cuuuuuauuaaaa

SEQ ID NO: 3833810 - RNA, 13 nt, Human
cuuuuuauugaau

SEQ ID NO: 3833811 - RNA, 15 nt, Human
cuuuuuauugaaucu

SEQ ID NO: 3833812 - RNA, 14 nt, Human
cuuuuuauugccuu

SEQ ID NO: 3833813 - RNA, 15 nt, Human
cuuuuuauugccuuc

SEQ ID NO: 3833814 - RNA, 16 nt, Human
cuuuuuauugccuucu

SEQ ID NO: 3833815 - RNA, 20 nt, Human
cuuuuuauuuauauguacug

SEQ ID NO: 3833816 - RNA, 13 nt, Human
cuuuuucauuauu

SEQ ID NO: 3833817 - RNA, 13 nt, Human
cuuuuucauuuau

SEQ ID NO: 3833818 - RNA, 23 nt, Human
cuuuuucauuuaucuauaauuua

SEQ ID NO: 3833819 - RNA, 17 nt, Human
cuuuuucauuuuccaau

SEQ ID NO: 3833820 - RNA, 17 nt, Human
cuuuuucccaauaaauu

SEQ ID NO: 3833821 - RNA, 12 nt, Human
cuuuuuccuccu

SEQ ID NO: 3833822 - RNA, 13 nt, Human
cuuuuucuaauga

SEQ ID NO: 3833823 - RNA, 21 nt, Human
cuuuuucuccagcugggcucu

SEQ ID NO: 3833824 - RNA, 17 nt, Human
cuuuuucugacuccagu

SEQ ID NO: 3833825 - RNA, 19 nt, Human
cuuuuucugauuagcuuug

SEQ ID NO: 3833826 - RNA, 22 nt, Human
cuuuuucugauuagcuuugugu

SEQ ID NO: 3833827 - RNA, 22 nt, Human
cuuuuucugcacuauaugcaaa

SEQ ID NO: 3833828 - RNA, 22 nt, Human
cuuuuucuggacugaagccugc

SEQ ID NO: 3833829 - RNA, 14 nt, Human
cuuuuucuguugua

SEQ ID NO: 3833830 - RNA, 18 nt, Human
cuuuuucuguuguaacuu

SEQ ID NO: 3833831 - RNA, 15 nt, Human
cuuuuugaaaucagc

SEQ ID NO: 3833832 - RNA, 13 nt, Human
cuuuuugaaauga

SEQ ID NO: 3833833 - RNA, 17 nt, Human
cuuuuugaaaugaaauu

SEQ ID NO: 3833834 - RNA, 23 nt, Human
cuuuuugaaaugaaauuuaaaca

SEQ ID NO: 3833835 - RNA, 19 nt, Human
cuuuuugaauguuauuugu

SEQ ID NO: 3833836 - RNA, 14 nt, Human
cuuuuugacacuga

SEQ ID NO: 3833837 - RNA, 15 nt, Human
cuuuuugacacugaa

SEQ ID NO: 3833838 - RNA, 15 nt, Human
cuuuuugaggcaaaa

SEQ ID NO: 3833839 - RNA, 20 nt, Human
cuuuuugaggcaaaagaagg

SEQ ID NO: 3833840 - RNA, 18 nt, Human
cuuuuugagguggcacuu

SEQ ID NO: 3833841 - RNA, 13 nt, Human
cuuuuugcuuucg

SEQ ID NO: 3833842 - RNA, 11 nt, Human
cuuuuuggaau

SEQ ID NO: 3833843 - RNA, 21 nt, Human
cuuuuuggaggugcuuaagca

SEQ ID NO: 3833844 - RNA, 19 nt, Human
cuuuuugggagagacuugu

SEQ ID NO: 3833845 - RNA, 20 nt, Human
cuuuuugggagagacuuguu

SEQ ID NO: 3833846 - RNA, 15 nt, Human
cuuuuugguggaugu

SEQ ID NO: 3833847 - RNA, 16 nt, Human
cuuuuugguggaugua

SEQ ID NO: 3833848 - RNA, 17 nt, Human
cuuuuugguuugcagau

SEQ ID NO: 3833849 - RNA, 14 nt, Human
cuuuuuguaccugg

SEQ ID NO: 3833850 - RNA, 21 nt, Human
cuuuuuguucugguccuuuuu

SEQ ID NO: 3833851 - RNA, 14 nt, Human
cuuuuuuaaauaaa

SEQ ID NO: 3833852 - RNA, 15 nt, Human
cuuuuuuaaauaaac

SEQ ID NO: 3833853 - RNA, 22 nt, Human
cuuuuuuaaauauuuucuauuu

SEQ ID NO: 3833854 - RNA, 16 nt, Human
cuuuuuuaaauuaaua

SEQ ID NO: 3833855 - RNA, 20 nt, Human
cuuuuuuaaauuuucuucag

SEQ ID NO: 3833856 - RNA, 19 nt, Human
cuuuuuuacucauugaaau

SEQ ID NO: 3833857 - RNA, 23 nt, Human
cuuuuuuacucauugaaauguca

SEQ ID NO: 3833858 - RNA, 14 nt, Human
cuuuuuuauacaca

SEQ ID NO: 3833859 - RNA, 15 nt, Human
cuuuuuuauacacau

SEQ ID NO: 3833860 - RNA, 15 nt, Human
cuuuuuuauaucuug

SEQ ID NO: 3833861 - RNA, 19 nt, Human
cuuuuuuaucaugugaaau

SEQ ID NO: 3833862 - RNA, 18 nt, Human
cuuuuuuaugugccgugu

SEQ ID NO: 3833863 - RNA, 18 nt, Human
cuuuuuuauuuuuuauac

SEQ ID NO: 3833864 - RNA, 12 nt, Human
cuuuuuucaaaa

SEQ ID NO: 3833865 - RNA, 13 nt, Human
cuuuuuucaaaau

SEQ ID NO: 3833866 - RNA, 22 nt, Human
cuuuuuucaaaauccaaaaaga

SEQ ID NO: 3833867 - RNA, 15 nt, Human
cuuuuuucacaaauu

SEQ ID NO: 3833868 - RNA, 21 nt, Human
cuuuuuucacggaaguuuuca

SEQ ID NO: 3833869 - RNA, 12 nt, Human
cuuuuuucccca

SEQ ID NO: 3833870 - RNA, 13 nt, Human
cuuuuuuccuaau

SEQ ID NO: 3833871 - RNA, 14 nt, Human
cuuuuuucuaaagu

SEQ ID NO: 3833872 - RNA, 15 nt, Human
cuuuuuucugccucc

SEQ ID NO: 3833873 - RNA, 16 nt, Human
cuuuuuucugccuccu

SEQ ID NO: 3833874 - RNA, 16 nt, Human
cuuuuuucuuuaagau

SEQ ID NO: 3833875 - RNA, 21 nt, Human
cuuuuuugauaaaguuucuca

SEQ ID NO: 3833876 - RNA, 15 nt, Human
cuuuuuuggcugcug

SEQ ID NO: 3833877 - RNA, 20 nt, Human
cuuuuuuggcugcugaaggc

SEQ ID NO: 3833878 - RNA, 15 nt, Human
cuuuuuuguuuguuu

SEQ ID NO: 3833879 - RNA, 21 nt, Human
cuuuuuuguuuuuucaaaaua

SEQ ID NO: 3833880 - RNA, 22 nt, Human
cuuuuuuguuuuuucaaaauag

SEQ ID NO: 3833881 - RNA, 16 nt, Human
cuuuuuuuccuuuuua

SEQ ID NO: 3833882 - RNA, 22 nt, Human
cuuuuuuucucugcauuuaaaa

SEQ ID NO: 3833883 - RNA, 16 nt, Human
cuuuuuuucuguacca

SEQ ID NO: 3833884 - RNA, 13 nt, Human
cuuuuuuugaaac

SEQ ID NO: 3833885 - RNA, 21 nt, Human
cuuuuuuuguauaguuaacac

SEQ ID NO: 3833886 - RNA, 16 nt, Human
cuuuuuuuguaugugu

SEQ ID NO: 3833887 - RNA, 17 nt, Human
cuuuuuuuguaugugug

SEQ ID NO: 3833888 - RNA, 13 nt, Human
cuuuuuuugugug

SEQ ID NO: 3833889 - RNA, 15 nt, Human
cuuuuuuuucuuuaa

SEQ ID NO: 3833890 - RNA, 13 nt, Human
cuuuuuuuuuaag

SEQ ID NO: 3833891 - RNA, 14 nt, Human
cuuuuuuuuuaagu

SEQ ID NO: 3833892 - RNA, 22 nt, Human
cuuuuuuuuuuaagugaaauuu

SEQ ID NO: 3833893 - RNA, 16 nt, Human
cuuuuuuuuuucuuua

SEQ ID NO: 3833894 - RNA, 18 nt, Human
cuuuuuuuuuucuuuaua

SEQ ID NO: 3833895 - RNA, 21 nt, Human
cuuugaugauuaauucaccuu

SEQ ID NO: 3833896 - RNA, 18 nt, Human
gaaaagacuccaaagaaa

SEQ ID NO: 3833897 - RNA, 21 nt, Human
gaaaagacuccaaagaaaugu

SEQ ID NO: 3833898 - RNA, 14 nt, Human
gaaaagagaagaag

SEQ ID NO: 3833899 - RNA, 15 nt, Human
gaaaagagaagaaga

SEQ ID NO: 3833900 - RNA, 13 nt, Human
gaaaagagacagg

SEQ ID NO: 3833901 - RNA, 13 nt, Human
gaaaagagagaaa

SEQ ID NO: 3833902 - RNA, 18 nt, Human
gaaaagagagcagagaau

SEQ ID NO: 3833903 - RNA, 21 nt, Human
gaaaagagauggccugagaag

SEQ ID NO: 3833904 - RNA, 12 nt, Human
gaaaagaggagu

SEQ ID NO: 3833905 - RNA, 20 nt, Human
gaaaagaggaguuucgaggu

SEQ ID NO: 3833906 - RNA, 13 nt, Human
gaaaagauaaaga

SEQ ID NO: 3833907 - RNA, 19 nt, Human
gaaaagauaaagaccagaa

SEQ ID NO: 3833908 - RNA, 16 nt, Human
gaaaagauacgacuuu

SEQ ID NO: 3833909 - RNA, 22 nt, Human
cuuuguaagaguguagaagcau

SEQ ID NO: 3833910 - RNA, 22 nt, Human
cuuuguaagucaguguugagau

SEQ ID NO: 3833911 - RNA, 21 nt, Human
cuuuguaaucguuaugugugu

SEQ ID NO: 3833912 - RNA, 13 nt, Human
cuuuguaaugaaa

SEQ ID NO: 3833913 - RNA, 15 nt, Human
cuuuguaaugaaaac

SEQ ID NO: 3833914 - RNA, 21 nt, Human
cuuuguaaugucaccaccuuc

SEQ ID NO: 3833915 - RNA, 20 nt, Human
cuuuguaauuauuuuuaaua

SEQ ID NO: 3833916 - RNA, 15 nt, Human
cuuuguacagcccag

SEQ ID NO: 3833917 - RNA, 13 nt, Human
cuuuguagauccu

SEQ ID NO: 3833918 - RNA, 15 nt, Human
cuuuguagcacucag

SEQ ID NO: 3833919 - RNA, 20 nt, Human
cuuuguagcauuuggugcuu

SEQ ID NO: 3833920 - RNA, 14 nt, Human
cuuuguauacuuua

SEQ ID NO: 3833921 - RNA, 12 nt, Human
cuuuguauaguu

SEQ ID NO: 3833922 - RNA, 18 nt, Human
cuuuguauaguuauguaa

SEQ ID NO: 3833923 - RNA, 19 nt, Human
cuuuguaucauucaucuuc

SEQ ID NO: 3833924 - RNA, 15 nt, Human
cuuuguaucuuccau

SEQ ID NO: 3833925 - RNA, 23 nt, Human
cuuuguaucuuccauauuuggaa

SEQ ID NO: 3833926 - RNA, 20 nt, Human
cuuuguaugucauuuccuuc

SEQ ID NO: 3833927 - RNA, 13 nt, Human
cuuuguauucaaa

SEQ ID NO: 3833928 - RNA, 17 nt, Human
cuuuguauucucuccug

SEQ ID NO: 3833929 - RNA, 12 nt, Human
cuuuguauuguc

SEQ ID NO: 3833930 - RNA, 16 nt, Human
cuuuguauuguccuau

SEQ ID NO: 3833931 - RNA, 22 nt, Human
cuuuguauuguccuauuagugu

SEQ ID NO: 3833932 - RNA, 20 nt, Human
cuuuguauuuuuacuuuuaa

SEQ ID NO: 3833933 - RNA, 14 nt, Human
cuuugucagggagu

SEQ ID NO: 3833934 - RNA, 14 nt, Human
cuuugucccacagc

SEQ ID NO: 3833935 - RNA, 15 nt, Human
cuuugucccacagcu

SEQ ID NO: 3833936 - RNA, 18 nt, Human
cuuuguccccaccgcaga

SEQ ID NO: 3833937 - RNA, 17 nt, Human
cuuuguccuccugcugc

SEQ ID NO: 3833938 - RNA, 23 nt, Human
cuuugucuacuucaaaaguuugu

SEQ ID NO: 3833939 - RNA, 15 nt, Human
cuuugucugaaaaau

SEQ ID NO: 3833940 - RNA, 13 nt, Human
cuuugucuuucaa

SEQ ID NO: 3833941 - RNA, 16 nt, Human
cuuugucuuucaaacu

SEQ ID NO: 3833942 - RNA, 23 nt, Human
cuuugugacuguauauaaaggaa

SEQ ID NO: 3833943 - RNA, 19 nt, Human
cuuugugagagugagcugu

SEQ ID NO: 3833944 - RNA, 19 nt, Human
cuuugugaggaagccgcug

SEQ ID NO: 3833945 - RNA, 18 nt, Human
cuuugugauuauuucacu

SEQ ID NO: 3833946 - RNA, 22 nt, Human
cuuugugauucaaucuguaaac

SEQ ID NO: 3833947 - RNA, 18 nt, Human
cuuugugauuuuuguaau

SEQ ID NO: 3833948 - RNA, 13 nt, Human
cuuugugcauucu

SEQ ID NO: 3833949 - RNA, 20 nt, Human
cuuugugcuacaugacgaca

SEQ ID NO: 3833950 - RNA, 15 nt, Human
cuuugugcugggguu

SEQ ID NO: 3833951 - RNA, 22 nt, Human
cuuugugcugggguuaucugaa

SEQ ID NO: 3833952 - RNA, 19 nt, Human
cuuuguggaccaauuauug

SEQ ID NO: 3833953 - RNA, 12 nt, Human
cuuuguggccaa

SEQ ID NO: 3833954 - RNA, 14 nt, Human
cuuuguggccaagg

SEQ ID NO: 3833955 - RNA, 16 nt, Human
cuuuguggccaaggag

SEQ ID NO: 3833956 - RNA, 21 nt, Human
cuuuguggccaaggagcugcu

SEQ ID NO: 3833957 - RNA, 21 nt, Human
cuuuguggggcuuggcgugga

SEQ ID NO: 3833958 - RNA, 17 nt, Human
cuuugugugcucuccau

SEQ ID NO: 3833959 - RNA, 19 nt, Human
cuuuguguucuuuguguca

SEQ ID NO: 3833960 - RNA, 11 nt, Human
cuuuguguugg

SEQ ID NO: 3833961 - RNA, 13 nt, Human
cuuuguguuguaa

SEQ ID NO: 3833962 - RNA, 19 nt, Human
cuuuguguuugguuuacau

SEQ ID NO: 3833963 - RNA, 15 nt, Human
cuuuguuaauuugga

SEQ ID NO: 3833964 - RNA, 15 nt, Human
cuuuguuacaggcac

SEQ ID NO: 3833965 - RNA, 16 nt, Human
cuuuguuaccuuaaaa

SEQ ID NO: 3833966 - RNA, 14 nt, Human
cuuuguuauaccau

SEQ ID NO: 3833967 - RNA, 12 nt, Human
cuuuguucccca

SEQ ID NO: 3833968 - RNA, 18 nt, Human
cuuuguuccccacuggag

SEQ ID NO: 3833969 - RNA, 19 nt, Human
cuuuguuccccacuggagc

SEQ ID NO: 3833970 - RNA, 17 nt, Human
cuuuguucucagcuccc

SEQ ID NO: 3833971 - RNA, 20 nt, Human
cuuuguucucagcucccccu

SEQ ID NO: 3833972 - RNA, 14 nt, Human
cuuuguucugcugu

SEQ ID NO: 3833973 - RNA, 13 nt, Human
cuuuguugaaaga

SEQ ID NO: 3833974 - RNA, 22 nt, Human
cuuuguugaacuguuagaaugu

SEQ ID NO: 3833975 - RNA, 19 nt, Human
cuuuguugcaagaugugaa

SEQ ID NO: 3833976 - RNA, 21 nt, Human
cuuuguugcaagaugugaauu

SEQ ID NO: 3833977 - RNA, 16 nt, Human
cuuuguugcccaggcu

SEQ ID NO: 3833978 - RNA, 17 nt, Human
cuuuguugugugccucu

SEQ ID NO: 3833979 - RNA, 22 nt, Human
cuuuguugugugccucuagcug

SEQ ID NO: 3833980 - RNA, 17 nt, Human
cuuuguuuguguuguug

SEQ ID NO: 3833981 - RNA, 18 nt, Human
cuuuguuuguugucagcu

SEQ ID NO: 3833982 - RNA, 17 nt, Human
cuuuguuuuacugucuu

SEQ ID NO: 3833983 - RNA, 16 nt, Human
cuuuguuuuauuuuca

SEQ ID NO: 3833984 - RNA, 19 nt, Human
cuuuguuuugauguuugug

SEQ ID NO: 3833985 - RNA, 24 nt, Human
cuuuguuuugauguuuguggccuc

SEQ ID NO: 3833986 - RNA, 16 nt, Human
cuuuguuuuuuuuucc

SEQ ID NO: 3833987 - RNA, 18 nt, Human
cuuuuaaaaacauaacau

SEQ ID NO: 3833988 - RNA, 18 nt, Human
cuuuuaaaacacuuccau

SEQ ID NO: 3833989 - RNA, 14 nt, Human
cuuuuaaaacuacu

SEQ ID NO: 3833990 - RNA, 14 nt, Human
cuuuuaaaagacaa

SEQ ID NO: 3833991 - RNA, 16 nt, Human
cuuuuaaaagacaaga

SEQ ID NO: 3833992 - RNA, 15 nt, Human
cuuuuaaaagauuuu

SEQ ID NO: 3833993 - RNA, 15 nt, Human
cuuuuaaacugugua

SEQ ID NO: 3833994 - RNA, 18 nt, Human
cuuuuaaagaauuucuuu

SEQ ID NO: 3833995 - RNA, 13 nt, Human
cuuuuaaaguguu

SEQ ID NO: 3833996 - RNA, 17 nt, Human
cuuuuaaaguguuacuu

SEQ ID NO: 3833997 - RNA, 14 nt, Human
cuuuuaaauccugu

SEQ ID NO: 3833998 - RNA, 14 nt, Human
cuuuuaacauuuug

SEQ ID NO: 3833999 - RNA, 16 nt, Human
cuuuuaaccaaacaau

SEQ ID NO: 3834000 - RNA, 17 nt, Human
cuuuuaaccaucugaua

SEQ ID NO: 3834001 - RNA, 15 nt, Human
cuuuuaacugugcaa

SEQ ID NO: 3834002 - RNA, 22 nt, Human
cuuuuaacuguuguagaagaca

SEQ ID NO: 3834003 - RNA, 14 nt, Human
cuuuuaacuucuuu

SEQ ID NO: 3834004 - RNA, 14 nt, Human
cuuuuaagaaucaa

SEQ ID NO: 3834005 - RNA, 23 nt, Human
cuuuuaaggauaaaucauaaagu

SEQ ID NO: 3834006 - RNA, 14 nt, Human
cuuuuaaucagaca

SEQ ID NO: 3834007 - RNA, 13 nt, Human
cuuuuaaugaaaa

SEQ ID NO: 3834008 - RNA, 18 nt, Human
cuuuuaaugaacaaaugg

SEQ ID NO: 3834009 - RNA, 15 nt, Human
cuuuuaaugcuucau

SEQ ID NO: 3834010 - RNA, 22 nt, Human
cuuuuaauuaaauaaaagcugg

SEQ ID NO: 3834011 - RNA, 15 nt, Human
cuuuuaauuaaaugc

SEQ ID NO: 3834012 - RNA, 19 nt, Human
cuuuuaauuaaugaaauau

SEQ ID NO: 3834013 - RNA, 12 nt, Human
cuuuuaauucau

SEQ ID NO: 3834014 - RNA, 16 nt, Human
cuuuuacccuggcccc

SEQ ID NO: 3834015 - RNA, 21 nt, Human
cuuuuacccuggccccucucc

SEQ ID NO: 3834016 - RNA, 22 nt, Human
cuuuuacccuggccccucuccc

SEQ ID NO: 3834017 - RNA, 23 nt, Human
cuuuuacccuggccccucucccu

SEQ ID NO: 3834018 - RNA, 18 nt, Human
cuuuuaccugcugcuucu

SEQ ID NO: 3834019 - RNA, 20 nt, Human
cuuuuaccugcugcuucucc

SEQ ID NO: 3834020 - RNA, 15 nt, Human
cuuuuacugguugca

SEQ ID NO: 3834021 - RNA, 16 nt, Human
cuuuuacugguugcau

SEQ ID NO: 3834022 - RNA, 11 nt, Human
cuuuuacugug

SEQ ID NO: 3834023 - RNA, 21 nt, Human
cuuuuagaaauacugcaagaa

SEQ ID NO: 3834024 - RNA, 23 nt, Human
cuuuuagaaauacugcaagaaaa

SEQ ID NO: 3834025 - RNA, 16 nt, Human
cuuuuagcaguaaaau

SEQ ID NO: 3834026 - RNA, 21 nt, Human
cuuuuaggaaaaucacuuugu

SEQ ID NO: 3834027 - RNA, 16 nt, Human
cuuuuagggagaguca

SEQ ID NO: 3834028 - RNA, 21 nt, Human
cuuuuaguaaagucaaggaga

SEQ ID NO: 3834029 - RNA, 18 nt, Human
cuuuuaguacccaccuga

SEQ ID NO: 3834030 - RNA, 20 nt, Human
cuuuuaguacccaccugagc

SEQ ID NO: 3834031 - RNA, 18 nt, Human
cuuuuaguuguaucucuu

SEQ ID NO: 3834032 - RNA, 19 nt, Human
cuuuuaguuguaucucuuu

SEQ ID NO: 3834033 - RNA, 22 nt, Human
cuuuuaguuuuaguugcagaaa

SEQ ID NO: 3834034 - RNA, 14 nt, Human
cuuuuaguuuuucu

SEQ ID NO: 3834035 - RNA, 22 nt, Human
cuuuuauaaaaaaaaugaaaug

SEQ ID NO: 3834036 - RNA, 16 nt, Human
cuuuuauaaaccucua

SEQ ID NO: 3834037 - RNA, 18 nt, Human
cuuuuauaaacuuuaccu

SEQ ID NO: 3834038 - RNA, 19 nt, Human
cuuuuauaaacuuuaccuu

SEQ ID NO: 3834039 - RNA, 16 nt, Human
cuuuuauaaauuaaau

SEQ ID NO: 3834040 - RNA, 14 nt, Human
cuuuuauaauaaaa

SEQ ID NO: 3834041 - RNA, 22 nt, Human
gaaaauuacaguccaaaauacu

SEQ ID NO: 3834042 - RNA, 18 nt, Human
gaaaauuagacugugauu

SEQ ID NO: 3834043 - RNA, 13 nt, Human
gaaaauuauuuaa

SEQ ID NO: 3834044 - RNA, 15 nt, Human
gaaaauuauuugcau

SEQ ID NO: 3834045 - RNA, 20 nt, Human
gaaaauucaaaaaguguuua

SEQ ID NO: 3834046 - RNA, 22 nt, Human
gaaaauucaaaaaguguuuauu

SEQ ID NO: 3834047 - RNA, 13 nt, Human
gaaaauucacuau

SEQ ID NO: 3834048 - RNA, 16 nt, Human
gaaaauucauuucaca

SEQ ID NO: 3834049 - RNA, 14 nt, Human
gaaaauucauuuuu

SEQ ID NO: 3834050 - RNA, 18 nt, Human
gaaaauuccagaaaggau

SEQ ID NO: 3834051 - RNA, 18 nt, Human
gaaaauugaauuuaacaa

SEQ ID NO: 3834052 - RNA, 18 nt, Human
gaaaauugccuuucugug

SEQ ID NO: 3834053 - RNA, 15 nt, Human
gaaaauugcugugcc

SEQ ID NO: 3834054 - RNA, 12 nt, Human
gaaaauuguauu

SEQ ID NO: 3834055 - RNA, 21 nt, Human
gaaaauuguuuagugauauua

SEQ ID NO: 3834056 - RNA, 12 nt, Human
gaaaauuugaau

SEQ ID NO: 3834057 - RNA, 14 nt, Human
gaaaauuuuaaaaa

SEQ ID NO: 3834058 - RNA, 20 nt, Human
gaaaauuuuaaaaauacaua

SEQ ID NO: 3834059 - RNA, 21 nt, Human
gaaaauuuuaaaaauacauau

SEQ ID NO: 3834060 - RNA, 19 nt, Human
gaaaauuuuaccagcagaa

SEQ ID NO: 3834061 - RNA, 20 nt, Human
gaaaauuuuaccagcagaag

SEQ ID NO: 3834062 - RNA, 19 nt, Human
gaaacaaaaacacuaaaaa

SEQ ID NO: 3834063 - RNA, 14 nt, Human
gaaacaaagaaggu

SEQ ID NO: 3834064 - RNA, 20 nt, Human
gaaacaaagacaauuuauaa

SEQ ID NO: 3834065 - RNA, 23 nt, Human
gaaacaaagaguucaagaaauaa

SEQ ID NO: 3834066 - RNA, 19 nt, Human
gaaacaaagcuuagcagga

SEQ ID NO: 3834067 - RNA, 22 nt, Human
gaaacaaagcuuagcaggagag

SEQ ID NO: 3834068 - RNA, 19 nt, Human
gaaacaaauaaucacauug

SEQ ID NO: 3834069 - RNA, 16 nt, Human
gaaacaacacuguagu

SEQ ID NO: 3834070 - RNA, 15 nt, Human
gaaacaacagcuuua

SEQ ID NO: 3834071 - RNA, 21 nt, Human
gaaacaacagcuuuaaaagaa

SEQ ID NO: 3834072 - RNA, 14 nt, Human
gaaacaacuuggaa

SEQ ID NO: 3834073 - RNA, 21 nt, Human
gaaacaagucagucauucaga

SEQ ID NO: 3834074 - RNA, 22 nt, Human
gaaacacagcuuacaaucgcaa

SEQ ID NO: 3834075 - RNA, 19 nt, Human
gaaacacauaauuaacacu

SEQ ID NO: 3834076 - RNA, 18 nt, Human
gaaacacccucacacugg

SEQ ID NO: 3834077 - RNA, 22 nt, Human
gaaacacccucacacugggacu

SEQ ID NO: 3834078 - RNA, 16 nt, Human
gaaacacgaaacuugu

SEQ ID NO: 3834079 - RNA, 17 nt, Human
gaaacacgaaacuuguu

SEQ ID NO: 3834080 - RNA, 22 nt, Human
gaaacacgaaacuuguuauugu

SEQ ID NO: 3834081 - RNA, 17 nt, Human
gaaacacuaaauguuaa

SEQ ID NO: 3834082 - RNA, 12 nt, Human
gaaacacugccu

SEQ ID NO: 3834083 - RNA, 16 nt, Human
gaaacacugccuuuuu

SEQ ID NO: 3834084 - RNA, 17 nt, Human
gaaacacugccuuuuua

SEQ ID NO: 3834085 - RNA, 18 nt, Human
gaaacacuggggcuggca

SEQ ID NO: 3834086 - RNA, 22 nt, Human
gaaacacugguuuuaaauauuu

SEQ ID NO: 3834087 - RNA, 13 nt, Human
gaaacacuuuuuu

SEQ ID NO: 3834088 - RNA, 19 nt, Human
gaaacagagacaggcccaa

SEQ ID NO: 3834089 - RNA, 23 nt, Human
gaaacagaggaccagcacacucc

SEQ ID NO: 3834090 - RNA, 20 nt, Human
gaaacagaggagagucccag

SEQ ID NO: 3834091 - RNA, 12 nt, Human
gaaacagaggcu

SEQ ID NO: 3834092 - RNA, 17 nt, Human
gaaacagcaucuccaag

SEQ ID NO: 3834093 - RNA, 18 nt, Human
gaaacagcaucuccaagc

SEQ ID NO: 3834094 - RNA, 17 nt, Human
gaaacagccugugucuu

SEQ ID NO: 3834095 - RNA, 20 nt, Human
gaaacagccugugucuuuaa

SEQ ID NO: 3834096 - RNA, 12 nt, Human
gaaacagcugcc

SEQ ID NO: 3834097 - RNA, 19 nt, Human
gaaacaguugcauguagua

SEQ ID NO: 3834098 - RNA, 23 nt, Human
gaaacaguugcauguaguaacac

SEQ ID NO: 3834099 - RNA, 23 nt, Human
gaaacaguugguaacuuuuguga

SEQ ID NO: 3834100 - RNA, 18 nt, Human
gaaacauaaauaaaauga

SEQ ID NO: 3834101 - RNA, 19 nt, Human
gaaacaucaguuacucuga

SEQ ID NO: 3834102 - RNA, 20 nt, Human
gaaacaucaguuacucugaa

SEQ ID NO: 3834103 - RNA, 16 nt, Human
gaaacaucucaauaaa

SEQ ID NO: 3834104 - RNA, 15 nt, Human
gaaacaugguuuuga

SEQ ID NO: 3834105 - RNA, 21 nt, Human
gaaacauguugccaaaauggu

SEQ ID NO: 3834106 - RNA, 13 nt, Human
gaaacauugcuuu

SEQ ID NO: 3834107 - RNA, 21 nt, Human
gaaacauugcuuuuaaaacua

SEQ ID NO: 3834108 - RNA, 14 nt, Human
gaaacauuggaagc

SEQ ID NO: 3834109 - RNA, 16 nt, Human
gaaaccaaagaagaaa

SEQ ID NO: 3834110 - RNA, 18 nt, Human
gaaaccaaucaagauaaa

SEQ ID NO: 3834111 - RNA, 23 nt, Human
gaaaccaaucaagauaaaggaca

SEQ ID NO: 3834112 - RNA, 17 nt, Human
gaaaccacagcugcugg

SEQ ID NO: 3834113 - RNA, 17 nt, Human
gaaaccagcuuccuuca

SEQ ID NO: 3834114 - RNA, 21 nt, Human
gaaauucccuucaucuggaac

SEQ ID NO: 3834115 - RNA, 17 nt, Human
gaaauucuccuggaggu

SEQ ID NO: 3834116 - RNA, 17 nt, Human
gaaauucugaauuugca

SEQ ID NO: 3834117 - RNA, 15 nt, Human
gaaauucuguuuuua

SEQ ID NO: 3834118 - RNA, 20 nt, Human
gaaauucuuuauacauucua

SEQ ID NO: 3834119 - RNA, 17 nt, Human
gaaauugaaaaguuauu

SEQ ID NO: 3834120 - RNA, 17 nt, Human
gaaauugaaccuuugug

SEQ ID NO: 3834121 - RNA, 13 nt, Human
gaaauugaauacu

SEQ ID NO: 3834122 - RNA, 19 nt, Human
gaaauugaauacuuugaau

SEQ ID NO: 3834123 - RNA, 13 nt, Human
gaaauugacagau

SEQ ID NO: 3834124 - RNA, 16 nt, Human
gaaauugcauacuuug

SEQ ID NO: 3834125 - RNA, 17 nt, Human
gaaauuggaacagaaug

SEQ ID NO: 3834126 - RNA, 16 nt, Human
gaaauuggaagagcac

SEQ ID NO: 3834127 - RNA, 21 nt, Human
gaaauugguaccuugcacaca

SEQ ID NO: 3834128 - RNA, 22 nt, Human
gaaauuguuuaaguguuguaaa

SEQ ID NO: 3834129 - RNA, 13 nt, Human
gaaauuuaaaaga

SEQ ID NO: 3834130 - RNA, 19 nt, Human
gaaauuuaaaagacacugu

SEQ ID NO: 3834131 - RNA, 23 nt, Human
gaaauuuaaacuauaagcaagaa

SEQ ID NO: 3834132 - RNA, 13 nt, Human
gaaauuuaaagca

SEQ ID NO: 3834133 - RNA, 22 nt, Human
gaaauuuaaagcagguucuugu

SEQ ID NO: 3834134 - RNA, 23 nt, Human
gaaauuuaaagcagguucuuguu

SEQ ID NO: 3834135 - RNA, 22 nt, Human
gaaauuuaauauagcuauuuuu

SEQ ID NO: 3834136 - RNA, 16 nt, Human
gaaauuuaauucaugu

SEQ ID NO: 3834137 - RNA, 21 nt, Human
gaaauuuaauucauguuucuu

SEQ ID NO: 3834138 - RNA, 23 nt, Human
gaaauuuaauucauguuucuuaa

SEQ ID NO: 3834139 - RNA, 21 nt, Human
gaaauuuauugaggaaaaaua

SEQ ID NO: 3834140 - RNA, 22 nt, Human
gaaauuuauuuccuaguucugu

SEQ ID NO: 3834141 - RNA, 23 nt, Human
gaaauuuauuuccuaguucugua

SEQ ID NO: 3834142 - RNA, 11 nt, Human
gaaauuucacg

SEQ ID NO: 3834143 - RNA, 16 nt, Human
gaaauuucacgucaua

SEQ ID NO: 3834144 - RNA, 21 nt, Human
gaaauuuccugggagcuuuug

SEQ ID NO: 3834145 - RNA, 16 nt, Human
gaaauuugaauuuugu

SEQ ID NO: 3834146 - RNA, 21 nt, Human
gaaauuugauuucuauucaag

SEQ ID NO: 3834147 - RNA, 14 nt, Human
gaaauuuguuauaa

SEQ ID NO: 3834148 - RNA, 17 nt, Human
gaaauuuguuauaauga

SEQ ID NO: 3834149 - RNA, 14 nt, Human
gaaauuuuaccaag

SEQ ID NO: 3834150 - RNA, 16 nt, Human
gaaauuuuaccaaguu

SEQ ID NO: 3834151 - RNA, 13 nt, Human
gaaauuuugcaaa

SEQ ID NO: 3834152 - RNA, 15 nt, Human
gaaauuuugcaaaua

SEQ ID NO: 3834153 - RNA, 24 nt, Human
gaaauuuugcaaauauaaacaucu

SEQ ID NO: 3834154 - RNA, 12 nt, Human
gaaauuuuguaa

SEQ ID NO: 3834155 - RNA, 13 nt, Human
gaaauuuuguaag

SEQ ID NO: 3834156 - RNA, 19 nt, Human
gaaauuuuguaagaaggca

SEQ ID NO: 3834157 - RNA, 13 nt, Human
gaaauuuuuauca

SEQ ID NO: 3834158 - RNA, 18 nt, Human
gaaauuuuuauuaaauua

SEQ ID NO: 3834159 - RNA, 17 nt, Human
gaaauuuuucuucuuga

SEQ ID NO: 3834160 - RNA, 16 nt, Human
gaaauuuuuguaaauc

SEQ ID NO: 3834161 - RNA, 18 nt, Human
gaacaaaaaaaccacaaa

SEQ ID NO: 3834162 - RNA, 20 nt, Human
gaacaaaaaaaccacaaagg

SEQ ID NO: 3834163 - RNA, 16 nt, Human
gaacaaaaaaaucugc

SEQ ID NO: 3834164 - RNA, 14 nt, Human
gaacaaaaggguca

SEQ ID NO: 3834165 - RNA, 15 nt, Human
gaacaaaaucuguug

SEQ ID NO: 3834166 - RNA, 16 nt, Human
gaacaaagaccaauuu

SEQ ID NO: 3834167 - RNA, 16 nt, Human
gaacaaagcuguuaaa

SEQ ID NO: 3834168 - RNA, 21 nt, Human
gaacaaagcuguuaaacuguu

SEQ ID NO: 3834169 - RNA, 22 nt, Human
gaacaaagcuguuaaacuguua

SEQ ID NO: 3834170 - RNA, 23 nt, Human
gaacaaauuuacagagacagaaa

SEQ ID NO: 3834171 - RNA, 21 nt, Human
gaacaaccucggcuccuggac

SEQ ID NO: 3834172 - RNA, 15 nt, Human
gaacaacuacuguga

SEQ ID NO: 3834173 - RNA, 19 nt, Human
gaacaacuaggcuucagca

SEQ ID NO: 3834174 - RNA, 21 nt, Human
gaacaacuaggcuucagcaua

SEQ ID NO: 3834175 - RNA, 15 nt, Human
gaacaagagaagcau

SEQ ID NO: 3834176 - RNA, 16 nt, Human
gaacaagcaaacccag

SEQ ID NO: 3834177 - RNA, 13 nt, Human
gaacaagccuaaa

SEQ ID NO: 3834178 - RNA, 17 nt, Human
gaacaaggcaaggcugu

SEQ ID NO: 3834179 - RNA, 18 nt, Human
gaacaaggcaaggcuguc

SEQ ID NO: 3834180 - RNA, 22 nt, Human
gaacaagucccuguaauuguug

SEQ ID NO: 3834181 - RNA, 20 nt, Human
gaacaaguugagcuaugacu

SEQ ID NO: 3834182 - RNA, 21 nt, Human
gaacaaguugagcuaugacuu

SEQ ID NO: 3834183 - RNA, 22 nt, Human
gaacaaguugagcuaugacuua

SEQ ID NO: 3834184 - RNA, 16 nt, Human
gaaacuugucacuugc

SEQ ID NO: 3834185 - RNA, 20 nt, Human
gaaacuugucacuugcaugu

SEQ ID NO: 3834186 - RNA, 20 nt, Human
gaaacuuguguaaauacaau

SEQ ID NO: 3834187 - RNA, 13 nt, Human
gaaacuuguuauu

SEQ ID NO: 3834188 - RNA, 15 nt, Human
gaaacuuguuauugu

SEQ ID NO: 3834189 - RNA, 16 nt, Human
gaaacuuguucuucca

SEQ ID NO: 3834190 - RNA, 12 nt, Human
gaaacuuuauac

SEQ ID NO: 3834191 - RNA, 15 nt, Human
gaaacuuuauacauu

SEQ ID NO: 3834192 - RNA, 18 nt, Human
gaaacuuuauacauuagu

SEQ ID NO: 3834193 - RNA, 21 nt, Human
gaaacuuugggaaaacauguu

SEQ ID NO: 3834194 - RNA, 13 nt, Human
gaaacuuugugcu

SEQ ID NO: 3834195 - RNA, 19 nt, Human
gaaacuuuuaacugagaaa

SEQ ID NO: 3834196 - RNA, 12 nt, Human
gaaacuuuuauc

SEQ ID NO: 3834197 - RNA, 14 nt, Human
gaaacuuuucuaga

SEQ ID NO: 3834198 - RNA, 15 nt, Human
gaaacuuuucuagaa

SEQ ID NO: 3834199 - RNA, 15 nt, Human
gaaacuuuuguaaag

SEQ ID NO: 3834200 - RNA, 23 nt, Human
gaaacuuuuguaaagaaauuuac

SEQ ID NO: 3834201 - RNA, 21 nt, Human
gaaagaaaauaccaaggaaca

SEQ ID NO: 3834202 - RNA, 22 nt, Human
gaaagaaacccgacagagggaa

SEQ ID NO: 3834203 - RNA, 15 nt, Human
gaaagaaaucauguu

SEQ ID NO: 3834204 - RNA, 19 nt, Human
gaaagaacauggacuugua

SEQ ID NO: 3834205 - RNA, 16 nt, Human
gaaagaacuaucuuca

SEQ ID NO: 3834206 - RNA, 15 nt, Human
gaaagaauagaaaga

SEQ ID NO: 3834207 - RNA, 13 nt, Human
gaaagaauagaac

SEQ ID NO: 3834208 - RNA, 13 nt, Human
gaaagaauauauu

SEQ ID NO: 3834209 - RNA, 16 nt, Human
gaaagaauauauuuau

SEQ ID NO: 3834210 - RNA, 17 nt, Human
gaaagaauuucauaugc

SEQ ID NO: 3834211 - RNA, 14 nt, Human
gaaagacaacacaa

SEQ ID NO: 3834212 - RNA, 14 nt, Human
gaaagacacugccu

SEQ ID NO: 3834213 - RNA, 16 nt, Human
gaaagacagcuucuca

SEQ ID NO: 3834214 - RNA, 21 nt, Human
gaaagacauccauaaagaagc

SEQ ID NO: 3834215 - RNA, 23 nt, Human
gaaagacauccauaaagaagcaa

SEQ ID NO: 3834216 - RNA, 17 nt, Human
gaaagacgcacuuuggc

SEQ ID NO: 3834217 - RNA, 14 nt, Human
gaaagacuauucaa

SEQ ID NO: 3834218 - RNA, 22 nt, Human
gaaagacuucucuacccaucuu

SEQ ID NO: 3834219 - RNA, 18 nt, Human
gaaagagaaacaguuggu

SEQ ID NO: 3834220 - RNA, 17 nt, Human
gaaagagaacuuccaga

SEQ ID NO: 3834221 - RNA, 12 nt, Human
gaaagagagaaa

SEQ ID NO: 3834222 - RNA, 21 nt, Human
gaaagagagaaaauaaaaagu

SEQ ID NO: 3834223 - RNA, 22 nt, Human
gaaagagagaaaauaaaaaguu

SEQ ID NO: 3834224 - RNA, 11 nt, Human
gaaagagagag

SEQ ID NO: 3834225 - RNA, 21 nt, Human
gaaagagagagaaacaaacuu

SEQ ID NO: 3834226 - RNA, 22 nt, Human
gaaagagagagagagagagaaa

SEQ ID NO: 3834227 - RNA, 13 nt, Human
gaaagagagcagg

SEQ ID NO: 3834228 - RNA, 16 nt, Human
gaaagagcacuuaaga

SEQ ID NO: 3834229 - RNA, 23 nt, Human
gaaagagcacuuaagagaauauu

SEQ ID NO: 3834230 - RNA, 21 nt, Human
gaaagaggaaugaaguacuca

SEQ ID NO: 3834231 - RNA, 16 nt, Human
gaaagaggcaccagga

SEQ ID NO: 3834232 - RNA, 17 nt, Human
gaaagaggcaccaggaa

SEQ ID NO: 3834233 - RNA, 20 nt, Human
gaaagaggcaccaggaagcc

SEQ ID NO: 3834234 - RNA, 18 nt, Human
gaaagaggcacccuucca

SEQ ID NO: 3834235 - RNA, 19 nt, Human
gaaagaggcacccuuccau

SEQ ID NO: 3834236 - RNA, 21 nt, Human
gaaagaggcugaggccuggac

SEQ ID NO: 3834237 - RNA, 22 nt, Human
gaaagaggcugaggccuggacu

SEQ ID NO: 3834238 - RNA, 21 nt, Human
gaaagaguacucuuguuuccu

SEQ ID NO: 3834239 - RNA, 17 nt, Human
gaaagagucuucaacau

SEQ ID NO: 3834240 - RNA, 16 nt, Human
gaaagauaaaauagug

SEQ ID NO: 3834241 - RNA, 17 nt, Human
gaaagauaauucacugu

SEQ ID NO: 3834242 - RNA, 21 nt, Human
gaaagaugcucagguacagag

SEQ ID NO: 3834243 - RNA, 23 nt, Human
gaaagaugcucagguacagagaa

SEQ ID NO: 3834244 - RNA, 22 nt, Human
gaaagauggcugugccucugcc

SEQ ID NO: 3834245 - RNA, 19 nt, Human
gaaagaugguuaaacauuu

SEQ ID NO: 3834246 - RNA, 23 nt, Human
gaaagcaaaaaugcuaauauuaa

SEQ ID NO: 3834247 - RNA, 16 nt, Human
gaaagcaaagcacaga

SEQ ID NO: 3834248 - RNA, 17 nt, Human
gaaagcaacaaagaaau

SEQ ID NO: 3834249 - RNA, 12 nt, Human
gaaagcaacuuu

SEQ ID NO: 3834250 - RNA, 20 nt, Human
gaaagcaagaaucagagaag

SEQ ID NO: 3834251 - RNA, 16 nt, Human
gaaagcacaggagaca

SEQ ID NO: 3834252 - RNA, 18 nt, Human
gaaagcagaggcuggccu

SEQ ID NO: 3834253 - RNA, 22 nt, Human
gaaagcagauaccucacccugc

SEQ ID NO: 3834254 - RNA, 19 nt, Human
gaaagcagcucaaaggcac

SEQ ID NO: 3834255 - RNA, 20 nt, Human
gaaagcagcucaaaggcaca

SEQ ID NO: 3834256 - RNA, 13 nt, Human
gaaagcaggggcu

SEQ ID NO: 3834257 - RNA, 15 nt, Human
gaaagcaguugaaau

SEQ ID NO: 3834258 - RNA, 12 nt, Human
gaaagcauuuga

SEQ ID NO: 3834259 - RNA, 21 nt, Human
gaaagcauuugaaugcauuuu

SEQ ID NO: 3834260 - RNA, 14 nt, Human
gaaagccagucuua

SEQ ID NO: 3834261 - RNA, 17 nt, Human
gaaagccagugacucca

SEQ ID NO: 3834262 - RNA, 20 nt, Human
gaaagcccagaaaaggacag

SEQ ID NO: 3834263 - RNA, 16 nt, Human
gaaagccccacccagg

SEQ ID NO: 3834264 - RNA, 15 nt, Human
gaaagccccagaaau

SEQ ID NO: 3834265 - RNA, 14 nt, Human
gaaagccccagcac

SEQ ID NO: 3834266 - RNA, 21 nt, Human
gaaagcccugagcuuucugcu

SEQ ID NO: 3834267 - RNA, 10 nt, Human
gaaagccuga

SEQ ID NO: 3834268 - RNA, 22 nt, Human
gaaagccuguaagccugcaagc

SEQ ID NO: 3834269 - RNA, 21 nt, Human
gaaagccuguuccccucacug

SEQ ID NO: 3834270 - RNA, 14 nt, Human
gaaagccuucuuuu

SEQ ID NO: 3834271 - RNA, 23 nt, Human
gaaagccuuucauuuugcuuuaa

SEQ ID NO: 3834272 - RNA, 13 nt, Human
gaacauugcaaua

SEQ ID NO: 3834273 - RNA, 17 nt, Human
gaacauugcaauagaaa

SEQ ID NO: 3834274 - RNA, 12 nt, Human
gaacauuggaau

SEQ ID NO: 3834275 - RNA, 21 nt, Human
gaacauuggaauguucucaga

SEQ ID NO: 3834276 - RNA, 10 nt, Human
gaacauugua

SEQ ID NO: 3834277 - RNA, 21 nt, Human
gaacauuuauuuuaugagaaa

SEQ ID NO: 3834278 - RNA, 16 nt, Human
gaacauuucauggugu

SEQ ID NO: 3834279 - RNA, 20 nt, Human
gaacauuucuguaaauacca

SEQ ID NO: 3834280 - RNA, 17 nt, Human
gaaccaaagagacugga

SEQ ID NO: 3834281 - RNA, 23 nt, Human
gaaccaaagcgaauuuuaaaaga

SEQ ID NO: 3834282 - RNA, 24 nt, Human
gaaccaacaaccucaacugccuac

SEQ ID NO: 3834283 - RNA, 15 nt, Human
gaaccaacacuaaca

SEQ ID NO: 3834284 - RNA, 17 nt, Human
gaaccaagcaggagacg

SEQ ID NO: 3834285 - RNA, 20 nt, Human
gaaccaagcaggagacgaca

SEQ ID NO: 3834286 - RNA, 15 nt, Human
gaaccacaagacugc

SEQ ID NO: 3834287 - RNA, 20 nt, Human
gaaccacaucuugcucugcu

SEQ ID NO: 3834288 - RNA, 16 nt, Human
gaaccaccacacccag

SEQ ID NO: 3834289 - RNA, 20 nt, Human
gaaccaccacacccagccca

SEQ ID NO: 3834290 - RNA, 13 nt, Human
gaaccacuuguag

SEQ ID NO: 3834291 - RNA, 14 nt, Human
gaaccacuuguaga

SEQ ID NO: 3834292 - RNA, 15 nt, Human
gaaccacuuguagau

SEQ ID NO: 3834293 - RNA, 13 nt, Human
gaaccacuuucuu

SEQ ID NO: 3834294 - RNA, 20 nt, Human
gaaccacuuucuuauuuuuu

SEQ ID NO: 3834295 - RNA, 16 nt, Human
gaaccagacucuugcc

SEQ ID NO: 3834296 - RNA, 17 nt, Human
gaaccagacucuugccu

SEQ ID NO: 3834297 - RNA, 23 nt, Human
gaaccagagccauggacucuaca

SEQ ID NO: 3834298 - RNA, 21 nt, Human
gaaccaggaaauggaacccca

SEQ ID NO: 3834299 - RNA, 20 nt, Human
gaaccaggcaacuugggaac

SEQ ID NO: 3834300 - RNA, 19 nt, Human
gaaccaguccccccacccu

SEQ ID NO: 3834301 - RNA, 19 nt, Human
gaaccaguuucagguguuu

SEQ ID NO: 3834302 - RNA, 14 nt, Human
gaaccauaaaaugu

SEQ ID NO: 3834303 - RNA, 20 nt, Human
gaaccauaguuacuguaaaa

SEQ ID NO: 3834304 - RNA, 22 nt, Human
gaaccauggucggaaaacaugc

SEQ ID NO: 3834305 - RNA, 16 nt, Human
gaaccauguuuguggc

SEQ ID NO: 3834306 - RNA, 16 nt, Human
gaaccauuaaccagau

SEQ ID NO: 3834307 - RNA, 16 nt, Human
gaacccaaguccaagc

SEQ ID NO: 3834308 - RNA, 15 nt, Human
gaacccaccugcuga

SEQ ID NO: 3834309 - RNA, 16 nt, Human
gaacccagacucagac

SEQ ID NO: 3834310 - RNA, 17 nt, Human
gaacccagcccaccccc

SEQ ID NO: 3834311 - RNA, 11 nt, Human
gaacccaggac

SEQ ID NO: 3834312 - RNA, 13 nt, Human
gaacccaggacaa

SEQ ID NO: 3834313 - RNA, 19 nt, Human
gaacccaggacgcuucuga

SEQ ID NO: 3834314 - RNA, 16 nt, Human
gaacccaggaggugga

SEQ ID NO: 3834315 - RNA, 12 nt, Human
gaacccagggcu

SEQ ID NO: 3834316 - RNA, 13 nt, Human
gaacccagggcuc

SEQ ID NO: 3834317 - RNA, 17 nt, Human
gaaccccccucccaccc

SEQ ID NO: 3834318 - RNA, 19 nt, Human
gaaccccgucgaggggcuc

SEQ ID NO: 3834319 - RNA, 21 nt, Human
gaaccccuacaugaaacagaa

SEQ ID NO: 3834320 - RNA, 14 nt, Human
gaaccccuuuccca

SEQ ID NO: 3834321 - RNA, 16 nt, Human
gaacccgggaggcaga

SEQ ID NO: 3834322 - RNA, 20 nt, Human
gaacccuggggccugacugc

SEQ ID NO: 3834323 - RNA, 13 nt, Human
gaacccugugcug

SEQ ID NO: 3834324 - RNA, 23 nt, Human
gaacccugugcugguguccugac

SEQ ID NO: 3834325 - RNA, 23 nt, Human
gaacccuuaaacaguugcacagc

SEQ ID NO: 3834326 - RNA, 12 nt, Human
gaacccuuggcu

SEQ ID NO: 3834327 - RNA, 18 nt, Human
gaacccuuggcuugccca

SEQ ID NO: 3834328 - RNA, 20 nt, Human
gaacccuuggcuugcccacg

SEQ ID NO: 3834329 - RNA, 24 nt, Human
gaacuuuccacauucagagcuuac

SEQ ID NO: 3834330 - RNA, 15 nt, Human
gaacuuuccauuuug

SEQ ID NO: 3834331 - RNA, 12 nt, Human
gaacuuuccugg

SEQ ID NO: 3834332 - RNA, 20 nt, Human
gaacuuuccuggaugucuga

SEQ ID NO: 3834333 - RNA, 11 nt, Human
gaacuuuggga

SEQ ID NO: 3834334 - RNA, 14 nt, Human
gaacuuugggaagc

SEQ ID NO: 3834335 - RNA, 21 nt, Human
gaacuuuguauaguuauguaa

SEQ ID NO: 3834336 - RNA, 16 nt, Human
gaacuuuuguacugaa

SEQ ID NO: 3834337 - RNA, 20 nt, Human
gaacuuuuguacugaauuuu

SEQ ID NO: 3834338 - RNA, 21 nt, Human
gaacuuuuguacugaauuuuu

SEQ ID NO: 3834339 - RNA, 16 nt, Human
gaacuuuuuuaaauaa

SEQ ID NO: 3834340 - RNA, 23 nt, Human
gaacuuuuuuaaauaaacuuuuu

SEQ ID NO: 3834341 - RNA, 10 nt, Human
gaagaaaaaa

SEQ ID NO: 3834342 - RNA, 19 nt, Human
gaagaaaaaaaaaaauuca

SEQ ID NO: 3834343 - RNA, 18 nt, Human
gaagaaaaaaaauaacac

SEQ ID NO: 3834344 - RNA, 23 nt, Human
gaagaaaaaaaucuucuccagau

SEQ ID NO: 3834345 - RNA, 18 nt, Human
gaagaaaaaauacauuuu

SEQ ID NO: 3834346 - RNA, 17 nt, Human
gaagaaaacacuguuau

SEQ ID NO: 3834347 - RNA, 22 nt, Human
gaagaaaacaucuauucucucc

SEQ ID NO: 3834348 - RNA, 22 nt, Human
gaagaaaacuccuuuagcaggu

SEQ ID NO: 3834349 - RNA, 17 nt, Human
gaagaaaauacuuaaau

SEQ ID NO: 3834350 - RNA, 21 nt, Human
gaagaaaauagaauugacauu

SEQ ID NO: 3834351 - RNA, 17 nt, Human
gaagaaaauugcugugc

SEQ ID NO: 3834352 - RNA, 18 nt, Human
gaagaaacacuuucucuu

SEQ ID NO: 3834353 - RNA, 15 nt, Human
gaagaaacagaucuc

SEQ ID NO: 3834354 - RNA, 14 nt, Human
gaagaaagaagaca

SEQ ID NO: 3834355 - RNA, 17 nt, Human
gaagaaagagaaggagc

SEQ ID NO: 3834356 - RNA, 23 nt, Human
gaagaaagaggugaccccagggc

SEQ ID NO: 3834357 - RNA, 17 nt, Human
gaagaaaggguguuuuu

SEQ ID NO: 3834358 - RNA, 15 nt, Human
gaagaaaguggaaaa

SEQ ID NO: 3834359 - RNA, 14 nt, Human
gaagaaauuccugu

SEQ ID NO: 3834360 - RNA, 15 nt, Human
gaagaaauuccugua

SEQ ID NO: 3834361 - RNA, 13 nt, Human
gaagaacauagaa

SEQ ID NO: 3834362 - RNA, 16 nt, Human
gaagaacauccaagga

SEQ ID NO: 3834363 - RNA, 20 nt, Human
gaagaacauccaaggagaaa

SEQ ID NO: 3834364 - RNA, 22 nt, Human
gaagaacguuuuuuccucagug

SEQ ID NO: 3834365 - RNA, 22 nt, Human
gaagaacuagcauauagccauu

SEQ ID NO: 3834366 - RNA, 19 nt, Human
gaagaacucaccaggguuu

SEQ ID NO: 3834367 - RNA, 17 nt, Human
gaagaacucaugugauu

SEQ ID NO: 3834368 - RNA, 12 nt, Human
gaagaacugaaa

SEQ ID NO: 3834369 - RNA, 16 nt, Human
gaagaacugaaaggcu

SEQ ID NO: 3834370 - RNA, 9 nt, Human
gaagaagaa

SEQ ID NO: 3834371 - RNA, 13 nt, Human
gaagaagaaaaca

SEQ ID NO: 3834372 - RNA, 14 nt, Human
gaagaagaaaagag

SEQ ID NO: 3834373 - RNA, 15 nt, Human
gaagaagaagaaaag

SEQ ID NO: 3834374 - RNA, 17 nt, Human
gaagaagagaagcugcu

SEQ ID NO: 3834375 - RNA, 15 nt, Human
gaagaagagggagag

SEQ ID NO: 3834376 - RNA, 21 nt, Human
gaagaagcaccaaucaugaau

SEQ ID NO: 3834377 - RNA, 15 nt, Human
gaagaagcagagaga

SEQ ID NO: 3834378 - RNA, 14 nt, Human
gaagaagcucucuc

SEQ ID NO: 3834379 - RNA, 16 nt, Human
gaagaagcuuaggcag

SEQ ID NO: 3834380 - RNA, 12 nt, Human
gaagaaggaaau

SEQ ID NO: 3834381 - RNA, 23 nt, Human
gaagaaggaggaaugcuggacug

SEQ ID NO: 3834382 - RNA, 19 nt, Human
gaagaagggagaagaaagg

SEQ ID NO: 3834383 - RNA, 14 nt, Human
gaagaaggugaaua

SEQ ID NO: 3834384 - RNA, 14 nt, Human
gaagaagucagaga

SEQ ID NO: 3834385 - RNA, 13 nt, Human
gaagaauauuguu

SEQ ID NO: 3834386 - RNA, 12 nt, Human
gaagaaugaaag

SEQ ID NO: 3834387 - RNA, 16 nt, Human
gaagaaugaaagcugu

SEQ ID NO: 3834388 - RNA, 14 nt, Human
gaagaaugaagccc

SEQ ID NO: 3834389 - RNA, 20 nt, Human
gaagaaugcacaagaaugga

SEQ ID NO: 3834390 - RNA, 14 nt, Human
gaagaaugcaugcu

SEQ ID NO: 3834391 - RNA, 19 nt, Human
gaagaauguguuucaaacu

SEQ ID NO: 3834392 - RNA, 13 nt, Human
gaagaauuauuuu

SEQ ID NO: 3834393 - RNA, 12 nt, Human
gaagaauuccag

SEQ ID NO: 3834394 - RNA, 12 nt, Human
gaagaauuuuaa

SEQ ID NO: 3834395 - RNA, 14 nt, Human
gaagaauuuuaaaa

SEQ ID NO: 3834396 - RNA, 15 nt, Human
gaagaauuuucagac

SEQ ID NO: 3834397 - RNA, 15 nt, Human
gaagacaaaaauacu

SEQ ID NO: 3834398 - RNA, 16 nt, Human
gaagacaaaaauacuc

SEQ ID NO: 3834399 - RNA, 19 nt, Human
gaagacaaaacauacauuu

SEQ ID NO: 3834400 - RNA, 22 nt, Human
gaagacaaugacuuacuguaca

SEQ ID NO: 3834401 - RNA, 21 nt, Human
gaagacacagacugcgauuug

SEQ ID NO: 3834402 - RNA, 15 nt, Human
gaagacaccagagca

SEQ ID NO: 3834403 - RNA, 16 nt, Human
gaagacaccagagcag

SEQ ID NO: 3834404 - RNA, 21 nt, Human
gaagacaccagagcagaugca

SEQ ID NO: 3834405 - RNA, 16 nt, Human
gaagacacugaugggc

SEQ ID NO: 3834406 - RNA, 17 nt, Human
gaagacagaaguuugca

SEQ ID NO: 3834407 - RNA, 18 nt, Human
gaagacagagaccuccug

SEQ ID NO: 3834408 - RNA, 15 nt, Human
gaagacagagcuaca

SEQ ID NO: 3834409 - RNA, 12 nt, Human
gaagacagcucu

SEQ ID NO: 3834410 - RNA, 15 nt, Human
gaagacaggacagug

SEQ ID NO: 3834411 - RNA, 22 nt, Human
gaagacauggggaggaaggaca

SEQ ID NO: 3834412 - RNA, 18 nt, Human
gaagacauguuuuagaca

SEQ ID NO: 3834413 - RNA, 20 nt, Human
gaagaccacauccacacacg

SEQ ID NO: 3834414 - RNA, 22 nt, Human
gaagaccauguggagacuucau

SEQ ID NO: 3834415 - RNA, 19 nt, Human
gaagaccccugacucauca

SEQ ID NO: 3834416 - RNA, 23 nt, Human
gaagacccucuugcccauccuga

SEQ ID NO: 3834417 - RNA, 13 nt, Human
gaagaccuaacca

SEQ ID NO: 3834418 - RNA, 18 nt, Human
gaagaccuaaccagggcc

SEQ ID NO: 3834419 - RNA, 20 nt, Human
gaagaccucaccuagaaauu

SEQ ID NO: 3834420 - RNA, 17 nt, Human
gaagaccugagaaugua

SEQ ID NO: 3834421 - RNA, 22 nt, Human
gaagaccugcugagggaccagc

SEQ ID NO: 3834422 - RNA, 14 nt, Human
gaagaccuuuuucu

SEQ ID NO: 3834423 - RNA, 23 nt, Human
gaagacuaucuuacuauuucaca

SEQ ID NO: 3834424 - RNA, 16 nt, Human
gaagacucauucuucu

SEQ ID NO: 3834425 - RNA, 17 nt, Human
gaagacugcauuauauu

SEQ ID NO: 3834426 - RNA, 20 nt, Human
gaagacuuacagcaaauccu

SEQ ID NO: 3834427 - RNA, 13 nt, Human
gaagacuucaaaa

SEQ ID NO: 3834428 - RNA, 19 nt, Human
gaagacuucaucccucugg

SEQ ID NO: 3834429 - RNA, 17 nt, Human
gaagacuuuggaaagag

SEQ ID NO: 3834430 - RNA, 20 nt, Human
gaagacuuuucuuucagcca

SEQ ID NO: 3834431 - RNA, 13 nt, Human
gaagagaaacagg

SEQ ID NO: 3834432 - RNA, 12 nt, Human
gaagagaaacca

SEQ ID NO: 3834433 - RNA, 20 nt, Human
gaagagaagcugcugaccaa

SEQ ID NO: 3834434 - RNA, 15 nt, Human
gaagagaaggagcag

SEQ ID NO: 3834435 - RNA, 23 nt, Human
gaagagacagagacaaguaauuu

SEQ ID NO: 3834436 - RNA, 15 nt, Human
gaagagacagcccag

SEQ ID NO: 3834437 - RNA, 16 nt, Human
gaagagacugggaaga

SEQ ID NO: 3834438 - RNA, 22 nt, Human
gaagagagaaggggcgggaaua

SEQ ID NO: 3834439 - RNA, 20 nt, Human
gaagagagccugcaggaucu

SEQ ID NO: 3834440 - RNA, 19 nt, Human
gaagagaggagaggagaga

SEQ ID NO: 3834441 - RNA, 12 nt, Human
gaagagaggagu

SEQ ID NO: 3834442 - RNA, 17 nt, Human
gaagagaggaguucaau

SEQ ID NO: 3834443 - RNA, 18 nt, Human
gaagagaggaguucaaug

SEQ ID NO: 3834444 - RNA, 22 nt, Human
gaagagaggaguucaaugaucu

SEQ ID NO: 3834445 - RNA, 21 nt, Human
gaagagaguccauauuucaau

SEQ ID NO: 3834446 - RNA, 16 nt, Human
gaagagaucaggaaga

SEQ ID NO: 3834447 - RNA, 15 nt, Human
gaagagauuuuucau

SEQ ID NO: 3834448 - RNA, 13 nt, Human
gaagagcaaaaau

SEQ ID NO: 3834449 - RNA, 17 nt, Human
gaagagcaaaaauaucc

SEQ ID NO: 3834450 - RNA, 21 nt, Human
gaagagcaaaaauaucccuuc

SEQ ID NO: 3834451 - RNA, 13 nt, Human
gaagagcacagcc

SEQ ID NO: 3834452 - RNA, 14 nt, Human
gaagagcacagccc

SEQ ID NO: 3834453 - RNA, 20 nt, Human
gaagagcacagcccucccgc

SEQ ID NO: 3834454 - RNA, 23 nt, Human
gaagagcagcaccuccucagccu

SEQ ID NO: 3834455 - RNA, 18 nt, Human
gaagagcaggcacaugga

SEQ ID NO: 3834456 - RNA, 23 nt, Human
gaagagcaggcacauggaggagc

SEQ ID NO: 3834457 - RNA, 12 nt, Human
gaagagccacag

SEQ ID NO: 3834458 - RNA, 16 nt, Human
gaagagcccagucugu

SEQ ID NO: 3834459 - RNA, 15 nt, Human
gaagagccccacucu

SEQ ID NO: 3834460 - RNA, 18 nt, Human
gaagagccugcaggugcu

SEQ ID NO: 3834461 - RNA, 15 nt, Human
gaagagcuggggaga

SEQ ID NO: 3834462 - RNA, 13 nt, Human
gaagagcuguuca

SEQ ID NO: 3834463 - RNA, 15 nt, Human
gaagagcuguucaca

SEQ ID NO: 3834464 - RNA, 10 nt, Human
gaagaggacu

SEQ ID NO: 3834465 - RNA, 16 nt, Human
gaagaggcgggccagc

SEQ ID NO: 3834466 - RNA, 17 nt, Human
gaagaggcgggccagcc

SEQ ID NO: 3834467 - RNA, 16 nt, Human
gaagaggcuggugcug

SEQ ID NO: 3834468 - RNA, 19 nt, Human
gaagagggauaagguaccu

SEQ ID NO: 3834469 - RNA, 14 nt, Human
gaagaggggacagg

SEQ ID NO: 3834470 - RNA, 13 nt, Human
gaagaggggcagc

SEQ ID NO: 3834471 - RNA, 15 nt, Human
gaagaggggcagccc

SEQ ID NO: 3834472 - RNA, 20 nt, Human
gaagaggggugcagaggcug

SEQ ID NO: 3834473 - RNA, 16 nt, Human
gaagaguccucugaau

SEQ ID NO: 3834474 - RNA, 22 nt, Human
gaagaguggcagcuauaggaaa

SEQ ID NO: 3834475 - RNA, 20 nt, Human
gaagccgugcucgccccagc

SEQ ID NO: 3834476 - RNA, 19 nt, Human
gaagccucagauuccuucc

SEQ ID NO: 3834477 - RNA, 21 nt, Human
gaagccucagauuccuuccca

SEQ ID NO: 3834478 - RNA, 16 nt, Human
gaagccuccccagcuc

SEQ ID NO: 3834479 - RNA, 13 nt, Human
gaagccucuggga

SEQ ID NO: 3834480 - RNA, 15 nt, Human
gaagccugcaggagu

SEQ ID NO: 3834481 - RNA, 23 nt, Human
gaagccugcguugguccagagcg

SEQ ID NO: 3834482 - RNA, 13 nt, Human
gaagccuggaaca

SEQ ID NO: 3834483 - RNA, 18 nt, Human
gaagccugggggccuggc

SEQ ID NO: 3834484 - RNA, 22 nt, Human
gaagccugggggccuggcuggc

SEQ ID NO: 3834485 - RNA, 18 nt, Human
gaagccuguggaugauca

SEQ ID NO: 3834486 - RNA, 20 nt, Human
gaagccuguggaugaucaau

SEQ ID NO: 3834487 - RNA, 20 nt, Human
gaagccuguuuuguuggaag

SEQ ID NO: 3834488 - RNA, 17 nt, Human
gaagccuuaccacgcag

SEQ ID NO: 3834489 - RNA, 20 nt, Human
gaaguggacuggccccuggg

SEQ ID NO: 3834490 - RNA, 16 nt, Human
gaaguguaacagcuga

SEQ ID NO: 3834491 - RNA, 18 nt, Human
gaaguguaacagcugagg

SEQ ID NO: 3834492 - RNA, 23 nt, Human
gaaguguaacagcugaggucucu

SEQ ID NO: 3834493 - RNA, 15 nt, Human
gaaguguaggcagac

SEQ ID NO: 3834494 - RNA, 16 nt, Human
gaaguguaggcagaca

SEQ ID NO: 3834495 - RNA, 18 nt, Human
gaaguguaggcagacaca

SEQ ID NO: 3834496 - RNA, 13 nt, Human
gaagugucauguu

SEQ ID NO: 3834497 - RNA, 20 nt, Human
gaagugugauugggaauaaa

SEQ ID NO: 3834498 - RNA, 23 nt, Human
gaagugugauugggaauaaauau

SEQ ID NO: 3834499 - RNA, 21 nt, Human
gaagugugggucugugugugu

SEQ ID NO: 3834500 - RNA, 24 nt, Human
gaagugugggucugugugugugua

SEQ ID NO: 3834501 - RNA, 15 nt, Human
gaaguguguuuccuu

SEQ ID NO: 3834502 - RNA, 22 nt, Human
gaaguguugcauggauguuuua

SEQ ID NO: 3834503 - RNA, 15 nt, Human
gaaguuacugaaugc

SEQ ID NO: 3834504 - RNA, 16 nt, Human
gaaguuacuuucuuaa

SEQ ID NO: 3834505 - RNA, 14 nt, Human
gaaguuagaauucc

SEQ ID NO: 3834506 - RNA, 20 nt, Human
gaaguuagaauuccuucagg

SEQ ID NO: 3834507 - RNA, 11 nt, Human
gaaguuagccu

SEQ ID NO: 3834508 - RNA, 17 nt, Human
gaaguuagcuuuaacuu

SEQ ID NO: 3834509 - RNA, 16 nt, Human
gaaguuaguuuguaua

SEQ ID NO: 3834510 - RNA, 13 nt, Human
gaaguuauauuuc

SEQ ID NO: 3834511 - RNA, 16 nt, Human
gaaguuauguguaugu

SEQ ID NO: 3834512 - RNA, 16 nt, Human
gaaguucuaguguuuu

SEQ ID NO: 3834513 - RNA, 14 nt, Human
gaaguucuuugauu

SEQ ID NO: 3834514 - RNA, 15 nt, Human
gaaguugaaugggca

SEQ ID NO: 3834515 - RNA, 21 nt, Human
gaaguugacuuauaguacaug

SEQ ID NO: 3834516 - RNA, 12 nt, Human
gaaguugcugcu

SEQ ID NO: 3834517 - RNA, 14 nt, Human
gaaguugcugcuuc

SEQ ID NO: 3834518 - RNA, 13 nt, Human
gaaguuggacagc

SEQ ID NO: 3834519 - RNA, 19 nt, Human
gaaguuguggauuucaguu

SEQ ID NO: 3834520 - RNA, 21 nt, Human
gaaguuuaaaacaguauuuau

SEQ ID NO: 3834521 - RNA, 16 nt, Human
gaaguuuacauuguaa

SEQ ID NO: 3834522 - RNA, 17 nt, Human
gaaguuuagcucugaga

SEQ ID NO: 3834523 - RNA, 21 nt, Human
gaaguuucaaguuuuaaaguu

SEQ ID NO: 3834524 - RNA, 15 nt, Human
gaaguuucauuuaug

SEQ ID NO: 3834525 - RNA, 13 nt, Human
gaaguuugaacau

SEQ ID NO: 3834526 - RNA, 13 nt, Human
gaaguuugaaugu

SEQ ID NO: 3834527 - RNA, 17 nt, Human
gaaguuugaauguuaaa

SEQ ID NO: 3834528 - RNA, 16 nt, Human
gaaguuugauaaauag

SEQ ID NO: 3834529 - RNA, 19 nt, Human
gaaguuugauaaauagugu

SEQ ID NO: 3834530 - RNA, 20 nt, Human
gaaguuugauaaauaguguu

SEQ ID NO: 3834531 - RNA, 14 nt, Human
gaaguuuggcugcu

SEQ ID NO: 3834532 - RNA, 21 nt, Human
gaaguuuguccauuuguaaaa

SEQ ID NO: 3834533 - RNA, 13 nt, Human
gaaguuuucagga

SEQ ID NO: 3834534 - RNA, 13 nt, Human
gaaguuuucugua

SEQ ID NO: 3834535 - RNA, 12 nt, Human
gaaguuuugcau

SEQ ID NO: 3834536 - RNA, 15 nt, Human
gaaguuuuguacaga

SEQ ID NO: 3834537 - RNA, 14 nt, Human
gaauaaaaaagaaa

SEQ ID NO: 3834538 - RNA, 16 nt, Human
gaauaaaaacuuugcu

SEQ ID NO: 3834539 - RNA, 13 nt, Human
gaauaaaaauuaa

SEQ ID NO: 3834540 - RNA, 21 nt, Human
gaauaaaauacuauuuuuacu

SEQ ID NO: 3834541 - RNA, 14 nt, Human
gaauaaaauccuaa

SEQ ID NO: 3834542 - RNA, 23 nt, Human
gaauaaaauccuaagacacaaau

SEQ ID NO: 3834543 - RNA, 16 nt, Human
gaauaaacauuuguua

SEQ ID NO: 3834544 - RNA, 12 nt, Human
gaauaaacuaga

SEQ ID NO: 3834545 - RNA, 19 nt, Human
gaauaaacuagauuacauu

SEQ ID NO: 3834546 - RNA, 12 nt, Human
gaauaaacuuca

SEQ ID NO: 3834547 - RNA, 13 nt, Human
gaauaaacuucag

SEQ ID NO: 3834548 - RNA, 13 nt, Human
gaauaaagaauac

SEQ ID NO: 3834549 - RNA, 14 nt, Human
gaauaaagacaccu

SEQ ID NO: 3834550 - RNA, 15 nt, Human
gaauaaagcaauuuu

SEQ ID NO: 3834551 - RNA, 16 nt, Human
gaauaaagcaauuuuc

SEQ ID NO: 3834552 - RNA, 17 nt, Human
gaauaaagcaauuuucc

SEQ ID NO: 3834553 - RNA, 18 nt, Human
gaauaaagcaauuuuccu

SEQ ID NO: 3834554 - RNA, 19 nt, Human
gaauaaagcaauuuuccuu

SEQ ID NO: 3834555 - RNA, 20 nt, Human
gaauaaagcaauuuuccuug

SEQ ID NO: 3834556 - RNA, 22 nt, Human
gaauaaagcaauuuuccuugaa

SEQ ID NO: 3834557 - RNA, 18 nt, Human
gaauaaaggcagcuguug

SEQ ID NO: 3834558 - RNA, 15 nt, Human
gaauaaaggcaguuu

SEQ ID NO: 3834559 - RNA, 13 nt, Human
gaauaaaguucug

SEQ ID NO: 3834560 - RNA, 19 nt, Human
gaauaaauaugccucuccu

SEQ ID NO: 3834561 - RNA, 17 nt, Human
gaauaaauuguacagcc

SEQ ID NO: 3834562 - RNA, 19 nt, Human
gaauaacauguaauuaagu

SEQ ID NO: 3834563 - RNA, 21 nt, Human
gaauaacucuguggcauuauu

SEQ ID NO: 3834564 - RNA, 16 nt, Human
gaauaagaauggagca

SEQ ID NO: 3834565 - RNA, 12 nt, Human
gaauaagaauuu

SEQ ID NO: 3834566 - RNA, 14 nt, Human
gaauaagaauuugc

SEQ ID NO: 3834567 - RNA, 16 nt, Human
gaauaagaauuugcau

SEQ ID NO: 3834568 - RNA, 22 nt, Human
gaauaagagaccuguuuuaaaa

SEQ ID NO: 3834569 - RNA, 16 nt, Human
gaauaagcacuuuuua

SEQ ID NO: 3834570 - RNA, 20 nt, Human
gaauaagccauucugacuca

SEQ ID NO: 3834571 - RNA, 18 nt, Human
gaauaagcucccagggcc

SEQ ID NO: 3834572 - RNA, 13 nt, Human
gaauaaguuauug

SEQ ID NO: 3834573 - RNA, 18 nt, Human
gaauaaguuauugcaguu

SEQ ID NO: 3834574 - RNA, 19 nt, Human
gaauaaguuauugcaguuu

SEQ ID NO: 3834575 - RNA, 14 nt, Human
gaauaauaaaauca

SEQ ID NO: 3834576 - RNA, 22 nt, Human
gaauaauaauuauccagaguuu

SEQ ID NO: 3834577 - RNA, 19 nt, Human
gaauaaucaaauacauuuu

SEQ ID NO: 3834578 - RNA, 19 nt, Human
gaauaaucacgcuuuccug

SEQ ID NO: 3834579 - RNA, 14 nt, Human
gaauaaugaaugga

SEQ ID NO: 3834580 - RNA, 20 nt, Human
gaauaaugguaccagauaaa

SEQ ID NO: 3834581 - RNA, 21 nt, Human
gaauaaugguaccagauaaaa

SEQ ID NO: 3834582 - RNA, 14 nt, Human
gaauaauguaaaau

SEQ ID NO: 3834583 - RNA, 22 nt, Human
gaauaauguaaaauguugaaua

SEQ ID NO: 3834584 - RNA, 17 nt, Human
gaauaaugugggaagaa

SEQ ID NO: 3834585 - RNA, 21 nt, Human
gaauaaugugggaagaaacaa

SEQ ID NO: 3834586 - RNA, 15 nt, Human
gaauaauucuuugau

SEQ ID NO: 3834587 - RNA, 14 nt, Human
gaauaauuucccaa

SEQ ID NO: 3834588 - RNA, 23 nt, Human
gaauaauuucccaauuaggaagu

SEQ ID NO: 3834589 - RNA, 21 nt, Human
gaauacagaggcaacugcauu

SEQ ID NO: 3834590 - RNA, 16 nt, Human
gaauacagcagcaaga

SEQ ID NO: 3834591 - RNA, 16 nt, Human
gaauaccacucuguaa

SEQ ID NO: 3834592 - RNA, 19 nt, Human
gaauaccauuaaaacugcu

SEQ ID NO: 3834593 - RNA, 20 nt, Human
gaauaccauuaaaacugcuu

SEQ ID NO: 3834594 - RNA, 21 nt, Human
gaauaccuuagugcaguuauu

SEQ ID NO: 3834595 - RNA, 17 nt, Human
gaauacugcuugaauaa

SEQ ID NO: 3834596 - RNA, 15 nt, Human
gaauacuugaaccau

SEQ ID NO: 3834597 - RNA, 14 nt, Human
gaauacuuuauaaa

SEQ ID NO: 3834598 - RNA, 16 nt, Human
gaauacuuugaaugug

SEQ ID NO: 3834599 - RNA, 18 nt, Human
gaauacuuugaauguguu

SEQ ID NO: 3834600 - RNA, 12 nt, Human
gaauagaaagaa

SEQ ID NO: 3834601 - RNA, 11 nt, Human
gaauagaagga

SEQ ID NO: 3834602 - RNA, 18 nt, Human
gaauagaaggaaacuagc

SEQ ID NO: 3834603 - RNA, 14 nt, Human
gaauagacaucaaa

SEQ ID NO: 3834604 - RNA, 13 nt, Human
gaauagcaucugu

SEQ ID NO: 3834605 - RNA, 15 nt, Human
gaauagcaugucacu

SEQ ID NO: 3834606 - RNA, 15 nt, Human
gaauagccacauuug

SEQ ID NO: 3834607 - RNA, 18 nt, Human
gaauagccacauuuggaa

SEQ ID NO: 3834608 - RNA, 22 nt, Human
gaauagcuuuaaugauaugcuu

SEQ ID NO: 3834609 - RNA, 20 nt, Human
gaauaguauccuccagguuu

SEQ ID NO: 3834610 - RNA, 21 nt, Human
gaauaguauccuccagguuuu

SEQ ID NO: 3834611 - RNA, 23 nt, Human
gaauaguugaaccuauuucucuu

SEQ ID NO: 3834612 - RNA, 14 nt, Human
gaauauaaacacua

SEQ ID NO: 3834613 - RNA, 14 nt, Human
gaauauaaaugugu

SEQ ID NO: 3834614 - RNA, 13 nt, Human
gaauauaacauga

SEQ ID NO: 3834615 - RNA, 20 nt, Human
gaauauaauauauuugugua

SEQ ID NO: 3834616 - RNA, 22 nt, Human
gaauauacaugaagaauagaaa

SEQ ID NO: 3834617 - RNA, 20 nt, Human
gaauauaggucucuucuccc

SEQ ID NO: 3834618 - RNA, 22 nt, Human
gaauauaggucucuucucccag

SEQ ID NO: 3834619 - RNA, 21 nt, Human
gaauauauaguguauagaagc

SEQ ID NO: 3834620 - RNA, 12 nt, Human
cucaccauucca

SEQ ID NO: 3834621 - RNA, 20 nt, Human
cucaccauuuccccagggca

SEQ ID NO: 3834622 - RNA, 21 nt, Human
cucaccauuuccccagggcac

SEQ ID NO: 3834623 - RNA, 17 nt, Human
cucacccaccccugcac

SEQ ID NO: 3834624 - RNA, 12 nt, Human
cucacccagucc

SEQ ID NO: 3834625 - RNA, 14 nt, Human
cucacccauccuag

SEQ ID NO: 3834626 - RNA, 21 nt, Human
cucacccaugcaagcagagga

SEQ ID NO: 3834627 - RNA, 23 nt, Human
cucaccccagacuccugacuguc

SEQ ID NO: 3834628 - RNA, 12 nt, Human
cucaccccaucc

SEQ ID NO: 3834629 - RNA, 22 nt, Human
cucaccccaucccacacccugg

SEQ ID NO: 3834630 - RNA, 22 nt, Human
cucacccccaaggggcagucug

SEQ ID NO: 3834631 - RNA, 17 nt, Human
cucacccccagcuuugc

SEQ ID NO: 3834632 - RNA, 19 nt, Human
cucaccccccacacucacu

SEQ ID NO: 3834633 - RNA, 20 nt, Human
cucaccccccacacucacuc

SEQ ID NO: 3834634 - RNA, 15 nt, Human
cucacccccucccac

SEQ ID NO: 3834635 - RNA, 14 nt, Human
cucacccccucggg

SEQ ID NO: 3834636 - RNA, 19 nt, Human
cucacccccuucuccaucc

SEQ ID NO: 3834637 - RNA, 20 nt, Human
cucacccccuucuccaucca

SEQ ID NO: 3834638 - RNA, 16 nt, Human
cucaccccgaggcccu

SEQ ID NO: 3834639 - RNA, 17 nt, Human
cucaccccgaggcccug

SEQ ID NO: 3834640 - RNA, 19 nt, Human
cucaccccgaggcccugca

SEQ ID NO: 3834641 - RNA, 15 nt, Human
cucaccccgucuggg

SEQ ID NO: 3834642 - RNA, 20 nt, Human
cucaccccguuacagcuccc

SEQ ID NO: 3834643 - RNA, 15 nt, Human
cucaccccugcccug

SEQ ID NO: 3834644 - RNA, 16 nt, Human
cucaccccugcccugg

SEQ ID NO: 3834645 - RNA, 14 nt, Human
cucaccccugguuc

SEQ ID NO: 3834646 - RNA, 23 nt, Human
cucaccccugguucucaucuuuc

SEQ ID NO: 3834647 - RNA, 13 nt, Human
cucaccccugucc

SEQ ID NO: 3834648 - RNA, 18 nt, Human
cucaccccuguccucacu

SEQ ID NO: 3834649 - RNA, 21 nt, Human
cucacccgccccacucccucc

SEQ ID NO: 3834650 - RNA, 19 nt, Human
cucacccugagccccuucc

SEQ ID NO: 3834651 - RNA, 20 nt, Human
cucacccugagccccuuccu

SEQ ID NO: 3834652 - RNA, 13 nt, Human
cucacccugccuu

SEQ ID NO: 3834653 - RNA, 15 nt, Human
cucacccugccuuau

SEQ ID NO: 3834654 - RNA, 21 nt, Human
cucacccugccuuaucuugca

SEQ ID NO: 3834655 - RNA, 14 nt, Human
cucacccuggggcu

SEQ ID NO: 3834656 - RNA, 14 nt, Human
cucaccgcccauca

SEQ ID NO: 3834657 - RNA, 18 nt, Human
cucaccgcuucccuccug

SEQ ID NO: 3834658 - RNA, 15 nt, Human
cucaccuagagccag

SEQ ID NO: 3834659 - RNA, 17 nt, Human
cucaccuagagccagac

SEQ ID NO: 3834660 - RNA, 15 nt, Human
cucaccuagccugau

SEQ ID NO: 3834661 - RNA, 15 nt, Human
cucaccucaugccca

SEQ ID NO: 3834662 - RNA, 17 nt, Human
cucaccucaugcccacc

SEQ ID NO: 3834663 - RNA, 16 nt, Human
cucaccucuaaaacag

SEQ ID NO: 3834664 - RNA, 19 nt, Human
cucaccucuacccaaaccc

SEQ ID NO: 3834665 - RNA, 16 nt, Human
cucaccucugccucaa

SEQ ID NO: 3834666 - RNA, 18 nt, Human
cucaccucugccucaaug

SEQ ID NO: 3834667 - RNA, 14 nt, Human
cucaccugccccuc

SEQ ID NO: 3834668 - RNA, 19 nt, Human
cucaccugcuggccccuca

SEQ ID NO: 3834669 - RNA, 20 nt, Human
cucaccuggggcugcuggcc

SEQ ID NO: 3834670 - RNA, 21 nt, Human
cucaccuggggugugggaggc

SEQ ID NO: 3834671 - RNA, 17 nt, Human
cucaccuguugcuuaca

SEQ ID NO: 3834672 - RNA, 15 nt, Human
cucaccuuccucauc

SEQ ID NO: 3834673 - RNA, 20 nt, Human
cucaccuugaacaccacgcu

SEQ ID NO: 3834674 - RNA, 18 nt, Human
cucaccuugcaacacaca

SEQ ID NO: 3834675 - RNA, 19 nt, Human
cucaccuugcaacacacag

SEQ ID NO: 3834676 - RNA, 17 nt, Human
cucaccuuggcaccaga

SEQ ID NO: 3834677 - RNA, 19 nt, Human
cucaccuuggcaccagaca

SEQ ID NO: 3834678 - RNA, 21 nt, Human
cucaccuugugcuggggacag

SEQ ID NO: 3834679 - RNA, 20 nt, Human
cucacgaauauuaugcccag

SEQ ID NO: 3834680 - RNA, 15 nt, Human
cucacgcauucucug

SEQ ID NO: 3834681 - RNA, 22 nt, Human
cucacgccuguaaucccagcag

SEQ ID NO: 3834682 - RNA, 21 nt, Human
cucacggccacacagcugccg

SEQ ID NO: 3834683 - RNA, 17 nt, Human
cucacgggcaugggcac

SEQ ID NO: 3834684 - RNA, 14 nt, Human
cucacguccugaga

SEQ ID NO: 3834685 - RNA, 15 nt, Human
cucacguccugagaa

SEQ ID NO: 3834686 - RNA, 22 nt, Human
cucacgucuguaaucccagcgc

SEQ ID NO: 3834687 - RNA, 16 nt, Human
cucacgugagaguguc

SEQ ID NO: 3834688 - RNA, 20 nt, Human
cucacuaaagcaugaaaugu

SEQ ID NO: 3834689 - RNA, 17 nt, Human
cucacuaccuccucagg

SEQ ID NO: 3834690 - RNA, 18 nt, Human
cucacuaccuccucaggg

SEQ ID NO: 3834691 - RNA, 18 nt, Human
cucacuaggcccccacuu

SEQ ID NO: 3834692 - RNA, 17 nt, Human
cucacuauaccaguaua

SEQ ID NO: 3834693 - RNA, 20 nt, Human
cucacuauguugcccaggca

SEQ ID NO: 3834694 - RNA, 21 nt, Human
cucacuauguugcccaggcag

SEQ ID NO: 3834695 - RNA, 20 nt, Human
cucacucagaaguccagagu

SEQ ID NO: 3834696 - RNA, 22 nt, Human
gaaucuggaccccaucugugaa

SEQ ID NO: 3834697 - RNA, 23 nt, Human
gaaucuggaccccaucugugaau

SEQ ID NO: 3834698 - RNA, 17 nt, Human
gaaucuguaugauucua

SEQ ID NO: 3834699 - RNA, 20 nt, Human
gaaucugugggucugggagu

SEQ ID NO: 3834700 - RNA, 14 nt, Human
gaaucuugucucaa

SEQ ID NO: 3834701 - RNA, 16 nt, Human
gaaucuugucucaaug

SEQ ID NO: 3834702 - RNA, 21 nt, Human
gaaucuugucucaaugcucau

SEQ ID NO: 3834703 - RNA, 23 nt, Human
gaaucuuuagagaaguauacaua

SEQ ID NO: 3834704 - RNA, 12 nt, Human
gaaugaaaaaug

SEQ ID NO: 3834705 - RNA, 17 nt, Human
gaaugaaaaaugaaaga

SEQ ID NO: 3834706 - RNA, 19 nt, Human
gaaugaaaaauuuaagcau

SEQ ID NO: 3834707 - RNA, 20 nt, Human
gaaugaaaaauuuaagcauu

SEQ ID NO: 3834708 - RNA, 23 nt, Human
gaaugaaaaauuuaagcauuguu

SEQ ID NO: 3834709 - RNA, 13 nt, Human
gaaugaaaagaca

SEQ ID NO: 3834710 - RNA, 13 nt, Human
gaaugaaaauaac

SEQ ID NO: 3834711 - RNA, 23 nt, Human
gaaugaaaauaacugaauuugga

SEQ ID NO: 3834712 - RNA, 19 nt, Human
gaaugaaacccccacacac

SEQ ID NO: 3834713 - RNA, 20 nt, Human
gaaugaaagucuugugacua

SEQ ID NO: 3834714 - RNA, 23 nt, Human
gaaugaaagucuugugacuagug

SEQ ID NO: 3834715 - RNA, 19 nt, Human
gaaugaaauacuguuugag

SEQ ID NO: 3834716 - RNA, 14 nt, Human
gaaugaaauguaug

SEQ ID NO: 3834717 - RNA, 18 nt, Human
gaaugaacaaccucggcu

SEQ ID NO: 3834718 - RNA, 15 nt, Human
gaaugaaccacugcc

SEQ ID NO: 3834719 - RNA, 15 nt, Human
gaaugaaccuucugg

SEQ ID NO: 3834720 - RNA, 19 nt, Human
gaaugaagauacugaaaua

SEQ ID NO: 3834721 - RNA, 17 nt, Human
gaaugaagcaguauuuu

SEQ ID NO: 3834722 - RNA, 20 nt, Human
gaaugaagcuuguguaucca

SEQ ID NO: 3834723 - RNA, 17 nt, Human
gaaugaaggugucagaa

SEQ ID NO: 3834724 - RNA, 15 nt, Human
gaaugaauggcuaag

SEQ ID NO: 3834725 - RNA, 11 nt, Human
gaaugaauguc

SEQ ID NO: 3834726 - RNA, 14 nt, Human
gaaugaauuaaaua

SEQ ID NO: 3834727 - RNA, 13 nt, Human
gaaugacaaagag

SEQ ID NO: 3834728 - RNA, 21 nt, Human
gaaugaccuuguaauguaacu

SEQ ID NO: 3834729 - RNA, 22 nt, Human
gaaugacuaagaggaaaguaca

SEQ ID NO: 3834730 - RNA, 13 nt, Human
gaaugacucguuu

SEQ ID NO: 3834731 - RNA, 14 nt, Human
gaaugagaaaugga

SEQ ID NO: 3834732 - RNA, 15 nt, Human
gaaugagacauccag

SEQ ID NO: 3834733 - RNA, 14 nt, Human
gaaugagcccagag

SEQ ID NO: 3834734 - RNA, 19 nt, Human
gaaugagcccagagaacag

SEQ ID NO: 3834735 - RNA, 13 nt, Human
gaaugagccucgg

SEQ ID NO: 3834736 - RNA, 16 nt, Human
gaaugagggggcucag

SEQ ID NO: 3834737 - RNA, 21 nt, Human
gaaugaggucccaggcagaga

SEQ ID NO: 3834738 - RNA, 22 nt, Human
gaaugaggucccaggcagagaa

SEQ ID NO: 3834739 - RNA, 15 nt, Human
gaaugaggugggagg

SEQ ID NO: 3834740 - RNA, 22 nt, Human
gaaugaggugggagguggaaga

SEQ ID NO: 3834741 - RNA, 21 nt, Human
gaaugagucuguuguguguca

SEQ ID NO: 3834742 - RNA, 16 nt, Human
gaaugaguugaggcca

SEQ ID NO: 3834743 - RNA, 13 nt, Human
gaaugaucugauu

SEQ ID NO: 3834744 - RNA, 18 nt, Human
gaaugaucuuucuuuccu

SEQ ID NO: 3834745 - RNA, 20 nt, Human
gaaugaugauccuaggcauu

SEQ ID NO: 3834746 - RNA, 15 nt, Human
gaaugauucaguguu

SEQ ID NO: 3834747 - RNA, 19 nt, Human
gaaugauucauguuauauu

SEQ ID NO: 3834748 - RNA, 20 nt, Human
gaaugauucauguuauauuu

SEQ ID NO: 3834749 - RNA, 16 nt, Human
gaaugauuuccaaaga

SEQ ID NO: 3834750 - RNA, 20 nt, Human
gaaugauuuccaaagagaaa

SEQ ID NO: 3834751 - RNA, 14 nt, Human
gaaugauuuuuaga

SEQ ID NO: 3834752 - RNA, 16 nt, Human
gaaugauuuuucuuua

SEQ ID NO: 3834753 - RNA, 20 nt, Human
gaaugcacaagaauggauca

SEQ ID NO: 3834754 - RNA, 20 nt, Human
gaaugcacacuagccucucc

SEQ ID NO: 3834755 - RNA, 22 nt, Human
gaaugcacacuagccucuccag

SEQ ID NO: 3834756 - RNA, 13 nt, Human
gaaugcacucaga

SEQ ID NO: 3834757 - RNA, 11 nt, Human
gaaugcagugg

SEQ ID NO: 3834758 - RNA, 18 nt, Human
gaaugcaugcuuuccaua

SEQ ID NO: 3834759 - RNA, 20 nt, Human
gaaugcauugauauugugaa

SEQ ID NO: 3834760 - RNA, 17 nt, Human
gaaugcccccagcuggc

SEQ ID NO: 3834761 - RNA, 14 nt, Human
gaaugccguggauu

SEQ ID NO: 3834762 - RNA, 22 nt, Human
gaaugccucaaugugaccaggg

SEQ ID NO: 3834763 - RNA, 17 nt, Human
gaaugccuccugugggg

SEQ ID NO: 3834764 - RNA, 17 nt, Human
gacagagacaccugcac

SEQ ID NO: 3834765 - RNA, 21 nt, Human
gacagagacaccugcaccucc

SEQ ID NO: 3834766 - RNA, 18 nt, Human
gacagagaggacgugggc

SEQ ID NO: 3834767 - RNA, 19 nt, Human
gacagagccaugcugggaa

SEQ ID NO: 3834768 - RNA, 17 nt, Human
gacagagcccugugagg

SEQ ID NO: 3834769 - RNA, 21 nt, Human
gacagagccugccccagcgcu

SEQ ID NO: 3834770 - RNA, 17 nt, Human
gacagagcgacagagca

SEQ ID NO: 3834771 - RNA, 15 nt, Human
gacagaggaugagcu

SEQ ID NO: 3834772 - RNA, 16 nt, Human
gacagaggcagcccca

SEQ ID NO: 3834773 - RNA, 18 nt, Human
gacagaggccccagccuc

SEQ ID NO: 3834774 - RNA, 15 nt, Human
gacagaggccugccc

SEQ ID NO: 3834775 - RNA, 16 nt, Human
gacagagggaagaaaa

SEQ ID NO: 3834776 - RNA, 16 nt, Human
gacagaggggacucug

SEQ ID NO: 3834777 - RNA, 20 nt, Human
gacagaggggacucugggcu

SEQ ID NO: 3834778 - RNA, 21 nt, Human
gacagaggggacucugggcua

SEQ ID NO: 3834779 - RNA, 15 nt, Human
gacagaggggguggc

SEQ ID NO: 3834780 - RNA, 19 nt, Human
gacagaggggguggccucc

SEQ ID NO: 3834781 - RNA, 23 nt, Human
gacagaggggguggccucccaac

SEQ ID NO: 3834782 - RNA, 20 nt, Human
gacagagggucacaguguuu

SEQ ID NO: 3834783 - RNA, 16 nt, Human
gacagaguaugaacac

SEQ ID NO: 3834784 - RNA, 16 nt, Human
gacagagugagacucu

SEQ ID NO: 3834785 - RNA, 20 nt, Human
gacagagugagacucugucu

SEQ ID NO: 3834786 - RNA, 22 nt, Human
gacagagugagacucugucuca

SEQ ID NO: 3834787 - RNA, 13 nt, Human
gacagauaacucu

SEQ ID NO: 3834788 - RNA, 14 nt, Human
gacagaucaagcug

SEQ ID NO: 3834789 - RNA, 17 nt, Human
gacagaucaagcuguga

SEQ ID NO: 3834790 - RNA, 20 nt, Human
gacagaucaagcugugagac

SEQ ID NO: 3834791 - RNA, 20 nt, Human
gacagaucauagauuucuga

SEQ ID NO: 3834792 - RNA, 15 nt, Human
gacagauccccguuc

SEQ ID NO: 3834793 - RNA, 21 nt, Human
gacagaucucugcuuuggaaa

SEQ ID NO: 3834794 - RNA, 15 nt, Human
gacagaugaggcuuu

SEQ ID NO: 3834795 - RNA, 19 nt, Human
gacagaugccccagagcug

SEQ ID NO: 3834796 - RNA, 22 nt, Human
gacagcaaaaccauugcuucac

SEQ ID NO: 3834797 - RNA, 20 nt, Human
gacagcagaacugcuauuuu

SEQ ID NO: 3834798 - RNA, 19 nt, Human
gacagcagcaucucuaccu

SEQ ID NO: 3834799 - RNA, 12 nt, Human
gacagcaggugg

SEQ ID NO: 3834800 - RNA, 22 nt, Human
gacagcagucuuaugcuuccag

SEQ ID NO: 3834801 - RNA, 18 nt, Human
gacagcauggugcaugcc

SEQ ID NO: 3834802 - RNA, 13 nt, Human
gacagcaugugcc

SEQ ID NO: 3834803 - RNA, 18 nt, Human
gacagcaugugcccuccu

SEQ ID NO: 3834804 - RNA, 18 nt, Human
gacagccaaaggcuggcg

SEQ ID NO: 3834805 - RNA, 19 nt, Human
gacagccaacuauggccug

SEQ ID NO: 3834806 - RNA, 18 nt, Human
gacagccacggccaggcc

SEQ ID NO: 3834807 - RNA, 19 nt, Human
gacagccacggccaggcca

SEQ ID NO: 3834808 - RNA, 13 nt, Human
gacagccagaacu

SEQ ID NO: 3834809 - RNA, 13 nt, Human
gacagcccagagc

SEQ ID NO: 3834810 - RNA, 15 nt, Human
gacagcccagagccu

SEQ ID NO: 3834811 - RNA, 17 nt, Human
gacagcccagagccugg

SEQ ID NO: 3834812 - RNA, 18 nt, Human
gacagccccagagcaggg

SEQ ID NO: 3834813 - RNA, 20 nt, Human
gacagccccagagcagggug

SEQ ID NO: 3834814 - RNA, 14 nt, Human
gacagcccgggcuc

SEQ ID NO: 3834815 - RNA, 16 nt, Human
gacagcccgggcucug

SEQ ID NO: 3834816 - RNA, 18 nt, Human
gacagcccgggcucugcc

SEQ ID NO: 3834817 - RNA, 21 nt, Human
gacagcccgggcucugccucc

SEQ ID NO: 3834818 - RNA, 23 nt, Human
gacagcccgggcucugccuccca

SEQ ID NO: 3834819 - RNA, 11 nt, Human
gacagccuccc

SEQ ID NO: 3834820 - RNA, 18 nt, Human
gacagccugcagcaggaa

SEQ ID NO: 3834821 - RNA, 13 nt, Human
gacagccuggcac

SEQ ID NO: 3834822 - RNA, 15 nt, Human
gacagcgcacagcug

SEQ ID NO: 3834823 - RNA, 18 nt, Human
gacagcuacacagagcuu

SEQ ID NO: 3834824 - RNA, 11 nt, Human
gacagcuccuu

SEQ ID NO: 3834825 - RNA, 13 nt, Human
gacagcuccuucu

SEQ ID NO: 3834826 - RNA, 19 nt, Human
gacagcuccuucuguccua

SEQ ID NO: 3834827 - RNA, 10 nt, Human
gacagcucuu

SEQ ID NO: 3834828 - RNA, 11 nt, Human
gacagcucuua

SEQ ID NO: 3834829 - RNA, 16 nt, Human
gacagcucuuuuugug

SEQ ID NO: 3834830 - RNA, 15 nt, Human
gacagcugccuggga

SEQ ID NO: 3834831 - RNA, 17 nt, Human
gacagcugccugggauc

SEQ ID NO: 3834832 - RNA, 22 nt, Human
gacagcugucccugucaccaag

SEQ ID NO: 3834833 - RNA, 15 nt, Human
gacagcugugcugua

SEQ ID NO: 3834834 - RNA, 23 nt, Human
gacagcuuagaauuauuugcacu

SEQ ID NO: 3834835 - RNA, 20 nt, Human
gacagcuuguaggggagggg

SEQ ID NO: 3834836 - RNA, 21 nt, Human
gacagcuuguggcaagugaau

SEQ ID NO: 3834837 - RNA, 20 nt, Human
gacagcuuuccccucauuuu

SEQ ID NO: 3834838 - RNA, 15 nt, Human
gacagcuuuucucaa

SEQ ID NO: 3834839 - RNA, 18 nt, Human
gacaggaaaauccucugg

SEQ ID NO: 3834840 - RNA, 14 nt, Human
gacaggacagugcu

SEQ ID NO: 3834841 - RNA, 23 nt, Human
gacaggaccagggauuuccauga

SEQ ID NO: 3834842 - RNA, 14 nt, Human
gacaggaccccagc

SEQ ID NO: 3834843 - RNA, 18 nt, Human
gacaggaccccagcucug

SEQ ID NO: 3834844 - RNA, 19 nt, Human
gacaggaccccagcucugc

SEQ ID NO: 3834845 - RNA, 14 nt, Human
gacaggaccuagga

SEQ ID NO: 3834846 - RNA, 15 nt, Human
gacaggaccugacua

SEQ ID NO: 3834847 - RNA, 13 nt, Human
gacaggacgcuga

SEQ ID NO: 3834848 - RNA, 20 nt, Human
gacaggacgggcuugggcuu

SEQ ID NO: 3834849 - RNA, 19 nt, Human
gacaggacuaacacucaga

SEQ ID NO: 3834850 - RNA, 24 nt, Human
gacaggacuaacacucagaagccu

SEQ ID NO: 3834851 - RNA, 24 nt, Human
gacaggagaaaugcauccauuccu

SEQ ID NO: 3834852 - RNA, 17 nt, Human
gacaggagaugcugugc

SEQ ID NO: 3834853 - RNA, 19 nt, Human
gacaggagaugcugugccc

SEQ ID NO: 3834854 - RNA, 17 nt, Human
gacaggagggcaagggc

SEQ ID NO: 3834855 - RNA, 18 nt, Human
gacaggauguguuugcuu

SEQ ID NO: 3834856 - RNA, 16 nt, Human
gacaggcaaugcuggc

SEQ ID NO: 3834857 - RNA, 19 nt, Human
gacaggcaaugcuggcugu

SEQ ID NO: 3834858 - RNA, 23 nt, Human
gacaggcaaugcuggcuguuggc

SEQ ID NO: 3834859 - RNA, 15 nt, Human
cucacucagcaccac

SEQ ID NO: 3834860 - RNA, 16 nt, Human
cucacucagcaccacu

SEQ ID NO: 3834861 - RNA, 19 nt, Human
cucacucagcacuuggccc

SEQ ID NO: 3834862 - RNA, 22 nt, Human
cucacucagccacccugaguug

SEQ ID NO: 3834863 - RNA, 17 nt, Human
cucacuccaccacccaa

SEQ ID NO: 3834864 - RNA, 19 nt, Human
cucacuccccagccugggc

SEQ ID NO: 3834865 - RNA, 12 nt, Human
cucacuccccau

SEQ ID NO: 3834866 - RNA, 22 nt, Human
cucacuccccuccuuucccaac

SEQ ID NO: 3834867 - RNA, 21 nt, Human
cucacucccuucccauaagcu

SEQ ID NO: 3834868 - RNA, 13 nt, Human
cucacuccuaccu

SEQ ID NO: 3834869 - RNA, 12 nt, Human
cucacuccugag

SEQ ID NO: 3834870 - RNA, 14 nt, Human
cucacuccugagac

SEQ ID NO: 3834871 - RNA, 22 nt, Human
cucacuccugagaccccuggcc

SEQ ID NO: 3834872 - RNA, 11 nt, Human
cucacuccugu

SEQ ID NO: 3834873 - RNA, 15 nt, Human
cucacuccuuuuaaa

SEQ ID NO: 3834874 - RNA, 21 nt, Human
cucacucucaggaaaugcuga

SEQ ID NO: 3834875 - RNA, 12 nt, Human
cucacucugcca

SEQ ID NO: 3834876 - RNA, 18 nt, Human
cucacucugccagggcag

SEQ ID NO: 3834877 - RNA, 21 nt, Human
cucacucugcuaccuugcccc

SEQ ID NO: 3834878 - RNA, 15 nt, Human
cucacucugggcugu

SEQ ID NO: 3834879 - RNA, 22 nt, Human
cucacucugucgcccagucugg

SEQ ID NO: 3834880 - RNA, 21 nt, Human
cucacugaaaacaucuggaag

SEQ ID NO: 3834881 - RNA, 14 nt, Human
cucacugaaaccag

SEQ ID NO: 3834882 - RNA, 15 nt, Human
cucacugaagccugc

SEQ ID NO: 3834883 - RNA, 23 nt, Human
cucacugaagccugcguuggucc

SEQ ID NO: 3834884 - RNA, 22 nt, Human
cucacugagaagauugugaaua

SEQ ID NO: 3834885 - RNA, 22 nt, Human
cucacugauauauuuuccaggg

SEQ ID NO: 3834886 - RNA, 13 nt, Human
cucacugcagccu

SEQ ID NO: 3834887 - RNA, 16 nt, Human
cucacugcagccucaa

SEQ ID NO: 3834888 - RNA, 15 nt, Human
cucacugccaggcca

SEQ ID NO: 3834889 - RNA, 18 nt, Human
cucacugccaggccagcc

SEQ ID NO: 3834890 - RNA, 12 nt, Human
cucacugcccgc

SEQ ID NO: 3834891 - RNA, 20 nt, Human
cucacugcccgcacacccuc

SEQ ID NO: 3834892 - RNA, 13 nt, Human
cucacugccuccc

SEQ ID NO: 3834893 - RNA, 20 nt, Human
cucacugcuaagaauauuug

SEQ ID NO: 3834894 - RNA, 21 nt, Human
cucacugcuaagaauauuuga

SEQ ID NO: 3834895 - RNA, 22 nt, Human
cucacugcuaagaauauuugaa

SEQ ID NO: 3834896 - RNA, 20 nt, Human
cucacugcucaagaagacau

SEQ ID NO: 3834897 - RNA, 19 nt, Human
cucacugcucccugaagcc

SEQ ID NO: 3834898 - RNA, 23 nt, Human
cucacugcucccugaagccagcc

SEQ ID NO: 3834899 - RNA, 16 nt, Human
cucacugcuugaacua

SEQ ID NO: 3834900 - RNA, 19 nt, Human
cucacuggcagccccagca

SEQ ID NO: 3834901 - RNA, 13 nt, Human
cucacuggggccu

SEQ ID NO: 3834902 - RNA, 16 nt, Human
cucacuggggccuaca

SEQ ID NO: 3834903 - RNA, 18 nt, Human
cucacuggggccuacagc

SEQ ID NO: 3834904 - RNA, 22 nt, Human
cucacugggguccuggggccuc

SEQ ID NO: 3834905 - RNA, 23 nt, Human
cucacugugggaaggccagcugc

SEQ ID NO: 3834906 - RNA, 19 nt, Human
cucacugugguaaaugcca

SEQ ID NO: 3834907 - RNA, 20 nt, Human
cucacuguucccucugcucc

SEQ ID NO: 3834908 - RNA, 16 nt, Human
gacccaaaaggcagaa

SEQ ID NO: 3834909 - RNA, 18 nt, Human
gaccuacuguucuaaagc

SEQ ID NO: 3834910 - RNA, 16 nt, Human
gaccuaggcaguaggc

SEQ ID NO: 3834911 - RNA, 21 nt, Human
gaccuagggauguucuggccc

SEQ ID NO: 3834912 - RNA, 23 nt, Human
gaccuauaaaucauuaagacaac

SEQ ID NO: 3834913 - RNA, 15 nt, Human
gaccuaucacuucca

SEQ ID NO: 3834914 - RNA, 13 nt, Human
gaccuauguuugc

SEQ ID NO: 3834915 - RNA, 13 nt, Human
gaccucaaccugu

SEQ ID NO: 3834916 - RNA, 23 nt, Human
gaccucaaguaauccaccugccu

SEQ ID NO: 3834917 - RNA, 21 nt, Human
gaccucaccaagcugcugugg

SEQ ID NO: 3834918 - RNA, 13 nt, Human
gaccucagaagua

SEQ ID NO: 3834919 - RNA, 14 nt, Human
gaccucagagucca

SEQ ID NO: 3834920 - RNA, 11 nt, Human
gaccucagcca

SEQ ID NO: 3834921 - RNA, 20 nt, Human
gaccucagccuuccccuugc

SEQ ID NO: 3834922 - RNA, 14 nt, Human
gaccucaggccugg

SEQ ID NO: 3834923 - RNA, 23 nt, Human
gaccucagguaaucgaccugccu

SEQ ID NO: 3834924 - RNA, 20 nt, Human
gaccucaggugauccaccca

SEQ ID NO: 3834925 - RNA, 21 nt, Human
gaccucaugcaucuccaccug

SEQ ID NO: 3834926 - RNA, 16 nt, Human
gaccuccaagccacug

SEQ ID NO: 3834927 - RNA, 14 nt, Human
gaccuccagcuguu

SEQ ID NO: 3834928 - RNA, 16 nt, Human
gaccuccagcuuuccu

SEQ ID NO: 3834929 - RNA, 15 nt, Human
gaccucccagcccua

SEQ ID NO: 3834930 - RNA, 23 nt, Human
gaccucccagcccuauggaugug

SEQ ID NO: 3834931 - RNA, 13 nt, Human
gaccuccccagcc

SEQ ID NO: 3834932 - RNA, 14 nt, Human
gaccuccccagccc

SEQ ID NO: 3834933 - RNA, 16 nt, Human
gaccuccccugaggcu

SEQ ID NO: 3834934 - RNA, 22 nt, Human
gaccuccggccaggugccuccu

SEQ ID NO: 3834935 - RNA, 12 nt, Human
gaccuccugccu

SEQ ID NO: 3834936 - RNA, 14 nt, Human
gaccuccugccucc

SEQ ID NO: 3834937 - RNA, 17 nt, Human
gaccucguccucccccu

SEQ ID NO: 3834938 - RNA, 18 nt, Human
gaccucuagcccugcccg

SEQ ID NO: 3834939 - RNA, 14 nt, Human
gaccucucccaggg

SEQ ID NO: 3834940 - RNA, 13 nt, Human
gaccucugccuga

SEQ ID NO: 3834941 - RNA, 16 nt, Human
gaccucugcucugagg

SEQ ID NO: 3834942 - RNA, 11 nt, Human
gaccucugggc

SEQ ID NO: 3834943 - RNA, 14 nt, Human
gaccucuguugucc

SEQ ID NO: 3834944 - RNA, 13 nt, Human
gaccucuugcugu

SEQ ID NO: 3834945 - RNA, 15 nt, Human
gaccugaaauuccaa

SEQ ID NO: 3834946 - RNA, 23 nt, Human
gaccugaaauuccaaagucucua

SEQ ID NO: 3834947 - RNA, 13 nt, Human
gaccugaaguuca

SEQ ID NO: 3834948 - RNA, 22 nt, Human
gaccugaaguucaccauuaaaa

SEQ ID NO: 3834949 - RNA, 11 nt, Human
gaccugagccu

SEQ ID NO: 3834950 - RNA, 14 nt, Human
gaccugaggaagcg

SEQ ID NO: 3834951 - RNA, 19 nt, Human
gaccugaggacauggcuuc

SEQ ID NO: 3834952 - RNA, 18 nt, Human
gaccugaggcccuucucu

SEQ ID NO: 3834953 - RNA, 13 nt, Human
gaccugaggcugu

SEQ ID NO: 3834954 - RNA, 14 nt, Human
gaccugaggcugug

SEQ ID NO: 3834955 - RNA, 15 nt, Human
gaccugauccuggag

SEQ ID NO: 3834956 - RNA, 21 nt, Human
gaccugauccuggaggcccag

SEQ ID NO: 3834957 - RNA, 23 nt, Human
gaccugauuucugagcauuuaau

SEQ ID NO: 3834958 - RNA, 20 nt, Human
gaccugcacuggggagcccg

SEQ ID NO: 3834959 - RNA, 13 nt, Human
gaccugcaggcca

SEQ ID NO: 3834960 - RNA, 16 nt, Human
gaccugccaggcaggg

SEQ ID NO: 3834961 - RNA, 17 nt, Human
gaccugccaggcagggg

SEQ ID NO: 3834962 - RNA, 20 nt, Human
gaccugccaggcaggggugg

SEQ ID NO: 3834963 - RNA, 22 nt, Human
gaccugccucccuucaugcaug

SEQ ID NO: 3834964 - RNA, 14 nt, Human
gaccugccuccugc

SEQ ID NO: 3834965 - RNA, 16 nt, Human
gaccugccuccugccu

SEQ ID NO: 3834966 - RNA, 20 nt, Human
gaccugccucucacacacau

SEQ ID NO: 3834967 - RNA, 12 nt, Human
gaccugccugua

SEQ ID NO: 3834968 - RNA, 19 nt, Human
gaccugcuaggccagagcc

SEQ ID NO: 3834969 - RNA, 21 nt, Human
gaccugcuaggccagagccca

SEQ ID NO: 3834970 - RNA, 19 nt, Human
gaccugcuccgcugcuccu

SEQ ID NO: 3834971 - RNA, 20 nt, Human
gaccugcugaaguccggaac

SEQ ID NO: 3834972 - RNA, 11 nt, Human
gaccugcugag

SEQ ID NO: 3834973 - RNA, 14 nt, Human
gaccugcugagcuc

SEQ ID NO: 3834974 - RNA, 22 nt, Human
gaccugcugagcucugagaggc

SEQ ID NO: 3834975 - RNA, 18 nt, Human
gaccugcuuuuugaaaug

SEQ ID NO: 3834976 - RNA, 13 nt, Human
gaccuggagcccc

SEQ ID NO: 3834977 - RNA, 17 nt, Human
gaccuggagccccuggg

SEQ ID NO: 3834978 - RNA, 18 nt, Human
gaccuggagccccugggu

SEQ ID NO: 3834979 - RNA, 17 nt, Human
gaccuggauaacuuagg

SEQ ID NO: 3834980 - RNA, 17 nt, Human
gaccuggcaaggacaca

SEQ ID NO: 3834981 - RNA, 20 nt, Human
gaccuggggcacaguccagg

SEQ ID NO: 3834982 - RNA, 17 nt, Human
gaccugguccacagggc

SEQ ID NO: 3834983 - RNA, 18 nt, Human
gaccugguuaaacaaacc

SEQ ID NO: 3834984 - RNA, 13 nt, Human
gaccugguuuuua

SEQ ID NO: 3834985 - RNA, 21 nt, Human
gaccuguauauuuguaaagcu

SEQ ID NO: 3834986 - RNA, 22 nt, Human
gaccuguauuuaagcaaauacu

SEQ ID NO: 3834987 - RNA, 17 nt, Human
gaccugucaugcccccc

SEQ ID NO: 3834988 - RNA, 15 nt, Human
gaccuguccuccugg

SEQ ID NO: 3834989 - RNA, 23 nt, Human
gaccuguggggauuucucccagc

SEQ ID NO: 3834990 - RNA, 18 nt, Human
gaccuguuagcagacagg

SEQ ID NO: 3834991 - RNA, 21 nt, Human
gaccuuaguguuucugugcau

SEQ ID NO: 3834992 - RNA, 22 nt, Human
gaccuuaucugugcgugaaaca

SEQ ID NO: 3834993 - RNA, 13 nt, Human
gaccuucagcuca

SEQ ID NO: 3834994 - RNA, 18 nt, Human
gaccuucagcucacgcuu

SEQ ID NO: 3834995 - RNA, 17 nt, Human
gaccuuccaagagccug

SEQ ID NO: 3834996 - RNA, 14 nt, Human
gaccuuccucaucc

SEQ ID NO: 3834997 - RNA, 23 nt, Human
gaccuuccucgcagagaggccag

SEQ ID NO: 3834998 - RNA, 17 nt, Human
gaccuuccucuggggcu

SEQ ID NO: 3834999 - RNA, 12 nt, Human
gaccuuccugcc

SEQ ID NO: 3835000 - RNA, 21 nt, Human
gaccuucuccuucaccuuugu

SEQ ID NO: 3835001 - RNA, 17 nt, Human
gaccuugaacuccuggg

SEQ ID NO: 3835002 - RNA, 13 nt, Human
gaccuugggccaa

SEQ ID NO: 3835003 - RNA, 16 nt, Human
gaccuuguaaaagaca

SEQ ID NO: 3835004 - RNA, 15 nt, Human
gaccuuguaauguaa

SEQ ID NO: 3835005 - RNA, 18 nt, Human
gaccuuguagugagccga

SEQ ID NO: 3835006 - RNA, 17 nt, Human
gaccuuguuacuucuga

SEQ ID NO: 3835007 - RNA, 15 nt, Human
gaccuuguucacacu

SEQ ID NO: 3835008 - RNA, 14 nt, Human
gaccuuguugcaug

SEQ ID NO: 3835009 - RNA, 20 nt, Human
gaccuuguugcaugauguau

SEQ ID NO: 3835010 - RNA, 22 nt, Human
gaccuuuagugguggccauuua

SEQ ID NO: 3835011 - RNA, 19 nt, Human
gaccuuucaauaggaaaaa

SEQ ID NO: 3835012 - RNA, 21 nt, Human
gaccuuucaauaggaaaaacu

SEQ ID NO: 3835013 - RNA, 18 nt, Human
gaccuuuccaccacagcc

SEQ ID NO: 3835014 - RNA, 17 nt, Human
gaccuuuugggggaggg

SEQ ID NO: 3835015 - RNA, 17 nt, Human
gaccuuuuucugcacua

SEQ ID NO: 3835016 - RNA, 18 nt, Human
gaccuuuuuuuuuuuucc

SEQ ID NO: 3835017 - RNA, 21 nt, Human
gacgaacauccaaccuuccca

SEQ ID NO: 3835018 - RNA, 21 nt, Human
gacgaacuuccauggcccuca

SEQ ID NO: 3835019 - RNA, 22 nt, Human
gacgacacggucggggcaucug

SEQ ID NO: 3835020 - RNA, 15 nt, Human
gacgacaggcgagag

SEQ ID NO: 3835021 - RNA, 14 nt, Human
gacgaccuuuaccu

SEQ ID NO: 3835022 - RNA, 20 nt, Human
gacgacuguuuucccaacac

SEQ ID NO: 3835023 - RNA, 14 nt, Human
gacgaggcugggcc

SEQ ID NO: 3835024 - RNA, 15 nt, Human
gacgaguugauuucc

SEQ ID NO: 3835025 - RNA, 15 nt, Human
gacgauuccuucucu

SEQ ID NO: 3835026 - RNA, 17 nt, Human
gacgauuccuucucuga

SEQ ID NO: 3835027 - RNA, 18 nt, Human
gacgauuccuucucugaa

SEQ ID NO: 3835028 - RNA, 14 nt, Human
gacgcaccagccca

SEQ ID NO: 3835029 - RNA, 14 nt, Human
gacgcagaccccac

SEQ ID NO: 3835030 - RNA, 19 nt, Human
gacgcagcaggaggccagg

SEQ ID NO: 3835031 - RNA, 15 nt, Human
gacgcauaugaguaa

SEQ ID NO: 3835032 - RNA, 14 nt, Human
gacgccacagccca

SEQ ID NO: 3835033 - RNA, 22 nt, Human
gacgccacagcccagccacgga

SEQ ID NO: 3835034 - RNA, 12 nt, Human
gacgccacccag

SEQ ID NO: 3835035 - RNA, 19 nt, Human
gacgccacucauuucaucu

SEQ ID NO: 3835036 - RNA, 15 nt, Human
gacgccaucccagcc

SEQ ID NO: 3835037 - RNA, 18 nt, Human
gacgcccucuccccaccc

SEQ ID NO: 3835038 - RNA, 21 nt, Human
gacgccggggacagaggccug

SEQ ID NO: 3835039 - RNA, 20 nt, Human
gacgccugcccuccccagag

SEQ ID NO: 3835040 - RNA, 18 nt, Human
gacgcuacccgggaaggg

SEQ ID NO: 3835041 - RNA, 22 nt, Human
gacgcuacccgggaagggggcu

SEQ ID NO: 3835042 - RNA, 23 nt, Human
gacgcuacccgggaagggggcug

SEQ ID NO: 3835043 - RNA, 14 nt, Human
gacgcucucuggcc

SEQ ID NO: 3835044 - RNA, 22 nt, Human
gacgcucugcugugggcacagg

SEQ ID NO: 3835045 - RNA, 13 nt, Human
gacgcugaauaaa

SEQ ID NO: 3835046 - RNA, 17 nt, Human
gacgcugaauaaauguc

SEQ ID NO: 3835047 - RNA, 19 nt, Human
gacgcugauacauaacuaa

SEQ ID NO: 3835048 - RNA, 22 nt, Human
gacgcugauacauaacuaaauu

SEQ ID NO: 3835049 - RNA, 12 nt, Human
gacgcuggcucc

SEQ ID NO: 3835050 - RNA, 20 nt, Human
gacgcugguagagauggagg

SEQ ID NO: 3835051 - RNA, 13 nt, Human
gacgcugugcugc

SEQ ID NO: 3835052 - RNA, 15 nt, Human
gacgcugugcugccc

SEQ ID NO: 3835053 - RNA, 17 nt, Human
gacucagggccccagca

SEQ ID NO: 3835054 - RNA, 18 nt, Human
gacucagggccccagcac

SEQ ID NO: 3835055 - RNA, 17 nt, Human
gacucagggcuccuggg

SEQ ID NO: 3835056 - RNA, 16 nt, Human
gacucaggugggcccu

SEQ ID NO: 3835057 - RNA, 15 nt, Human
gacucagguugucug

SEQ ID NO: 3835058 - RNA, 14 nt, Human
gacucagugcagau

SEQ ID NO: 3835059 - RNA, 14 nt, Human
gacucaucauuugu

SEQ ID NO: 3835060 - RNA, 21 nt, Human
gacucaucuuucccuccuugg

SEQ ID NO: 3835061 - RNA, 13 nt, Human
gacucaugaggag

SEQ ID NO: 3835062 - RNA, 17 nt, Human
gacucauuuuaaaaaau

SEQ ID NO: 3835063 - RNA, 11 nt, Human
gacuccaaaga

SEQ ID NO: 3835064 - RNA, 14 nt, Human
gacuccacccaucc

SEQ ID NO: 3835065 - RNA, 18 nt, Human
gacuccacgauccugcca

SEQ ID NO: 3835066 - RNA, 20 nt, Human
gacuccacgauccugccacc

SEQ ID NO: 3835067 - RNA, 23 nt, Human
gacuccacgauccugccacccug

SEQ ID NO: 3835068 - RNA, 16 nt, Human
gacuccagacucucug

SEQ ID NO: 3835069 - RNA, 16 nt, Human
gacuccagaucugcac

SEQ ID NO: 3835070 - RNA, 13 nt, Human
gacuccagccagc

SEQ ID NO: 3835071 - RNA, 14 nt, Human
gacuccagccagcg

SEQ ID NO: 3835072 - RNA, 20 nt, Human
gacuccagccagcgccuccc

SEQ ID NO: 3835073 - RNA, 15 nt, Human
gacuccaggcagcag

SEQ ID NO: 3835074 - RNA, 11 nt, Human
gacccuguaua

SEQ ID NO: 3835075 - RNA, 19 nt, Human
gacccuguauauagcccag

SEQ ID NO: 3835076 - RNA, 20 nt, Human
gacccugugacauggugccu

SEQ ID NO: 3835077 - RNA, 21 nt, Human
gacccuguugcuaagccccag

SEQ ID NO: 3835078 - RNA, 15 nt, Human
gacccuuauaaaauc

SEQ ID NO: 3835079 - RNA, 21 nt, Human
gacccuuauuacacggaaaac

SEQ ID NO: 3835080 - RNA, 17 nt, Human
gacccuuccagacauac

SEQ ID NO: 3835081 - RNA, 23 nt, Human
gacccuugccgucuaccugaggg

SEQ ID NO: 3835082 - RNA, 20 nt, Human
gacccuuguggucccacccc

SEQ ID NO: 3835083 - RNA, 14 nt, Human
gacccuuuccuucc

SEQ ID NO: 3835084 - RNA, 23 nt, Human
gacccuuuccuuccuucccuggc

SEQ ID NO: 3835085 - RNA, 12 nt, Human
gacccuuuucau

SEQ ID NO: 3835086 - RNA, 16 nt, Human
gaccgcccccuccucu

SEQ ID NO: 3835087 - RNA, 15 nt, Human
gaccgcccccugucu

SEQ ID NO: 3835088 - RNA, 19 nt, Human
gaccgcuacaccacucugg

SEQ ID NO: 3835089 - RNA, 23 nt, Human
gaccgcuacaccacucuggcagc

SEQ ID NO: 3835090 - RNA, 21 nt, Human
gaccgcuuguggggacccagg

SEQ ID NO: 3835091 - RNA, 17 nt, Human
gaccggaagcuccuggu

SEQ ID NO: 3835092 - RNA, 15 nt, Human
gaccggccugccagg

SEQ ID NO: 3835093 - RNA, 17 nt, Human
gaccggccugccaggag

SEQ ID NO: 3835094 - RNA, 19 nt, Human
gaccggcggaccccagcca

SEQ ID NO: 3835095 - RNA, 16 nt, Human
gaccgggcccuggguu

SEQ ID NO: 3835096 - RNA, 14 nt, Human
gaccgugaggccag

SEQ ID NO: 3835097 - RNA, 18 nt, Human
gaccgugaggccagagac

SEQ ID NO: 3835098 - RNA, 13 nt, Human
gaccguggcccug

SEQ ID NO: 3835099 - RNA, 21 nt, Human
gaccgugggcggggccuugcg

SEQ ID NO: 3835100 - RNA, 22 nt, Human
gaccguuauaaagugugccaca

SEQ ID NO: 3835101 - RNA, 20 nt, Human
gaccuaaaauuugcccuccc

SEQ ID NO: 3835102 - RNA, 15 nt, Human
gaccuaaccagggcc

SEQ ID NO: 3835103 - RNA, 18 nt, Human
gaccuaaccagggccaga

SEQ ID NO: 3835104 - RNA, 22 nt, Human
gaccuaaccagggccagaagua

SEQ ID NO: 3835105 - RNA, 14 nt, Human
gaccuaaugcuccu

SEQ ID NO: 3835106 - RNA, 22 nt, Human
gaccuaaugcuccuuguuccua

SEQ ID NO: 3835107 - RNA, 20 nt, Human
gaccuacagggggucuggcu

SEQ ID NO: 3835108 - RNA, 22 nt, Human
gaccuacagggggucuggcugg

SEQ ID NO: 3835109 - RNA, 14 nt, Human
gaccuaccucaggu

SEQ ID NO: 3835110 - RNA, 15 nt, Human
gaccuacuguucuaa

SEQ ID NO: 3835111 - RNA, 20 nt, Human
gaccuaggauaucuucucca

SEQ ID NO: 3835112 - RNA, 17 nt, Human
gaccuagggaggaccuu

SEQ ID NO: 3835113 - RNA, 22 nt, Human
gaccuauguccuaaggacacac

SEQ ID NO: 3835114 - RNA, 23 nt, Human
gaccuauguccuaaggacacacu

SEQ ID NO: 3835115 - RNA, 17 nt, Human
gaccucaccauuuuugu

SEQ ID NO: 3835116 - RNA, 16 nt, Human
gaccucagaaguaaag

SEQ ID NO: 3835117 - RNA, 18 nt, Human
gaccucagaguccaggcc

SEQ ID NO: 3835118 - RNA, 13 nt, Human
gaccucagccuuc

SEQ ID NO: 3835119 - RNA, 13 nt, Human
gaccucaggccug

SEQ ID NO: 3835120 - RNA, 13 nt, Human
gaccucagggcac

SEQ ID NO: 3835121 - RNA, 21 nt, Human
gaccucaguuuuaucauuuuc

SEQ ID NO: 3835122 - RNA, 10 nt, Human
gaccucauca

SEQ ID NO: 3835123 - RNA, 13 nt, Human
gaccucaucagga

SEQ ID NO: 3835124 - RNA, 23 nt, Human
gaccucaucaggaugaacccagg

SEQ ID NO: 3835125 - RNA, 22 nt, Human
gaccucaugcaucuccaccugc

SEQ ID NO: 3835126 - RNA, 19 nt, Human
gaccuccagcuuuccugua

SEQ ID NO: 3835127 - RNA, 21 nt, Human
gaccucccagcccuauggaug

SEQ ID NO: 3835128 - RNA, 12 nt, Human
gaccucccccuc

SEQ ID NO: 3835129 - RNA, 17 nt, Human
gaccucccccuccuucc

SEQ ID NO: 3835130 - RNA, 12 nt, Human
gaccucccuucc

SEQ ID NO: 3835131 - RNA, 20 nt, Human
gaccucccuuccgacccucu

SEQ ID NO: 3835132 - RNA, 17 nt, Human
gaccuccuaacaaguag

SEQ ID NO: 3835133 - RNA, 20 nt, Human
gaccuccucuucccccuucc

SEQ ID NO: 3835134 - RNA, 18 nt, Human
gaccucguccucccccug

SEQ ID NO: 3835135 - RNA, 19 nt, Human
gaccucguccucccccugc

SEQ ID NO: 3835136 - RNA, 21 nt, Human
gaccucguccucccccugcca

SEQ ID NO: 3835137 - RNA, 23 nt, Human
gaccucuauaauugccacugaga

SEQ ID NO: 3835138 - RNA, 12 nt, Human
gaccucucccag

SEQ ID NO: 3835139 - RNA, 22 nt, Human
gaccucuccccuggaacugucu

SEQ ID NO: 3835140 - RNA, 17 nt, Human
gaccucugacagcagca

SEQ ID NO: 3835141 - RNA, 12 nt, Human
gaccucuugcug

SEQ ID NO: 3835142 - RNA, 14 nt, Human
gaccucuugcuguc

SEQ ID NO: 3835143 - RNA, 15 nt, Human
gaccucuugcugucu

SEQ ID NO: 3835144 - RNA, 16 nt, Human
gaccucuugcugucuc

SEQ ID NO: 3835145 - RNA, 17 nt, Human
gaccucuugcugucucu

SEQ ID NO: 3835146 - RNA, 18 nt, Human
gaccucuugcugucucug

SEQ ID NO: 3835147 - RNA, 20 nt, Human
gaccucuugcugucucugcu

SEQ ID NO: 3835148 - RNA, 17 nt, Human
gaccugaaauuccaaag

SEQ ID NO: 3835149 - RNA, 15 nt, Human
gaccugacucaggca

SEQ ID NO: 3835150 - RNA, 15 nt, Human
gaccugagccugccg

SEQ ID NO: 3835151 - RNA, 16 nt, Human
gaccugagccugccga

SEQ ID NO: 3835152 - RNA, 16 nt, Human
gaccugagcuccccac

SEQ ID NO: 3835153 - RNA, 18 nt, Human
gaccugagcuccccacca

SEQ ID NO: 3835154 - RNA, 22 nt, Human
gaccugagcuccccaccacccc

SEQ ID NO: 3835155 - RNA, 22 nt, Human
gaccugaggacauggcuucuga

SEQ ID NO: 3835156 - RNA, 11 nt, Human
gaccugaggcc

SEQ ID NO: 3835157 - RNA, 14 nt, Human
gaccugaggcccuu

SEQ ID NO: 3835158 - RNA, 15 nt, Human
gaccugaggcccuuc

SEQ ID NO: 3835159 - RNA, 14 nt, Human
gaccugaggcuccu

SEQ ID NO: 3835160 - RNA, 18 nt, Human
gaccugaggcuccugugc

SEQ ID NO: 3835161 - RNA, 19 nt, Human
gaccugauuuacaguuuca

SEQ ID NO: 3835162 - RNA, 17 nt, Human
gaccugcagacgcccag

SEQ ID NO: 3835163 - RNA, 20 nt, Human
gaccugcaggccaagagcag

SEQ ID NO: 3835164 - RNA, 18 nt, Human
gaccugccaggcaggggu

SEQ ID NO: 3835165 - RNA, 23 nt, Human
gaccugcccccgcauccccugcc

SEQ ID NO: 3835166 - RNA, 21 nt, Human
gaccugccccgcccagcugca

SEQ ID NO: 3835167 - RNA, 21 nt, Human
gaccugccccuccucucugcc

SEQ ID NO: 3835168 - RNA, 13 nt, Human
gaccugccuccug

SEQ ID NO: 3835169 - RNA, 22 nt, Human
gaccugccuccugccugccccu

SEQ ID NO: 3835170 - RNA, 18 nt, Human
gaccugccugcauaggag

SEQ ID NO: 3835171 - RNA, 20 nt, Human
gaccugcggcugcugugugc

SEQ ID NO: 3835172 - RNA, 17 nt, Human
gaccugcuccgcugcuc

SEQ ID NO: 3835173 - RNA, 18 nt, Human
gaccugcuccgcugcucc

SEQ ID NO: 3835174 - RNA, 19 nt, Human
gaccugcugagcucugaga

SEQ ID NO: 3835175 - RNA, 20 nt, Human
gaccugcugagggaccagcc

SEQ ID NO: 3835176 - RNA, 19 nt, Human
gaccugcuuuuugaaauga

SEQ ID NO: 3835177 - RNA, 14 nt, Human
gaccuggaagaaca

SEQ ID NO: 3835178 - RNA, 20 nt, Human
gaccuggaagaacaggccuc

SEQ ID NO: 3835179 - RNA, 20 nt, Human
gaccuggaagggaggugggc

SEQ ID NO: 3835180 - RNA, 18 nt, Human
gaccuggacacaggccug

SEQ ID NO: 3835181 - RNA, 16 nt, Human
gaccuggagccccugg

SEQ ID NO: 3835182 - RNA, 18 nt, Human
gaccuggcaaggacacag

SEQ ID NO: 3835183 - RNA, 18 nt, Human
gaccuggcacuggaugca

SEQ ID NO: 3835184 - RNA, 18 nt, Human
gaccugggaccuccccug

SEQ ID NO: 3835185 - RNA, 17 nt, Human
gaccugguacccuccug

SEQ ID NO: 3835186 - RNA, 17 nt, Human
gaccuggugcugccucu

SEQ ID NO: 3835187 - RNA, 22 nt, Human
gaccuggugcugccucuaccug

SEQ ID NO: 3835188 - RNA, 17 nt, Human
gaccuguaacuuuugua

SEQ ID NO: 3835189 - RNA, 12 nt, Human
gaccuguaauca

SEQ ID NO: 3835190 - RNA, 16 nt, Human
gaccuguccuccuggu

SEQ ID NO: 3835191 - RNA, 19 nt, Human
gaccuguccuccugguggg

SEQ ID NO: 3835192 - RNA, 15 nt, Human
gaccugugagcccag

SEQ ID NO: 3835193 - RNA, 23 nt, Human
gaccugugagcccagcuggguca

SEQ ID NO: 3835194 - RNA, 22 nt, Human
gaccuguggggauuucucccag

SEQ ID NO: 3835195 - RNA, 14 nt, Human
gaccuguggugcaa

SEQ ID NO: 3835196 - RNA, 19 nt, Human
gaccuguuagcagacaggc

SEQ ID NO: 3835197 - RNA, 19 nt, Human
gagaaaccagcuuccuuca

SEQ ID NO: 3835198 - RNA, 17 nt, Human
gagaaacucuugagauc

SEQ ID NO: 3835199 - RNA, 15 nt, Human
gagaaagaauuuagu

SEQ ID NO: 3835200 - RNA, 18 nt, Human
gagaaagacuauucaaac

SEQ ID NO: 3835201 - RNA, 18 nt, Human
gagaaagagcacuuaaga

SEQ ID NO: 3835202 - RNA, 19 nt, Human
gagaaagaggcaccaggaa

SEQ ID NO: 3835203 - RNA, 20 nt, Human
gagaaagcauauugacuuuu

SEQ ID NO: 3835204 - RNA, 16 nt, Human
gagaaagccaggcagg

SEQ ID NO: 3835205 - RNA, 19 nt, Human
gagaaagcgcagaugcuag

SEQ ID NO: 3835206 - RNA, 14 nt, Human
gagaaagcucaaag

SEQ ID NO: 3835207 - RNA, 13 nt, Human
gagaaagcugacu

SEQ ID NO: 3835208 - RNA, 21 nt, Human
gagaaagcugacuuggcuggu

SEQ ID NO: 3835209 - RNA, 22 nt, Human
gagaaaguacuucuccacccug

SEQ ID NO: 3835210 - RNA, 23 nt, Human
gagaaaucuggcuucuggccagg

SEQ ID NO: 3835211 - RNA, 12 nt, Human
gagaaaugaaaa

SEQ ID NO: 3835212 - RNA, 21 nt, Human
gagaaaugaaaaaauauauau

SEQ ID NO: 3835213 - RNA, 12 nt, Human
gagaaaugagcu

SEQ ID NO: 3835214 - RNA, 11 nt, Human
gagaaauguaa

SEQ ID NO: 3835215 - RNA, 13 nt, Human
gagaaauguaaug

SEQ ID NO: 3835216 - RNA, 11 nt, Human
gagaaauuauu

SEQ ID NO: 3835217 - RNA, 22 nt, Human
gagaaauucuguuaaaaucuau

SEQ ID NO: 3835218 - RNA, 17 nt, Human
gagaacaaacagaucga

SEQ ID NO: 3835219 - RNA, 15 nt, Human
gagaacaaauauuca

SEQ ID NO: 3835220 - RNA, 19 nt, Human
gagaacaagaaagggccag

SEQ ID NO: 3835221 - RNA, 20 nt, Human
gagaacagaucuccaaagcu

SEQ ID NO: 3835222 - RNA, 21 nt, Human
gagaacagaucuccaaagcuu

SEQ ID NO: 3835223 - RNA, 13 nt, Human
gagaacaggacua

SEQ ID NO: 3835224 - RNA, 19 nt, Human
gagaacaugaaucaaaagu

SEQ ID NO: 3835225 - RNA, 21 nt, Human
gagaacccugcguggggacag

SEQ ID NO: 3835226 - RNA, 19 nt, Human
gagaaccuggaguuccuga

SEQ ID NO: 3835227 - RNA, 14 nt, Human
gagaaccuggccuu

SEQ ID NO: 3835228 - RNA, 21 nt, Human
gagaaccuggguugcagacag

SEQ ID NO: 3835229 - RNA, 22 nt, Human
gagaacucgcgcucaguaaacg

SEQ ID NO: 3835230 - RNA, 18 nt, Human
gagaacugaaaagagagc

SEQ ID NO: 3835231 - RNA, 23 nt, Human
gagaacugcauauguuucgcuga

SEQ ID NO: 3835232 - RNA, 16 nt, Human
gagaacuuuauuucca

SEQ ID NO: 3835233 - RNA, 17 nt, Human
gagaacuuuccauuuug

SEQ ID NO: 3835234 - RNA, 11 nt, Human
gagaagaaaau

SEQ ID NO: 3835235 - RNA, 20 nt, Human
gagaagaaaggugaguuuga

SEQ ID NO: 3835236 - RNA, 14 nt, Human
gagaagaagaaaaa

SEQ ID NO: 3835237 - RNA, 11 nt, Human
gagaagaauag

SEQ ID NO: 3835238 - RNA, 14 nt, Human
gagaagaauagccu

SEQ ID NO: 3835239 - RNA, 15 nt, Human
gagaagaauauuguu

SEQ ID NO: 3835240 - RNA, 19 nt, Human
gagaagaauauuguuccua

SEQ ID NO: 3835241 - RNA, 21 nt, Human
gagaagaauuuucagacccca

SEQ ID NO: 3835242 - RNA, 15 nt, Human
gagaagacaaaauua

SEQ ID NO: 3835243 - RNA, 16 nt, Human
gagaagagaaugcaca

SEQ ID NO: 3835244 - RNA, 15 nt, Human
gagaagagaggagag

SEQ ID NO: 3835245 - RNA, 15 nt, Human
gagaagagcgcagug

SEQ ID NO: 3835246 - RNA, 13 nt, Human
gagaagagcuguu

SEQ ID NO: 3835247 - RNA, 12 nt, Human
gagaagaggagc

SEQ ID NO: 3835248 - RNA, 19 nt, Human
gagaagagggccuguggga

SEQ ID NO: 3835249 - RNA, 23 nt, Human
gagaagauucuucccauucucca

SEQ ID NO: 3835250 - RNA, 18 nt, Human
gagaagcagugagccgca

SEQ ID NO: 3835251 - RNA, 19 nt, Human
gagaagcauauagaggcaa

SEQ ID NO: 3835252 - RNA, 15 nt, Human
gagaagccagcuugu

SEQ ID NO: 3835253 - RNA, 23 nt, Human
gagaagccaggaauuucccagga

SEQ ID NO: 3835254 - RNA, 19 nt, Human
gagaagccaucaccucaga

SEQ ID NO: 3835255 - RNA, 20 nt, Human
gagaagccaucaccucagau

SEQ ID NO: 3835256 - RNA, 15 nt, Human
gagaagccauugucu

SEQ ID NO: 3835257 - RNA, 22 nt, Human
gagaagccccuuccccauggga

SEQ ID NO: 3835258 - RNA, 16 nt, Human
gagaagccuucaagcu

SEQ ID NO: 3835259 - RNA, 18 nt, Human
gagaagccuucaagcucu

SEQ ID NO: 3835260 - RNA, 20 nt, Human
gagaagccuucaagcucuga

SEQ ID NO: 3835261 - RNA, 22 nt, Human
gagaagccuucaagcucugagg

SEQ ID NO: 3835262 - RNA, 13 nt, Human
gagaagccuucag

SEQ ID NO: 3835263 - RNA, 14 nt, Human
gagaagccuucagc

SEQ ID NO: 3835264 - RNA, 16 nt, Human
gagaagcggauuucca

SEQ ID NO: 3835265 - RNA, 16 nt, Human
gagaagcggcuggcag

SEQ ID NO: 3835266 - RNA, 19 nt, Human
gagaagcuccucuccccag

SEQ ID NO: 3835267 - RNA, 22 nt, Human
gagaagcuccucuccccagccc

SEQ ID NO: 3835268 - RNA, 13 nt, Human
gagaagcugcagg

SEQ ID NO: 3835269 - RNA, 11 nt, Human
gagaagcugcu

SEQ ID NO: 3835270 - RNA, 12 nt, Human
gagaagcugcuc

SEQ ID NO: 3835271 - RNA, 13 nt, Human
gagaagcugcuca

SEQ ID NO: 3835272 - RNA, 15 nt, Human
gagaagcuggggagg

SEQ ID NO: 3835273 - RNA, 14 nt, Human
gagaaggaaggaga

SEQ ID NO: 3835274 - RNA, 15 nt, Human
gagaaggagagaaag

SEQ ID NO: 3835275 - RNA, 13 nt, Human
gagaaggagcaga

SEQ ID NO: 3835276 - RNA, 12 nt, Human
gagaaggcagcc

SEQ ID NO: 3835277 - RNA, 22 nt, Human
gagaagucucagcuaagcucac

SEQ ID NO: 3835278 - RNA, 21 nt, Human
gagaagucuucuauuuauuua

SEQ ID NO: 3835279 - RNA, 20 nt, Human
gagaagugaaugcugggacu

SEQ ID NO: 3835280 - RNA, 15 nt, Human
gagaagugccccugc

SEQ ID NO: 3835281 - RNA, 16 nt, Human
gagaagugccccugcu

SEQ ID NO: 3835282 - RNA, 20 nt, Human
gagaagugccccugcugccu

SEQ ID NO: 3835283 - RNA, 16 nt, Human
gagaaguuucuggccc

SEQ ID NO: 3835284 - RNA, 17 nt, Human
gagaaguuuuguacaga

SEQ ID NO: 3835285 - RNA, 16 nt, Human
gagaaguuuuguuuuu

SEQ ID NO: 3835286 - RNA, 18 nt, Human
gagaauaagagaaagaaa

SEQ ID NO: 3835287 - RNA, 13 nt, Human
gagaauagaagga

SEQ ID NO: 3835288 - RNA, 16 nt, Human
gagaauagaaggaaac

SEQ ID NO: 3835289 - RNA, 20 nt, Human
gagaauauaacaugaaauga

SEQ ID NO: 3835290 - RNA, 14 nt, Human
gagaauauauacau

SEQ ID NO: 3835291 - RNA, 13 nt, Human
gagaaucacuuga

SEQ ID NO: 3835292 - RNA, 14 nt, Human
gagaaucacuugaa

SEQ ID NO: 3835293 - RNA, 15 nt, Human
gagaaucuauauuua

SEQ ID NO: 3835294 - RNA, 15 nt, Human
gagaaugaaagggcc

SEQ ID NO: 3835295 - RNA, 14 nt, Human
gagaaugagaaaug

SEQ ID NO: 3835296 - RNA, 20 nt, Human
gagaaugagagacacacuga

SEQ ID NO: 3835297 - RNA, 21 nt, Human
gagaaugagagacacacugaa

SEQ ID NO: 3835298 - RNA, 23 nt, Human
gagaaugaguccuugauuucaaa

SEQ ID NO: 3835299 - RNA, 15 nt, Human
gagaaugcacaaaca

SEQ ID NO: 3835300 - RNA, 22 nt, Human
gagaaugcacaaacagaggccg

SEQ ID NO: 3835301 - RNA, 16 nt, Human
gagaaugcacagauau

SEQ ID NO: 3835302 - RNA, 20 nt, Human
gagaaugcccuucuccuuau

SEQ ID NO: 3835303 - RNA, 19 nt, Human
gagaauggaaaccacaacu

SEQ ID NO: 3835304 - RNA, 20 nt, Human
gagaauggugugaacccggg

SEQ ID NO: 3835305 - RNA, 23 nt, Human
gagaauggugugaacccgggagc

SEQ ID NO: 3835306 - RNA, 15 nt, Human
gagaauguaagaacu

SEQ ID NO: 3835307 - RNA, 22 nt, Human
gagaauucuuacauguuuucuu

SEQ ID NO: 3835308 - RNA, 21 nt, Human
gagaauugcugaagggcauuc

SEQ ID NO: 3835309 - RNA, 19 nt, Human
gagaauugggcggcucuga

SEQ ID NO: 3835310 - RNA, 13 nt, Human
gagaauuucuaaa

SEQ ID NO: 3835311 - RNA, 20 nt, Human
gagacaaaaauuaucuauuu

SEQ ID NO: 3835312 - RNA, 18 nt, Human
gagacaaaucuaugccac

SEQ ID NO: 3835313 - RNA, 16 nt, Human
gagacaaauggaggcc

SEQ ID NO: 3835314 - RNA, 17 nt, Human
gagacaagaaaucccug

SEQ ID NO: 3835315 - RNA, 19 nt, Human
gagacaaugucugcagccc

SEQ ID NO: 3835316 - RNA, 15 nt, Human
gagacacaccugagg

SEQ ID NO: 3835317 - RNA, 18 nt, Human
gagacacacugaagaagc

SEQ ID NO: 3835318 - RNA, 16 nt, Human
gagacacagcgucccu

SEQ ID NO: 3835319 - RNA, 12 nt, Human
gagacaccucag

SEQ ID NO: 3835320 - RNA, 13 nt, Human
gagacaccucaga

SEQ ID NO: 3835321 - RNA, 21 nt, Human
gagacaccugcaccucccccc

SEQ ID NO: 3835322 - RNA, 15 nt, Human
gagacacuggccccu

SEQ ID NO: 3835323 - RNA, 16 nt, Human
gagacagaagcaggcu

SEQ ID NO: 3835324 - RNA, 18 nt, Human
gagacagaauguaucugu

SEQ ID NO: 3835325 - RNA, 20 nt, Human
gagacagaauguaucuguga

SEQ ID NO: 3835326 - RNA, 20 nt, Human
gagacagagccucgcucugu

SEQ ID NO: 3835327 - RNA, 20 nt, Human
gagacagagcgacagagcag

SEQ ID NO: 3835328 - RNA, 14 nt, Human
gagacagagcuggu

SEQ ID NO: 3835329 - RNA, 23 nt, Human
gagacagauaccuccaacccugc

SEQ ID NO: 3835330 - RNA, 14 nt, Human
gagacagccccaga

SEQ ID NO: 3835331 - RNA, 15 nt, Human
gagacagccccagag

SEQ ID NO: 3835332 - RNA, 23 nt, Human
gagacagcccgggcucugccucc

SEQ ID NO: 3835333 - RNA, 15 nt, Human
gagacagcucugcau

SEQ ID NO: 3835334 - RNA, 16 nt, Human
gagacagcucugcaua

SEQ ID NO: 3835335 - RNA, 18 nt, Human
gagacagcucugcauacu

SEQ ID NO: 3835336 - RNA, 21 nt, Human
gagacagcugauacuucauuu

SEQ ID NO: 3835337 - RNA, 19 nt, Human
gagacagcuugaucaaagg

SEQ ID NO: 3835338 - RNA, 19 nt, Human
gagacaggaaaauccucug

SEQ ID NO: 3835339 - RNA, 14 nt, Human
gagacaggcagagc

SEQ ID NO: 3835340 - RNA, 14 nt, Human
gagacaggguccug

SEQ ID NO: 3835341 - RNA, 12 nt, Human
gagacaggguuu

SEQ ID NO: 3835342 - RNA, 13 nt, Human
gagagagcuggag

SEQ ID NO: 3835343 - RNA, 20 nt, Human
gagagaggcuaaaauguuuu

SEQ ID NO: 3835344 - RNA, 17 nt, Human
gagagagguugaaaaac

SEQ ID NO: 3835345 - RNA, 18 nt, Human
gagagauauaucugaaaa

SEQ ID NO: 3835346 - RNA, 15 nt, Human
gagagaucaaagaug

SEQ ID NO: 3835347 - RNA, 18 nt, Human
gagagaugggagcuccuc

SEQ ID NO: 3835348 - RNA, 12 nt, Human
gagagaugugug

SEQ ID NO: 3835349 - RNA, 22 nt, Human
gagagauguguguugauacugu

SEQ ID NO: 3835350 - RNA, 17 nt, Human
gagagcaaagugaccug

SEQ ID NO: 3835351 - RNA, 15 nt, Human
gagagcaacauuuua

SEQ ID NO: 3835352 - RNA, 13 nt, Human
gagagcaacucug

SEQ ID NO: 3835353 - RNA, 17 nt, Human
gagagcaacucugagau

SEQ ID NO: 3835354 - RNA, 13 nt, Human
gagagcagagaau

SEQ ID NO: 3835355 - RNA, 14 nt, Human
gagagcagccagga

SEQ ID NO: 3835356 - RNA, 18 nt, Human
gagagcagcuucugccac

SEQ ID NO: 3835357 - RNA, 23 nt, Human
gagagcaggcuggcagcucucca

SEQ ID NO: 3835358 - RNA, 16 nt, Human
gagagcagugcuuuug

SEQ ID NO: 3835359 - RNA, 12 nt, Human
gagagcauaauu

SEQ ID NO: 3835360 - RNA, 14 nt, Human
gagagcaucaggcc

SEQ ID NO: 3835361 - RNA, 19 nt, Human
gagagccagagaagugaca

SEQ ID NO: 3835362 - RNA, 11 nt, Human
gagagccagcc

SEQ ID NO: 3835363 - RNA, 13 nt, Human
gagagccagcccu

SEQ ID NO: 3835364 - RNA, 14 nt, Human
gagagccagcccuc

SEQ ID NO: 3835365 - RNA, 20 nt, Human
gagagccagcccucccuguc

SEQ ID NO: 3835366 - RNA, 14 nt, Human
gagagccauuuugu

SEQ ID NO: 3835367 - RNA, 13 nt, Human
gagagcccagcca

SEQ ID NO: 3835368 - RNA, 14 nt, Human
gagagcccaggagc

SEQ ID NO: 3835369 - RNA, 15 nt, Human
gagagccccagcuga

SEQ ID NO: 3835370 - RNA, 19 nt, Human
gagagcccugaggccuaga

SEQ ID NO: 3835371 - RNA, 14 nt, Human
gagagcccugggac

SEQ ID NO: 3835372 - RNA, 16 nt, Human
gagagcccuucauuug

SEQ ID NO: 3835373 - RNA, 17 nt, Human
gagagccugcaggaucu

SEQ ID NO: 3835374 - RNA, 19 nt, Human
gagagccuggugcugcugc

SEQ ID NO: 3835375 - RNA, 13 nt, Human
gagagccuuccag

SEQ ID NO: 3835376 - RNA, 16 nt, Human
gagagccuuccagggg

SEQ ID NO: 3835377 - RNA, 20 nt, Human
gagagccuuccagggguggg

SEQ ID NO: 3835378 - RNA, 14 nt, Human
gagagcgcagcccg

SEQ ID NO: 3835379 - RNA, 22 nt, Human
gagagcgccugccccucccaga

SEQ ID NO: 3835380 - RNA, 21 nt, Human
gagagcggucucaggcuggug

SEQ ID NO: 3835381 - RNA, 21 nt, Human
gagagcgugcuccagccuggc

SEQ ID NO: 3835382 - RNA, 19 nt, Human
gagagcuagaacccggcag

SEQ ID NO: 3835383 - RNA, 18 nt, Human
gagagcuagaaccuggag

SEQ ID NO: 3835384 - RNA, 19 nt, Human
gagagcuagaaccuggagg

SEQ ID NO: 3835385 - RNA, 15 nt, Human
gagagcuagcagcag

SEQ ID NO: 3835386 - RNA, 22 nt, Human
gagagcuaggagcaaagccugu

SEQ ID NO: 3835387 - RNA, 13 nt, Human
gagagcugggugu

SEQ ID NO: 3835388 - RNA, 18 nt, Human
gagagcuguucccaaauu

SEQ ID NO: 3835389 - RNA, 16 nt, Human
gagagcuuaaugauaa

SEQ ID NO: 3835390 - RNA, 19 nt, Human
gagagcuuagggucucagg

SEQ ID NO: 3835391 - RNA, 22 nt, Human
gagagcuucuguugcugccuca

SEQ ID NO: 3835392 - RNA, 23 nt, Human
gagagcuuucuguccuuuuggca

SEQ ID NO: 3835393 - RNA, 20 nt, Human
gagaggaaauauugcugggg

SEQ ID NO: 3835394 - RNA, 19 nt, Human
gagaggacaauacuggggu

SEQ ID NO: 3835395 - RNA, 16 nt, Human
gagaggacgugggcgg

SEQ ID NO: 3835396 - RNA, 19 nt, Human
gagaggagagaggcagaga

SEQ ID NO: 3835397 - RNA, 19 nt, Human
gagaggagagccagagaag

SEQ ID NO: 3835398 - RNA, 22 nt, Human
gagaggagcgggaccuguggcu

SEQ ID NO: 3835399 - RNA, 13 nt, Human
gagaggaguucaa

SEQ ID NO: 3835400 - RNA, 16 nt, Human
gagaggaguucaauga

SEQ ID NO: 3835401 - RNA, 21 nt, Human
gagaggaugaauguaugugca

SEQ ID NO: 3835402 - RNA, 21 nt, Human
gagaggaugagagcccagagg

SEQ ID NO: 3835403 - RNA, 14 nt, Human
gagaggcaaugauu

SEQ ID NO: 3835404 - RNA, 20 nt, Human
gagaggcaauggcuccuuca

SEQ ID NO: 3835405 - RNA, 22 nt, Human
gagaggcagacuucccugaaug

SEQ ID NO: 3835406 - RNA, 12 nt, Human
gagaggcagaga

SEQ ID NO: 3835407 - RNA, 16 nt, Human
gagaggcagagaaaga

SEQ ID NO: 3835408 - RNA, 12 nt, Human
gagaggcaggca

SEQ ID NO: 3835409 - RNA, 15 nt, Human
gagaggcaggcauag

SEQ ID NO: 3835410 - RNA, 14 nt, Human
gagaggcauccagu

SEQ ID NO: 3835411 - RNA, 13 nt, Human
gagaggcccugga

SEQ ID NO: 3835412 - RNA, 17 nt, Human
gagaggccucgacccac

SEQ ID NO: 3835413 - RNA, 18 nt, Human
gagaggccuuuuggaaug

SEQ ID NO: 3835414 - RNA, 16 nt, Human
gagaggcuaaaauguu

SEQ ID NO: 3835415 - RNA, 20 nt, Human
gagaggcuaaaauguuuuca

SEQ ID NO: 3835416 - RNA, 22 nt, Human
gagaggcuaaaauguuuucagc

SEQ ID NO: 3835417 - RNA, 13 nt, Human
gagaggcuguggu

SEQ ID NO: 3835418 - RNA, 15 nt, Human
gagagggaaugugaa

SEQ ID NO: 3835419 - RNA, 19 nt, Human
gagagggacagcccacuga

SEQ ID NO: 3835420 - RNA, 10 nt, Human
gagagggaga

SEQ ID NO: 3835421 - RNA, 21 nt, Human
gagagggcaugcgcacaaggc

SEQ ID NO: 3835422 - RNA, 19 nt, Human
gagaggggaacagacugga

SEQ ID NO: 3835423 - RNA, 18 nt, Human
gagaggggaagaguguac

SEQ ID NO: 3835424 - RNA, 21 nt, Human
gagaggggacaaaacccaccu

SEQ ID NO: 3835425 - RNA, 22 nt, Human
gagaggggacaaaacccaccuu

SEQ ID NO: 3835426 - RNA, 14 nt, Human
gagaggggaggcca

SEQ ID NO: 3835427 - RNA, 13 nt, Human
gagaggggcacag

SEQ ID NO: 3835428 - RNA, 23 nt, Human
gagagggggccugggacuuccau

SEQ ID NO: 3835429 - RNA, 18 nt, Human
gagagggucuggagaagc

SEQ ID NO: 3835430 - RNA, 19 nt, Human
gagaggucaagcccaggag

SEQ ID NO: 3835431 - RNA, 21 nt, Human
gagaggugccagcaacugaau

SEQ ID NO: 3835432 - RNA, 23 nt, Human
gagaggugggccagucuguggau

SEQ ID NO: 3835433 - RNA, 17 nt, Human
gagagguugucuguggc

SEQ ID NO: 3835434 - RNA, 16 nt, Human
gagaguacagugagcc

SEQ ID NO: 3835435 - RNA, 22 nt, Human
gagagucccacugccucagguu

SEQ ID NO: 3835436 - RNA, 13 nt, Human
gagagucuagauu

SEQ ID NO: 3835437 - RNA, 18 nt, Human
gagagucuggcccuagac

SEQ ID NO: 3835438 - RNA, 17 nt, Human
gagagucuugcagugau

SEQ ID NO: 3835439 - RNA, 12 nt, Human
gagaguggcucc

SEQ ID NO: 3835440 - RNA, 16 nt, Human
gagaguggcuccuccc

SEQ ID NO: 3835441 - RNA, 17 nt, Human
gagaguggcuggggcau

SEQ ID NO: 3835442 - RNA, 16 nt, Human
gagaguuuagcuguaa

SEQ ID NO: 3835443 - RNA, 15 nt, Human
gagauaauaugagaa

SEQ ID NO: 3835444 - RNA, 18 nt, Human
gagauaauuacugccuug

SEQ ID NO: 3835445 - RNA, 19 nt, Human
gagauaauuacugccuuga

SEQ ID NO: 3835446 - RNA, 16 nt, Human
gagauacauacagaau

SEQ ID NO: 3835447 - RNA, 17 nt, Human
gagauaccaagaugcca

SEQ ID NO: 3835448 - RNA, 13 nt, Human
cuccucacugccc

SEQ ID NO: 3835449 - RNA, 15 nt, Human
cuccucacugcccgc

SEQ ID NO: 3835450 - RNA, 14 nt, Human
cuccucacuggcca

SEQ ID NO: 3835451 - RNA, 16 nt, Human
cuccucacuguaucca

SEQ ID NO: 3835452 - RNA, 18 nt, Human
cuccucaggcacacagcu

SEQ ID NO: 3835453 - RNA, 17 nt, Human
cuccucagggacucagg

SEQ ID NO: 3835454 - RNA, 14 nt, Human
cuccucagggaugg

SEQ ID NO: 3835455 - RNA, 23 nt, Human
cuccucaggguugagguccagcc

SEQ ID NO: 3835456 - RNA, 15 nt, Human
cuccucaguucuugc

SEQ ID NO: 3835457 - RNA, 14 nt, Human
cuccucaucucuaa

SEQ ID NO: 3835458 - RNA, 20 nt, Human
cuccucauggcagccuacuc

SEQ ID NO: 3835459 - RNA, 11 nt, Human
cuccucaugua

SEQ ID NO: 3835460 - RNA, 16 nt, Human
cuccuccaccaccgcc

SEQ ID NO: 3835461 - RNA, 13 nt, Human
cuccuccaccgcc

SEQ ID NO: 3835462 - RNA, 16 nt, Human
cuccuccacucucccc

SEQ ID NO: 3835463 - RNA, 13 nt, Human
cuccuccagaguc

SEQ ID NO: 3835464 - RNA, 20 nt, Human
cuccuccagccccuguccca

SEQ ID NO: 3835465 - RNA, 17 nt, Human
cuccuccaggccugccu

SEQ ID NO: 3835466 - RNA, 18 nt, Human
cuccuccaggccugccuc

SEQ ID NO: 3835467 - RNA, 19 nt, Human
cuccuccaggccugccucc

SEQ ID NO: 3835468 - RNA, 23 nt, Human
cuccuccaggccugccucccacu

SEQ ID NO: 3835469 - RNA, 13 nt, Human
cuccuccagggac

SEQ ID NO: 3835470 - RNA, 14 nt, Human
cuccuccagggaca

SEQ ID NO: 3835471 - RNA, 13 nt, Human
cuccuccagggcc

SEQ ID NO: 3835472 - RNA, 22 nt, Human
cuccuccagggccacgugccag

SEQ ID NO: 3835473 - RNA, 17 nt, Human
cuccuccagugugggcu

SEQ ID NO: 3835474 - RNA, 15 nt, Human
cuccuccaugggaga

SEQ ID NO: 3835475 - RNA, 18 nt, Human
cuccuccaugggagaaaa

SEQ ID NO: 3835476 - RNA, 17 nt, Human
cuccucccaggcgcccc

SEQ ID NO: 3835477 - RNA, 11 nt, Human
cuccucccaua

SEQ ID NO: 3835478 - RNA, 15 nt, Human
cuccucccauguuau

SEQ ID NO: 3835479 - RNA, 17 nt, Human
cuccuccccaaaucaau

SEQ ID NO: 3835480 - RNA, 19 nt, Human
cuccuccccaacugugggg

SEQ ID NO: 3835481 - RNA, 18 nt, Human
cuccuccccacccuccug

SEQ ID NO: 3835482 - RNA, 14 nt, Human
cuccuccccuggag

SEQ ID NO: 3835483 - RNA, 14 nt, Human
cuccucccggugcc

SEQ ID NO: 3835484 - RNA, 14 nt, Human
cuccucccucccag

SEQ ID NO: 3835485 - RNA, 14 nt, Human
cuccucccuccugc

SEQ ID NO: 3835486 - RNA, 14 nt, Human
cuccucccucugag

SEQ ID NO: 3835487 - RNA, 14 nt, Human
cuccucccugcauc

SEQ ID NO: 3835488 - RNA, 18 nt, Human
gaggaaccagagccaugg

SEQ ID NO: 3835489 - RNA, 16 nt, Human
gaggaacuguccagag

SEQ ID NO: 3835490 - RNA, 18 nt, Human
gaggaacuguccagagag

SEQ ID NO: 3835491 - RNA, 21 nt, Human
gaggaacuguccagagagcaa

SEQ ID NO: 3835492 - RNA, 23 nt, Human
gaggaacuucagacacaaaaguc

SEQ ID NO: 3835493 - RNA, 19 nt, Human
gaggaagaacggggcucuu

SEQ ID NO: 3835494 - RNA, 20 nt, Human
gaggaagaagcuuaggcagg

SEQ ID NO: 3835495 - RNA, 14 nt, Human
gaggaagcagaaua

SEQ ID NO: 3835496 - RNA, 19 nt, Human
gaggaagcccuaagacguc

SEQ ID NO: 3835497 - RNA, 18 nt, Human
gaggaagccgcuggggcc

SEQ ID NO: 3835498 - RNA, 22 nt, Human
gaggaaggaaacccagcucugg

SEQ ID NO: 3835499 - RNA, 19 nt, Human
gaggaaggaacagcaaugg

SEQ ID NO: 3835500 - RNA, 16 nt, Human
gaggaaggaugcaaag

SEQ ID NO: 3835501 - RNA, 16 nt, Human
gaggaaggauuguaaa

SEQ ID NO: 3835502 - RNA, 16 nt, Human
gaggaaguacaaacua

SEQ ID NO: 3835503 - RNA, 13 nt, Human
gaggaaguucaga

SEQ ID NO: 3835504 - RNA, 17 nt, Human
gaggaauaauuauuuau

SEQ ID NO: 3835505 - RNA, 14 nt, Human
gaggaauccagacc

SEQ ID NO: 3835506 - RNA, 15 nt, Human
gaggaauccuggcag

SEQ ID NO: 3835507 - RNA, 16 nt, Human
gaggaauccuggcagc

SEQ ID NO: 3835508 - RNA, 19 nt, Human
gaggaaucugugggucugg

SEQ ID NO: 3835509 - RNA, 22 nt, Human
gaggaaucugugggucugggag

SEQ ID NO: 3835510 - RNA, 18 nt, Human
gaggaauggacauuucua

SEQ ID NO: 3835511 - RNA, 14 nt, Human
gaggaaagagagca

SEQ ID NO: 3835512 - RNA, 20 nt, Human
gaggaaagagucuucaacau

SEQ ID NO: 3835513 - RNA, 21 nt, Human
gaggaaagagucuucaacaua

SEQ ID NO: 3835514 - RNA, 14 nt, Human
gaggaaaggccagc

SEQ ID NO: 3835515 - RNA, 18 nt, Human
gaggaaagucauuggcuu

SEQ ID NO: 3835516 - RNA, 21 nt, Human
gaggaaauaagaaaaaucaug

SEQ ID NO: 3835517 - RNA, 20 nt, Human
gaggaaaucaaagugcuauu

SEQ ID NO: 3835518 - RNA, 17 nt, Human
gaggaaaucccuucaua

SEQ ID NO: 3835519 - RNA, 19 nt, Human
gaggaacaaucggcugcau

SEQ ID NO: 3835520 - RNA, 15 nt, Human
gaggaaccgaaaggc

SEQ ID NO: 3835521 - RNA, 20 nt, Human
gaggaacuagccaccaacuc

SEQ ID NO: 3835522 - RNA, 16 nt, Human
gaggaacuccuuggcc

SEQ ID NO: 3835523 - RNA, 23 nt, Human
gaggaagaacggggcucuucuca

SEQ ID NO: 3835524 - RNA, 13 nt, Human
gaggaagaauggu

SEQ ID NO: 3835525 - RNA, 17 nt, Human
gaggaagagaaaaaaua

SEQ ID NO: 3835526 - RNA, 13 nt, Human
gaggaagagcagg

SEQ ID NO: 3835527 - RNA, 17 nt, Human
gaggaagagcaggcaca

SEQ ID NO: 3835528 - RNA, 19 nt, Human
gaggaagagugcaaaacau

SEQ ID NO: 3835529 - RNA, 12 nt, Human
gaggaagcagaa

SEQ ID NO: 3835530 - RNA, 13 nt, Human
gaggaagcagaau

SEQ ID NO: 3835531 - RNA, 16 nt, Human
gaggaagcagaauaaa

SEQ ID NO: 3835532 - RNA, 17 nt, Human
gaggaagcagaauaaag

SEQ ID NO: 3835533 - RNA, 13 nt, Human
gaggaagccgcug

SEQ ID NO: 3835534 - RNA, 18 nt, Human
gaggaagccugauuaaag

SEQ ID NO: 3835535 - RNA, 19 nt, Human
gaggaaggaaacccagcuc

SEQ ID NO: 3835536 - RNA, 20 nt, Human
gaggaaggaaacccagcucu

SEQ ID NO: 3835537 - RNA, 21 nt, Human
gaggaaggaaacccagcucug

SEQ ID NO: 3835538 - RNA, 14 nt, Human
gaggaaggagagaa

SEQ ID NO: 3835539 - RNA, 16 nt, Human
gaggaaggagagaagg

SEQ ID NO: 3835540 - RNA, 14 nt, Human
gaggaaggauugua

SEQ ID NO: 3835541 - RNA, 15 nt, Human
gaggaaggauuguaa

SEQ ID NO: 3835542 - RNA, 21 nt, Human
gaggaaggcaagagggggugg

SEQ ID NO: 3835543 - RNA, 16 nt, Human
gaggaaggcaggaaga

SEQ ID NO: 3835544 - RNA, 21 nt, Human
gaggaaggcaugccuggacaa

SEQ ID NO: 3835545 - RNA, 18 nt, Human
gaggaauaauuauuuauu

SEQ ID NO: 3835546 - RNA, 20 nt, Human
gaggaaucaacagggcagca

SEQ ID NO: 3835547 - RNA, 19 nt, Human
gaggaaucacucuugugga

SEQ ID NO: 3835548 - RNA, 17 nt, Human
gaggaauccuggcagcc

SEQ ID NO: 3835549 - RNA, 20 nt, Human
gaggaaucugugggucuggg

SEQ ID NO: 3835550 - RNA, 21 nt, Human
gaggaaucugugggucuggga

SEQ ID NO: 3835551 - RNA, 15 nt, Human
gaggaaugaaaaaag

SEQ ID NO: 3835552 - RNA, 17 nt, Human
gaggaaugcuggacugg

SEQ ID NO: 3835553 - RNA, 18 nt, Human
gaggaaugcuggacugga

SEQ ID NO: 3835554 - RNA, 13 nt, Human
gaggaauguauau

SEQ ID NO: 3835555 - RNA, 14 nt, Human
gaggaauguauaug

SEQ ID NO: 3835556 - RNA, 15 nt, Human
gaggacaaccauucc

SEQ ID NO: 3835557 - RNA, 12 nt, Human
gaggacaauuca

SEQ ID NO: 3835558 - RNA, 20 nt, Human
gaggacaauucaugaacuuc

SEQ ID NO: 3835559 - RNA, 21 nt, Human
gaggacaauucaugaacuucg

SEQ ID NO: 3835560 - RNA, 15 nt, Human
gaggacaauuuccag

SEQ ID NO: 3835561 - RNA, 20 nt, Human
gaggacaccuguacuggaga

SEQ ID NO: 3835562 - RNA, 21 nt, Human
gaggacaccuguacuggagag

SEQ ID NO: 3835563 - RNA, 13 nt, Human
gaggacagcuguc

SEQ ID NO: 3835564 - RNA, 22 nt, Human
gaggacagggaggugaccccag

SEQ ID NO: 3835565 - RNA, 22 nt, Human
gaggacaguauuuguggggagg

SEQ ID NO: 3835566 - RNA, 20 nt, Human
gaggacauaaugggguccug

SEQ ID NO: 3835567 - RNA, 14 nt, Human
gaggaccagggccu

SEQ ID NO: 3835568 - RNA, 16 nt, Human
gaggacccagacccag

SEQ ID NO: 3835569 - RNA, 15 nt, Human
gaggacccaggacag

SEQ ID NO: 3835570 - RNA, 16 nt, Human
gaggaccugacccuac

SEQ ID NO: 3835571 - RNA, 16 nt, Human
gaggaccugagccugc

SEQ ID NO: 3835572 - RNA, 18 nt, Human
gaggaccuguauuuaagc

SEQ ID NO: 3835573 - RNA, 20 nt, Human
gaggaccuguauuuaagcaa

SEQ ID NO: 3835574 - RNA, 19 nt, Human
gaggaccuuaucugugcgu

SEQ ID NO: 3835575 - RNA, 16 nt, Human
gaggacggugcaaccc

SEQ ID NO: 3835576 - RNA, 16 nt, Human
gaggacgugggcggca

SEQ ID NO: 3835577 - RNA, 18 nt, Human
gaggacuagaaccuggag

SEQ ID NO: 3835578 - RNA, 18 nt, Human
gaggacuguauuugugac

SEQ ID NO: 3835579 - RNA, 16 nt, Human
gaggacuugugucucu

SEQ ID NO: 3835580 - RNA, 16 nt, Human
gaggacuuuucuuugu

SEQ ID NO: 3835581 - RNA, 23 nt, Human
gaggacuuuucuuuguggcuucc

SEQ ID NO: 3835582 - RNA, 14 nt, Human
gaggagaaacugga

SEQ ID NO: 3835583 - RNA, 16 nt, Human
gaggagaacuugcugc

SEQ ID NO: 3835584 - RNA, 23 nt, Human
gaggagacggaggggaguagaga

SEQ ID NO: 3835585 - RNA, 11 nt, Human
gaggagagagg

SEQ ID NO: 3835586 - RNA, 12 nt, Human
gaggagagaggc

SEQ ID NO: 3835587 - RNA, 15 nt, Human
gaggagagaggcaga

SEQ ID NO: 3835588 - RNA, 16 nt, Human
gaggagagaggcagag

SEQ ID NO: 3835589 - RNA, 20 nt, Human
gaggagagauagccuguggc

SEQ ID NO: 3835590 - RNA, 13 nt, Human
gaggagagccaga

SEQ ID NO: 3835591 - RNA, 23 nt, Human
gaggagagccagagaagugacag

SEQ ID NO: 3835592 - RNA, 14 nt, Human
gaggagagccuggu

SEQ ID NO: 3835593 - RNA, 13 nt, Human
gaggagaggagag

SEQ ID NO: 3835594 - RNA, 14 nt, Human
gaggagaggagaga

SEQ ID NO: 3835595 - RNA, 16 nt, Human
gaggagaggagagagg

SEQ ID NO: 3835596 - RNA, 17 nt, Human
gaggagaggagagaggc

SEQ ID NO: 3835597 - RNA, 20 nt, Human
gaggagaggggaagggccag

SEQ ID NO: 3835598 - RNA, 17 nt, Human
gaggagaugcuccuugg

SEQ ID NO: 3835599 - RNA, 18 nt, Human
gaggagauucugccuuug

SEQ ID NO: 3835600 - RNA, 16 nt, Human
gaggagcagcaggagg

SEQ ID NO: 3835601 - RNA, 21 nt, Human
gaggagcauguuuuguauaca

SEQ ID NO: 3835602 - RNA, 16 nt, Human
gaggagccaccaguuc

SEQ ID NO: 3835603 - RNA, 18 nt, Human
gaggagccaccaguucuc

SEQ ID NO: 3835604 - RNA, 14 nt, Human
gaggagccagacag

SEQ ID NO: 3835605 - RNA, 21 nt, Human
gaggagcccaggccaggacuc

SEQ ID NO: 3835606 - RNA, 23 nt, Human
gaggagcccccacccuguuccug

SEQ ID NO: 3835607 - RNA, 14 nt, Human
gaggagccuguccu

SEQ ID NO: 3835608 - RNA, 18 nt, Human
gaggagccuguccugccu

SEQ ID NO: 3835609 - RNA, 19 nt, Human
gaggagccuguccugccug

SEQ ID NO: 3835610 - RNA, 13 nt, Human
gaggagcuucugg

SEQ ID NO: 3835611 - RNA, 13 nt, Human
gaggaggaaggca

SEQ ID NO: 3835612 - RNA, 13 nt, Human
gaggaggcagcag

SEQ ID NO: 3835613 - RNA, 15 nt, Human
gaggaggcagcagga

SEQ ID NO: 3835614 - RNA, 16 nt, Human
gaggaggcagcaggac

SEQ ID NO: 3835615 - RNA, 21 nt, Human
gaggaggccugggggcaggga

SEQ ID NO: 3835616 - RNA, 22 nt, Human
gaggaggccuugggcucugcug

SEQ ID NO: 3835617 - RNA, 11 nt, Human
gaggagggaga

SEQ ID NO: 3835618 - RNA, 14 nt, Human
gaggagggcaggca

SEQ ID NO: 3835619 - RNA, 17 nt, Human
gaggagggcggggggca

SEQ ID NO: 3835620 - RNA, 20 nt, Human
gaggagggcgugacucaccc

SEQ ID NO: 3835621 - RNA, 12 nt, Human
gaggaggggagg

SEQ ID NO: 3835622 - RNA, 16 nt, Human
gaggaggggccgcugc

SEQ ID NO: 3835623 - RNA, 18 nt, Human
gaggaggggccgcugcca

SEQ ID NO: 3835624 - RNA, 17 nt, Human
gaggagggugggggagg

SEQ ID NO: 3835625 - RNA, 18 nt, Human
gaggagguggcagcccug

SEQ ID NO: 3835626 - RNA, 20 nt, Human
gaggagguggcagcccugua

SEQ ID NO: 3835627 - RNA, 23 nt, Human
gaggaggugucucaggcugccug

SEQ ID NO: 3835628 - RNA, 15 nt, Human
gaggaggugugagga

SEQ ID NO: 3835629 - RNA, 17 nt, Human
gaggagguuuaggucaa

SEQ ID NO: 3835630 - RNA, 20 nt, Human
gaggagguuuggggucugcc

SEQ ID NO: 3835631 - RNA, 21 nt, Human
gaggaguaacaauacaaaugg

SEQ ID NO: 3835632 - RNA, 22 nt, Human
gaggaguaacaauacaaaugga

SEQ ID NO: 3835633 - RNA, 14 nt, Human
cucuccccuccagc

SEQ ID NO: 3835634 - RNA, 16 nt, Human
cucuccccuccagccu

SEQ ID NO: 3835635 - RNA, 20 nt, Human
cucuccccucuuauguaccu

SEQ ID NO: 3835636 - RNA, 15 nt, Human
cucuccccugaccug

SEQ ID NO: 3835637 - RNA, 19 nt, Human
cucuccccugcccccugca

SEQ ID NO: 3835638 - RNA, 20 nt, Human
cucuccccugcccccugcag

SEQ ID NO: 3835639 - RNA, 22 nt, Human
cucuccccugcccccugcagga

SEQ ID NO: 3835640 - RNA, 16 nt, Human
cucuccccugcccugc

SEQ ID NO: 3835641 - RNA, 23 nt, Human
cucucccggagguugggugggcc

SEQ ID NO: 3835642 - RNA, 17 nt, Human
cucucccgucagggccc

SEQ ID NO: 3835643 - RNA, 22 nt, Human
cucucccucuaggcucugccuu

SEQ ID NO: 3835644 - RNA, 18 nt, Human
cucucccucuggcccugc

SEQ ID NO: 3835645 - RNA, 21 nt, Human
cucucccucuggcccugccuu

SEQ ID NO: 3835646 - RNA, 22 nt, Human
cucucccucuggcccugccuuc

SEQ ID NO: 3835647 - RNA, 12 nt, Human
cucucccugacc

SEQ ID NO: 3835648 - RNA, 20 nt, Human
cucucccugacccuguauau

SEQ ID NO: 3835649 - RNA, 12 nt, Human
cucucccuggcc

SEQ ID NO: 3835650 - RNA, 13 nt, Human
cucucccuggccc

SEQ ID NO: 3835651 - RNA, 13 nt, Human
cucucccuuaccc

SEQ ID NO: 3835652 - RNA, 13 nt, Human
cucucccuucccu

SEQ ID NO: 3835653 - RNA, 13 nt, Human
cucucccuuggau

SEQ ID NO: 3835654 - RNA, 16 nt, Human
cucucccuugggcucu

SEQ ID NO: 3835655 - RNA, 17 nt, Human
cucuccgccccugagcc

SEQ ID NO: 3835656 - RNA, 21 nt, Human
cucuccguuuauuauaaacug

SEQ ID NO: 3835657 - RNA, 14 nt, Human
cucuccucaucucu

SEQ ID NO: 3835658 - RNA, 20 nt, Human
cucuccuccaagacacugug

SEQ ID NO: 3835659 - RNA, 15 nt, Human
cucuccuccagaguc

SEQ ID NO: 3835660 - RNA, 20 nt, Human
cucuccuccccaaggagaca

SEQ ID NO: 3835661 - RNA, 19 nt, Human
cucuccuccugcccaccug

SEQ ID NO: 3835662 - RNA, 18 nt, Human
cucuccucugcugcuggc

SEQ ID NO: 3835663 - RNA, 14 nt, Human
cucuccucuugcca

SEQ ID NO: 3835664 - RNA, 22 nt, Human
cucuccucuugccacugccucu

SEQ ID NO: 3835665 - RNA, 13 nt, Human
cucuccugccaca

SEQ ID NO: 3835666 - RNA, 15 nt, Human
cucuccugccccuug

SEQ ID NO: 3835667 - RNA, 12 nt, Human
cucuccugccua

SEQ ID NO: 3835668 - RNA, 22 nt, Human
cucuccuggccuauccgcugcc

SEQ ID NO: 3835669 - RNA, 13 nt, Human
cucuccuggcuuc

SEQ ID NO: 3835670 - RNA, 17 nt, Human
cucuccuggcuucccau

SEQ ID NO: 3835671 - RNA, 22 nt, Human
cucuccuggcuucccaucccca

SEQ ID NO: 3835672 - RNA, 13 nt, Human
gaggauuuugagu

SEQ ID NO: 3835673 - RNA, 13 nt, Human
gaggcaaaagaag

SEQ ID NO: 3835674 - RNA, 22 nt, Human
gaggcaaugggagcugaggcca

SEQ ID NO: 3835675 - RNA, 23 nt, Human
gaggcaaugucaggaacagaagg

SEQ ID NO: 3835676 - RNA, 20 nt, Human
gaggcacacagcugcagaga

SEQ ID NO: 3835677 - RNA, 24 nt, Human
gaggcacacagcugcagagacaga

SEQ ID NO: 3835678 - RNA, 16 nt, Human
gaggcacagagccaaa

SEQ ID NO: 3835679 - RNA, 17 nt, Human
gaggcacaugucagcaa

SEQ ID NO: 3835680 - RNA, 20 nt, Human
gaggcaccugguggccaugc

SEQ ID NO: 3835681 - RNA, 18 nt, Human
gaggcacugaagugcuua

SEQ ID NO: 3835682 - RNA, 20 nt, Human
gaggcagaaaauugcacaau

SEQ ID NO: 3835683 - RNA, 18 nt, Human
gaggcagaaagcagaggc

SEQ ID NO: 3835684 - RNA, 20 nt, Human
gaggcagaaagcagaggcug

SEQ ID NO: 3835685 - RNA, 23 nt, Human
gaggcagaacccuggugaggaag

SEQ ID NO: 3835686 - RNA, 15 nt, Human
gaggcagacagcagc

SEQ ID NO: 3835687 - RNA, 17 nt, Human
gaggcagagaaagaaga

SEQ ID NO: 3835688 - RNA, 21 nt, Human
gaggcagagaaagaagagaca

SEQ ID NO: 3835689 - RNA, 12 nt, Human
gaggcagagagc

SEQ ID NO: 3835690 - RNA, 22 nt, Human
gaggcagagagcggucucaggc

SEQ ID NO: 3835691 - RNA, 17 nt, Human
gaggcagccacuucggc

SEQ ID NO: 3835692 - RNA, 13 nt, Human
gaggcagcccagg

SEQ ID NO: 3835693 - RNA, 23 nt, Human
gaggcagccccauucugccugcc

SEQ ID NO: 3835694 - RNA, 23 nt, Human
gaggcagcgugaaagcagaugag

SEQ ID NO: 3835695 - RNA, 9 nt, Human
gaggcaggg

SEQ ID NO: 3835696 - RNA, 21 nt, Human
gaggcagggaacauggggagg

SEQ ID NO: 3835697 - RNA, 23 nt, Human
gaggcagggaacauggggaggag

SEQ ID NO: 3835698 - RNA, 14 nt, Human
gaggcagggaaguc

SEQ ID NO: 3835699 - RNA, 15 nt, Human
gaggcagggccuugc

SEQ ID NO: 3835700 - RNA, 18 nt, Human
gaggcagggccuugccca

SEQ ID NO: 3835701 - RNA, 21 nt, Human
gaggcagggccuugcccagag

SEQ ID NO: 3835702 - RNA, 21 nt, Human
gaggcaggggcuuccuggugc

SEQ ID NO: 3835703 - RNA, 23 nt, Human
gaggcaggggcuuccuggugcug

SEQ ID NO: 3835704 - RNA, 14 nt, Human
gaggcagggucuca

SEQ ID NO: 3835705 - RNA, 22 nt, Human
gaggcagggucucacucugucg

SEQ ID NO: 3835706 - RNA, 23 nt, Human
gaggcaguaccugggcaagcugg

SEQ ID NO: 3835707 - RNA, 16 nt, Human
gaggcaguuugaggau

SEQ ID NO: 3835708 - RNA, 17 nt, Human
gaggcaucgcaauguaa

SEQ ID NO: 3835709 - RNA, 20 nt, Human
gaggcaugugaugagaggaa

SEQ ID NO: 3835710 - RNA, 21 nt, Human
gaggcauuuguuugaacugau

SEQ ID NO: 3835711 - RNA, 18 nt, Human
gaggccaacacugugggu

SEQ ID NO: 3835712 - RNA, 22 nt, Human
gaggccaagaauauugcaaaau

SEQ ID NO: 3835713 - RNA, 19 nt, Human
gaggccaagaguggcccca

SEQ ID NO: 3835714 - RNA, 17 nt, Human
gaggccaaggugggagg

SEQ ID NO: 3835715 - RNA, 21 nt, Human
gaggccacacucagcacaagg

SEQ ID NO: 3835716 - RNA, 13 nt, Human
gaggccaccuccu

SEQ ID NO: 3835717 - RNA, 18 nt, Human
gaggccaccucuccaagg

SEQ ID NO: 3835718 - RNA, 16 nt, Human
gaggccacugaagagg

SEQ ID NO: 3835719 - RNA, 19 nt, Human
gaggccacugaagaggagg

SEQ ID NO: 3835720 - RNA, 19 nt, Human
gaggccagagacacaagcc

SEQ ID NO: 3835721 - RNA, 18 nt, Human
gaggccagagagggcgug

SEQ ID NO: 3835722 - RNA, 13 nt, Human
gaggccagcccca

SEQ ID NO: 3835723 - RNA, 20 nt, Human
gaggccagccccacccagga

SEQ ID NO: 3835724 - RNA, 16 nt, Human
gaggccagccuggccu

SEQ ID NO: 3835725 - RNA, 18 nt, Human
gaggccagccuggccucc

SEQ ID NO: 3835726 - RNA, 22 nt, Human
gaggccagccuggccuccugcc

SEQ ID NO: 3835727 - RNA, 13 nt, Human
gaggccagccuug

SEQ ID NO: 3835728 - RNA, 12 nt, Human
gaggccaggagu

SEQ ID NO: 3835729 - RNA, 15 nt, Human
gaggccagggcagag

SEQ ID NO: 3835730 - RNA, 19 nt, Human
gaggccagggcagagugag

SEQ ID NO: 3835731 - RNA, 14 nt, Human
gaggccaggugcag

SEQ ID NO: 3835732 - RNA, 14 nt, Human
gaggccaucuggag

SEQ ID NO: 3835733 - RNA, 22 nt, Human
gaggccaucuggagagcccaga

SEQ ID NO: 3835734 - RNA, 20 nt, Human
gaggccaugggccuccugug

SEQ ID NO: 3835735 - RNA, 23 nt, Human
gaggccauguuccaauaaacagg

SEQ ID NO: 3835736 - RNA, 14 nt, Human
gaggcccagagggc

SEQ ID NO: 3835737 - RNA, 16 nt, Human
gaggcccagagggccu

SEQ ID NO: 3835738 - RNA, 18 nt, Human
gaggcccaggcugccguc

SEQ ID NO: 3835739 - RNA, 12 nt, Human
gaggcccaggga

SEQ ID NO: 3835740 - RNA, 13 nt, Human
gaggcccaguuca

SEQ ID NO: 3835741 - RNA, 18 nt, Human
gaggcccaguucacccug

SEQ ID NO: 3835742 - RNA, 15 nt, Human
gaggccccaacccug

SEQ ID NO: 3835743 - RNA, 15 nt, Human
gaggccccacugaug

SEQ ID NO: 3835744 - RNA, 12 nt, Human
gaggccccagcc

SEQ ID NO: 3835745 - RNA, 13 nt, Human
gaggccccagccu

SEQ ID NO: 3835746 - RNA, 17 nt, Human
gaggcccccagcccagg

SEQ ID NO: 3835747 - RNA, 13 nt, Human
gaggccccuggac

SEQ ID NO: 3835748 - RNA, 15 nt, Human
gaggccccuggccca

SEQ ID NO: 3835749 - RNA, 20 nt, Human
gaggccccuucuagguggca

SEQ ID NO: 3835750 - RNA, 17 nt, Human
gaggccccuucucuccc

SEQ ID NO: 3835751 - RNA, 13 nt, Human
gaggcccggccuc

SEQ ID NO: 3835752 - RNA, 18 nt, Human
gaggcccucgggcccagc

SEQ ID NO: 3835753 - RNA, 20 nt, Human
gaggcccucgggcccagccc

SEQ ID NO: 3835754 - RNA, 21 nt, Human
gaggcccucgggcccagcccc

SEQ ID NO: 3835755 - RNA, 17 nt, Human
gaggcccucuggagugg

SEQ ID NO: 3835756 - RNA, 14 nt, Human
gaggcccugcaugg

SEQ ID NO: 3835757 - RNA, 13 nt, Human
gaggcccuggauc

SEQ ID NO: 3835758 - RNA, 22 nt, Human
gaggcccuggaucagcguggcc

SEQ ID NO: 3835759 - RNA, 23 nt, Human
gaggcccuggaucagcguggccu

SEQ ID NO: 3835760 - RNA, 22 nt, Human
gaggccgcuagaggccugagga

SEQ ID NO: 3835761 - RNA, 19 nt, Human
gaggccgggugcucagggc

SEQ ID NO: 3835762 - RNA, 18 nt, Human
gaggccguugauucacuu

SEQ ID NO: 3835763 - RNA, 15 nt, Human
gaggccuagacucug

SEQ ID NO: 3835764 - RNA, 15 nt, Human
gaggccuaggagggu

SEQ ID NO: 3835765 - RNA, 14 nt, Human
gaggccucaggugc

SEQ ID NO: 3835766 - RNA, 15 nt, Human
gaggccucaggugcu

SEQ ID NO: 3835767 - RNA, 23 nt, Human
gaggccuccuguggccugccagu

SEQ ID NO: 3835768 - RNA, 22 nt, Human
gaggccucucauuccagaggaa

SEQ ID NO: 3835769 - RNA, 22 nt, Human
gaggccugaagccagcugcccu

SEQ ID NO: 3835770 - RNA, 18 nt, Human
gaggccugacugccaagc

SEQ ID NO: 3835771 - RNA, 20 nt, Human
gaggccugacugccaagcca

SEQ ID NO: 3835772 - RNA, 13 nt, Human
gaggccugagacc

SEQ ID NO: 3835773 - RNA, 20 nt, Human
gaggccugagcgcuccugcc

SEQ ID NO: 3835774 - RNA, 21 nt, Human
gaggccugaggaugagcugga

SEQ ID NO: 3835775 - RNA, 22 nt, Human
gaggccugaggaugagcuggaa

SEQ ID NO: 3835776 - RNA, 22 nt, Human
gaggccugaucugcccaucgug

SEQ ID NO: 3835777 - RNA, 14 nt, Human
gagugacuagacgu

SEQ ID NO: 3835778 - RNA, 15 nt, Human
gagugacucaagaag

SEQ ID NO: 3835779 - RNA, 23 nt, Human
gagugacucaagaagugaagaau

SEQ ID NO: 3835780 - RNA, 15 nt, Human
gagugacucgagggu

SEQ ID NO: 3835781 - RNA, 13 nt, Human
gagugacucucca

SEQ ID NO: 3835782 - RNA, 23 nt, Human
gagugagacccagcccucauccc

SEQ ID NO: 3835783 - RNA, 14 nt, Human
gagugagacucugu

SEQ ID NO: 3835784 - RNA, 18 nt, Human
gagugagacucugucuca

SEQ ID NO: 3835785 - RNA, 15 nt, Human
gagugagaggggagg

SEQ ID NO: 3835786 - RNA, 24 nt, Human
gagugagcacuaaggugugcucug

SEQ ID NO: 3835787 - RNA, 15 nt, Human
gagugagcuacagag

SEQ ID NO: 3835788 - RNA, 22 nt, Human
gagugagcuacagagccgagca

SEQ ID NO: 3835789 - RNA, 22 nt, Human
gagugaggaauaguugagcccc

SEQ ID NO: 3835790 - RNA, 18 nt, Human
gagugaggaugucugggc

SEQ ID NO: 3835791 - RNA, 17 nt, Human
gagugaggcaggugaca

SEQ ID NO: 3835792 - RNA, 19 nt, Human
gagugagggguaaaagcug

SEQ ID NO: 3835793 - RNA, 14 nt, Human
gagugaguggcccu

SEQ ID NO: 3835794 - RNA, 19 nt, Human
gagugaguguggcuccccu

SEQ ID NO: 3835795 - RNA, 19 nt, Human
gagugauagucuuuugcuu

SEQ ID NO: 3835796 - RNA, 15 nt, Human
gagugauugcagcuu

SEQ ID NO: 3835797 - RNA, 16 nt, Human
gagugcaacaguagca

SEQ ID NO: 3835798 - RNA, 15 nt, Human
gagugcacagcuguc

SEQ ID NO: 3835799 - RNA, 15 nt, Human
gagugcaccaaagag

SEQ ID NO: 3835800 - RNA, 16 nt, Human
gagugcagccguuuga

SEQ ID NO: 3835801 - RNA, 16 nt, Human
gagugcaggcccaccc

SEQ ID NO: 3835802 - RNA, 14 nt, Human
gagugcaguccuga

SEQ ID NO: 3835803 - RNA, 17 nt, Human
gagugcaguccugauca

SEQ ID NO: 3835804 - RNA, 13 nt, Human
gagugcagugagc

SEQ ID NO: 3835805 - RNA, 14 nt, Human
gagugccaggacuc

SEQ ID NO: 3835806 - RNA, 20 nt, Human
gagugccaggacuccccagg

SEQ ID NO: 3835807 - RNA, 23 nt, Human
gagugccccauucuuuuguaauu

SEQ ID NO: 3835808 - RNA, 15 nt, Human
gagugccuucugugg

SEQ ID NO: 3835809 - RNA, 18 nt, Human
gagugccuuuugcagaag

SEQ ID NO: 3835810 - RNA, 21 nt, Human
gagugcuggcucacaguacag

SEQ ID NO: 3835811 - RNA, 15 nt, Human
gagugcuguuuuguu

SEQ ID NO: 3835812 - RNA, 18 nt, Human
gagugcuugcuuuucaug

SEQ ID NO: 3835813 - RNA, 17 nt, Human
gaguggaggaggccugg

SEQ ID NO: 3835814 - RNA, 20 nt, Human
gaguggagguuuauaguuaa

SEQ ID NO: 3835815 - RNA, 20 nt, Human
gaguggauagaugcccugcu

SEQ ID NO: 3835816 - RNA, 16 nt, Human
gaguggaugccucaga

SEQ ID NO: 3835817 - RNA, 14 nt, Human
gaguggcagcccag

SEQ ID NO: 3835818 - RNA, 16 nt, Human
gaguggcaggggacag

SEQ ID NO: 3835819 - RNA, 17 nt, Human
gaguggccccaccuggc

SEQ ID NO: 3835820 - RNA, 21 nt, Human
gaguggccccaccuggcccuc

SEQ ID NO: 3835821 - RNA, 22 nt, Human
gaguggcccuuucggauccagg

SEQ ID NO: 3835822 - RNA, 15 nt, Human
gaguggcuccucccg

SEQ ID NO: 3835823 - RNA, 19 nt, Human
gaguggcuucacuccugcu

SEQ ID NO: 3835824 - RNA, 20 nt, Human
gaguggcuucacuccugcug

SEQ ID NO: 3835825 - RNA, 20 nt, Human
gaguggggagacaccucaga

SEQ ID NO: 3835826 - RNA, 19 nt, Human
gagugggggagagcaggcu

SEQ ID NO: 3835827 - RNA, 21 nt, Human
gaguggucuuucuggagaggu

SEQ ID NO: 3835828 - RNA, 16 nt, Human
gaguggugcagacaga

SEQ ID NO: 3835829 - RNA, 14 nt, Human
gaguguaacaagaa

SEQ ID NO: 3835830 - RNA, 18 nt, Human
gaguguaacaagaaagga

SEQ ID NO: 3835831 - RNA, 17 nt, Human
gaguguaagugugagua

SEQ ID NO: 3835832 - RNA, 20 nt, Human
gaguguaagugugaguaaga

SEQ ID NO: 3835833 - RNA, 17 nt, Human
gaguguaauguuuguua

SEQ ID NO: 3835834 - RNA, 13 nt, Human
gaguguacaagua

SEQ ID NO: 3835835 - RNA, 15 nt, Human
gaguguacagagugg

SEQ ID NO: 3835836 - RNA, 15 nt, Human
gaguguacucccagg

SEQ ID NO: 3835837 - RNA, 18 nt, Human
gaguguacuuaacuauuc

SEQ ID NO: 3835838 - RNA, 17 nt, Human
gaguguagacuguggcu

SEQ ID NO: 3835839 - RNA, 13 nt, Human
gaguguaugagua

SEQ ID NO: 3835840 - RNA, 21 nt, Human
gaguguauguagggcauaaug

SEQ ID NO: 3835841 - RNA, 17 nt, Human
gagugucaaccagacag

SEQ ID NO: 3835842 - RNA, 19 nt, Human
gaguguccucuucccucuc

SEQ ID NO: 3835843 - RNA, 17 nt, Human
gagugucucugauaaaa

SEQ ID NO: 3835844 - RNA, 19 nt, Human
gagugucuuaauuaaaaga

SEQ ID NO: 3835845 - RNA, 13 nt, Human
gagugucuuucca

SEQ ID NO: 3835846 - RNA, 19 nt, Human
gagugucuuuccacggagc

SEQ ID NO: 3835847 - RNA, 21 nt, Human
gagugucuuuccacggagcca

SEQ ID NO: 3835848 - RNA, 14 nt, Human
gagugugacagggc

SEQ ID NO: 3835849 - RNA, 20 nt, Human
gagugugaccaaaaguuaca

SEQ ID NO: 3835850 - RNA, 18 nt, Human
gagugugauccaguuuuu

SEQ ID NO: 3835851 - RNA, 13 nt, Human
gagugugcaugga

SEQ ID NO: 3835852 - RNA, 15 nt, Human
gagugugcauggagg

SEQ ID NO: 3835853 - RNA, 17 nt, Human
gagugugccugaagucc

SEQ ID NO: 3835854 - RNA, 23 nt, Human
gagugugcugcuguaagaaaucu

SEQ ID NO: 3835855 - RNA, 17 nt, Human
gaguguggaagccggag

SEQ ID NO: 3835856 - RNA, 15 nt, Human
gaguguggacucugg

SEQ ID NO: 3835857 - RNA, 18 nt, Human
gagugugggaagggagag

SEQ ID NO: 3835858 - RNA, 21 nt, Human
gaguguguaauuuaaaauugu

SEQ ID NO: 3835859 - RNA, 17 nt, Human
gaguguguauuguuccc

SEQ ID NO: 3835860 - RNA, 19 nt, Human
gaguguguauuguucccag

SEQ ID NO: 3835861 - RNA, 14 nt, Human
gagugugugugugu

SEQ ID NO: 3835862 - RNA, 15 nt, Human
gaguguuauguauuu

SEQ ID NO: 3835863 - RNA, 19 nt, Human
gaguguuccccuuccacug

SEQ ID NO: 3835864 - RNA, 16 nt, Human
gaguguugaaacggau

SEQ ID NO: 3835865 - RNA, 18 nt, Human
gaguguuucuaauaaacu

SEQ ID NO: 3835866 - RNA, 13 nt, Human
gaguuaaaaugca

SEQ ID NO: 3835867 - RNA, 18 nt, Human
gaguuaacgggugaauaa

SEQ ID NO: 3835868 - RNA, 16 nt, Human
gaguuaagaagcuguu

SEQ ID NO: 3835869 - RNA, 21 nt, Human
gaguuaagaagcuguuguaca

SEQ ID NO: 3835870 - RNA, 21 nt, Human
gaguuaagaccuggcagcucu

SEQ ID NO: 3835871 - RNA, 13 nt, Human
gaguuacagacaa

SEQ ID NO: 3835872 - RNA, 18 nt, Human
gaguuacagcgagaggca

SEQ ID NO: 3835873 - RNA, 15 nt, Human
gaguuacaguucugu

SEQ ID NO: 3835874 - RNA, 17 nt, Human
gaguuacaguucugugg

SEQ ID NO: 3835875 - RNA, 17 nt, Human
gaguuacauuaauguua

SEQ ID NO: 3835876 - RNA, 21 nt, Human
gaguuagaauaauaaauauuu

SEQ ID NO: 3835877 - RNA, 19 nt, Human
cucugucucauccuccugg

SEQ ID NO: 3835878 - RNA, 21 nt, Human
cucugucucauccuccuggaa

SEQ ID NO: 3835879 - RNA, 23 nt, Human
cucugucucaugugugcucuucu

SEQ ID NO: 3835880 - RNA, 18 nt, Human
cucugucucgagcgcccu

SEQ ID NO: 3835881 - RNA, 22 nt, Human
cucugucucgagcgcccugcag

SEQ ID NO: 3835882 - RNA, 17 nt, Human
cucugucuucaccugau

SEQ ID NO: 3835883 - RNA, 23 nt, Human
cucugugaacgauuuagaaagaa

SEQ ID NO: 3835884 - RNA, 18 nt, Human
cucugugaccaaugucuu

SEQ ID NO: 3835885 - RNA, 19 nt, Human
cucugugaccaaugucuug

SEQ ID NO: 3835886 - RNA, 12 nt, Human
cucugugaccca

SEQ ID NO: 3835887 - RNA, 24 nt, Human
cucugugacccacuucucaucaca

SEQ ID NO: 3835888 - RNA, 16 nt, Human
cucugugaccucaggc

SEQ ID NO: 3835889 - RNA, 24 nt, Human
cucugugaccucaggcacuagccu

SEQ ID NO: 3835890 - RNA, 14 nt, Human
cucugugacugaug

SEQ ID NO: 3835891 - RNA, 19 nt, Human
cucugugagaagguuuauu

SEQ ID NO: 3835892 - RNA, 21 nt, Human
cucugugagcaucacaguuuu

SEQ ID NO: 3835893 - RNA, 17 nt, Human
cucugugccagagccug

SEQ ID NO: 3835894 - RNA, 18 nt, Human
cucugugccagagccugg

SEQ ID NO: 3835895 - RNA, 19 nt, Human
cucugugccagagccuggg

SEQ ID NO: 3835896 - RNA, 21 nt, Human
cucugugccagagccuggggc

SEQ ID NO: 3835897 - RNA, 12 nt, Human
cucugugcccau

SEQ ID NO: 3835898 - RNA, 14 nt, Human
cucugugcccaugg

SEQ ID NO: 3835899 - RNA, 23 nt, Human
cucugugcccaugggcacugcug

SEQ ID NO: 3835900 - RNA, 13 nt, Human
cucugugccuucg

SEQ ID NO: 3835901 - RNA, 14 nt, Human
cucugugcugacau

SEQ ID NO: 3835902 - RNA, 12 nt, Human
cucugugcuggc

SEQ ID NO: 3835903 - RNA, 16 nt, Human
cucugugcuggccagc

SEQ ID NO: 3835904 - RNA, 14 nt, Human
cucugugcugugga

SEQ ID NO: 3835905 - RNA, 21 nt, Human
cucugugcuuugacucaccug

SEQ ID NO: 3835906 - RNA, 16 nt, Human
cucuguggcgagccau

SEQ ID NO: 3835907 - RNA, 17 nt, Human
cucugugggugaugggg

SEQ ID NO: 3835908 - RNA, 22 nt, Human
cucugugggugauggggagggg

SEQ ID NO: 3835909 - RNA, 16 nt, Human
cucuguggugucugcc

SEQ ID NO: 3835910 - RNA, 18 nt, Human
cucuguguauuugcuuuu

SEQ ID NO: 3835911 - RNA, 18 nt, Human
cucugugucacuggcugc

SEQ ID NO: 3835912 - RNA, 19 nt, Human
cucugugucagguggggca

SEQ ID NO: 3835913 - RNA, 20 nt, Human
cucuguguugugaaugucau

SEQ ID NO: 3835914 - RNA, 22 nt, Human
cucuguuacacuuuuuggaagu

SEQ ID NO: 3835915 - RNA, 18 nt, Human
cucuguucaaagcugccu

SEQ ID NO: 3835916 - RNA, 21 nt, Human
cucuguucaguaacagggccu

SEQ ID NO: 3835917 - RNA, 15 nt, Human
cucuguucaguguaa

SEQ ID NO: 3835918 - RNA, 18 nt, Human
cucuguucaguguaaaua

SEQ ID NO: 3835919 - RNA, 18 nt, Human
cucuguucauuccuccag

SEQ ID NO: 3835920 - RNA, 19 nt, Human
cucuguucauuccuccagg

SEQ ID NO: 3835921 - RNA, 14 nt, Human
cucuugagggagcu

SEQ ID NO: 3835922 - RNA, 15 nt, Human
cucuugagggagcuu

SEQ ID NO: 3835923 - RNA, 23 nt, Human
cucuugaguuguuuuuguauauu

SEQ ID NO: 3835924 - RNA, 19 nt, Human
cucuugauaccccccucug

SEQ ID NO: 3835925 - RNA, 21 nt, Human
cucuugaugccuggcggggug

SEQ ID NO: 3835926 - RNA, 20 nt, Human
cucuugcaauccacaaucug

SEQ ID NO: 3835927 - RNA, 19 nt, Human
cucuugcacccgccucucc

SEQ ID NO: 3835928 - RNA, 20 nt, Human
cucuugcacccgccucuccc

SEQ ID NO: 3835929 - RNA, 15 nt, Human
cucuugcagagaagc

SEQ ID NO: 3835930 - RNA, 17 nt, Human
cucuugcagagaagccu

SEQ ID NO: 3835931 - RNA, 14 nt, Human
cucuugcaggucuc

SEQ ID NO: 3835932 - RNA, 22 nt, Human
cucuugccaaccuguaauaaau

SEQ ID NO: 3835933 - RNA, 16 nt, Human
cucuugccacugccuc

SEQ ID NO: 3835934 - RNA, 18 nt, Human
cucuugccacugccucuu

SEQ ID NO: 3835935 - RNA, 14 nt, Human
cucuugcccauccu

SEQ ID NO: 3835936 - RNA, 16 nt, Human
cucuugcccauccuga

SEQ ID NO: 3835937 - RNA, 14 nt, Human
cucuugcccuuccc

SEQ ID NO: 3835938 - RNA, 19 nt, Human
cucuugcccuucccugucc

SEQ ID NO: 3835939 - RNA, 20 nt, Human
cucuugccgaggagccaggc

SEQ ID NO: 3835940 - RNA, 18 nt, Human
cucuugccucaaccuccc

SEQ ID NO: 3835941 - RNA, 21 nt, Human
cucuugccucagcuuccccag

SEQ ID NO: 3835942 - RNA, 22 nt, Human
cucuugccucagcuuccccagu

SEQ ID NO: 3835943 - RNA, 21 nt, Human
cucuugcuaaucagugucuca

SEQ ID NO: 3835944 - RNA, 22 nt, Human
cucuugcuaaucagugucucac

SEQ ID NO: 3835945 - RNA, 16 nt, Human
cucuugcuauugaauu

SEQ ID NO: 3835946 - RNA, 13 nt, Human
cucuugcucuuuc

SEQ ID NO: 3835947 - RNA, 12 nt, Human
cucuugcugucu

SEQ ID NO: 3835948 - RNA, 15 nt, Human
cucuugcugucucug

SEQ ID NO: 3835949 - RNA, 12 nt, Human
cucuuggaccuc

SEQ ID NO: 3835950 - RNA, 17 nt, Human
cucuuggaccucugcuc

SEQ ID NO: 3835951 - RNA, 15 nt, Human
cucuuggagaagucu

SEQ ID NO: 3835952 - RNA, 18 nt, Human
cucuuggagaccuuaccc

SEQ ID NO: 3835953 - RNA, 22 nt, Human
cucuuggagccugcagagcugc

SEQ ID NO: 3835954 - RNA, 15 nt, Human
cucuuggagcuguga

SEQ ID NO: 3835955 - RNA, 15 nt, Human
cucuuggcuggaccc

SEQ ID NO: 3835956 - RNA, 20 nt, Human
cucuuggcuggacccagcca

SEQ ID NO: 3835957 - RNA, 19 nt, Human
cucuugggaaauaugucaa

SEQ ID NO: 3835958 - RNA, 15 nt, Human
cucuugggcaauauu

SEQ ID NO: 3835959 - RNA, 16 nt, Human
cucuugggcugagacu

SEQ ID NO: 3835960 - RNA, 17 nt, Human
cucuugggcugagacug

SEQ ID NO: 3835961 - RNA, 23 nt, Human
cucuuggggaguuuagggugggg

SEQ ID NO: 3835962 - RNA, 19 nt, Human
cucuugguccugcugcagu

SEQ ID NO: 3835963 - RNA, 16 nt, Human
cucuuggucuucccag

SEQ ID NO: 3835964 - RNA, 18 nt, Human
cucuuggucuucccaggc

SEQ ID NO: 3835965 - RNA, 14 nt, Human
cucuuguaaagacu

SEQ ID NO: 3835966 - RNA, 15 nt, Human
cucuuguaaagacug

SEQ ID NO: 3835967 - RNA, 17 nt, Human
cucuuguaaauaaagcc

SEQ ID NO: 3835968 - RNA, 17 nt, Human
cucuuguaagauuuuga

SEQ ID NO: 3835969 - RNA, 19 nt, Human
cucuuguaagauuuugaaa

SEQ ID NO: 3835970 - RNA, 20 nt, Human
cucuuguagcccaggcugga

SEQ ID NO: 3835971 - RNA, 21 nt, Human
cucuuguaucccuagugcucc

SEQ ID NO: 3835972 - RNA, 16 nt, Human
cucuugucccacgugu

SEQ ID NO: 3835973 - RNA, 18 nt, Human
cucuugucccacgugucu

SEQ ID NO: 3835974 - RNA, 12 nt, Human
cucuugucuccc

SEQ ID NO: 3835975 - RNA, 14 nt, Human
cucuugucuccccu

SEQ ID NO: 3835976 - RNA, 16 nt, Human
cucuugucuccccugu

SEQ ID NO: 3835977 - RNA, 17 nt, Human
cucuugucuuccuauuu

SEQ ID NO: 3835978 - RNA, 23 nt, Human
cucuugucuuccuauuucagaag

SEQ ID NO: 3835979 - RNA, 20 nt, Human
cucuugugaggaaagucauu

SEQ ID NO: 3835980 - RNA, 17 nt, Human
cucuugugauuucuuua

SEQ ID NO: 3835981 - RNA, 16 nt, Human
cucuuguucuuacuuu

SEQ ID NO: 3835982 - RNA, 11 nt, Human
cucuuguugag

SEQ ID NO: 3835983 - RNA, 13 nt, Human
cucuuguuucucc

SEQ ID NO: 3835984 - RNA, 15 nt, Human
cucuuguuuuguuug

SEQ ID NO: 3835985 - RNA, 18 nt, Human
cucuuguuuuguuugucu

SEQ ID NO: 3835986 - RNA, 20 nt, Human
cucuuguuuuuauuaauuua

SEQ ID NO: 3835987 - RNA, 13 nt, Human
cucuuuaaaaaca

SEQ ID NO: 3835988 - RNA, 12 nt, Human
cucuuuaaaaca

SEQ ID NO: 3835989 - RNA, 14 nt, Human
cucuuuaaaacaaa

SEQ ID NO: 3835990 - RNA, 18 nt, Human
cucuuuaacucaggacuc

SEQ ID NO: 3835991 - RNA, 21 nt, Human
cucuuuaagaguuaguuucuu

SEQ ID NO: 3835992 - RNA, 19 nt, Human
cucuuuaagggcaugccuu

SEQ ID NO: 3835993 - RNA, 22 nt, Human
cucuuuaagggcaugccuugug

SEQ ID NO: 3835994 - RNA, 21 nt, Human
cucuuuaaugucacaggcagg

SEQ ID NO: 3835995 - RNA, 23 nt, Human
cucuuuaaugucacaggcagguc

SEQ ID NO: 3835996 - RNA, 12 nt, Human
cucuuuagccag

SEQ ID NO: 3835997 - RNA, 17 nt, Human
cucuuuaugaucuggcc

SEQ ID NO: 3835998 - RNA, 13 nt, Human
cucuuuauuuucc

SEQ ID NO: 3835999 - RNA, 22 nt, Human
cucuuuccaguggaucauaaga

SEQ ID NO: 3836000 - RNA, 17 nt, Human
cucuuuccaucuacccu

SEQ ID NO: 3836001 - RNA, 18 nt, Human
cucuuuccaugacaucaa

SEQ ID NO: 3836002 - RNA, 18 nt, Human
cucuuucccacccagccu

SEQ ID NO: 3836003 - RNA, 10 nt, Human
cucuuucccu

SEQ ID NO: 3836004 - RNA, 15 nt, Human
cucuuucccuggucc

SEQ ID NO: 3836005 - RNA, 17 nt, Human
cucuuucccuggucccu

SEQ ID NO: 3836006 - RNA, 16 nt, Human
cucuuuccuucuugcc

SEQ ID NO: 3836007 - RNA, 15 nt, Human
cucuuucgucacccu

SEQ ID NO: 3836008 - RNA, 18 nt, Human
cucuuucgucacccuugg

SEQ ID NO: 3836009 - RNA, 16 nt, Human
cucuuucuaaugcuga

SEQ ID NO: 3836010 - RNA, 17 nt, Human
cucuuucuauuguuucu

SEQ ID NO: 3836011 - RNA, 14 nt, Human
cucuuucucucccc

SEQ ID NO: 3836012 - RNA, 14 nt, Human
cucuuucucucuuc

SEQ ID NO: 3836013 - RNA, 17 nt, Human
cucuuucucugccagug

SEQ ID NO: 3836014 - RNA, 13 nt, Human
cucuuucucuuuc

SEQ ID NO: 3836015 - RNA, 18 nt, Human
cucuuucugagugccuuc

SEQ ID NO: 3836016 - RNA, 19 nt, Human
cucuuucugagugccuucu

SEQ ID NO: 3836017 - RNA, 23 nt, Human
cucuuucugagugccuucugugg

SEQ ID NO: 3836018 - RNA, 19 nt, Human
cucuuucugucccuucugu

SEQ ID NO: 3836019 - RNA, 15 nt, Human
cucuuucuucccaug

SEQ ID NO: 3836020 - RNA, 14 nt, Human
cucuuucuuccuuu

SEQ ID NO: 3836021 - RNA, 23 nt, Human
cucuuucuuccuuuacuuucccu

SEQ ID NO: 3836022 - RNA, 18 nt, Human
cucuuucuucucugcugc

SEQ ID NO: 3836023 - RNA, 11 nt, Human
cucuuugaaac

SEQ ID NO: 3836024 - RNA, 22 nt, Human
cucuuugaaauagucuguguga

SEQ ID NO: 3836025 - RNA, 23 nt, Human
cucuuugagauagaagaacugca

SEQ ID NO: 3836026 - RNA, 14 nt, Human
cucuuugauuauuu

SEQ ID NO: 3836027 - RNA, 18 nt, Human
cucuuugauuauuugcau

SEQ ID NO: 3836028 - RNA, 20 nt, Human
cucuuugauuauuugcaugu

SEQ ID NO: 3836029 - RNA, 21 nt, Human
cucuuugauuauuugcauguu

SEQ ID NO: 3836030 - RNA, 12 nt, Human
cucuuugcugca

SEQ ID NO: 3836031 - RNA, 14 nt, Human
cucuuugcuuugcu

SEQ ID NO: 3836032 - RNA, 13 nt, Human
cucuuuggaaaag

SEQ ID NO: 3836033 - RNA, 18 nt, Human
cucuuuggacacucacac

SEQ ID NO: 3836034 - RNA, 21 nt, Human
cucuuugggaauguuugucuc

SEQ ID NO: 3836035 - RNA, 22 nt, Human
cucuuuggucuacacugugcug

SEQ ID NO: 3836036 - RNA, 14 nt, Human
cucuuugucuaaaa

SEQ ID NO: 3836037 - RNA, 21 nt, Human
cucuuugucuaaaacaauaaa

SEQ ID NO: 3836038 - RNA, 18 nt, Human
cucuuuguggggcuuggc

SEQ ID NO: 3836039 - RNA, 17 nt, Human
cucuuuguucucagcuc

SEQ ID NO: 3836040 - RNA, 19 nt, Human
cucuuuguucucagcuccc

SEQ ID NO: 3836041 - RNA, 23 nt, Human
cucuuuuacccuggccccucucc

SEQ ID NO: 3836042 - RNA, 14 nt, Human
gauacaaucagcug

SEQ ID NO: 3836043 - RNA, 13 nt, Human
gauacaaugcugu

SEQ ID NO: 3836044 - RNA, 22 nt, Human
gauacaauguauuuauuuaaaa

SEQ ID NO: 3836045 - RNA, 21 nt, Human
gauacacccaaaguaucagga

SEQ ID NO: 3836046 - RNA, 21 nt, Human
gauacaccgggccuggagaac

SEQ ID NO: 3836047 - RNA, 22 nt, Human
gauacacugaaguuaacagaga

SEQ ID NO: 3836048 - RNA, 19 nt, Human
gauacaggaaaagcugcug

SEQ ID NO: 3836049 - RNA, 23 nt, Human
gauacaggaaaagcugcugacag

SEQ ID NO: 3836050 - RNA, 18 nt, Human
gauacagucaacaagccu

SEQ ID NO: 3836051 - RNA, 19 nt, Human
gauacagucccuaaagaaa

SEQ ID NO: 3836052 - RNA, 19 nt, Human
gauacaguuacucagaauu

SEQ ID NO: 3836053 - RNA, 23 nt, Human
gauacaguuacucagaauucucu

SEQ ID NO: 3836054 - RNA, 19 nt, Human
gauacaguuuucagaaaaa

SEQ ID NO: 3836055 - RNA, 14 nt, Human
gauacauacagaau

SEQ ID NO: 3836056 - RNA, 13 nt, Human
gauacaucacugc

SEQ ID NO: 3836057 - RNA, 14 nt, Human
gauacaucacugcu

SEQ ID NO: 3836058 - RNA, 16 nt, Human
gauacaucacugcuug

SEQ ID NO: 3836059 - RNA, 17 nt, Human
gauacaucacugcuuga

SEQ ID NO: 3836060 - RNA, 21 nt, Human
gauacaucacugcuugaugaa

SEQ ID NO: 3836061 - RNA, 23 nt, Human
gauacauccaaagcagacagcuc

SEQ ID NO: 3836062 - RNA, 17 nt, Human
gauaccagguugaaaga

SEQ ID NO: 3836063 - RNA, 18 nt, Human
gauaccauauacagcuca

SEQ ID NO: 3836064 - RNA, 19 nt, Human
gauaccaugcuguaaggau

SEQ ID NO: 3836065 - RNA, 14 nt, Human
gaugguucuagcau

SEQ ID NO: 3836066 - RNA, 20 nt, Human
gauguaaacagugccugcug

SEQ ID NO: 3836067 - RNA, 21 nt, Human
gauguaaacagugccugcuga

SEQ ID NO: 3836068 - RNA, 14 nt, Human
gauguaaagauguu

SEQ ID NO: 3836069 - RNA, 13 nt, Human
gauguaaaugaag

SEQ ID NO: 3836070 - RNA, 12 nt, Human
gauguaaauuuu

SEQ ID NO: 3836071 - RNA, 17 nt, Human
gauguaaggaugggcau

SEQ ID NO: 3836072 - RNA, 22 nt, Human
gauguaauacuucuugugugua

SEQ ID NO: 3836073 - RNA, 16 nt, Human
gauguacaauuaaaaa

SEQ ID NO: 3836074 - RNA, 18 nt, Human
gauguacagucugucaug

SEQ ID NO: 3836075 - RNA, 15 nt, Human
gauguacauuuccaa

SEQ ID NO: 3836076 - RNA, 22 nt, Human
gauguacauuuccaaauucaca

SEQ ID NO: 3836077 - RNA, 19 nt, Human
gauguaccaugaaacaaag

SEQ ID NO: 3836078 - RNA, 17 nt, Human
gauguagaggagaaacu

SEQ ID NO: 3836079 - RNA, 18 nt, Human
gauguagaggagaaacug

SEQ ID NO: 3836080 - RNA, 17 nt, Human
gauguagauuuauuuca

SEQ ID NO: 3836081 - RNA, 18 nt, Human
gauguagcagaauauuuc

SEQ ID NO: 3836082 - RNA, 20 nt, Human
gauguaggguaaggugccuu

SEQ ID NO: 3836083 - RNA, 13 nt, Human
gauguaguauuuu

SEQ ID NO: 3836084 - RNA, 13 nt, Human
gauguaucugagu

SEQ ID NO: 3836085 - RNA, 21 nt, Human
gauguaugaauacagcagcaa

SEQ ID NO: 3836086 - RNA, 18 nt, Human
gaugucaauuucuguguu

SEQ ID NO: 3836087 - RNA, 13 nt, Human
gaugucacagggc

SEQ ID NO: 3836088 - RNA, 22 nt, Human
gaugucagccgagccgggccug

SEQ ID NO: 3836089 - RNA, 16 nt, Human
gaugucauacagagaa

SEQ ID NO: 3836090 - RNA, 17 nt, Human
gaugucauacagagaag

SEQ ID NO: 3836091 - RNA, 21 nt, Human
gaugucaucccauugucuucu

SEQ ID NO: 3836092 - RNA, 20 nt, Human
gaugucccuuucuuggccag

SEQ ID NO: 3836093 - RNA, 22 nt, Human
cugacagcaugugcccuccuga

SEQ ID NO: 3836094 - RNA, 20 nt, Human
cugacaggcaaugcuggcug

SEQ ID NO: 3836095 - RNA, 16 nt, Human
cugacaguuuuucugu

SEQ ID NO: 3836096 - RNA, 13 nt, Human
cugacaucacagc

SEQ ID NO: 3836097 - RNA, 19 nt, Human
cugacaucagagguaucuu

SEQ ID NO: 3836098 - RNA, 15 nt, Human
cugacaucuugaauc

SEQ ID NO: 3836099 - RNA, 23 nt, Human
cugacaugaagcuguugugugag

SEQ ID NO: 3836100 - RNA, 16 nt, Human
cugacaugauuccuuc

SEQ ID NO: 3836101 - RNA, 20 nt, Human
cugacaugcccucccuucuc

SEQ ID NO: 3836102 - RNA, 13 nt, Human
cugacauggcucu

SEQ ID NO: 3836103 - RNA, 17 nt, Human
cugacauggcucuggac

SEQ ID NO: 3836104 - RNA, 21 nt, Human
cugacauguggggccagguca

SEQ ID NO: 3836105 - RNA, 17 nt, Human
cugacauucaccugccc

SEQ ID NO: 3836106 - RNA, 18 nt, Human
cugacauuccuugcugaa

SEQ ID NO: 3836107 - RNA, 17 nt, Human
cugacauuguuggccaa

SEQ ID NO: 3836108 - RNA, 22 nt, Human
cugacauuguuggccaaagcca

SEQ ID NO: 3836109 - RNA, 14 nt, Human
cugaccaacaggcu

SEQ ID NO: 3836110 - RNA, 15 nt, Human
cugaccaauauugua

SEQ ID NO: 3836111 - RNA, 20 nt, Human
cugaccaauauuguacaguu

SEQ ID NO: 3836112 - RNA, 21 nt, Human
cugaccaauauuguacaguuu

SEQ ID NO: 3836113 - RNA, 15 nt, Human
cugaccacacgcggg

SEQ ID NO: 3836114 - RNA, 20 nt, Human
cugaccacacuuccugucca

SEQ ID NO: 3836115 - RNA, 13 nt, Human
cugaccacccucc

SEQ ID NO: 3836116 - RNA, 22 nt, Human
cugaccacggacguuuccauca

SEQ ID NO: 3836117 - RNA, 13 nt, Human
cugaccacucaga

SEQ ID NO: 3836118 - RNA, 16 nt, Human
cugaccacucagagac

SEQ ID NO: 3836119 - RNA, 17 nt, Human
cugaccacucagagaca

SEQ ID NO: 3836120 - RNA, 18 nt, Human
cugaccacuugaggccug

SEQ ID NO: 3836121 - RNA, 19 nt, Human
cugaccacuugaggccuga

SEQ ID NO: 3836122 - RNA, 15 nt, Human
cugaccagcagcgcc

SEQ ID NO: 3836123 - RNA, 21 nt, Human
cugaccagcagcgccuuuccc

SEQ ID NO: 3836124 - RNA, 17 nt, Human
cugaccagccuccaugc

SEQ ID NO: 3836125 - RNA, 22 nt, Human
cugaccagcucccccucccucc

SEQ ID NO: 3836126 - RNA, 13 nt, Human
cugaccagcugcu

SEQ ID NO: 3836127 - RNA, 22 nt, Human
cugaccauccacucuacccucc

SEQ ID NO: 3836128 - RNA, 14 nt, Human
cugaccaugcauuu

SEQ ID NO: 3836129 - RNA, 11 nt, Human
cugacccacug

SEQ ID NO: 3836130 - RNA, 13 nt, Human
cugacccacugcu

SEQ ID NO: 3836131 - RNA, 21 nt, Human
cugacccaggccgcagcucuu

SEQ ID NO: 3836132 - RNA, 12 nt, Human
cugacccagucc

SEQ ID NO: 3836133 - RNA, 16 nt, Human
cugacccagucccugg

SEQ ID NO: 3836134 - RNA, 18 nt, Human
cugacccagucccugggg

SEQ ID NO: 3836135 - RNA, 12 nt, Human
cugacccagugc

SEQ ID NO: 3836136 - RNA, 23 nt, Human
cugacccagugcccccacugacc

SEQ ID NO: 3836137 - RNA, 14 nt, Human
cugacccaugcugc

SEQ ID NO: 3836138 - RNA, 20 nt, Human
cugacccaugcugcccugug

SEQ ID NO: 3836139 - RNA, 21 nt, Human
cugacccaugcugcccuguga

SEQ ID NO: 3836140 - RNA, 13 nt, Human
cugacccaugggc

SEQ ID NO: 3836141 - RNA, 17 nt, Human
cugacccaugggcagga

SEQ ID NO: 3836142 - RNA, 19 nt, Human
cugacccaugggcaggaga

SEQ ID NO: 3836143 - RNA, 14 nt, Human
cugacccauugcug

SEQ ID NO: 3836144 - RNA, 20 nt, Human
cugaccccaaacaccuucca

SEQ ID NO: 3836145 - RNA, 21 nt, Human
cugaccccagugguauccugu

SEQ ID NO: 3836146 - RNA, 16 nt, Human
cugaccccaucaccua

SEQ ID NO: 3836147 - RNA, 18 nt, Human
cugaccccaucaccuacu

SEQ ID NO: 3836148 - RNA, 19 nt, Human
cugaccccccucaggaccc

SEQ ID NO: 3836149 - RNA, 21 nt, Human
cugaccccucauagcccucac

SEQ ID NO: 3836150 - RNA, 12 nt, Human
cugaccccuccu

SEQ ID NO: 3836151 - RNA, 17 nt, Human
cugaccccuccucacug

SEQ ID NO: 3836152 - RNA, 23 nt, Human
cugacccuccaccgcagaaggaa

SEQ ID NO: 3836153 - RNA, 22 nt, Human
cugacccuccccaaaggcuuug

SEQ ID NO: 3836154 - RNA, 22 nt, Human
cugacccuccuguugcacccag

SEQ ID NO: 3836155 - RNA, 23 nt, Human
cugacccuccuguugcacccagc

SEQ ID NO: 3836156 - RNA, 18 nt, Human
cugacccucuccacccca

SEQ ID NO: 3836157 - RNA, 17 nt, Human
cugacccugcagagaug

SEQ ID NO: 3836158 - RNA, 18 nt, Human
cugacccugcagagaugc

SEQ ID NO: 3836159 - RNA, 17 nt, Human
cugacccugguucucuc

SEQ ID NO: 3836160 - RNA, 13 nt, Human
cugacccuguaua

SEQ ID NO: 3836161 - RNA, 21 nt, Human
cugacccuguauauagcccag

SEQ ID NO: 3836162 - RNA, 20 nt, Human
cugacccuuacagccucuga

SEQ ID NO: 3836163 - RNA, 16 nt, Human
cugacccuuccagaca

SEQ ID NO: 3836164 - RNA, 17 nt, Human
cugacccuuccagacau

SEQ ID NO: 3836165 - RNA, 18 nt, Human
cugaccgaaacagcgcug

SEQ ID NO: 3836166 - RNA, 20 nt, Human
cugaccgaaacagcgcuggg

SEQ ID NO: 3836167 - RNA, 13 nt, Human
cugaccuccacag

SEQ ID NO: 3836168 - RNA, 14 nt, Human
cugaccuccacagc

SEQ ID NO: 3836169 - RNA, 11 nt, Human
cugaccuccca

SEQ ID NO: 3836170 - RNA, 14 nt, Human
cugaccucccagcc

SEQ ID NO: 3836171 - RNA, 17 nt, Human
cugaccucccagcccua

SEQ ID NO: 3836172 - RNA, 22 nt, Human
cugaccucccagcccuauggau

SEQ ID NO: 3836173 - RNA, 14 nt, Human
cugaccucccccuc

SEQ ID NO: 3836174 - RNA, 16 nt, Human
cugaccucccccuccu

SEQ ID NO: 3836175 - RNA, 17 nt, Human
cugaccucccccuccuu

SEQ ID NO: 3836176 - RNA, 18 nt, Human
cugaccucccucuaauuu

SEQ ID NO: 3836177 - RNA, 14 nt, Human
cugaccucuugcug

SEQ ID NO: 3836178 - RNA, 15 nt, Human
cugaccucuugcugu

SEQ ID NO: 3836179 - RNA, 20 nt, Human
cugaccucuugcugucucug

SEQ ID NO: 3836180 - RNA, 22 nt, Human
cugaccucuugcugucucugcu

SEQ ID NO: 3836181 - RNA, 13 nt, Human
cugaccugaggcu

SEQ ID NO: 3836182 - RNA, 21 nt, Human
cugaccugaggcuccugugcu

SEQ ID NO: 3836183 - RNA, 14 nt, Human
cugaccugccucuc

SEQ ID NO: 3836184 - RNA, 14 nt, Human
cugaccugcugacc

SEQ ID NO: 3836185 - RNA, 20 nt, Human
cugaccugcugaccugugca

SEQ ID NO: 3836186 - RNA, 10 nt, Human
cugaccuggc

SEQ ID NO: 3836187 - RNA, 19 nt, Human
cugaccugucaugcccccc

SEQ ID NO: 3836188 - RNA, 22 nt, Human
cugaccugucaugccccccuca

SEQ ID NO: 3836189 - RNA, 18 nt, Human
cugaccugugagcccagc

SEQ ID NO: 3836190 - RNA, 22 nt, Human
cugaccuucagcucacgcuuca

SEQ ID NO: 3836191 - RNA, 16 nt, Human
cugaccuuccucgcag

SEQ ID NO: 3836192 - RNA, 20 nt, Human
cugaccuugaacuccugggc

SEQ ID NO: 3836193 - RNA, 21 nt, Human
cugaccuugaacuccugggcu

SEQ ID NO: 3836194 - RNA, 22 nt, Human
cugaccuugaacuccugggcuc

SEQ ID NO: 3836195 - RNA, 19 nt, Human
cugaccuuguaaaagacag

SEQ ID NO: 3836196 - RNA, 23 nt, Human
cugaccuuugucaucuuucuucu

SEQ ID NO: 3836197 - RNA, 21 nt, Human
cugacgaaacuggccccggau

SEQ ID NO: 3836198 - RNA, 17 nt, Human
cugacgaggcugggcca

SEQ ID NO: 3836199 - RNA, 19 nt, Human
cugacgaggcugggccaag

SEQ ID NO: 3836200 - RNA, 16 nt, Human
cugacgcaacccacgu

SEQ ID NO: 3836201 - RNA, 22 nt, Human
cugacggaagccaacuuggcuu

SEQ ID NO: 3836202 - RNA, 16 nt, Human
cugacggaguccugug

SEQ ID NO: 3836203 - RNA, 14 nt, Human
cugacggcccugca

SEQ ID NO: 3836204 - RNA, 14 nt, Human
cugacggcgccccc

SEQ ID NO: 3836205 - RNA, 19 nt, Human
cugacggcgcccccagugu

SEQ ID NO: 3836206 - RNA, 22 nt, Human
cugacgucugaagcuugacucc

SEQ ID NO: 3836207 - RNA, 13 nt, Human
cugacguuccggg

SEQ ID NO: 3836208 - RNA, 23 nt, Human
cugacguuccgggcaaaugccag

SEQ ID NO: 3836209 - RNA, 17 nt, Human
gaugguuuuaaacuuuc

SEQ ID NO: 3836210 - RNA, 15 nt, Human
gauguaaaaucuugu

SEQ ID NO: 3836211 - RNA, 16 nt, Human
gauguaaaaucuuguc

SEQ ID NO: 3836212 - RNA, 12 nt, Human
gauguaaaguga

SEQ ID NO: 3836213 - RNA, 13 nt, Human
gauguaagagcuu

SEQ ID NO: 3836214 - RNA, 14 nt, Human
gauguaauacuucu

SEQ ID NO: 3836215 - RNA, 22 nt, Human
gauguaaucucucugcagcugc

SEQ ID NO: 3836216 - RNA, 12 nt, Human
gauguaauuuag

SEQ ID NO: 3836217 - RNA, 13 nt, Human
gauguaauuuugu

SEQ ID NO: 3836218 - RNA, 19 nt, Human
gauguaauuuuguguaaga

SEQ ID NO: 3836219 - RNA, 17 nt, Human
gauguacagucugucau

SEQ ID NO: 3836220 - RNA, 19 nt, Human
gauguacagucugucauga

SEQ ID NO: 3836221 - RNA, 14 nt, Human
gauguagauuuauu

SEQ ID NO: 3836222 - RNA, 21 nt, Human
gauguagcaaacccugucaaa

SEQ ID NO: 3836223 - RNA, 15 nt, Human
gauguagcauuaugc

SEQ ID NO: 3836224 - RNA, 19 nt, Human
gauguaggguaaggugccu

SEQ ID NO: 3836225 - RNA, 20 nt, Human
gauguaugaaggcuuuuggu

SEQ ID NO: 3836226 - RNA, 19 nt, Human
gauguaugcagcuaucugg

SEQ ID NO: 3836227 - RNA, 15 nt, Human
gauguauuuugugag

SEQ ID NO: 3836228 - RNA, 18 nt, Human
gauguauuuuuguacccu

SEQ ID NO: 3836229 - RNA, 15 nt, Human
gaugucacagggcca

SEQ ID NO: 3836230 - RNA, 18 nt, Human
gaugucauacagagaagu

SEQ ID NO: 3836231 - RNA, 20 nt, Human
gaugucauacagagaaguca

SEQ ID NO: 3836232 - RNA, 14 nt, Human
gaugucauguguuc

SEQ ID NO: 3836233 - RNA, 16 nt, Human
gaugucauguguuccc

SEQ ID NO: 3836234 - RNA, 12 nt, Human
gauguccagaag

SEQ ID NO: 3836235 - RNA, 15 nt, Human
gauguccccagcaga

SEQ ID NO: 3836236 - RNA, 16 nt, Human
gaugucccugggccag

SEQ ID NO: 3836237 - RNA, 20 nt, Human
gaugucccugggccaggguc

SEQ ID NO: 3836238 - RNA, 14 nt, Human
gaugucuaauaguu

SEQ ID NO: 3836239 - RNA, 14 nt, Human
gaugucugccaauu

SEQ ID NO: 3836240 - RNA, 19 nt, Human
gaugucuguuugcugaugg

SEQ ID NO: 3836241 - RNA, 18 nt, Human
gaugucuucauaccuaca

SEQ ID NO: 3836242 - RNA, 20 nt, Human
gaugucuucguacaguucuu

SEQ ID NO: 3836243 - RNA, 13 nt, Human
gaugucuuggaac

SEQ ID NO: 3836244 - RNA, 16 nt, Human
gaugucuuuguuaaga

SEQ ID NO: 3836245 - RNA, 19 nt, Human
gaugucuuuuuauuaaaau

SEQ ID NO: 3836246 - RNA, 18 nt, Human
gaugugaauuauugacac

SEQ ID NO: 3836247 - RNA, 14 nt, Human
gaugugacauuugu

SEQ ID NO: 3836248 - RNA, 17 nt, Human
gauguccucaccacaug

SEQ ID NO: 3836249 - RNA, 14 nt, Human
gauguccuguaaac

SEQ ID NO: 3836250 - RNA, 15 nt, Human
gaugucuccuaagca

SEQ ID NO: 3836251 - RNA, 16 nt, Human
gaugucucuaaagcac

SEQ ID NO: 3836252 - RNA, 22 nt, Human
gaugucugccaauuuuugccuu

SEQ ID NO: 3836253 - RNA, 16 nt, Human
gaugucuuauuuuuag

SEQ ID NO: 3836254 - RNA, 15 nt, Human
gaugucuucugccug

SEQ ID NO: 3836255 - RNA, 16 nt, Human
gaugucuucugccugu

SEQ ID NO: 3836256 - RNA, 18 nt, Human
gaugucuucugccuguua

SEQ ID NO: 3836257 - RNA, 20 nt, Human
gaugucuucugccuguuaua

SEQ ID NO: 3836258 - RNA, 13 nt, Human
gaugucuuuuaua

SEQ ID NO: 3836259 - RNA, 14 nt, Human
gaugucuuuucuug

SEQ ID NO: 3836260 - RNA, 19 nt, Human
gaugugaaacacuuugccu

SEQ ID NO: 3836261 - RNA, 12 nt, Human
gaugugaagcca

SEQ ID NO: 3836262 - RNA, 20 nt, Human
gaugugaauuauugacacug

SEQ ID NO: 3836263 - RNA, 22 nt, Human
gaugugaauuauugacacugaa

SEQ ID NO: 3836264 - RNA, 22 nt, Human
gaugugaauugccugcagagag

SEQ ID NO: 3836265 - RNA, 14 nt, Human
gaugugagaaaacc

SEQ ID NO: 3836266 - RNA, 16 nt, Human
gaugugauuguggaau

SEQ ID NO: 3836267 - RNA, 23 nt, Human
gaugugauuuaauaguguuaauc

SEQ ID NO: 3836268 - RNA, 16 nt, Human
gaugugcaaaaauuuu

SEQ ID NO: 3836269 - RNA, 16 nt, Human
gaugugcaaaaccuuu

SEQ ID NO: 3836270 - RNA, 20 nt, Human
gaugugcaaaaccuuuuacu

SEQ ID NO: 3836271 - RNA, 12 nt, Human
gaugugcaagcg

SEQ ID NO: 3836272 - RNA, 19 nt, Human
gaugugcaagcgacgacag

SEQ ID NO: 3836273 - RNA, 11 nt, Human
gaugugcauuc

SEQ ID NO: 3836274 - RNA, 15 nt, Human
gaugugccugggugg

SEQ ID NO: 3836275 - RNA, 20 nt, Human
gaugugcuuguuaacugagu

SEQ ID NO: 3836276 - RNA, 11 nt, Human
gaugugcuuuu

SEQ ID NO: 3836277 - RNA, 16 nt, Human
gaugugcuuuucucca

SEQ ID NO: 3836278 - RNA, 21 nt, Human
gauguggaaaagccaagaggc

SEQ ID NO: 3836279 - RNA, 19 nt, Human
gauguggaacugcugccac

SEQ ID NO: 3836280 - RNA, 12 nt, Human
gauguggagcac

SEQ ID NO: 3836281 - RNA, 14 nt, Human
gauguggagccagg

SEQ ID NO: 3836282 - RNA, 13 nt, Human
gauguggcccugg

SEQ ID NO: 3836283 - RNA, 14 nt, Human
gauguggcccuggc

SEQ ID NO: 3836284 - RNA, 20 nt, Human
gauguggcccuggccugcug

SEQ ID NO: 3836285 - RNA, 16 nt, Human
gauguggcugcagcag

SEQ ID NO: 3836286 - RNA, 18 nt, Human
gauguggcugcagcagcg

SEQ ID NO: 3836287 - RNA, 23 nt, Human
gaugugggagggagcagacagga

SEQ ID NO: 3836288 - RNA, 17 nt, Human
gauguggucacagcugu

SEQ ID NO: 3836289 - RNA, 14 nt, Human
gauguggugaaaag

SEQ ID NO: 3836290 - RNA, 22 nt, Human
gauguggugaggcaggcuuugu

SEQ ID NO: 3836291 - RNA, 22 nt, Human
gauguggugccugaggucugua

SEQ ID NO: 3836292 - RNA, 13 nt, Human
gauguguaauuuu

SEQ ID NO: 3836293 - RNA, 15 nt, Human
gauguguaucagugu

SEQ ID NO: 3836294 - RNA, 17 nt, Human
gauguguccugacacug

SEQ ID NO: 3836295 - RNA, 13 nt, Human
gaugugugcaugu

SEQ ID NO: 3836296 - RNA, 20 nt, Human
gauguguguugauacuguug

SEQ ID NO: 3836297 - RNA, 21 nt, Human
gauguguguugauacuguugc

SEQ ID NO: 3836298 - RNA, 23 nt, Human
gauguguguugauacuguugcac

SEQ ID NO: 3836299 - RNA, 22 nt, Human
gauguuaaaaaaauaagaagaa

SEQ ID NO: 3836300 - RNA, 17 nt, Human
gauguuaaaauaaaugg

SEQ ID NO: 3836301 - RNA, 19 nt, Human
gauguuaacacauuuugua

SEQ ID NO: 3836302 - RNA, 21 nt, Human
gauguuaacacauuuuguaua

SEQ ID NO: 3836303 - RNA, 22 nt, Human
gauguuaacacauuuuguauaa

SEQ ID NO: 3836304 - RNA, 18 nt, Human
gauguuaguguuuuaaga

SEQ ID NO: 3836305 - RNA, 20 nt, Human
gauguuauauuuuucuuaaa

SEQ ID NO: 3836306 - RNA, 15 nt, Human
gauguucaccuccug

SEQ ID NO: 3836307 - RNA, 18 nt, Human
gauguucacuguggcauu

SEQ ID NO: 3836308 - RNA, 19 nt, Human
gauguucagauugcuuuga

SEQ ID NO: 3836309 - RNA, 20 nt, Human
gauguucagauugcuuugau

SEQ ID NO: 3836310 - RNA, 12 nt, Human
gauguucuaagg

SEQ ID NO: 3836311 - RNA, 16 nt, Human
gauguucuaaggcucu

SEQ ID NO: 3836312 - RNA, 18 nt, Human
gauguucuaaggcucuga

SEQ ID NO: 3836313 - RNA, 21 nt, Human
gauguucuacuuuguucugcu

SEQ ID NO: 3836314 - RNA, 18 nt, Human
gauguucuagcauggcug

SEQ ID NO: 3836315 - RNA, 22 nt, Human
gauguucuauuuuuuguuuugu

SEQ ID NO: 3836316 - RNA, 14 nt, Human
gauguucuggcccu

SEQ ID NO: 3836317 - RNA, 19 nt, Human
gauguugaaaaaguucugc

SEQ ID NO: 3836318 - RNA, 18 nt, Human
gauguugaagaauacagu

SEQ ID NO: 3836319 - RNA, 16 nt, Human
gauguugagaaaccug

SEQ ID NO: 3836320 - RNA, 16 nt, Human
gauguugcuaacagca

SEQ ID NO: 3836321 - RNA, 14 nt, Human
gauguuuaaaacac

SEQ ID NO: 3836322 - RNA, 23 nt, Human
gauguuuaaaacaccuucuauag

SEQ ID NO: 3836323 - RNA, 23 nt, Human
gauguuuacagguggacacacaa

SEQ ID NO: 3836324 - RNA, 16 nt, Human
gauguuuaguaaucau

SEQ ID NO: 3836325 - RNA, 14 nt, Human
gauguuuauucuuc

SEQ ID NO: 3836326 - RNA, 23 nt, Human
gauguuuauucuucuagaguuca

SEQ ID NO: 3836327 - RNA, 13 nt, Human
gauguuucauuuu

SEQ ID NO: 3836328 - RNA, 16 nt, Human
gauguuugagcagugg

SEQ ID NO: 3836329 - RNA, 13 nt, Human
gauguuugcccaa

SEQ ID NO: 3836330 - RNA, 18 nt, Human
gauguuugcccaaaauuu

SEQ ID NO: 3836331 - RNA, 22 nt, Human
gauguuugcucuuguuuuuauu

SEQ ID NO: 3836332 - RNA, 15 nt, Human
gauguuuguggccuc

SEQ ID NO: 3836333 - RNA, 17 nt, Human
gauguuuguggccucag

SEQ ID NO: 3836334 - RNA, 23 nt, Human
gauguuuuagccauuguuggcuu

SEQ ID NO: 3836335 - RNA, 22 nt, Human
gauguuuugguagauuaaauau

SEQ ID NO: 3836336 - RNA, 18 nt, Human
gauguuuuuaaaaguuuc

SEQ ID NO: 3836337 - RNA, 16 nt, Human
gauguuuuuaaaaucu

SEQ ID NO: 3836338 - RNA, 17 nt, Human
gauuaaacuuaugaaug

SEQ ID NO: 3836339 - RNA, 16 nt, Human
gauuaaauaagauucu

SEQ ID NO: 3836340 - RNA, 19 nt, Human
gauuaaauucuugcaaagu

SEQ ID NO: 3836341 - RNA, 13 nt, Human
gauuaacaaauau

SEQ ID NO: 3836342 - RNA, 21 nt, Human
gauuaaccacuucagcugacu

SEQ ID NO: 3836343 - RNA, 19 nt, Human
gauuaacuuauuuagagau

SEQ ID NO: 3836344 - RNA, 17 nt, Human
gauuaaggucucucuuu

SEQ ID NO: 3836345 - RNA, 19 nt, Human
gauuaaggucucucuuugg

SEQ ID NO: 3836346 - RNA, 15 nt, Human
gauuaauuccuuucc

SEQ ID NO: 3836347 - RNA, 20 nt, Human
gauuaauuugcaucugaaau

SEQ ID NO: 3836348 - RNA, 21 nt, Human
gauuacaaaucagaagucauc

SEQ ID NO: 3836349 - RNA, 23 nt, Human
gauuacaggcaugggccaccacg

SEQ ID NO: 3836350 - RNA, 18 nt, Human
gauuacaggcuccugcca

SEQ ID NO: 3836351 - RNA, 18 nt, Human
gauuacagggaugagcca

SEQ ID NO: 3836352 - RNA, 20 nt, Human
gauuacaggugugaaccacc

SEQ ID NO: 3836353 - RNA, 15 nt, Human
gauuacauucaguug

SEQ ID NO: 3836354 - RNA, 21 nt, Human
gauuacaagcgugagccacug

SEQ ID NO: 3836355 - RNA, 14 nt, Human
gauuacacacguga

SEQ ID NO: 3836356 - RNA, 13 nt, Human
gauuacagaggaa

SEQ ID NO: 3836357 - RNA, 18 nt, Human
gauuacaggcgugagcca

SEQ ID NO: 3836358 - RNA, 20 nt, Human
gauuacaggcgugagccacc

SEQ ID NO: 3836359 - RNA, 21 nt, Human
gauuacaggcuccugccacca

SEQ ID NO: 3836360 - RNA, 20 nt, Human
gauuacagggaugagccacc

SEQ ID NO: 3836361 - RNA, 14 nt, Human
gauuacauaaucug

SEQ ID NO: 3836362 - RNA, 21 nt, Human
gauuacccaagcaaaaucaug

SEQ ID NO: 3836363 - RNA, 14 nt, Human
gauuaccuccugag

SEQ ID NO: 3836364 - RNA, 17 nt, Human
gauuacugucaauaaac

SEQ ID NO: 3836365 - RNA, 19 nt, Human
gauuacuucucuauaaaaa

SEQ ID NO: 3836366 - RNA, 19 nt, Human
gauuagaaaaauuccuaag

SEQ ID NO: 3836367 - RNA, 14 nt, Human
gauuagaauucugu

SEQ ID NO: 3836368 - RNA, 14 nt, Human
gauuagacagaaca

SEQ ID NO: 3836369 - RNA, 19 nt, Human
gauuagacagaacaccuau

SEQ ID NO: 3836370 - RNA, 19 nt, Human
gauuagacuggacagcuug

SEQ ID NO: 3836371 - RNA, 14 nt, Human
gauuagagaguguu

SEQ ID NO: 3836372 - RNA, 18 nt, Human
gauuagaggcagaucugg

SEQ ID NO: 3836373 - RNA, 17 nt, Human
gauuagagggagguguu

SEQ ID NO: 3836374 - RNA, 15 nt, Human
gauuagaucuuuuaa

SEQ ID NO: 3836375 - RNA, 16 nt, Human
gauuagcucuggacca

SEQ ID NO: 3836376 - RNA, 12 nt, Human
gauuagcuuugu

SEQ ID NO: 3836377 - RNA, 19 nt, Human
gauuagguuucagcagagc

SEQ ID NO: 3836378 - RNA, 20 nt, Human
gauuagguuucagcagagcu

SEQ ID NO: 3836379 - RNA, 15 nt, Human
gauuaguaaagaaau

SEQ ID NO: 3836380 - RNA, 15 nt, Human
gauuaguuuagaaca

SEQ ID NO: 3836381 - RNA, 16 nt, Human
gauuaguuuucuuguu

SEQ ID NO: 3836382 - RNA, 22 nt, Human
gauuaguuuucuuguugcuuug

SEQ ID NO: 3836383 - RNA, 17 nt, Human
gauuauaacuugucuaa

SEQ ID NO: 3836384 - RNA, 13 nt, Human
gauuauacagaau

SEQ ID NO: 3836385 - RNA, 21 nt, Human
gauuauaguugugggugggag

SEQ ID NO: 3836386 - RNA, 21 nt, Human
gauuauauaaagaccuauaaa

SEQ ID NO: 3836387 - RNA, 18 nt, Human
gauuauauaucccugaua

SEQ ID NO: 3836388 - RNA, 18 nt, Human
gauuauaucaaaguauuu

SEQ ID NO: 3836389 - RNA, 19 nt, Human
gauuauauugagacaaaaa

SEQ ID NO: 3836390 - RNA, 21 nt, Human
gauuaucguuuucuuaaagug

SEQ ID NO: 3836391 - RNA, 20 nt, Human
gauuauggaaaaauaaaacu

SEQ ID NO: 3836392 - RNA, 17 nt, Human
gauuaugggucacagga

SEQ ID NO: 3836393 - RNA, 16 nt, Human
gauuaugguuuuguga

SEQ ID NO: 3836394 - RNA, 18 nt, Human
gauuaugucuuuuauauu

SEQ ID NO: 3836395 - RNA, 20 nt, Human
gauuaugucuuuuauauuug

SEQ ID NO: 3836396 - RNA, 15 nt, Human
gauuauucacugauu

SEQ ID NO: 3836397 - RNA, 16 nt, Human
gauuauucacugauuu

SEQ ID NO: 3836398 - RNA, 21 nt, Human
gauuauucacugauuugacau

SEQ ID NO: 3836399 - RNA, 16 nt, Human
gauuauucauuuaaaa

SEQ ID NO: 3836400 - RNA, 23 nt, Human
gauuauucccuguacaauauuua

SEQ ID NO: 3836401 - RNA, 13 nt, Human
gauuauugaaaua

SEQ ID NO: 3836402 - RNA, 14 nt, Human
gauuauuguauuua

SEQ ID NO: 3836403 - RNA, 17 nt, Human
gauuauuuaagacuaaa

SEQ ID NO: 3836404 - RNA, 17 nt, Human
gauuauuuaauaacauu

SEQ ID NO: 3836405 - RNA, 18 nt, Human
gauuauuuaauaacauua

SEQ ID NO: 3836406 - RNA, 11 nt, Human
gauuauuugca

SEQ ID NO: 3836407 - RNA, 12 nt, Human
gauuauuugcau

SEQ ID NO: 3836408 - RNA, 23 nt, Human
gauuauuuguuauuuguacaguu

SEQ ID NO: 3836409 - RNA, 14 nt, Human
gauuauuuuggaaa

SEQ ID NO: 3836410 - RNA, 15 nt, Human
gauuauuuuuuauga

SEQ ID NO: 3836411 - RNA, 17 nt, Human
gauuauuuuuucagacc

SEQ ID NO: 3836412 - RNA, 14 nt, Human
gauuggacauuuuc

SEQ ID NO: 3836413 - RNA, 14 nt, Human
gauuggaccaggcc

SEQ ID NO: 3836414 - RNA, 15 nt, Human
gauuggaccaggcca

SEQ ID NO: 3836415 - RNA, 22 nt, Human
gauuggauacgcaucagacaga

SEQ ID NO: 3836416 - RNA, 20 nt, Human
gauuggauuauucauuuaaa

SEQ ID NO: 3836417 - RNA, 20 nt, Human
gauuggauuauuuaauaaca

SEQ ID NO: 3836418 - RNA, 16 nt, Human
gauuggccuguagagu

SEQ ID NO: 3836419 - RNA, 12 nt, Human
gauuggcucacc

SEQ ID NO: 3836420 - RNA, 18 nt, Human
gauuggcucacccaagca

SEQ ID NO: 3836421 - RNA, 20 nt, Human
gauuggcuuguagaauuguu

SEQ ID NO: 3836422 - RNA, 13 nt, Human
gauugggacagag

SEQ ID NO: 3836423 - RNA, 19 nt, Human
gauugggugggcaggaaaa

SEQ ID NO: 3836424 - RNA, 21 nt, Human
gauuggguuuuuggacuucug

SEQ ID NO: 3836425 - RNA, 17 nt, Human
gauugguuucucuucuc

SEQ ID NO: 3836426 - RNA, 20 nt, Human
gauugguuuuaauugaagga

SEQ ID NO: 3836427 - RNA, 13 nt, Human
gauuguaaaaaaa

SEQ ID NO: 3836428 - RNA, 18 nt, Human
gauuguaaaaaaaaaugc

SEQ ID NO: 3836429 - RNA, 22 nt, Human
gauuguaaaaaaaaaugccuuu

SEQ ID NO: 3836430 - RNA, 23 nt, Human
gauuguaaaccgcuuuggccuga

SEQ ID NO: 3836431 - RNA, 22 nt, Human
gauuguaacguugcugugggaa

SEQ ID NO: 3836432 - RNA, 23 nt, Human
gauuguaacguugcugugggaac

SEQ ID NO: 3836433 - RNA, 22 nt, Human
gauuguacagaaucauugcuua

SEQ ID NO: 3836434 - RNA, 15 nt, Human
gauuguauuguugaa

SEQ ID NO: 3836435 - RNA, 21 nt, Human
gauugucaccaugaucacuua

SEQ ID NO: 3836436 - RNA, 19 nt, Human
gauuguccucauuucucca

SEQ ID NO: 3836437 - RNA, 13 nt, Human
gauugugccccug

SEQ ID NO: 3836438 - RNA, 18 nt, Human
gauugugccuaauguguu

SEQ ID NO: 3836439 - RNA, 16 nt, Human
gauuguggaauguugg

SEQ ID NO: 3836440 - RNA, 21 nt, Human
gauuguggaauguuggauaag

SEQ ID NO: 3836441 - RNA, 23 nt, Human
gauugugggaauuaaggaaguga

SEQ ID NO: 3836442 - RNA, 16 nt, Human
gauuguuaaaauaacu

SEQ ID NO: 3836443 - RNA, 15 nt, Human
gauuguuaauuucag

SEQ ID NO: 3836444 - RNA, 14 nt, Human
gauuguuauuaaau

SEQ ID NO: 3836445 - RNA, 21 nt, Human
gauuguuuaucuagauguaaa

SEQ ID NO: 3836446 - RNA, 15 nt, Human
gauuguuucuauaca

SEQ ID NO: 3836447 - RNA, 12 nt, Human
gauuguuuuauc

SEQ ID NO: 3836448 - RNA, 18 nt, Human
gauuguuuuaucaugaca

SEQ ID NO: 3836449 - RNA, 22 nt, Human
gauuguuuuuuaaaaauggaua

SEQ ID NO: 3836450 - RNA, 16 nt, Human
gauuuaaacacacaga

SEQ ID NO: 3836451 - RNA, 17 nt, Human
gauuuaaacacacagau

SEQ ID NO: 3836452 - RNA, 14 nt, Human
gauuuaaacucuga

SEQ ID NO: 3836453 - RNA, 20 nt, Human
gauuuaacagaaauguacag

SEQ ID NO: 3836454 - RNA, 17 nt, Human
gauuuaacagucauuua

SEQ ID NO: 3836455 - RNA, 18 nt, Human
gauuuaagacacuuuuug

SEQ ID NO: 3836456 - RNA, 16 nt, Human
gauuuaagcacaaacu

SEQ ID NO: 3836457 - RNA, 15 nt, Human
gauuuaagguauuua

SEQ ID NO: 3836458 - RNA, 13 nt, Human
gauuuaauaaaau

SEQ ID NO: 3836459 - RNA, 17 nt, Human
gauuuaauaaaauaauu

SEQ ID NO: 3836460 - RNA, 22 nt, Human
gauuuaauaaaauaauucuaaa

SEQ ID NO: 3836461 - RNA, 19 nt, Human
gauuuaauaguguuaauca

SEQ ID NO: 3836462 - RNA, 23 nt, Human
gauuuaauaguguuaaucaauuu

SEQ ID NO: 3836463 - RNA, 23 nt, Human
gauuuaauauaaaguuuuauaua

SEQ ID NO: 3836464 - RNA, 15 nt, Human
gauuuaauucucuug

SEQ ID NO: 3836465 - RNA, 20 nt, Human
gauuuaauuugccaaaauaa

SEQ ID NO: 3836466 - RNA, 15 nt, Human
gauuuaccacuugug

SEQ ID NO: 3836467 - RNA, 16 nt, Human
gauuuaccacuugugu

SEQ ID NO: 3836468 - RNA, 20 nt, Human
gauuuacccagaaugucaga

SEQ ID NO: 3836469 - RNA, 22 nt, Human
gauuuacccagaaugucagauu

SEQ ID NO: 3836470 - RNA, 15 nt, Human
gauuuagaaguguca

SEQ ID NO: 3836471 - RNA, 22 nt, Human
gauuuagugaaagcuagagaua

SEQ ID NO: 3836472 - RNA, 13 nt, Human
gauuuaguuucag

SEQ ID NO: 3836473 - RNA, 13 nt, Human
gauuuauaaaugc

SEQ ID NO: 3836474 - RNA, 18 nt, Human
gauuuauaaaugcuauuu

SEQ ID NO: 3836475 - RNA, 19 nt, Human
gauuuauauaaauguaaaa

SEQ ID NO: 3836476 - RNA, 12 nt, Human
gauuuaucaaau

SEQ ID NO: 3836477 - RNA, 14 nt, Human
gauuuaucaaauca

SEQ ID NO: 3836478 - RNA, 17 nt, Human
gauuuaucacacaaagc

SEQ ID NO: 3836479 - RNA, 20 nt, Human
gauuuaucacacaaagcaga

SEQ ID NO: 3836480 - RNA, 16 nt, Human
gauuuauuaaagaaaa

SEQ ID NO: 3836481 - RNA, 17 nt, Human
gauuuauuaaagaaaaa

SEQ ID NO: 3836482 - RNA, 12 nt, Human
gauuuauuaacu

SEQ ID NO: 3836483 - RNA, 17 nt, Human
gauuuauuugcuucuuc

SEQ ID NO: 3836484 - RNA, 19 nt, Human
gauuucaagaaaaaauaaa

SEQ ID NO: 3836485 - RNA, 11 nt, Human
gauuucacucu

SEQ ID NO: 3836486 - RNA, 17 nt, Human
gauuucacucuccuugg

SEQ ID NO: 3836487 - RNA, 18 nt, Human
gauuucacucuccuuggu

SEQ ID NO: 3836488 - RNA, 12 nt, Human
gauuucagaaac

SEQ ID NO: 3836489 - RNA, 15 nt, Human
gauuucagcucacug

SEQ ID NO: 3836490 - RNA, 22 nt, Human
gauuucaggauacucugucaga

SEQ ID NO: 3836491 - RNA, 16 nt, Human
gauuucagucuuuucc

SEQ ID NO: 3836492 - RNA, 17 nt, Human
gauuucagucuuuuccu

SEQ ID NO: 3836493 - RNA, 23 nt, Human
gauuucauaccucagaauguaaa

SEQ ID NO: 3836494 - RNA, 17 nt, Human
gauuucaucugcucucc

SEQ ID NO: 3836495 - RNA, 20 nt, Human
gauuucaugcuaucucugug

SEQ ID NO: 3836496 - RNA, 12 nt, Human
gauuucauguac

SEQ ID NO: 3836497 - RNA, 21 nt, Human
gauuucauguacugcauuauu

SEQ ID NO: 3836498 - RNA, 20 nt, Human
gauuucauuucaacuguuug

SEQ ID NO: 3836499 - RNA, 15 nt, Human
cugcaccccccuggg

SEQ ID NO: 3836500 - RNA, 16 nt, Human
cugcaccccccugggc

SEQ ID NO: 3836501 - RNA, 17 nt, Human
cugcacccccuccugcu

SEQ ID NO: 3836502 - RNA, 14 nt, Human
cugcaccccuuccu

SEQ ID NO: 3836503 - RNA, 19 nt, Human
cugcaccccuuccugggca

SEQ ID NO: 3836504 - RNA, 19 nt, Human
cugcaccccuucucuccuc

SEQ ID NO: 3836505 - RNA, 21 nt, Human
cugcaccccuucucuccuccc

SEQ ID NO: 3836506 - RNA, 13 nt, Human
cugcacccuccac

SEQ ID NO: 3836507 - RNA, 15 nt, Human
cugcacccuccaccc

SEQ ID NO: 3836508 - RNA, 18 nt, Human
cugcacccuccacccugu

SEQ ID NO: 3836509 - RNA, 13 nt, Human
cugcacccuucuu

SEQ ID NO: 3836510 - RNA, 22 nt, Human
cugcaccggcuggccuggcccc

SEQ ID NO: 3836511 - RNA, 12 nt, Human
cugcaccgggcc

SEQ ID NO: 3836512 - RNA, 14 nt, Human
cugcaccgggccac

SEQ ID NO: 3836513 - RNA, 18 nt, Human
cugcaccgggccacagag

SEQ ID NO: 3836514 - RNA, 23 nt, Human
cugcaccgggccacagagaaagu

SEQ ID NO: 3836515 - RNA, 14 nt, Human
cugcaccggggccu

SEQ ID NO: 3836516 - RNA, 20 nt, Human
cugcaccuccccccacugca

SEQ ID NO: 3836517 - RNA, 13 nt, Human
cugcaccugugca

SEQ ID NO: 3836518 - RNA, 15 nt, Human
cugcaccuuaucuua

SEQ ID NO: 3836519 - RNA, 22 nt, Human
cugcacgaauggaagaggcacc

SEQ ID NO: 3836520 - RNA, 18 nt, Human
cugcacggugggccuugc

SEQ ID NO: 3836521 - RNA, 19 nt, Human
cugcacggugggccuugcu

SEQ ID NO: 3836522 - RNA, 18 nt, Human
cugcacuaaagccagccu

SEQ ID NO: 3836523 - RNA, 21 nt, Human
cugcacuaaagccagccugac

SEQ ID NO: 3836524 - RNA, 23 nt, Human
cugcacuaaagccagccugaccu

SEQ ID NO: 3836525 - RNA, 17 nt, Human
cugcacuaacagagugg

SEQ ID NO: 3836526 - RNA, 23 nt, Human
cugcacuacuccucugcagugcc

SEQ ID NO: 3836527 - RNA, 14 nt, Human
cugcacuacugaca

SEQ ID NO: 3836528 - RNA, 17 nt, Human
cugcacuauagccuagg

SEQ ID NO: 3836529 - RNA, 20 nt, Human
cugcacuauagccuagguga

SEQ ID NO: 3836530 - RNA, 22 nt, Human
cugcacuauagccuaggugaca

SEQ ID NO: 3836531 - RNA, 14 nt, Human
cugcacucaagcuu

SEQ ID NO: 3836532 - RNA, 20 nt, Human
cugcacuccagccugggcga

SEQ ID NO: 3836533 - RNA, 19 nt, Human
cugcacuccagccugggug

SEQ ID NO: 3836534 - RNA, 16 nt, Human
cugcacucccaccuga

SEQ ID NO: 3836535 - RNA, 13 nt, Human
cugcacuccccug

SEQ ID NO: 3836536 - RNA, 16 nt, Human
cugcacuccccugcug

SEQ ID NO: 3836537 - RNA, 17 nt, Human
cugcacuccccugcugg

SEQ ID NO: 3836538 - RNA, 18 nt, Human
cugcacuccccugcuggg

SEQ ID NO: 3836539 - RNA, 19 nt, Human
cugcacuccccugcugggu

SEQ ID NO: 3836540 - RNA, 23 nt, Human
cugcacucuaacccuaggcauca

SEQ ID NO: 3836541 - RNA, 16 nt, Human
cugcacucuagccgga

SEQ ID NO: 3836542 - RNA, 20 nt, Human
cugcacucuagccuggguga

SEQ ID NO: 3836543 - RNA, 13 nt, Human
cugcacucugugc

SEQ ID NO: 3836544 - RNA, 16 nt, Human
cugcacucugugccca

SEQ ID NO: 3836545 - RNA, 22 nt, Human
cugcacucugugcccaugggca

SEQ ID NO: 3836546 - RNA, 14 nt, Human
cugcacugaaaagg

SEQ ID NO: 3836547 - RNA, 14 nt, Human
cugcacuguaaaau

SEQ ID NO: 3836548 - RNA, 15 nt, Human
cugcacuguaaaaug

SEQ ID NO: 3836549 - RNA, 16 nt, Human
cugcacuguccugcuc

SEQ ID NO: 3836550 - RNA, 17 nt, Human
cugcacuguccugcucc

SEQ ID NO: 3836551 - RNA, 20 nt, Human
cugcacuguccugcuccaca

SEQ ID NO: 3836552 - RNA, 16 nt, Human
cugcacuuacuugcuu

SEQ ID NO: 3836553 - RNA, 23 nt, Human
cugcacuugcagacucuacagag

SEQ ID NO: 3836554 - RNA, 23 nt, Human
cugcacuugcgguuccggcaugg

SEQ ID NO: 3836555 - RNA, 15 nt, Human
cugcacuugggggcu

SEQ ID NO: 3836556 - RNA, 21 nt, Human
cugcacuugggggcucagcaa

SEQ ID NO: 3836557 - RNA, 23 nt, Human
cugcacuugggggcucagcaagg

SEQ ID NO: 3836558 - RNA, 20 nt, Human
cugcacuuugaugucaugug

SEQ ID NO: 3836559 - RNA, 23 nt, Human
cugcacuuugaugucauguguuc

SEQ ID NO: 3836560 - RNA, 19 nt, Human
cugcagaaccggagagcca

SEQ ID NO: 3836561 - RNA, 21 nt, Human
cugcagaacguauugguccag

SEQ ID NO: 3836562 - RNA, 23 nt, Human
cugcagaacguauugguccagcu

SEQ ID NO: 3836563 - RNA, 15 nt, Human
cugcagacccugccc

SEQ ID NO: 3836564 - RNA, 21 nt, Human
cugcagacccugcccuuguuu

SEQ ID NO: 3836565 - RNA, 14 nt, Human
cugcagaccugucc

SEQ ID NO: 3836566 - RNA, 20 nt, Human
cugcagaccuguccuccugg

SEQ ID NO: 3836567 - RNA, 15 nt, Human
cugcagacgcccaga

SEQ ID NO: 3836568 - RNA, 13 nt, Human
cugcagacugcua

SEQ ID NO: 3836569 - RNA, 14 nt, Human
cugcagacugcuag

SEQ ID NO: 3836570 - RNA, 14 nt, Human
cugcagacuuccca

SEQ ID NO: 3836571 - RNA, 17 nt, Human
cugcagacuucccagcu

SEQ ID NO: 3836572 - RNA, 14 nt, Human
cugcagagagaagc

SEQ ID NO: 3836573 - RNA, 15 nt, Human
cugcagagcaccuuu

SEQ ID NO: 3836574 - RNA, 21 nt, Human
cugcagagcaguaagggaaca

SEQ ID NO: 3836575 - RNA, 12 nt, Human
cugcagagcugc

SEQ ID NO: 3836576 - RNA, 23 nt, Human
cugcagagcugcgggcugggugu

SEQ ID NO: 3836577 - RNA, 12 nt, Human
cugcagaggacg

SEQ ID NO: 3836578 - RNA, 13 nt, Human
cugcagaggccag

SEQ ID NO: 3836579 - RNA, 21 nt, Human
cugcagaggccagaggccccc

SEQ ID NO: 3836580 - RNA, 23 nt, Human
cugcagaggggaaaccaguguag

SEQ ID NO: 3836581 - RNA, 23 nt, Human
cugcagaggggcaggcccugcac

SEQ ID NO: 3836582 - RNA, 13 nt, Human
cugcagaggguua

SEQ ID NO: 3836583 - RNA, 22 nt, Human
cugcagaggguuaggagugggu

SEQ ID NO: 3836584 - RNA, 17 nt, Human
cugcagaggucugugcu

SEQ ID NO: 3836585 - RNA, 14 nt, Human
cugcagaguuugga

SEQ ID NO: 3836586 - RNA, 18 nt, Human
cugcagauagaaagcauu

SEQ ID NO: 3836587 - RNA, 21 nt, Human
cugcagaugccacccuagcca

SEQ ID NO: 3836588 - RNA, 18 nt, Human
cugcagauuugggcugga

SEQ ID NO: 3836589 - RNA, 17 nt, Human
cugcagcaaacacucca

SEQ ID NO: 3836590 - RNA, 15 nt, Human
cugcagcaauaaagc

SEQ ID NO: 3836591 - RNA, 17 nt, Human
cugcagcaauaaagcag

SEQ ID NO: 3836592 - RNA, 12 nt, Human
cugcagcaccuc

SEQ ID NO: 3836593 - RNA, 17 nt, Human
cugcagcaccuccaggc

SEQ ID NO: 3836594 - RNA, 20 nt, Human
cugcagcaccuccaggccug

SEQ ID NO: 3836595 - RNA, 14 nt, Human
cugcagcacggaca

SEQ ID NO: 3836596 - RNA, 20 nt, Human
cugcagcacggacaauaaac

SEQ ID NO: 3836597 - RNA, 13 nt, Human
cugcagcagaggc

SEQ ID NO: 3836598 - RNA, 18 nt, Human
cugcagcagaggcacugg

SEQ ID NO: 3836599 - RNA, 20 nt, Human
cugcagcagcgguggccucu

SEQ ID NO: 3836600 - RNA, 19 nt, Human
cugcagcaugaccugugac

SEQ ID NO: 3836601 - RNA, 22 nt, Human
cugcagcauguugcugaggagu

SEQ ID NO: 3836602 - RNA, 16 nt, Human
cugcagccaggccacu

SEQ ID NO: 3836603 - RNA, 12 nt, Human
cugcagcccugg

SEQ ID NO: 3836604 - RNA, 17 nt, Human
cugcagcccuggcccau

SEQ ID NO: 3836605 - RNA, 13 nt, Human
cugcagccucaga

SEQ ID NO: 3836606 - RNA, 16 nt, Human
cugcagccucaggacu

SEQ ID NO: 3836607 - RNA, 17 nt, Human
cugcagccucaggacug

SEQ ID NO: 3836608 - RNA, 18 nt, Human
cugcagccucaggacugg

SEQ ID NO: 3836609 - RNA, 20 nt, Human
cugcagccucaggacuggga

SEQ ID NO: 3836610 - RNA, 21 nt, Human
cugcagccucaggacugggag

SEQ ID NO: 3836611 - RNA, 13 nt, Human
cugcagccucccu

SEQ ID NO: 3836612 - RNA, 21 nt, Human
cugcagccuccgcuucccugg

SEQ ID NO: 3836613 - RNA, 20 nt, Human
cugcagccuccuccugacca

SEQ ID NO: 3836614 - RNA, 18 nt, Human
cugcagccuccuucuccu

SEQ ID NO: 3836615 - RNA, 12 nt, Human
cugcagccugca

SEQ ID NO: 3836616 - RNA, 15 nt, Human
cugcagccugcagga

SEQ ID NO: 3836617 - RNA, 15 nt, Human
cugcagccuggaggc

SEQ ID NO: 3836618 - RNA, 23 nt, Human
gcaaauaaguguauuuugaaauu

SEQ ID NO: 3836619 - RNA, 22 nt, Human
gcaaauaauuuccuggugugaa

SEQ ID NO: 3836620 - RNA, 22 nt, Human
gcaaauacuuagcaaaaagugg

SEQ ID NO: 3836621 - RNA, 14 nt, Human
gcaaauauaaacau

SEQ ID NO: 3836622 - RNA, 15 nt, Human
gcaaauauaaacauc

SEQ ID NO: 3836623 - RNA, 17 nt, Human
gcaaauauaaacaucuc

SEQ ID NO: 3836624 - RNA, 20 nt, Human
gcaaaucagaaacuugugaa

SEQ ID NO: 3836625 - RNA, 15 nt, Human
gcaaaucauagcugg

SEQ ID NO: 3836626 - RNA, 14 nt, Human
gcaaaucauuuguu

SEQ ID NO: 3836627 - RNA, 17 nt, Human
gcaaauccuaugugauu

SEQ ID NO: 3836628 - RNA, 23 nt, Human
gcaaauccuaugugauuuuaacu

SEQ ID NO: 3836629 - RNA, 17 nt, Human
gcaaauccuuugugaaa

SEQ ID NO: 3836630 - RNA, 22 nt, Human
gcaaaucgaaugaaauuaacug

SEQ ID NO: 3836631 - RNA, 12 nt, Human
gcaaaugacuuu

SEQ ID NO: 3836632 - RNA, 16 nt, Human
gcaaaugagcucugaa

SEQ ID NO: 3836633 - RNA, 15 nt, Human
gcaaaugccagggcc

SEQ ID NO: 3836634 - RNA, 20 nt, Human
gcaaaugcccaagggaaaga

SEQ ID NO: 3836635 - RNA, 11 nt, Human
gcaaaugcccu

SEQ ID NO: 3836636 - RNA, 14 nt, Human
gcaaauggccucau

SEQ ID NO: 3836637 - RNA, 19 nt, Human
gcaaaugucaugcugccuu

SEQ ID NO: 3836638 - RNA, 15 nt, Human
gcaaauguuacauag

SEQ ID NO: 3836639 - RNA, 16 nt, Human
gcaaauguuuaaacau

SEQ ID NO: 3836640 - RNA, 17 nt, Human
gcaaauguuuaaacauu

SEQ ID NO: 3836641 - RNA, 19 nt, Human
gcaaauguuuauuuaaaag

SEQ ID NO: 3836642 - RNA, 16 nt, Human
gcaaauugucacagga

SEQ ID NO: 3836643 - RNA, 19 nt, Human
gcaaggggugccugggaac

SEQ ID NO: 3836644 - RNA, 14 nt, Human
gcaaggucauuuuu

SEQ ID NO: 3836645 - RNA, 18 nt, Human
gcaagguccggcccaucc

SEQ ID NO: 3836646 - RNA, 19 nt, Human
gcaagguuaagcaaggugg

SEQ ID NO: 3836647 - RNA, 17 nt, Human
gcaagguuuaaguuauu

SEQ ID NO: 3836648 - RNA, 22 nt, Human
gcaagguuuaaguuauuaagag

SEQ ID NO: 3836649 - RNA, 20 nt, Human
gcaagguuuaggcugguggc

SEQ ID NO: 3836650 - RNA, 23 nt, Human
gcaagguuuaggcugguggccca

SEQ ID NO: 3836651 - RNA, 18 nt, Human
gcaaguagauaaauauuu

SEQ ID NO: 3836652 - RNA, 19 nt, Human
gcaaguagauaaauauuug

SEQ ID NO: 3836653 - RNA, 14 nt, Human
gcaaguaugugagu

SEQ ID NO: 3836654 - RNA, 18 nt, Human
gcaaguaugugagugugu

SEQ ID NO: 3836655 - RNA, 12 nt, Human
gcaagucaggac

SEQ ID NO: 3836656 - RNA, 20 nt, Human
gcaagucccugacucucugu

SEQ ID NO: 3836657 - RNA, 21 nt, Human
gcaaguccuaagccuguuagc

SEQ ID NO: 3836658 - RNA, 19 nt, Human
gcaaguccuuuuguaaagu

SEQ ID NO: 3836659 - RNA, 19 nt, Human
gcaagucucuuuauauggc

SEQ ID NO: 3836660 - RNA, 21 nt, Human
gcaagucugcagcccggcgcc

SEQ ID NO: 3836661 - RNA, 22 nt, Human
gcaagucuuuaggucuuuguaa

SEQ ID NO: 3836662 - RNA, 21 nt, Human
gcaagugaagguuuacaauuu

SEQ ID NO: 3836663 - RNA, 13 nt, Human
gcaagugaauuug

SEQ ID NO: 3836664 - RNA, 20 nt, Human
gcaagugaauuuuucucuaa

SEQ ID NO: 3836665 - RNA, 17 nt, Human
gcaagugagagagaugg

SEQ ID NO: 3836666 - RNA, 22 nt, Human
gcaagugagagagaugggagcu

SEQ ID NO: 3836667 - RNA, 13 nt, Human
gcaagugagagcu

SEQ ID NO: 3836668 - RNA, 21 nt, Human
gcaaguguaugcacgugugca

SEQ ID NO: 3836669 - RNA, 23 nt, Human
gcaaguguguaugugcgugugug

SEQ ID NO: 3836670 - RNA, 12 nt, Human
gcaagugugugc

SEQ ID NO: 3836671 - RNA, 13 nt, Human
gcaagugugugca

SEQ ID NO: 3836672 - RNA, 20 nt, Human
gcaaguuaagagaaacuuua

SEQ ID NO: 3836673 - RNA, 22 nt, Human
gcaaguuucuagcuagaaauau

SEQ ID NO: 3836674 - RNA, 20 nt, Human
gcaaguuuucccugaaguua

SEQ ID NO: 3836675 - RNA, 16 nt, Human
gcaauaaaagcccagg

SEQ ID NO: 3836676 - RNA, 19 nt, Human
gcaauaaaagcccaggagc

SEQ ID NO: 3836677 - RNA, 16 nt, Human
gcaauaaaauggguuu

SEQ ID NO: 3836678 - RNA, 13 nt, Human
gcaauaaaauuua

SEQ ID NO: 3836679 - RNA, 15 nt, Human
gcaauaaaauuuaaa

SEQ ID NO: 3836680 - RNA, 13 nt, Human
gcaauaaagaaga

SEQ ID NO: 3836681 - RNA, 11 nt, Human
gcaauaaagca

SEQ ID NO: 3836682 - RNA, 13 nt, Human
gcaauaaaguaua

SEQ ID NO: 3836683 - RNA, 19 nt, Human
gcaauaaaucugacccagu

SEQ ID NO: 3836684 - RNA, 21 nt, Human
gcaauaaaucugacccagugc

SEQ ID NO: 3836685 - RNA, 16 nt, Human
gcaauaaauuuugaaa

SEQ ID NO: 3836686 - RNA, 16 nt, Human
gcaauaacagcugcaa

SEQ ID NO: 3836687 - RNA, 22 nt, Human
gcaauaacaguaguguuacaug

SEQ ID NO: 3836688 - RNA, 21 nt, Human
gcaauaacguuuaagccaaaa

SEQ ID NO: 3836689 - RNA, 23 nt, Human
gcaauaaggggagaguaacccug

SEQ ID NO: 3836690 - RNA, 13 nt, Human
gcaauaaugcagu

SEQ ID NO: 3836691 - RNA, 18 nt, Human
gcaauaauggucccaucc

SEQ ID NO: 3836692 - RNA, 20 nt, Human
gcaauaauggucccauccag

SEQ ID NO: 3836693 - RNA, 17 nt, Human
gcaauagugggcccucc

SEQ ID NO: 3836694 - RNA, 17 nt, Human
gcaauaguguguucuga

SEQ ID NO: 3836695 - RNA, 14 nt, Human
gcaauauaaccaau

SEQ ID NO: 3836696 - RNA, 17 nt, Human
gcaauauaaccaauguu

SEQ ID NO: 3836697 - RNA, 20 nt, Human
gcaauauacuggaaagcuuu

SEQ ID NO: 3836698 - RNA, 17 nt, Human
gcaauauagaaacacga

SEQ ID NO: 3836699 - RNA, 13 nt, Human
gcaauauauuuug

SEQ ID NO: 3836700 - RNA, 18 nt, Human
gcaauauauuuuguaugc

SEQ ID NO: 3836701 - RNA, 19 nt, Human
gcaauaucuucguuaguaa

SEQ ID NO: 3836702 - RNA, 22 nt, Human
gcaauauuguauauuuuuaucu

SEQ ID NO: 3836703 - RNA, 17 nt, Human
gcaauauuuaaggagau

SEQ ID NO: 3836704 - RNA, 19 nt, Human
gcaauauuuccucauguga

SEQ ID NO: 3836705 - RNA, 18 nt, Human
gcaauauuugaauuuuaa

SEQ ID NO: 3836706 - RNA, 15 nt, Human
gcaaucaaaucugcu

SEQ ID NO: 3836707 - RNA, 15 nt, Human
gcaaucacagaugag

SEQ ID NO: 3836708 - RNA, 20 nt, Human
gcaauccauguuaguuuuua

SEQ ID NO: 3836709 - RNA, 22 nt, Human
gcaauccauguuaguuuuuacu

SEQ ID NO: 3836710 - RNA, 10 nt, Human
gcaauccuaa

SEQ ID NO: 3836711 - RNA, 12 nt, Human
gcaauccuccug

SEQ ID NO: 3836712 - RNA, 13 nt, Human
gcaauccuccuga

SEQ ID NO: 3836713 - RNA, 17 nt, Human
gcaauccugcaagaaca

SEQ ID NO: 3836714 - RNA, 16 nt, Human
gcaauccuuacaaaug

SEQ ID NO: 3836715 - RNA, 21 nt, Human
gcaaucguaauguacagaugg

SEQ ID NO: 3836716 - RNA, 14 nt, Human
gcaaucuauaauau

SEQ ID NO: 3836717 - RNA, 23 nt, Human
gcaaucuauuaauagcugccuua

SEQ ID NO: 3836718 - RNA, 19 nt, Human
gcaaucucggcucauugaa

SEQ ID NO: 3836719 - RNA, 17 nt, Human
gcaaucucuucauuauu

SEQ ID NO: 3836720 - RNA, 23 nt, Human
gcaaucucuucauuauucucugc

SEQ ID NO: 3836721 - RNA, 22 nt, Human
gcaaucugacccuaugggucua

SEQ ID NO: 3836722 - RNA, 16 nt, Human
gcaaugaaagguacua

SEQ ID NO: 3836723 - RNA, 18 nt, Human
gcaaugacagguaaauua

SEQ ID NO: 3836724 - RNA, 19 nt, Human
gcaaugacaucucaggggc

SEQ ID NO: 3836725 - RNA, 14 nt, Human
gcaaugaccuuuca

SEQ ID NO: 3836726 - RNA, 20 nt, Human
gcaaugaguguguuggcuug

SEQ ID NO: 3836727 - RNA, 16 nt, Human
gcaaugaugaaugaga

SEQ ID NO: 3836728 - RNA, 15 nt, Human
gcaaugauguccaga

SEQ ID NO: 3836729 - RNA, 19 nt, Human
gcaaugccaucaucuccug

SEQ ID NO: 3836730 - RNA, 13 nt, Human
gcaauggcagccu

SEQ ID NO: 3836731 - RNA, 14 nt, Human
gcaauggcagccuu

SEQ ID NO: 3836732 - RNA, 15 nt, Human
gcaauggcagccuug

SEQ ID NO: 3836733 - RNA, 14 nt, Human
gcaaugggcacugg

SEQ ID NO: 3836734 - RNA, 19 nt, Human
gcaaugguaguuucugugg

SEQ ID NO: 3836735 - RNA, 20 nt, Human
gcaaugguguugcccugagu

SEQ ID NO: 3836736 - RNA, 15 nt, Human
gcaauguaaauauuu

SEQ ID NO: 3836737 - RNA, 18 nt, Human
gcaauguaaauauuuuaa

SEQ ID NO: 3836738 - RNA, 14 nt, Human
gcaaugucugugcu

SEQ ID NO: 3836739 - RNA, 15 nt, Human
gcaaugucugugcua

SEQ ID NO: 3836740 - RNA, 14 nt, Human
gcaaugugaaaaau

SEQ ID NO: 3836741 - RNA, 14 nt, Human
gcaaugugauaaaa

SEQ ID NO: 3836742 - RNA, 14 nt, Human
gcaaugugcuacug

SEQ ID NO: 3836743 - RNA, 16 nt, Human
gcaauguguauaaaca

SEQ ID NO: 3836744 - RNA, 20 nt, Human
gcaauguguguauauggaca

SEQ ID NO: 3836745 - RNA, 21 nt, Human
gcaauuaaagugauacugaaa

SEQ ID NO: 3836746 - RNA, 20 nt, Human
gcaauuacaacggagucaaa

SEQ ID NO: 3836747 - RNA, 16 nt, Human
gcaauuaggauuuuga

SEQ ID NO: 3836748 - RNA, 19 nt, Human
gcaauuaggauuuugaugu

SEQ ID NO: 3836749 - RNA, 16 nt, Human
gcaauuaugaaaauaa

SEQ ID NO: 3836750 - RNA, 22 nt, Human
gcaauucaaaaguuccaagagu

SEQ ID NO: 3836751 - RNA, 18 nt, Human
gcaauuccccucugcugc

SEQ ID NO: 3836752 - RNA, 16 nt, Human
gcaauucuccugccuc

SEQ ID NO: 3836753 - RNA, 18 nt, Human
gcaauucuccugccucag

SEQ ID NO: 3836754 - RNA, 12 nt, Human
gcaauugccuuu

SEQ ID NO: 3836755 - RNA, 15 nt, Human
gcaauugcuuaggau

SEQ ID NO: 3836756 - RNA, 18 nt, Human
gcaauuggaacaaaguga

SEQ ID NO: 3836757 - RNA, 13 nt, Human
gcaauugucuauu

SEQ ID NO: 3836758 - RNA, 24 nt, Human
gcaauugugcucuucauuuaggau

SEQ ID NO: 3836759 - RNA, 17 nt, Human
gcaauuuauuaaaauga

SEQ ID NO: 3836760 - RNA, 18 nt, Human
gcaauuuguuugugcuuc

SEQ ID NO: 3836761 - RNA, 21 nt, Human
gcaauuuuaacacacauaaag

SEQ ID NO: 3836762 - RNA, 19 nt, Human
gcaauuuuccuugaagccg

SEQ ID NO: 3836763 - RNA, 22 nt, Human
gcaauuuucuaagcaauuucuu

SEQ ID NO: 3836764 - RNA, 16 nt, Human
gcaauuuuuauauuaa

SEQ ID NO: 3836765 - RNA, 17 nt, Human
gcacaaacacaagguca

SEQ ID NO: 3836766 - RNA, 17 nt, Human
gcacaaacauuuuucaa

SEQ ID NO: 3836767 - RNA, 18 nt, Human
gcacaaacauuuuucaac

SEQ ID NO: 3836768 - RNA, 23 nt, Human
gcacaaagaugggugaaggcugg

SEQ ID NO: 3836769 - RNA, 13 nt, Human
gcacaaaguggca

SEQ ID NO: 3836770 - RNA, 14 nt, Human
gcacaaaguggcau

SEQ ID NO: 3836771 - RNA, 17 nt, Human
gcacaacccccagcucc

SEQ ID NO: 3836772 - RNA, 17 nt, Human
gcacaaccugcaucuuu

SEQ ID NO: 3836773 - RNA, 19 nt, Human
gcacaacuuuaagaggaca

SEQ ID NO: 3836774 - RNA, 17 nt, Human
gcacaagaagcgugaga

SEQ ID NO: 3836775 - RNA, 14 nt, Human
gcacaagaauggau

SEQ ID NO: 3836776 - RNA, 19 nt, Human
gcacaagacugacgccagg

SEQ ID NO: 3836777 - RNA, 23 nt, Human
gcacaagcaaaagggugucugag

SEQ ID NO: 3836778 - RNA, 12 nt, Human
gcacaagccagg

SEQ ID NO: 3836779 - RNA, 15 nt, Human
gcacaaggauugaaa

SEQ ID NO: 3836780 - RNA, 21 nt, Human
gcacaaguguaaugaauaccu

SEQ ID NO: 3836781 - RNA, 17 nt, Human
gcacaaguuauuuaaau

SEQ ID NO: 3836782 - RNA, 16 nt, Human
gcacaauaaaaauguu

SEQ ID NO: 3836783 - RNA, 18 nt, Human
gcacaauaaauggcugua

SEQ ID NO: 3836784 - RNA, 17 nt, Human
aacauccauguccuaug

SEQ ID NO: 3836785 - RNA, 22 nt, Human
aacauccauguccuauguguga

SEQ ID NO: 3836786 - RNA, 16 nt, Human
aacaucccauugcccu

SEQ ID NO: 3836787 - RNA, 18 nt, Human
gcagagcugauggagaag

SEQ ID NO: 3836788 - RNA, 21 nt, Human
gcagagcugauggagaaggaa

SEQ ID NO: 3836789 - RNA, 17 nt, Human
gcagagcugcgggcugg

SEQ ID NO: 3836790 - RNA, 12 nt, Human
gcagagcuggcu

SEQ ID NO: 3836791 - RNA, 12 nt, Human
gcagagcuggug

SEQ ID NO: 3836792 - RNA, 15 nt, Human
gcagagcuuuucaga

SEQ ID NO: 3836793 - RNA, 18 nt, Human
gcagaggaaagcaaagga

SEQ ID NO: 3836794 - RNA, 12 nt, Human
gcagaggagggg

SEQ ID NO: 3836795 - RNA, 12 nt, Human
gcagaggcacug

SEQ ID NO: 3836796 - RNA, 21 nt, Human
gcagaggcaguaccugggcaa

SEQ ID NO: 3836797 - RNA, 17 nt, Human
gcagaggccugggcugg

SEQ ID NO: 3836798 - RNA, 22 nt, Human
gcagaggccugggcugggaaaa

SEQ ID NO: 3836799 - RNA, 11 nt, Human
gcagaggcugg

SEQ ID NO: 3836800 - RNA, 21 nt, Human
gcagaggcuggaggcagggcc

SEQ ID NO: 3836801 - RNA, 22 nt, Human
gcagaggcuggaggcagggccu

SEQ ID NO: 3836802 - RNA, 17 nt, Human
gcagaggcuggccucag

SEQ ID NO: 3836803 - RNA, 18 nt, Human
gcagaggcuggccucaga

SEQ ID NO: 3836804 - RNA, 14 nt, Human
gcagagggcacaga

SEQ ID NO: 3836805 - RNA, 21 nt, Human
gcagagggcuggaggcccagg

SEQ ID NO: 3836806 - RNA, 24 nt, Human
gcagagggcuggaggcccaggcug

SEQ ID NO: 3836807 - RNA, 13 nt, Human
gcagaggggcaga

SEQ ID NO: 3836808 - RNA, 17 nt, Human
gcagaggggcaggcccu

SEQ ID NO: 3836809 - RNA, 18 nt, Human
gcagaggggcaggcccug

SEQ ID NO: 3836810 - RNA, 18 nt, Human
gcagaggggcuuucugga

SEQ ID NO: 3836811 - RNA, 21 nt, Human
gcagagguaaaagugugagca

SEQ ID NO: 3836812 - RNA, 14 nt, Human
gcagagguacccug

SEQ ID NO: 3836813 - RNA, 16 nt, Human
gcagagguacccuggg

SEQ ID NO: 3836814 - RNA, 16 nt, Human
gcagaggucugugcug

SEQ ID NO: 3836815 - RNA, 18 nt, Human
gcagaggucugugcugag

SEQ ID NO: 3836816 - RNA, 18 nt, Human
gcagagguugcagugagc

SEQ ID NO: 3836817 - RNA, 14 nt, Human
gcagagucagcaga

SEQ ID NO: 3836818 - RNA, 13 nt, Human
gcagaguggcagu

SEQ ID NO: 3836819 - RNA, 17 nt, Human
gcagaguuacaguucug

SEQ ID NO: 3836820 - RNA, 18 nt, Human
gcagaguuacaguucugu

SEQ ID NO: 3836821 - RNA, 21 nt, Human
gcagaguuacaguucuguggu

SEQ ID NO: 3836822 - RNA, 15 nt, Human
gcagaguuacuugau

SEQ ID NO: 3836823 - RNA, 21 nt, Human
gcagaguugaagacagagcua

SEQ ID NO: 3836824 - RNA, 14 nt, Human
gcagaguuguaaau

SEQ ID NO: 3836825 - RNA, 16 nt, Human
gcagaguuguaaauau

SEQ ID NO: 3836826 - RNA, 20 nt, Human
gcagaguuuguguguugucu

SEQ ID NO: 3836827 - RNA, 24 nt, Human
gcagaguuuguguguugucuugaa

SEQ ID NO: 3836828 - RNA, 21 nt, Human
gcagauaacauuuguguguua

SEQ ID NO: 3836829 - RNA, 16 nt, Human
gcagauaaucagccuc

SEQ ID NO: 3836830 - RNA, 17 nt, Human
gcagauaaucagccucu

SEQ ID NO: 3836831 - RNA, 18 nt, Human
gcagauaccucacccugc

SEQ ID NO: 3836832 - RNA, 22 nt, Human
gcagauacuacugaccagacaa

SEQ ID NO: 3836833 - RNA, 16 nt, Human
gcagauacugcugugu

SEQ ID NO: 3836834 - RNA, 17 nt, Human
gcagaucaccugagguc

SEQ ID NO: 3836835 - RNA, 14 nt, Human
gcagauccaggacu

SEQ ID NO: 3836836 - RNA, 15 nt, Human
gcagauccaggacua

SEQ ID NO: 3836837 - RNA, 15 nt, Human
gcagaucccagcuca

SEQ ID NO: 3836838 - RNA, 13 nt, Human
gcagaucugugcc

SEQ ID NO: 3836839 - RNA, 23 nt, Human
gcagcugggcccaacccugucug

SEQ ID NO: 3836840 - RNA, 14 nt, Human
gcagcuguuagagu

SEQ ID NO: 3836841 - RNA, 16 nt, Human
gcagcuguuuaaaugu

SEQ ID NO: 3836842 - RNA, 20 nt, Human
gcagcuguuuuguugacauu

SEQ ID NO: 3836843 - RNA, 20 nt, Human
gcagcuuagggcccuggagg

SEQ ID NO: 3836844 - RNA, 14 nt, Human
gcagcuucaccaga

SEQ ID NO: 3836845 - RNA, 14 nt, Human
gcagcuuccuguca

SEQ ID NO: 3836846 - RNA, 14 nt, Human
gcagcuucugccac

SEQ ID NO: 3836847 - RNA, 17 nt, Human
gcagcuucugccacuuc

SEQ ID NO: 3836848 - RNA, 16 nt, Human
gcagcuucugcccccu

SEQ ID NO: 3836849 - RNA, 16 nt, Human
gcagcuugaggguugg

SEQ ID NO: 3836850 - RNA, 21 nt, Human
gcagcuugggagagccccugg

SEQ ID NO: 3836851 - RNA, 16 nt, Human
gcagcuuguagccagc

SEQ ID NO: 3836852 - RNA, 19 nt, Human
gcagcuuguagccagccgg

SEQ ID NO: 3836853 - RNA, 17 nt, Human
gcagcuuuaaacucagg

SEQ ID NO: 3836854 - RNA, 19 nt, Human
gcagcuuuaaacucaggga

SEQ ID NO: 3836855 - RNA, 21 nt, Human
gcagcuuuaaccauuaaaacu

SEQ ID NO: 3836856 - RNA, 13 nt, Human
gcagcuuugcuca

SEQ ID NO: 3836857 - RNA, 14 nt, Human
gcagcuuugcucau

SEQ ID NO: 3836858 - RNA, 15 nt, Human
gcagcuuugcucaua

SEQ ID NO: 3836859 - RNA, 18 nt, Human
gcaggaaauggcugugga

SEQ ID NO: 3836860 - RNA, 16 nt, Human
gcaggaacaaacaggg

SEQ ID NO: 3836861 - RNA, 17 nt, Human
gcaggaacaaugacuac

SEQ ID NO: 3836862 - RNA, 16 nt, Human
gcaggaacucccagca

SEQ ID NO: 3836863 - RNA, 18 nt, Human
gcaggaaggagcugccug

SEQ ID NO: 3836864 - RNA, 20 nt, Human
gcaggaaggagcugccugga

SEQ ID NO: 3836865 - RNA, 23 nt, Human
gcaggaaggagcugccuggaccc

SEQ ID NO: 3836866 - RNA, 15 nt, Human
gcaggaaggccuggg

SEQ ID NO: 3836867 - RNA, 17 nt, Human
gcaggaaggccugggug

SEQ ID NO: 3836868 - RNA, 11 nt, Human
gcaggaaggcu

SEQ ID NO: 3836869 - RNA, 19 nt, Human
gcaggacaacgaggaagcc

SEQ ID NO: 3836870 - RNA, 19 nt, Human
gcaggacacugcagaacag

SEQ ID NO: 3836871 - RNA, 22 nt, Human
gcaggaccagccagcagcagcc

SEQ ID NO: 3836872 - RNA, 13 nt, Human
gcaggaccagccc

SEQ ID NO: 3836873 - RNA, 14 nt, Human
gcaggaccagccca

SEQ ID NO: 3836874 - RNA, 16 nt, Human
gcaggaccagcccacg

SEQ ID NO: 3836875 - RNA, 11 nt, Human
gcaggaccuca

SEQ ID NO: 3836876 - RNA, 15 nt, Human
gcaggaccucgugcc

SEQ ID NO: 3836877 - RNA, 14 nt, Human
gcaggaccugccug

SEQ ID NO: 3836878 - RNA, 15 nt, Human
gcaggaccugccugu

SEQ ID NO: 3836879 - RNA, 20 nt, Human
gcaggaccuucgggcugugc

SEQ ID NO: 3836880 - RNA, 13 nt, Human
gcaggacgacugu

SEQ ID NO: 3836881 - RNA, 17 nt, Human
gcaggacgugggcuggg

SEQ ID NO: 3836882 - RNA, 23 nt, Human
gcaggacucacagguuggaagag

SEQ ID NO: 3836883 - RNA, 13 nt, Human
gcaggacugaugu

SEQ ID NO: 3836884 - RNA, 19 nt, Human
gcaggacuuugaggcaagu

SEQ ID NO: 3836885 - RNA, 16 nt, Human
gcaggagaggagagcc

SEQ ID NO: 3836886 - RNA, 18 nt, Human
gcaggagaggagagccag

SEQ ID NO: 3836887 - RNA, 19 nt, Human
gcaggagaggagagccaga

SEQ ID NO: 3836888 - RNA, 16 nt, Human
gcaggagcacacccag

SEQ ID NO: 3836889 - RNA, 20 nt, Human
gcaggagcacacccagcccc

SEQ ID NO: 3836890 - RNA, 13 nt, Human
gcaggagcaguau

SEQ ID NO: 3836891 - RNA, 17 nt, Human
gcaggagcaguaucaug

SEQ ID NO: 3836892 - RNA, 14 nt, Human
gcaggagccugagc

SEQ ID NO: 3836893 - RNA, 13 nt, Human
gcaggagcucaga

SEQ ID NO: 3836894 - RNA, 16 nt, Human
gcaggagcucagauga

SEQ ID NO: 3836895 - RNA, 22 nt, Human
gcaggagcuucugggagauuuu

SEQ ID NO: 3836896 - RNA, 15 nt, Human
gcaggaggaggugcc

SEQ ID NO: 3836897 - RNA, 20 nt, Human
gcaggaggaucacuugaguc

SEQ ID NO: 3836898 - RNA, 23 nt, Human
gcaggaggaucacuugaguccag

SEQ ID NO: 3836899 - RNA, 14 nt, Human
gcaggaggccaggc

SEQ ID NO: 3836900 - RNA, 14 nt, Human
gcaggaggccccug

SEQ ID NO: 3836901 - RNA, 11 nt, Human
gcaggagggag

SEQ ID NO: 3836902 - RNA, 18 nt, Human
gcaggagggcccuaccug

SEQ ID NO: 3836903 - RNA, 13 nt, Human
gcaggaggggagu

SEQ ID NO: 3836904 - RNA, 15 nt, Human
gcaggaggggggagg

SEQ ID NO: 3836905 - RNA, 17 nt, Human
gcaggaguagcugagcu

SEQ ID NO: 3836906 - RNA, 19 nt, Human
gcaggaguagcugagcuca

SEQ ID NO: 3836907 - RNA, 15 nt, Human
gcaggaguggugcag

SEQ ID NO: 3836908 - RNA, 20 nt, Human
gcaggaguuucguuuucaaa

SEQ ID NO: 3836909 - RNA, 21 nt, Human
gcaggaguuucguuuucaaaa

SEQ ID NO: 3836910 - RNA, 18 nt, Human
gcaggaucucaccaggca

SEQ ID NO: 3836911 - RNA, 20 nt, Human
gcaggaucucagaucacugc

SEQ ID NO: 3836912 - RNA, 16 nt, Human
gcaggauggccuggcc

SEQ ID NO: 3836913 - RNA, 21 nt, Human
gcaggauugauuaugcagaau

SEQ ID NO: 3836914 - RNA, 21 nt, Human
gcaggauuggggaagagagcc

SEQ ID NO: 3836915 - RNA, 16 nt, Human
gcaggauuuguucucu

SEQ ID NO: 3836916 - RNA, 17 nt, Human
gcaggauuuguucucug

SEQ ID NO: 3836917 - RNA, 18 nt, Human
gcaggcacagcacaggga

SEQ ID NO: 3836918 - RNA, 20 nt, Human
gcaggcaccuuaguggcuuu

SEQ ID NO: 3836919 - RNA, 10 nt, Human
gcaggcagac

SEQ ID NO: 3836920 - RNA, 11 nt, Human
gcaggcagaca

SEQ ID NO: 3836921 - RNA, 14 nt, Human
gcaggcagccagca

SEQ ID NO: 3836922 - RNA, 19 nt, Human
gcaggcagccagcaucugg

SEQ ID NO: 3836923 - RNA, 21 nt, Human
gcaggcagcgccaagcaaccu

SEQ ID NO: 3836924 - RNA, 22 nt, Human
gcaggcagcgccaagcaaccug

SEQ ID NO: 3836925 - RNA, 18 nt, Human
gcaggcaggaacaaacag

SEQ ID NO: 3836926 - RNA, 22 nt, Human
gcaggcaggaacaaacagggcu

SEQ ID NO: 3836927 - RNA, 18 nt, Human
gcaggcaggcucccaggg

SEQ ID NO: 3836928 - RNA, 13 nt, Human
gcaggcagggcug

SEQ ID NO: 3836929 - RNA, 20 nt, Human
gcaggcagguguuuauuaaa

SEQ ID NO: 3836930 - RNA, 17 nt, Human
gcaggcauagaggcuuc

SEQ ID NO: 3836931 - RNA, 21 nt, Human
gcaggcaucggggagccggga

SEQ ID NO: 3836932 - RNA, 20 nt, Human
cugccucucugcaggucccu

SEQ ID NO: 3836933 - RNA, 22 nt, Human
cugccucucugcaggucccuaa

SEQ ID NO: 3836934 - RNA, 21 nt, Human
cugccucugagggaaagccca

SEQ ID NO: 3836935 - RNA, 12 nt, Human
cugccucugcca

SEQ ID NO: 3836936 - RNA, 20 nt, Human
cugccucugccacacucuga

SEQ ID NO: 3836937 - RNA, 14 nt, Human
cugccucugccugc

SEQ ID NO: 3836938 - RNA, 18 nt, Human
cugccucugccugcauuc

SEQ ID NO: 3836939 - RNA, 13 nt, Human
cugccucugccuu

SEQ ID NO: 3836940 - RNA, 20 nt, Human
cugccucuguuugacaaacc

SEQ ID NO: 3836941 - RNA, 23 nt, Human
cugccucuuagacuucugcuuuc

SEQ ID NO: 3836942 - RNA, 13 nt, Human
cugccucuucucu

SEQ ID NO: 3836943 - RNA, 22 nt, Human
cugccucuucugggagggcagc

SEQ ID NO: 3836944 - RNA, 16 nt, Human
cugccucuucuguggg

SEQ ID NO: 3836945 - RNA, 16 nt, Human
cugccugagggccccu

SEQ ID NO: 3836946 - RNA, 20 nt, Human
cugccugagggccccucugc

SEQ ID NO: 3836947 - RNA, 22 nt, Human
cugccugagggccccucugccc

SEQ ID NO: 3836948 - RNA, 20 nt, Human
cugccugagucgugaccugc

SEQ ID NO: 3836949 - RNA, 18 nt, Human
cugccugcaauauuugaa

SEQ ID NO: 3836950 - RNA, 16 nt, Human
cugccugcagaggucu

SEQ ID NO: 3836951 - RNA, 20 nt, Human
cugccugcaguacuuuaccu

SEQ ID NO: 3836952 - RNA, 17 nt, Human
cugccugccauguaccu

SEQ ID NO: 3836953 - RNA, 13 nt, Human
cugccugcccagg

SEQ ID NO: 3836954 - RNA, 15 nt, Human
cugccugccccgccc

SEQ ID NO: 3836955 - RNA, 14 nt, Human
cugccugcccuggu

SEQ ID NO: 3836956 - RNA, 21 nt, Human
cugccugcccugucaggaggc

SEQ ID NO: 3836957 - RNA, 14 nt, Human
cugccugccugucu

SEQ ID NO: 3836958 - RNA, 16 nt, Human
cugccugccugucugu

SEQ ID NO: 3836959 - RNA, 20 nt, Human
cugccugccuuaagugagga

SEQ ID NO: 3836960 - RNA, 17 nt, Human
cugccugcgucuuccgc

SEQ ID NO: 3836961 - RNA, 18 nt, Human
cugccugcucgcucccug

SEQ ID NO: 3836962 - RNA, 13 nt, Human
cugccugcuuggg

SEQ ID NO: 3836963 - RNA, 22 nt, Human
cugccugcuuuucacugcugca

SEQ ID NO: 3836964 - RNA, 22 nt, Human
cugccugcuuuuuauggccugu

SEQ ID NO: 3836965 - RNA, 20 nt, Human
cugccuggaagagcagcccu

SEQ ID NO: 3836966 - RNA, 17 nt, Human
cugccuggaccagccuc

SEQ ID NO: 3836967 - RNA, 18 nt, Human
cugccuggacuagaggga

SEQ ID NO: 3836968 - RNA, 10 nt, Human
cugccuggag

SEQ ID NO: 3836969 - RNA, 19 nt, Human
cugccuggagccccacugc

SEQ ID NO: 3836970 - RNA, 12 nt, Human
cugccuggagga

SEQ ID NO: 3836971 - RNA, 15 nt, Human
cugccuggaggaccu

SEQ ID NO: 3836972 - RNA, 17 nt, Human
cugccuggaggaccuga

SEQ ID NO: 3836973 - RNA, 20 nt, Human
cugccuggaggaccugagcc

SEQ ID NO: 3836974 - RNA, 21 nt, Human
cugccuggaggaccugagccu

SEQ ID NO: 3836975 - RNA, 18 nt, Human
cugccuggccacugcucc

SEQ ID NO: 3836976 - RNA, 16 nt, Human
cugccuggccaggcag

SEQ ID NO: 3836977 - RNA, 11 nt, Human
cugccuggccc

SEQ ID NO: 3836978 - RNA, 12 nt, Human
cugccuggcccc

SEQ ID NO: 3836979 - RNA, 14 nt, Human
cugccuggccccca

SEQ ID NO: 3836980 - RNA, 19 nt, Human
cugccuggcccccaaccuc

SEQ ID NO: 3836981 - RNA, 16 nt, Human
cugccuggcccccagc

SEQ ID NO: 3836982 - RNA, 15 nt, Human
cugccuggccggcca

SEQ ID NO: 3836983 - RNA, 12 nt, Human
cugccuggccuu

SEQ ID NO: 3836984 - RNA, 16 nt, Human
cugccugggcuguugg

SEQ ID NO: 3836985 - RNA, 19 nt, Human
cugccugggcuguuggcac

SEQ ID NO: 3836986 - RNA, 22 nt, Human
cugccuggggcgggccccucau

SEQ ID NO: 3836987 - RNA, 22 nt, Human
cugccuggguuccaauccuggc

SEQ ID NO: 3836988 - RNA, 12 nt, Human
cugccuggguuu

SEQ ID NO: 3836989 - RNA, 20 nt, Human
cugccuggguuuuguucccu

SEQ ID NO: 3836990 - RNA, 17 nt, Human
cugccugguccucacac

SEQ ID NO: 3836991 - RNA, 17 nt, Human
cugccuggucuccugcc

SEQ ID NO: 3836992 - RNA, 16 nt, Human
cugccuguagcaguga

SEQ ID NO: 3836993 - RNA, 15 nt, Human
cugccuguagcccac

SEQ ID NO: 3836994 - RNA, 14 nt, Human
gcagaugacaagau

SEQ ID NO: 3836995 - RNA, 21 nt, Human
gcagaugacaagaugguacaa

SEQ ID NO: 3836996 - RNA, 13 nt, Human
gcagaugcaauga

SEQ ID NO: 3836997 - RNA, 19 nt, Human
gcagaugcagcucuuccug

SEQ ID NO: 3836998 - RNA, 14 nt, Human
gcagaugccacccu

SEQ ID NO: 3836999 - RNA, 22 nt, Human
gcagauggaaugcuguguuaaa

SEQ ID NO: 3837000 - RNA, 16 nt, Human
gcagaugugcagcaga

SEQ ID NO: 3837001 - RNA, 22 nt, Human
gcagaugugcagcagauuggaa

SEQ ID NO: 3837002 - RNA, 16 nt, Human
gcagauuauucacuga

SEQ ID NO: 3837003 - RNA, 19 nt, Human
gcagauucagaaaugaggc

SEQ ID NO: 3837004 - RNA, 21 nt, Human
gcagauucagaaaugaggcca

SEQ ID NO: 3837005 - RNA, 19 nt, Human
gcagauucauuuuucuuuc

SEQ ID NO: 3837006 - RNA, 19 nt, Human
gcagauugagaccuacagg

SEQ ID NO: 3837007 - RNA, 16 nt, Human
gcagauuggaaggaga

SEQ ID NO: 3837008 - RNA, 22 nt, Human
gcagauuggaaggagacacaga

SEQ ID NO: 3837009 - RNA, 20 nt, Human
gcagauuuagugaaagcuag

SEQ ID NO: 3837010 - RNA, 16 nt, Human
gcagauuuuacaaaag

SEQ ID NO: 3837011 - RNA, 16 nt, Human
gcagauuuuacagagc

SEQ ID NO: 3837012 - RNA, 17 nt, Human
gcagauuuuaguuuuau

SEQ ID NO: 3837013 - RNA, 15 nt, Human
gcagcaaaaauauaa

SEQ ID NO: 3837014 - RNA, 16 nt, Human
gcagcaaaaauauaaa

SEQ ID NO: 3837015 - RNA, 19 nt, Human
gcagcaaaaauauaaaaua

SEQ ID NO: 3837016 - RNA, 14 nt, Human
gcagcaacacacau

SEQ ID NO: 3837017 - RNA, 15 nt, Human
gcagcaacuuguccu

SEQ ID NO: 3837018 - RNA, 18 nt, Human
gcagcaacuuguccuagc

SEQ ID NO: 3837019 - RNA, 14 nt, Human
gcagcaagaaaaaa

SEQ ID NO: 3837020 - RNA, 15 nt, Human
gcagcaagaaaaaaa

SEQ ID NO: 3837021 - RNA, 19 nt, Human
gcagcaagaaaaaaaaaug

SEQ ID NO: 3837022 - RNA, 17 nt, Human
gcagcaaggcccgagca

SEQ ID NO: 3837023 - RNA, 21 nt, Human
gcagcaaggcccgagcagcug

SEQ ID NO: 3837024 - RNA, 12 nt, Human
gcagcaauaaag

SEQ ID NO: 3837025 - RNA, 12 nt, Human
gcagcaauuuaa

SEQ ID NO: 3837026 - RNA, 22 nt, Human
gcagcacagcaaggaggcuggc

SEQ ID NO: 3837027 - RNA, 16 nt, Human
gcagcaccgccucuuc

SEQ ID NO: 3837028 - RNA, 19 nt, Human
gcagcaccguucugugcac

SEQ ID NO: 3837029 - RNA, 14 nt, Human
gcagcaccuccagg

SEQ ID NO: 3837030 - RNA, 18 nt, Human
gcagcaccuccaggccug

SEQ ID NO: 3837031 - RNA, 17 nt, Human
gcagcaccuccucagcc

SEQ ID NO: 3837032 - RNA, 20 nt, Human
gcagcaccuccucagccuga

SEQ ID NO: 3837033 - RNA, 17 nt, Human
gcagcagacacaugcca

SEQ ID NO: 3837034 - RNA, 18 nt, Human
gcagcagagccuggaaga

SEQ ID NO: 3837035 - RNA, 21 nt, Human
gcagcagauuggaaggagaca

SEQ ID NO: 3837036 - RNA, 17 nt, Human
gcagcagccagcccugc

SEQ ID NO: 3837037 - RNA, 20 nt, Human
gcagcagccagcccugccug

SEQ ID NO: 3837038 - RNA, 13 nt, Human
gcagcagccccca

SEQ ID NO: 3837039 - RNA, 22 nt, Human
gcagcagcccccagcucccacc

SEQ ID NO: 3837040 - RNA, 20 nt, Human
gcagcagccucgccccuggc

SEQ ID NO: 3837041 - RNA, 21 nt, Human
gcagcaggaauauaugugugc

SEQ ID NO: 3837042 - RNA, 18 nt, Human
gcagcaggacuguccccu

SEQ ID NO: 3837043 - RNA, 15 nt, Human
gcagcaggagggggg

SEQ ID NO: 3837044 - RNA, 19 nt, Human
gcagcaggaggggggaggg

SEQ ID NO: 3837045 - RNA, 21 nt, Human
gcagcaggaggggggagggaa

SEQ ID NO: 3837046 - RNA, 19 nt, Human
gcagcagggagggcuucug

SEQ ID NO: 3837047 - RNA, 20 nt, Human
gcagcagggagggcuucugc

SEQ ID NO: 3837048 - RNA, 12 nt, Human
gcagcagggcua

SEQ ID NO: 3837049 - RNA, 19 nt, Human
gcagcagggcuacccugag

SEQ ID NO: 3837050 - RNA, 19 nt, Human
gcagcagguagccugcugg

SEQ ID NO: 3837051 - RNA, 14 nt, Human
gcagcaggugcugc

SEQ ID NO: 3837052 - RNA, 17 nt, Human
gcagcaggugcugcuac

SEQ ID NO: 3837053 - RNA, 20 nt, Human
gcagcaggugcugcuacccu

SEQ ID NO: 3837054 - RNA, 20 nt, Human
gcagcagguggcagaauggg

SEQ ID NO: 3837055 - RNA, 18 nt, Human
gcagcagugaaaacaagu

SEQ ID NO: 3837056 - RNA, 23 nt, Human
gcagcagugugaggccagggcag

SEQ ID NO: 3837057 - RNA, 17 nt, Human
gcagcauaaagaauuug

SEQ ID NO: 3837058 - RNA, 12 nt, Human
gcagcauaaagg

SEQ ID NO: 3837059 - RNA, 18 nt, Human
gcagcauauucaggaagc

SEQ ID NO: 3837060 - RNA, 19 nt, Human
gcagcauauucaggaagcu

SEQ ID NO: 3837061 - RNA, 23 nt, Human
gcagcauauucaggaagcucagg

SEQ ID NO: 3837062 - RNA, 22 nt, Human
gcagcaucucuaccuucucccc

SEQ ID NO: 3837063 - RNA, 15 nt, Human
gcagcaucugcuaau

SEQ ID NO: 3837064 - RNA, 15 nt, Human
gcagcaucuucaaac

SEQ ID NO: 3837065 - RNA, 21 nt, Human
gcagcaucuucaaacauguac

SEQ ID NO: 3837066 - RNA, 15 nt, Human
gcagcauuugauaau

SEQ ID NO: 3837067 - RNA, 18 nt, Human
gcagcauuugauaaugau

SEQ ID NO: 3837068 - RNA, 21 nt, Human
gcagccaaacccaugaggcaa

SEQ ID NO: 3837069 - RNA, 20 nt, Human
gcagccaagcuccuugggag

SEQ ID NO: 3837070 - RNA, 12 nt, Human
gcagccaaggcc

SEQ ID NO: 3837071 - RNA, 21 nt, Human
gcagccaaggccgaagcucug

SEQ ID NO: 3837072 - RNA, 23 nt, Human
gcagccaaggccgaagcucuggc

SEQ ID NO: 3837073 - RNA, 12 nt, Human
gcagccaaggga

SEQ ID NO: 3837074 - RNA, 22 nt, Human
gcagccacacuucucaggacac

SEQ ID NO: 3837075 - RNA, 12 nt, Human
gcagccacccug

SEQ ID NO: 3837076 - RNA, 16 nt, Human
gcauuuuacuguacag

SEQ ID NO: 3837077 - RNA, 17 nt, Human
gcauuuuacuguacaga

SEQ ID NO: 3837078 - RNA, 18 nt, Human
gcauuuuccucugcuuug

SEQ ID NO: 3837079 - RNA, 13 nt, Human
gcauuuucugaaa

SEQ ID NO: 3837080 - RNA, 17 nt, Human
gcauuuucugaaacuaa

SEQ ID NO: 3837081 - RNA, 21 nt, Human
gcauuuucugaaacuaaugaa

SEQ ID NO: 3837082 - RNA, 19 nt, Human
gcauuuugcuauuguaaau

SEQ ID NO: 3837083 - RNA, 22 nt, Human
gcauuuuggagaguuuccugaa

SEQ ID NO: 3837084 - RNA, 23 nt, Human
gcauuuuggagaguuuccugaaa

SEQ ID NO: 3837085 - RNA, 13 nt, Human
gcauuuuggucca

SEQ ID NO: 3837086 - RNA, 22 nt, Human
gcauuuuguaaguugaagcaaa

SEQ ID NO: 3837087 - RNA, 23 nt, Human
gcauuuuguauuugucuaacugg

SEQ ID NO: 3837088 - RNA, 21 nt, Human
gcauuuuguuugguauuguau

SEQ ID NO: 3837089 - RNA, 17 nt, Human
gcauuuuugcaggagca

SEQ ID NO: 3837090 - RNA, 18 nt, Human
gcauuuuugugaaaugaa

SEQ ID NO: 3837091 - RNA, 21 nt, Human
gcauuuuugugaaaugaaaac

SEQ ID NO: 3837092 - RNA, 16 nt, Human
gcauuuuuuaaaacaa

SEQ ID NO: 3837093 - RNA, 17 nt, Human
gcauuuuuuaaaacaag

SEQ ID NO: 3837094 - RNA, 18 nt, Human
gcauuuuuuaaaacaaga

SEQ ID NO: 3837095 - RNA, 19 nt, Human
gcauuuuuuaaccuccuaa

SEQ ID NO: 3837096 - RNA, 16 nt, Human
gccaaaaaaagacagg

SEQ ID NO: 3837097 - RNA, 22 nt, Human
gccaaaaagugaaauaaugugu

SEQ ID NO: 3837098 - RNA, 13 nt, Human
gccaaaacccagc

SEQ ID NO: 3837099 - RNA, 20 nt, Human
gccaaaagcuucccucccug

SEQ ID NO: 3837100 - RNA, 22 nt, Human
gccaaaagcuucccucccugcu

SEQ ID NO: 3837101 - RNA, 11 nt, Human
gccaaacauua

SEQ ID NO: 3837102 - RNA, 23 nt, Human
gccaaacauuaauguugauuucu

SEQ ID NO: 3837103 - RNA, 24 nt, Human
gccaaacauuaauguugauuucua

SEQ ID NO: 3837104 - RNA, 17 nt, Human
gccaaaccucaccaacu

SEQ ID NO: 3837105 - RNA, 17 nt, Human
gccaaaccucuguucag

SEQ ID NO: 3837106 - RNA, 17 nt, Human
gccaaacucugccagcc

SEQ ID NO: 3837107 - RNA, 15 nt, Human
gccaaagacaaauag

SEQ ID NO: 3837108 - RNA, 14 nt, Human
gccaaagaccaaau

SEQ ID NO: 3837109 - RNA, 14 nt, Human
gccaaagaucacuu

SEQ ID NO: 3837110 - RNA, 16 nt, Human
gccaaagccuccucca

SEQ ID NO: 3837111 - RNA, 19 nt, Human
gccaaagccuccuccagcc

SEQ ID NO: 3837112 - RNA, 14 nt, Human
gccaaaggaagcac

SEQ ID NO: 3837113 - RNA, 18 nt, Human
gccaaaggaugugauaua

SEQ ID NO: 3837114 - RNA, 22 nt, Human
gccaaauaaugucucugugaga

SEQ ID NO: 3837115 - RNA, 14 nt, Human
gccaaauagcaaag

SEQ ID NO: 3837116 - RNA, 17 nt, Human
gccaaauauauucucuu

SEQ ID NO: 3837117 - RNA, 18 nt, Human
gccaaauccgcucucuuc

SEQ ID NO: 3837118 - RNA, 22 nt, Human
gccaaaugcucucucaaauugu

SEQ ID NO: 3837119 - RNA, 18 nt, Human
gccaaauguaauugaaua

SEQ ID NO: 3837120 - RNA, 16 nt, Human
gccaaauuaaaaaaga

SEQ ID NO: 3837121 - RNA, 22 nt, Human
gccaaauuaaaaaagauaaaca

SEQ ID NO: 3837122 - RNA, 18 nt, Human
gccaaauuauuuguguaa

SEQ ID NO: 3837123 - RNA, 14 nt, Human
gccaaauuuuggcc

SEQ ID NO: 3837124 - RNA, 19 nt, Human
gccaacaagaaugcauuga

SEQ ID NO: 3837125 - RNA, 21 nt, Human
gccaacacgcaccugccucag

SEQ ID NO: 3837126 - RNA, 23 nt, Human
gccaacacgcaccugccucagga

SEQ ID NO: 3837127 - RNA, 20 nt, Human
gccaacacucaagaagcagg

SEQ ID NO: 3837128 - RNA, 22 nt, Human
gccaacagcuacaacagccuca

SEQ ID NO: 3837129 - RNA, 16 nt, Human
gccaacagguggcagg

SEQ ID NO: 3837130 - RNA, 21 nt, Human
gccaacaguguuaggccuggc

SEQ ID NO: 3837131 - RNA, 23 nt, Human
gccaacaguguuaggccuggcac

SEQ ID NO: 3837132 - RNA, 23 nt, Human
gccaacaucgugaaacccugucu

SEQ ID NO: 3837133 - RNA, 23 nt, Human
gccaaccccgcccuaggccuggc

SEQ ID NO: 3837134 - RNA, 15 nt, Human
gccaaccucgcucca

SEQ ID NO: 3837135 - RNA, 22 nt, Human
gccaaccuguaauaaauaugag

SEQ ID NO: 3837136 - RNA, 15 nt, Human
gccaacuagccccug

SEQ ID NO: 3837137 - RNA, 16 nt, Human
gccaacuagccccugg

SEQ ID NO: 3837138 - RNA, 20 nt, Human
gccaacuagccccuggggug

SEQ ID NO: 3837139 - RNA, 12 nt, Human
gccaacugcugc

SEQ ID NO: 3837140 - RNA, 17 nt, Human
gccaacugguguuugaa

SEQ ID NO: 3837141 - RNA, 14 nt, Human
gccaacuuguaaau

SEQ ID NO: 3837142 - RNA, 17 nt, Human
gccaacuuguaaauaca

SEQ ID NO: 3837143 - RNA, 19 nt, Human
gccaagaaagauguauaua

SEQ ID NO: 3837144 - RNA, 13 nt, Human
gccaagaacugaa

SEQ ID NO: 3837145 - RNA, 16 nt, Human
gccaagaauauugcaa

SEQ ID NO: 3837146 - RNA, 19 nt, Human
gccaagaauauugcaaaau

SEQ ID NO: 3837147 - RNA, 13 nt, Human
gccaagaauguac

SEQ ID NO: 3837148 - RNA, 15 nt, Human
gccaagacaaaucaa

SEQ ID NO: 3837149 - RNA, 15 nt, Human
gccaagacugcugug

SEQ ID NO: 3837150 - RNA, 22 nt, Human
gccaagacugcuguggccagga

SEQ ID NO: 3837151 - RNA, 20 nt, Human
gccaagagcagaggcagcga

SEQ ID NO: 3837152 - RNA, 14 nt, Human
gccaagaggcugca

SEQ ID NO: 3837153 - RNA, 18 nt, Human
gccaagaguggccccacc

SEQ ID NO: 3837154 - RNA, 22 nt, Human
gccaagaguggccccaccuggc

SEQ ID NO: 3837155 - RNA, 20 nt, Human
gccaagauaggaccuugggc

SEQ ID NO: 3837156 - RNA, 15 nt, Human
gccaagauuuuccuc

SEQ ID NO: 3837157 - RNA, 20 nt, Human
gccaagcaaccuggguccaa

SEQ ID NO: 3837158 - RNA, 21 nt, Human
gccaagcacagugguggcagg

SEQ ID NO: 3837159 - RNA, 18 nt, Human
gccaagcacugugcucag

SEQ ID NO: 3837160 - RNA, 14 nt, Human
gccaagcagccaag

SEQ ID NO: 3837161 - RNA, 13 nt, Human
gccaagccaggga

SEQ ID NO: 3837162 - RNA, 21 nt, Human
gccaagccccauccugccgcc

SEQ ID NO: 3837163 - RNA, 22 nt, Human
gccaagcccuccccaucccaug

SEQ ID NO: 3837164 - RNA, 21 nt, Human
gccaagcugaggugcccagga

SEQ ID NO: 3837165 - RNA, 22 nt, Human
gccaagcugaggugcccaggag

SEQ ID NO: 3837166 - RNA, 23 nt, Human
gccaagcugaggugcccaggaga

SEQ ID NO: 3837167 - RNA, 15 nt, Human
gccaaggaccugaga

SEQ ID NO: 3837168 - RNA, 14 nt, Human
gccaaggacugccg

SEQ ID NO: 3837169 - RNA, 15 nt, Human
gccaaggagcugcua

SEQ ID NO: 3837170 - RNA, 20 nt, Human
gccaaggagcugcuauagcc

SEQ ID NO: 3837171 - RNA, 20 nt, Human
gccaaggaggugaggagcag

SEQ ID NO: 3837172 - RNA, 16 nt, Human
gccaaggcagaggccu

SEQ ID NO: 3837173 - RNA, 19 nt, Human
gccaaggccgaagcucugg

SEQ ID NO: 3837174 - RNA, 17 nt, Human
gccaaggcucuguuuau

SEQ ID NO: 3837175 - RNA, 18 nt, Human
gccaagggaaaggggugc

SEQ ID NO: 3837176 - RNA, 21 nt, Human
gccaagggauggacaucuugu

SEQ ID NO: 3837177 - RNA, 16 nt, Human
gccaagggcuuuguuu

SEQ ID NO: 3837178 - RNA, 22 nt, Human
gccaaggggagucaccuucccu

SEQ ID NO: 3837179 - RNA, 15 nt, Human
gccaaggugggagga

SEQ ID NO: 3837180 - RNA, 18 nt, Human
gccaaggugggcugagcc

SEQ ID NO: 3837181 - RNA, 19 nt, Human
gccaaggugggcugagccc

SEQ ID NO: 3837182 - RNA, 21 nt, Human
gccaaggugggcugagcccug

SEQ ID NO: 3837183 - RNA, 16 nt, Human
gccaagguguccuaca

SEQ ID NO: 3837184 - RNA, 19 nt, Human
gccaagguguccuacagaa

SEQ ID NO: 3837185 - RNA, 21 nt, Human
gccaagguguccuacagaaaa

SEQ ID NO: 3837186 - RNA, 22 nt, Human
gccaagucagcuuugccuucca

SEQ ID NO: 3837187 - RNA, 18 nt, Human
gccaaguccagguccugg

SEQ ID NO: 3837188 - RNA, 15 nt, Human
gccaagugcaggcug

SEQ ID NO: 3837189 - RNA, 18 nt, Human
gccaagugccaaaugcuc

SEQ ID NO: 3837190 - RNA, 12 nt, Human
gccaaguuccuc

SEQ ID NO: 3837191 - RNA, 20 nt, Human
gccaaguuuauauacaauua

SEQ ID NO: 3837192 - RNA, 16 nt, Human
gccaauagugucaucc

SEQ ID NO: 3837193 - RNA, 20 nt, Human
gccaauauccuaauaaaaag

SEQ ID NO: 3837194 - RNA, 22 nt, Human
gccaauauccuaauaaaaaggu

SEQ ID NO: 3837195 - RNA, 18 nt, Human
gccaauauuaaaucugcu

SEQ ID NO: 3837196 - RNA, 22 nt, Human
cugcugcaaggccuuucugugu

SEQ ID NO: 3837197 - RNA, 18 nt, Human
cugcugcaccaacccagc

SEQ ID NO: 3837198 - RNA, 21 nt, Human
cugcugcagagcaguaaggga

SEQ ID NO: 3837199 - RNA, 16 nt, Human
cugcugcagaggggca

SEQ ID NO: 3837200 - RNA, 13 nt, Human
cugcugcaggggc

SEQ ID NO: 3837201 - RNA, 15 nt, Human
cugcugcaguagggg

SEQ ID NO: 3837202 - RNA, 14 nt, Human
cugcugcaguugcc

SEQ ID NO: 3837203 - RNA, 16 nt, Human
cugcugcaugcccucu

SEQ ID NO: 3837204 - RNA, 16 nt, Human
cugcugcauggggugg

SEQ ID NO: 3837205 - RNA, 16 nt, Human
cugcugccacugaggg

SEQ ID NO: 3837206 - RNA, 17 nt, Human
cugcugccacugagggg

SEQ ID NO: 3837207 - RNA, 16 nt, Human
cugcugccaugaacug

SEQ ID NO: 3837208 - RNA, 15 nt, Human
cugcugcccagccuc

SEQ ID NO: 3837209 - RNA, 12 nt, Human
cugcugcccagg

SEQ ID NO: 3837210 - RNA, 19 nt, Human
cugcugccccaaaggaagc

SEQ ID NO: 3837211 - RNA, 22 nt, Human
cugcugcccccaccccggggac

SEQ ID NO: 3837212 - RNA, 22 nt, Human
cugcugccccugcacagcaggc

SEQ ID NO: 3837213 - RNA, 17 nt, Human
cugcugcccuccauccc

SEQ ID NO: 3837214 - RNA, 13 nt, Human
cugcugcccuccc

SEQ ID NO: 3837215 - RNA, 14 nt, Human
cugcugcccucccc

SEQ ID NO: 3837216 - RNA, 20 nt, Human
cugcugccgccccacccaga

SEQ ID NO: 3837217 - RNA, 19 nt, Human
cugcugccgccucccagcc

SEQ ID NO: 3837218 - RNA, 14 nt, Human
cugcugccucccca

SEQ ID NO: 3837219 - RNA, 17 nt, Human
gcaugccuggauggggc

SEQ ID NO: 3837220 - RNA, 22 nt, Human
gcaugccuggauggggcugcac

SEQ ID NO: 3837221 - RNA, 15 nt, Human
gcaugccugugugac

SEQ ID NO: 3837222 - RNA, 21 nt, Human
gcaugccuuccagcacccugc

SEQ ID NO: 3837223 - RNA, 13 nt, Human
gcaugccuugugc

SEQ ID NO: 3837224 - RNA, 13 nt, Human
gcaugcggcccag

SEQ ID NO: 3837225 - RNA, 14 nt, Human
gcaugcggcccagc

SEQ ID NO: 3837226 - RNA, 18 nt, Human
gcaugcggcccagcccgg

SEQ ID NO: 3837227 - RNA, 19 nt, Human
gcaugcggcccagcccggc

SEQ ID NO: 3837228 - RNA, 18 nt, Human
gcaugcgggcuuccuccu

SEQ ID NO: 3837229 - RNA, 18 nt, Human
gcaugcucucugcagcca

SEQ ID NO: 3837230 - RNA, 13 nt, Human
gcaugcugcuuua

SEQ ID NO: 3837231 - RNA, 17 nt, Human
gcaugcuggugagccaa

SEQ ID NO: 3837232 - RNA, 18 nt, Human
gcaugcuuaaauuuuaac

SEQ ID NO: 3837233 - RNA, 14 nt, Human
gcaugcuuuccaua

SEQ ID NO: 3837234 - RNA, 16 nt, Human
gcauggaaaucagcca

SEQ ID NO: 3837235 - RNA, 14 nt, Human
gcauggacaaugga

SEQ ID NO: 3837236 - RNA, 18 nt, Human
gcauggacaauggaccgg

SEQ ID NO: 3837237 - RNA, 23 nt, Human
gcauggacaccccuuauccagga

SEQ ID NO: 3837238 - RNA, 14 nt, Human
gcauggagaacagu

SEQ ID NO: 3837239 - RNA, 15 nt, Human
gcauggagaauaaac

SEQ ID NO: 3837240 - RNA, 19 nt, Human
gcauggagaaugcaccaua

SEQ ID NO: 3837241 - RNA, 15 nt, Human
gcauggagcuggccg

SEQ ID NO: 3837242 - RNA, 19 nt, Human
gcauggaguguguauuguu

SEQ ID NO: 3837243 - RNA, 22 nt, Human
gcauggaguguguauuguuccc

SEQ ID NO: 3837244 - RNA, 23 nt, Human
gcauggaguguguauuguuccca

SEQ ID NO: 3837245 - RNA, 18 nt, Human
gcauggaguugggcguua

SEQ ID NO: 3837246 - RNA, 20 nt, Human
gcauggauauaguuuuacuu

SEQ ID NO: 3837247 - RNA, 20 nt, Human
gcauggcaaggacugcaggg

SEQ ID NO: 3837248 - RNA, 21 nt, Human
gcauggcaagucacaugcgua

SEQ ID NO: 3837249 - RNA, 17 nt, Human
gcauggcauccuccagc

SEQ ID NO: 3837250 - RNA, 14 nt, Human
gcauggccaggugg

SEQ ID NO: 3837251 - RNA, 14 nt, Human
gcauggcccugggc

SEQ ID NO: 3837252 - RNA, 18 nt, Human
gcauggcuccagaaaugu

SEQ ID NO: 3837253 - RNA, 13 nt, Human
gcauggcuccagu

SEQ ID NO: 3837254 - RNA, 15 nt, Human
gcauggcugugagga

SEQ ID NO: 3837255 - RNA, 13 nt, Human
gcaugggaaugaa

SEQ ID NO: 3837256 - RNA, 13 nt, Human
gcaugggccuggc

SEQ ID NO: 3837257 - RNA, 22 nt, Human
gcauggggauaaaggagaaggc

SEQ ID NO: 3837258 - RNA, 18 nt, Human
gcaugggggccucagggc

SEQ ID NO: 3837259 - RNA, 18 nt, Human
gcauggggggugggggga

SEQ ID NO: 3837260 - RNA, 16 nt, Human
gcauggguuuuguagg

SEQ ID NO: 3837261 - RNA, 20 nt, Human
gcaugguaccagcccugggg

SEQ ID NO: 3837262 - RNA, 22 nt, Human
gcaugguccauucucaagggac

SEQ ID NO: 3837263 - RNA, 19 nt, Human
gcauggucccacaucccug

SEQ ID NO: 3837264 - RNA, 21 nt, Human
gcauggucccacaucccuggg

SEQ ID NO: 3837265 - RNA, 13 nt, Human
gcauggugcaguu

SEQ ID NO: 3837266 - RNA, 14 nt, Human
gcauggugcaugcc

SEQ ID NO: 3837267 - RNA, 13 nt, Human
gcaugguggccag

SEQ ID NO: 3837268 - RNA, 14 nt, Human
gcaugguggccaga

SEQ ID NO: 3837269 - RNA, 20 nt, Human
gcauggugguugggacccag

SEQ ID NO: 3837270 - RNA, 13 nt, Human
gcaugguuucagc

SEQ ID NO: 3837271 - RNA, 14 nt, Human
gcaugguuucagca

SEQ ID NO: 3837272 - RNA, 21 nt, Human
gcaugguuuugugccaucugu

SEQ ID NO: 3837273 - RNA, 22 nt, Human
gcauguaaaagccuaggucuau

SEQ ID NO: 3837274 - RNA, 17 nt, Human
gcauguaaaagcggaaa

SEQ ID NO: 3837275 - RNA, 17 nt, Human
gcauguaaacacgccug

SEQ ID NO: 3837276 - RNA, 19 nt, Human
gcauguaaacacgccugca

SEQ ID NO: 3837277 - RNA, 14 nt, Human
gcauguaggacccu

SEQ ID NO: 3837278 - RNA, 15 nt, Human
gcauguaggagaauc

SEQ ID NO: 3837279 - RNA, 22 nt, Human
gcauguaguaacacuaauauau

SEQ ID NO: 3837280 - RNA, 23 nt, Human
gcauguaguaacacuaauauauu

SEQ ID NO: 3837281 - RNA, 22 nt, Human
gcauguagugugggaggcuccu

SEQ ID NO: 3837282 - RNA, 15 nt, Human
gcauguauuggccug

SEQ ID NO: 3837283 - RNA, 16 nt, Human
gcauguauuggccugg

SEQ ID NO: 3837284 - RNA, 20 nt, Human
gcauguauuggccuggaggu

SEQ ID NO: 3837285 - RNA, 21 nt, Human
gcauguauugugucuuuugca

SEQ ID NO: 3837286 - RNA, 18 nt, Human
gcauguauuuuugucaau

SEQ ID NO: 3837287 - RNA, 21 nt, Human
gcaugugaaaaucaaauacau

SEQ ID NO: 3837288 - RNA, 20 nt, Human
gcaugugacucugaagcuga

SEQ ID NO: 3837289 - RNA, 21 nt, Human
gcaugugacucugaagcugac

SEQ ID NO: 3837290 - RNA, 20 nt, Human
gcaugugguuugguuccucu

SEQ ID NO: 3837291 - RNA, 15 nt, Human
gcaugugucaugcau

SEQ ID NO: 3837292 - RNA, 12 nt, Human
gcauguguguau

SEQ ID NO: 3837293 - RNA, 15 nt, Human
gcauguguguauaag

SEQ ID NO: 3837294 - RNA, 16 nt, Human
gcaugugugugcucag

SEQ ID NO: 3837295 - RNA, 21 nt, Human
gcauguucucugaggacacua

SEQ ID NO: 3837296 - RNA, 18 nt, Human
gcauguugaccaugucua

SEQ ID NO: 3837297 - RNA, 16 nt, Human
gcauguugcugaggag

SEQ ID NO: 3837298 - RNA, 17 nt, Human
gcauguugucuaagaaa

SEQ ID NO: 3837299 - RNA, 15 nt, Human
gcauguuucauguuu

SEQ ID NO: 3837300 - RNA, 20 nt, Human
gcauguuucauguuuuguga

SEQ ID NO: 3837301 - RNA, 18 nt, Human
gcauguuugaaaugaggu

SEQ ID NO: 3837302 - RNA, 14 nt, Human
gcauguuuuguaua

SEQ ID NO: 3837303 - RNA, 17 nt, Human
gcauguuuuguauacaa

SEQ ID NO: 3837304 - RNA, 15 nt, Human
gcauguuuuguugcu

SEQ ID NO: 3837305 - RNA, 14 nt, Human
gcauuaaaagaaaa

SEQ ID NO: 3837306 - RNA, 14 nt, Human
gcauuaaauuacag

SEQ ID NO: 3837307 - RNA, 19 nt, Human
gcauuaaauuuuaagguag

SEQ ID NO: 3837308 - RNA, 16 nt, Human
gcauuacauuuccaaa

SEQ ID NO: 3837309 - RNA, 21 nt, Human
gcauuacccccaaccucauuu

SEQ ID NO: 3837310 - RNA, 19 nt, Human
gcauuaccgcguuguaaaa

SEQ ID NO: 3837311 - RNA, 23 nt, Human
gcauuaccgcguuguaaaauaua

SEQ ID NO: 3837312 - RNA, 16 nt, Human
gcauuacucuuguaag

SEQ ID NO: 3837313 - RNA, 18 nt, Human
gcauuacucuuguaagau

SEQ ID NO: 3837314 - RNA, 19 nt, Human
gcauuacucuuguaagauu

SEQ ID NO: 3837315 - RNA, 16 nt, Human
gcauuagaaauagaca

SEQ ID NO: 3837316 - RNA, 18 nt, Human
gcauuagaauuauuuaaa

SEQ ID NO: 3837317 - RNA, 21 nt, Human
gcauuagagucaacuacacaa

SEQ ID NO: 3837318 - RNA, 14 nt, Human
gcauuagcacagau

SEQ ID NO: 3837319 - RNA, 19 nt, Human
gcauuagcacagauuuuaa

SEQ ID NO: 3837320 - RNA, 22 nt, Human
gcauuagcacagauuuuaauug

SEQ ID NO: 3837321 - RNA, 15 nt, Human
gcauuauauaccauu

SEQ ID NO: 3837322 - RNA, 19 nt, Human
gcauuauauaccauuuauc

SEQ ID NO: 3837323 - RNA, 18 nt, Human
gcauuauauuuguaaauu

SEQ ID NO: 3837324 - RNA, 21 nt, Human
gcauuauguccacuguguaua

SEQ ID NO: 3837325 - RNA, 14 nt, Human
gcauuauuaaauug

SEQ ID NO: 3837326 - RNA, 18 nt, Human
gcauuauuaaauuguaaa

SEQ ID NO: 3837327 - RNA, 12 nt, Human
gcauuauucauu

SEQ ID NO: 3837328 - RNA, 16 nt, Human
gcauuauucucuuuua

SEQ ID NO: 3837329 - RNA, 14 nt, Human
gcauuauugcauua

SEQ ID NO: 3837330 - RNA, 23 nt, Human
gcauuauuggaauauaauuguuu

SEQ ID NO: 3837331 - RNA, 22 nt, Human
gcauucaauuuauucaagaaaa

SEQ ID NO: 3837332 - RNA, 19 nt, Human
gcauucacauuuagaaaag

SEQ ID NO: 3837333 - RNA, 19 nt, Human
gcauucacccagacagcuc

SEQ ID NO: 3837334 - RNA, 16 nt, Human
gcauucagagagcagc

SEQ ID NO: 3837335 - RNA, 18 nt, Human
gcauucauuuuuauagca

SEQ ID NO: 3837336 - RNA, 17 nt, Human
gcauuccaacaaagggu

SEQ ID NO: 3837337 - RNA, 19 nt, Human
gcauuccagccccucuggu

SEQ ID NO: 3837338 - RNA, 12 nt, Human
gcauuccaggcu

SEQ ID NO: 3837339 - RNA, 13 nt, Human
gcauuccaggcuc

SEQ ID NO: 3837340 - RNA, 14 nt, Human
gcauuccaggcucc

SEQ ID NO: 3837341 - RNA, 12 nt, Human
gcauucccaggu

SEQ ID NO: 3837342 - RNA, 13 nt, Human
gcauucccaggua

SEQ ID NO: 3837343 - RNA, 16 nt, Human
gcauuccccaggaggc

SEQ ID NO: 3837344 - RNA, 18 nt, Human
gcauuccccaggaggcca

SEQ ID NO: 3837345 - RNA, 21 nt, Human
gcauucccugagucaccagga

SEQ ID NO: 3837346 - RNA, 22 nt, Human
gcauucccugagucaccaggaa

SEQ ID NO: 3837347 - RNA, 21 nt, Human
gcauuccugauaugauuuaaa

SEQ ID NO: 3837348 - RNA, 13 nt, Human
gcauuccuucuuu

SEQ ID NO: 3837349 - RNA, 14 nt, Human
gcauuccuucuuug

SEQ ID NO: 3837350 - RNA, 23 nt, Human
gcauuccuucuuugauaauguua

SEQ ID NO: 3837351 - RNA, 17 nt, Human
gcauucuaaccuggagg

SEQ ID NO: 3837352 - RNA, 15 nt, Human
gccaaucaagggcaa

SEQ ID NO: 3837353 - RNA, 15 nt, Human
gccaaucagaagcua

SEQ ID NO: 3837354 - RNA, 22 nt, Human
gccaaucccucaccuucugagu

SEQ ID NO: 3837355 - RNA, 12 nt, Human
gccaaugagguc

SEQ ID NO: 3837356 - RNA, 19 nt, Human
gccaaugaggucugaaaug

SEQ ID NO: 3837357 - RNA, 22 nt, Human
gccaaugaggucugaaauggag

SEQ ID NO: 3837358 - RNA, 21 nt, Human
gccaaugcaccuaaagaaaaa

SEQ ID NO: 3837359 - RNA, 18 nt, Human
gccaaugccccacuggca

SEQ ID NO: 3837360 - RNA, 13 nt, Human
gccaauggaaacc

SEQ ID NO: 3837361 - RNA, 19 nt, Human
gccaauggaaaccucacgc

SEQ ID NO: 3837362 - RNA, 19 nt, Human
gccaauggaaccuccuuuc

SEQ ID NO: 3837363 - RNA, 16 nt, Human
gccaauggagacuguc

SEQ ID NO: 3837364 - RNA, 19 nt, Human
gccaacagguggcaggacc

SEQ ID NO: 3837365 - RNA, 20 nt, Human
gccaacagucaaaacagaga

SEQ ID NO: 3837366 - RNA, 20 nt, Human
gccaacaguguuaggccugg

SEQ ID NO: 3837367 - RNA, 15 nt, Human
gccaccugucugucu

SEQ ID NO: 3837368 - RNA, 13 nt, Human
gccacgcagccag

SEQ ID NO: 3837369 - RNA, 14 nt, Human
gccacgcagccagg

SEQ ID NO: 3837370 - RNA, 15 nt, Human
gccacgcagccagga

SEQ ID NO: 3837371 - RNA, 18 nt, Human
gccacgcagccaggacac

SEQ ID NO: 3837372 - RNA, 14 nt, Human
gccacgcuccagcu

SEQ ID NO: 3837373 - RNA, 16 nt, Human
gccacggacgcuggcu

SEQ ID NO: 3837374 - RNA, 18 nt, Human
gccacggacgcuggcucc

SEQ ID NO: 3837375 - RNA, 14 nt, Human
gccacggcagccua

SEQ ID NO: 3837376 - RNA, 17 nt, Human
gccacggccaggccaga

SEQ ID NO: 3837377 - RNA, 18 nt, Human
gccacggggacucagccc

SEQ ID NO: 3837378 - RNA, 22 nt, Human
gccacgggucuguguucgacuc

SEQ ID NO: 3837379 - RNA, 23 nt, Human
gccacguguuugugcuguggugu

SEQ ID NO: 3837380 - RNA, 23 nt, Human
gccacuaaccuugccugguacag

SEQ ID NO: 3837381 - RNA, 23 nt, Human
gccacuaagcagaggaggggccg

SEQ ID NO: 3837382 - RNA, 18 nt, Human
gccacuaauuuuaguauu

SEQ ID NO: 3837383 - RNA, 18 nt, Human
gccacuacacuccagccu

SEQ ID NO: 3837384 - RNA, 21 nt, Human
gccacuacacuccagccugag

SEQ ID NO: 3837385 - RNA, 17 nt, Human
gccacucacacagccag

SEQ ID NO: 3837386 - RNA, 20 nt, Human
gccacucacacagccaggug

SEQ ID NO: 3837387 - RNA, 20 nt, Human
gccacucaggaggcugaggc

SEQ ID NO: 3837388 - RNA, 14 nt, Human
gccacucauuucau

SEQ ID NO: 3837389 - RNA, 15 nt, Human
gccacucauuucauc

SEQ ID NO: 3837390 - RNA, 19 nt, Human
gccacuccagaccccuggc

SEQ ID NO: 3837391 - RNA, 21 nt, Human
gccacuccagaccccuggcuu

SEQ ID NO: 3837392 - RNA, 16 nt, Human
gccacuccccuccacu

SEQ ID NO: 3837393 - RNA, 16 nt, Human
gccacuccucccuccg

SEQ ID NO: 3837394 - RNA, 15 nt, Human
gccacuccugaaccc

SEQ ID NO: 3837395 - RNA, 17 nt, Human
gccacuccuuccugccc

SEQ ID NO: 3837396 - RNA, 23 nt, Human
gccacucgggaggcugagacagg

SEQ ID NO: 3837397 - RNA, 23 nt, Human
gccacucuaccagugcaggcugg

SEQ ID NO: 3837398 - RNA, 14 nt, Human
gccacucugccucu

SEQ ID NO: 3837399 - RNA, 17 nt, Human
gccacugaagcugggau

SEQ ID NO: 3837400 - RNA, 19 nt, Human
gccacugaagcugggauuc

SEQ ID NO: 3837401 - RNA, 18 nt, Human
gccacugacugcagggac

SEQ ID NO: 3837402 - RNA, 17 nt, Human
gccacugcacagagcuc

SEQ ID NO: 3837403 - RNA, 18 nt, Human
gccacugcaccgggccac

SEQ ID NO: 3837404 - RNA, 12 nt, Human
gccacugcacuc

SEQ ID NO: 3837405 - RNA, 19 nt, Human
gccacugcacuccagccug

SEQ ID NO: 3837406 - RNA, 20 nt, Human
gccacugcacuccagccugg

SEQ ID NO: 3837407 - RNA, 19 nt, Human
gccacugccauuaaagaau

SEQ ID NO: 3837408 - RNA, 16 nt, Human
gccacugcccgagcug

SEQ ID NO: 3837409 - RNA, 18 nt, Human
gccacugcccgagcuggu

SEQ ID NO: 3837410 - RNA, 19 nt, Human
gccacugcccgagcuggug

SEQ ID NO: 3837411 - RNA, 15 nt, Human
gccacugccucuccc

SEQ ID NO: 3837412 - RNA, 13 nt, Human
gccacugccucuu

SEQ ID NO: 3837413 - RNA, 21 nt, Human
gccacugcucccuaagccagc

SEQ ID NO: 3837414 - RNA, 19 nt, Human
gccacugcuccguggagga

SEQ ID NO: 3837415 - RNA, 23 nt, Human
gccacugcuuuucccuuugugag

SEQ ID NO: 3837416 - RNA, 12 nt, Human
gccacuggccau

SEQ ID NO: 3837417 - RNA, 16 nt, Human
gccacuggccaucucc

SEQ ID NO: 3837418 - RNA, 12 nt, Human
gccacuggggcu

SEQ ID NO: 3837419 - RNA, 14 nt, Human
gccacuggggcuca

SEQ ID NO: 3837420 - RNA, 15 nt, Human
gccacuggggcucag

SEQ ID NO: 3837421 - RNA, 17 nt, Human
gccacuggggcucagag

SEQ ID NO: 3837422 - RNA, 18 nt, Human
gccacugugaagagaacc

SEQ ID NO: 3837423 - RNA, 19 nt, Human
gccacugugaagagaacca

SEQ ID NO: 3837424 - RNA, 16 nt, Human
gccacugugguggcag

SEQ ID NO: 3837425 - RNA, 15 nt, Human
gccacuguguuccuu

SEQ ID NO: 3837426 - RNA, 18 nt, Human
gccacuguguuccuuccg

SEQ ID NO: 3837427 - RNA, 19 nt, Human
gccacuuaauguauguuac

SEQ ID NO: 3837428 - RNA, 19 nt, Human
gccacuuaccuucaauaaa

SEQ ID NO: 3837429 - RNA, 22 nt, Human
gccacuuaccuucaauaaagua

SEQ ID NO: 3837430 - RNA, 23 nt, Human
gccacuuaccuucaauaaaguau

SEQ ID NO: 3837431 - RNA, 18 nt, Human
gccacuuccuuuuaacug

SEQ ID NO: 3837432 - RNA, 13 nt, Human
gccacuucuaaga

SEQ ID NO: 3837433 - RNA, 22 nt, Human
gccacuugaacaaaaucuguug

SEQ ID NO: 3837434 - RNA, 21 nt, Human
gccacuugaugacccccaacc

SEQ ID NO: 3837435 - RNA, 17 nt, Human
gccacuuuaagagagaa

SEQ ID NO: 3837436 - RNA, 18 nt, Human
gccacuuuacccaccuag

SEQ ID NO: 3837437 - RNA, 22 nt, Human
gccacuuugguacauggccagu

SEQ ID NO: 3837438 - RNA, 10 nt, Human
gccagaaaaa

SEQ ID NO: 3837439 - RNA, 20 nt, Human
gccagaaaaacguguugccu

SEQ ID NO: 3837440 - RNA, 18 nt, Human
gccagaacaguuuguaca

SEQ ID NO: 3837441 - RNA, 16 nt, Human
gccagaacucuguguc

SEQ ID NO: 3837442 - RNA, 19 nt, Human
gccagaagauccccucagg

SEQ ID NO: 3837443 - RNA, 19 nt, Human
gccagaagaugaacagacu

SEQ ID NO: 3837444 - RNA, 20 nt, Human
gccagaagaugaacagacug

SEQ ID NO: 3837445 - RNA, 18 nt, Human
gccagaaguagcuuugca

SEQ ID NO: 3837446 - RNA, 23 nt, Human
gccagaaguuguggauuucaguu

SEQ ID NO: 3837447 - RNA, 20 nt, Human
gccagaaucagcacagauaa

SEQ ID NO: 3837448 - RNA, 17 nt, Human
gccagacacaggcccuc

SEQ ID NO: 3837449 - RNA, 22 nt, Human
gccagacaucaacagauaaaua

SEQ ID NO: 3837450 - RNA, 18 nt, Human
gccagacaugccacaagg

SEQ ID NO: 3837451 - RNA, 13 nt, Human
gccagaccagagc

SEQ ID NO: 3837452 - RNA, 17 nt, Human
gccagaccagagcucug

SEQ ID NO: 3837453 - RNA, 19 nt, Human
gccagaccagagcucugga

SEQ ID NO: 3837454 - RNA, 16 nt, Human
gccagaccauggacac

SEQ ID NO: 3837455 - RNA, 22 nt, Human
gccagacggcacccacccagca

SEQ ID NO: 3837456 - RNA, 21 nt, Human
gccagacuucccacggcuccu

SEQ ID NO: 3837457 - RNA, 13 nt, Human
gccagagaaguga

SEQ ID NO: 3837458 - RNA, 17 nt, Human
gccagagaagugacagg

SEQ ID NO: 3837459 - RNA, 18 nt, Human
gccagagaagugacaggg

SEQ ID NO: 3837460 - RNA, 19 nt, Human
gccagagaagugacaggga

SEQ ID NO: 3837461 - RNA, 16 nt, Human
gccagagacacaagcc

SEQ ID NO: 3837462 - RNA, 21 nt, Human
gccagagacacaagccuucgg

SEQ ID NO: 3837463 - RNA, 20 nt, Human
gccagagacggaagccuuuu

SEQ ID NO: 3837464 - RNA, 21 nt, Human
gccagagagccuggugcugcu

SEQ ID NO: 3837465 - RNA, 22 nt, Human
gccagagccaaggggcuucagg

SEQ ID NO: 3837466 - RNA, 14 nt, Human
gccagagccgggca

SEQ ID NO: 3837467 - RNA, 13 nt, Human
gccagagccuggg

SEQ ID NO: 3837468 - RNA, 18 nt, Human
gccagagccuggggcucu

SEQ ID NO: 3837469 - RNA, 19 nt, Human
gccagagccuggggcucua

SEQ ID NO: 3837470 - RNA, 15 nt, Human
gccagagcugggagg

SEQ ID NO: 3837471 - RNA, 20 nt, Human
gccagaggaacuguccagag

SEQ ID NO: 3837472 - RNA, 22 nt, Human
gccagaggaacuguccagagag

SEQ ID NO: 3837473 - RNA, 17 nt, Human
gccagaggaauccuggc

SEQ ID NO: 3837474 - RNA, 15 nt, Human
gccagaggagagagg

SEQ ID NO: 3837475 - RNA, 15 nt, Human
gccagaggcccccag

SEQ ID NO: 3837476 - RNA, 18 nt, Human
gccagaggcccccagccc

SEQ ID NO: 3837477 - RNA, 19 nt, Human
gccagagggcuugugaaca

SEQ ID NO: 3837478 - RNA, 19 nt, Human
gccagaggugggcaggugg

SEQ ID NO: 3837479 - RNA, 17 nt, Human
gccagaguggccuggcc

SEQ ID NO: 3837480 - RNA, 23 nt, Human
gccagaguggccuggccaggagc

SEQ ID NO: 3837481 - RNA, 24 nt, Human
gccagaguggccuggccaggagcu

SEQ ID NO: 3837482 - RNA, 22 nt, Human
gccagaguuccugcggagugaa

SEQ ID NO: 3837483 - RNA, 24 nt, Human
gccagaguuccugcggagugaaga

SEQ ID NO: 3837484 - RNA, 16 nt, Human
gccagauccagccugg

SEQ ID NO: 3837485 - RNA, 17 nt, Human
gccagauccagccuggg

SEQ ID NO: 3837486 - RNA, 20 nt, Human
gccagauccagccugggguc

SEQ ID NO: 3837487 - RNA, 15 nt, Human
gccagauccucuugg

SEQ ID NO: 3837488 - RNA, 21 nt, Human
gccagaugcacaucccuggaa

SEQ ID NO: 3837489 - RNA, 12 nt, Human
gccagaugcuga

SEQ ID NO: 3837490 - RNA, 24 nt, Human
gccagaugcugauguucaguguaa

SEQ ID NO: 3837491 - RNA, 15 nt, Human
gccagaugcugcaga

SEQ ID NO: 3837492 - RNA, 18 nt, Human
gccagauggggccucugu

SEQ ID NO: 3837493 - RNA, 15 nt, Human
gccagauguccuaau

SEQ ID NO: 3837494 - RNA, 15 nt, Human
gccagauugccaucc

SEQ ID NO: 3837495 - RNA, 15 nt, Human
gccagauuugucuuu

SEQ ID NO: 3837496 - RNA, 20 nt, Human
gccagauuugucuuuuuguu

SEQ ID NO: 3837497 - RNA, 20 nt, Human
gccagcaaaacuuagaugug

SEQ ID NO: 3837498 - RNA, 14 nt, Human
gccagcaaagcccc

SEQ ID NO: 3837499 - RNA, 16 nt, Human
gccagcaaagccccau

SEQ ID NO: 3837500 - RNA, 23 nt, Human
gccagcaaagccccaugcuggag

SEQ ID NO: 3837501 - RNA, 13 nt, Human
gccagcaacgcuu

SEQ ID NO: 3837502 - RNA, 14 nt, Human
gccagcaacgcuug

SEQ ID NO: 3837503 - RNA, 18 nt, Human
gccagcaacgcuuguaga

SEQ ID NO: 3837504 - RNA, 22 nt, Human
gccagcaacgcuuguagaacuc

SEQ ID NO: 3837505 - RNA, 13 nt, Human
gccagcaacugaa

SEQ ID NO: 3837506 - RNA, 14 nt, Human
gccagcaacugaau

SEQ ID NO: 3837507 - RNA, 19 nt, Human
gccagggucucucccucag

SEQ ID NO: 3837508 - RNA, 23 nt, Human
gccagggucucucccucaggugu

SEQ ID NO: 3837509 - RNA, 18 nt, Human
gccagggucugugugaau

SEQ ID NO: 3837510 - RNA, 20 nt, Human
gccagggucugugugaaugu

SEQ ID NO: 3837511 - RNA, 21 nt, Human
gccagggucugugugaaugug

SEQ ID NO: 3837512 - RNA, 22 nt, Human
gccagggucugugugaaugugg

SEQ ID NO: 3837513 - RNA, 20 nt, Human
gccaggguggucuugaucuc

SEQ ID NO: 3837514 - RNA, 14 nt, Human
gccaggguguggcc

SEQ ID NO: 3837515 - RNA, 21 nt, Human
gccaggucacccuuugcugug

SEQ ID NO: 3837516 - RNA, 15 nt, Human
gccagguccagagag

SEQ ID NO: 3837517 - RNA, 13 nt, Human
gccaggucccucu

SEQ ID NO: 3837518 - RNA, 15 nt, Human
gccaggugagaaacu

SEQ ID NO: 3837519 - RNA, 13 nt, Human
gccaggugccuug

SEQ ID NO: 3837520 - RNA, 18 nt, Human
gccaggugggcgggcagc

SEQ ID NO: 3837521 - RNA, 19 nt, Human
gccaggugggcgggcagca

SEQ ID NO: 3837522 - RNA, 23 nt, Human
gccagguucuauuuggaauuuau

SEQ ID NO: 3837523 - RNA, 23 nt, Human
gccagguucuccguuagcuccug

SEQ ID NO: 3837524 - RNA, 14 nt, Human
gccagguugcuaag

SEQ ID NO: 3837525 - RNA, 22 nt, Human
gccagguuucugcccacauugg

SEQ ID NO: 3837526 - RNA, 19 nt, Human
gccagguuuucuggguguc

SEQ ID NO: 3837527 - RNA, 22 nt, Human
gccaguaacacaggccacccug

SEQ ID NO: 3837528 - RNA, 16 nt, Human
gccaguaacaggcuca

SEQ ID NO: 3837529 - RNA, 19 nt, Human
gccaguaacgcgucuuccu

SEQ ID NO: 3837530 - RNA, 19 nt, Human
gccaguaauccuguaggaa

SEQ ID NO: 3837531 - RNA, 21 nt, Human
gccaguaucuauauaugugua

SEQ ID NO: 3837532 - RNA, 17 nt, Human
gccaguauuuuaaaaua

SEQ ID NO: 3837533 - RNA, 20 nt, Human
gccagucaccccggccaccu

SEQ ID NO: 3837534 - RNA, 12 nt, Human
gccagucaggcc

SEQ ID NO: 3837535 - RNA, 13 nt, Human
gccaguccaggcu

SEQ ID NO: 3837536 - RNA, 14 nt, Human
gccaguccaggcug

SEQ ID NO: 3837537 - RNA, 20 nt, Human
gccaguccaggcugccgugg

SEQ ID NO: 3837538 - RNA, 21 nt, Human
gccaguccaggcugccguggg

SEQ ID NO: 3837539 - RNA, 13 nt, Human
gccagucccaggg

SEQ ID NO: 3837540 - RNA, 16 nt, Human
gccagucccugaggca

SEQ ID NO: 3837541 - RNA, 16 nt, Human
gccaguccuagcugca

SEQ ID NO: 3837542 - RNA, 14 nt, Human
gccagucgcgcugc

SEQ ID NO: 3837543 - RNA, 16 nt, Human
gccagucgcgcugccu

SEQ ID NO: 3837544 - RNA, 18 nt, Human
gccagucgcgcugccugu

SEQ ID NO: 3837545 - RNA, 15 nt, Human
gccagucuaguuccu

SEQ ID NO: 3837546 - RNA, 22 nt, Human
gccagucucacugugggaaggc

SEQ ID NO: 3837547 - RNA, 15 nt, Human
gccagucugggcugc

SEQ ID NO: 3837548 - RNA, 16 nt, Human
gccagucugggcugcc

SEQ ID NO: 3837549 - RNA, 12 nt, Human
gccagucugugg

SEQ ID NO: 3837550 - RNA, 13 nt, Human
gccagucugugga

SEQ ID NO: 3837551 - RNA, 17 nt, Human
gccagugaccaaccuuu

SEQ ID NO: 3837552 - RNA, 18 nt, Human
gccagugacuccaggaga

SEQ ID NO: 3837553 - RNA, 20 nt, Human
gccagugaugcuaaagguug

SEQ ID NO: 3837554 - RNA, 13 nt, Human
gccagugcccuga

SEQ ID NO: 3837555 - RNA, 14 nt, Human
gccagugcccugag

SEQ ID NO: 3837556 - RNA, 12 nt, Human
gccagugccugg

SEQ ID NO: 3837557 - RNA, 14 nt, Human
gccagugccugggu

SEQ ID NO: 3837558 - RNA, 17 nt, Human
gccagugccuuaccucc

SEQ ID NO: 3837559 - RNA, 20 nt, Human
gccagugccuuaccuccugc

SEQ ID NO: 3837560 - RNA, 22 nt, Human
gccagugccuuaccuccugccc

SEQ ID NO: 3837561 - RNA, 15 nt, Human
gccagugcuccagcc

SEQ ID NO: 3837562 - RNA, 18 nt, Human
gccaguguaaucccccag

SEQ ID NO: 3837563 - RNA, 15 nt, Human
gccagugucuguccc

SEQ ID NO: 3837564 - RNA, 14 nt, Human
gccagugucuuucu

SEQ ID NO: 3837565 - RNA, 15 nt, Human
gccagugucuuucuu

SEQ ID NO: 3837566 - RNA, 18 nt, Human
gccagugucuuucuuugg

SEQ ID NO: 3837567 - RNA, 17 nt, Human
gccagugugaucccaag

SEQ ID NO: 3837568 - RNA, 17 nt, Human
gccagugugcugauggg

SEQ ID NO: 3837569 - RNA, 18 nt, Human
gccaguguugccuaagua

SEQ ID NO: 3837570 - RNA, 17 nt, Human
gccaguguuuaaaacuu

SEQ ID NO: 3837571 - RNA, 13 nt, Human
gccaguugguccc

SEQ ID NO: 3837572 - RNA, 15 nt, Human
cuggccgggcacagc

SEQ ID NO: 3837573 - RNA, 20 nt, Human
cuggccggugugggggcccc

SEQ ID NO: 3837574 - RNA, 13 nt, Human
cuggccguacuug

SEQ ID NO: 3837575 - RNA, 15 nt, Human
cuggccgugggccug

SEQ ID NO: 3837576 - RNA, 22 nt, Human
cuggccguugauguuggcuggg

SEQ ID NO: 3837577 - RNA, 16 nt, Human
cuggccuaaaaucuug

SEQ ID NO: 3837578 - RNA, 19 nt, Human
cuggccuaaaaucuuggaa

SEQ ID NO: 3837579 - RNA, 14 nt, Human
cuggccuagcauac

SEQ ID NO: 3837580 - RNA, 22 nt, Human
cuggccuauccgcugccagccu

SEQ ID NO: 3837581 - RNA, 16 nt, Human
cuggccucaaagcaag

SEQ ID NO: 3837582 - RNA, 12 nt, Human
cuggccucagac

SEQ ID NO: 3837583 - RNA, 22 nt, Human
cuggccucagacugcacccagg

SEQ ID NO: 3837584 - RNA, 22 nt, Human
cuggccucaggugggccgcagg

SEQ ID NO: 3837585 - RNA, 11 nt, Human
cuggccuccag

SEQ ID NO: 3837586 - RNA, 12 nt, Human
cuggccuccagg

SEQ ID NO: 3837587 - RNA, 15 nt, Human
cuggccuccaggccc

SEQ ID NO: 3837588 - RNA, 16 nt, Human
cuggccucccaaauga

SEQ ID NO: 3837589 - RNA, 14 nt, Human
cuggccucccacag

SEQ ID NO: 3837590 - RNA, 13 nt, Human
cuggccucccacc

SEQ ID NO: 3837591 - RNA, 22 nt, Human
cuggccucccacccgaugcugc

SEQ ID NO: 3837592 - RNA, 22 nt, Human
cuggccuccggcgucagccucc

SEQ ID NO: 3837593 - RNA, 13 nt, Human
cuggccuccugcc

SEQ ID NO: 3837594 - RNA, 18 nt, Human
cuggccucgccuggccug

SEQ ID NO: 3837595 - RNA, 20 nt, Human
cuggccucgccuggccugag

SEQ ID NO: 3837596 - RNA, 13 nt, Human
cuggccucugcac

SEQ ID NO: 3837597 - RNA, 12 nt, Human
cuggccucugcg

SEQ ID NO: 3837598 - RNA, 14 nt, Human
cuggccucugcuuu

SEQ ID NO: 3837599 - RNA, 15 nt, Human
cuggccucugcuuuc

SEQ ID NO: 3837600 - RNA, 17 nt, Human
cuggccucuggcucuca

SEQ ID NO: 3837601 - RNA, 17 nt, Human
cuggccucugucauauc

SEQ ID NO: 3837602 - RNA, 13 nt, Human
cuggccucugugc

SEQ ID NO: 3837603 - RNA, 14 nt, Human
cuggccucugugcc

SEQ ID NO: 3837604 - RNA, 16 nt, Human
cuggccucugugccuu

SEQ ID NO: 3837605 - RNA, 15 nt, Human
cuggccucuucuaga

SEQ ID NO: 3837606 - RNA, 18 nt, Human
cuggccugacuuggggga

SEQ ID NO: 3837607 - RNA, 15 nt, Human
cuggccugagaguca

SEQ ID NO: 3837608 - RNA, 13 nt, Human
cuggccugagcug

SEQ ID NO: 3837609 - RNA, 18 nt, Human
cuggccugagcugggaug

SEQ ID NO: 3837610 - RNA, 13 nt, Human
cuggccugaggag

SEQ ID NO: 3837611 - RNA, 15 nt, Human
cuggccugcugggcu

SEQ ID NO: 3837612 - RNA, 19 nt, Human
cuggccugcugggcucucc

SEQ ID NO: 3837613 - RNA, 23 nt, Human
cuggccuggacaguaucccacau

SEQ ID NO: 3837614 - RNA, 14 nt, Human
cuggccuggacugu

SEQ ID NO: 3837615 - RNA, 22 nt, Human
cuggccuggcacacaucaggag

SEQ ID NO: 3837616 - RNA, 19 nt, Human
cuggccuggccauacugug

SEQ ID NO: 3837617 - RNA, 14 nt, Human
cuggccuggccccu

SEQ ID NO: 3837618 - RNA, 19 nt, Human
cuggccuggccccucaggg

SEQ ID NO: 3837619 - RNA, 14 nt, Human
cuggccuggcccug

SEQ ID NO: 3837620 - RNA, 15 nt, Human
cuggccuggcccugc

SEQ ID NO: 3837621 - RNA, 16 nt, Human
cuggccuggcccugcc

SEQ ID NO: 3837622 - RNA, 14 nt, Human
cuggccuggccggc

SEQ ID NO: 3837623 - RNA, 15 nt, Human
cuggccuggccuggc

SEQ ID NO: 3837624 - RNA, 18 nt, Human
cuggccuggccuggcccu

SEQ ID NO: 3837625 - RNA, 14 nt, Human
cuggccuggcuucu

SEQ ID NO: 3837626 - RNA, 17 nt, Human
cuggccuggcuucuccu

SEQ ID NO: 3837627 - RNA, 18 nt, Human
cuggccuggggucaggcc

SEQ ID NO: 3837628 - RNA, 14 nt, Human
cuggccugugucua

SEQ ID NO: 3837629 - RNA, 13 nt, Human
cuggccuuacacc

SEQ ID NO: 3837630 - RNA, 14 nt, Human
cuggccuuacaccu

SEQ ID NO: 3837631 - RNA, 18 nt, Human
cuggccuucggccuccau

SEQ ID NO: 3837632 - RNA, 20 nt, Human
cuggccuugggcccucuggu

SEQ ID NO: 3837633 - RNA, 21 nt, Human
cuggccuugugguccaaauag

SEQ ID NO: 3837634 - RNA, 14 nt, Human
cuggccuuuuccua

SEQ ID NO: 3837635 - RNA, 22 nt, Human
cuggcgacacguagcagcuuag

SEQ ID NO: 3837636 - RNA, 19 nt, Human
cuggcgagagucuggcccu

SEQ ID NO: 3837637 - RNA, 22 nt, Human
cuggcgagugaaugccagugug

SEQ ID NO: 3837638 - RNA, 23 nt, Human
cuggcgagugaaugccagugugc

SEQ ID NO: 3837639 - RNA, 24 nt, Human
cuggcgcagaacgaaccuuggccu

SEQ ID NO: 3837640 - RNA, 12 nt, Human
cuggcgcagcca

SEQ ID NO: 3837641 - RNA, 14 nt, Human
cuggcgcagguggg

SEQ ID NO: 3837642 - RNA, 16 nt, Human
cuggcgcaggugggcu

SEQ ID NO: 3837643 - RNA, 20 nt, Human
cuggcgccucugcaagggca

SEQ ID NO: 3837644 - RNA, 18 nt, Human
cuggcggcuacucagcag

SEQ ID NO: 3837645 - RNA, 23 nt, Human
cuggcggcuacucagcagcccuc

SEQ ID NO: 3837646 - RNA, 20 nt, Human
cuggcgggaugggccaccgc

SEQ ID NO: 3837647 - RNA, 19 nt, Human
cuggcgucaugcaaaguca

SEQ ID NO: 3837648 - RNA, 23 nt, Human
cuggcgucugucuucaagggcuu

SEQ ID NO: 3837649 - RNA, 22 nt, Human
cuggcgugaacccaggaggcgg

SEQ ID NO: 3837650 - RNA, 14 nt, Human
cuggcuaacaaggc

SEQ ID NO: 3837651 - RNA, 16 nt, Human
cuggcuaacuggaagc

SEQ ID NO: 3837652 - RNA, 17 nt, Human
cuggcuaacuggaagca

SEQ ID NO: 3837653 - RNA, 21 nt, Human
gccccaaguuuugugaaauuu

SEQ ID NO: 3837654 - RNA, 16 nt, Human
gccccacacagcuaca

SEQ ID NO: 3837655 - RNA, 21 nt, Human
gccccacaccagggccagccu

SEQ ID NO: 3837656 - RNA, 22 nt, Human
gccccacaccagggccagccuc

SEQ ID NO: 3837657 - RNA, 11 nt, Human
gccccacagcc

SEQ ID NO: 3837658 - RNA, 23 nt, Human
gccccacagcccacguccuguca

SEQ ID NO: 3837659 - RNA, 11 nt, Human
gccccaccacc

SEQ ID NO: 3837660 - RNA, 14 nt, Human
gccccaccaccuag

SEQ ID NO: 3837661 - RNA, 18 nt, Human
gccccaccaccuaggcca

SEQ ID NO: 3837662 - RNA, 14 nt, Human
gccccaccagugcc

SEQ ID NO: 3837663 - RNA, 17 nt, Human
gccccaccagugccucu

SEQ ID NO: 3837664 - RNA, 18 nt, Human
gccccaccagugccucuc

SEQ ID NO: 3837665 - RNA, 11 nt, Human
gccccacccag

SEQ ID NO: 3837666 - RNA, 19 nt, Human
gccccaccccagggcagcc

SEQ ID NO: 3837667 - RNA, 20 nt, Human
gccccaccccagggcagcca

SEQ ID NO: 3837668 - RNA, 22 nt, Human
gccccaccccagggcagccagg

SEQ ID NO: 3837669 - RNA, 18 nt, Human
gccccacccucagaugca

SEQ ID NO: 3837670 - RNA, 23 nt, Human
gccccacccucguggacaccugc

SEQ ID NO: 3837671 - RNA, 23 nt, Human
gccccacccugggcccugggcug

SEQ ID NO: 3837672 - RNA, 17 nt, Human
gccccaccugcagcucc

SEQ ID NO: 3837673 - RNA, 12 nt, Human
gccccaccugcc

SEQ ID NO: 3837674 - RNA, 15 nt, Human
gccccaccuggcccu

SEQ ID NO: 3837675 - RNA, 22 nt, Human
gccccaccuggcugaggcgcca

SEQ ID NO: 3837676 - RNA, 20 nt, Human
gccccaccuuuauuaaaauc

SEQ ID NO: 3837677 - RNA, 20 nt, Human
gccccacucccuugcuggcc

SEQ ID NO: 3837678 - RNA, 13 nt, Human
gccccacucucag

SEQ ID NO: 3837679 - RNA, 16 nt, Human
gccccacucucagagg

SEQ ID NO: 3837680 - RNA, 17 nt, Human
gccccacucucagaggc

SEQ ID NO: 3837681 - RNA, 19 nt, Human
gccccacucucagaggccc

SEQ ID NO: 3837682 - RNA, 21 nt, Human
gccccacucucagaggcccca

SEQ ID NO: 3837683 - RNA, 12 nt, Human
gccccacugaug

SEQ ID NO: 3837684 - RNA, 13 nt, Human
gccccacugaugc

SEQ ID NO: 3837685 - RNA, 18 nt, Human
gccccacugaugcuguuc

SEQ ID NO: 3837686 - RNA, 15 nt, Human
gccccacugccagca

SEQ ID NO: 3837687 - RNA, 23 nt, Human
gccccacugccagcagcagcagg

SEQ ID NO: 3837688 - RNA, 14 nt, Human
gccccacuggggaa

SEQ ID NO: 3837689 - RNA, 15 nt, Human
gccccacuggggaaa

SEQ ID NO: 3837690 - RNA, 14 nt, Human
gccccacuuaccgc

SEQ ID NO: 3837691 - RNA, 15 nt, Human
gccccagaaggcagg

SEQ ID NO: 3837692 - RNA, 22 nt, Human
gccccagagcaggguguuggga

SEQ ID NO: 3837693 - RNA, 14 nt, Human
gccccagagcuguu

SEQ ID NO: 3837694 - RNA, 23 nt, Human
gccccagagcuguuuauggccuc

SEQ ID NO: 3837695 - RNA, 15 nt, Human
gccccagaggccucu

SEQ ID NO: 3837696 - RNA, 19 nt, Human
gccccagauaccagccccu

SEQ ID NO: 3837697 - RNA, 18 nt, Human
gccccagaucaccagccc

SEQ ID NO: 3837698 - RNA, 20 nt, Human
gccccagcacagcuugaccu

SEQ ID NO: 3837699 - RNA, 18 nt, Human
gccccagcaccaccaggu

SEQ ID NO: 3837700 - RNA, 21 nt, Human
gccccagcaccucagccugca

SEQ ID NO: 3837701 - RNA, 12 nt, Human
gccccagcacua

SEQ ID NO: 3837702 - RNA, 17 nt, Human
gccccagcacuaaagca

SEQ ID NO: 3837703 - RNA, 20 nt, Human
gccccagccagaguuccugc

SEQ ID NO: 3837704 - RNA, 15 nt, Human
gccccagcccaaguc

SEQ ID NO: 3837705 - RNA, 16 nt, Human
gccccagcccaagucc

SEQ ID NO: 3837706 - RNA, 14 nt, Human
gccccagcccaccc

SEQ ID NO: 3837707 - RNA, 15 nt, Human
gccccagcccacccu

SEQ ID NO: 3837708 - RNA, 21 nt, Human
gccccagcccacccuccuguc

SEQ ID NO: 3837709 - RNA, 12 nt, Human
gccccagcccag

SEQ ID NO: 3837710 - RNA, 14 nt, Human
gccccagcccagau

SEQ ID NO: 3837711 - RNA, 19 nt, Human
gccccagcccagccccacu

SEQ ID NO: 3837712 - RNA, 22 nt, Human
gccccagcccagccccacuccu

SEQ ID NO: 3837713 - RNA, 15 nt, Human
gccccagcccugcug

SEQ ID NO: 3837714 - RNA, 20 nt, Human
gccccagcccugcuggggau

SEQ ID NO: 3837715 - RNA, 21 nt, Human
gccccagccucccugaagccu

SEQ ID NO: 3837716 - RNA, 14 nt, Human
gccccagccugcua

SEQ ID NO: 3837717 - RNA, 17 nt, Human
gccccagccugcuagcu

SEQ ID NO: 3837718 - RNA, 12 nt, Human
gccccagccugg

SEQ ID NO: 3837719 - RNA, 13 nt, Human
gccccagccuggc

SEQ ID NO: 3837720 - RNA, 19 nt, Human
gccccagccuggcccagcu

SEQ ID NO: 3837721 - RNA, 21 nt, Human
gccccagccuggcccagcucc

SEQ ID NO: 3837722 - RNA, 23 nt, Human
gccccagcgcugacgugucagga

SEQ ID NO: 3837723 - RNA, 13 nt, Human
gccccagcucugg

SEQ ID NO: 3837724 - RNA, 17 nt, Human
gccccagcugacaugga

SEQ ID NO: 3837725 - RNA, 15 nt, Human
gccccaggaaaggcc

SEQ ID NO: 3837726 - RNA, 12 nt, Human
gccccaggacca

SEQ ID NO: 3837727 - RNA, 16 nt, Human
gccccaggaccagcuc

SEQ ID NO: 3837728 - RNA, 23 nt, Human
gccaguuggucccccuuccaugg

SEQ ID NO: 3837729 - RNA, 20 nt, Human
gccaguuuuguuuccuuuca

SEQ ID NO: 3837730 - RNA, 22 nt, Human
gccauaaaacauuaagaaaauc

SEQ ID NO: 3837731 - RNA, 15 nt, Human
gccauacuggccucg

SEQ ID NO: 3837732 - RNA, 20 nt, Human
gccauacuuaucucucugug

SEQ ID NO: 3837733 - RNA, 17 nt, Human
gccauagaguacacugc

SEQ ID NO: 3837734 - RNA, 18 nt, Human
gccauagcuccugcucca

SEQ ID NO: 3837735 - RNA, 23 nt, Human
gccauauaaguuugaaggaaaca

SEQ ID NO: 3837736 - RNA, 16 nt, Human
gccauaugaaaaggcu

SEQ ID NO: 3837737 - RNA, 16 nt, Human
gccauaugauuuacau

SEQ ID NO: 3837738 - RNA, 17 nt, Human
gccauaugauuuacauu

SEQ ID NO: 3837739 - RNA, 14 nt, Human
gccauauuaaauuu

SEQ ID NO: 3837740 - RNA, 21 nt, Human
gccauauugcacaugucuuaa

SEQ ID NO: 3837741 - RNA, 22 nt, Human
gccauauugcacaugucuuaau

SEQ ID NO: 3837742 - RNA, 17 nt, Human
gccauauuuaccucagc

SEQ ID NO: 3837743 - RNA, 21 nt, Human
gccauauuuaccucagccugg

SEQ ID NO: 3837744 - RNA, 17 nt, Human
gccauauuuacuaccuu

SEQ ID NO: 3837745 - RNA, 13 nt, Human
gccauauuuguaa

SEQ ID NO: 3837746 - RNA, 15 nt, Human
gccaucaaaaugcuu

SEQ ID NO: 3837747 - RNA, 18 nt, Human
gccaucaaaaugcuuuuu

SEQ ID NO: 3837748 - RNA, 14 nt, Human
gccaucaaacugua

SEQ ID NO: 3837749 - RNA, 21 nt, Human
gccaucaacuaaaguuguacu

SEQ ID NO: 3837750 - RNA, 24 nt, Human
gccaucaauaaaaaauuaugacau

SEQ ID NO: 3837751 - RNA, 14 nt, Human
gccaucaccuuaga

SEQ ID NO: 3837752 - RNA, 23 nt, Human
gccaucaucuccugccuuccucc

SEQ ID NO: 3837753 - RNA, 17 nt, Human
gccaucauguuuacaga

SEQ ID NO: 3837754 - RNA, 18 nt, Human
gccaucauugcugucugc

SEQ ID NO: 3837755 - RNA, 19 nt, Human
gccaucauugcugucugca

SEQ ID NO: 3837756 - RNA, 13 nt, Human
gccaucauuucug

SEQ ID NO: 3837757 - RNA, 17 nt, Human
gccaucccagccccaau

SEQ ID NO: 3837758 - RNA, 17 nt, Human
gccaucccagccuuggc

SEQ ID NO: 3837759 - RNA, 15 nt, Human
gccaucccucccucc

SEQ ID NO: 3837760 - RNA, 14 nt, Human
gccaucccucgugg

SEQ ID NO: 3837761 - RNA, 15 nt, Human
gccaucccugugagg

SEQ ID NO: 3837762 - RNA, 19 nt, Human
gccauccuaaaagccaccc

SEQ ID NO: 3837763 - RNA, 23 nt, Human
gccauccucaaacacugcaggca

SEQ ID NO: 3837764 - RNA, 18 nt, Human
gccauccuggcccagggc

SEQ ID NO: 3837765 - RNA, 23 nt, Human
gccaucgccgggacuccagaacc

SEQ ID NO: 3837766 - RNA, 16 nt, Human
gccaucuagccagccc

SEQ ID NO: 3837767 - RNA, 19 nt, Human
gccaucucaccuccugcug

SEQ ID NO: 3837768 - RNA, 21 nt, Human
gccaucucaccuccugcuggg

SEQ ID NO: 3837769 - RNA, 18 nt, Human
gccaucucaugaggggag

SEQ ID NO: 3837770 - RNA, 20 nt, Human
gccaucucaugaggggagag

SEQ ID NO: 3837771 - RNA, 22 nt, Human
gccaucuccacccccagcugcu

SEQ ID NO: 3837772 - RNA, 14 nt, Human
gccaucucugcucc

SEQ ID NO: 3837773 - RNA, 12 nt, Human
gccaucugccca

SEQ ID NO: 3837774 - RNA, 13 nt, Human
gccaucugcccag

SEQ ID NO: 3837775 - RNA, 12 nt, Human
gccaucugcucc

SEQ ID NO: 3837776 - RNA, 19 nt, Human
gccaucuggagagcccaga

SEQ ID NO: 3837777 - RNA, 18 nt, Human
gccaucuggggcuccuuc

SEQ ID NO: 3837778 - RNA, 23 nt, Human
gccaucugguuaggauggcagga

SEQ ID NO: 3837779 - RNA, 12 nt, Human
gccaucuguggg

SEQ ID NO: 3837780 - RNA, 13 nt, Human
gccaucugugggc

SEQ ID NO: 3837781 - RNA, 15 nt, Human
gccaucugugggcac

SEQ ID NO: 3837782 - RNA, 15 nt, Human
gccaucuugguaaau

SEQ ID NO: 3837783 - RNA, 22 nt, Human
gccaucuugguaaauuucccca

SEQ ID NO: 3837784 - RNA, 16 nt, Human
gccaugaacuggaggc

SEQ ID NO: 3837785 - RNA, 12 nt, Human
gccaugaacugu

SEQ ID NO: 3837786 - RNA, 13 nt, Human
gccaugaacuuug

SEQ ID NO: 3837787 - RNA, 23 nt, Human
gccaugaagaggaugcugugaaa

SEQ ID NO: 3837788 - RNA, 23 nt, Human
gccaugacaacuucuaauugcca

SEQ ID NO: 3837789 - RNA, 17 nt, Human
gccaugacccugccucu

SEQ ID NO: 3837790 - RNA, 21 nt, Human
gccaugacccugccucuccca

SEQ ID NO: 3837791 - RNA, 18 nt, Human
gccaugaccuuacauuuc

SEQ ID NO: 3837792 - RNA, 22 nt, Human
gccaugagaauguuuuagcaca

SEQ ID NO: 3837793 - RNA, 14 nt, Human
gccaugagcuccag

SEQ ID NO: 3837794 - RNA, 15 nt, Human
gccaugagcuccaga

SEQ ID NO: 3837795 - RNA, 19 nt, Human
gccaugagcuccagacccc

SEQ ID NO: 3837796 - RNA, 20 nt, Human
gccaugaggaacaaggcaag

SEQ ID NO: 3837797 - RNA, 14 nt, Human
gcccugcuccuccc

SEQ ID NO: 3837798 - RNA, 17 nt, Human
gcccugcuccucccugg

SEQ ID NO: 3837799 - RNA, 18 nt, Human
gcccugcuccucccuggc

SEQ ID NO: 3837800 - RNA, 21 nt, Human
gcccugcuccucccuggcugc

SEQ ID NO: 3837801 - RNA, 17 nt, Human
gcccugcuccugcagca

SEQ ID NO: 3837802 - RNA, 19 nt, Human
gcccugcugagucaucugu

SEQ ID NO: 3837803 - RNA, 17 nt, Human
gcccugcugcccucccc

SEQ ID NO: 3837804 - RNA, 18 nt, Human
gcccugcugcugccugcc

SEQ ID NO: 3837805 - RNA, 18 nt, Human
gcccugcuggccgccuca

SEQ ID NO: 3837806 - RNA, 20 nt, Human
gcccugcuggccgccucacc

SEQ ID NO: 3837807 - RNA, 22 nt, Human
gcccugcuggccgccucacccc

SEQ ID NO: 3837808 - RNA, 14 nt, Human
gcccugcuuucaga

SEQ ID NO: 3837809 - RNA, 20 nt, Human
gcccugcuuugggcugcccu

SEQ ID NO: 3837810 - RNA, 22 nt, Human
gcccugcuuugggcugcccugg

SEQ ID NO: 3837811 - RNA, 20 nt, Human
gcccuggaacauccuuugca

SEQ ID NO: 3837812 - RNA, 21 nt, Human
gcccuggaacucuaucugggc

SEQ ID NO: 3837813 - RNA, 22 nt, Human
gcccuggagaccccaccagccu

SEQ ID NO: 3837814 - RNA, 20 nt, Human
gcccuggagccaacugcugc

SEQ ID NO: 3837815 - RNA, 23 nt, Human
gcccuggagccaacugcugcuuu

SEQ ID NO: 3837816 - RNA, 22 nt, Human
gcccuggaggugccagcaaagc

SEQ ID NO: 3837817 - RNA, 15 nt, Human
gcccuggagguggcu

SEQ ID NO: 3837818 - RNA, 15 nt, Human
gcccuggcagggggc

SEQ ID NO: 3837819 - RNA, 16 nt, Human
gcccuggcagggggca

SEQ ID NO: 3837820 - RNA, 21 nt, Human
gcccuggcagggucauccugu

SEQ ID NO: 3837821 - RNA, 15 nt, Human
gcccuggcaugucaa

SEQ ID NO: 3837822 - RNA, 15 nt, Human
gcccuggccagaggc

SEQ ID NO: 3837823 - RNA, 16 nt, Human
gcccuggccagaggcu

SEQ ID NO: 3837824 - RNA, 16 nt, Human
gcccuggcccccacau

SEQ ID NO: 3837825 - RNA, 14 nt, Human
gcccuggccucccc

SEQ ID NO: 3837826 - RNA, 17 nt, Human
gcccuggccuccccugc

SEQ ID NO: 3837827 - RNA, 19 nt, Human
gcccuggccuccccugcca

SEQ ID NO: 3837828 - RNA, 24 nt, Human
gcccuggccuccccugccaccagg

SEQ ID NO: 3837829 - RNA, 12 nt, Human
gcccuggccugc

SEQ ID NO: 3837830 - RNA, 13 nt, Human
gcccuggccugcu

SEQ ID NO: 3837831 - RNA, 16 nt, Human
gcccuggccugcuggg

SEQ ID NO: 3837832 - RNA, 15 nt, Human
gcccuggcucccaca

SEQ ID NO: 3837833 - RNA, 14 nt, Human
gcccuggcucugca

SEQ ID NO: 3837834 - RNA, 10 nt, Human
gcccuggcug

SEQ ID NO: 3837835 - RNA, 16 nt, Human
gcccuggcugaaggac

SEQ ID NO: 3837836 - RNA, 17 nt, Human
gcccuggcugaaggacu

SEQ ID NO: 3837837 - RNA, 19 nt, Human
gcccuggcugaaggacugu

SEQ ID NO: 3837838 - RNA, 12 nt, Human
gcccuggcugac

SEQ ID NO: 3837839 - RNA, 16 nt, Human
gcccuggcugccggca

SEQ ID NO: 3837840 - RNA, 14 nt, Human
gcccuggcugcugc

SEQ ID NO: 3837841 - RNA, 16 nt, Human
gcccuggcugcugccc

SEQ ID NO: 3837842 - RNA, 22 nt, Human
gcccuggcugcugcccccaccc

SEQ ID NO: 3837843 - RNA, 23 nt, Human
gcccuggcuguucugugguuccu

SEQ ID NO: 3837844 - RNA, 22 nt, Human
gcccugggaaaccccuucucug

SEQ ID NO: 3837845 - RNA, 16 nt, Human
gcccugggaggcagug

SEQ ID NO: 3837846 - RNA, 23 nt, Human
gcccugggaggcucuggagccca

SEQ ID NO: 3837847 - RNA, 17 nt, Human
gcccugggaucacugug

SEQ ID NO: 3837848 - RNA, 15 nt, Human
gcccugggccugccu

SEQ ID NO: 3837849 - RNA, 16 nt, Human
gcccugggccugccuc

SEQ ID NO: 3837850 - RNA, 23 nt, Human
gcccugggcucggaggcugcccc

SEQ ID NO: 3837851 - RNA, 13 nt, Human
gcccugggcugga

SEQ ID NO: 3837852 - RNA, 14 nt, Human
gcccuggggccugu

SEQ ID NO: 3837853 - RNA, 17 nt, Human
gcccuggggccuguaca

SEQ ID NO: 3837854 - RNA, 18 nt, Human
gcccuggggccuguacug

SEQ ID NO: 3837855 - RNA, 21 nt, Human
gcccuggggccuguacugccu

SEQ ID NO: 3837856 - RNA, 22 nt, Human
gcccuggggccuguacugccug

SEQ ID NO: 3837857 - RNA, 23 nt, Human
gcccuggggccuguacugccugc

SEQ ID NO: 3837858 - RNA, 16 nt, Human
gcccuggggcugggcc

SEQ ID NO: 3837859 - RNA, 21 nt, Human
gcccugggucuaagggguugg

SEQ ID NO: 3837860 - RNA, 17 nt, Human
gcccugguccagggaag

SEQ ID NO: 3837861 - RNA, 15 nt, Human
gcccugguccuucca

SEQ ID NO: 3837862 - RNA, 16 nt, Human
gcccuggugcugccac

SEQ ID NO: 3837863 - RNA, 19 nt, Human
gcccugguggcagugggag

SEQ ID NO: 3837864 - RNA, 20 nt, Human
gcccugguggcccucucccc

SEQ ID NO: 3837865 - RNA, 18 nt, Human
gcccugguguuucuagca

SEQ ID NO: 3837866 - RNA, 16 nt, Human
gcccugguuucacugg

SEQ ID NO: 3837867 - RNA, 18 nt, Human
gcccugguuucacuggcc

SEQ ID NO: 3837868 - RNA, 17 nt, Human
gcccugguuuccugccc

SEQ ID NO: 3837869 - RNA, 21 nt, Human
gcccuguaucaacccagaaac

SEQ ID NO: 3837870 - RNA, 22 nt, Human
gcccuguaucaacccagaaaca

SEQ ID NO: 3837871 - RNA, 17 nt, Human
gcccugucaggaggcag

SEQ ID NO: 3837872 - RNA, 15 nt, Human
gcccugucagugcag

SEQ ID NO: 3837873 - RNA, 13 nt, Human
gcccugucccucc

SEQ ID NO: 3837874 - RNA, 17 nt, Human
gcccuguccugguggua

SEQ ID NO: 3837875 - RNA, 22 nt, Human
gcccuguccuggugguauuuuc

SEQ ID NO: 3837876 - RNA, 21 nt, Human
gcccugucgagacacuugccu

SEQ ID NO: 3837877 - RNA, 19 nt, Human
gcccugugaggcugggucc

SEQ ID NO: 3837878 - RNA, 13 nt, Human
gcccugugcucca

SEQ ID NO: 3837879 - RNA, 23 nt, Human
gcccuguggaagggacuaggagc

SEQ ID NO: 3837880 - RNA, 22 nt, Human
gcccuguggaugagcccucaga

SEQ ID NO: 3837881 - RNA, 19 nt, Human
gcccugugggaccccaggc

SEQ ID NO: 3837882 - RNA, 21 nt, Human
gcccugugggcccccaaaugg

SEQ ID NO: 3837883 - RNA, 12 nt, Human
gcccugugugca

SEQ ID NO: 3837884 - RNA, 13 nt, Human
gcccugugugcag

SEQ ID NO: 3837885 - RNA, 14 nt, Human
gcccuguuaaaaga

SEQ ID NO: 3837886 - RNA, 17 nt, Human
gcccuguuaaaagauga

SEQ ID NO: 3837887 - RNA, 20 nt, Human
gcccuguugaauuuuguucu

SEQ ID NO: 3837888 - RNA, 16 nt, Human
gcccuguugacacagg

SEQ ID NO: 3837889 - RNA, 20 nt, Human
gcccuuaccugccaggaagc

SEQ ID NO: 3837890 - RNA, 13 nt, Human
gcccuuaccuucc

SEQ ID NO: 3837891 - RNA, 18 nt, Human
gcccuuacuucuugcccu

SEQ ID NO: 3837892 - RNA, 23 nt, Human
gcccuuagucccccaacucugag

SEQ ID NO: 3837893 - RNA, 18 nt, Human
gcccuuauuuucaagaaa

SEQ ID NO: 3837894 - RNA, 20 nt, Human
gcccuuauuuucaagaaacu

SEQ ID NO: 3837895 - RNA, 15 nt, Human
gcccuuccaaacucu

SEQ ID NO: 3837896 - RNA, 16 nt, Human
gcccuucccugucccu

SEQ ID NO: 3837897 - RNA, 19 nt, Human
gcccuuccuccuccaccac

SEQ ID NO: 3837898 - RNA, 20 nt, Human
gcccuuccuccuccaccacc

SEQ ID NO: 3837899 - RNA, 23 nt, Human
gcccuuccucuccacccucccag

SEQ ID NO: 3837900 - RNA, 20 nt, Human
gcccuuccucuccacugccu

SEQ ID NO: 3837901 - RNA, 21 nt, Human
gcccuuccucuccacugccuu

SEQ ID NO: 3837902 - RNA, 12 nt, Human
gcccuuccugga

SEQ ID NO: 3837903 - RNA, 14 nt, Human
gcccuuccuggaca

SEQ ID NO: 3837904 - RNA, 19 nt, Human
gcccuuccuggacagcugu

SEQ ID NO: 3837905 - RNA, 22 nt, Human
gcccuuccuggacagcugugcc

SEQ ID NO: 3837906 - RNA, 22 nt, Human
gcccuucuauacccacccagaa

SEQ ID NO: 3837907 - RNA, 14 nt, Human
gcccuucucuccag

SEQ ID NO: 3837908 - RNA, 17 nt, Human
gcccuucucuccagccc

SEQ ID NO: 3837909 - RNA, 18 nt, Human
gcccuucucuccagcccc

SEQ ID NO: 3837910 - RNA, 23 nt, Human
gcccuucuugcugcccugcccca

SEQ ID NO: 3837911 - RNA, 17 nt, Human
gcccuugagcuccccaa

SEQ ID NO: 3837912 - RNA, 20 nt, Human
gcccuugcaguucagcacca

SEQ ID NO: 3837913 - RNA, 21 nt, Human
gcccuugcaguucagcaccac

SEQ ID NO: 3837914 - RNA, 13 nt, Human
gcccuugcccuga

SEQ ID NO: 3837915 - RNA, 14 nt, Human
gcccuugcccugac

SEQ ID NO: 3837916 - RNA, 16 nt, Human
gcccuugccuccccau

SEQ ID NO: 3837917 - RNA, 12 nt, Human
gcccuuggagcg

SEQ ID NO: 3837918 - RNA, 16 nt, Human
gcccuuggaggccagc

SEQ ID NO: 3837919 - RNA, 16 nt, Human
gcccuuggccaugggu

SEQ ID NO: 3837920 - RNA, 24 nt, Human
gcccuugucccacucaagccaagc

SEQ ID NO: 3837921 - RNA, 21 nt, Human
gcccuuguuuggggcaggagu

SEQ ID NO: 3837922 - RNA, 22 nt, Human
gcccuuguuuggggcaggagua

SEQ ID NO: 3837923 - RNA, 20 nt, Human
gcccuuuacuugucuuucug

SEQ ID NO: 3837924 - RNA, 22 nt, Human
gcccuuuccccgacgcccaccc

SEQ ID NO: 3837925 - RNA, 13 nt, Human
gcccuuuccucag

SEQ ID NO: 3837926 - RNA, 22 nt, Human
gcccuuucggauccagggaggc

SEQ ID NO: 3837927 - RNA, 12 nt, Human
gcccuuucugug

SEQ ID NO: 3837928 - RNA, 21 nt, Human
gcccuuugggaggcugaggcg

SEQ ID NO: 3837929 - RNA, 14 nt, Human
gcccuuuuuaagga

SEQ ID NO: 3837930 - RNA, 17 nt, Human
gcccuuuuuucugccuc

SEQ ID NO: 3837931 - RNA, 19 nt, Human
gcccuuuuuucugccuccu

SEQ ID NO: 3837932 - RNA, 12 nt, Human
gccgaaccagga

SEQ ID NO: 3837933 - RNA, 16 nt, Human
gcccccaccuggcuca

SEQ ID NO: 3837934 - RNA, 12 nt, Human
gcccccacugac

SEQ ID NO: 3837935 - RNA, 15 nt, Human
gcccccacuggcugu

SEQ ID NO: 3837936 - RNA, 12 nt, Human
gcccccacuggu

SEQ ID NO: 3837937 - RNA, 16 nt, Human
gcccccagagcccagg

SEQ ID NO: 3837938 - RNA, 13 nt, Human
gcccccagccugu

SEQ ID NO: 3837939 - RNA, 22 nt, Human
gcccccagccugucagauccag

SEQ ID NO: 3837940 - RNA, 22 nt, Human
gcccccagcuaagaaccuggaa

SEQ ID NO: 3837941 - RNA, 12 nt, Human
gccguggcuucc

SEQ ID NO: 3837942 - RNA, 15 nt, Human
gccguggcuucccgc

SEQ ID NO: 3837943 - RNA, 22 nt, Human
gccguggcuucccgcucagccc

SEQ ID NO: 3837944 - RNA, 18 nt, Human
gccguggggguugaggca

SEQ ID NO: 3837945 - RNA, 23 nt, Human
gccguggugauuuagcaggaagc

SEQ ID NO: 3837946 - RNA, 14 nt, Human
gccgugugagugug

SEQ ID NO: 3837947 - RNA, 18 nt, Human
gccgugugagugugacag

SEQ ID NO: 3837948 - RNA, 19 nt, Human
gccgugugagugugacagg

SEQ ID NO: 3837949 - RNA, 15 nt, Human
gccccugcccggcug

SEQ ID NO: 3837950 - RNA, 18 nt, Human
gccccugccucucugcag

SEQ ID NO: 3837951 - RNA, 15 nt, Human
gccccugccugccau

SEQ ID NO: 3837952 - RNA, 21 nt, Human
gccccugccugccauguaccu

SEQ ID NO: 3837953 - RNA, 14 nt, Human
gccccugcuacugc

SEQ ID NO: 3837954 - RNA, 17 nt, Human
gccccugcuacugccaa

SEQ ID NO: 3837955 - RNA, 13 nt, Human
gccccugcugccu

SEQ ID NO: 3837956 - RNA, 15 nt, Human
gccccugcugccucc

SEQ ID NO: 3837957 - RNA, 19 nt, Human
gccccugcugccuccccaa

SEQ ID NO: 3837958 - RNA, 22 nt, Human
gccccugcugcugucaccucuc

SEQ ID NO: 3837959 - RNA, 21 nt, Human
gccccugcugguucaggguug

SEQ ID NO: 3837960 - RNA, 14 nt, Human
gccccugcuucucc

SEQ ID NO: 3837961 - RNA, 15 nt, Human
gccccugcuucucca

SEQ ID NO: 3837962 - RNA, 16 nt, Human
gccccugcuucuccag

SEQ ID NO: 3837963 - RNA, 13 nt, Human
gccccuggagcca

SEQ ID NO: 3837964 - RNA, 14 nt, Human
gccccuggagccag

SEQ ID NO: 3837965 - RNA, 22 nt, Human
gccccuggaggcugccucccaa

SEQ ID NO: 3837966 - RNA, 22 nt, Human
gccccuggaugcagccucacag

SEQ ID NO: 3837967 - RNA, 23 nt, Human
gccccuggcagagaugccucccu

SEQ ID NO: 3837968 - RNA, 15 nt, Human
gccccuggcagcccc

SEQ ID NO: 3837969 - RNA, 16 nt, Human
gccccuggcagccccu

SEQ ID NO: 3837970 - RNA, 20 nt, Human
gccccuggccgcgcuccggg

SEQ ID NO: 3837971 - RNA, 12 nt, Human
gccccuggcugg

SEQ ID NO: 3837972 - RNA, 12 nt, Human
gccccugggcuu

SEQ ID NO: 3837973 - RNA, 20 nt, Human
gccccugggcuuggccugcu

SEQ ID NO: 3837974 - RNA, 21 nt, Human
gccccugggcuuggccugcug

SEQ ID NO: 3837975 - RNA, 15 nt, Human
gccccugucccaccc

SEQ ID NO: 3837976 - RNA, 18 nt, Human
gccccugucuagagaggg

SEQ ID NO: 3837977 - RNA, 19 nt, Human
gccccugucuagagaggga

SEQ ID NO: 3837978 - RNA, 13 nt, Human
gccccuguucucu

SEQ ID NO: 3837979 - RNA, 22 nt, Human
gccccuuagcccccacccacuu

SEQ ID NO: 3837980 - RNA, 20 nt, Human
gccccuucacuucugaccac

SEQ ID NO: 3837981 - RNA, 21 nt, Human
gccccuucacuucugaccaca

SEQ ID NO: 3837982 - RNA, 15 nt, Human
gccccuuccgccacu

SEQ ID NO: 3837983 - RNA, 18 nt, Human
gccccuucuacacucucc

SEQ ID NO: 3837984 - RNA, 22 nt, Human
gccccuucuacacucuccuggg

SEQ ID NO: 3837985 - RNA, 23 nt, Human
gccccuucuacacucuccugggc

SEQ ID NO: 3837986 - RNA, 19 nt, Human
gccccuucucucccugcca

SEQ ID NO: 3837987 - RNA, 23 nt, Human
gccccuucucucccugccagagg

SEQ ID NO: 3837988 - RNA, 14 nt, Human
gccccuucugcuca

SEQ ID NO: 3837989 - RNA, 17 nt, Human
gccccuucugcucagcu

SEQ ID NO: 3837990 - RNA, 20 nt, Human
gccccuugcucuccccugcc

SEQ ID NO: 3837991 - RNA, 12 nt, Human
gccccuuuauaa

SEQ ID NO: 3837992 - RNA, 13 nt, Human
gccccuuuauaaa

SEQ ID NO: 3837993 - RNA, 18 nt, Human
gccccuuugcugacccuc

SEQ ID NO: 3837994 - RNA, 16 nt, Human
gccccuuuuuacuccc

SEQ ID NO: 3837995 - RNA, 18 nt, Human
gccccuuuuuacuccccu

SEQ ID NO: 3837996 - RNA, 20 nt, Human
gccccuuuuuacuccccuug

SEQ ID NO: 3837997 - RNA, 13 nt, Human
gcccgaauacaaa

SEQ ID NO: 3837998 - RNA, 14 nt, Human
gcccgacagccugg

SEQ ID NO: 3837999 - RNA, 19 nt, Human
gcccgacagccuggcacag

SEQ ID NO: 3838000 - RNA, 23 nt, Human
gcccgacuugcuguuuuguucug

SEQ ID NO: 3838001 - RNA, 18 nt, Human
gcccgagcagcugagcag

SEQ ID NO: 3838002 - RNA, 20 nt, Human
gcccgaggaggugucucagg

SEQ ID NO: 3838003 - RNA, 23 nt, Human
gcccgagggaggggaagcuucug

SEQ ID NO: 3838004 - RNA, 13 nt, Human
gcccgcacacccu

SEQ ID NO: 3838005 - RNA, 14 nt, Human
gcccgcacacccuc

SEQ ID NO: 3838006 - RNA, 21 nt, Human
gcccgcacccccacccuuugg

SEQ ID NO: 3838007 - RNA, 16 nt, Human
gcccgcagaccucugg

SEQ ID NO: 3838008 - RNA, 18 nt, Human
gcccgcagaccucuggau

SEQ ID NO: 3838009 - RNA, 22 nt, Human
gcccgcagagcgcgccccuagc

SEQ ID NO: 3838010 - RNA, 15 nt, Human
gcccgcaucagcugc

SEQ ID NO: 3838011 - RNA, 17 nt, Human
gcccgcaugcggcccag

SEQ ID NO: 3838012 - RNA, 18 nt, Human
gcccgcccacuguccugg

SEQ ID NO: 3838013 - RNA, 21 nt, Human
gcccgcgauguggaacugcug

SEQ ID NO: 3838014 - RNA, 15 nt, Human
gcccgcgccacagga

SEQ ID NO: 3838015 - RNA, 23 nt, Human
gcccgcgccacaggacccucgcc

SEQ ID NO: 3838016 - RNA, 13 nt, Human
gcccgcgcccgcg

SEQ ID NO: 3838017 - RNA, 18 nt, Human
gcccgcggggacauuggg

SEQ ID NO: 3838018 - RNA, 12 nt, Human
gcccgcucccag

SEQ ID NO: 3838019 - RNA, 15 nt, Human
gcccgcucugcagac

SEQ ID NO: 3838020 - RNA, 13 nt, Human
gcccgcugggcug

SEQ ID NO: 3838021 - RNA, 14 nt, Human
gcccgcugggcuga

SEQ ID NO: 3838022 - RNA, 15 nt, Human
gcccgcugggcugag

SEQ ID NO: 3838023 - RNA, 16 nt, Human
gcccgcugggcugagc

SEQ ID NO: 3838024 - RNA, 22 nt, Human
gcccgcuugccucggcuccugc

SEQ ID NO: 3838025 - RNA, 23 nt, Human
gcccgcuugccucggcuccugcu

SEQ ID NO: 3838026 - RNA, 14 nt, Human
gcccggaccuuggc

SEQ ID NO: 3838027 - RNA, 21 nt, Human
gcccggacgcccaggacccca

SEQ ID NO: 3838028 - RNA, 19 nt, Human
gcccggagauuggacggcc

SEQ ID NO: 3838029 - RNA, 19 nt, Human
gcccggagcugccccucuc

SEQ ID NO: 3838030 - RNA, 15 nt, Human
gcccggaugcugcuu

SEQ ID NO: 3838031 - RNA, 14 nt, Human
gcccggaugcuucu

SEQ ID NO: 3838032 - RNA, 16 nt, Human
gcccggauucugggag

SEQ ID NO: 3838033 - RNA, 12 nt, Human
gcccggccagcc

SEQ ID NO: 3838034 - RNA, 17 nt, Human
gcccggcgccccugcca

SEQ ID NO: 3838035 - RNA, 17 nt, Human
gcccggcgcccucuguc

SEQ ID NO: 3838036 - RNA, 18 nt, Human
gcccggcgcccucugucc

SEQ ID NO: 3838037 - RNA, 21 nt, Human
gcccggcgcgguggcucacgc

SEQ ID NO: 3838038 - RNA, 12 nt, Human
gcccggcuccag

SEQ ID NO: 3838039 - RNA, 13 nt, Human
gcccggcuccagg

SEQ ID NO: 3838040 - RNA, 15 nt, Human
gcccggcuccaggcu

SEQ ID NO: 3838041 - RNA, 13 nt, Human
gcccggcuccugg

SEQ ID NO: 3838042 - RNA, 15 nt, Human
gcccggcuccugguc

SEQ ID NO: 3838043 - RNA, 15 nt, Human
gcccgggagccuagg

SEQ ID NO: 3838044 - RNA, 20 nt, Human
gcccgggagccuaggaccac

SEQ ID NO: 3838045 - RNA, 15 nt, Human
gcccgggagcucagg

SEQ ID NO: 3838046 - RNA, 15 nt, Human
gcccgggcccagagg

SEQ ID NO: 3838047 - RNA, 19 nt, Human
gcccgggcgcggccagccc

SEQ ID NO: 3838048 - RNA, 13 nt, Human
gcccgggcucugc

SEQ ID NO: 3838049 - RNA, 15 nt, Human
gcccgggcucugccu

SEQ ID NO: 3838050 - RNA, 21 nt, Human
gcccgggcucugccucccauc

SEQ ID NO: 3838051 - RNA, 23 nt, Human
gcccgggcucugccucccaucac

SEQ ID NO: 3838052 - RNA, 12 nt, Human
gcccgggcugcc

SEQ ID NO: 3838053 - RNA, 15 nt, Human
gcccgggcugccugg

SEQ ID NO: 3838054 - RNA, 16 nt, Human
gcccgggcugccuggg

SEQ ID NO: 3838055 - RNA, 23 nt, Human
gcccgggcugccugggcuguugg

SEQ ID NO: 3838056 - RNA, 20 nt, Human
gcccggggcagcagcagccc

SEQ ID NO: 3838057 - RNA, 14 nt, Human
gcccggggcagcug

SEQ ID NO: 3838058 - RNA, 22 nt, Human
gcccggggcagcugccagagaa

SEQ ID NO: 3838059 - RNA, 13 nt, Human
gcccguccugccu

SEQ ID NO: 3838060 - RNA, 17 nt, Human
gcccguccugccugugg

SEQ ID NO: 3838061 - RNA, 18 nt, Human
gcccguccugccuguggc

SEQ ID NO: 3838062 - RNA, 17 nt, Human
gcccgucucucucccau

SEQ ID NO: 3838063 - RNA, 15 nt, Human
gcccgucuucagccu

SEQ ID NO: 3838064 - RNA, 13 nt, Human
gcccgugacagac

SEQ ID NO: 3838065 - RNA, 19 nt, Human
gcccgugacagacuccuga

SEQ ID NO: 3838066 - RNA, 19 nt, Human
gcccguggggccggggcuu

SEQ ID NO: 3838067 - RNA, 17 nt, Human
gcccguguacauagugc

SEQ ID NO: 3838068 - RNA, 23 nt, Human
gcccguguaguccccaaccgugu

SEQ ID NO: 3838069 - RNA, 13 nt, Human
gcccguguggccc

SEQ ID NO: 3838070 - RNA, 19 nt, Human
gcccguugucucccuggcc

SEQ ID NO: 3838071 - RNA, 21 nt, Human
gcccguugucucccuggcccu

SEQ ID NO: 3838072 - RNA, 23 nt, Human
gcccguugucucccuggcccuca

SEQ ID NO: 3838073 - RNA, 19 nt, Human
gcccuaaaauuccacugcg

SEQ ID NO: 3838074 - RNA, 18 nt, Human
gcccuaaccccuuccaga

SEQ ID NO: 3838075 - RNA, 15 nt, Human
gcccuaagcagaaag

SEQ ID NO: 3838076 - RNA, 21 nt, Human
gcccuaagcagaaagugccuu

SEQ ID NO: 3838077 - RNA, 16 nt, Human
gcccuaauucagccau

SEQ ID NO: 3838078 - RNA, 22 nt, Human
gcccuaauucagccauguacag

SEQ ID NO: 3838079 - RNA, 21 nt, Human
gcccuacagaggucucugccg

SEQ ID NO: 3838080 - RNA, 13 nt, Human
gcccuaccagcgc

SEQ ID NO: 3838081 - RNA, 21 nt, Human
gcccuaccagcgcccgcuggg

SEQ ID NO: 3838082 - RNA, 23 nt, Human
gcccuaccagcgcccgcugggcu

SEQ ID NO: 3838083 - RNA, 16 nt, Human
gcccuaccugccccac

SEQ ID NO: 3838084 - RNA, 15 nt, Human
gcccuacucauuggg

SEQ ID NO: 3838085 - RNA, 16 nt, Human
gcccuacucccugcag

SEQ ID NO: 3838086 - RNA, 16 nt, Human
cugugacccccagcuc

SEQ ID NO: 3838087 - RNA, 18 nt, Human
cugugacccccagcuccg

SEQ ID NO: 3838088 - RNA, 17 nt, Human
cugugaccucaggcacu

SEQ ID NO: 3838089 - RNA, 16 nt, Human
cugugaccugccccgc

SEQ ID NO: 3838090 - RNA, 17 nt, Human
cugugaccugcugagcu

SEQ ID NO: 3838091 - RNA, 20 nt, Human
cugugaccugcugagcucug

SEQ ID NO: 3838092 - RNA, 23 nt, Human
cugugaccugcugagcucugaga

SEQ ID NO: 3838093 - RNA, 18 nt, Human
cugugaccuugagaagau

SEQ ID NO: 3838094 - RNA, 14 nt, Human
cugugacugauguu

SEQ ID NO: 3838095 - RNA, 19 nt, Human
cugugagaagguuuauugu

SEQ ID NO: 3838096 - RNA, 22 nt, Human
cugugagaagguuuauuguuaa

SEQ ID NO: 3838097 - RNA, 15 nt, Human
cugugagacaguggg

SEQ ID NO: 3838098 - RNA, 13 nt, Human
cugugagauuuug

SEQ ID NO: 3838099 - RNA, 13 nt, Human
cugugagccaguc

SEQ ID NO: 3838100 - RNA, 15 nt, Human
cugugagcccagcug

SEQ ID NO: 3838101 - RNA, 16 nt, Human
cugugaggagccccau

SEQ ID NO: 3838102 - RNA, 17 nt, Human
cugugaggagccccauc

SEQ ID NO: 3838103 - RNA, 18 nt, Human
cugugaggcaggggcgga

SEQ ID NO: 3838104 - RNA, 18 nt, Human
cugugaggccccuggaca

SEQ ID NO: 3838105 - RNA, 12 nt, Human
cugugaggcugu

SEQ ID NO: 3838106 - RNA, 17 nt, Human
cugugaggcuguccugu

SEQ ID NO: 3838107 - RNA, 14 nt, Human
cugugagggagggg

SEQ ID NO: 3838108 - RNA, 17 nt, Human
cugugagguuucccaau

SEQ ID NO: 3838109 - RNA, 17 nt, Human
cugugaguaaauauuga

SEQ ID NO: 3838110 - RNA, 21 nt, Human
cugugagucuuugguucuaag

SEQ ID NO: 3838111 - RNA, 19 nt, Human
cugugaguguaagugugag

SEQ ID NO: 3838112 - RNA, 21 nt, Human
cugugauacagaacucuuaaa

SEQ ID NO: 3838113 - RNA, 20 nt, Human
cugugaucaauauuuuuaua

SEQ ID NO: 3838114 - RNA, 13 nt, Human
cugugaucuuauu

SEQ ID NO: 3838115 - RNA, 15 nt, Human
cugugaucuuauuuu

SEQ ID NO: 3838116 - RNA, 18 nt, Human
cugugaucuuuuaaagug

SEQ ID NO: 3838117 - RNA, 14 nt, Human
cugugaugagcuga

SEQ ID NO: 3838118 - RNA, 18 nt, Human
cugugaugagcugaucug

SEQ ID NO: 3838119 - RNA, 14 nt, Human
cugugaugccacac

SEQ ID NO: 3838120 - RNA, 16 nt, Human
cugugaugccacacag

SEQ ID NO: 3838121 - RNA, 17 nt, Human
cugugaugccacacaga

SEQ ID NO: 3838122 - RNA, 14 nt, Human
cugugaugcccugc

SEQ ID NO: 3838123 - RNA, 18 nt, Human
cugugaugcuuugaagua

SEQ ID NO: 3838124 - RNA, 21 nt, Human
cugugauggggcccugccucc

SEQ ID NO: 3838125 - RNA, 16 nt, Human
cugugcaaauccuuga

SEQ ID NO: 3838126 - RNA, 18 nt, Human
cugugcaacgccgugggc

SEQ ID NO: 3838127 - RNA, 22 nt, Human
cugugcaacggucuccugacug

SEQ ID NO: 3838128 - RNA, 22 nt, Human
cugugcacaaaacccagaccug

SEQ ID NO: 3838129 - RNA, 19 nt, Human
cugugcacaaaguggcaua

SEQ ID NO: 3838130 - RNA, 12 nt, Human
cugugcacacac

SEQ ID NO: 3838131 - RNA, 15 nt, Human
cugugcacacccacc

SEQ ID NO: 3838132 - RNA, 17 nt, Human
cugugcacaccccacuc

SEQ ID NO: 3838133 - RNA, 19 nt, Human
cugugcacaucugugucuu

SEQ ID NO: 3838134 - RNA, 23 nt, Human
cugugcagaagggagcuggcucc

SEQ ID NO: 3838135 - RNA, 17 nt, Human
cugugcagccgcugagc

SEQ ID NO: 3838136 - RNA, 21 nt, Human
cugugcagccgcugagcgagg

SEQ ID NO: 3838137 - RNA, 15 nt, Human
cugugcagcgcagcu

SEQ ID NO: 3838138 - RNA, 21 nt, Human
cugugcagcgcagcuggacuc

SEQ ID NO: 3838139 - RNA, 15 nt, Human
cugugcagggaggag

SEQ ID NO: 3838140 - RNA, 18 nt, Human
cugugcauagugcuggga

SEQ ID NO: 3838141 - RNA, 15 nt, Human
cugugcauguauguc

SEQ ID NO: 3838142 - RNA, 15 nt, Human
cugugcauugggauu

SEQ ID NO: 3838143 - RNA, 17 nt, Human
cugugcauuucugguug

SEQ ID NO: 3838144 - RNA, 11 nt, Human
cugugccaccc

SEQ ID NO: 3838145 - RNA, 13 nt, Human
cugugccacccug

SEQ ID NO: 3838146 - RNA, 17 nt, Human
cugugccacccugggcu

SEQ ID NO: 3838147 - RNA, 18 nt, Human
cugugccacccugggcuc

SEQ ID NO: 3838148 - RNA, 13 nt, Human
cugugccagagcc

SEQ ID NO: 3838149 - RNA, 14 nt, Human
cugugccaggugag

SEQ ID NO: 3838150 - RNA, 13 nt, Human
cugugccaugugc

SEQ ID NO: 3838151 - RNA, 18 nt, Human
cugugccaugugccaggu

SEQ ID NO: 3838152 - RNA, 15 nt, Human
cugugccauguguuu

SEQ ID NO: 3838153 - RNA, 14 nt, Human
cugugccauuuugu

SEQ ID NO: 3838154 - RNA, 13 nt, Human
cugugcccagcuc

SEQ ID NO: 3838155 - RNA, 15 nt, Human
cugugcccagcucag

SEQ ID NO: 3838156 - RNA, 21 nt, Human
gccuggcgaaaccccaucucu

SEQ ID NO: 3838157 - RNA, 19 nt, Human
gccuggcgacagagcgaga

SEQ ID NO: 3838158 - RNA, 20 nt, Human
gccuggcgggaugggccacc

SEQ ID NO: 3838159 - RNA, 23 nt, Human
gccuggcgggaugggccaccgcc

SEQ ID NO: 3838160 - RNA, 16 nt, Human
gccuggcucagagcca

SEQ ID NO: 3838161 - RNA, 13 nt, Human
gccuggcucaggu

SEQ ID NO: 3838162 - RNA, 20 nt, Human
gccuggcucccacaggcagc

SEQ ID NO: 3838163 - RNA, 22 nt, Human
gccuggcucccacaggcagcuu

SEQ ID NO: 3838164 - RNA, 23 nt, Human
gccuggcucccacaggcagcuuu

SEQ ID NO: 3838165 - RNA, 19 nt, Human
gccuggcucccucacucuc

SEQ ID NO: 3838166 - RNA, 23 nt, Human
gccuggcucccucacucucagga

SEQ ID NO: 3838167 - RNA, 23 nt, Human
gccuggcucuuucgucacccuug

SEQ ID NO: 3838168 - RNA, 21 nt, Human
gccuggcugcugaucgccuuc

SEQ ID NO: 3838169 - RNA, 14 nt, Human
gccuggcuucugga

SEQ ID NO: 3838170 - RNA, 17 nt, Human
gccuggcuucuggagcc

SEQ ID NO: 3838171 - RNA, 18 nt, Human
gccuggcuucuggagccc

SEQ ID NO: 3838172 - RNA, 22 nt, Human
gccuggcuucuggagcccuugg

SEQ ID NO: 3838173 - RNA, 23 nt, Human
gccuggcuucuggagcccuuggg

SEQ ID NO: 3838174 - RNA, 16 nt, Human
gccugggacaacugcu

SEQ ID NO: 3838175 - RNA, 10 nt, Human
gccugggagg

SEQ ID NO: 3838176 - RNA, 17 nt, Human
gccugggauaggggcag

SEQ ID NO: 3838177 - RNA, 23 nt, Human
gccugggcaacaaagugagacuc

SEQ ID NO: 3838178 - RNA, 19 nt, Human
gccugggcaacagagcaag

SEQ ID NO: 3838179 - RNA, 15 nt, Human
gccugggcaauaaag

SEQ ID NO: 3838180 - RNA, 22 nt, Human
gccugggcaauaaagugagacc

SEQ ID NO: 3838181 - RNA, 13 nt, Human
gccugggcagcau

SEQ ID NO: 3838182 - RNA, 16 nt, Human
gccugggccgcugcca

SEQ ID NO: 3838183 - RNA, 17 nt, Human
gccugggccgcugccac

SEQ ID NO: 3838184 - RNA, 18 nt, Human
gccugggccgcugccacg

SEQ ID NO: 3838185 - RNA, 22 nt, Human
gccugggccguaucuccggcuc

SEQ ID NO: 3838186 - RNA, 14 nt, Human
gccugggccuaugg

SEQ ID NO: 3838187 - RNA, 23 nt, Human
gccugggccuauggagagcccug

SEQ ID NO: 3838188 - RNA, 16 nt, Human
gccugggccuggcucc

SEQ ID NO: 3838189 - RNA, 20 nt, Human
gccugggcgcugguccuuuc

SEQ ID NO: 3838190 - RNA, 14 nt, Human
gccugggcuccugg

SEQ ID NO: 3838191 - RNA, 21 nt, Human
gccugggcugaccccgguggc

SEQ ID NO: 3838192 - RNA, 17 nt, Human
gccuggggccugagaga

SEQ ID NO: 3838193 - RNA, 18 nt, Human
gccuggggccugagagaa

SEQ ID NO: 3838194 - RNA, 13 nt, Human
gccuggggccugg

SEQ ID NO: 3838195 - RNA, 14 nt, Human
gccuggggccuggc

SEQ ID NO: 3838196 - RNA, 15 nt, Human
gccuggggccuggca

SEQ ID NO: 3838197 - RNA, 21 nt, Human
gccuggggcucuaacgccuga

SEQ ID NO: 3838198 - RNA, 22 nt, Human
gccuggggcugaggcugaggca

SEQ ID NO: 3838199 - RNA, 20 nt, Human
gccugggggacagaaagaga

SEQ ID NO: 3838200 - RNA, 22 nt, Human
gccugggggcagggagaggagu

SEQ ID NO: 3838201 - RNA, 14 nt, Human
gccugggggccugg

SEQ ID NO: 3838202 - RNA, 20 nt, Human
gccugggggcugggcagagg

SEQ ID NO: 3838203 - RNA, 14 nt, Human
gccuggggucugga

SEQ ID NO: 3838204 - RNA, 22 nt, Human
gccuggggugacccggcacccc

SEQ ID NO: 3838205 - RNA, 21 nt, Human
gccugggucacacacggaggc

SEQ ID NO: 3838206 - RNA, 19 nt, Human
gccugggucugugucucuu

SEQ ID NO: 3838207 - RNA, 21 nt, Human
gccugggugcuggcugcccag

SEQ ID NO: 3838208 - RNA, 15 nt, Human
gccuggguggacaug

SEQ ID NO: 3838209 - RNA, 23 nt, Human
gccuggguggaucggccuccucu

SEQ ID NO: 3838210 - RNA, 15 nt, Human
gccuggguggggcug

SEQ ID NO: 3838211 - RNA, 18 nt, Human
gccuggguggggcugcuc

SEQ ID NO: 3838212 - RNA, 20 nt, Human
gccuggguggggcugcuccu

SEQ ID NO: 3838213 - RNA, 19 nt, Human
gccuggguguaaaaccugg

SEQ ID NO: 3838214 - RNA, 14 nt, Human
gccuggucagccca

SEQ ID NO: 3838215 - RNA, 15 nt, Human
gccuggucagcccaa

SEQ ID NO: 3838216 - RNA, 18 nt, Human
gccuggucaggcccuggu

SEQ ID NO: 3838217 - RNA, 14 nt, Human
gccuggucccuggg

SEQ ID NO: 3838218 - RNA, 17 nt, Human
gccuggucgccuuccac

SEQ ID NO: 3838219 - RNA, 18 nt, Human
gccuggucucacccugga

SEQ ID NO: 3838220 - RNA, 20 nt, Human
gccuggucucacccuggagg

SEQ ID NO: 3838221 - RNA, 22 nt, Human
gccuggucucacccuggaggca

SEQ ID NO: 3838222 - RNA, 19 nt, Human
gccuggucuccugccccca

SEQ ID NO: 3838223 - RNA, 13 nt, Human
gccugguggcagc

SEQ ID NO: 3838224 - RNA, 14 nt, Human
gccugguggcagcu

SEQ ID NO: 3838225 - RNA, 19 nt, Human
gccuguaacaagccagauu

SEQ ID NO: 3838226 - RNA, 17 nt, Human
gccuguaaucccagcua

SEQ ID NO: 3838227 - RNA, 18 nt, Human
gccuguaaucccagcuac

SEQ ID NO: 3838228 - RNA, 20 nt, Human
gccuguaauccuagcacuuu

SEQ ID NO: 3838229 - RNA, 20 nt, Human
gccuguaauucaguguauuu

SEQ ID NO: 3838230 - RNA, 22 nt, Human
gccuuccuaagccuguggcugu

SEQ ID NO: 3838231 - RNA, 13 nt, Human
gccuuccuccugg

SEQ ID NO: 3838232 - RNA, 14 nt, Human
gccuuccuccuggg

SEQ ID NO: 3838233 - RNA, 16 nt, Human
gccuuccucucuccag

SEQ ID NO: 3838234 - RNA, 17 nt, Human
gccuuccucugcagcug

SEQ ID NO: 3838235 - RNA, 19 nt, Human
gccuuccucugcagcugac

SEQ ID NO: 3838236 - RNA, 20 nt, Human
gccuuccucugcagcugacc

SEQ ID NO: 3838237 - RNA, 19 nt, Human
gccuuccuguuuuucacau

SEQ ID NO: 3838238 - RNA, 13 nt, Human
gccuuccuugacc

SEQ ID NO: 3838239 - RNA, 18 nt, Human
gccuuccuugaccuuccu

SEQ ID NO: 3838240 - RNA, 13 nt, Human
gccuuccuuucuc

SEQ ID NO: 3838241 - RNA, 17 nt, Human
gccuucgcuucuugccu

SEQ ID NO: 3838242 - RNA, 21 nt, Human
gccuucgcuucuugccucugu

SEQ ID NO: 3838243 - RNA, 22 nt, Human
gccuucgcuucuugccucugug

SEQ ID NO: 3838244 - RNA, 19 nt, Human
gccuucggacaacucaguc

SEQ ID NO: 3838245 - RNA, 19 nt, Human
gccuucggccuccauccug

SEQ ID NO: 3838246 - RNA, 20 nt, Human
gccuucggccuccauccuga

SEQ ID NO: 3838247 - RNA, 14 nt, Human
gccuucgugccccc

SEQ ID NO: 3838248 - RNA, 12 nt, Human
gccuucucacca

SEQ ID NO: 3838249 - RNA, 16 nt, Human
gccuucucaccagcug

SEQ ID NO: 3838250 - RNA, 23 nt, Human
gccuucucaccagcugcaaagug

SEQ ID NO: 3838251 - RNA, 19 nt, Human
gccuucugacggcccugca

SEQ ID NO: 3838252 - RNA, 19 nt, Human
gccuucugaggacauucca

SEQ ID NO: 3838253 - RNA, 21 nt, Human
gccuucuggauucuuggcccg

SEQ ID NO: 3838254 - RNA, 16 nt, Human
gccuucuguccuggug

SEQ ID NO: 3838255 - RNA, 18 nt, Human
gccuucuguccugguguc

SEQ ID NO: 3838256 - RNA, 14 nt, Human
gccuucugugggga

SEQ ID NO: 3838257 - RNA, 18 nt, Human
gccuucuuauucucacuc

SEQ ID NO: 3838258 - RNA, 19 nt, Human
gccuucuuauucucacucc

SEQ ID NO: 3838259 - RNA, 15 nt, Human
gccuucuucacccag

SEQ ID NO: 3838260 - RNA, 17 nt, Human
gccuucuucacccagcu

SEQ ID NO: 3838261 - RNA, 18 nt, Human
gccuucuucuuuuugcug

SEQ ID NO: 3838262 - RNA, 19 nt, Human
gccuucuuugcuugccucu

SEQ ID NO: 3838263 - RNA, 21 nt, Human
gccuucuuuucucccuuuuaa

SEQ ID NO: 3838264 - RNA, 23 nt, Human
gccuucuuuugggggucaacagu

SEQ ID NO: 3838265 - RNA, 18 nt, Human
gccuugaaccacuucccu

SEQ ID NO: 3838266 - RNA, 19 nt, Human
gccuugaaccacuucccuc

SEQ ID NO: 3838267 - RNA, 16 nt, Human
gccuugaacucugggc

SEQ ID NO: 3838268 - RNA, 14 nt, Human
gccuugaacuuuga

SEQ ID NO: 3838269 - RNA, 22 nt, Human
gccuugaauauccccucccagu

SEQ ID NO: 3838270 - RNA, 16 nt, Human
gccuugacaucaguuc

SEQ ID NO: 3838271 - RNA, 16 nt, Human
gccuugaccauucucc

SEQ ID NO: 3838272 - RNA, 15 nt, Human
gccuugaguuccagu

SEQ ID NO: 3838273 - RNA, 13 nt, Human
gccuugcagaacu

SEQ ID NO: 3838274 - RNA, 22 nt, Human
gccuugcccacuccugcucugc

SEQ ID NO: 3838275 - RNA, 23 nt, Human
gccuugcccacuccugcucugcu

SEQ ID NO: 3838276 - RNA, 14 nt, Human
gccuugcccagaga

SEQ ID NO: 3838277 - RNA, 14 nt, Human
gccuugcccagccu

SEQ ID NO: 3838278 - RNA, 19 nt, Human
gccuugcccagccuggaug

SEQ ID NO: 3838279 - RNA, 23 nt, Human
gccuugccuaaauuuaaugcugc

SEQ ID NO: 3838280 - RNA, 18 nt, Human
gccuugcggcuccucagg

SEQ ID NO: 3838281 - RNA, 18 nt, Human
gccuugcgguauccgccc

SEQ ID NO: 3838282 - RNA, 19 nt, Human
gccuugcgguauccgcccc

SEQ ID NO: 3838283 - RNA, 19 nt, Human
gccuugcuguuuguccuga

SEQ ID NO: 3838284 - RNA, 15 nt, Human
gccuuggccucccaa

SEQ ID NO: 3838285 - RNA, 14 nt, Human
gccuuggccuggag

SEQ ID NO: 3838286 - RNA, 20 nt, Human
gccuuggcugacaugaagcu

SEQ ID NO: 3838287 - RNA, 19 nt, Human
gccuugggauccaggcccc

SEQ ID NO: 3838288 - RNA, 21 nt, Human
gccuugggcuccgugugggag

SEQ ID NO: 3838289 - RNA, 15 nt, Human
gccuugggcucugcu

SEQ ID NO: 3838290 - RNA, 15 nt, Human
gccuugggcugcucc

SEQ ID NO: 3838291 - RNA, 22 nt, Human
gccuugggcugcuccucauggu

SEQ ID NO: 3838292 - RNA, 18 nt, Human
gccuuggggaauuuccuc

SEQ ID NO: 3838293 - RNA, 20 nt, Human
gccuuggggaggacaaaacu

SEQ ID NO: 3838294 - RNA, 21 nt, Human
gccuuggggaggacaaaacuu

SEQ ID NO: 3838295 - RNA, 17 nt, Human
gccuuggggucagguug

SEQ ID NO: 3838296 - RNA, 18 nt, Human
gccuuggucuaacuuuug

SEQ ID NO: 3838297 - RNA, 16 nt, Human
gccuugguguccaccu

SEQ ID NO: 3838298 - RNA, 22 nt, Human
gccuugguguccaccuggcccc

SEQ ID NO: 3838299 - RNA, 19 nt, Human
gccuugguucaucaguguu

SEQ ID NO: 3838300 - RNA, 21 nt, Human
gccuuguauaauauugaaaau

SEQ ID NO: 3838301 - RNA, 17 nt, Human
gccuugucacgccagac

SEQ ID NO: 3838302 - RNA, 18 nt, Human
gccuuguccucagccagu

SEQ ID NO: 3838303 - RNA, 14 nt, Human
gccuugucuccuac

SEQ ID NO: 3838304 - RNA, 22 nt, Human
gccuugugaugucauacagaga

SEQ ID NO: 3838305 - RNA, 17 nt, Human
gccuugugcuguuaaua

SEQ ID NO: 3838306 - RNA, 14 nt, Human
gccuugugguccaa

SEQ ID NO: 3838307 - RNA, 17 nt, Human
gccuugugguccaaaua

SEQ ID NO: 3838308 - RNA, 17 nt, Human
gccuugugucuacagag

SEQ ID NO: 3838309 - RNA, 16 nt, Human
gccuuguucugucacc

SEQ ID NO: 3838310 - RNA, 15 nt, Human
gccuuguuuaauggu

SEQ ID NO: 3838311 - RNA, 13 nt, Human
gccuuuaaaauuu

SEQ ID NO: 3838312 - RNA, 19 nt, Human
gccuuuagugaucacagca

SEQ ID NO: 3838313 - RNA, 22 nt, Human
gccuuuaucuaccaacuuucaa

SEQ ID NO: 3838314 - RNA, 19 nt, Human
gccuuuauuuccacugugc

SEQ ID NO: 3838315 - RNA, 20 nt, Human
gccuuuauuuccacugugca

SEQ ID NO: 3838316 - RNA, 15 nt, Human
gccuuuccauccaug

SEQ ID NO: 3838317 - RNA, 20 nt, Human
gccuuuccauccauggccag

SEQ ID NO: 3838318 - RNA, 18 nt, Human
gccuuucccaacucuagc

SEQ ID NO: 3838319 - RNA, 19 nt, Human
gccuuucccaacucuagcu

SEQ ID NO: 3838320 - RNA, 14 nt, Human
gccuuuccucucua

SEQ ID NO: 3838321 - RNA, 13 nt, Human
gccuuuccuguuc

SEQ ID NO: 3838322 - RNA, 16 nt, Human
gccuuuccuguucagc

SEQ ID NO: 3838323 - RNA, 19 nt, Human
gccuuuccuguucagcauu

SEQ ID NO: 3838324 - RNA, 12 nt, Human
gccuuucugugu

SEQ ID NO: 3838325 - RNA, 17 nt, Human
gccuuucuucucuccag

SEQ ID NO: 3838326 - RNA, 15 nt, Human
gccuuugacauuuaa

SEQ ID NO: 3838327 - RNA, 20 nt, Human
gccuuugagacaguuucuua

SEQ ID NO: 3838328 - RNA, 23 nt, Human
gccuuugagacaguuucuuagcu

SEQ ID NO: 3838329 - RNA, 14 nt, Human
gccuuugagcucag

SEQ ID NO: 3838330 - RNA, 17 nt, Human
gccuuugauguuacaga

SEQ ID NO: 3838331 - RNA, 15 nt, Human
gccuuugcaaaucag

SEQ ID NO: 3838332 - RNA, 21 nt, Human
gccuuugcagcucagaaccac

SEQ ID NO: 3838333 - RNA, 16 nt, Human
gccuuugccaggugac

SEQ ID NO: 3838334 - RNA, 16 nt, Human
gccuuugcgcuccugg

SEQ ID NO: 3838335 - RNA, 18 nt, Human
gccuuugcucuggucuau

SEQ ID NO: 3838336 - RNA, 16 nt, Human
gccuuuggccuuggcu

SEQ ID NO: 3838337 - RNA, 22 nt, Human
gccuuugggugcuguuuugcca

SEQ ID NO: 3838338 - RNA, 15 nt, Human
gccuuuguaaguuau

SEQ ID NO: 3838339 - RNA, 18 nt, Human
gccuuuguuccccacugg

SEQ ID NO: 3838340 - RNA, 23 nt, Human
gccuuuguuccccacuggagcag

SEQ ID NO: 3838341 - RNA, 14 nt, Human
gccuuuguucuggg

SEQ ID NO: 3838342 - RNA, 13 nt, Human
gccuuuuaacauu

SEQ ID NO: 3838343 - RNA, 17 nt, Human
gccuuuuaguuccugug

SEQ ID NO: 3838344 - RNA, 20 nt, Human
gccuuuuaguuccugugcac

SEQ ID NO: 3838345 - RNA, 12 nt, Human
gccuuuucuauu

SEQ ID NO: 3838346 - RNA, 22 nt, Human
gccuuuucuggcaccgcaguuu

SEQ ID NO: 3838347 - RNA, 14 nt, Human
gccuuuugcacccc

SEQ ID NO: 3838348 - RNA, 16 nt, Human
gccuuuugcagaagag

SEQ ID NO: 3838349 - RNA, 21 nt, Human
gccuuuugggggugggucugg

SEQ ID NO: 3838350 - RNA, 12 nt, Human
gccuuuuguaua

SEQ ID NO: 3838351 - RNA, 18 nt, Human
gccuuuuuaaaacacaug

SEQ ID NO: 3838352 - RNA, 12 nt, Human
gccuuuuucauu

SEQ ID NO: 3838353 - RNA, 20 nt, Human
gccuuuuucauuauuuuauu

SEQ ID NO: 3838354 - RNA, 22 nt, Human
gccuuuuucauuauuuuauuau

SEQ ID NO: 3838355 - RNA, 23 nt, Human
gccuuuuucauuauuuuauuaug

SEQ ID NO: 3838356 - RNA, 19 nt, Human
gccuuuuucauuuaucuau

SEQ ID NO: 3838357 - RNA, 14 nt, Human
gccuuuuuucccca

SEQ ID NO: 3838358 - RNA, 17 nt, Human
gccuuuuuuccccagac

SEQ ID NO: 3838359 - RNA, 19 nt, Human
gccuuuuuuccccagacuu

SEQ ID NO: 3838360 - RNA, 14 nt, Human
gcgaaagaaaacuc

SEQ ID NO: 3838361 - RNA, 23 nt, Human
gcgaaaggauguaaacagugccu

SEQ ID NO: 3838362 - RNA, 21 nt, Human
gcgaacggaacguuggacuuu

SEQ ID NO: 3838363 - RNA, 17 nt, Human
gcgaagcguuguccuca

SEQ ID NO: 3838364 - RNA, 14 nt, Human
gcgaaggggcccug

SEQ ID NO: 3838365 - RNA, 14 nt, Human
gcgaaguccuaugg

SEQ ID NO: 3838366 - RNA, 11 nt, Human
gcgaaugguag

SEQ ID NO: 3838367 - RNA, 14 nt, Human
gcgaauuuuaaaag

SEQ ID NO: 3838368 - RNA, 13 nt, Human
gcgacaaagauga

SEQ ID NO: 3838369 - RNA, 21 nt, Human
gcgacaaugcaaaccaucauu

SEQ ID NO: 3838370 - RNA, 13 nt, Human
gcgacagagcagu

SEQ ID NO: 3838371 - RNA, 19 nt, Human
gcgaccaccccugccucca

SEQ ID NO: 3838372 - RNA, 12 nt, Human
gcgaccaccgcc

SEQ ID NO: 3838373 - RNA, 14 nt, Human
gcgaccccaucugc

SEQ ID NO: 3838374 - RNA, 17 nt, Human
gcucagcucugggccau

SEQ ID NO: 3838375 - RNA, 12 nt, Human
gcucagcuucuc

SEQ ID NO: 3838376 - RNA, 11 nt, Human
gcucaggaaaa

SEQ ID NO: 3838377 - RNA, 19 nt, Human
gcucaggaaccgaggcagg

SEQ ID NO: 3838378 - RNA, 20 nt, Human
gcucaggaaccgaggcaggg

SEQ ID NO: 3838379 - RNA, 21 nt, Human
gcucaggaaccgaggcaggga

SEQ ID NO: 3838380 - RNA, 16 nt, Human
gcucaggaggcuugga

SEQ ID NO: 3838381 - RNA, 19 nt, Human
gcucaggcaggggccucca

SEQ ID NO: 3838382 - RNA, 20 nt, Human
gcucagggaccacagcaagg

SEQ ID NO: 3838383 - RNA, 12 nt, Human
gccuuccccuca

SEQ ID NO: 3838384 - RNA, 19 nt, Human
gccuuccccuggcacuggc

SEQ ID NO: 3838385 - RNA, 22 nt, Human
gccuuccccuuauccucccugu

SEQ ID NO: 3838386 - RNA, 21 nt, Human
gccuuccuaagccuguggcug

SEQ ID NO: 3838387 - RNA, 13 nt, Human
gccuuccucugca

SEQ ID NO: 3838388 - RNA, 21 nt, Human
gccuuccucugcagcugaccu

SEQ ID NO: 3838389 - RNA, 19 nt, Human
gccuuccugcccuacagag

SEQ ID NO: 3838390 - RNA, 17 nt, Human
gccuuccuuucuccagg

SEQ ID NO: 3838391 - RNA, 16 nt, Human
gccuucgaggucagag

SEQ ID NO: 3838392 - RNA, 18 nt, Human
gccuucgauacaccgggc

SEQ ID NO: 3838393 - RNA, 22 nt, Human
gccuucgauacaccgggccugg

SEQ ID NO: 3838394 - RNA, 18 nt, Human
gccuucggccuccauccu

SEQ ID NO: 3838395 - RNA, 21 nt, Human
gccuucggccuccauccugag

SEQ ID NO: 3838396 - RNA, 19 nt, Human
gccuucgucuuucccaugg

SEQ ID NO: 3838397 - RNA, 13 nt, Human
gccuucucaccag

SEQ ID NO: 3838398 - RNA, 17 nt, Human
gccuucucaccagcugc

SEQ ID NO: 3838399 - RNA, 17 nt, Human
gccuucucaugauccaa

SEQ ID NO: 3838400 - RNA, 14 nt, Human
gccuucuccucccc

SEQ ID NO: 3838401 - RNA, 19 nt, Human
gccuucucuaaacauuuca

SEQ ID NO: 3838402 - RNA, 15 nt, Human
gccuucucugaagga

SEQ ID NO: 3838403 - RNA, 18 nt, Human
gccuucugacggcccugc

SEQ ID NO: 3838404 - RNA, 17 nt, Human
gccuucugaugaaaugu

SEQ ID NO: 3838405 - RNA, 13 nt, Human
gccuucugugggg

SEQ ID NO: 3838406 - RNA, 19 nt, Human
gccuucuguggggacuccg

SEQ ID NO: 3838407 - RNA, 14 nt, Human
gccuucuucagggc

SEQ ID NO: 3838408 - RNA, 18 nt, Human
gccuucuucagggccugg

SEQ ID NO: 3838409 - RNA, 17 nt, Human
gccuucuuccaucccag

SEQ ID NO: 3838410 - RNA, 20 nt, Human
gccuucuuccaucccaggac

SEQ ID NO: 3838411 - RNA, 22 nt, Human
gccuucuuccaucccaggacac

SEQ ID NO: 3838412 - RNA, 22 nt, Human
gccuucuucggggaacuccugg

SEQ ID NO: 3838413 - RNA, 11 nt, Human
gccuucuucuu

SEQ ID NO: 3838414 - RNA, 13 nt, Human
gccuucuuugaag

SEQ ID NO: 3838415 - RNA, 15 nt, Human
gccuucuuugcuugc

SEQ ID NO: 3838416 - RNA, 15 nt, Human
gccuucuuuugauua

SEQ ID NO: 3838417 - RNA, 22 nt, Human
gccuucuuuugauuauguuuuu

SEQ ID NO: 3838418 - RNA, 16 nt, Human
gccuucuuuuucugga

SEQ ID NO: 3838419 - RNA, 17 nt, Human
gccuucuuuuucuggac

SEQ ID NO: 3838420 - RNA, 14 nt, Human
gccuugaaccugug

SEQ ID NO: 3838421 - RNA, 14 nt, Human
gccuugaagccacu

SEQ ID NO: 3838422 - RNA, 15 nt, Human
gccuugaagccacug

SEQ ID NO: 3838423 - RNA, 17 nt, Human
gccuugaauauccccuc

SEQ ID NO: 3838424 - RNA, 18 nt, Human
gccuugacaucaguuccu

SEQ ID NO: 3838425 - RNA, 23 nt, Human
gccuugaccauucuccaccugcc

SEQ ID NO: 3838426 - RNA, 15 nt, Human
gccuugcagaacugc

SEQ ID NO: 3838427 - RNA, 14 nt, Human
gccuugcauaccca

SEQ ID NO: 3838428 - RNA, 17 nt, Human
gccuugcccacuccugc

SEQ ID NO: 3838429 - RNA, 20 nt, Human
gccuugcccagagaugccuc

SEQ ID NO: 3838430 - RNA, 17 nt, Human
gccuugcccagccugga

SEQ ID NO: 3838431 - RNA, 18 nt, Human
gccuugcccagccuggau

SEQ ID NO: 3838432 - RNA, 16 nt, Human
gccuugcggcuccuca

SEQ ID NO: 3838433 - RNA, 17 nt, Human
gccuugcggcuccucag

SEQ ID NO: 3838434 - RNA, 17 nt, Human
gccuugcuguuuguccu

SEQ ID NO: 3838435 - RNA, 22 nt, Human
gccuugcuguuuguccugagau

SEQ ID NO: 3838436 - RNA, 13 nt, Human
gccuugcuuguua

SEQ ID NO: 3838437 - RNA, 14 nt, Human
gccuuggaaauucc

SEQ ID NO: 3838438 - RNA, 23 nt, Human
gccuuggauaaugcuguugccuc

SEQ ID NO: 3838439 - RNA, 15 nt, Human
gccuuggccucagag

SEQ ID NO: 3838440 - RNA, 20 nt, Human
gccuuggccuccccugcuga

SEQ ID NO: 3838441 - RNA, 23 nt, Human
gccuuggccuguguucuuccugg

SEQ ID NO: 3838442 - RNA, 12 nt, Human
gccuuggcucag

SEQ ID NO: 3838443 - RNA, 14 nt, Human
gccuuggcucagac

SEQ ID NO: 3838444 - RNA, 15 nt, Human
gccuuggcucagaca

SEQ ID NO: 3838445 - RNA, 16 nt, Human
gccuuggcucagacau

SEQ ID NO: 3838446 - RNA, 22 nt, Human
gccuugggcuauuuggacucag

SEQ ID NO: 3838447 - RNA, 17 nt, Human
gccuugggcuccgugug

SEQ ID NO: 3838448 - RNA, 18 nt, Human
gccuugggcuccgugugg

SEQ ID NO: 3838449 - RNA, 20 nt, Human
gccuugggcuccguguggga

SEQ ID NO: 3838450 - RNA, 14 nt, Human
gccuugggcucugc

SEQ ID NO: 3838451 - RNA, 15 nt, Human
gccuuggggacaacc

SEQ ID NO: 3838452 - RNA, 17 nt, Human
gccuuggggaggacaaa

SEQ ID NO: 3838453 - RNA, 23 nt, Human
gccuuggggaggacaaaacuucu

SEQ ID NO: 3838454 - RNA, 18 nt, Human
gccuuggggcugaugcag

SEQ ID NO: 3838455 - RNA, 17 nt, Human
gccuugguguccaccug

SEQ ID NO: 3838456 - RNA, 22 nt, Human
gccuugguuuuuacugcucuga

SEQ ID NO: 3838457 - RNA, 20 nt, Human
gccuuguaauucuaaaugaa

SEQ ID NO: 3838458 - RNA, 22 nt, Human
gccuuguauaauauugaaaauu

SEQ ID NO: 3838459 - RNA, 15 nt, Human
gccuugucacgccag

SEQ ID NO: 3838460 - RNA, 23 nt, Human
gccuugucuccuacuccugacuc

SEQ ID NO: 3838461 - RNA, 21 nt, Human
gccuugugaugucauacagag

SEQ ID NO: 3838462 - RNA, 23 nt, Human
gccuugugaugucauacagagaa

SEQ ID NO: 3838463 - RNA, 13 nt, Human
gccuuguguauau

SEQ ID NO: 3838464 - RNA, 16 nt, Human
gccuuguuuuuuucua

SEQ ID NO: 3838465 - RNA, 21 nt, Human
gccuuuaaaauuuuuuuagaa

SEQ ID NO: 3838466 - RNA, 15 nt, Human
gccuuuaaaguauga

SEQ ID NO: 3838467 - RNA, 18 nt, Human
gccuuuaaaguaugaauc

SEQ ID NO: 3838468 - RNA, 21 nt, Human
gccuuuaauggacuuauuucu

SEQ ID NO: 3838469 - RNA, 21 nt, Human
gccuuuacugacccuggggcu

SEQ ID NO: 3838470 - RNA, 22 nt, Human
gccuuuagugaucacagcagcu

SEQ ID NO: 3838471 - RNA, 21 nt, Human
gccuuuaucuaccaacuuuca

SEQ ID NO: 3838472 - RNA, 14 nt, Human
gccuuuaugguuuc

SEQ ID NO: 3838473 - RNA, 14 nt, Human
gccuuuauuguguu

SEQ ID NO: 3838474 - RNA, 22 nt, Human
gccuuuauuguguuugucauua

SEQ ID NO: 3838475 - RNA, 14 nt, Human
gccuuucaggaucu

SEQ ID NO: 3838476 - RNA, 21 nt, Human
gccuuuccauaaggaauguag

SEQ ID NO: 3838477 - RNA, 22 nt, Human
gccuuuccauaaggaauguagc

SEQ ID NO: 3838478 - RNA, 19 nt, Human
gccuuuccauccauggcca

SEQ ID NO: 3838479 - RNA, 18 nt, Human
gccuuucccuaagccagc

SEQ ID NO: 3838480 - RNA, 20 nt, Human
gccuuuccucaaaacuggag

SEQ ID NO: 3838481 - RNA, 21 nt, Human
gccuuuccucaaaacuggagu

SEQ ID NO: 3838482 - RNA, 18 nt, Human
gccuuuccucucuccugu

SEQ ID NO: 3838483 - RNA, 21 nt, Human
gccuuuccuguagccuucugu

SEQ ID NO: 3838484 - RNA, 15 nt, Human
gccuuuccuguucag

SEQ ID NO: 3838485 - RNA, 20 nt, Human
gccuuuccuguucagcauuc

SEQ ID NO: 3838486 - RNA, 22 nt, Human
gccuuucucccaggccaggcuc

SEQ ID NO: 3838487 - RNA, 15 nt, Human
gccuuucuguguuua

SEQ ID NO: 3838488 - RNA, 20 nt, Human
gccuuugaagagugaaauac

SEQ ID NO: 3838489 - RNA, 21 nt, Human
gccuuugagacaguuucuuag

SEQ ID NO: 3838490 - RNA, 16 nt, Human
gccuuugcagaaacag

SEQ ID NO: 3838491 - RNA, 15 nt, Human
gccuuugccagguga

SEQ ID NO: 3838492 - RNA, 15 nt, Human
gccuuugccuccccg

SEQ ID NO: 3838493 - RNA, 21 nt, Human
gccuuugcgcuccuggcccag

SEQ ID NO: 3838494 - RNA, 18 nt, Human
gccuuuggacuugucccg

SEQ ID NO: 3838495 - RNA, 11 nt, Human
gccuuuguaag

SEQ ID NO: 3838496 - RNA, 15 nt, Human
gccuuuguugcucag

SEQ ID NO: 3838497 - RNA, 14 nt, Human
gccuuuuaacauuu

SEQ ID NO: 3838498 - RNA, 16 nt, Human
gccuuuuaacauuuug

SEQ ID NO: 3838499 - RNA, 20 nt, Human
gccuuuuaacauuuuguucu

SEQ ID NO: 3838500 - RNA, 16 nt, Human
gccuuuuaagaagaaa

SEQ ID NO: 3838501 - RNA, 22 nt, Human
gccuuuuaucccaaaguuguug

SEQ ID NO: 3838502 - RNA, 16 nt, Human
gccuuuuauuucuuaa

SEQ ID NO: 3838503 - RNA, 14 nt, Human
gccuuuucuagccc

SEQ ID NO: 3838504 - RNA, 17 nt, Human
gccuuuucuuuaacuuu

SEQ ID NO: 3838505 - RNA, 13 nt, Human
gccuuuugacagc

SEQ ID NO: 3838506 - RNA, 18 nt, Human
gccuuuugcaaccaggaa

SEQ ID NO: 3838507 - RNA, 18 nt, Human
gccuuuugcaccccuccc

SEQ ID NO: 3838508 - RNA, 19 nt, Human
gccuuuugcaccccuccca

SEQ ID NO: 3838509 - RNA, 20 nt, Human
gccuuuugcaccccucccau

SEQ ID NO: 3838510 - RNA, 22 nt, Human
gccuuuuguauacauccugggu

SEQ ID NO: 3838511 - RNA, 21 nt, Human
gccuuuuguucauuucauccu

SEQ ID NO: 3838512 - RNA, 16 nt, Human
gccuuuuucauuauuu

SEQ ID NO: 3838513 - RNA, 22 nt, Human
gccuuuuucauuuaucuauaau

SEQ ID NO: 3838514 - RNA, 20 nt, Human
gccuuuuuucacggaaguuu

SEQ ID NO: 3838515 - RNA, 23 nt, Human
gccuuuuuucacggaaguuuuca

SEQ ID NO: 3838516 - RNA, 20 nt, Human
gccuuuuuuccccagacuug

SEQ ID NO: 3838517 - RNA, 23 nt, Human
gcucggaggcugcccccggcccc

SEQ ID NO: 3838518 - RNA, 15 nt, Human
gcucggccugccccc

SEQ ID NO: 3838519 - RNA, 21 nt, Human
gcucggccugcccccacccca

SEQ ID NO: 3838520 - RNA, 16 nt, Human
gcucggcucagcucgg

SEQ ID NO: 3838521 - RNA, 23 nt, Human
gcucgguacccggggcccagggc

SEQ ID NO: 3838522 - RNA, 24 nt, Human
gcucgguacccggggcccagggca

SEQ ID NO: 3838523 - RNA, 14 nt, Human
gcucgguggaccca

SEQ ID NO: 3838524 - RNA, 15 nt, Human
gcucguguauccugg

SEQ ID NO: 3838525 - RNA, 16 nt, Human
gcucguguauccuggg

SEQ ID NO: 3838526 - RNA, 17 nt, Human
gcucguguauccugggg

SEQ ID NO: 3838527 - RNA, 18 nt, Human
gcucguguauccuggggc

SEQ ID NO: 3838528 - RNA, 15 nt, Human
gcucgugugccuggc

SEQ ID NO: 3838529 - RNA, 23 nt, Human
gcucuaaaauauuuaugaagaaa

SEQ ID NO: 3838530 - RNA, 16 nt, Human
gcucuaacgccugagc

SEQ ID NO: 3838531 - RNA, 20 nt, Human
gcucuaacgccugagcccag

SEQ ID NO: 3838532 - RNA, 12 nt, Human
gcucuaauaaaa

SEQ ID NO: 3838533 - RNA, 12 nt, Human
gcucuaauacau

SEQ ID NO: 3838534 - RNA, 16 nt, Human
gcucuaauguuugcau

SEQ ID NO: 3838535 - RNA, 19 nt, Human
gcucuaauguuugcauaua

SEQ ID NO: 3838536 - RNA, 18 nt, Human
gcucuaauucacagugcu

SEQ ID NO: 3838537 - RNA, 19 nt, Human
gcucuacaucuucugccuu

SEQ ID NO: 3838538 - RNA, 14 nt, Human
gcucuacccagggc

SEQ ID NO: 3838539 - RNA, 22 nt, Human
gcucuacuuccccauggcccug

SEQ ID NO: 3838540 - RNA, 16 nt, Human
gcucuagacaacccug

SEQ ID NO: 3838541 - RNA, 18 nt, Human
gcucuagacaacccugca

SEQ ID NO: 3838542 - RNA, 20 nt, Human
gcucuagaucauaaggcuuc

SEQ ID NO: 3838543 - RNA, 21 nt, Human
gcucuaggguugcuggagccu

SEQ ID NO: 3838544 - RNA, 20 nt, Human
gcucuagugggacagcccag

SEQ ID NO: 3838545 - RNA, 18 nt, Human
gcucuaucucucaaaacu

SEQ ID NO: 3838546 - RNA, 18 nt, Human
gcucuaugagucuagaug

SEQ ID NO: 3838547 - RNA, 21 nt, Human
gcucucaccuugguuccuggg

SEQ ID NO: 3838548 - RNA, 23 nt, Human
gcucucacggccacacagcugcc

SEQ ID NO: 3838549 - RNA, 11 nt, Human
gcucucagaag

SEQ ID NO: 3838550 - RNA, 12 nt, Human
gcucucagaagg

SEQ ID NO: 3838551 - RNA, 16 nt, Human
gcucucagcucagcgc

SEQ ID NO: 3838552 - RNA, 15 nt, Human
gcucucaggccagcu

SEQ ID NO: 3838553 - RNA, 12 nt, Human
gcggagcuggcc

SEQ ID NO: 3838554 - RNA, 14 nt, Human
gcggagcuggcccc

SEQ ID NO: 3838555 - RNA, 17 nt, Human
gcggagcuggccccgcc

SEQ ID NO: 3838556 - RNA, 21 nt, Human
gcggagguguggagccgaggc

SEQ ID NO: 3838557 - RNA, 16 nt, Human
gcggagguugcaggga

SEQ ID NO: 3838558 - RNA, 15 nt, Human
gcggauggauggaag

SEQ ID NO: 3838559 - RNA, 19 nt, Human
gcggauuaauuugcaucug

SEQ ID NO: 3838560 - RNA, 20 nt, Human
gcggauuaauuugcaucuga

SEQ ID NO: 3838561 - RNA, 14 nt, Human
gcggcaaaaggaaa

SEQ ID NO: 3838562 - RNA, 15 nt, Human
gcggcacuccaaccu

SEQ ID NO: 3838563 - RNA, 16 nt, Human
gcggcagauggggaga

SEQ ID NO: 3838564 - RNA, 16 nt, Human
gcggcaggggccugga

SEQ ID NO: 3838565 - RNA, 21 nt, Human
gcggccaagauaggaccuugg

SEQ ID NO: 3838566 - RNA, 16 nt, Human
gcggcccaauccaagg

SEQ ID NO: 3838567 - RNA, 13 nt, Human
gcggcccagcccg

SEQ ID NO: 3838568 - RNA, 16 nt, Human
gcggcccagcccggcu

SEQ ID NO: 3838569 - RNA, 18 nt, Human
gcggccgcauucccugag

SEQ ID NO: 3838570 - RNA, 13 nt, Human
gcggccggccagc

SEQ ID NO: 3838571 - RNA, 23 nt, Human
gcggccuaugacuugggcacccc

SEQ ID NO: 3838572 - RNA, 20 nt, Human
gcggccuuuguugcucagca

SEQ ID NO: 3838573 - RNA, 16 nt, Human
gcggcgaccgcccucc

SEQ ID NO: 3838574 - RNA, 18 nt, Human
gcggcgaccgcccuccgc

SEQ ID NO: 3838575 - RNA, 20 nt, Human
gcggcggagcuggccccgcc

SEQ ID NO: 3838576 - RNA, 16 nt, Human
gcggcggucccagcuc

SEQ ID NO: 3838577 - RNA, 22 nt, Human
gcggcucccggggcagggcagc

SEQ ID NO: 3838578 - RNA, 14 nt, Human
gcggcuccucaggg

SEQ ID NO: 3838579 - RNA, 21 nt, Human
gcggcugagagccccagcuga

SEQ ID NO: 3838580 - RNA, 16 nt, Human
gcggcuggccauggag

SEQ ID NO: 3838581 - RNA, 20 nt, Human
gcggcuggccauggagaaag

SEQ ID NO: 3838582 - RNA, 16 nt, Human
gcggcuggggucccag

SEQ ID NO: 3838583 - RNA, 18 nt, Human
gcggcuggggucccagca

SEQ ID NO: 3838584 - RNA, 20 nt, Human
gcggcuggggucccagcagc

SEQ ID NO: 3838585 - RNA, 15 nt, Human
gcggcuggugcaggg

SEQ ID NO: 3838586 - RNA, 12 nt, Human
gcggcugugcuu

SEQ ID NO: 3838587 - RNA, 14 nt, Human
gcgggaaggagggu

SEQ ID NO: 3838588 - RNA, 16 nt, Human
gcgggacagugcugca

SEQ ID NO: 3838589 - RNA, 15 nt, Human
gcgggaccuguggcu

SEQ ID NO: 3838590 - RNA, 21 nt, Human
gcgggagcgguggcccugucc

SEQ ID NO: 3838591 - RNA, 21 nt, Human
gcgggaggauguucugggaca

SEQ ID NO: 3838592 - RNA, 22 nt, Human
gcgggaggauguucugggacac

SEQ ID NO: 3838593 - RNA, 16 nt, Human
gcgggauggggcuccc

SEQ ID NO: 3838594 - RNA, 17 nt, Human
gcgggcacaccuccucc

SEQ ID NO: 3838595 - RNA, 15 nt, Human
gcgggcagagggcug

SEQ ID NO: 3838596 - RNA, 17 nt, Human
gcgggcagagggcugga

SEQ ID NO: 3838597 - RNA, 13 nt, Human
gcgggccaaggac

SEQ ID NO: 3838598 - RNA, 16 nt, Human
gcgggccagccaggcg

SEQ ID NO: 3838599 - RNA, 20 nt, Human
gcgggccccucaucgcgucc

SEQ ID NO: 3838600 - RNA, 16 nt, Human
gcgggcccugcccaca

SEQ ID NO: 3838601 - RNA, 17 nt, Human
gcggggacagcuccuuc

SEQ ID NO: 3838602 - RNA, 19 nt, Human
gcggggacagcuccuucug

SEQ ID NO: 3838603 - RNA, 23 nt, Human
gcggggacagcuccuucuguccu

SEQ ID NO: 3838604 - RNA, 23 nt, Human
gcggggaucagagcgcacaggga

SEQ ID NO: 3838605 - RNA, 20 nt, Human
gcggggcgaagcccaggccc

SEQ ID NO: 3838606 - RNA, 11 nt, Human
gcggggggagg

SEQ ID NO: 3838607 - RNA, 15 nt, Human
gcgguagccagcaca

SEQ ID NO: 3838608 - RNA, 21 nt, Human
gcgguagccagcacacagggc

SEQ ID NO: 3838609 - RNA, 22 nt, Human
gcgguagccagcacacagggca

SEQ ID NO: 3838610 - RNA, 16 nt, Human
gcgguccacccaggag

SEQ ID NO: 3838611 - RNA, 14 nt, Human
gcggucccagcucc

SEQ ID NO: 3838612 - RNA, 23 nt, Human
gcggucuucaacauccugccagc

SEQ ID NO: 3838613 - RNA, 16 nt, Human
gcggugcuguccucag

SEQ ID NO: 3838614 - RNA, 14 nt, Human
gcgguggaaggccc

SEQ ID NO: 3838615 - RNA, 18 nt, Human
gcgguggaaggcccgagg

SEQ ID NO: 3838616 - RNA, 15 nt, Human
gcgguggcccugucc

SEQ ID NO: 3838617 - RNA, 15 nt, Human
gcgguggcucacgcc

SEQ ID NO: 3838618 - RNA, 18 nt, Human
gcggugggcacccacccu

SEQ ID NO: 3838619 - RNA, 14 nt, Human
gcggugggggagga

SEQ ID NO: 3838620 - RNA, 22 nt, Human
gcgguuauaaaaaaugguucag

SEQ ID NO: 3838621 - RNA, 23 nt, Human
gcgguuaugaaauucacccccuu

SEQ ID NO: 3838622 - RNA, 18 nt, Human
gcgguuccggcauggaca

SEQ ID NO: 3838623 - RNA, 19 nt, Human
gcgguuccucguucucccu

SEQ ID NO: 3838624 - RNA, 14 nt, Human
gcgguuuggggagc

SEQ ID NO: 3838625 - RNA, 21 nt, Human
gcgguuugguuugcagcgacu

SEQ ID NO: 3838626 - RNA, 16 nt, Human
gcguaaguacagagaa

SEQ ID NO: 3838627 - RNA, 19 nt, Human
gcguaaguacagagaagcc

SEQ ID NO: 3838628 - RNA, 20 nt, Human
gcguaaguacagagaagcca

SEQ ID NO: 3838629 - RNA, 14 nt, Human
gcguacaggcuggc

SEQ ID NO: 3838630 - RNA, 21 nt, Human
gcguagaucaccagaauaaac

SEQ ID NO: 3838631 - RNA, 20 nt, Human
gcguagcgugcccgugugca

SEQ ID NO: 3838632 - RNA, 14 nt, Human
gcguaggcuacaga

SEQ ID NO: 3838633 - RNA, 19 nt, Human
gcguaggcuacagagaagc

SEQ ID NO: 3838634 - RNA, 21 nt, Human
gcguaugucuguuaccauguc

SEQ ID NO: 3838635 - RNA, 17 nt, Human
gcgucagccuccagccu

SEQ ID NO: 3838636 - RNA, 18 nt, Human
gcgucagccuccagccuc

SEQ ID NO: 3838637 - RNA, 19 nt, Human
gcgucagucuuuuucuguu

SEQ ID NO: 3838638 - RNA, 14 nt, Human
gcgucaucuggucc

SEQ ID NO: 3838639 - RNA, 23 nt, Human
gcgucauuacagggcacaggcca

SEQ ID NO: 3838640 - RNA, 14 nt, Human
gcguccagaaaugg

SEQ ID NO: 3838641 - RNA, 17 nt, Human
gcgucccaagauguuga

SEQ ID NO: 3838642 - RNA, 14 nt, Human
gcgucccccugccg

SEQ ID NO: 3838643 - RNA, 18 nt, Human
gcgucccccugccggccg

SEQ ID NO: 3838644 - RNA, 19 nt, Human
gcguccgcgcgccagcaca

SEQ ID NO: 3838645 - RNA, 19 nt, Human
gcguccugucggagcccug

SEQ ID NO: 3838646 - RNA, 16 nt, Human
gcgucgcccucccagg

SEQ ID NO: 3838647 - RNA, 19 nt, Human
gcgucucauacucaccuca

SEQ ID NO: 3838648 - RNA, 20 nt, Human
gcgucuccuguuuuucuggg

SEQ ID NO: 3838649 - RNA, 21 nt, Human
gcgucuggaaguccaaugugg

SEQ ID NO: 3838650 - RNA, 21 nt, Human
gcgucuggaggggccccugcu

SEQ ID NO: 3838651 - RNA, 16 nt, Human
gcgucuguucccccuu

SEQ ID NO: 3838652 - RNA, 13 nt, Human
gcgucuuccugag

SEQ ID NO: 3838653 - RNA, 21 nt, Human
gcgucuuccugaguggugcca

SEQ ID NO: 3838654 - RNA, 19 nt, Human
gcgugaaacacaccaggcu

SEQ ID NO: 3838655 - RNA, 23 nt, Human
gcgugaaacacaccaggcugugg

SEQ ID NO: 3838656 - RNA, 20 nt, Human
gcgugaacccaggaggcgga

SEQ ID NO: 3838657 - RNA, 13 nt, Human
gcgugaaggccga

SEQ ID NO: 3838658 - RNA, 15 nt, Human
gcgugaaggccgaga

SEQ ID NO: 3838659 - RNA, 12 nt, Human
gcgugaaucugu

SEQ ID NO: 3838660 - RNA, 13 nt, Human
gcgugacaauaaa

SEQ ID NO: 3838661 - RNA, 18 nt, Human
cuuccagaucacugccac

SEQ ID NO: 3838662 - RNA, 19 nt, Human
cuuccagauccuggaaauc

SEQ ID NO: 3838663 - RNA, 18 nt, Human
cuuccagauggucaucca

SEQ ID NO: 3838664 - RNA, 15 nt, Human
cuuccagcacccugc

SEQ ID NO: 3838665 - RNA, 12 nt, Human
cuuccagcagga

SEQ ID NO: 3838666 - RNA, 23 nt, Human
cuuccagcaggagggacagucuc

SEQ ID NO: 3838667 - RNA, 13 nt, Human
cuuccagcauuua

SEQ ID NO: 3838668 - RNA, 13 nt, Human
cuuccagcccaga

SEQ ID NO: 3838669 - RNA, 16 nt, Human
cuuccagcuagugacc

SEQ ID NO: 3838670 - RNA, 13 nt, Human
cuuccagcuccug

SEQ ID NO: 3838671 - RNA, 15 nt, Human
cuuccagcuccugua

SEQ ID NO: 3838672 - RNA, 14 nt, Human
cuuccagcugcugu

SEQ ID NO: 3838673 - RNA, 20 nt, Human
cuuccaggaaaaaggacagg

SEQ ID NO: 3838674 - RNA, 13 nt, Human
cuuccaggaaacu

SEQ ID NO: 3838675 - RNA, 17 nt, Human
cuuccaggaaacuccac

SEQ ID NO: 3838676 - RNA, 23 nt, Human
cuuccaggaaacuccacaucugc

SEQ ID NO: 3838677 - RNA, 14 nt, Human
cuuccaggccauca

SEQ ID NO: 3838678 - RNA, 16 nt, Human
cuuccaggccaucaga

SEQ ID NO: 3838679 - RNA, 12 nt, Human
cuuccaggcugg

SEQ ID NO: 3838680 - RNA, 19 nt, Human
cuuccaggcugggagagcc

SEQ ID NO: 3838681 - RNA, 21 nt, Human
cuuccaggggagguucaguga

SEQ ID NO: 3838682 - RNA, 13 nt, Human
cuuccagggggaa

SEQ ID NO: 3838683 - RNA, 20 nt, Human
cuuccagggggaaggccaag

SEQ ID NO: 3838684 - RNA, 17 nt, Human
cuuccaggggugggaca

SEQ ID NO: 3838685 - RNA, 21 nt, Human
cuuccaggggugggacacccu

SEQ ID NO: 3838686 - RNA, 22 nt, Human
cuuccaggggugggacacccug

SEQ ID NO: 3838687 - RNA, 20 nt, Human
cuuccagguaucuccaggau

SEQ ID NO: 3838688 - RNA, 19 nt, Human
cuuccaggugcccagcuau

SEQ ID NO: 3838689 - RNA, 16 nt, Human
cuuccagguguuacug

SEQ ID NO: 3838690 - RNA, 20 nt, Human
cuuccagguguuacuguaau

SEQ ID NO: 3838691 - RNA, 22 nt, Human
cuuccagguguuacuguaauuc

SEQ ID NO: 3838692 - RNA, 21 nt, Human
cuuccagucuuccugacacuu

SEQ ID NO: 3838693 - RNA, 20 nt, Human
cuuccagugaggcucugccc

SEQ ID NO: 3838694 - RNA, 23 nt, Human
cuuccagugaggcucugcccuug

SEQ ID NO: 3838695 - RNA, 23 nt, Human
cuuccagugguuugagacacugg

SEQ ID NO: 3838696 - RNA, 17 nt, Human
cuuccagugucauuucu

SEQ ID NO: 3838697 - RNA, 16 nt, Human
cuuccaguuacuuucc

SEQ ID NO: 3838698 - RNA, 11 nt, Human
cuuccauaauc

SEQ ID NO: 3838699 - RNA, 17 nt, Human
cuuccauagcugcugcc

SEQ ID NO: 3838700 - RNA, 16 nt, Human
cuuccauaugaccuca

SEQ ID NO: 3838701 - RNA, 21 nt, Human
cuuccauaugaccucaugcau

SEQ ID NO: 3838702 - RNA, 14 nt, Human
cuuccauauggauc

SEQ ID NO: 3838703 - RNA, 12 nt, Human
cuuccaucaugu

SEQ ID NO: 3838704 - RNA, 17 nt, Human
cuuccaucccaaccagu

SEQ ID NO: 3838705 - RNA, 21 nt, Human
cuuccaucccaaccagugcca

SEQ ID NO: 3838706 - RNA, 17 nt, Human
cuuccaucccaggacac

SEQ ID NO: 3838707 - RNA, 17 nt, Human
cuuccaucccuaccccc

SEQ ID NO: 3838708 - RNA, 18 nt, Human
cuuccaucuuuccugaug

SEQ ID NO: 3838709 - RNA, 22 nt, Human
cuuccaucuuuccugauggcag

SEQ ID NO: 3838710 - RNA, 18 nt, Human
cuuccaugaauuuuaaaa

SEQ ID NO: 3838711 - RNA, 20 nt, Human
cuuccaugaauuuuaaaauc

SEQ ID NO: 3838712 - RNA, 17 nt, Human
cuuccaugauucuauuu

SEQ ID NO: 3838713 - RNA, 16 nt, Human
cuuccauggacuuugu

SEQ ID NO: 3838714 - RNA, 19 nt, Human
cuuccauguaucuuuugaa

SEQ ID NO: 3838715 - RNA, 18 nt, Human
cuuccaugucgccucugc

SEQ ID NO: 3838716 - RNA, 14 nt, Human
cuuccaugugaggg

SEQ ID NO: 3838717 - RNA, 16 nt, Human
cuuccauuccacaucc

SEQ ID NO: 3838718 - RNA, 14 nt, Human
cuuccauuugcaag

SEQ ID NO: 3838719 - RNA, 23 nt, Human
cuuccauuuucccccacuacugc

SEQ ID NO: 3838720 - RNA, 21 nt, Human
cuucccaaaggacuccaccca

SEQ ID NO: 3838721 - RNA, 23 nt, Human
cuucccaaaguccugggauuaca

SEQ ID NO: 3838722 - RNA, 20 nt, Human
cuucccaaaugugugcccag

SEQ ID NO: 3838723 - RNA, 17 nt, Human
cuucccaagggcugccg

SEQ ID NO: 3838724 - RNA, 20 nt, Human
cuucccaaucagcacugaaa

SEQ ID NO: 3838725 - RNA, 17 nt, Human
cuucccacccaucgcug

SEQ ID NO: 3838726 - RNA, 13 nt, Human
cuucccacccugc

SEQ ID NO: 3838727 - RNA, 21 nt, Human
cuucccaccucccugcccagg

SEQ ID NO: 3838728 - RNA, 23 nt, Human
cuucccaccucucucacuccuug

SEQ ID NO: 3838729 - RNA, 22 nt, Human
cuucccacucuagggcagugga

SEQ ID NO: 3838730 - RNA, 14 nt, Human
cuucccacuggagg

SEQ ID NO: 3838731 - RNA, 19 nt, Human
cuucccagaggggccugcc

SEQ ID NO: 3838732 - RNA, 21 nt, Human
cuucccagaggggccugccac

SEQ ID NO: 3838733 - RNA, 11 nt, Human
cuucccagcuu

SEQ ID NO: 3838734 - RNA, 18 nt, Human
cuucccaguggcugcugc

SEQ ID NO: 3838735 - RNA, 22 nt, Human
cuucccaguucaggagucccaa

SEQ ID NO: 3838736 - RNA, 11 nt, Human
cuucccaucac

SEQ ID NO: 3838737 - RNA, 14 nt, Human
cuucccauccccag

SEQ ID NO: 3838738 - RNA, 12 nt, Human
cuucccauccua

SEQ ID NO: 3838739 - RNA, 15 nt, Human
cuucccauccuaccc

SEQ ID NO: 3838740 - RNA, 19 nt, Human
cuucccauccuacccucgg

SEQ ID NO: 3838741 - RNA, 15 nt, Human
cuucccaucgcuguc

SEQ ID NO: 3838742 - RNA, 15 nt, Human
cuucccaugacccag

SEQ ID NO: 3838743 - RNA, 22 nt, Human
cuucccaugacccaggcugggc

SEQ ID NO: 3838744 - RNA, 23 nt, Human
cuucccaugacccaggcugggca

SEQ ID NO: 3838745 - RNA, 13 nt, Human
cuucccaugcauu

SEQ ID NO: 3838746 - RNA, 14 nt, Human
cuucccauucucca

SEQ ID NO: 3838747 - RNA, 18 nt, Human
cuucccauuguggcuccu

SEQ ID NO: 3838748 - RNA, 23 nt, Human
cuuccccaacgaaaagcacaucc

SEQ ID NO: 3838749 - RNA, 11 nt, Human
cuuccccacug

SEQ ID NO: 3838750 - RNA, 18 nt, Human
cuuccccacugcacacac

SEQ ID NO: 3838751 - RNA, 19 nt, Human
cuuccccacugccugccca

SEQ ID NO: 3838752 - RNA, 20 nt, Human
cuuccccacugccugcccac

SEQ ID NO: 3838753 - RNA, 22 nt, Human
cuuccccacugccugcccaccc

SEQ ID NO: 3838754 - RNA, 19 nt, Human
cuuccccaugcuuccuugc

SEQ ID NO: 3838755 - RNA, 13 nt, Human
cuucccccaccac

SEQ ID NO: 3838756 - RNA, 23 nt, Human
cuucccccaccgguccagcuggc

SEQ ID NO: 3838757 - RNA, 15 nt, Human
cuucccccauagcca

SEQ ID NO: 3838758 - RNA, 13 nt, Human
gcugcugcccagg

SEQ ID NO: 3838759 - RNA, 13 nt, Human
gcugcugccccug

SEQ ID NO: 3838760 - RNA, 12 nt, Human
gcugcugccugc

SEQ ID NO: 3838761 - RNA, 17 nt, Human
gcugcugccuggccacu

SEQ ID NO: 3838762 - RNA, 12 nt, Human
gcugcugcgccc

SEQ ID NO: 3838763 - RNA, 20 nt, Human
gcugcugcuaaucuucaggg

SEQ ID NO: 3838764 - RNA, 12 nt, Human
gcugcugcucug

SEQ ID NO: 3838765 - RNA, 12 nt, Human
gcugcugcugcu

SEQ ID NO: 3838766 - RNA, 13 nt, Human
gcugcugcugggc

SEQ ID NO: 3838767 - RNA, 13 nt, Human
gcugcuggagacu

SEQ ID NO: 3838768 - RNA, 14 nt, Human
gcugcuggagacuc

SEQ ID NO: 3838769 - RNA, 22 nt, Human
gcugcuggaggaaaacugagac

SEQ ID NO: 3838770 - RNA, 12 nt, Human
gcugcuggcgcc

SEQ ID NO: 3838771 - RNA, 19 nt, Human
gcugcuggcgccucugcaa

SEQ ID NO: 3838772 - RNA, 13 nt, Human
gcugcuggcuggu

SEQ ID NO: 3838773 - RNA, 11 nt, Human
gcugcuggcuu

SEQ ID NO: 3838774 - RNA, 18 nt, Human
gcugcuggggaagacagu

SEQ ID NO: 3838775 - RNA, 19 nt, Human
gcugcuggggaagacagug

SEQ ID NO: 3838776 - RNA, 18 nt, Human
gcugcuggggccucagac

SEQ ID NO: 3838777 - RNA, 22 nt, Human
gcugcugggggcaacuggccau

SEQ ID NO: 3838778 - RNA, 21 nt, Human
gcugcugucaccucucccacg

SEQ ID NO: 3838779 - RNA, 16 nt, Human
gcugcugucugggugc

SEQ ID NO: 3838780 - RNA, 20 nt, Human
gcugcugucugggugcuacu

SEQ ID NO: 3838781 - RNA, 24 nt, Human
gcugcugucugggugcuacugggg

SEQ ID NO: 3838782 - RNA, 20 nt, Human
gcugcuguggccaucaaccu

SEQ ID NO: 3838783 - RNA, 18 nt, Human
gcugcuuagacauaacaa

SEQ ID NO: 3838784 - RNA, 12 nt, Human
gcugcuucccuc

SEQ ID NO: 3838785 - RNA, 23 nt, Human
gcugcuucccucugccugucccu

SEQ ID NO: 3838786 - RNA, 19 nt, Human
gcugcuucccugaagcucc

SEQ ID NO: 3838787 - RNA, 16 nt, Human
gcugcuuccuccugga

SEQ ID NO: 3838788 - RNA, 17 nt, Human
gcugcuuccuccuggaa

SEQ ID NO: 3838789 - RNA, 23 nt, Human
gcugcuuggaccucgugcuuuaa

SEQ ID NO: 3838790 - RNA, 17 nt, Human
gcugcuugggcuucauc

SEQ ID NO: 3838791 - RNA, 22 nt, Human
gcugcuugugucccuccuggga

SEQ ID NO: 3838792 - RNA, 14 nt, Human
gcugcuuuccccug

SEQ ID NO: 3838793 - RNA, 19 nt, Human
gcugcuuuccccugugggg

SEQ ID NO: 3838794 - RNA, 15 nt, Human
gcugcuuugauauau

SEQ ID NO: 3838795 - RNA, 23 nt, Human
gcugcuuuguuaccuuaaaacua

SEQ ID NO: 3838796 - RNA, 12 nt, Human
gcugcuuuucuu

SEQ ID NO: 3838797 - RNA, 21 nt, Human
gcuggaaaaguauguuagugc

SEQ ID NO: 3838798 - RNA, 17 nt, Human
gcuggaaaauaauacug

SEQ ID NO: 3838799 - RNA, 20 nt, Human
gcuggaaacagacucgauuc

SEQ ID NO: 3838800 - RNA, 18 nt, Human
gcuggaagauccugcggg

SEQ ID NO: 3838801 - RNA, 22 nt, Human
gcuggaagcccagccccuacug

SEQ ID NO: 3838802 - RNA, 16 nt, Human
gcuggaagcugggagg

SEQ ID NO: 3838803 - RNA, 20 nt, Human
gcuggaauuuuuuauucuug

SEQ ID NO: 3838804 - RNA, 15 nt, Human
gcuggacaggucugg

SEQ ID NO: 3838805 - RNA, 15 nt, Human
cuucccuccugcuuu

SEQ ID NO: 3838806 - RNA, 16 nt, Human
cuucccucuccccaag

SEQ ID NO: 3838807 - RNA, 14 nt, Human
cuucccucucugga

SEQ ID NO: 3838808 - RNA, 11 nt, Human
cuucccucugc

SEQ ID NO: 3838809 - RNA, 13 nt, Human
cuucccucugccu

SEQ ID NO: 3838810 - RNA, 17 nt, Human
cuucccucugccugucc

SEQ ID NO: 3838811 - RNA, 18 nt, Human
cuucccucugccuguccc

SEQ ID NO: 3838812 - RNA, 22 nt, Human
cuucccucuuccuucccugcug

SEQ ID NO: 3838813 - RNA, 15 nt, Human
cuucccugaagcucc

SEQ ID NO: 3838814 - RNA, 13 nt, Human
cuucccugacuca

SEQ ID NO: 3838815 - RNA, 20 nt, Human
cuucccugauugaccugcuc

SEQ ID NO: 3838816 - RNA, 18 nt, Human
cuucccugcgccugugau

SEQ ID NO: 3838817 - RNA, 12 nt, Human
cuucccugggcu

SEQ ID NO: 3838818 - RNA, 22 nt, Human
cuucccuggguuagacugccag

SEQ ID NO: 3838819 - RNA, 18 nt, Human
cuucccugguaagaaaaa

SEQ ID NO: 3838820 - RNA, 22 nt, Human
cuucccuguauuuucuuucucu

SEQ ID NO: 3838821 - RNA, 16 nt, Human
cuucccugugccuccu

SEQ ID NO: 3838822 - RNA, 23 nt, Human
cuucccuguuuuccccccaaggg

SEQ ID NO: 3838823 - RNA, 15 nt, Human
cuucccuuccacugc

SEQ ID NO: 3838824 - RNA, 17 nt, Human
cuucccuuccacugccu

SEQ ID NO: 3838825 - RNA, 23 nt, Human
cuucccuuccacugccucugccu

SEQ ID NO: 3838826 - RNA, 16 nt, Human
cuucccuugagcccuc

SEQ ID NO: 3838827 - RNA, 15 nt, Human
cuucccuugccacuu

SEQ ID NO: 3838828 - RNA, 16 nt, Human
cuucccuugccacuuu

SEQ ID NO: 3838829 - RNA, 14 nt, Human
cuucccuuuucugu

SEQ ID NO: 3838830 - RNA, 17 nt, Human
cuuccgacccucuggga

SEQ ID NO: 3838831 - RNA, 15 nt, Human
cuuccgcaguguggc

SEQ ID NO: 3838832 - RNA, 15 nt, Human
cuuccgccacugggg

SEQ ID NO: 3838833 - RNA, 14 nt, Human
cuuccgccccugcc

SEQ ID NO: 3838834 - RNA, 15 nt, Human
cuuccgccccugccu

SEQ ID NO: 3838835 - RNA, 18 nt, Human
cuuccgccccuucccuuc

SEQ ID NO: 3838836 - RNA, 19 nt, Human
cuuccgccccuucccuucc

SEQ ID NO: 3838837 - RNA, 22 nt, Human
cuuccgcuuggagcuauuuucc

SEQ ID NO: 3838838 - RNA, 23 nt, Human
cuuccgcuuggagcuauuuucca

SEQ ID NO: 3838839 - RNA, 15 nt, Human
cuuccggagauguag

SEQ ID NO: 3838840 - RNA, 13 nt, Human
cuuccggccccuc

SEQ ID NO: 3838841 - RNA, 17 nt, Human
cuuccguaacccaacuc

SEQ ID NO: 3838842 - RNA, 23 nt, Human
cuuccguaacccaacucuccugg

SEQ ID NO: 3838843 - RNA, 19 nt, Human
cuuccuaaauauuaugaga

SEQ ID NO: 3838844 - RNA, 16 nt, Human
cuuccuaaauuuuccu

SEQ ID NO: 3838845 - RNA, 15 nt, Human
cuuccuaagccugug

SEQ ID NO: 3838846 - RNA, 16 nt, Human
cuuccuaagccugugg

SEQ ID NO: 3838847 - RNA, 21 nt, Human
cuuccuaauuucccuucuugc

SEQ ID NO: 3838848 - RNA, 22 nt, Human
cuuccuaccacccgguccccac

SEQ ID NO: 3838849 - RNA, 16 nt, Human
cuuccuacccacaccu

SEQ ID NO: 3838850 - RNA, 23 nt, Human
cuuccuacccacaccucugccag

SEQ ID NO: 3838851 - RNA, 16 nt, Human
cuuccuacccuccugc

SEQ ID NO: 3838852 - RNA, 17 nt, Human
cuuccuacccugccucc

SEQ ID NO: 3838853 - RNA, 14 nt, Human
cuuccuacucuucu

SEQ ID NO: 3838854 - RNA, 18 nt, Human
cuuccuacucuucucucu

SEQ ID NO: 3838855 - RNA, 17 nt, Human
cuuccuaguucaucccu

SEQ ID NO: 3838856 - RNA, 24 nt, Human
cuuccuaguucaucccuucucuuc

SEQ ID NO: 3838857 - RNA, 22 nt, Human
cuuccuaguuuucuccucccag

SEQ ID NO: 3838858 - RNA, 14 nt, Human
cuuccuauaacuug

SEQ ID NO: 3838859 - RNA, 22 nt, Human
cuuccuauaacuugaugcaugu

SEQ ID NO: 3838860 - RNA, 20 nt, Human
cuuccuauaauuuugauagu

SEQ ID NO: 3838861 - RNA, 22 nt, Human
cuuccuauuccaagcuuccaua

SEQ ID NO: 3838862 - RNA, 14 nt, Human
cuuccuauuucaga

SEQ ID NO: 3838863 - RNA, 16 nt, Human
cuuccucacugcccaa

SEQ ID NO: 3838864 - RNA, 13 nt, Human
cuuccucacuucc

SEQ ID NO: 3838865 - RNA, 14 nt, Human
cuuccucacuucca

SEQ ID NO: 3838866 - RNA, 11 nt, Human
cuuccucagcc

SEQ ID NO: 3838867 - RNA, 16 nt, Human
cuuccucagccagccu

SEQ ID NO: 3838868 - RNA, 20 nt, Human
cuuccucaguuuaauccuuc

SEQ ID NO: 3838869 - RNA, 21 nt, Human
cuuccucccaaguggugccua

SEQ ID NO: 3838870 - RNA, 23 nt, Human
cuuccucccaaguggugccuaaa

SEQ ID NO: 3838871 - RNA, 21 nt, Human
cuuccuccgaggccaguaccu

SEQ ID NO: 3838872 - RNA, 14 nt, Human
cuuccuccucccuc

SEQ ID NO: 3838873 - RNA, 19 nt, Human
cuuccuccucccuccugcc

SEQ ID NO: 3838874 - RNA, 14 nt, Human
cuuccuccugacac

SEQ ID NO: 3838875 - RNA, 14 nt, Human
cuuccuccuggaaa

SEQ ID NO: 3838876 - RNA, 13 nt, Human
cuuccuccuggug

SEQ ID NO: 3838877 - RNA, 22 nt, Human
cuuccucucauccuuuucuccu

SEQ ID NO: 3838878 - RNA, 13 nt, Human
cuuccucuccacu

SEQ ID NO: 3838879 - RNA, 15 nt, Human
cuuccucuccacugc

SEQ ID NO: 3838880 - RNA, 17 nt, Human
cuuccucuccacugccu

SEQ ID NO: 3838881 - RNA, 12 nt, Human
cuuccucuccuu

SEQ ID NO: 3838882 - RNA, 19 nt, Human
cuuccucugaggcuggauc

SEQ ID NO: 3838883 - RNA, 14 nt, Human
cuuccucugcagcu

SEQ ID NO: 3838884 - RNA, 14 nt, Human
cuuccucugcuaaa

SEQ ID NO: 3838885 - RNA, 12 nt, Human
cuuccucugcuc

SEQ ID NO: 3838886 - RNA, 13 nt, Human
cuuccucugcucc

SEQ ID NO: 3838887 - RNA, 15 nt, Human
cuuccucugcucccc

SEQ ID NO: 3838888 - RNA, 13 nt, Human
cuuccucugcuga

SEQ ID NO: 3838889 - RNA, 20 nt, Human
cuuccucuggggcucuaggg

SEQ ID NO: 3838890 - RNA, 17 nt, Human
cuuccucuucccccaag

SEQ ID NO: 3838891 - RNA, 18 nt, Human
cuuccucuugacccugca

SEQ ID NO: 3838892 - RNA, 20 nt, Human
cuuccucuugacccugcacc

SEQ ID NO: 3838893 - RNA, 22 nt, Human
cuuccucuugacccugcacccu

SEQ ID NO: 3838894 - RNA, 16 nt, Human
cuuccucuugucugau

SEQ ID NO: 3838895 - RNA, 18 nt, Human
cuuccucuugucugauuu

SEQ ID NO: 3838896 - RNA, 13 nt, Human
cuuccugaagcug

SEQ ID NO: 3838897 - RNA, 15 nt, Human
cuuccugagcuuuau

SEQ ID NO: 3838898 - RNA, 17 nt, Human
cuuccugcaacaccuug

SEQ ID NO: 3838899 - RNA, 17 nt, Human
cuuccugcauucaccca

SEQ ID NO: 3838900 - RNA, 22 nt, Human
cuuccugcauucacccagacag

SEQ ID NO: 3838901 - RNA, 13 nt, Human
cuuccugccacca

SEQ ID NO: 3838902 - RNA, 18 nt, Human
cuuccugccaccagucac

SEQ ID NO: 3838903 - RNA, 21 nt, Human
cuuccugccaccagucacugu

SEQ ID NO: 3838904 - RNA, 14 nt, Human
cuuccugccagccc

SEQ ID NO: 3838905 - RNA, 20 nt, Human
cuuccugccagccccugcca

SEQ ID NO: 3838906 - RNA, 13 nt, Human
cuuccugccccuc

SEQ ID NO: 3838907 - RNA, 16 nt, Human
cuuccugccccucuuu

SEQ ID NO: 3838908 - RNA, 22 nt, Human
cuuccugccccucuuucucuuu

SEQ ID NO: 3838909 - RNA, 17 nt, Human
cuuccugccuggucucc

SEQ ID NO: 3838910 - RNA, 15 nt, Human
cuuccugcguccucc

SEQ ID NO: 3838911 - RNA, 18 nt, Human
cuuccugcguccuccuca

SEQ ID NO: 3838912 - RNA, 20 nt, Human
cuuccugcguccuccucacc

SEQ ID NO: 3838913 - RNA, 18 nt, Human
cuuccugcuuccucagag

SEQ ID NO: 3838914 - RNA, 12 nt, Human
cuuccugcuugc

SEQ ID NO: 3838915 - RNA, 16 nt, Human
cuuccugcuugccaag

SEQ ID NO: 3838916 - RNA, 23 nt, Human
cuuccuggacagcugugccucgc

SEQ ID NO: 3838917 - RNA, 12 nt, Human
cuuccuggagca

SEQ ID NO: 3838918 - RNA, 21 nt, Human
cuuccuggagcagaagcagca

SEQ ID NO: 3838919 - RNA, 11 nt, Human
cuuccuggccg

SEQ ID NO: 3838920 - RNA, 12 nt, Human
cuuccuggccug

SEQ ID NO: 3838921 - RNA, 22 nt, Human
cuuccugggcacacgcugcucu

SEQ ID NO: 3838922 - RNA, 16 nt, Human
cuuccugucuagucuc

SEQ ID NO: 3838923 - RNA, 23 nt, Human
cuuccugucuagucucuccugua

SEQ ID NO: 3838924 - RNA, 12 nt, Human
gcugguggccca

SEQ ID NO: 3838925 - RNA, 15 nt, Human
gcugguggcucccgg

SEQ ID NO: 3838926 - RNA, 21 nt, Human
gcuggugggaagcgucugucc

SEQ ID NO: 3838927 - RNA, 12 nt, Human
gcuggugggagg

SEQ ID NO: 3838928 - RNA, 14 nt, Human
gcuggugggagggg

SEQ ID NO: 3838929 - RNA, 21 nt, Human
gcuggugggcaccaagagcca

SEQ ID NO: 3838930 - RNA, 19 nt, Human
gcuggugggugaaagaaau

SEQ ID NO: 3838931 - RNA, 18 nt, Human
gcugguguagcuacagag

SEQ ID NO: 3838932 - RNA, 20 nt, Human
gcugguguagcuacagagaa

SEQ ID NO: 3838933 - RNA, 23 nt, Human
gcugguguagcuacagagaaacc

SEQ ID NO: 3838934 - RNA, 16 nt, Human
gcugguguccugacca

SEQ ID NO: 3838935 - RNA, 17 nt, Human
gcuggugugguacagag

SEQ ID NO: 3838936 - RNA, 18 nt, Human
gcuggugugguacagaga

SEQ ID NO: 3838937 - RNA, 19 nt, Human
gcuggugugguacagagaa

SEQ ID NO: 3838938 - RNA, 21 nt, Human
gcuggugugguacagagaagc

SEQ ID NO: 3838939 - RNA, 13 nt, Human
gcugguguuaaca

SEQ ID NO: 3838940 - RNA, 18 nt, Human
gcugguguuaacagaagg

SEQ ID NO: 3838941 - RNA, 23 nt, Human
gcugguucaggguuggccccugc

SEQ ID NO: 3838942 - RNA, 16 nt, Human
gcugguuccugcuaga

SEQ ID NO: 3838943 - RNA, 19 nt, Human
gcugguuccugcuagaaau

SEQ ID NO: 3838944 - RNA, 14 nt, Human
gcugguugcugugu

SEQ ID NO: 3838945 - RNA, 17 nt, Human
gcugguuggagagcuag

SEQ ID NO: 3838946 - RNA, 18 nt, Human
gcugguuggagagcuaga

SEQ ID NO: 3838947 - RNA, 15 nt, Human
gcugguuuaauguuu

SEQ ID NO: 3838948 - RNA, 15 nt, Human
gcugguuuccucauu

SEQ ID NO: 3838949 - RNA, 14 nt, Human
gcuguaaaaucuug

SEQ ID NO: 3838950 - RNA, 12 nt, Human
cuugaaaaaugu

SEQ ID NO: 3838951 - RNA, 18 nt, Human
cuugaaaaaugugcaaaa

SEQ ID NO: 3838952 - RNA, 15 nt, Human
cuugaaaagagacag

SEQ ID NO: 3838953 - RNA, 16 nt, Human
cuugaaaauaagaaua

SEQ ID NO: 3838954 - RNA, 23 nt, Human
cuugaaaauauuuuuuauauaua

SEQ ID NO: 3838955 - RNA, 18 nt, Human
cuugaaacuuugggaaaa

SEQ ID NO: 3838956 - RNA, 23 nt, Human
cuugaaacuuugggaaaacaugu

SEQ ID NO: 3838957 - RNA, 21 nt, Human
cuugaaagaagaaaagguucu

SEQ ID NO: 3838958 - RNA, 17 nt, Human
cuugaaagaauuuuccu

SEQ ID NO: 3838959 - RNA, 16 nt, Human
cuugaaagcauccaug

SEQ ID NO: 3838960 - RNA, 17 nt, Human
cuugaaagcauccaugu

SEQ ID NO: 3838961 - RNA, 18 nt, Human
cuugaaagcauccaugug

SEQ ID NO: 3838962 - RNA, 13 nt, Human
cuugaaagcugug

SEQ ID NO: 3838963 - RNA, 19 nt, Human
cuugaaauauccugcuuga

SEQ ID NO: 3838964 - RNA, 20 nt, Human
cuugaaauuaagaaggcaaa

SEQ ID NO: 3838965 - RNA, 17 nt, Human
cuugaaauuauaucugu

SEQ ID NO: 3838966 - RNA, 16 nt, Human
cuugaaauuuuaaccu

SEQ ID NO: 3838967 - RNA, 17 nt, Human
cuugaaauuuuaaccua

SEQ ID NO: 3838968 - RNA, 17 nt, Human
cuugaacaaaaggguca

SEQ ID NO: 3838969 - RNA, 20 nt, Human
cuugaacaaaagggucagag

SEQ ID NO: 3838970 - RNA, 17 nt, Human
cuugaacaaaaucuguu

SEQ ID NO: 3838971 - RNA, 15 nt, Human
cuugaacacaguauu

SEQ ID NO: 3838972 - RNA, 19 nt, Human
cuugaacacucaugcugaa

SEQ ID NO: 3838973 - RNA, 20 nt, Human
cuugaacacucaugcugaaa

SEQ ID NO: 3838974 - RNA, 13 nt, Human
cuugaacacuggg

SEQ ID NO: 3838975 - RNA, 18 nt, Human
cuugaacauguuuuguau

SEQ ID NO: 3838976 - RNA, 15 nt, Human
cuugaacccaggagg

SEQ ID NO: 3838977 - RNA, 23 nt, Human
cuugaacccaggucucccuggau

SEQ ID NO: 3838978 - RNA, 20 nt, Human
cuugaacccgggaggcagag

SEQ ID NO: 3838979 - RNA, 16 nt, Human
cuugaaccugggaggu

SEQ ID NO: 3838980 - RNA, 13 nt, Human
ggaaaaauguuug

SEQ ID NO: 3838981 - RNA, 18 nt, Human
ggaaaacaugcuacacac

SEQ ID NO: 3838982 - RNA, 12 nt, Human
ggaaaacauuug

SEQ ID NO: 3838983 - RNA, 12 nt, Human
ggaaaaccagac

SEQ ID NO: 3838984 - RNA, 16 nt, Human
ggaaaaccugaagacu

SEQ ID NO: 3838985 - RNA, 16 nt, Human
ggaaaacugacagagg

SEQ ID NO: 3838986 - RNA, 13 nt, Human
ggaaaacuguguu

SEQ ID NO: 3838987 - RNA, 14 nt, Human
ggaaaacuguguug

SEQ ID NO: 3838988 - RNA, 23 nt, Human
ggaaaaggaagguaguucaagaa

SEQ ID NO: 3838989 - RNA, 13 nt, Human
ggaaaaggccugg

SEQ ID NO: 3838990 - RNA, 14 nt, Human
ggaaaaggccuggg

SEQ ID NO: 3838991 - RNA, 22 nt, Human
ggaaaaggccuggggugacccg

SEQ ID NO: 3838992 - RNA, 16 nt, Human
ggaaaaggcugguaca

SEQ ID NO: 3838993 - RNA, 15 nt, Human
ggaaaagguugaaua

SEQ ID NO: 3838994 - RNA, 17 nt, Human
ggaaaauaaaaaaagaa

SEQ ID NO: 3838995 - RNA, 22 nt, Human
ggaaaauaccccaucauucaug

SEQ ID NO: 3838996 - RNA, 19 nt, Human
ggaaaaucagccugcucca

SEQ ID NO: 3838997 - RNA, 12 nt, Human
ggaaaauuauuu

SEQ ID NO: 3838998 - RNA, 14 nt, Human
ggaaaauucauuuu

SEQ ID NO: 3838999 - RNA, 18 nt, Human
ggaaaauuuuaaaaauac

SEQ ID NO: 3839000 - RNA, 15 nt, Human
ggaaacaacauuuau

SEQ ID NO: 3839001 - RNA, 17 nt, Human
ggaaacacuaaauguua

SEQ ID NO: 3839002 - RNA, 21 nt, Human
ggaaacacuaaauguuaaaga

SEQ ID NO: 3839003 - RNA, 15 nt, Human
ggaaacacuccuugc

SEQ ID NO: 3839004 - RNA, 13 nt, Human
ggaaacagacucg

SEQ ID NO: 3839005 - RNA, 15 nt, Human
ggaaacagguuggga

SEQ ID NO: 3839006 - RNA, 18 nt, Human
ggaaacaguugcauguag

SEQ ID NO: 3839007 - RNA, 20 nt, Human
ggaaacaugacucguauaug

SEQ ID NO: 3839008 - RNA, 16 nt, Human
ggaaaccacagcugcu

SEQ ID NO: 3839009 - RNA, 18 nt, Human
ggaaaccacagcugcugg

SEQ ID NO: 3839010 - RNA, 19 nt, Human
ggaaaccacagcugcugga

SEQ ID NO: 3839011 - RNA, 23 nt, Human
ggaaacccauaggcccacacaca

SEQ ID NO: 3839012 - RNA, 19 nt, Human
ggaaaccccuucucuguga

SEQ ID NO: 3839013 - RNA, 12 nt, Human
ggaaaccugccc

SEQ ID NO: 3839014 - RNA, 13 nt, Human
ggaaaccugcccu

SEQ ID NO: 3839015 - RNA, 14 nt, Human
ggaaaccugcccug

SEQ ID NO: 3839016 - RNA, 18 nt, Human
ggaaaccugcccugccug

SEQ ID NO: 3839017 - RNA, 17 nt, Human
ggaaaccuuccacccag

SEQ ID NO: 3839018 - RNA, 18 nt, Human
ggaaaccuuccacccagu

SEQ ID NO: 3839019 - RNA, 22 nt, Human
ggaaacuaauaaaauauuuucu

SEQ ID NO: 3839020 - RNA, 16 nt, Human
ggaaacuagcuuacau

SEQ ID NO: 3839021 - RNA, 21 nt, Human
ggaaacucaccugcuggcccc

SEQ ID NO: 3839022 - RNA, 17 nt, Human
ggaaacuccugugacca

SEQ ID NO: 3839023 - RNA, 17 nt, Human
ggaaacuggaugagguc

SEQ ID NO: 3839024 - RNA, 18 nt, Human
ggaaacuggguuccugca

SEQ ID NO: 3839025 - RNA, 15 nt, Human
ggaaagaagagccgg

SEQ ID NO: 3839026 - RNA, 23 nt, Human
ggaaagaauuccuacaauauaua

SEQ ID NO: 3839027 - RNA, 20 nt, Human
ggaaagacuuuuccaacccu

SEQ ID NO: 3839028 - RNA, 16 nt, Human
ggaaagaguaggaaga

SEQ ID NO: 3839029 - RNA, 19 nt, Human
ggaaagcaaaggagauugg

SEQ ID NO: 3839030 - RNA, 15 nt, Human
ggaaagcaauaaaug

SEQ ID NO: 3839031 - RNA, 12 nt, Human
ggaaagcacaga

SEQ ID NO: 3839032 - RNA, 17 nt, Human
ggaaagcacaggugggc

SEQ ID NO: 3839033 - RNA, 19 nt, Human
ggaaagccagugacuccag

SEQ ID NO: 3839034 - RNA, 14 nt, Human
ggaaagccucugcu

SEQ ID NO: 3839035 - RNA, 19 nt, Human
ggaaagcgccuccaacccu

SEQ ID NO: 3839036 - RNA, 23 nt, Human
ggaaagcucagcuacugauuuuu

SEQ ID NO: 3839037 - RNA, 13 nt, Human
ggaaaggaaugca

SEQ ID NO: 3839038 - RNA, 21 nt, Human
ggaaaggagccuaggccaggu

SEQ ID NO: 3839039 - RNA, 18 nt, Human
ggaaaggcaaaugcccaa

SEQ ID NO: 3839040 - RNA, 18 nt, Human
ggaaaggccagcuggcag

SEQ ID NO: 3839041 - RNA, 23 nt, Human
ggaaaggcucagucucaggagca

SEQ ID NO: 3839042 - RNA, 17 nt, Human
ggaaaggcuccaggagc

SEQ ID NO: 3839043 - RNA, 20 nt, Human
ggaaaggcuccaggagcagc

SEQ ID NO: 3839044 - RNA, 12 nt, Human
ggaaagggagga

SEQ ID NO: 3839045 - RNA, 12 nt, Human
ggaaaggggaga

SEQ ID NO: 3839046 - RNA, 14 nt, Human
ggaaaggggagagc

SEQ ID NO: 3839047 - RNA, 21 nt, Human
ggaaaggggcaggccagagcu

SEQ ID NO: 3839048 - RNA, 14 nt, Human
ggaaaggggggagc

SEQ ID NO: 3839049 - RNA, 22 nt, Human
ggaaagggggucccagugggag

SEQ ID NO: 3839050 - RNA, 21 nt, Human
ggaaagggguuggggugacag

SEQ ID NO: 3839051 - RNA, 20 nt, Human
ggaaagggugcugcuucccu

SEQ ID NO: 3839052 - RNA, 20 nt, Human
ggaaaggugugagacuggga

SEQ ID NO: 3839053 - RNA, 21 nt, Human
ggaaaguacauuuuuugaaau

SEQ ID NO: 3839054 - RNA, 18 nt, Human
ggaaagugaauuugaaug

SEQ ID NO: 3839055 - RNA, 16 nt, Human
ggaaaguguaaagcau

SEQ ID NO: 3839056 - RNA, 19 nt, Human
ggaaaguguaaagcauucc

SEQ ID NO: 3839057 - RNA, 21 nt, Human
ggaaaguuuacccaugaagau

SEQ ID NO: 3839058 - RNA, 14 nt, Human
ggaaaguuucuuug

SEQ ID NO: 3839059 - RNA, 22 nt, Human
ggaaauaaaaaagucucuauuu

SEQ ID NO: 3839060 - RNA, 19 nt, Human
ggaaauaaaaccuuucaaa

SEQ ID NO: 3839061 - RNA, 20 nt, Human
ggaaauaauaaagaugcucu

SEQ ID NO: 3839062 - RNA, 16 nt, Human
ggaaauaccaguucug

SEQ ID NO: 3839063 - RNA, 23 nt, Human
ggaaauaggcccaaccaccagau

SEQ ID NO: 3839064 - RNA, 23 nt, Human
ggaaauauauacaaaaagaaaau

SEQ ID NO: 3839065 - RNA, 20 nt, Human
ggaaauauuuagcaaauaau

SEQ ID NO: 3839066 - RNA, 13 nt, Human
ggaaauauuuauu

SEQ ID NO: 3839067 - RNA, 20 nt, Human
ggaaauauuuugauaauaaa

SEQ ID NO: 3839068 - RNA, 16 nt, Human
ggaaaucaaauaugca

SEQ ID NO: 3839069 - RNA, 18 nt, Human
ggaaaucaaauguaaagu

SEQ ID NO: 3839070 - RNA, 14 nt, Human
ggaaaucaccgaaa

SEQ ID NO: 3839071 - RNA, 23 nt, Human
ggaaaucagccaaguuuuauaau

SEQ ID NO: 3839072 - RNA, 19 nt, Human
ggaaaucaggguuaguauu

SEQ ID NO: 3839073 - RNA, 16 nt, Human
ggaaauccaggguggu

SEQ ID NO: 3839074 - RNA, 15 nt, Human
ggaaaucccuucaua

SEQ ID NO: 3839075 - RNA, 20 nt, Human
ggaaauccuaguuuccucuc

SEQ ID NO: 3839076 - RNA, 22 nt, Human
ggaaauccuaguuuccucuccu

SEQ ID NO: 3839077 - RNA, 18 nt, Human
ggaaaucucaccccaucc

SEQ ID NO: 3839078 - RNA, 13 nt, Human
ggaaaucuuaaac

SEQ ID NO: 3839079 - RNA, 16 nt, Human
ggaaaugaaugugugu

SEQ ID NO: 3839080 - RNA, 14 nt, Human
ggaaaugcugauuu

SEQ ID NO: 3839081 - RNA, 15 nt, Human
ggaaaugcugggcug

SEQ ID NO: 3839082 - RNA, 14 nt, Human
ggaaaugggcagag

SEQ ID NO: 3839083 - RNA, 17 nt, Human
ggaaaugggcagagcag

SEQ ID NO: 3839084 - RNA, 18 nt, Human
ggaaaugguauccagaau

SEQ ID NO: 3839085 - RNA, 18 nt, Human
ggaaaugucacagaagca

SEQ ID NO: 3839086 - RNA, 20 nt, Human
ggaaauguuuucauauuuuu

SEQ ID NO: 3839087 - RNA, 20 nt, Human
ggaaauuagguugaaacaua

SEQ ID NO: 3839088 - RNA, 23 nt, Human
ggaaauucaggugaaaauguuca

SEQ ID NO: 3839089 - RNA, 22 nt, Human
ggaaauucccuucaucuggaac

SEQ ID NO: 3839090 - RNA, 14 nt, Human
ggaaauuuagcauu

SEQ ID NO: 3839091 - RNA, 15 nt, Human
ggaacaaacagggcu

SEQ ID NO: 3839092 - RNA, 13 nt, Human
ggaacaaaucuuc

SEQ ID NO: 3839093 - RNA, 15 nt, Human
ggaacaaauuauuuu

SEQ ID NO: 3839094 - RNA, 17 nt, Human
gcugccagcucuguauc

SEQ ID NO: 3839095 - RNA, 17 nt, Human
gcugccaggccugggac

SEQ ID NO: 3839096 - RNA, 10 nt, Human
gcugccagua

SEQ ID NO: 3839097 - RNA, 15 nt, Human
gcugccaguaccagc

SEQ ID NO: 3839098 - RNA, 17 nt, Human
gcugccaguaccagccc

SEQ ID NO: 3839099 - RNA, 13 nt, Human
gcugccagugccu

SEQ ID NO: 3839100 - RNA, 18 nt, Human
gcugccaguguccugagc

SEQ ID NO: 3839101 - RNA, 19 nt, Human
gcugccaguguccugagcc

SEQ ID NO: 3839102 - RNA, 21 nt, Human
gcugccauccagguucagcuu

SEQ ID NO: 3839103 - RNA, 23 nt, Human
gcugccaucucaccuccugcugg

SEQ ID NO: 3839104 - RNA, 23 nt, Human
gcugccauggcgugucccucucg

SEQ ID NO: 3839105 - RNA, 17 nt, Human
gcugccaugugaagagg

SEQ ID NO: 3839106 - RNA, 17 nt, Human
gcugcccacacacccca

SEQ ID NO: 3839107 - RNA, 17 nt, Human
gcugcccacagcaggcc

SEQ ID NO: 3839108 - RNA, 23 nt, Human
gcugcccacuguuucucuugagc

SEQ ID NO: 3839109 - RNA, 19 nt, Human
gcugcccaggggagcccuc

SEQ ID NO: 3839110 - RNA, 19 nt, Human
gcugcccaucauguggccc

SEQ ID NO: 3839111 - RNA, 17 nt, Human
gcugccccaaccugcug

SEQ ID NO: 3839112 - RNA, 23 nt, Human
gcugccccaugaagccacagccc

SEQ ID NO: 3839113 - RNA, 15 nt, Human
gcugcccccaccccg

SEQ ID NO: 3839114 - RNA, 15 nt, Human
gcugcccccaccucu

SEQ ID NO: 3839115 - RNA, 21 nt, Human
gcugcccccagagccacaguu

SEQ ID NO: 3839116 - RNA, 15 nt, Human
gcugccccggccccu

SEQ ID NO: 3839117 - RNA, 22 nt, Human
gcugccccucccugccagcacc

SEQ ID NO: 3839118 - RNA, 12 nt, Human
gcugccccucuc

SEQ ID NO: 3839119 - RNA, 13 nt, Human
gcugccccucuca

SEQ ID NO: 3839120 - RNA, 14 nt, Human
gcugccccucucac

SEQ ID NO: 3839121 - RNA, 16 nt, Human
gcugccccucucacca

SEQ ID NO: 3839122 - RNA, 18 nt, Human
gcugccccucucaccaaa

SEQ ID NO: 3839123 - RNA, 16 nt, Human
gcugccccugcacagc

SEQ ID NO: 3839124 - RNA, 20 nt, Human
gcugccccugcacagcaggc

SEQ ID NO: 3839125 - RNA, 13 nt, Human
gcugccccugccu

SEQ ID NO: 3839126 - RNA, 14 nt, Human
gcugccccugccuu

SEQ ID NO: 3839127 - RNA, 17 nt, Human
gcugccccuggcagccc

SEQ ID NO: 3839128 - RNA, 18 nt, Human
gcugccccuggcagcccc

SEQ ID NO: 3839129 - RNA, 15 nt, Human
gcugcccgcucccag

SEQ ID NO: 3839130 - RNA, 17 nt, Human
gcugcccggcgcccucu

SEQ ID NO: 3839131 - RNA, 23 nt, Human
gcugcccggcgcccucuguccug

SEQ ID NO: 3839132 - RNA, 21 nt, Human
gcugcccgucuucagccuagc

SEQ ID NO: 3839133 - RNA, 20 nt, Human
gcugcccuaguuuucuuucc

SEQ ID NO: 3839134 - RNA, 16 nt, Human
gcugcccuaugggccu

SEQ ID NO: 3839135 - RNA, 15 nt, Human
gcugcccuccauccc

SEQ ID NO: 3839136 - RNA, 23 nt, Human
gcugcccuccccuccggacuggu

SEQ ID NO: 3839137 - RNA, 12 nt, Human
gcugcccuccug

SEQ ID NO: 3839138 - RNA, 13 nt, Human
gcugcccucuccu

SEQ ID NO: 3839139 - RNA, 17 nt, Human
gcugcccucuccugggc

SEQ ID NO: 3839140 - RNA, 22 nt, Human
gcugcccucuccugggcagcug

SEQ ID NO: 3839141 - RNA, 13 nt, Human
gcugcccugagaa

SEQ ID NO: 3839142 - RNA, 13 nt, Human
gcugcccugccca

SEQ ID NO: 3839143 - RNA, 16 nt, Human
gcugcccugcccaccu

SEQ ID NO: 3839144 - RNA, 20 nt, Human
gcugcccugcccaccuggcc

SEQ ID NO: 3839145 - RNA, 21 nt, Human
gcugcccugcccaccuggccu

SEQ ID NO: 3839146 - RNA, 23 nt, Human
gcugcccugcccaccuggccucu

SEQ ID NO: 3839147 - RNA, 14 nt, Human
gcugcccugcccca

SEQ ID NO: 3839148 - RNA, 15 nt, Human
gcugcccugcggccc

SEQ ID NO: 3839149 - RNA, 14 nt, Human
gcugcccuggcccu

SEQ ID NO: 3839150 - RNA, 16 nt, Human
gcugcccuggcccuga

SEQ ID NO: 3839151 - RNA, 17 nt, Human
gcugcccuggcccugag

SEQ ID NO: 3839152 - RNA, 12 nt, Human
gcugcccuggug

SEQ ID NO: 3839153 - RNA, 14 nt, Human
gcugcccuggugcu

SEQ ID NO: 3839154 - RNA, 18 nt, Human
gcugcccuggugcugcca

SEQ ID NO: 3839155 - RNA, 18 nt, Human
gcugcccuguaccccagc

SEQ ID NO: 3839156 - RNA, 11 nt, Human
gcugcccugug

SEQ ID NO: 3839157 - RNA, 18 nt, Human
gcugcccuugggccaccc

SEQ ID NO: 3839158 - RNA, 22 nt, Human
gcugccgcaccccagagugugg

SEQ ID NO: 3839159 - RNA, 17 nt, Human
gcugccgccccacccag

SEQ ID NO: 3839160 - RNA, 19 nt, Human
gcugccgccucccagccug

SEQ ID NO: 3839161 - RNA, 16 nt, Human
gcugccgcgcagugug

SEQ ID NO: 3839162 - RNA, 19 nt, Human
gcugccgggccugauuugg

SEQ ID NO: 3839163 - RNA, 17 nt, Human
gcugccggggcagcccc

SEQ ID NO: 3839164 - RNA, 13 nt, Human
gcugccguggggc

SEQ ID NO: 3839165 - RNA, 15 nt, Human
gcugccuaagaggca

SEQ ID NO: 3839166 - RNA, 17 nt, Human
gcugccuaaguggcugc

SEQ ID NO: 3839167 - RNA, 22 nt, Human
gcugccuagcaagcuggccucu

SEQ ID NO: 3839168 - RNA, 21 nt, Human
gcugccucauuuagagaggaa

SEQ ID NO: 3839169 - RNA, 12 nt, Human
gcugccuccacu

SEQ ID NO: 3839170 - RNA, 21 nt, Human
gcugccuccacucccacuucc

SEQ ID NO: 3839171 - RNA, 12 nt, Human
gcugccucccaa

SEQ ID NO: 3839172 - RNA, 13 nt, Human
gcugccuccccaa

SEQ ID NO: 3839173 - RNA, 21 nt, Human
gcugccuccccaacccugccc

SEQ ID NO: 3839174 - RNA, 23 nt, Human
gcugccuccccaacccugccccu

SEQ ID NO: 3839175 - RNA, 16 nt, Human
gcugccuccccuccuc

SEQ ID NO: 3839176 - RNA, 17 nt, Human
gcugccuccccuccucu

SEQ ID NO: 3839177 - RNA, 21 nt, Human
gcugccuccccuccucugcuu

SEQ ID NO: 3839178 - RNA, 22 nt, Human
gcugccuccccuccucugcuug

SEQ ID NO: 3839179 - RNA, 21 nt, Human
gcugccuccccucuccuuccu

SEQ ID NO: 3839180 - RNA, 18 nt, Human
gcugccucccucugcugu

SEQ ID NO: 3839181 - RNA, 21 nt, Human
gcugccucccuuguggcagca

SEQ ID NO: 3839182 - RNA, 16 nt, Human
gcugccucucccauca

SEQ ID NO: 3839183 - RNA, 13 nt, Human
gcugccucuucug

SEQ ID NO: 3839184 - RNA, 15 nt, Human
gcugccugagcaccu

SEQ ID NO: 3839185 - RNA, 22 nt, Human
gcugccugagucgugaccugcu

SEQ ID NO: 3839186 - RNA, 13 nt, Human
gcugccugcccac

SEQ ID NO: 3839187 - RNA, 15 nt, Human
gcugccugcccacac

SEQ ID NO: 3839188 - RNA, 18 nt, Human
gcugccugcccacacagg

SEQ ID NO: 3839189 - RNA, 13 nt, Human
gcugccugccccu

SEQ ID NO: 3839190 - RNA, 20 nt, Human
gcugccugcccgcacagcag

SEQ ID NO: 3839191 - RNA, 14 nt, Human
gcugccugccuguc

SEQ ID NO: 3839192 - RNA, 12 nt, Human
gcugccuggacc

SEQ ID NO: 3839193 - RNA, 14 nt, Human
gcugccuggacccg

SEQ ID NO: 3839194 - RNA, 13 nt, Human
gcugccuggagcc

SEQ ID NO: 3839195 - RNA, 14 nt, Human
gcugccuggagccc

SEQ ID NO: 3839196 - RNA, 16 nt, Human
gcugccugggaucccu

SEQ ID NO: 3839197 - RNA, 19 nt, Human
gcugccugggaucccucau

SEQ ID NO: 3839198 - RNA, 21 nt, Human
gcugccugggaucccucaucc

SEQ ID NO: 3839199 - RNA, 12 nt, Human
gcugccugggcu

SEQ ID NO: 3839200 - RNA, 13 nt, Human
gcugccugggcug

SEQ ID NO: 3839201 - RNA, 20 nt, Human
gcugccuguaguuaggaaau

SEQ ID NO: 3839202 - RNA, 18 nt, Human
gcugccuguucagcucca

SEQ ID NO: 3839203 - RNA, 19 nt, Human
gcugccuguucagcuccag

SEQ ID NO: 3839204 - RNA, 22 nt, Human
gcugccuguucagcuccagcuc

SEQ ID NO: 3839205 - RNA, 16 nt, Human
gcugccuucccuagcu

SEQ ID NO: 3839206 - RNA, 20 nt, Human
gcugccuucugacggcccug

SEQ ID NO: 3839207 - RNA, 21 nt, Human
gcugccuucugacggcccugc

SEQ ID NO: 3839208 - RNA, 17 nt, Human
gcugccuucuggauucu

SEQ ID NO: 3839209 - RNA, 16 nt, Human
gcugccuuggcucaga

SEQ ID NO: 3839210 - RNA, 18 nt, Human
gcugcgacgcuugcucug

SEQ ID NO: 3839211 - RNA, 14 nt, Human
gcugcgcacugugu

SEQ ID NO: 3839212 - RNA, 16 nt, Human
gcugcgcuugcuuuuc

SEQ ID NO: 3839213 - RNA, 14 nt, Human
gcugcggcacccuu

SEQ ID NO: 3839214 - RNA, 16 nt, Human
gcugcgguccacccag

SEQ ID NO: 3839215 - RNA, 14 nt, Human
gcugcgugccugug

SEQ ID NO: 3839216 - RNA, 18 nt, Human
gcugcuaauauuuuccuc

SEQ ID NO: 3839217 - RNA, 21 nt, Human
gcugcuaauauuuuccuccug

SEQ ID NO: 3839218 - RNA, 24 nt, Human
gcugcuaauauuuuccuccugagu

SEQ ID NO: 3839219 - RNA, 16 nt, Human
gcugcuacccucccug

SEQ ID NO: 3839220 - RNA, 22 nt, Human
gcugcuacccucccugcugucc

SEQ ID NO: 3839221 - RNA, 12 nt, Human
gcugcuagaacu

SEQ ID NO: 3839222 - RNA, 15 nt, Human
gcugcuagaacuuuu

SEQ ID NO: 3839223 - RNA, 17 nt, Human
gcugcuagaacuuuuuu

SEQ ID NO: 3839224 - RNA, 13 nt, Human
gcugcuagaguga

SEQ ID NO: 3839225 - RNA, 20 nt, Human
gcugcuagcacuuggagcca

SEQ ID NO: 3839226 - RNA, 23 nt, Human
gcugcuagcacuuggagccaagg

SEQ ID NO: 3839227 - RNA, 16 nt, Human
gcugcuauagccuggg

SEQ ID NO: 3839228 - RNA, 21 nt, Human
gcugcuauccccaucucccug

SEQ ID NO: 3839229 - RNA, 23 nt, Human
gcugcucacuaccuccucaggga

SEQ ID NO: 3839230 - RNA, 21 nt, Human
gcugcucagggaaaagcagcu

SEQ ID NO: 3839231 - RNA, 23 nt, Human
gcugcuccaggccugcagcagga

SEQ ID NO: 3839232 - RNA, 24 nt, Human
gcugcucccaccuggcucuguggc

SEQ ID NO: 3839233 - RNA, 22 nt, Human
gcugcuccccacgucagcuggg

SEQ ID NO: 3839234 - RNA, 20 nt, Human
gcugcuccccucccuccucu

SEQ ID NO: 3839235 - RNA, 12 nt, Human
gcugcucccuca

SEQ ID NO: 3839236 - RNA, 14 nt, Human
gcugcucccucaga

SEQ ID NO: 3839237 - RNA, 15 nt, Human
gcugcuccuagaggg

SEQ ID NO: 3839238 - RNA, 16 nt, Human
gcugcuccuagaggga

SEQ ID NO: 3839239 - RNA, 22 nt, Human
cuuguguauccauuaucaugug

SEQ ID NO: 3839240 - RNA, 23 nt, Human
cuuguguauccauuaucaugugu

SEQ ID NO: 3839241 - RNA, 14 nt, Human
cuugugucccauga

SEQ ID NO: 3839242 - RNA, 18 nt, Human
cuugugucucugugcuuu

SEQ ID NO: 3839243 - RNA, 13 nt, Human
cuugugucugcgu

SEQ ID NO: 3839244 - RNA, 18 nt, Human
cuugugucuguacacgug

SEQ ID NO: 3839245 - RNA, 23 nt, Human
cuugugucuuuggaggugcugcu

SEQ ID NO: 3839246 - RNA, 20 nt, Human
cuugugugugggcugugagu

SEQ ID NO: 3839247 - RNA, 21 nt, Human
cuugugugugggcugugagug

SEQ ID NO: 3839248 - RNA, 21 nt, Human
cuuguguguuuauugucaaag

SEQ ID NO: 3839249 - RNA, 17 nt, Human
cuuguguguuucacuuu

SEQ ID NO: 3839250 - RNA, 14 nt, Human
cuuguguuggcugu

SEQ ID NO: 3839251 - RNA, 20 nt, Human
cuuguguuguccuuuugucu

SEQ ID NO: 3839252 - RNA, 13 nt, Human
cuuguuaauauuc

SEQ ID NO: 3839253 - RNA, 17 nt, Human
cuuguuaaugcuuucug

SEQ ID NO: 3839254 - RNA, 17 nt, Human
cuuguuacccaugaaaa

SEQ ID NO: 3839255 - RNA, 18 nt, Human
cuuguuacccaugaaaaa

SEQ ID NO: 3839256 - RNA, 19 nt, Human
cuuguuacccaugaaaaac

SEQ ID NO: 3839257 - RNA, 15 nt, Human
cuuguuacuucugag

SEQ ID NO: 3839258 - RNA, 13 nt, Human
cuuguuagaaaac

SEQ ID NO: 3839259 - RNA, 13 nt, Human
cuuguuagaucua

SEQ ID NO: 3839260 - RNA, 22 nt, Human
cuuguuagaucuaguucacucu

SEQ ID NO: 3839261 - RNA, 16 nt, Human
cuuguuauugugaaug

SEQ ID NO: 3839262 - RNA, 15 nt, Human
cuuguuauuuauaac

SEQ ID NO: 3839263 - RNA, 20 nt, Human
cuuguucaaaauauguucuu

SEQ ID NO: 3839264 - RNA, 16 nt, Human
cuuguucaucauccag

SEQ ID NO: 3839265 - RNA, 17 nt, Human
cuuguuccaaggccagg

SEQ ID NO: 3839266 - RNA, 18 nt, Human
cuuguuccaaugccacau

SEQ ID NO: 3839267 - RNA, 16 nt, Human
cuuguuccagcucuuu

SEQ ID NO: 3839268 - RNA, 22 nt, Human
cuuguucucucuaugguaaaga

SEQ ID NO: 3839269 - RNA, 16 nt, Human
cuuguucugagauuca

SEQ ID NO: 3839270 - RNA, 12 nt, Human
cuuguucuguca

SEQ ID NO: 3839271 - RNA, 12 nt, Human
cuuguucuguuu

SEQ ID NO: 3839272 - RNA, 13 nt, Human
cuuguucuguuuu

SEQ ID NO: 3839273 - RNA, 16 nt, Human
cuuguucuguuuuguu

SEQ ID NO: 3839274 - RNA, 14 nt, Human
cuuguucuuacuuu

SEQ ID NO: 3839275 - RNA, 21 nt, Human
cuuguugacacggccaugacc

SEQ ID NO: 3839276 - RNA, 19 nt, Human
cuuguugagccgugggcaa

SEQ ID NO: 3839277 - RNA, 19 nt, Human
cuuguugcaugauguauuu

SEQ ID NO: 3839278 - RNA, 20 nt, Human
cuuguugcucaaaaaaugag

SEQ ID NO: 3839279 - RNA, 21 nt, Human
cuuguugcuuuguugcacuga

SEQ ID NO: 3839280 - RNA, 14 nt, Human
cuuguuggagccug

SEQ ID NO: 3839281 - RNA, 22 nt, Human
cuuguuggcguaggcuacagag

SEQ ID NO: 3839282 - RNA, 20 nt, Human
cuuguugggauuccugaccc

SEQ ID NO: 3839283 - RNA, 17 nt, Human
cuuguuguaaagcaaua

SEQ ID NO: 3839284 - RNA, 15 nt, Human
cuuguugugcuuuua

SEQ ID NO: 3839285 - RNA, 17 nt, Human
cuuguugugcuuuuagu

SEQ ID NO: 3839286 - RNA, 16 nt, Human
cuuguuguuuuacuaa

SEQ ID NO: 3839287 - RNA, 16 nt, Human
cuuguuuacaugcuua

SEQ ID NO: 3839288 - RNA, 21 nt, Human
cuuguuuacaugcuuauucca

SEQ ID NO: 3839289 - RNA, 19 nt, Human
cuuguuuauugaguuugua

SEQ ID NO: 3839290 - RNA, 13 nt, Human
cuuguuucauauu

SEQ ID NO: 3839291 - RNA, 12 nt, Human
cuuguuucuugg

SEQ ID NO: 3839292 - RNA, 14 nt, Human
cuuguuucuuuuca

SEQ ID NO: 3839293 - RNA, 23 nt, Human
cuuguuugauuuuagcugcagaa

SEQ ID NO: 3839294 - RNA, 17 nt, Human
cuuguuugcuucaacug

SEQ ID NO: 3839295 - RNA, 17 nt, Human
cuuguuuggggcaggag

SEQ ID NO: 3839296 - RNA, 22 nt, Human
cuuguuuuauaaaauuuugcuu

SEQ ID NO: 3839297 - RNA, 14 nt, Human
cuuguuuucaguuu

SEQ ID NO: 3839298 - RNA, 20 nt, Human
cuuguuuucuuucuuuaaau

SEQ ID NO: 3839299 - RNA, 21 nt, Human
cuuguuuucuuucuuuaaaug

SEQ ID NO: 3839300 - RNA, 17 nt, Human
cuuguuuugcuuccccu

SEQ ID NO: 3839301 - RNA, 13 nt, Human
cuuguuuuggaug

SEQ ID NO: 3839302 - RNA, 14 nt, Human
cuuguuuuggaugc

SEQ ID NO: 3839303 - RNA, 21 nt, Human
cuuguuuuggauggcuugucu

SEQ ID NO: 3839304 - RNA, 13 nt, Human
cuuguuuuguuug

SEQ ID NO: 3839305 - RNA, 22 nt, Human
cuuguuuuguuugucucuccuu

SEQ ID NO: 3839306 - RNA, 23 nt, Human
cuuguuuuguuugucucuccuuu

SEQ ID NO: 3839307 - RNA, 20 nt, Human
cuuguuuuuauuaauuuaua

SEQ ID NO: 3839308 - RNA, 18 nt, Human
cuuguuuuuccacuacug

SEQ ID NO: 3839309 - RNA, 12 nt, Human
cuuguuuuugca

SEQ ID NO: 3839310 - RNA, 21 nt, Human
cuuguuuuuguaaagaaaaau

SEQ ID NO: 3839311 - RNA, 19 nt, Human
cuuguuuuuuuuuuccacu

SEQ ID NO: 3839312 - RNA, 21 nt, Human
cuuguuuuuuuuuuccacuua

SEQ ID NO: 3839313 - RNA, 20 nt, Human
cuuuaaaaaaaaaaguuaca

SEQ ID NO: 3839314 - RNA, 20 nt, Human
cuuuaaaaaaaauccuucua

SEQ ID NO: 3839315 - RNA, 22 nt, Human
cuuuaaaaaagcuauaaauuau

SEQ ID NO: 3839316 - RNA, 19 nt, Human
cuuuaaaaaauauuuauua

SEQ ID NO: 3839317 - RNA, 14 nt, Human
cuuuaaaaacuguu

SEQ ID NO: 3839318 - RNA, 16 nt, Human
cuuuaaaaaugucuua

SEQ ID NO: 3839319 - RNA, 12 nt, Human
cuuuaaaagaau

SEQ ID NO: 3839320 - RNA, 16 nt, Human
cuuuaaaagagagaga

SEQ ID NO: 3839321 - RNA, 21 nt, Human
cuuuaaaagagagagagagaa

SEQ ID NO: 3839322 - RNA, 17 nt, Human
cuuuaaaaggaaagaaa

SEQ ID NO: 3839323 - RNA, 18 nt, Human
cuuuaaaaggaaagaaaa

SEQ ID NO: 3839324 - RNA, 17 nt, Human
cuuuaaaauaucuacau

SEQ ID NO: 3839325 - RNA, 20 nt, Human
cuuuaaaauuacaacuaagu

SEQ ID NO: 3839326 - RNA, 23 nt, Human
cuuuaaaauuuuuuuagaaagca

SEQ ID NO: 3839327 - RNA, 18 nt, Human
cuuuaaacaguauuucau

SEQ ID NO: 3839328 - RNA, 13 nt, Human
cuuuaaacucagg

SEQ ID NO: 3839329 - RNA, 20 nt, Human
cuuuaaacugucgugucaua

SEQ ID NO: 3839330 - RNA, 20 nt, Human
cuuuaaagaugaacucugaa

SEQ ID NO: 3839331 - RNA, 18 nt, Human
cuuuaaaggaaaaaaugu

SEQ ID NO: 3839332 - RNA, 14 nt, Human
cuuuaaaggcccag

SEQ ID NO: 3839333 - RNA, 15 nt, Human
cuuuaaaggcccagc

SEQ ID NO: 3839334 - RNA, 18 nt, Human
cuuuaaaggcccagcccc

SEQ ID NO: 3839335 - RNA, 19 nt, Human
cuuuaaaggcccagccccu

SEQ ID NO: 3839336 - RNA, 20 nt, Human
cuuuaaagggauggcaagau

SEQ ID NO: 3839337 - RNA, 22 nt, Human
cuuuaaaguaugaaucuaugcc

SEQ ID NO: 3839338 - RNA, 21 nt, Human
cuuuaaaguguaauaauauga

SEQ ID NO: 3839339 - RNA, 15 nt, Human
cuuuaaauaauuuaa

SEQ ID NO: 3839340 - RNA, 16 nt, Human
cuuuaaauaauuuaac

SEQ ID NO: 3839341 - RNA, 18 nt, Human
cuuuaaauaauuuaacua

SEQ ID NO: 3839342 - RNA, 15 nt, Human
cuuuaaaugcugcuu

SEQ ID NO: 3839343 - RNA, 11 nt, Human
cuuuaaauguu

SEQ ID NO: 3839344 - RNA, 13 nt, Human
cuuuaaauugugu

SEQ ID NO: 3839345 - RNA, 15 nt, Human
cuuuaacaacauguu

SEQ ID NO: 3839346 - RNA, 22 nt, Human
cuuuaacaacauguuuccagca

SEQ ID NO: 3839347 - RNA, 17 nt, Human
cuuuaaccagucugaag

SEQ ID NO: 3839348 - RNA, 17 nt, Human
cuuuaaccuuguauaaa

SEQ ID NO: 3839349 - RNA, 18 nt, Human
cuuuaaccuuguauaaau

SEQ ID NO: 3839350 - RNA, 14 nt, Human
gcuucaguggagaa

SEQ ID NO: 3839351 - RNA, 14 nt, Human
gcuucaguggcagc

SEQ ID NO: 3839352 - RNA, 16 nt, Human
gcuucaguggcagcug

SEQ ID NO: 3839353 - RNA, 20 nt, Human
gcuucaguggcagcugcuuu

SEQ ID NO: 3839354 - RNA, 15 nt, Human
gcuucaguugcuugu

SEQ ID NO: 3839355 - RNA, 18 nt, Human
gcuucaguuguuuucccg

SEQ ID NO: 3839356 - RNA, 22 nt, Human
gcuucauaaaugaagcagcuuu

SEQ ID NO: 3839357 - RNA, 10 nt, Human
gcuucauaca

SEQ ID NO: 3839358 - RNA, 11 nt, Human
gcuucauacag

SEQ ID NO: 3839359 - RNA, 17 nt, Human
gcuucauagagacuugg

SEQ ID NO: 3839360 - RNA, 12 nt, Human
gcuucauccucc

SEQ ID NO: 3839361 - RNA, 15 nt, Human
gcuucauccuccuca

SEQ ID NO: 3839362 - RNA, 16 nt, Human
gcuucaugacauuccu

SEQ ID NO: 3839363 - RNA, 15 nt, Human
gcuucaugccuuugu

SEQ ID NO: 3839364 - RNA, 16 nt, Human
gcuucaugccuuugua

SEQ ID NO: 3839365 - RNA, 18 nt, Human
gcuucaugcucagcccug

SEQ ID NO: 3839366 - RNA, 17 nt, Human
gcuucauggcagaaggc

SEQ ID NO: 3839367 - RNA, 16 nt, Human
gcuucaugugucccag

SEQ ID NO: 3839368 - RNA, 22 nt, Human
gcuucauguucccaaaaucacc

SEQ ID NO: 3839369 - RNA, 16 nt, Human
gcuucauuagagcagg

SEQ ID NO: 3839370 - RNA, 17 nt, Human
gcuucauuagagcaggc

SEQ ID NO: 3839371 - RNA, 15 nt, Human
gcuucauucuccuug

SEQ ID NO: 3839372 - RNA, 10 nt, Human
gcuucauugu

SEQ ID NO: 3839373 - RNA, 15 nt, Human
gcuuccaaauauugu

SEQ ID NO: 3839374 - RNA, 21 nt, Human
gcuuccaaggcagaagcagca

SEQ ID NO: 3839375 - RNA, 12 nt, Human
gcuuccaauuuu

SEQ ID NO: 3839376 - RNA, 14 nt, Human
gcuuccaccucacc

SEQ ID NO: 3839377 - RNA, 17 nt, Human
gcuuccaccucacccca

SEQ ID NO: 3839378 - RNA, 19 nt, Human
gcuuccaccucaccccacu

SEQ ID NO: 3839379 - RNA, 21 nt, Human
gcuuccacguacugcagccuc

SEQ ID NO: 3839380 - RNA, 20 nt, Human
gcuuccagagaguccucugg

SEQ ID NO: 3839381 - RNA, 14 nt, Human
gcuuccagcaggag

SEQ ID NO: 3839382 - RNA, 21 nt, Human
gcuuccagguaucuccaggau

SEQ ID NO: 3839383 - RNA, 23 nt, Human
gcuuccaucccaaccagugccaa

SEQ ID NO: 3839384 - RNA, 15 nt, Human
gcuugccugcagggc

SEQ ID NO: 3839385 - RNA, 16 nt, Human
gcuugccugcagggcc

SEQ ID NO: 3839386 - RNA, 16 nt, Human
gcuugccugccugcuc

SEQ ID NO: 3839387 - RNA, 18 nt, Human
gcuugcggcaaaaggaaa

SEQ ID NO: 3839388 - RNA, 16 nt, Human
gcuugcuaauuauuuu

SEQ ID NO: 3839389 - RNA, 14 nt, Human
gcuugcucauuuuu

SEQ ID NO: 3839390 - RNA, 19 nt, Human
gcuugcucuguuugugggg

SEQ ID NO: 3839391 - RNA, 21 nt, Human
gcuugcugcaccccaagucca

SEQ ID NO: 3839392 - RNA, 14 nt, Human
gcuugcuucaaccc

SEQ ID NO: 3839393 - RNA, 15 nt, Human
gcuuggaagagccug

SEQ ID NO: 3839394 - RNA, 16 nt, Human
gcuuggaccagaucua

SEQ ID NO: 3839395 - RNA, 14 nt, Human
gcuuggagcagagg

SEQ ID NO: 3839396 - RNA, 18 nt, Human
gcuuggagcagaggggcu

SEQ ID NO: 3839397 - RNA, 18 nt, Human
gcuuggccacagccaggg

SEQ ID NO: 3839398 - RNA, 18 nt, Human
gcuuggccagaagggggc

SEQ ID NO: 3839399 - RNA, 13 nt, Human
gcuuggcccagga

SEQ ID NO: 3839400 - RNA, 14 nt, Human
gcuuggcccaggag

SEQ ID NO: 3839401 - RNA, 15 nt, Human
gcuuggcccaggagu

SEQ ID NO: 3839402 - RNA, 12 nt, Human
gcuuggcccugg

SEQ ID NO: 3839403 - RNA, 15 nt, Human
gcuuggcccuggcag

SEQ ID NO: 3839404 - RNA, 16 nt, Human
gcuuggccuaucuccu

SEQ ID NO: 3839405 - RNA, 19 nt, Human
gcuuggcguggagcaggcg

SEQ ID NO: 3839406 - RNA, 22 nt, Human
gcuugggaaaggugguguuucu

SEQ ID NO: 3839407 - RNA, 14 nt, Human
gcuugggauuugcu

SEQ ID NO: 3839408 - RNA, 14 nt, Human
gcuugggcccagcu

SEQ ID NO: 3839409 - RNA, 19 nt, Human
gcuugggcccagcugggcu

SEQ ID NO: 3839410 - RNA, 18 nt, Human
gcuugggccuaggcugca

SEQ ID NO: 3839411 - RNA, 16 nt, Human
gcuugggcgccgugcu

SEQ ID NO: 3839412 - RNA, 16 nt, Human
gcuuggggaccagagc

SEQ ID NO: 3839413 - RNA, 20 nt, Human
gcuuggggaccagagcugcc

SEQ ID NO: 3839414 - RNA, 15 nt, Human
gcuuggggcaacauu

SEQ ID NO: 3839415 - RNA, 23 nt, Human
gcuuggggccaccaaagcugccc

SEQ ID NO: 3839416 - RNA, 16 nt, Human
gcuuggggcucacaca

SEQ ID NO: 3839417 - RNA, 20 nt, Human
gcuuggggcucacacaccug

SEQ ID NO: 3839418 - RNA, 17 nt, Human
gcuuggggcuggagagg

SEQ ID NO: 3839419 - RNA, 14 nt, Human
gcuuggggggugau

SEQ ID NO: 3839420 - RNA, 13 nt, Human
gcuuggguggaga

SEQ ID NO: 3839421 - RNA, 18 nt, Human
gcuuggguggagaagcca

SEQ ID NO: 3839422 - RNA, 21 nt, Human
gcuuggguguaacaggucucc

SEQ ID NO: 3839423 - RNA, 15 nt, Human
gcuugguucugugaa

SEQ ID NO: 3839424 - RNA, 13 nt, Human
gcuuguaaauacc

SEQ ID NO: 3839425 - RNA, 17 nt, Human
gcuuguaaauaccagga

SEQ ID NO: 3839426 - RNA, 17 nt, Human
gcuuguaaauagcucag

SEQ ID NO: 3839427 - RNA, 14 nt, Human
gcuuguaacaagaa

SEQ ID NO: 3839428 - RNA, 16 nt, Human
gcuuguaacaagaaaa

SEQ ID NO: 3839429 - RNA, 18 nt, Human
gcuuguaacaagaaaaca

SEQ ID NO: 3839430 - RNA, 16 nt, Human
gcuuguacauaaugcg

SEQ ID NO: 3839431 - RNA, 19 nt, Human
gcuuguaccacuuuugcaa

SEQ ID NO: 3839432 - RNA, 22 nt, Human
gcuuguaccucuggcugacuaa

SEQ ID NO: 3839433 - RNA, 22 nt, Human
gcuuguagaacucacucugggc

SEQ ID NO: 3839434 - RNA, 13 nt, Human
gcuuguaggagcu

SEQ ID NO: 3839435 - RNA, 17 nt, Human
gcuuguaucaacacugu

SEQ ID NO: 3839436 - RNA, 16 nt, Human
gcuugucauagccagu

SEQ ID NO: 3839437 - RNA, 16 nt, Human
gcuuguccagcgccua

SEQ ID NO: 3839438 - RNA, 19 nt, Human
gcuuguccccuccucacuc

SEQ ID NO: 3839439 - RNA, 12 nt, Human
gcuugugaacag

SEQ ID NO: 3839440 - RNA, 17 nt, Human
gcuugugaucugggaac

SEQ ID NO: 3839441 - RNA, 15 nt, Human
gcuugugcaacaaua

SEQ ID NO: 3839442 - RNA, 21 nt, Human
gcuugugcagaaaacauuguu

SEQ ID NO: 3839443 - RNA, 14 nt, Human
gcuuguggagcccc

SEQ ID NO: 3839444 - RNA, 19 nt, Human
gcuuguggagccccacacu

SEQ ID NO: 3839445 - RNA, 20 nt, Human
gcuuguggagccccacacug

SEQ ID NO: 3839446 - RNA, 18 nt, Human
gcuuguggcaagugaauu

SEQ ID NO: 3839447 - RNA, 13 nt, Human
gcuuguggcucca

SEQ ID NO: 3839448 - RNA, 17 nt, Human
gcuuguggggacccagg

SEQ ID NO: 3839449 - RNA, 21 nt, Human
gcuuguggggacccaggcucc

SEQ ID NO: 3839450 - RNA, 16 nt, Human
gcuuguggggccuggg

SEQ ID NO: 3839451 - RNA, 11 nt, Human
gcuuguguauc

SEQ ID NO: 3839452 - RNA, 21 nt, Human
gcuuguguguuucacuuuuag

SEQ ID NO: 3839453 - RNA, 12 nt, Human
gcuuguguuaag

SEQ ID NO: 3839454 - RNA, 17 nt, Human
gcuuguuauauuaagca

SEQ ID NO: 3839455 - RNA, 14 nt, Human
gcuuguuggauuuu

SEQ ID NO: 3839456 - RNA, 21 nt, Human
gcuuguugggauuccugaccc

SEQ ID NO: 3839457 - RNA, 23 nt, Human
gcuuguugggauuccugacccag

SEQ ID NO: 3839458 - RNA, 24 nt, Human
gcuuguugggauuccugacccagg

SEQ ID NO: 3839459 - RNA, 19 nt, Human
gcuuguuuacaugcuuauu

SEQ ID NO: 3839460 - RNA, 16 nt, Human
gcuuguuuaccuuucu

SEQ ID NO: 3839461 - RNA, 18 nt, Human
gcuuguuuaccuuucucu

SEQ ID NO: 3839462 - RNA, 23 nt, Human
gcuuguuuuauaaaauuuugcuu

SEQ ID NO: 3839463 - RNA, 14 nt, Human
gcuuguuuuccagu

SEQ ID NO: 3839464 - RNA, 20 nt, Human
gcuuuaaaaacuauuuaacu

SEQ ID NO: 3839465 - RNA, 23 nt, Human
gcuuuaaaaacuauuuaacuuga

SEQ ID NO: 3839466 - RNA, 21 nt, Human
gcuuuaaacucagggacagag

SEQ ID NO: 3839467 - RNA, 16 nt, Human
gcuuuaaaguguaaua

SEQ ID NO: 3839468 - RNA, 13 nt, Human
gcuuuaauauaaa

SEQ ID NO: 3839469 - RNA, 14 nt, Human
gcuuuaauauaaau

SEQ ID NO: 3839470 - RNA, 15 nt, Human
gcuuuaauauaaaug

SEQ ID NO: 3839471 - RNA, 19 nt, Human
gcuuuaauauaaaugcaaa

SEQ ID NO: 3839472 - RNA, 22 nt, Human
gcuuuaauaucaucaguauuga

SEQ ID NO: 3839473 - RNA, 13 nt, Human
gcuuuaaucagaa

SEQ ID NO: 3839474 - RNA, 14 nt, Human
gcuuuacaaaaaga

SEQ ID NO: 3839475 - RNA, 15 nt, Human
gcuuuacaaaaagac

SEQ ID NO: 3839476 - RNA, 12 nt, Human
gcuuuacacaca

SEQ ID NO: 3839477 - RNA, 21 nt, Human
gcuuuaccaaacagcaaacca

SEQ ID NO: 3839478 - RNA, 21 nt, Human
gcuuuaccuuuucagggcugg

SEQ ID NO: 3839479 - RNA, 22 nt, Human
gcuuuaccuuuucagggcuggc

SEQ ID NO: 3839480 - RNA, 16 nt, Human
gcuuuacuauuuuuau

SEQ ID NO: 3839481 - RNA, 16 nt, Human
gcuuuacuuagcuuau

SEQ ID NO: 3839482 - RNA, 12 nt, Human
gcuuuagaaaca

SEQ ID NO: 3839483 - RNA, 20 nt, Human
gcuuuagaaacagugcaaca

SEQ ID NO: 3839484 - RNA, 15 nt, Human
gcuuuagacccuggg

SEQ ID NO: 3839485 - RNA, 12 nt, Human
gcuuuagacuug

SEQ ID NO: 3839486 - RNA, 15 nt, Human
gcuuuagacuugaaa

SEQ ID NO: 3839487 - RNA, 11 nt, Human
gcuuuagagcu

SEQ ID NO: 3839488 - RNA, 14 nt, Human
gcuuuagagcuagg

SEQ ID NO: 3839489 - RNA, 23 nt, Human
gcuuuaguccuagaggaccugag

SEQ ID NO: 3839490 - RNA, 18 nt, Human
gcuuuauauauggacaug

SEQ ID NO: 3839491 - RNA, 19 nt, Human
gcuuuauauauggacaugg

SEQ ID NO: 3839492 - RNA, 15 nt, Human
gcuuuauccucuuua

SEQ ID NO: 3839493 - RNA, 17 nt, Human
gcuuuauccucuuuaga

SEQ ID NO: 3839494 - RNA, 14 nt, Human
gcuuuaugauuuuc

SEQ ID NO: 3839495 - RNA, 16 nt, Human
gcuuuaugauuuucau

SEQ ID NO: 3839496 - RNA, 18 nt, Human
gcuuuaugauuuucauaa

SEQ ID NO: 3839497 - RNA, 20 nt, Human
gcuuuauggguguuaauuga

SEQ ID NO: 3839498 - RNA, 12 nt, Human
gcuuuauguuca

SEQ ID NO: 3839499 - RNA, 23 nt, Human
gcuuuauguucauuuguuuguuu

SEQ ID NO: 3839500 - RNA, 16 nt, Human
gcuuuauuaauguuuu

SEQ ID NO: 3839501 - RNA, 13 nt, Human
gcuuuauucuuca

SEQ ID NO: 3839502 - RNA, 17 nt, Human
gcuuuauuuguaaauuu

SEQ ID NO: 3839503 - RNA, 19 nt, Human
gcuuuauuuuuuaaguauu

SEQ ID NO: 3839504 - RNA, 18 nt, Human
gcuuucaaagcauuuaca

SEQ ID NO: 3839505 - RNA, 15 nt, Human
gcuuucaagugccuu

SEQ ID NO: 3839506 - RNA, 14 nt, Human
gcuuucagauacug

SEQ ID NO: 3839507 - RNA, 18 nt, Human
gcuuucagauacuggauu

SEQ ID NO: 3839508 - RNA, 15 nt, Human
gcuuucaggagcucc

SEQ ID NO: 3839509 - RNA, 12 nt, Human
gcuuucaugauu

SEQ ID NO: 3839510 - RNA, 12 nt, Human
gcuuucauguaa

SEQ ID NO: 3839511 - RNA, 20 nt, Human
gcuuucauguaaacugugca

SEQ ID NO: 3839512 - RNA, 17 nt, Human
gcuuucauuuucucuca

SEQ ID NO: 3839513 - RNA, 14 nt, Human
gcuuuccaaagcca

SEQ ID NO: 3839514 - RNA, 14 nt, Human
gcuuuccagcucac

SEQ ID NO: 3839515 - RNA, 21 nt, Human
gcuuuccauauuuuuuuccuu

SEQ ID NO: 3839516 - RNA, 17 nt, Human
cuuuaacucccauuacc

SEQ ID NO: 3839517 - RNA, 21 nt, Human
cuuuaacucccauuaccaugu

SEQ ID NO: 3839518 - RNA, 23 nt, Human
cuuuaacugccguaauuuaacuu

SEQ ID NO: 3839519 - RNA, 15 nt, Human
cuuuaagagagaaau

SEQ ID NO: 3839520 - RNA, 14 nt, Human
cuuuaagaggacau

SEQ ID NO: 3839521 - RNA, 20 nt, Human
cuuuaagaguuuaaaaucau

SEQ ID NO: 3839522 - RNA, 20 nt, Human
cuuuaagcacuacauaaacu

SEQ ID NO: 3839523 - RNA, 14 nt, Human
cuuuaagcagcucu

SEQ ID NO: 3839524 - RNA, 18 nt, Human
cuuuaagccuucaaaacu

SEQ ID NO: 3839525 - RNA, 20 nt, Human
cuuuaagccuucaaaacuau

SEQ ID NO: 3839526 - RNA, 12 nt, Human
cuuuaaggaaaa

SEQ ID NO: 3839527 - RNA, 20 nt, Human
cuuuaagggcaugccuugug

SEQ ID NO: 3839528 - RNA, 17 nt, Human
cuuuaagugcacaacau

SEQ ID NO: 3839529 - RNA, 14 nt, Human
cuuuaauauaaaug

SEQ ID NO: 3839530 - RNA, 14 nt, Human
ggaauuaaaacaau

SEQ ID NO: 3839531 - RNA, 14 nt, Human
ggaauuaaccuggu

SEQ ID NO: 3839532 - RNA, 17 nt, Human
ggaauuaaccuggugcu

SEQ ID NO: 3839533 - RNA, 19 nt, Human
ggaauuacauguaaaacau

SEQ ID NO: 3839534 - RNA, 19 nt, Human
ggaauuacgugcucugugg

SEQ ID NO: 3839535 - RNA, 20 nt, Human
ggaauuagcuuggggccagg

SEQ ID NO: 3839536 - RNA, 17 nt, Human
ggaauucuguauagauu

SEQ ID NO: 3839537 - RNA, 20 nt, Human
ggaauugacuucgacuguga

SEQ ID NO: 3839538 - RNA, 18 nt, Human
ggaauugauuugcauuga

SEQ ID NO: 3839539 - RNA, 23 nt, Human
ggaauuguggcuauccugauuau

SEQ ID NO: 3839540 - RNA, 17 nt, Human
ggaauuucccaggaccc

SEQ ID NO: 3839541 - RNA, 18 nt, Human
ggaauuucccaggacccu

SEQ ID NO: 3839542 - RNA, 23 nt, Human
ggaauuucucccagucauuuaau

SEQ ID NO: 3839543 - RNA, 19 nt, Human
ggaauuuguaaguuuaugu

SEQ ID NO: 3839544 - RNA, 19 nt, Human
ggaauuuucaucuaggauu

SEQ ID NO: 3839545 - RNA, 13 nt, Human
ggaauuuuuuugu

SEQ ID NO: 3839546 - RNA, 21 nt, Human
ggacaaaacuucuugucagac

SEQ ID NO: 3839547 - RNA, 11 nt, Human
ggacaaaauga

SEQ ID NO: 3839548 - RNA, 17 nt, Human
ggacaaaauggaauacu

SEQ ID NO: 3839549 - RNA, 15 nt, Human
ggacaaacccuucuu

SEQ ID NO: 3839550 - RNA, 13 nt, Human
ggacaaagaaccu

SEQ ID NO: 3839551 - RNA, 17 nt, Human
ggacaaaggagccugug

SEQ ID NO: 3839552 - RNA, 18 nt, Human
ggacaaaggagccuguga

SEQ ID NO: 3839553 - RNA, 17 nt, Human
ggacaaauugagacagu

SEQ ID NO: 3839554 - RNA, 20 nt, Human
ggacaaauugagacagugca

SEQ ID NO: 3839555 - RNA, 17 nt, Human
ggacaaauuuaaaacaa

SEQ ID NO: 3839556 - RNA, 21 nt, Human
ggacaacugcucccaccuccu

SEQ ID NO: 3839557 - RNA, 13 nt, Human
ggacaagagcagg

SEQ ID NO: 3839558 - RNA, 13 nt, Human
ggacaagcauggu

SEQ ID NO: 3839559 - RNA, 15 nt, Human
ggacaaggaguguga

SEQ ID NO: 3839560 - RNA, 17 nt, Human
ggacaaggugcaggcag

SEQ ID NO: 3839561 - RNA, 19 nt, Human
ggacaauaaaccuccgcca

SEQ ID NO: 3839562 - RNA, 16 nt, Human
ggacaaucaguccccu

SEQ ID NO: 3839563 - RNA, 19 nt, Human
ggacaaucaugaaauaugc

SEQ ID NO: 3839564 - RNA, 15 nt, Human
ggacaauuguuuuaa

SEQ ID NO: 3839565 - RNA, 23 nt, Human
ggacacaaaacuccgcccccagc

SEQ ID NO: 3839566 - RNA, 13 nt, Human
ggacacacaaggu

SEQ ID NO: 3839567 - RNA, 12 nt, Human
ggacacacuaau

SEQ ID NO: 3839568 - RNA, 15 nt, Human
ggacacagcucuucu

SEQ ID NO: 3839569 - RNA, 11 nt, Human
ggacacaggcc

SEQ ID NO: 3839570 - RNA, 22 nt, Human
cuuugauaauguuaaauuugua

SEQ ID NO: 3839571 - RNA, 15 nt, Human
cuuugauauuucaau

SEQ ID NO: 3839572 - RNA, 15 nt, Human
cuuugaucccuucug

SEQ ID NO: 3839573 - RNA, 18 nt, Human
cuuugaugucauauggaa

SEQ ID NO: 3839574 - RNA, 12 nt, Human
cuuugauguguu

SEQ ID NO: 3839575 - RNA, 20 nt, Human
cuuugauguuaacacauuuu

SEQ ID NO: 3839576 - RNA, 21 nt, Human
cuuugauguuaacacauuuug

SEQ ID NO: 3839577 - RNA, 14 nt, Human
cuuugauguuccuu

SEQ ID NO: 3839578 - RNA, 16 nt, Human
cuuugauuaauccaga

SEQ ID NO: 3839579 - RNA, 19 nt, Human
cuuugauuaguuuucuugu

SEQ ID NO: 3839580 - RNA, 20 nt, Human
cuuugauuaguuuucuuguu

SEQ ID NO: 3839581 - RNA, 16 nt, Human
cuuugauuauuugcau

SEQ ID NO: 3839582 - RNA, 17 nt, Human
cuuugauuauuugcaug

SEQ ID NO: 3839583 - RNA, 21 nt, Human
cuuugauuauuugcauguuau

SEQ ID NO: 3839584 - RNA, 22 nt, Human
cuuugauuauuugcauguuaug

SEQ ID NO: 3839585 - RNA, 16 nt, Human
cuuugauucacauguu

SEQ ID NO: 3839586 - RNA, 12 nt, Human
cuuugauucaua

SEQ ID NO: 3839587 - RNA, 15 nt, Human
cuuugauuccaucuc

SEQ ID NO: 3839588 - RNA, 16 nt, Human
cuuugauuccaucucc

SEQ ID NO: 3839589 - RNA, 19 nt, Human
cuuugauucuccuucagcc

SEQ ID NO: 3839590 - RNA, 22 nt, Human
cuuugauucuccuucagcccuc

SEQ ID NO: 3839591 - RNA, 23 nt, Human
cuuugauucuccuuuuaugugua

SEQ ID NO: 3839592 - RNA, 18 nt, Human
cuuugauuuacagcaagu

SEQ ID NO: 3839593 - RNA, 20 nt, Human
cuuugauuuccaaguaauau

SEQ ID NO: 3839594 - RNA, 16 nt, Human
cuuugcaaaggagcuc

SEQ ID NO: 3839595 - RNA, 21 nt, Human
cuuugcaaaguauuguaaauu

SEQ ID NO: 3839596 - RNA, 15 nt, Human
cuuugcacacuuugg

SEQ ID NO: 3839597 - RNA, 16 nt, Human
cuuugcacaggaugcu

SEQ ID NO: 3839598 - RNA, 15 nt, Human
cuuugcacauuuuga

SEQ ID NO: 3839599 - RNA, 17 nt, Human
cuuugcacgacgcccuc

SEQ ID NO: 3839600 - RNA, 18 nt, Human
cuuugcacgacgcccucu

SEQ ID NO: 3839601 - RNA, 15 nt, Human
cuuugcagaaacaga

SEQ ID NO: 3839602 - RNA, 14 nt, Human
cuuugcagacaggc

SEQ ID NO: 3839603 - RNA, 22 nt, Human
cuuugcagccggcacagggucu

SEQ ID NO: 3839604 - RNA, 14 nt, Human
cuuugcaggaaauc

SEQ ID NO: 3839605 - RNA, 13 nt, Human
cuuugcaggcuca

SEQ ID NO: 3839606 - RNA, 14 nt, Human
cuuugcagggcagc

SEQ ID NO: 3839607 - RNA, 18 nt, Human
cuuugcauaugagccgug

SEQ ID NO: 3839608 - RNA, 17 nt, Human
cuuugcaucguccccuc

SEQ ID NO: 3839609 - RNA, 22 nt, Human
cuuugcaucucaguaugaauua

SEQ ID NO: 3839610 - RNA, 21 nt, Human
cuuugcauggagacuugagga

SEQ ID NO: 3839611 - RNA, 17 nt, Human
cuuugcauggauuucuu

SEQ ID NO: 3839612 - RNA, 22 nt, Human
cuuugcauggauuucuuugaaa

SEQ ID NO: 3839613 - RNA, 14 nt, Human
cuuugcauuuggaa

SEQ ID NO: 3839614 - RNA, 22 nt, Human
cuuugcauuuggaauuuuugcu

SEQ ID NO: 3839615 - RNA, 22 nt, Human
cuuugcauuuuaaaaaugaaau

SEQ ID NO: 3839616 - RNA, 17 nt, Human
cuuugccaagaccuuuc

SEQ ID NO: 3839617 - RNA, 18 nt, Human
cuuugccagaaagcauaa

SEQ ID NO: 3839618 - RNA, 18 nt, Human
cuuugccagcugcugcug

SEQ ID NO: 3839619 - RNA, 20 nt, Human
cuuugccagcuuuuccuccc

SEQ ID NO: 3839620 - RNA, 19 nt, Human
cuuugccagucauucagca

SEQ ID NO: 3839621 - RNA, 19 nt, Human
cuuugccaucucugcucca

SEQ ID NO: 3839622 - RNA, 15 nt, Human
cuuugccaugugcuu

SEQ ID NO: 3839623 - RNA, 19 nt, Human
cuuugcccaacaccagccc

SEQ ID NO: 3839624 - RNA, 22 nt, Human
cuuugcccaacaccagccccug

SEQ ID NO: 3839625 - RNA, 14 nt, Human
cuuugcccacaaug

SEQ ID NO: 3839626 - RNA, 20 nt, Human
cuuugcccugcugcccuccc

SEQ ID NO: 3839627 - RNA, 22 nt, Human
cuuugcccugcugcccuccccc

SEQ ID NO: 3839628 - RNA, 16 nt, Human
cuuugcccuucuuucu

SEQ ID NO: 3839629 - RNA, 12 nt, Human
cuuugccucaaa

SEQ ID NO: 3839630 - RNA, 12 nt, Human
cuuugccuccag

SEQ ID NO: 3839631 - RNA, 22 nt, Human
cuuugccuuccacgcugucucc

SEQ ID NO: 3839632 - RNA, 23 nt, Human
cuuugccuuccacgcugucucca

SEQ ID NO: 3839633 - RNA, 16 nt, Human
cuuugccuugggcugc

SEQ ID NO: 3839634 - RNA, 12 nt, Human
cuuugccuuugc

SEQ ID NO: 3839635 - RNA, 15 nt, Human
cuuugcgcuccuggc

SEQ ID NO: 3839636 - RNA, 22 nt, Human
cuuugcgcuccuggcccagccu

SEQ ID NO: 3839637 - RNA, 17 nt, Human
cuuugcgugcccggggc

SEQ ID NO: 3839638 - RNA, 21 nt, Human
cuuugcgugcccggggcagca

SEQ ID NO: 3839639 - RNA, 11 nt, Human
cuuugcucuga

SEQ ID NO: 3839640 - RNA, 16 nt, Human
cuuugcucuuguccca

SEQ ID NO: 3839641 - RNA, 14 nt, Human
cuuugcucuuucuu

SEQ ID NO: 3839642 - RNA, 13 nt, Human
cuuugcugacccu

SEQ ID NO: 3839643 - RNA, 23 nt, Human
cuuugcugacccuccccaaaggc

SEQ ID NO: 3839644 - RNA, 18 nt, Human
cuuugcugagccuguaaa

SEQ ID NO: 3839645 - RNA, 11 nt, Human
cuuugcugcua

SEQ ID NO: 3839646 - RNA, 18 nt, Human
cuuugcuguaagaugucu

SEQ ID NO: 3839647 - RNA, 19 nt, Human
cuuugcuguaagaugucug

SEQ ID NO: 3839648 - RNA, 20 nt, Human
cuuugcuguaagaugucugu

SEQ ID NO: 3839649 - RNA, 14 nt, Human
cuuugcugucccau

SEQ ID NO: 3839650 - RNA, 23 nt, Human
cuuugcugucccauagucccugc

SEQ ID NO: 3839651 - RNA, 12 nt, Human
cuuugcuucauu

SEQ ID NO: 3839652 - RNA, 23 nt, Human
cuuugcuucauucaagucagcuc

SEQ ID NO: 3839653 - RNA, 15 nt, Human
cuuugcuucccauug

SEQ ID NO: 3839654 - RNA, 17 nt, Human
cuuugcuugaacacagu

SEQ ID NO: 3839655 - RNA, 19 nt, Human
cuuugcuugaacacaguau

SEQ ID NO: 3839656 - RNA, 17 nt, Human
cuuugcuugccucucug

SEQ ID NO: 3839657 - RNA, 12 nt, Human
cuuugcuugcuu

SEQ ID NO: 3839658 - RNA, 18 nt, Human
cuuugcuugcuuugaagu

SEQ ID NO: 3839659 - RNA, 11 nt, Human
cuuugcuuugc

SEQ ID NO: 3839660 - RNA, 16 nt, Human
cuuugcuuugcccagc

SEQ ID NO: 3839661 - RNA, 17 nt, Human
cuuugcuuugcuuucug

SEQ ID NO: 3839662 - RNA, 18 nt, Human
cuuuggaaaaauguuugu

SEQ ID NO: 3839663 - RNA, 20 nt, Human
cuuuggaaaaugcauuguau

SEQ ID NO: 3839664 - RNA, 12 nt, Human
cuuuggaaagac

SEQ ID NO: 3839665 - RNA, 23 nt, Human
cuuuggaaagacuuuuccaaccc

SEQ ID NO: 3839666 - RNA, 22 nt, Human
cuuuggaaaguacacucugcug

SEQ ID NO: 3839667 - RNA, 12 nt, Human
cuuuggaagcag

SEQ ID NO: 3839668 - RNA, 17 nt, Human
cuuuggaaggagugaga

SEQ ID NO: 3839669 - RNA, 20 nt, Human
cuuuggaaguuuagcucuga

SEQ ID NO: 3839670 - RNA, 21 nt, Human
cuuuggaaguuuagcucugag

SEQ ID NO: 3839671 - RNA, 19 nt, Human
cuuuggacagaagcagcuc

SEQ ID NO: 3839672 - RNA, 17 nt, Human
cuuuggacccugaggcc

SEQ ID NO: 3839673 - RNA, 12 nt, Human
cuuuggacuugu

SEQ ID NO: 3839674 - RNA, 23 nt, Human
cuuuggagaucaaggagaggagg

SEQ ID NO: 3839675 - RNA, 18 nt, Human
ggcaucagucccuaugua

SEQ ID NO: 3839676 - RNA, 20 nt, Human
ggcaucaucaauaaaacagu

SEQ ID NO: 3839677 - RNA, 17 nt, Human
ggcaucaucucagcuca

SEQ ID NO: 3839678 - RNA, 23 nt, Human
ggcaucaugcaucuuacugaagg

SEQ ID NO: 3839679 - RNA, 12 nt, Human
ggcaucauucca

SEQ ID NO: 3839680 - RNA, 22 nt, Human
ggcauccagagucccugccugg

SEQ ID NO: 3839681 - RNA, 18 nt, Human
ggcauccaguaucuugaa

SEQ ID NO: 3839682 - RNA, 21 nt, Human
ggcaucccaguggccucaacc

SEQ ID NO: 3839683 - RNA, 14 nt, Human
ggcaucccugggcc

SEQ ID NO: 3839684 - RNA, 13 nt, Human
ggcauccugugaa

SEQ ID NO: 3839685 - RNA, 16 nt, Human
ggcauccuucugccuu

SEQ ID NO: 3839686 - RNA, 22 nt, Human
ggcaucuagagcuugaugccag

SEQ ID NO: 3839687 - RNA, 18 nt, Human
ggcaucuaucugugcuag

SEQ ID NO: 3839688 - RNA, 12 nt, Human
ggcaucuccagg

SEQ ID NO: 3839689 - RNA, 21 nt, Human
ggcaucuccugugcaugggug

SEQ ID NO: 3839690 - RNA, 18 nt, Human
ggcaucucuaauuggaag

SEQ ID NO: 3839691 - RNA, 12 nt, Human
ggcaucucuggg

SEQ ID NO: 3839692 - RNA, 17 nt, Human
ggcaucucugggcugga

SEQ ID NO: 3839693 - RNA, 17 nt, Human
ggcaucugacacaaaaa

SEQ ID NO: 3839694 - RNA, 19 nt, Human
ggcaucugccccuccccca

SEQ ID NO: 3839695 - RNA, 13 nt, Human
ggcaucuggccuu

SEQ ID NO: 3839696 - RNA, 15 nt, Human
ggcaucuugcuggcu

SEQ ID NO: 3839697 - RNA, 17 nt, Human
ggcaucuuugccuuggg

SEQ ID NO: 3839698 - RNA, 19 nt, Human
ggcaucuuugccuugggcu

SEQ ID NO: 3839699 - RNA, 13 nt, Human
ggcaucuuugggg

SEQ ID NO: 3839700 - RNA, 13 nt, Human
ggcaugagaaaua

SEQ ID NO: 3839701 - RNA, 14 nt, Human
ggcaugagggauca

SEQ ID NO: 3839702 - RNA, 21 nt, Human
ggcaugaguuacugugcauug

SEQ ID NO: 3839703 - RNA, 15 nt, Human
ggcaugaugcgggcc

SEQ ID NO: 3839704 - RNA, 14 nt, Human
ggcaugcaccugca

SEQ ID NO: 3839705 - RNA, 18 nt, Human
ggcaugccccggccaccu

SEQ ID NO: 3839706 - RNA, 23 nt, Human
ggcaugccucugauaugggacug

SEQ ID NO: 3839707 - RNA, 13 nt, Human
ggcaugccugugu

SEQ ID NO: 3839708 - RNA, 16 nt, Human
ggcaugccugugugac

SEQ ID NO: 3839709 - RNA, 14 nt, Human
ggcaugcuggggca

SEQ ID NO: 3839710 - RNA, 12 nt, Human
ggcauggaaauu

SEQ ID NO: 3839711 - RNA, 16 nt, Human
ggcauggcccugggcg

SEQ ID NO: 3839712 - RNA, 16 nt, Human
ggcauggcccuggggu

SEQ ID NO: 3839713 - RNA, 14 nt, Human
ggcauggcugggaa

SEQ ID NO: 3839714 - RNA, 21 nt, Human
ggcauggcuuuauuuguuuuu

SEQ ID NO: 3839715 - RNA, 20 nt, Human
ggcauggggugggccucugg

SEQ ID NO: 3839716 - RNA, 19 nt, Human
ggcaugguacggagauguu

SEQ ID NO: 3839717 - RNA, 19 nt, Human
ggcaugguauuugagacau

SEQ ID NO: 3839718 - RNA, 15 nt, Human
ggcauggucugcccu

SEQ ID NO: 3839719 - RNA, 18 nt, Human
ggcaugguuuugugccau

SEQ ID NO: 3839720 - RNA, 16 nt, Human
ggcauguaggacccug

SEQ ID NO: 3839721 - RNA, 18 nt, Human
ggcauguauuggccugga

SEQ ID NO: 3839722 - RNA, 21 nt, Human
ggcaugugccuauagucccag

SEQ ID NO: 3839723 - RNA, 19 nt, Human
ggcauguggccuguggccu

SEQ ID NO: 3839724 - RNA, 14 nt, Human
ggcaugugggcuuc

SEQ ID NO: 3839725 - RNA, 23 nt, Human
ggcauguguuuacuuuauguuac

SEQ ID NO: 3839726 - RNA, 14 nt, Human
ggcauguuccucug

SEQ ID NO: 3839727 - RNA, 23 nt, Human
ggcauguucucugaggacacuaa

SEQ ID NO: 3839728 - RNA, 17 nt, Human
ggcauuagaauuauuua

SEQ ID NO: 3839729 - RNA, 18 nt, Human
ggcauuccccaggaggcc

SEQ ID NO: 3839730 - RNA, 19 nt, Human
ggcauucuggaccucuggg

SEQ ID NO: 3839731 - RNA, 20 nt, Human
ggcauucuggaccucugggu

SEQ ID NO: 3839732 - RNA, 14 nt, Human
ggcauucuuguaca

SEQ ID NO: 3839733 - RNA, 20 nt, Human
ggcauugacaaaucugugua

SEQ ID NO: 3839734 - RNA, 18 nt, Human
ggcauuggcagcaggugc

SEQ ID NO: 3839735 - RNA, 17 nt, Human
cuuuguauacuuuaaau

SEQ ID NO: 3839736 - RNA, 19 nt, Human
cuuuguauacuuuaaauaa

SEQ ID NO: 3839737 - RNA, 13 nt, Human
cuuuguauauuac

SEQ ID NO: 3839738 - RNA, 15 nt, Human
cuuuguauauuauuu

SEQ ID NO: 3839739 - RNA, 14 nt, Human
cuuuguaugauauu

SEQ ID NO: 3839740 - RNA, 15 nt, Human
cuuuguaugauauuc

SEQ ID NO: 3839741 - RNA, 22 nt, Human
cuuuguauucucuccuguaccu

SEQ ID NO: 3839742 - RNA, 22 nt, Human
cuuuguauuguauauuacaaug

SEQ ID NO: 3839743 - RNA, 17 nt, Human
cuuuguauuuugauuau

SEQ ID NO: 3839744 - RNA, 18 nt, Human
cuuuguauuuugauuauu

SEQ ID NO: 3839745 - RNA, 23 nt, Human
cuuuguauuuuuacuuuuaaaug

SEQ ID NO: 3839746 - RNA, 14 nt, Human
cuuugucaaaagga

SEQ ID NO: 3839747 - RNA, 18 nt, Human
cuuugucaucuuucuucu

SEQ ID NO: 3839748 - RNA, 15 nt, Human
cuuuguccccaccgc

SEQ ID NO: 3839749 - RNA, 14 nt, Human
cuuuguccccugcu

SEQ ID NO: 3839750 - RNA, 15 nt, Human
cuuuguccccugcuu

SEQ ID NO: 3839751 - RNA, 16 nt, Human
cuuuguccccugcuuc

SEQ ID NO: 3839752 - RNA, 13 nt, Human
cuuuguccuccug

SEQ ID NO: 3839753 - RNA, 18 nt, Human
cuuuguccuccugcugcc

SEQ ID NO: 3839754 - RNA, 21 nt, Human
cuuuguccuccugcugccagu

SEQ ID NO: 3839755 - RNA, 19 nt, Human
cuuugucuaaaacaauaaa

SEQ ID NO: 3839756 - RNA, 17 nt, Human
cuuugucuaagaaacau

SEQ ID NO: 3839757 - RNA, 18 nt, Human
cuuugucuaagaaacauu

SEQ ID NO: 3839758 - RNA, 21 nt, Human
cuuugucuaagaaacauugga

SEQ ID NO: 3839759 - RNA, 23 nt, Human
cuuugucuaagaaacauuggaag

SEQ ID NO: 3839760 - RNA, 23 nt, Human
cuuugucuacaccauuaugugcg

SEQ ID NO: 3839761 - RNA, 14 nt, Human
cuuugucuuucaaa

SEQ ID NO: 3839762 - RNA, 22 nt, Human
cuuugugaauagaacucugaaa

SEQ ID NO: 3839763 - RNA, 15 nt, Human
cuuugugaggaagcc

SEQ ID NO: 3839764 - RNA, 23 nt, Human
cuuugugaggaagccgcuggggc

SEQ ID NO: 3839765 - RNA, 13 nt, Human
cuuugugauaauu

SEQ ID NO: 3839766 - RNA, 16 nt, Human
cuuugugauaauuuaa

SEQ ID NO: 3839767 - RNA, 23 nt, Human
cuuugugauucaaucuguaaacu

SEQ ID NO: 3839768 - RNA, 17 nt, Human
cuuugugauuuuuguaa

SEQ ID NO: 3839769 - RNA, 16 nt, Human
cuuugugcacauuuau

SEQ ID NO: 3839770 - RNA, 23 nt, Human
cuuugugcacauuuauuuccucc

SEQ ID NO: 3839771 - RNA, 13 nt, Human
cuuugugcccuau

SEQ ID NO: 3839772 - RNA, 17 nt, Human
cuuugugcuguggggcu

SEQ ID NO: 3839773 - RNA, 16 nt, Human
cuuuguggaugucuuc

SEQ ID NO: 3839774 - RNA, 20 nt, Human
cuuuguggaugucuuccuug

SEQ ID NO: 3839775 - RNA, 11 nt, Human
cuuuguggcca

SEQ ID NO: 3839776 - RNA, 13 nt, Human
cuuuguggccaag

SEQ ID NO: 3839777 - RNA, 22 nt, Human
cuuuguggccaaggagcugcua

SEQ ID NO: 3839778 - RNA, 15 nt, Human
cuuuguggugagaau

SEQ ID NO: 3839779 - RNA, 22 nt, Human
cuuuguguauuuuucaauaaua

SEQ ID NO: 3839780 - RNA, 15 nt, Human
cuuuguguguguguc

SEQ ID NO: 3839781 - RNA, 20 nt, Human
cuuugugugugugucagcug

SEQ ID NO: 3839782 - RNA, 15 nt, Human
cuuuguguuguaauu

SEQ ID NO: 3839783 - RNA, 22 nt, Human
cuuuguguuguaauucuucagu

SEQ ID NO: 3839784 - RNA, 14 nt, Human
cuuuguguuucuau

SEQ ID NO: 3839785 - RNA, 17 nt, Human
cuuuguguuugguuuac

SEQ ID NO: 3839786 - RNA, 18 nt, Human
cuuuguguuugguuuaca

SEQ ID NO: 3839787 - RNA, 20 nt, Human
cuuuguguuugguuuacauu

SEQ ID NO: 3839788 - RNA, 21 nt, Human
cuuuguguuugguuuacauuu

SEQ ID NO: 3839789 - RNA, 18 nt, Human
cuuuguuaagacugcuga

SEQ ID NO: 3839790 - RNA, 13 nt, Human
cuuuguuacacug

SEQ ID NO: 3839791 - RNA, 18 nt, Human
cuuuguuaguuucuccaa

SEQ ID NO: 3839792 - RNA, 16 nt, Human
cuuuguuccccacugg

SEQ ID NO: 3839793 - RNA, 20 nt, Human
cuuuguucugcuguucucua

SEQ ID NO: 3839794 - RNA, 16 nt, Human
cuuuguucuggcucuu

SEQ ID NO: 3839795 - RNA, 17 nt, Human
cuuuguugaacuguuag

SEQ ID NO: 3839796 - RNA, 21 nt, Human
cuuuguugcaaguacugcugu

SEQ ID NO: 3839797 - RNA, 20 nt, Human
cuuuguugcucagcaagggg

SEQ ID NO: 3839798 - RNA, 13 nt, Human
cuuuguugugugc

SEQ ID NO: 3839799 - RNA, 19 nt, Human
cuuuguuuagucuuuauac

SEQ ID NO: 3839800 - RNA, 16 nt, Human
cuuuguuucuccccca

SEQ ID NO: 3839801 - RNA, 15 nt, Human
cuuuguuucuuguuu

SEQ ID NO: 3839802 - RNA, 15 nt, Human
cuuuguuuggcuggg

SEQ ID NO: 3839803 - RNA, 15 nt, Human
cuuuguuuguucuug

SEQ ID NO: 3839804 - RNA, 21 nt, Human
cuuuguuuguucuuguuuuua

SEQ ID NO: 3839805 - RNA, 15 nt, Human
cuuuguuuuauuuuc

SEQ ID NO: 3839806 - RNA, 19 nt, Human
cuuuguuuugcacacuuug

SEQ ID NO: 3839807 - RNA, 18 nt, Human
cuuuguuuugugucucuu

SEQ ID NO: 3839808 - RNA, 23 nt, Human
cuuuguuuuuuuuuccuguccuu

SEQ ID NO: 3839809 - RNA, 15 nt, Human
cuuuuaaaaaguauu

SEQ ID NO: 3839810 - RNA, 16 nt, Human
cuuuuaaaaaguauug

SEQ ID NO: 3839811 - RNA, 21 nt, Human
cuuuuaaaaaguauugccaaa

SEQ ID NO: 3839812 - RNA, 23 nt, Human
cuuuuaaaaaguauugccaaaca

SEQ ID NO: 3839813 - RNA, 19 nt, Human
cuuuuaaaacuacuuagca

SEQ ID NO: 3839814 - RNA, 22 nt, Human
cuuuuaaaagacaagacuucag

SEQ ID NO: 3839815 - RNA, 17 nt, Human
cuuuuaaaccauuuucu

SEQ ID NO: 3839816 - RNA, 11 nt, Human
cuuuuaaacuc

SEQ ID NO: 3839817 - RNA, 12 nt, Human
cuuuuaaacugu

SEQ ID NO: 3839818 - RNA, 15 nt, Human
cuuuuaaagaaaaaa

SEQ ID NO: 3839819 - RNA, 22 nt, Human
cuuuuaaagaaaaaaauugaaa

SEQ ID NO: 3839820 - RNA, 14 nt, Human
gaaaaagaaaauaa

SEQ ID NO: 3839821 - RNA, 13 nt, Human
gaaaaagaaaugc

SEQ ID NO: 3839822 - RNA, 15 nt, Human
gaaaaagacauucag

SEQ ID NO: 3839823 - RNA, 20 nt, Human
gaaaaagacuuuaaaaguga

SEQ ID NO: 3839824 - RNA, 16 nt, Human
gaaaaagcacaagaag

SEQ ID NO: 3839825 - RNA, 13 nt, Human
gaaaaagcaugua

SEQ ID NO: 3839826 - RNA, 16 nt, Human
gaaaaagcauguacag

SEQ ID NO: 3839827 - RNA, 13 nt, Human
gaaaaagcgaaaa

SEQ ID NO: 3839828 - RNA, 12 nt, Human
gaaaaaggagga

SEQ ID NO: 3839829 - RNA, 17 nt, Human
gaaaaaggaugcacaga

SEQ ID NO: 3839830 - RNA, 23 nt, Human
gaaaaaggaugcacagaguuguu

SEQ ID NO: 3839831 - RNA, 15 nt, Human
gaaaaaggcugugcu

SEQ ID NO: 3839832 - RNA, 16 nt, Human
gaaaaaggcugugcug

SEQ ID NO: 3839833 - RNA, 12 nt, Human
gaaaaaguaacu

SEQ ID NO: 3839834 - RNA, 13 nt, Human
gaaaaauaaagaa

SEQ ID NO: 3839835 - RNA, 14 nt, Human
gaaaaauaaagaaa

SEQ ID NO: 3839836 - RNA, 17 nt, Human
gaaaaauagugucuuug

SEQ ID NO: 3839837 - RNA, 11 nt, Human
gaaaaauauga

SEQ ID NO: 3839838 - RNA, 16 nt, Human
gaaaaauauguaccaa

SEQ ID NO: 3839839 - RNA, 15 nt, Human
gaaaaauaugugaag

SEQ ID NO: 3839840 - RNA, 16 nt, Human
gaaaaauaugugaagg

SEQ ID NO: 3839841 - RNA, 15 nt, Human
gaaaaauauuuaaug

SEQ ID NO: 3839842 - RNA, 19 nt, Human
gaaaaaucacauccuggcc

SEQ ID NO: 3839843 - RNA, 21 nt, Human
gaaaaaucacuugauucauaa

SEQ ID NO: 3839844 - RNA, 18 nt, Human
gaaaaauccucuuccucu

SEQ ID NO: 3839845 - RNA, 19 nt, Human
gaaaaaucgcgaguguuuc

SEQ ID NO: 3839846 - RNA, 22 nt, Human
gaaaaaucuugugcuagaauac

SEQ ID NO: 3839847 - RNA, 17 nt, Human
gaaaaaugaaagaugau

SEQ ID NO: 3839848 - RNA, 18 nt, Human
gaaaaaugagagaaggga

SEQ ID NO: 3839849 - RNA, 16 nt, Human
gaaaaaugagccuggc

SEQ ID NO: 3839850 - RNA, 17 nt, Human
gaaaaaugcuccccaca

SEQ ID NO: 3839851 - RNA, 22 nt, Human
gaaaaauggauccccagugaaa

SEQ ID NO: 3839852 - RNA, 17 nt, Human
gaaaaauguaggagacu

SEQ ID NO: 3839853 - RNA, 20 nt, Human
gaaaaauguguauuuuaaga

SEQ ID NO: 3839854 - RNA, 16 nt, Human
gaaaaauguuaggaca

SEQ ID NO: 3839855 - RNA, 20 nt, Human
gaaaaauucagcaaaccauu

SEQ ID NO: 3839856 - RNA, 16 nt, Human
gaaaaauuggggagga

SEQ ID NO: 3839857 - RNA, 16 nt, Human
gaaaaauuuaagcauu

SEQ ID NO: 3839858 - RNA, 15 nt, Human
gaaaaauuucacgau

SEQ ID NO: 3839859 - RNA, 18 nt, Human
gaaaacaacaaaaaauaa

SEQ ID NO: 3839860 - RNA, 12 nt, Human
gaaaacaaggaa

SEQ ID NO: 3839861 - RNA, 14 nt, Human
gaaaacaaggauga

SEQ ID NO: 3839862 - RNA, 12 nt, Human
gaaaacaaugca

SEQ ID NO: 3839863 - RNA, 13 nt, Human
gaaaacacauuuu

SEQ ID NO: 3839864 - RNA, 17 nt, Human
gaaaacacccagggaac

SEQ ID NO: 3839865 - RNA, 14 nt, Human
gaaaacacugugca

SEQ ID NO: 3839866 - RNA, 21 nt, Human
gaaaacacugugcacaucugu

SEQ ID NO: 3839867 - RNA, 18 nt, Human
gaaaacacuguucucugc

SEQ ID NO: 3839868 - RNA, 20 nt, Human
gaaaacacuguucucugccc

SEQ ID NO: 3839869 - RNA, 22 nt, Human
gaaaacacuguucucugcccuc

SEQ ID NO: 3839870 - RNA, 14 nt, Human
gaaaacagaaauug

SEQ ID NO: 3839871 - RNA, 15 nt, Human
gaaaacagaacacuu

SEQ ID NO: 3839872 - RNA, 17 nt, Human
gaaaacagacucagguu

SEQ ID NO: 3839873 - RNA, 21 nt, Human
gaaaacaggaaaaaaacuuuu

SEQ ID NO: 3839874 - RNA, 21 nt, Human
gaaaacagucaaccaacccca

SEQ ID NO: 3839875 - RNA, 18 nt, Human
gaaaacaguguguaaaca

SEQ ID NO: 3839876 - RNA, 23 nt, Human
gaaaacaucucaucaugucuauu

SEQ ID NO: 3839877 - RNA, 14 nt, Human
gaaaacaugcagaa

SEQ ID NO: 3839878 - RNA, 16 nt, Human
gaaaacaugcuacaca

SEQ ID NO: 3839879 - RNA, 18 nt, Human
gaaaacaugcuacacacu

SEQ ID NO: 3839880 - RNA, 14 nt, Human
gaaaacauguuaau

SEQ ID NO: 3839881 - RNA, 21 nt, Human
gaaaaccaaaaugacaucuuu

SEQ ID NO: 3839882 - RNA, 13 nt, Human
gaaaaccaaacaa

SEQ ID NO: 3839883 - RNA, 15 nt, Human
gaaaaccaacaccau

SEQ ID NO: 3839884 - RNA, 21 nt, Human
gaaaaccaacaccaucacagc

SEQ ID NO: 3839885 - RNA, 18 nt, Human
gaaaaccaagccguggcu

SEQ ID NO: 3839886 - RNA, 21 nt, Human
gaaaaccaagccguggcuucc

SEQ ID NO: 3839887 - RNA, 20 nt, Human
gaaaaccagcucagcacugc

SEQ ID NO: 3839888 - RNA, 16 nt, Human
gaaaaccaucacauga

SEQ ID NO: 3839889 - RNA, 19 nt, Human
gaaaaccaucuggccuggc

SEQ ID NO: 3839890 - RNA, 21 nt, Human
gaaaaccaucuggccuggccu

SEQ ID NO: 3839891 - RNA, 15 nt, Human
gaaaacccagagagg

SEQ ID NO: 3839892 - RNA, 17 nt, Human
gaaaacccuugggccag

SEQ ID NO: 3839893 - RNA, 22 nt, Human
gaaaacccuugggccagaagua

SEQ ID NO: 3839894 - RNA, 13 nt, Human
gaaaacggagcug

SEQ ID NO: 3839895 - RNA, 17 nt, Human
gaaaacgguuaaaacug

SEQ ID NO: 3839896 - RNA, 18 nt, Human
gaaaacguuuuauugugu

SEQ ID NO: 3839897 - RNA, 19 nt, Human
gaaaacguuuuauuguguu

SEQ ID NO: 3839898 - RNA, 20 nt, Human
gaaaacguuuuauuguguuu

SEQ ID NO: 3839899 - RNA, 14 nt, Human
gaaaacuauacaac

SEQ ID NO: 3839900 - RNA, 16 nt, Human
gaaaacucuuugcugc

SEQ ID NO: 3839901 - RNA, 16 nt, Human
gaaaacugaaaaucua

SEQ ID NO: 3839902 - RNA, 20 nt, Human
gaaaacugaaaaucuaauau

SEQ ID NO: 3839903 - RNA, 19 nt, Human
gaaaacugcaacuuguaaa

SEQ ID NO: 3839904 - RNA, 23 nt, Human
gaaaacuuaugaccucuuccuuu

SEQ ID NO: 3839905 - RNA, 15 nt, Human
gaaaacuuauuugag

SEQ ID NO: 3839906 - RNA, 13 nt, Human
gaaaacuuauuuu

SEQ ID NO: 3839907 - RNA, 20 nt, Human
gaaaacuugaauucauagaa

SEQ ID NO: 3839908 - RNA, 21 nt, Human
gaaaacuugaauucauagaaa

SEQ ID NO: 3839909 - RNA, 22 nt, Human
gaaaacuugugugaaauuuucu

SEQ ID NO: 3839910 - RNA, 13 nt, Human
gaaaacuuuguua

SEQ ID NO: 3839911 - RNA, 9 nt, Human
gaaaagaaa

SEQ ID NO: 3839912 - RNA, 11 nt, Human
gaaaagaaaaa

SEQ ID NO: 3839913 - RNA, 12 nt, Human
gaaaagaaaaaa

SEQ ID NO: 3839914 - RNA, 22 nt, Human
gaaaagaaaccccaaacucagg

SEQ ID NO: 3839915 - RNA, 14 nt, Human
gaaaagaaacucua

SEQ ID NO: 3839916 - RNA, 15 nt, Human
gaaaagaaguagugu

SEQ ID NO: 3839917 - RNA, 18 nt, Human
gaaaagaauacagaaaga

SEQ ID NO: 3839918 - RNA, 16 nt, Human
gaaaagagaagaagaa

SEQ ID NO: 3839919 - RNA, 15 nt, Human
gaaaagagauauuuu

SEQ ID NO: 3839920 - RNA, 21 nt, Human
gaaaagaggaguuucgaggua

SEQ ID NO: 3839921 - RNA, 19 nt, Human
gaaaagauacgacuuuauu

SEQ ID NO: 3839922 - RNA, 22 nt, Human
gaaaagauacgacuuuauuuuc

SEQ ID NO: 3839923 - RNA, 20 nt, Human
gaaaagauguaccuggugga

SEQ ID NO: 3839924 - RNA, 19 nt, Human
gaaaagauguagauuuauu

SEQ ID NO: 3839925 - RNA, 21 nt, Human
gaaaagauguagauuuauuuc

SEQ ID NO: 3839926 - RNA, 13 nt, Human
gaaaagauuuuaa

SEQ ID NO: 3839927 - RNA, 16 nt, Human
gaaaagcaccugccga

SEQ ID NO: 3839928 - RNA, 17 nt, Human
gaaaagcaccugccgac

SEQ ID NO: 3839929 - RNA, 15 nt, Human
gaaaagcagacauuu

SEQ ID NO: 3839930 - RNA, 20 nt, Human
gaaaagcagcccuuggccag

SEQ ID NO: 3839931 - RNA, 14 nt, Human
gaaaagcagcucuc

SEQ ID NO: 3839932 - RNA, 19 nt, Human
gaaaagcaguucuggaugg

SEQ ID NO: 3839933 - RNA, 16 nt, Human
gaaaagccauguuuaa

SEQ ID NO: 3839934 - RNA, 21 nt, Human
gaaaagccauguuuaagauuu

SEQ ID NO: 3839935 - RNA, 21 nt, Human
gaaaagccucugugucacugg

SEQ ID NO: 3839936 - RNA, 19 nt, Human
gaaaagccucuguuuugau

SEQ ID NO: 3839937 - RNA, 20 nt, Human
gaaaagcggacaucagcugg

SEQ ID NO: 3839938 - RNA, 11 nt, Human
gaaaagcuauu

SEQ ID NO: 3839939 - RNA, 14 nt, Human
gaaaagcuauuagc

SEQ ID NO: 3839940 - RNA, 14 nt, Human
gaaaagcugaaucc

SEQ ID NO: 3839941 - RNA, 13 nt, Human
gaaaagcugcuga

SEQ ID NO: 3839942 - RNA, 19 nt, Human
ggagguugaucagaucuga

SEQ ID NO: 3839943 - RNA, 12 nt, Human
ggagguugcagg

SEQ ID NO: 3839944 - RNA, 17 nt, Human
ggagguugcagggagcc

SEQ ID NO: 3839945 - RNA, 20 nt, Human
ggagguuuaggucaagaaga

SEQ ID NO: 3839946 - RNA, 20 nt, Human
ggaguagaccccuggcuggu

SEQ ID NO: 3839947 - RNA, 17 nt, Human
ggaguagcugagcucac

SEQ ID NO: 3839948 - RNA, 13 nt, Human
ggagucacacagu

SEQ ID NO: 3839949 - RNA, 22 nt, Human
ggagucaccuucccuugccacu

SEQ ID NO: 3839950 - RNA, 15 nt, Human
ggagucacugagacc

SEQ ID NO: 3839951 - RNA, 19 nt, Human
ggagucagccaggagcugu

SEQ ID NO: 3839952 - RNA, 15 nt, Human
ggagucagugccagg

SEQ ID NO: 3839953 - RNA, 23 nt, Human
ggagucaucucaaccauccccuc

SEQ ID NO: 3839954 - RNA, 17 nt, Human
ggagucccaaggaaagc

SEQ ID NO: 3839955 - RNA, 20 nt, Human
ggagucccaccuuggcugca

SEQ ID NO: 3839956 - RNA, 21 nt, Human
ggaguccccuccccggcccua

SEQ ID NO: 3839957 - RNA, 23 nt, Human
ggaguccccuccccggcccuacc

SEQ ID NO: 3839958 - RNA, 16 nt, Human
ggagucccgucaggac

SEQ ID NO: 3839959 - RNA, 15 nt, Human
ggagucugaagcaga

SEQ ID NO: 3839960 - RNA, 20 nt, Human
ggagucugagguccugagca

SEQ ID NO: 3839961 - RNA, 18 nt, Human
ggagucuguccugugacg

SEQ ID NO: 3839962 - RNA, 18 nt, Human
ggagugaagaggggcagc

SEQ ID NO: 3839963 - RNA, 23 nt, Human
ggagugaagaggggcagcccuug

SEQ ID NO: 3839964 - RNA, 21 nt, Human
ggagugaguugauagcacaga

SEQ ID NO: 3839965 - RNA, 20 nt, Human
ggaugauccccacgccacag

SEQ ID NO: 3839966 - RNA, 16 nt, Human
ggaugaucuaggaaga

SEQ ID NO: 3839967 - RNA, 18 nt, Human
ggaugaucuaggaagacu

SEQ ID NO: 3839968 - RNA, 18 nt, Human
ggaugaugacuauggaaa

SEQ ID NO: 3839969 - RNA, 14 nt, Human
ggaugaugccacac

SEQ ID NO: 3839970 - RNA, 21 nt, Human
ggaugcaacacgcauggucaa

SEQ ID NO: 3839971 - RNA, 17 nt, Human
ggaugcagccucacagu

SEQ ID NO: 3839972 - RNA, 22 nt, Human
ggaugcagugcucgcuguugcu

SEQ ID NO: 3839973 - RNA, 16 nt, Human
ggaugcauggagauag

SEQ ID NO: 3839974 - RNA, 21 nt, Human
ggaugcauguuuuccagcucc

SEQ ID NO: 3839975 - RNA, 19 nt, Human
ggaugccaagaaguuuaag

SEQ ID NO: 3839976 - RNA, 19 nt, Human
ggaugcccaaagaugcagc

SEQ ID NO: 3839977 - RNA, 17 nt, Human
ggaugccccgucccccu

SEQ ID NO: 3839978 - RNA, 21 nt, Human
ggaugcccuggagguggcuga

SEQ ID NO: 3839979 - RNA, 13 nt, Human
ggaugccuggugg

SEQ ID NO: 3839980 - RNA, 17 nt, Human
ggaugccugguggcagc

SEQ ID NO: 3839981 - RNA, 16 nt, Human
ggaugcgcagugccuu

SEQ ID NO: 3839982 - RNA, 16 nt, Human
ggaugcggauggccgg

SEQ ID NO: 3839983 - RNA, 22 nt, Human
ggaugcuucaugugaacguggg

SEQ ID NO: 3839984 - RNA, 19 nt, Human
ggauggaaaaggaagacua

SEQ ID NO: 3839985 - RNA, 19 nt, Human
ggauggaagguuggaugga

SEQ ID NO: 3839986 - RNA, 13 nt, Human
ggauggacaucuu

SEQ ID NO: 3839987 - RNA, 19 nt, Human
ggauggaggggugguccug

SEQ ID NO: 3839988 - RNA, 13 nt, Human
ggauggccccagc

SEQ ID NO: 3839989 - RNA, 16 nt, Human
ggauggccccagcaca

SEQ ID NO: 3839990 - RNA, 20 nt, Human
ggauggccgcagggcugugc

SEQ ID NO: 3839991 - RNA, 12 nt, Human
ggauggccgugg

SEQ ID NO: 3839992 - RNA, 21 nt, Human
ggauggccuggccagggccug

SEQ ID NO: 3839993 - RNA, 16 nt, Human
ggauggcggguggggg

SEQ ID NO: 3839994 - RNA, 22 nt, Human
ggaugggcagucauuuugcaga

SEQ ID NO: 3839995 - RNA, 16 nt, Human
ggaugggcugcagcag

SEQ ID NO: 3839996 - RNA, 15 nt, Human
ggauggggccacagc

SEQ ID NO: 3839997 - RNA, 13 nt, Human
ggauggggcuccc

SEQ ID NO: 3839998 - RNA, 22 nt, Human
ggaugggggcuggccucuggcu

SEQ ID NO: 3839999 - RNA, 15 nt, Human
ggaugggucagagcu

SEQ ID NO: 3840000 - RNA, 16 nt, Human
ggaugguaguuuuuuc

SEQ ID NO: 3840001 - RNA, 16 nt, Human
ggaugguccuggggcu

SEQ ID NO: 3840002 - RNA, 13 nt, Human
ggauggugcccug

SEQ ID NO: 3840003 - RNA, 15 nt, Human
ggauggugggcuuca

SEQ ID NO: 3840004 - RNA, 17 nt, Human
ggauggugugccuucca

SEQ ID NO: 3840005 - RNA, 21 nt, Human
ggaugguguuacugcaguuga

SEQ ID NO: 3840006 - RNA, 13 nt, Human
ggauguccccagc

SEQ ID NO: 3840007 - RNA, 22 nt, Human
ggaugucccugggccagggucu

SEQ ID NO: 3840008 - RNA, 14 nt, Human
ggaugucugccaau

SEQ ID NO: 3840009 - RNA, 14 nt, Human
ggaugucuuccuug

SEQ ID NO: 3840010 - RNA, 15 nt, Human
ggaugugacaguggc

SEQ ID NO: 3840011 - RNA, 16 nt, Human
ggaugugacaguggcg

SEQ ID NO: 3840012 - RNA, 18 nt, Human
ggaugugauuguggaaug

SEQ ID NO: 3840013 - RNA, 15 nt, Human
ggauguguccugaca

SEQ ID NO: 3840014 - RNA, 13 nt, Human
ggauguucuggga

SEQ ID NO: 3840015 - RNA, 22 nt, Human
ggauguugaaaaaguucugcag

SEQ ID NO: 3840016 - RNA, 23 nt, Human
ggauguuucugucacaucagcuc

SEQ ID NO: 3840017 - RNA, 19 nt, Human
ggauuaaacuuaugaaugu

SEQ ID NO: 3840018 - RNA, 21 nt, Human
ggauuaaacuuaugaauguuu

SEQ ID NO: 3840019 - RNA, 17 nt, Human
ggauuaaccucugcacu

SEQ ID NO: 3840020 - RNA, 18 nt, Human
ggauuaaccucugcacua

SEQ ID NO: 3840021 - RNA, 14 nt, Human
ggauuaauaugaaa

SEQ ID NO: 3840022 - RNA, 23 nt, Human
ggauuacaagcgugagccacugc

SEQ ID NO: 3840023 - RNA, 18 nt, Human
ggauuacuucucuauaaa

SEQ ID NO: 3840024 - RNA, 19 nt, Human
ggauuagucccuggccucu

SEQ ID NO: 3840025 - RNA, 12 nt, Human
ggauuauauuau

SEQ ID NO: 3840026 - RNA, 13 nt, Human
ggauuauccugag

SEQ ID NO: 3840027 - RNA, 19 nt, Human
ggauuaugggucacaggaa

SEQ ID NO: 3840028 - RNA, 19 nt, Human
ggauuauuagaaucaaaca

SEQ ID NO: 3840029 - RNA, 17 nt, Human
ggauuauucauuuaaaa

SEQ ID NO: 3840030 - RNA, 17 nt, Human
ggauuauuuaauaacau

SEQ ID NO: 3840031 - RNA, 18 nt, Human
ggauuauuuuuucagacc

SEQ ID NO: 3840032 - RNA, 11 nt, Human
ggauucaaauu

SEQ ID NO: 3840033 - RNA, 12 nt, Human
ggauucagccuu

SEQ ID NO: 3840034 - RNA, 19 nt, Human
ggauucaggaaaaggccug

SEQ ID NO: 3840035 - RNA, 20 nt, Human
ggauucaggaaaaggccugg

SEQ ID NO: 3840036 - RNA, 14 nt, Human
ggauucaggcugcu

SEQ ID NO: 3840037 - RNA, 20 nt, Human
ggauucaguuucuaaaauug

SEQ ID NO: 3840038 - RNA, 15 nt, Human
ggauucauuuccugc

SEQ ID NO: 3840039 - RNA, 22 nt, Human
ggauucccaccaaggucuucag

SEQ ID NO: 3840040 - RNA, 18 nt, Human
ggauuccccaucucaggc

SEQ ID NO: 3840041 - RNA, 13 nt, Human
ggauuccucuuuu

SEQ ID NO: 3840042 - RNA, 15 nt, Human
ggauuccucuuuucu

SEQ ID NO: 3840043 - RNA, 13 nt, Human
ggauuccugaccc

SEQ ID NO: 3840044 - RNA, 15 nt, Human
ggauuccugacccag

SEQ ID NO: 3840045 - RNA, 16 nt, Human
ggauuccugacccagg

SEQ ID NO: 3840046 - RNA, 19 nt, Human
ggauuccugacccaggccg

SEQ ID NO: 3840047 - RNA, 20 nt, Human
ggauucuacuuuaagcacua

SEQ ID NO: 3840048 - RNA, 16 nt, Human
ggauucugagagcugu

SEQ ID NO: 3840049 - RNA, 21 nt, Human
ggauucuggccuagucccuuc

SEQ ID NO: 3840050 - RNA, 14 nt, Human
ggauucugguucca

SEQ ID NO: 3840051 - RNA, 18 nt, Human
ggauucugguuccagggu

SEQ ID NO: 3840052 - RNA, 23 nt, Human
ggauucuguacaugcauugagcu

SEQ ID NO: 3840053 - RNA, 18 nt, Human
ggauucuuaaaguugaau

SEQ ID NO: 3840054 - RNA, 16 nt, Human
ggauucuuccaucuga

SEQ ID NO: 3840055 - RNA, 21 nt, Human
ggauucuuccucccucccucu

SEQ ID NO: 3840056 - RNA, 14 nt, Human
ggauucuuuccauu

SEQ ID NO: 3840057 - RNA, 18 nt, Human
ggauucuuuccauuauga

SEQ ID NO: 3840058 - RNA, 20 nt, Human
ggauugaacuucuuugaauu

SEQ ID NO: 3840059 - RNA, 20 nt, Human
ggauugaucggagccuccuc

SEQ ID NO: 3840060 - RNA, 14 nt, Human
ggauugauuuuaaa

SEQ ID NO: 3840061 - RNA, 15 nt, Human
ggauugcacguggcc

SEQ ID NO: 3840062 - RNA, 17 nt, Human
ggauugcacguggccuc

SEQ ID NO: 3840063 - RNA, 18 nt, Human
ggauugcacguggccucu

SEQ ID NO: 3840064 - RNA, 15 nt, Human
ggauugccucugaaa

SEQ ID NO: 3840065 - RNA, 18 nt, Human
ggauugcgagagaugugu

SEQ ID NO: 3840066 - RNA, 19 nt, Human
ggauugcgagagaugugug

SEQ ID NO: 3840067 - RNA, 16 nt, Human
ggauugcuaugaauga

SEQ ID NO: 3840068 - RNA, 15 nt, Human
ggauugggccccugc

SEQ ID NO: 3840069 - RNA, 17 nt, Human
ggauuggggucccucua

SEQ ID NO: 3840070 - RNA, 22 nt, Human
ggauuguaaaaaaaaaugccuu

SEQ ID NO: 3840071 - RNA, 16 nt, Human
ggauuguuaauuucag

SEQ ID NO: 3840072 - RNA, 18 nt, Human
ggauuuaaaagccugcuc

SEQ ID NO: 3840073 - RNA, 12 nt, Human
ggauuuaacaga

SEQ ID NO: 3840074 - RNA, 17 nt, Human
ggauuuaacagaaaugu

SEQ ID NO: 3840075 - RNA, 21 nt, Human
ggauuuaacagucauuuaaaa

SEQ ID NO: 3840076 - RNA, 14 nt, Human
ggauuuagaagugu

SEQ ID NO: 3840077 - RNA, 12 nt, Human
ggauuucuuagg

SEQ ID NO: 3840078 - RNA, 13 nt, Human
ggauuugaagcaa

SEQ ID NO: 3840079 - RNA, 18 nt, Human
ggauuugaugcuguuuga

SEQ ID NO: 3840080 - RNA, 18 nt, Human
ggauuuggagagaaauau

SEQ ID NO: 3840081 - RNA, 19 nt, Human
ggauuuuaaacuagaugac

SEQ ID NO: 3840082 - RNA, 15 nt, Human
ggauuuuauguugac

SEQ ID NO: 3840083 - RNA, 21 nt, Human
ggauuuuauguugacauuugu

SEQ ID NO: 3840084 - RNA, 16 nt, Human
ggauuuucaucagggg

SEQ ID NO: 3840085 - RNA, 16 nt, Human
ggauuuugucaagcag

SEQ ID NO: 3840086 - RNA, 15 nt, Human
ggauuuuuaauuaaa

SEQ ID NO: 3840087 - RNA, 16 nt, Human
ggauuuuuagaauuaa

SEQ ID NO: 3840088 - RNA, 16 nt, Human
ggcaaaagccuugugu

SEQ ID NO: 3840089 - RNA, 20 nt, Human
ggcaaaagccuuguguauau

SEQ ID NO: 3840090 - RNA, 11 nt, Human
ggcaaaauaau

SEQ ID NO: 3840091 - RNA, 23 nt, Human
ggcaaacaggcaguuggccagag

SEQ ID NO: 3840092 - RNA, 14 nt, Human
ggcaaacagggccu

SEQ ID NO: 3840093 - RNA, 18 nt, Human
ggcaaacagggccucugc

SEQ ID NO: 3840094 - RNA, 17 nt, Human
ggcaaacuucagacuga

SEQ ID NO: 3840095 - RNA, 11 nt, Human
ggcaaagccag

SEQ ID NO: 3840096 - RNA, 18 nt, Human
ggcaaagcuuuuagaaau

SEQ ID NO: 3840097 - RNA, 19 nt, Human
ggcaaaggguccagaagga

SEQ ID NO: 3840098 - RNA, 17 nt, Human
ggcaaauaaaauucccu

SEQ ID NO: 3840099 - RNA, 13 nt, Human
ggcaaauauaaaa

SEQ ID NO: 3840100 - RNA, 19 nt, Human
ggcaaaugacaugcacuga

SEQ ID NO: 3840101 - RNA, 20 nt, Human
ggcaaaugacaugcacugac

SEQ ID NO: 3840102 - RNA, 13 nt, Human
ggcaaaugcccaa

SEQ ID NO: 3840103 - RNA, 16 nt, Human
ggcaaaugcccaaggg

SEQ ID NO: 3840104 - RNA, 20 nt, Human
ggcaaauuaacuugaguuuu

SEQ ID NO: 3840105 - RNA, 14 nt, Human
ggcaaauucuuuug

SEQ ID NO: 3840106 - RNA, 21 nt, Human
ggcaaauuuuuauuuuuuagu

SEQ ID NO: 3840107 - RNA, 21 nt, Human
ggcaacacagcgagacuccgu

SEQ ID NO: 3840108 - RNA, 18 nt, Human
ggcgugagaccugccccu

SEQ ID NO: 3840109 - RNA, 17 nt, Human
ggcgugagccaccucgc

SEQ ID NO: 3840110 - RNA, 20 nt, Human
ggcauccucagguggucagg

SEQ ID NO: 3840111 - RNA, 19 nt, Human
ggcauccuucugccuuuuu

SEQ ID NO: 3840112 - RNA, 18 nt, Human
ggcaucgcaccauucuga

SEQ ID NO: 3840113 - RNA, 21 nt, Human
ggcaucgcaccauucugacuc

SEQ ID NO: 3840114 - RNA, 22 nt, Human
ggcaucggggagccgggagccu

SEQ ID NO: 3840115 - RNA, 15 nt, Human
ggcaucuaucugugc

SEQ ID NO: 3840116 - RNA, 16 nt, Human
ggcaucuccaggaagg

SEQ ID NO: 3840117 - RNA, 17 nt, Human
ggcaucuccugugcaug

SEQ ID NO: 3840118 - RNA, 15 nt, Human
ggcaucucuaauugg

SEQ ID NO: 3840119 - RNA, 13 nt, Human
ggcaucucugggc

SEQ ID NO: 3840120 - RNA, 14 nt, Human
ggcaucucugggcu

SEQ ID NO: 3840121 - RNA, 16 nt, Human
ggcaucucugggcugg

SEQ ID NO: 3840122 - RNA, 21 nt, Human
ggcaucucugucccauucccu

SEQ ID NO: 3840123 - RNA, 22 nt, Human
ggcaucucugucccauucccug

SEQ ID NO: 3840124 - RNA, 23 nt, Human
ggcaucucugucccauucccugg

SEQ ID NO: 3840125 - RNA, 15 nt, Human
ggcaucugacacaaa

SEQ ID NO: 3840126 - RNA, 19 nt, Human
ggcaucugauuugcauauu

SEQ ID NO: 3840127 - RNA, 22 nt, Human
ggcaucugcacccucgaugaag

SEQ ID NO: 3840128 - RNA, 16 nt, Human
ggcaucuggccuggcc

SEQ ID NO: 3840129 - RNA, 23 nt, Human
ggcaucuuugccuugggcugcuc

SEQ ID NO: 3840130 - RNA, 20 nt, Human
ggcaucuuugcuauggggac

SEQ ID NO: 3840131 - RNA, 17 nt, Human
ggcaucuuuuguauuaa

SEQ ID NO: 3840132 - RNA, 21 nt, Human
ggcaucuuuuguauuaagaaa

SEQ ID NO: 3840133 - RNA, 19 nt, Human
ggcaugaaaugaacacaaa

SEQ ID NO: 3840134 - RNA, 15 nt, Human
ggcaugaagacagau

SEQ ID NO: 3840135 - RNA, 21 nt, Human
ggcaugagacucagugcagau

SEQ ID NO: 3840136 - RNA, 16 nt, Human
ggcaugauccaagcaa

SEQ ID NO: 3840137 - RNA, 18 nt, Human
ggcaugauccaagcaaga

SEQ ID NO: 3840138 - RNA, 16 nt, Human
ggcaugcaccugcaau

SEQ ID NO: 3840139 - RNA, 21 nt, Human
ggcaugcaccugcaaucccag

SEQ ID NO: 3840140 - RNA, 20 nt, Human
ggcaugccccggccaccucu

SEQ ID NO: 3840141 - RNA, 13 nt, Human
ggcaugccuugug

SEQ ID NO: 3840142 - RNA, 16 nt, Human
ggcaugcuggggcaag

SEQ ID NO: 3840143 - RNA, 17 nt, Human
ggcauggccagguggcc

SEQ ID NO: 3840144 - RNA, 13 nt, Human
ggcauggcccugg

SEQ ID NO: 3840145 - RNA, 23 nt, Human
ggcauggcuuuauuuguuuuuuu

SEQ ID NO: 3840146 - RNA, 21 nt, Human
ggcaugggaaagccaccucuc

SEQ ID NO: 3840147 - RNA, 18 nt, Human
ggcaugggaaggugggcg

SEQ ID NO: 3840148 - RNA, 23 nt, Human
ggcaugggggccucagggcagcc

SEQ ID NO: 3840149 - RNA, 18 nt, Human
ggcauggggugggccucu

SEQ ID NO: 3840150 - RNA, 16 nt, Human
ggcaugguguucuccu

SEQ ID NO: 3840151 - RNA, 18 nt, Human
ggcauguaaauguaaacu

SEQ ID NO: 3840152 - RNA, 17 nt, Human
ggcauguauuggccugg

SEQ ID NO: 3840153 - RNA, 21 nt, Human
ggcauguauuggccuggaggu

SEQ ID NO: 3840154 - RNA, 24 nt, Human
ggcaugucaacagcguuccuagag

SEQ ID NO: 3840155 - RNA, 13 nt, Human
ggcauguggccug

SEQ ID NO: 3840156 - RNA, 15 nt, Human
ggcauguggccugug

SEQ ID NO: 3840157 - RNA, 17 nt, Human
ggcauguggccuguggc

SEQ ID NO: 3840158 - RNA, 23 nt, Human
ggcauguuagcccuuccuccaau

SEQ ID NO: 3840159 - RNA, 19 nt, Human
ggcauguuuugugcauuug

SEQ ID NO: 3840160 - RNA, 16 nt, Human
ggcauuaauguuucua

SEQ ID NO: 3840161 - RNA, 20 nt, Human
ggcauuagaauuauuuaaac

SEQ ID NO: 3840162 - RNA, 24 nt, Human
ggcauuagcuaaaaccuuccaugu

SEQ ID NO: 3840163 - RNA, 23 nt, Human
ggcauuccagcuccuccgugcuu

SEQ ID NO: 3840164 - RNA, 17 nt, Human
ggcauuccccaggaggc

SEQ ID NO: 3840165 - RNA, 16 nt, Human
ggcauugauggggaag

SEQ ID NO: 3840166 - RNA, 12 nt, Human
ggcauugcuuuc

SEQ ID NO: 3840167 - RNA, 13 nt, Human
ggcauugcuuucc

SEQ ID NO: 3840168 - RNA, 14 nt, Human
ggcauuucccccac

SEQ ID NO: 3840169 - RNA, 15 nt, Human
ggcauuuccugggug

SEQ ID NO: 3840170 - RNA, 16 nt, Human
ggcauuuccugggugg

SEQ ID NO: 3840171 - RNA, 18 nt, Human
ggcauuuccuggguggcu

SEQ ID NO: 3840172 - RNA, 20 nt, Human
ggcauuugcaggguccucuu

SEQ ID NO: 3840173 - RNA, 14 nt, Human
ggcauuugcugaau

SEQ ID NO: 3840174 - RNA, 12 nt, Human
ggcauuuguuca

SEQ ID NO: 3840175 - RNA, 17 nt, Human
ggcauuuguuucuuucu

SEQ ID NO: 3840176 - RNA, 17 nt, Human
ggcauuuguuugaacug

SEQ ID NO: 3840177 - RNA, 21 nt, Human
ggcauuuuuaccaucacugag

SEQ ID NO: 3840178 - RNA, 17 nt, Human
ggccaaaagcuagacag

SEQ ID NO: 3840179 - RNA, 15 nt, Human
ggccaaaaggaaaaa

SEQ ID NO: 3840180 - RNA, 14 nt, Human
ggccaaacugcugg

SEQ ID NO: 3840181 - RNA, 17 nt, Human
ggccaaacugcuggacg

SEQ ID NO: 3840182 - RNA, 16 nt, Human
ggccaaaggcuggugg

SEQ ID NO: 3840183 - RNA, 20 nt, Human
ggccaaaggggaccuggaag

SEQ ID NO: 3840184 - RNA, 13 nt, Human
ggccaaaguguua

SEQ ID NO: 3840185 - RNA, 18 nt, Human
ggccaacaccagggaugg

SEQ ID NO: 3840186 - RNA, 19 nt, Human
ggccaacaucgugaaaccc

SEQ ID NO: 3840187 - RNA, 13 nt, Human
ggccaagaggcug

SEQ ID NO: 3840188 - RNA, 23 nt, Human
ggccaagagguuuggcuccugcc

SEQ ID NO: 3840189 - RNA, 14 nt, Human
ggccaagcagggag

SEQ ID NO: 3840190 - RNA, 23 nt, Human
ggccaagcugaggugcccaggag

SEQ ID NO: 3840191 - RNA, 15 nt, Human
ggccaaggacugccg

SEQ ID NO: 3840192 - RNA, 15 nt, Human
ggccaagguguccua

SEQ ID NO: 3840193 - RNA, 16 nt, Human
ggccaagucccaccgg

SEQ ID NO: 3840194 - RNA, 16 nt, Human
ggccaaguccgcagaa

SEQ ID NO: 3840195 - RNA, 20 nt, Human
ggccaagugcaggcuggcac

SEQ ID NO: 3840196 - RNA, 13 nt, Human
ggccaaguuccuc

SEQ ID NO: 3840197 - RNA, 15 nt, Human
ggccacacugugaca

SEQ ID NO: 3840198 - RNA, 17 nt, Human
ggccacacugugacaca

SEQ ID NO: 3840199 - RNA, 17 nt, Human
ggccacacuucaaacua

SEQ ID NO: 3840200 - RNA, 20 nt, Human
ggccacacuucaaacuacuu

SEQ ID NO: 3840201 - RNA, 14 nt, Human
ggccacagaaaauu

SEQ ID NO: 3840202 - RNA, 22 nt, Human
ggccacagaggacucacuugcc

SEQ ID NO: 3840203 - RNA, 23 nt, Human
ggccacagggcgagacuccgucu

SEQ ID NO: 3840204 - RNA, 20 nt, Human
ggccacaguagucuugauga

SEQ ID NO: 3840205 - RNA, 20 nt, Human
ggccacaugagucccagugg

SEQ ID NO: 3840206 - RNA, 20 nt, Human
ggccacaugggagcagucca

SEQ ID NO: 3840207 - RNA, 18 nt, Human
ggccacaugggaggcuca

SEQ ID NO: 3840208 - RNA, 19 nt, Human
ggccacauggggcugggca

SEQ ID NO: 3840209 - RNA, 14 nt, Human
ggccacauuuaaua

SEQ ID NO: 3840210 - RNA, 20 nt, Human
ggccacauuuucagccaaag

SEQ ID NO: 3840211 - RNA, 14 nt, Human
ggccaccacccccc

SEQ ID NO: 3840212 - RNA, 17 nt, Human
ggccaccaccccccacu

SEQ ID NO: 3840213 - RNA, 18 nt, Human
ggccaccaccccccacuc

SEQ ID NO: 3840214 - RNA, 12 nt, Human
ggccaccaggcu

SEQ ID NO: 3840215 - RNA, 21 nt, Human
ggccacccguucugcuggccu

SEQ ID NO: 3840216 - RNA, 24 nt, Human
ggccacccguucugcuggccugga

SEQ ID NO: 3840217 - RNA, 18 nt, Human
ggccacccugugcagaag

SEQ ID NO: 3840218 - RNA, 18 nt, Human
ggccaccgccuugcccag

SEQ ID NO: 3840219 - RNA, 13 nt, Human
ggccaccucccca

SEQ ID NO: 3840220 - RNA, 16 nt, Human
ggccaccuccccagca

SEQ ID NO: 3840221 - RNA, 17 nt, Human
ggccaccuccccagcau

SEQ ID NO: 3840222 - RNA, 11 nt, Human
ggccaccuccu

SEQ ID NO: 3840223 - RNA, 23 nt, Human
ggccaccuccuaaaaggcccaga

SEQ ID NO: 3840224 - RNA, 18 nt, Human
ggccaccucuccaagggc

SEQ ID NO: 3840225 - RNA, 20 nt, Human
ggccaccucuccaagggcuu

SEQ ID NO: 3840226 - RNA, 12 nt, Human
ggccaccucugc

SEQ ID NO: 3840227 - RNA, 17 nt, Human
ggccaccugaggugggc

SEQ ID NO: 3840228 - RNA, 12 nt, Human
ggccaccugcag

SEQ ID NO: 3840229 - RNA, 13 nt, Human
ggccaccugcagg

SEQ ID NO: 3840230 - RNA, 13 nt, Human
ggccaccugcccc

SEQ ID NO: 3840231 - RNA, 14 nt, Human
ggccaccugccccc

SEQ ID NO: 3840232 - RNA, 17 nt, Human
ggccaccuggcucucac

SEQ ID NO: 3840233 - RNA, 14 nt, Human
ggccacgcagccag

SEQ ID NO: 3840234 - RNA, 15 nt, Human
ggccacgcagccagg

SEQ ID NO: 3840235 - RNA, 11 nt, Human
ggccacgugcc

SEQ ID NO: 3840236 - RNA, 24 nt, Human
ggccacuccagaccccuggcuuuu

SEQ ID NO: 3840237 - RNA, 13 nt, Human
ggccacuccucca

SEQ ID NO: 3840238 - RNA, 15 nt, Human
ggccacuccuuccug

SEQ ID NO: 3840239 - RNA, 19 nt, Human
ggccacuccuuccugcccc

SEQ ID NO: 3840240 - RNA, 21 nt, Human
ggccacucugccucugccugc

SEQ ID NO: 3840241 - RNA, 14 nt, Human
ggccacugaagaua

SEQ ID NO: 3840242 - RNA, 22 nt, Human
ggccacugcucccuaagccagc

SEQ ID NO: 3840243 - RNA, 11 nt, Human
ggccacuguga

SEQ ID NO: 3840244 - RNA, 20 nt, Human
ggccacugugaagagaacca

SEQ ID NO: 3840245 - RNA, 14 nt, Human
ggccacuucugucc

SEQ ID NO: 3840246 - RNA, 14 nt, Human
ggccagaagaugaa

SEQ ID NO: 3840247 - RNA, 21 nt, Human
ggccagaagaugaacagacug

SEQ ID NO: 3840248 - RNA, 16 nt, Human
ggccagaaguaccaga

SEQ ID NO: 3840249 - RNA, 17 nt, Human
ggccagaaguagcuuug

SEQ ID NO: 3840250 - RNA, 17 nt, Human
ggccagacacaggcccu

SEQ ID NO: 3840251 - RNA, 14 nt, Human
ggccagaccagagc

SEQ ID NO: 3840252 - RNA, 15 nt, Human
ggccagaccagagcu

SEQ ID NO: 3840253 - RNA, 16 nt, Human
ggccagaccagagcuc

SEQ ID NO: 3840254 - RNA, 16 nt, Human
ggccagaccauggaca

SEQ ID NO: 3840255 - RNA, 23 nt, Human
gaaagugccuuugcagcucagaa

SEQ ID NO: 3840256 - RNA, 21 nt, Human
gaaaguggccaugccacccug

SEQ ID NO: 3840257 - RNA, 18 nt, Human
gaaagugggcaaaagcuu

SEQ ID NO: 3840258 - RNA, 22 nt, Human
gaaagugggcuuaauggaguuc

SEQ ID NO: 3840259 - RNA, 15 nt, Human
gaaaguguaaagcau

SEQ ID NO: 3840260 - RNA, 19 nt, Human
gaaaguguauaauaagaaa

SEQ ID NO: 3840261 - RNA, 15 nt, Human
gaaaguguauuugga

SEQ ID NO: 3840262 - RNA, 18 nt, Human
gaaaguguucuguuacaa

SEQ ID NO: 3840263 - RNA, 22 nt, Human
gaaaguugcaaggcaaauguuu

SEQ ID NO: 3840264 - RNA, 20 nt, Human
gaaaguugcacggcugcuga

SEQ ID NO: 3840265 - RNA, 13 nt, Human
gaaaguuguacau

SEQ ID NO: 3840266 - RNA, 23 nt, Human
gaaaguuuccccaccagugaaug

SEQ ID NO: 3840267 - RNA, 20 nt, Human
gaaaguuucguuauauuaaa

SEQ ID NO: 3840268 - RNA, 23 nt, Human
gaaaguuuugaguagauauuacu

SEQ ID NO: 3840269 - RNA, 21 nt, Human
gaaaguuuuguaaaagaaauc

SEQ ID NO: 3840270 - RNA, 15 nt, Human
gaaauaaaaaagucu

SEQ ID NO: 3840271 - RNA, 18 nt, Human
gaaauaaaaaagucucua

SEQ ID NO: 3840272 - RNA, 14 nt, Human
gaaauaaaaccuuu

SEQ ID NO: 3840273 - RNA, 16 nt, Human
gaaauaaaaccuuuca

SEQ ID NO: 3840274 - RNA, 17 nt, Human
gaaauaaaaccuuucaa

SEQ ID NO: 3840275 - RNA, 23 nt, Human
gaaauaaaaggaagccaaagagu

SEQ ID NO: 3840276 - RNA, 17 nt, Human
gaaauaaacgucuuaaa

SEQ ID NO: 3840277 - RNA, 18 nt, Human
gaaauaaacgucuuaaau

SEQ ID NO: 3840278 - RNA, 14 nt, Human
gaaauaaagucaga

SEQ ID NO: 3840279 - RNA, 18 nt, Human
gaaauaaaguuggugaca

SEQ ID NO: 3840280 - RNA, 17 nt, Human
gaaauaaaguuugcuua

SEQ ID NO: 3840281 - RNA, 23 nt, Human
gaaauaaauagcuauauccaugu

SEQ ID NO: 3840282 - RNA, 15 nt, Human
gaaauaaaugcccca

SEQ ID NO: 3840283 - RNA, 20 nt, Human
gaaauaaauguaccugaugu

SEQ ID NO: 3840284 - RNA, 17 nt, Human
gaaauaacaauguuaag

SEQ ID NO: 3840285 - RNA, 20 nt, Human
gaaauaacaauguuaaggaa

SEQ ID NO: 3840286 - RNA, 17 nt, Human
gaaauaacagaagaaaa

SEQ ID NO: 3840287 - RNA, 19 nt, Human
gaaauaacagaagaaaaua

SEQ ID NO: 3840288 - RNA, 21 nt, Human
gaaauaagaaaaaucauguuu

SEQ ID NO: 3840289 - RNA, 18 nt, Human
gaaauaagugcccucucc

SEQ ID NO: 3840290 - RNA, 13 nt, Human
gaaauaauaaauc

SEQ ID NO: 3840291 - RNA, 13 nt, Human
gaaauaauaauau

SEQ ID NO: 3840292 - RNA, 21 nt, Human
gaaauaaugcuacaauuuuaa

SEQ ID NO: 3840293 - RNA, 18 nt, Human
gaaauaauuuuauuccag

SEQ ID NO: 3840294 - RNA, 12 nt, Human
gaaauacauauu

SEQ ID NO: 3840295 - RNA, 21 nt, Human
gaaauacauauuuccaagaag

SEQ ID NO: 3840296 - RNA, 17 nt, Human
gaaauacauggacaaua

SEQ ID NO: 3840297 - RNA, 14 nt, Human
gaaauacccuucuu

SEQ ID NO: 3840298 - RNA, 16 nt, Human
gaaauaccucauguuu

SEQ ID NO: 3840299 - RNA, 21 nt, Human
gaaauaccucauguuuaugaa

SEQ ID NO: 3840300 - RNA, 19 nt, Human
gaaauacuacuccuguaau

SEQ ID NO: 3840301 - RNA, 17 nt, Human
gaaauacuacuguguaa

SEQ ID NO: 3840302 - RNA, 20 nt, Human
gaaauacuagauuugggaga

SEQ ID NO: 3840303 - RNA, 14 nt, Human
gaaauacuauuuaa

SEQ ID NO: 3840304 - RNA, 20 nt, Human
gaaauagaaaaacccugccc

SEQ ID NO: 3840305 - RNA, 21 nt, Human
gaaauagaaaaacccugcccc

SEQ ID NO: 3840306 - RNA, 19 nt, Human
gaaauagacaaaaaguaua

SEQ ID NO: 3840307 - RNA, 18 nt, Human
gaaauagacagcaugaga

SEQ ID NO: 3840308 - RNA, 19 nt, Human
gaaauagcuuaugaaaaga

SEQ ID NO: 3840309 - RNA, 15 nt, Human
gaaauagguuagagu

SEQ ID NO: 3840310 - RNA, 17 nt, Human
gaaauagucugugugaa

SEQ ID NO: 3840311 - RNA, 15 nt, Human
gaaauauaauaaaau

SEQ ID NO: 3840312 - RNA, 13 nt, Human
gaaauauaauuga

SEQ ID NO: 3840313 - RNA, 23 nt, Human
gaaauauacuuuuacaaguaaca

SEQ ID NO: 3840314 - RNA, 19 nt, Human
gaaauauauacaaaaagaa

SEQ ID NO: 3840315 - RNA, 15 nt, Human
gaaauauauauacau

SEQ ID NO: 3840316 - RNA, 12 nt, Human
gaaauauauauu

SEQ ID NO: 3840317 - RNA, 15 nt, Human
gaaauauauauuaua

SEQ ID NO: 3840318 - RNA, 23 nt, Human
gaaauauauggucuaauguuuaa

SEQ ID NO: 3840319 - RNA, 13 nt, Human
gaaauauauguga

SEQ ID NO: 3840320 - RNA, 14 nt, Human
gaaauauaugugaa

SEQ ID NO: 3840321 - RNA, 23 nt, Human
gaaauaucaguuacucagcccug

SEQ ID NO: 3840322 - RNA, 22 nt, Human
gaaauaucaucacguauguuau

SEQ ID NO: 3840323 - RNA, 17 nt, Human
ggccaggcugcucucaa

SEQ ID NO: 3840324 - RNA, 14 nt, Human
ggccaggcuggucu

SEQ ID NO: 3840325 - RNA, 15 nt, Human
ggccagggagaagcu

SEQ ID NO: 3840326 - RNA, 13 nt, Human
ggccagggcagag

SEQ ID NO: 3840327 - RNA, 21 nt, Human
ggccagggccacgcuccagcu

SEQ ID NO: 3840328 - RNA, 17 nt, Human
ggccagggcccugcaga

SEQ ID NO: 3840329 - RNA, 18 nt, Human
ggccagggcccugcagag

SEQ ID NO: 3840330 - RNA, 12 nt, Human
ggccagggccug

SEQ ID NO: 3840331 - RNA, 20 nt, Human
ggccagggcuauagcucagg

SEQ ID NO: 3840332 - RNA, 17 nt, Human
ggccagggcugcccuga

SEQ ID NO: 3840333 - RNA, 18 nt, Human
ggccagggcugcccugag

SEQ ID NO: 3840334 - RNA, 17 nt, Human
ggccagggucuguguga

SEQ ID NO: 3840335 - RNA, 19 nt, Human
ggccagggucugugugaau

SEQ ID NO: 3840336 - RNA, 22 nt, Human
ggccagggucugugugaaugug

SEQ ID NO: 3840337 - RNA, 23 nt, Human
ggccagggucugugugaaugugg

SEQ ID NO: 3840338 - RNA, 14 nt, Human
ggccaggugcacag

SEQ ID NO: 3840339 - RNA, 14 nt, Human
ggccaggugccucc

SEQ ID NO: 3840340 - RNA, 18 nt, Human
ggccaguaccuuuccauu

SEQ ID NO: 3840341 - RNA, 14 nt, Human
ggccaguccaggcu

SEQ ID NO: 3840342 - RNA, 22 nt, Human
ggccaguccugccuggccaggc

SEQ ID NO: 3840343 - RNA, 17 nt, Human
ggccagucugggcugcc

SEQ ID NO: 3840344 - RNA, 15 nt, Human
ggccagucuguggau

SEQ ID NO: 3840345 - RNA, 15 nt, Human
ggccagugcuccagc

SEQ ID NO: 3840346 - RNA, 19 nt, Human
ggccaguggggccugugga

SEQ ID NO: 3840347 - RNA, 14 nt, Human
ggccaguguuuaaa

SEQ ID NO: 3840348 - RNA, 17 nt, Human
ggccaguuggucccccu

SEQ ID NO: 3840349 - RNA, 22 nt, Human
ggccauacuggccucgccuggc

SEQ ID NO: 3840350 - RNA, 20 nt, Human
ggccauauuuaccucagccu

SEQ ID NO: 3840351 - RNA, 16 nt, Human
ggccaucccaaggucu

SEQ ID NO: 3840352 - RNA, 20 nt, Human
ggccauccuucccugucugc

SEQ ID NO: 3840353 - RNA, 23 nt, Human
ggccaucuccacccccagcugcu

SEQ ID NO: 3840354 - RNA, 21 nt, Human
ggccaucucugaacuucagcu

SEQ ID NO: 3840355 - RNA, 20 nt, Human
ggccaucuggagagcccaga

SEQ ID NO: 3840356 - RNA, 15 nt, Human
ggccaugaacuuugu

SEQ ID NO: 3840357 - RNA, 22 nt, Human
ggccaugacccugccucuccca

SEQ ID NO: 3840358 - RNA, 18 nt, Human
ggccaugagcuccagacc

SEQ ID NO: 3840359 - RNA, 15 nt, Human
ggccaugauggcaac

SEQ ID NO: 3840360 - RNA, 18 nt, Human
ggccaugauggcaacaga

SEQ ID NO: 3840361 - RNA, 21 nt, Human
ggccaugauucgcccaaagcc

SEQ ID NO: 3840362 - RNA, 17 nt, Human
ggccaugccuccucagg

SEQ ID NO: 3840363 - RNA, 18 nt, Human
ggccaugccuccucagga

SEQ ID NO: 3840364 - RNA, 13 nt, Human
ggccaugccugcc

SEQ ID NO: 3840365 - RNA, 15 nt, Human
ggccaugcuccucuu

SEQ ID NO: 3840366 - RNA, 17 nt, Human
ggccaugcugaagggac

SEQ ID NO: 3840367 - RNA, 21 nt, Human
ggccauggacucuguccugaa

SEQ ID NO: 3840368 - RNA, 22 nt, Human
ggccauggacucuguccugaag

SEQ ID NO: 3840369 - RNA, 16 nt, Human
ggccauggagaaagcu

SEQ ID NO: 3840370 - RNA, 18 nt, Human
ggccauggagaaagcuga

SEQ ID NO: 3840371 - RNA, 16 nt, Human
ggccauggagagcugg

SEQ ID NO: 3840372 - RNA, 22 nt, Human
ggccauggagagcuggagccug

SEQ ID NO: 3840373 - RNA, 13 nt, Human
ggccaugggaggc

SEQ ID NO: 3840374 - RNA, 15 nt, Human
ggccaugggaggccu

SEQ ID NO: 3840375 - RNA, 16 nt, Human
ggccaugggccuccug

SEQ ID NO: 3840376 - RNA, 19 nt, Human
ggccaugguacccccuucu

SEQ ID NO: 3840377 - RNA, 20 nt, Human
ggccaugguacccccuucug

SEQ ID NO: 3840378 - RNA, 16 nt, Human
ggccauguaugaagcc

SEQ ID NO: 3840379 - RNA, 22 nt, Human
ggccauguccaaagaggcugcc

SEQ ID NO: 3840380 - RNA, 23 nt, Human
ggccauguuccaauaaacaggag

SEQ ID NO: 3840381 - RNA, 14 nt, Human
ggccauuugcaaua

SEQ ID NO: 3840382 - RNA, 19 nt, Human
ggcccaacaggggcuccau

SEQ ID NO: 3840383 - RNA, 16 nt, Human
ggcccaacccugucug

SEQ ID NO: 3840384 - RNA, 20 nt, Human
ggcccaagagucuggggacc

SEQ ID NO: 3840385 - RNA, 11 nt, Human
ggcccacacac

SEQ ID NO: 3840386 - RNA, 14 nt, Human
ggcccacacacagg

SEQ ID NO: 3840387 - RNA, 23 nt, Human
ggcccacagcaggugcugagcaa

SEQ ID NO: 3840388 - RNA, 16 nt, Human
ggcccacauuggaaga

SEQ ID NO: 3840389 - RNA, 12 nt, Human
ggcccacccugc

SEQ ID NO: 3840390 - RNA, 22 nt, Human
ggcccacccugcuuggcccagg

SEQ ID NO: 3840391 - RNA, 14 nt, Human
ggcccaccuggcca

SEQ ID NO: 3840392 - RNA, 16 nt, Human
ggcccaccuggccacc

SEQ ID NO: 3840393 - RNA, 17 nt, Human
ggcccacgugguugggg

SEQ ID NO: 3840394 - RNA, 13 nt, Human
ggcccacugugcc

SEQ ID NO: 3840395 - RNA, 17 nt, Human
ggcccacugugccucag

SEQ ID NO: 3840396 - RNA, 18 nt, Human
ggcccacugugccucaga

SEQ ID NO: 3840397 - RNA, 20 nt, Human
ggcccagagagaagagcccc

SEQ ID NO: 3840398 - RNA, 23 nt, Human
ggcccagagagaagagccccacu

SEQ ID NO: 3840399 - RNA, 20 nt, Human
ggggaguuucuuuccugccu

SEQ ID NO: 3840400 - RNA, 20 nt, Human
ggggauaaaaugacuacuua

SEQ ID NO: 3840401 - RNA, 13 nt, Human
ggggauaugcuua

SEQ ID NO: 3840402 - RNA, 22 nt, Human
ggggaucaucugccgugccugg

SEQ ID NO: 3840403 - RNA, 13 nt, Human
ggggauguguccu

SEQ ID NO: 3840404 - RNA, 11 nt, Human
ggggauucuua

SEQ ID NO: 3840405 - RNA, 15 nt, Human
ggggauucuuaaagu

SEQ ID NO: 3840406 - RNA, 13 nt, Human
ggggcacagggag

SEQ ID NO: 3840407 - RNA, 13 nt, Human
ggggcagaacagc

SEQ ID NO: 3840408 - RNA, 14 nt, Human
ggggcagagccucc

SEQ ID NO: 3840409 - RNA, 23 nt, Human
ggggcagaggcaguaccugggca

SEQ ID NO: 3840410 - RNA, 18 nt, Human
ggggcagcacccuauaaa

SEQ ID NO: 3840411 - RNA, 15 nt, Human
ggggcagcagcagcc

SEQ ID NO: 3840412 - RNA, 16 nt, Human
ggggcagcagcagccc

SEQ ID NO: 3840413 - RNA, 19 nt, Human
ggggcagcagcagcccugc

SEQ ID NO: 3840414 - RNA, 20 nt, Human
ggggcagcagcagcccugcc

SEQ ID NO: 3840415 - RNA, 12 nt, Human
ggggcagccccc

SEQ ID NO: 3840416 - RNA, 14 nt, Human
ggggcagccugccu

SEQ ID NO: 3840417 - RNA, 23 nt, Human
ggggcagcuucuauuagccaguc

SEQ ID NO: 3840418 - RNA, 16 nt, Human
ggggcaggagcucaga

SEQ ID NO: 3840419 - RNA, 16 nt, Human
ggggcaggagggcccu

SEQ ID NO: 3840420 - RNA, 11 nt, Human
ggggcaggagu

SEQ ID NO: 3840421 - RNA, 17 nt, Human
ggggcaggcacagcaca

SEQ ID NO: 3840422 - RNA, 22 nt, Human
ggggcaggcccugcacuguccu

SEQ ID NO: 3840423 - RNA, 19 nt, Human
ggggcagggagcugggccc

SEQ ID NO: 3840424 - RNA, 14 nt, Human
ggggcagucaccug

SEQ ID NO: 3840425 - RNA, 19 nt, Human
ggggcagucugagagaggc

SEQ ID NO: 3840426 - RNA, 13 nt, Human
ggggcagugcuca

SEQ ID NO: 3840427 - RNA, 17 nt, Human
ggggcagugcucaccca

SEQ ID NO: 3840428 - RNA, 21 nt, Human
ggggcagugcuuggcccagga

SEQ ID NO: 3840429 - RNA, 14 nt, Human
ggggcaucugcccc

SEQ ID NO: 3840430 - RNA, 16 nt, Human
ggggcaugcuggggca

SEQ ID NO: 3840431 - RNA, 23 nt, Human
ggggccagaggaacuguccagag

SEQ ID NO: 3840432 - RNA, 12 nt, Human
ggggccagaggc

SEQ ID NO: 3840433 - RNA, 19 nt, Human
ggggccagauccagccugg

SEQ ID NO: 3840434 - RNA, 16 nt, Human
ggggccaggcuggguc

SEQ ID NO: 3840435 - RNA, 19 nt, Human
ggggccaguuggucccccu

SEQ ID NO: 3840436 - RNA, 17 nt, Human
ggggccaugccuccuca

SEQ ID NO: 3840437 - RNA, 19 nt, Human
ggggcccaaggcggccccu

SEQ ID NO: 3840438 - RNA, 16 nt, Human
ggggccccagucagcc

SEQ ID NO: 3840439 - RNA, 21 nt, Human
ggggccccgucucaggucuga

SEQ ID NO: 3840440 - RNA, 18 nt, Human
ggggccccucucagcccu

SEQ ID NO: 3840441 - RNA, 22 nt, Human
ggggccccuuuuuacuccccuu

SEQ ID NO: 3840442 - RNA, 23 nt, Human
ggggcccgccuggcagaacugag

SEQ ID NO: 3840443 - RNA, 20 nt, Human
ggggcccgcuugccucggcu

SEQ ID NO: 3840444 - RNA, 21 nt, Human
ggggcccguugucucccuggc

SEQ ID NO: 3840445 - RNA, 23 nt, Human
ggggcccguugucucccuggccc

SEQ ID NO: 3840446 - RNA, 16 nt, Human
ggggcccugccuccuu

SEQ ID NO: 3840447 - RNA, 23 nt, Human
ggggcccugccuccuuugugagg

SEQ ID NO: 3840448 - RNA, 12 nt, Human
ggggcccugguc

SEQ ID NO: 3840449 - RNA, 18 nt, Human
ggggcccuuggagcgugg

SEQ ID NO: 3840450 - RNA, 19 nt, Human
ggggccgaugcccagagac

SEQ ID NO: 3840451 - RNA, 14 nt, Human
ggggccgcugccac

SEQ ID NO: 3840452 - RNA, 13 nt, Human
ggggccgggcaca

SEQ ID NO: 3840453 - RNA, 13 nt, Human
ggggccucagacg

SEQ ID NO: 3840454 - RNA, 12 nt, Human
ggggccucaggu

SEQ ID NO: 3840455 - RNA, 14 nt, Human
ggggccugacugcu

SEQ ID NO: 3840456 - RNA, 19 nt, Human
ggggccugccaccuggacc

SEQ ID NO: 3840457 - RNA, 14 nt, Human
ggggccuggaccug

SEQ ID NO: 3840458 - RNA, 11 nt, Human
ggggccuggcu

SEQ ID NO: 3840459 - RNA, 19 nt, Human
ggggccuggcuggcugagg

SEQ ID NO: 3840460 - RNA, 23 nt, Human
ggggccugggacuuccaugccuu

SEQ ID NO: 3840461 - RNA, 12 nt, Human
ggggccugggag

SEQ ID NO: 3840462 - RNA, 20 nt, Human
ggggccuuagggcacugggc

SEQ ID NO: 3840463 - RNA, 17 nt, Human
ggggccuuaucgggcuc

SEQ ID NO: 3840464 - RNA, 17 nt, Human
ggggcgaggcagaggac

SEQ ID NO: 3840465 - RNA, 13 nt, Human
ggggcgaggcagg

SEQ ID NO: 3840466 - RNA, 22 nt, Human
ggggcgccgcaaaccacacugg

SEQ ID NO: 3840467 - RNA, 13 nt, Human
ggggcgcuggccc

SEQ ID NO: 3840468 - RNA, 13 nt, Human
ggggcguccaggc

SEQ ID NO: 3840469 - RNA, 20 nt, Human
ggggcgucuguucccccuuc

SEQ ID NO: 3840470 - RNA, 15 nt, Human
ggggcuaagacuucc

SEQ ID NO: 3840471 - RNA, 14 nt, Human
ggggcuaauuuaac

SEQ ID NO: 3840472 - RNA, 11 nt, Human
ggggcucagag

SEQ ID NO: 3840473 - RNA, 12 nt, Human
ggggcucagcaa

SEQ ID NO: 3840474 - RNA, 14 nt, Human
ggggcucagcaagg

SEQ ID NO: 3840475 - RNA, 16 nt, Human
ggggcucccuccgccc

SEQ ID NO: 3840476 - RNA, 12 nt, Human
ggggcuccugga

SEQ ID NO: 3840477 - RNA, 13 nt, Human
ggggcuccuggaa

SEQ ID NO: 3840478 - RNA, 21 nt, Human
ggggcuccuggaaaggcucag

SEQ ID NO: 3840479 - RNA, 15 nt, Human
ggggcucgccaugcc

SEQ ID NO: 3840480 - RNA, 17 nt, Human
ggggcucuaacgccuga

SEQ ID NO: 3840481 - RNA, 18 nt, Human
ggggcucuaacgccugag

SEQ ID NO: 3840482 - RNA, 23 nt, Human
ggggcucuaacgccugagcccag

SEQ ID NO: 3840483 - RNA, 22 nt, Human
ggggcucuaggguugcuggagc

SEQ ID NO: 3840484 - RNA, 23 nt, Human
ggggcucuaggguugcuggagcc

SEQ ID NO: 3840485 - RNA, 16 nt, Human
ggggcucucagcucag

SEQ ID NO: 3840486 - RNA, 24 nt, Human
ggggcucucauguuuucaacugcc

SEQ ID NO: 3840487 - RNA, 23 nt, Human
ggggcucugcccucccuccuucc

SEQ ID NO: 3840488 - RNA, 19 nt, Human
ggggcugaggugggaggau

SEQ ID NO: 3840489 - RNA, 21 nt, Human
ggggcugcaccggcuggccug

SEQ ID NO: 3840490 - RNA, 18 nt, Human
ggggcugcccuugggcca

SEQ ID NO: 3840491 - RNA, 18 nt, Human
ggggcugcucccaccugg

SEQ ID NO: 3840492 - RNA, 22 nt, Human
ggggcugcugcugggcucagug

SEQ ID NO: 3840493 - RNA, 18 nt, Human
ggggcugcuuccuccugg

SEQ ID NO: 3840494 - RNA, 19 nt, Human
ggggcugcuuccuccugga

SEQ ID NO: 3840495 - RNA, 13 nt, Human
ggggcuggaggag

SEQ ID NO: 3840496 - RNA, 16 nt, Human
ggggcuggccuuccug

SEQ ID NO: 3840497 - RNA, 19 nt, Human
ggggcuggccuuccugccc

SEQ ID NO: 3840498 - RNA, 13 nt, Human
ggggcugggacau

SEQ ID NO: 3840499 - RNA, 12 nt, Human
ggggcuggggca

SEQ ID NO: 3840500 - RNA, 16 nt, Human
ggggcuggggcaggag

SEQ ID NO: 3840501 - RNA, 19 nt, Human
ggggcuggguuggcgcacc

SEQ ID NO: 3840502 - RNA, 19 nt, Human
ggggcugguagcucaggug

SEQ ID NO: 3840503 - RNA, 22 nt, Human
ggggcuuagggucggaacccaa

SEQ ID NO: 3840504 - RNA, 22 nt, Human
ggggcuucaaccuugagacagc

SEQ ID NO: 3840505 - RNA, 13 nt, Human
ggggcuuccuggu

SEQ ID NO: 3840506 - RNA, 21 nt, Human
ggggcuuccuggugcuggagg

SEQ ID NO: 3840507 - RNA, 22 nt, Human
ggggcuucugugcaccugggcu

SEQ ID NO: 3840508 - RNA, 17 nt, Human
ggggcuugaagccaaag

SEQ ID NO: 3840509 - RNA, 14 nt, Human
ggggcuugccuucu

SEQ ID NO: 3840510 - RNA, 20 nt, Human
ggggcuuucguccacagcuu

SEQ ID NO: 3840511 - RNA, 18 nt, Human
gggggaacgaugugucug

SEQ ID NO: 3840512 - RNA, 19 nt, Human
gggggaagagcacagcccu

SEQ ID NO: 3840513 - RNA, 12 nt, Human
gggggaaugagc

SEQ ID NO: 3840514 - RNA, 16 nt, Human
gggggaaugagcccag

SEQ ID NO: 3840515 - RNA, 21 nt, Human
gggggaaugagcccagagaac

SEQ ID NO: 3840516 - RNA, 18 nt, Human
gggggacagggcuggccc

SEQ ID NO: 3840517 - RNA, 23 nt, Human
gggggacagggcuggcccagccc

SEQ ID NO: 3840518 - RNA, 15 nt, Human
gggggacccagugca

SEQ ID NO: 3840519 - RNA, 16 nt, Human
gggggacuagccccug

SEQ ID NO: 3840520 - RNA, 22 nt, Human
gggggagccccuucugcucagc

SEQ ID NO: 3840521 - RNA, 22 nt, Human
gggggagccgguaacuguccug

SEQ ID NO: 3840522 - RNA, 14 nt, Human
gggggagggggagg

SEQ ID NO: 3840523 - RNA, 13 nt, Human
gggggaguggaau

SEQ ID NO: 3840524 - RNA, 16 nt, Human
gggggcacaagacuga

SEQ ID NO: 3840525 - RNA, 23 nt, Human
gggggcacaugcugagucuccca

SEQ ID NO: 3840526 - RNA, 11 nt, Human
gggggcagagg

SEQ ID NO: 3840527 - RNA, 12 nt, Human
gggggcagaggg

SEQ ID NO: 3840528 - RNA, 22 nt, Human
gggggcagaucuuggacucaug

SEQ ID NO: 3840529 - RNA, 15 nt, Human
gaacuguuagaaugu

SEQ ID NO: 3840530 - RNA, 13 nt, Human
gaacuguuguaua

SEQ ID NO: 3840531 - RNA, 14 nt, Human
gaacuguuguauaa

SEQ ID NO: 3840532 - RNA, 18 nt, Human
gaacuuaaauaaauguca

SEQ ID NO: 3840533 - RNA, 20 nt, Human
gaacuuacuguagccucaga

SEQ ID NO: 3840534 - RNA, 17 nt, Human
gaacuucaccugcaaag

SEQ ID NO: 3840535 - RNA, 18 nt, Human
gaacuucagaaagacuug

SEQ ID NO: 3840536 - RNA, 18 nt, Human
gaacuucgcaucaaaaga

SEQ ID NO: 3840537 - RNA, 13 nt, Human
gaacuucuaauau

SEQ ID NO: 3840538 - RNA, 15 nt, Human
gaacuucuaauauau

SEQ ID NO: 3840539 - RNA, 22 nt, Human
gaacuugaaauauccugcuuga

SEQ ID NO: 3840540 - RNA, 13 nt, Human
gaacuugaaauuu

SEQ ID NO: 3840541 - RNA, 18 nt, Human
gaacuugaagccugcucc

SEQ ID NO: 3840542 - RNA, 14 nt, Human
gaacuugaaugugu

SEQ ID NO: 3840543 - RNA, 17 nt, Human
gaacuugaaugugucag

SEQ ID NO: 3840544 - RNA, 20 nt, Human
gggggccuggcuggcugagg

SEQ ID NO: 3840545 - RNA, 15 nt, Human
gggggcgccuguggu

SEQ ID NO: 3840546 - RNA, 18 nt, Human
gggggcgcggcugggagg

SEQ ID NO: 3840547 - RNA, 16 nt, Human
gggggcugaggagcag

SEQ ID NO: 3840548 - RNA, 13 nt, Human
gggggcuggccua

SEQ ID NO: 3840549 - RNA, 14 nt, Human
gggggcuggugcca

SEQ ID NO: 3840550 - RNA, 13 nt, Human
ggggggcagagcc

SEQ ID NO: 3840551 - RNA, 15 nt, Human
ggggggccaaaagga

SEQ ID NO: 3840552 - RNA, 14 nt, Human
ggggguagagcuga

SEQ ID NO: 3840553 - RNA, 18 nt, Human
gggggucaggaggcaggg

SEQ ID NO: 3840554 - RNA, 18 nt, Human
gggggucccagugggagg

SEQ ID NO: 3840555 - RNA, 16 nt, Human
ggggguccuccuccag

SEQ ID NO: 3840556 - RNA, 18 nt, Human
gggggugaugagggcagc

SEQ ID NO: 3840557 - RNA, 22 nt, Human
gggggugaugagggcagcagcc

SEQ ID NO: 3840558 - RNA, 19 nt, Human
gggggugcugggccccugc

SEQ ID NO: 3840559 - RNA, 15 nt, Human
gggguagcagcugga

SEQ ID NO: 3840560 - RNA, 13 nt, Human
gggguagggggcu

SEQ ID NO: 3840561 - RNA, 21 nt, Human
ggggucaugcccuccucuccc

SEQ ID NO: 3840562 - RNA, 12 nt, Human
ggggucccagca

SEQ ID NO: 3840563 - RNA, 11 nt, Human
gggguccuggc

SEQ ID NO: 3840564 - RNA, 13 nt, Human
gggguccuggcca

SEQ ID NO: 3840565 - RNA, 14 nt, Human
gggguccuggccau

SEQ ID NO: 3840566 - RNA, 19 nt, Human
gggguccuguggcaggcag

SEQ ID NO: 3840567 - RNA, 15 nt, Human
ggggucucucacaga

SEQ ID NO: 3840568 - RNA, 23 nt, Human
ggggucucuucugaauaaagcaa

SEQ ID NO: 3840569 - RNA, 13 nt, Human
ggggucuggcugg

SEQ ID NO: 3840570 - RNA, 14 nt, Human
ggggucuuaccuug

SEQ ID NO: 3840571 - RNA, 13 nt, Human
ggggugaggacca

SEQ ID NO: 3840572 - RNA, 14 nt, Human
ggggugaggagcug

SEQ ID NO: 3840573 - RNA, 23 nt, Human
ggggugaugagggcagcagccag

SEQ ID NO: 3840574 - RNA, 13 nt, Human
ggggugcccccuc

SEQ ID NO: 3840575 - RNA, 20 nt, Human
ggggugcccccuccucuccc

SEQ ID NO: 3840576 - RNA, 21 nt, Human
ggggugcccuccacugcccuc

SEQ ID NO: 3840577 - RNA, 17 nt, Human
ggggugccgccugcccg

SEQ ID NO: 3840578 - RNA, 20 nt, Human
ggggugcggcggucccagcu

SEQ ID NO: 3840579 - RNA, 12 nt, Human
ggggugcugggc

SEQ ID NO: 3840580 - RNA, 16 nt, Human
ggggugcuuccuugua

SEQ ID NO: 3840581 - RNA, 13 nt, Human
gggguggccugug

SEQ ID NO: 3840582 - RNA, 15 nt, Human
gggguggguauaaaa

SEQ ID NO: 3840583 - RNA, 21 nt, Human
gggguguguuccaacugcccc

SEQ ID NO: 3840584 - RNA, 16 nt, Human
gggguguuaauuuaug

SEQ ID NO: 3840585 - RNA, 16 nt, Human
gggguuauuuucuggu

SEQ ID NO: 3840586 - RNA, 16 nt, Human
gggguucagccccucc

SEQ ID NO: 3840587 - RNA, 17 nt, Human
gggguucagccccuccu

SEQ ID NO: 3840588 - RNA, 22 nt, Human
gggguucagccccuccucugcc

SEQ ID NO: 3840589 - RNA, 14 nt, Human
gggguucaggcccg

SEQ ID NO: 3840590 - RNA, 21 nt, Human
gggguucgagaccagucuggc

SEQ ID NO: 3840591 - RNA, 22 nt, Human
gggguucuuucuuccucugcug

SEQ ID NO: 3840592 - RNA, 13 nt, Human
gggguuggcuggg

SEQ ID NO: 3840593 - RNA, 21 nt, Human
gggguugggauugggggcugg

SEQ ID NO: 3840594 - RNA, 22 nt, Human
gggguugggauugggggcuggu

SEQ ID NO: 3840595 - RNA, 17 nt, Human
gggguuggggugacagu

SEQ ID NO: 3840596 - RNA, 19 nt, Human
gggguuuccuggcacugga

SEQ ID NO: 3840597 - RNA, 18 nt, Human
gggguuugccauuugaua

SEQ ID NO: 3840598 - RNA, 11 nt, Human
gggguuuuucu

SEQ ID NO: 3840599 - RNA, 15 nt, Human
ggguaaaauacuuuu

SEQ ID NO: 3840600 - RNA, 13 nt, Human
ggguaaacugugg

SEQ ID NO: 3840601 - RNA, 13 nt, Human
ggguaaauuauuc

SEQ ID NO: 3840602 - RNA, 16 nt, Human
ggguaagggauuucuu

SEQ ID NO: 3840603 - RNA, 14 nt, Human
ggguaaggugccuu

SEQ ID NO: 3840604 - RNA, 17 nt, Human
ggguaagugagagaggg

SEQ ID NO: 3840605 - RNA, 21 nt, Human
ggguaauaaacuuagaauaaa

SEQ ID NO: 3840606 - RNA, 17 nt, Human
ggguacauggugcuggg

SEQ ID NO: 3840607 - RNA, 22 nt, Human
ggguaccacugaaucuguacag

SEQ ID NO: 3840608 - RNA, 15 nt, Human
ggguacccacugcuc

SEQ ID NO: 3840609 - RNA, 19 nt, Human
ggguagaguuuacagcucu

SEQ ID NO: 3840610 - RNA, 13 nt, Human
ggguagcagcugg

SEQ ID NO: 3840611 - RNA, 21 nt, Human
ggguagcccgccugccagucc

SEQ ID NO: 3840612 - RNA, 16 nt, Human
ggguagcuagaggaac

SEQ ID NO: 3840613 - RNA, 23 nt, Human
ggguagcuguaaggcaugaagga

SEQ ID NO: 3840614 - RNA, 19 nt, Human
ggguagcuucugaccucag

SEQ ID NO: 3840615 - RNA, 18 nt, Human
ggguaggaggaugggcuc

SEQ ID NO: 3840616 - RNA, 13 nt, Human
ggguaggcaggau

SEQ ID NO: 3840617 - RNA, 18 nt, Human
ggguagggggcuggagga

SEQ ID NO: 3840618 - RNA, 12 nt, Human
ggguagugagca

SEQ ID NO: 3840619 - RNA, 13 nt, Human
ggguauauucauu

SEQ ID NO: 3840620 - RNA, 20 nt, Human
ggguauauuuuuguuuguuu

SEQ ID NO: 3840621 - RNA, 19 nt, Human
ggguauccaaguuggacug

SEQ ID NO: 3840622 - RNA, 21 nt, Human
ggguaugaagagcuugcuuug

SEQ ID NO: 3840623 - RNA, 10 nt, Human
ggguauuuuu

SEQ ID NO: 3840624 - RNA, 19 nt, Human
gggucaagaaacagccagc

SEQ ID NO: 3840625 - RNA, 13 nt, Human
gggucaaguuauu

SEQ ID NO: 3840626 - RNA, 20 nt, Human
gggucacucuggcagcucag

SEQ ID NO: 3840627 - RNA, 23 nt, Human
gggucacugaggccugagaccca

SEQ ID NO: 3840628 - RNA, 14 nt, Human
gggucagaagagag

SEQ ID NO: 3840629 - RNA, 18 nt, Human
gggucagccagggccugc

SEQ ID NO: 3840630 - RNA, 19 nt, Human
gggucaggaaggaugagca

SEQ ID NO: 3840631 - RNA, 15 nt, Human
gggucaggcagccag

SEQ ID NO: 3840632 - RNA, 12 nt, Human
gggucaggccuu

SEQ ID NO: 3840633 - RNA, 19 nt, Human
gggucaggccuuugagcuc

SEQ ID NO: 3840634 - RNA, 12 nt, Human
gggucaggcucc

SEQ ID NO: 3840635 - RNA, 20 nt, Human
gggucagguugacaggaggu

SEQ ID NO: 3840636 - RNA, 21 nt, Human
gggucauccugugcucggagg

SEQ ID NO: 3840637 - RNA, 21 nt, Human
gggucaucuguaccucugccu

SEQ ID NO: 3840638 - RNA, 21 nt, Human
gggucaugcccuccucuccca

SEQ ID NO: 3840639 - RNA, 21 nt, Human
gggucauguuugcagggguga

SEQ ID NO: 3840640 - RNA, 13 nt, Human
ggguccaaauaaa

SEQ ID NO: 3840641 - RNA, 20 nt, Human
ggguccaggauuccucuuuu

SEQ ID NO: 3840642 - RNA, 17 nt, Human
ggguccagggagcaggc

SEQ ID NO: 3840643 - RNA, 19 nt, Human
ggguccaggggaugggagg

SEQ ID NO: 3840644 - RNA, 15 nt, Human
gggucccaagcuggg

SEQ ID NO: 3840645 - RNA, 20 nt, Human
gggucccaagcugggcccca

SEQ ID NO: 3840646 - RNA, 17 nt, Human
gggucccacuuccccuc

SEQ ID NO: 3840647 - RNA, 13 nt, Human
gggucccagcagc

SEQ ID NO: 3840648 - RNA, 13 nt, Human
ggguccccagggc

SEQ ID NO: 3840649 - RNA, 16 nt, Human
ggguccccuccaggag

SEQ ID NO: 3840650 - RNA, 17 nt, Human
ggguccccuccaggagu

SEQ ID NO: 3840651 - RNA, 18 nt, Human
gggucccggcucuguggg

SEQ ID NO: 3840652 - RNA, 16 nt, Human
gggucccugcuguguu

SEQ ID NO: 3840653 - RNA, 16 nt, Human
ggguccuccuccaggg

SEQ ID NO: 3840654 - RNA, 17 nt, Human
ggguccuggccauccca

SEQ ID NO: 3840655 - RNA, 13 nt, Human
ggguccuggcucc

SEQ ID NO: 3840656 - RNA, 18 nt, Human
ggguccuggcuccugagg

SEQ ID NO: 3840657 - RNA, 16 nt, Human
ggguccuucccucucc

SEQ ID NO: 3840658 - RNA, 23 nt, Human
ggguccuucccucuccccaagac

SEQ ID NO: 3840659 - RNA, 15 nt, Human
ggguccuucuccaca

SEQ ID NO: 3840660 - RNA, 22 nt, Human
ggguccuuuugacacugcucua

SEQ ID NO: 3840661 - RNA, 17 nt, Human
gggucgacuucgggcug

SEQ ID NO: 3840662 - RNA, 13 nt, Human
gggucgcccauga

SEQ ID NO: 3840663 - RNA, 15 nt, Human
gggucgcccuggacu

SEQ ID NO: 3840664 - RNA, 14 nt, Human
gggucgccuguccu

SEQ ID NO: 3840665 - RNA, 15 nt, Human
gggucuauuccagcu

SEQ ID NO: 3840666 - RNA, 22 nt, Human
gggucucacuauguugcccagg

SEQ ID NO: 3840667 - RNA, 12 nt, Human
gggucucacucu

SEQ ID NO: 3840668 - RNA, 22 nt, Human
gggucucagggugucccagacc

SEQ ID NO: 3840669 - RNA, 15 nt, Human
gggucucccuggagu

SEQ ID NO: 3840670 - RNA, 17 nt, Human
gggucucccuggcuccc

SEQ ID NO: 3840671 - RNA, 21 nt, Human
gggucucccuggcucccuccu

SEQ ID NO: 3840672 - RNA, 15 nt, Human
gggucucuagugcug

SEQ ID NO: 3840673 - RNA, 22 nt, Human
gggucucucacagacaggaccc

SEQ ID NO: 3840674 - RNA, 17 nt, Human
gggucucucccucaggu

SEQ ID NO: 3840675 - RNA, 13 nt, Human
gggucucugcugc

SEQ ID NO: 3840676 - RNA, 16 nt, Human
gggucugagcuccagc

SEQ ID NO: 3840677 - RNA, 12 nt, Human
gggucugaggaa

SEQ ID NO: 3840678 - RNA, 21 nt, Human
gggucugaggaauccagaccc

SEQ ID NO: 3840679 - RNA, 20 nt, Human
gggucugccaccauccugcu

SEQ ID NO: 3840680 - RNA, 12 nt, Human
gggucuggcugg

SEQ ID NO: 3840681 - RNA, 14 nt, Human
gggucuggcuggug

SEQ ID NO: 3840682 - RNA, 23 nt, Human
gggucugggcggcgggcggcugg

SEQ ID NO: 3840683 - RNA, 13 nt, Human
gggucuguaaaau

SEQ ID NO: 3840684 - RNA, 14 nt, Human
gggucuguaaaauc

SEQ ID NO: 3840685 - RNA, 20 nt, Human
gggucuguagguugcacacu

SEQ ID NO: 3840686 - RNA, 21 nt, Human
gggucuguagguugcacacuu

SEQ ID NO: 3840687 - RNA, 20 nt, Human
gggucuucagcauucccucc

SEQ ID NO: 3840688 - RNA, 20 nt, Human
gggucuucagggggccaggu

SEQ ID NO: 3840689 - RNA, 19 nt, Human
gggucuugauucagucaca

SEQ ID NO: 3840690 - RNA, 19 nt, Human
gggauccccgccuggccag

SEQ ID NO: 3840691 - RNA, 17 nt, Human
gggauccgacugcuuug

SEQ ID NO: 3840692 - RNA, 14 nt, Human
gggauccugccugc

SEQ ID NO: 3840693 - RNA, 19 nt, Human
gggaucugguccuacccau

SEQ ID NO: 3840694 - RNA, 23 nt, Human
gggaucugguccuacccaucccc

SEQ ID NO: 3840695 - RNA, 20 nt, Human
gggaugacaugcacucagcu

SEQ ID NO: 3840696 - RNA, 15 nt, Human
gggaugagccgcugu

SEQ ID NO: 3840697 - RNA, 15 nt, Human
gggaugauugaagaa

SEQ ID NO: 3840698 - RNA, 16 nt, Human
gggaugauugaagaaa

SEQ ID NO: 3840699 - RNA, 17 nt, Human
gggaugauugaagaaac

SEQ ID NO: 3840700 - RNA, 16 nt, Human
gggaugcccuggaggu

SEQ ID NO: 3840701 - RNA, 12 nt, Human
gggaugcuucau

SEQ ID NO: 3840702 - RNA, 19 nt, Human
gggauggacgaucucccac

SEQ ID NO: 3840703 - RNA, 15 nt, Human
gggauggaggggagu

SEQ ID NO: 3840704 - RNA, 23 nt, Human
gggauggggggggauguggauca

SEQ ID NO: 3840705 - RNA, 19 nt, Human
gggaugguaagagaaaaga

SEQ ID NO: 3840706 - RNA, 15 nt, Human
gggaugguccugggg

SEQ ID NO: 3840707 - RNA, 12 nt, Human
gggauggugccc

SEQ ID NO: 3840708 - RNA, 22 nt, Human
gggauguucagcacugucccuu

SEQ ID NO: 3840709 - RNA, 13 nt, Human
gggauguucuggc

SEQ ID NO: 3840710 - RNA, 16 nt, Human
gggauguucuggcccu

SEQ ID NO: 3840711 - RNA, 13 nt, Human
gggauguuuuucu

SEQ ID NO: 3840712 - RNA, 16 nt, Human
gggauuaaccucugca

SEQ ID NO: 3840713 - RNA, 20 nt, Human
gggauuacaggcgugagcca

SEQ ID NO: 3840714 - RNA, 18 nt, Human
gggauuaugggucacagg

SEQ ID NO: 3840715 - RNA, 14 nt, Human
gggauucaggcugc

SEQ ID NO: 3840716 - RNA, 21 nt, Human
gggauuccugacccaggccgc

SEQ ID NO: 3840717 - RNA, 15 nt, Human
gggauugcugccacu

SEQ ID NO: 3840718 - RNA, 16 nt, Human
gggauuguaaaauggu

SEQ ID NO: 3840719 - RNA, 22 nt, Human
gggauuucaccacucaaaggcc

SEQ ID NO: 3840720 - RNA, 15 nt, Human
gggauuuccaugaug

SEQ ID NO: 3840721 - RNA, 14 nt, Human
gggauuucuuaggg

SEQ ID NO: 3840722 - RNA, 14 nt, Human
gggauuucuuugcu

SEQ ID NO: 3840723 - RNA, 23 nt, Human
gggauuuguugauucucuccauu

SEQ ID NO: 3840724 - RNA, 21 nt, Human
gggauuuucagcccucagaau

SEQ ID NO: 3840725 - RNA, 16 nt, Human
gggcaaaacugaauua

SEQ ID NO: 3840726 - RNA, 13 nt, Human
gggcaaauaauga

SEQ ID NO: 3840727 - RNA, 20 nt, Human
gggcaacaaagugagacucc

SEQ ID NO: 3840728 - RNA, 22 nt, Human
gggcaacagagcaagauccugu

SEQ ID NO: 3840729 - RNA, 16 nt, Human
gggcaacccccagccu

SEQ ID NO: 3840730 - RNA, 18 nt, Human
gggcaacccccagccugc

SEQ ID NO: 3840731 - RNA, 17 nt, Human
gggcaacccuggugacc

SEQ ID NO: 3840732 - RNA, 14 nt, Human
gggcaacgaagaaa

SEQ ID NO: 3840733 - RNA, 23 nt, Human
gggcaacgaagaaaaaaaauaac

SEQ ID NO: 3840734 - RNA, 21 nt, Human
gggcaagaagaucacgcuccc

SEQ ID NO: 3840735 - RNA, 19 nt, Human
gggcaauauucucuguaca

SEQ ID NO: 3840736 - RNA, 20 nt, Human
gggcaauauucucuguacau

SEQ ID NO: 3840737 - RNA, 18 nt, Human
gggcaauuuagaaaaaga

SEQ ID NO: 3840738 - RNA, 17 nt, Human
gggcacaaagggcccag

SEQ ID NO: 3840739 - RNA, 16 nt, Human
gggcacaagacugacg

SEQ ID NO: 3840740 - RNA, 12 nt, Human
gggcacacacug

SEQ ID NO: 3840741 - RNA, 23 nt, Human
gggcacaccgggcacucagaaga

SEQ ID NO: 3840742 - RNA, 15 nt, Human
gggcacaccuccucc

SEQ ID NO: 3840743 - RNA, 13 nt, Human
gggcacacgcugc

SEQ ID NO: 3840744 - RNA, 19 nt, Human
gggcacacgcugcucugcc

SEQ ID NO: 3840745 - RNA, 20 nt, Human
gggcacacgcugcucugccc

SEQ ID NO: 3840746 - RNA, 12 nt, Human
gguggacccagg

SEQ ID NO: 3840747 - RNA, 13 nt, Human
gguggacccaggg

SEQ ID NO: 3840748 - RNA, 15 nt, Human
gguggacucgccugu

SEQ ID NO: 3840749 - RNA, 17 nt, Human
gguggacuuagaaagca

SEQ ID NO: 3840750 - RNA, 20 nt, Human
gguggacuuagaaagcaggg

SEQ ID NO: 3840751 - RNA, 21 nt, Human
gguggacuugaacuuuccugg

SEQ ID NO: 3840752 - RNA, 21 nt, Human
gguggagaaagcacugaccug

SEQ ID NO: 3840753 - RNA, 15 nt, Human
gguggagaagccauu

SEQ ID NO: 3840754 - RNA, 18 nt, Human
gguggaggagagccuggu

SEQ ID NO: 3840755 - RNA, 15 nt, Human
gguggaggcuuccug

SEQ ID NO: 3840756 - RNA, 13 nt, Human
gguggagggccac

SEQ ID NO: 3840757 - RNA, 20 nt, Human
gguggagguugcauugagcu

SEQ ID NO: 3840758 - RNA, 22 nt, Human
gguggaucacgaggucaggaga

SEQ ID NO: 3840759 - RNA, 14 nt, Human
gguggauggcccca

SEQ ID NO: 3840760 - RNA, 13 nt, Human
gguggcaagagcc

SEQ ID NO: 3840761 - RNA, 20 nt, Human
gguggcaaggcugugcuccc

SEQ ID NO: 3840762 - RNA, 17 nt, Human
gguggcacaggcccccu

SEQ ID NO: 3840763 - RNA, 20 nt, Human
gguggcaccagcagccugga

SEQ ID NO: 3840764 - RNA, 23 nt, Human
gguggcaccagcgaagggagugc

SEQ ID NO: 3840765 - RNA, 18 nt, Human
gguggcagcccuguaggg

SEQ ID NO: 3840766 - RNA, 11 nt, Human
gguggcagcug

SEQ ID NO: 3840767 - RNA, 15 nt, Human
gguggcaggaccagg

SEQ ID NO: 3840768 - RNA, 18 nt, Human
gguggcaggaccaggacu

SEQ ID NO: 3840769 - RNA, 21 nt, Human
gguggcagugcagcaaccaga

SEQ ID NO: 3840770 - RNA, 16 nt, Human
gguggcagugggagcu

SEQ ID NO: 3840771 - RNA, 19 nt, Human
gguggcagugggagcugcc

SEQ ID NO: 3840772 - RNA, 22 nt, Human
gguggcagugggagcugccugu

SEQ ID NO: 3840773 - RNA, 21 nt, Human
gguggcaucauuccaggcccg

SEQ ID NO: 3840774 - RNA, 13 nt, Human
gguggcaucccag

SEQ ID NO: 3840775 - RNA, 19 nt, Human
gguggcaugugccuauagu

SEQ ID NO: 3840776 - RNA, 23 nt, Human
gguggcaugugccuauaguccca

SEQ ID NO: 3840777 - RNA, 16 nt, Human
gguggccaggccggga

SEQ ID NO: 3840778 - RNA, 17 nt, Human
gguggccaugccucagc

SEQ ID NO: 3840779 - RNA, 22 nt, Human
gguggcccauccccccucacca

SEQ ID NO: 3840780 - RNA, 18 nt, Human
gguggcccucuccccugc

SEQ ID NO: 3840781 - RNA, 19 nt, Human
gguggcccucuccccugcc

SEQ ID NO: 3840782 - RNA, 23 nt, Human
gguggcccugucccucccaccuc

SEQ ID NO: 3840783 - RNA, 21 nt, Human
gguggccgcugaguggcaggg

SEQ ID NO: 3840784 - RNA, 13 nt, Human
gguggccucccaa

SEQ ID NO: 3840785 - RNA, 22 nt, Human
gguggccucgggacaccugccc

SEQ ID NO: 3840786 - RNA, 23 nt, Human
gguggccucuccuuguggccugg

SEQ ID NO: 3840787 - RNA, 21 nt, Human
gguggcgacucuauagacucu

SEQ ID NO: 3840788 - RNA, 19 nt, Human
gguggcgggcaccuauagu

SEQ ID NO: 3840789 - RNA, 16 nt, Human
gguggcuacucugugc

SEQ ID NO: 3840790 - RNA, 23 nt, Human
gguggcuacucugugccagagcc

SEQ ID NO: 3840791 - RNA, 22 nt, Human
gguggcuagucaagcuccuccu

SEQ ID NO: 3840792 - RNA, 16 nt, Human
gguggcuagucagaga

SEQ ID NO: 3840793 - RNA, 14 nt, Human
gguggcucuggaau

SEQ ID NO: 3840794 - RNA, 15 nt, Human
gguggcugacccagu

SEQ ID NO: 3840795 - RNA, 22 nt, Human
gguggcuggagacgggugggcg

SEQ ID NO: 3840796 - RNA, 12 nt, Human
gguggcugggca

SEQ ID NO: 3840797 - RNA, 12 nt, Human
gguggcuggguu

SEQ ID NO: 3840798 - RNA, 15 nt, Human
gguggcuucagcucc

SEQ ID NO: 3840799 - RNA, 16 nt, Human
gguggcuucagcucca

SEQ ID NO: 3840800 - RNA, 17 nt, Human
gguggcuucagcuccag

SEQ ID NO: 3840801 - RNA, 21 nt, Human
gguggcuucuuuucuuuguau

SEQ ID NO: 3840802 - RNA, 23 nt, Human
gguggcuuuugcgguucaggaaa

SEQ ID NO: 3840803 - RNA, 16 nt, Human
ggugggagcaggagau

SEQ ID NO: 3840804 - RNA, 20 nt, Human
ggugggaggaucucuugagc

SEQ ID NO: 3840805 - RNA, 17 nt, Human
ggugggaggaugugaau

SEQ ID NO: 3840806 - RNA, 18 nt, Human
ggugggcaccaagagcca

SEQ ID NO: 3840807 - RNA, 18 nt, Human
ggugggcacccacccugg

SEQ ID NO: 3840808 - RNA, 20 nt, Human
ggugggcagaucacgagguc

SEQ ID NO: 3840809 - RNA, 14 nt, Human
ggugggcaggaaaa

SEQ ID NO: 3840810 - RNA, 20 nt, Human
ggugggccagccccucccac

SEQ ID NO: 3840811 - RNA, 13 nt, Human
ggugggccucugg

SEQ ID NO: 3840812 - RNA, 13 nt, Human
ggugggcucugug

SEQ ID NO: 3840813 - RNA, 15 nt, Human
ggugggcugagcccu

SEQ ID NO: 3840814 - RNA, 17 nt, Human
ggugggcugagcccugg

SEQ ID NO: 3840815 - RNA, 18 nt, Human
ggugggcugagcccuggc

SEQ ID NO: 3840816 - RNA, 14 nt, Human
ggugggcuucccag

SEQ ID NO: 3840817 - RNA, 22 nt, Human
ggugggcuugucauagccagug

SEQ ID NO: 3840818 - RNA, 21 nt, Human
gguggggagagacgggcccug

SEQ ID NO: 3840819 - RNA, 12 nt, Human
gguggggcggga

SEQ ID NO: 3840820 - RNA, 20 nt, Human
gguggggggaucacaagguc

SEQ ID NO: 3840821 - RNA, 22 nt, Human
gguggggggggggcgcggcugg

SEQ ID NO: 3840822 - RNA, 15 nt, Human
gguggggucaugccc

SEQ ID NO: 3840823 - RNA, 19 nt, Human
gguggggucaugcccuccu

SEQ ID NO: 3840824 - RNA, 23 nt, Human
ggugggguccuggagcagaccac

SEQ ID NO: 3840825 - RNA, 10 nt, Human
ggugggucca

SEQ ID NO: 3840826 - RNA, 20 nt, Human
gguggguccaggggccccuc

SEQ ID NO: 3840827 - RNA, 18 nt, Human
ggugggucccggcucugu

SEQ ID NO: 3840828 - RNA, 16 nt, Human
gguggguuuucuuccc

SEQ ID NO: 3840829 - RNA, 14 nt, Human
ggugguaacccugg

SEQ ID NO: 3840830 - RNA, 16 nt, Human
ggugguacccucugga

SEQ ID NO: 3840831 - RNA, 14 nt, Human
ggugguaugugugu

SEQ ID NO: 3840832 - RNA, 15 nt, Human
gguggucugaauguu

SEQ ID NO: 3840833 - RNA, 16 nt, Human
gguggucugcaggcag

SEQ ID NO: 3840834 - RNA, 21 nt, Human
guaaaauauuuugaaucaaua

SEQ ID NO: 3840835 - RNA, 15 nt, Human
guaaaaucuuucuuu

SEQ ID NO: 3840836 - RNA, 21 nt, Human
guaaaaucuuucuuucuuaga

SEQ ID NO: 3840837 - RNA, 15 nt, Human
guaaaaugucuuucc

SEQ ID NO: 3840838 - RNA, 23 nt, Human
guaaaaugugggauuauggguca

SEQ ID NO: 3840839 - RNA, 14 nt, Human
guaaaauugcaugg

SEQ ID NO: 3840840 - RNA, 16 nt, Human
guaaaauugccauauu

SEQ ID NO: 3840841 - RNA, 21 nt, Human
guaaaauugccauauugcaca

SEQ ID NO: 3840842 - RNA, 15 nt, Human
guaaacaaaaugaag

SEQ ID NO: 3840843 - RNA, 19 nt, Human
guaaacaaacucuugaaga

SEQ ID NO: 3840844 - RNA, 19 nt, Human
guaaacagccucuuuuuga

SEQ ID NO: 3840845 - RNA, 13 nt, Human
guaaacagugccu

SEQ ID NO: 3840846 - RNA, 17 nt, Human
guaaacagugccugcug

SEQ ID NO: 3840847 - RNA, 22 nt, Human
guaaacagugccugcugaauga

SEQ ID NO: 3840848 - RNA, 15 nt, Human
guaaacaucucagag

SEQ ID NO: 3840849 - RNA, 20 nt, Human
guaaacauguguuuuaauuc

SEQ ID NO: 3840850 - RNA, 12 nt, Human
guaaacauuuau

SEQ ID NO: 3840851 - RNA, 23 nt, Human
guaaaccaauccuaugcaugguu

SEQ ID NO: 3840852 - RNA, 15 nt, Human
guaaaccaauuuuuu

SEQ ID NO: 3840853 - RNA, 12 nt, Human
guaaaccacuga

SEQ ID NO: 3840854 - RNA, 13 nt, Human
guaaaccacugaa

SEQ ID NO: 3840855 - RNA, 14 nt, Human
guaaaccacugaaa

SEQ ID NO: 3840856 - RNA, 19 nt, Human
guaaaccacugaaaaaaua

SEQ ID NO: 3840857 - RNA, 22 nt, Human
guaaaccacugaaaaaauauau

SEQ ID NO: 3840858 - RNA, 21 nt, Human
guaaaccgcuuuggccugagu

SEQ ID NO: 3840859 - RNA, 20 nt, Human
guaaacgcugucccuaguaa

SEQ ID NO: 3840860 - RNA, 22 nt, Human
guaaacgggaacaugcccccug

SEQ ID NO: 3840861 - RNA, 21 nt, Human
guaaacuauuuaucuguguuu

SEQ ID NO: 3840862 - RNA, 14 nt, Human
guaaacugcccugu

SEQ ID NO: 3840863 - RNA, 17 nt, Human
guaaagaaaaauauuua

SEQ ID NO: 3840864 - RNA, 17 nt, Human
guaaagaaagagagaaa

SEQ ID NO: 3840865 - RNA, 19 nt, Human
guaaagaaagagagaaaau

SEQ ID NO: 3840866 - RNA, 23 nt, Human
guaaagaaagagagaaaauaaaa

SEQ ID NO: 3840867 - RNA, 16 nt, Human
guaaagaaaugucuua

SEQ ID NO: 3840868 - RNA, 14 nt, Human
guaaagacuggcuu

SEQ ID NO: 3840869 - RNA, 19 nt, Human
guaaagacugguuuucugc

SEQ ID NO: 3840870 - RNA, 16 nt, Human
guaaagacuguagaag

SEQ ID NO: 3840871 - RNA, 19 nt, Human
guaaagagaaacuuugugc

SEQ ID NO: 3840872 - RNA, 14 nt, Human
guaaagagaccuac

SEQ ID NO: 3840873 - RNA, 21 nt, Human
guaaagagaccuaccucaggu

SEQ ID NO: 3840874 - RNA, 22 nt, Human
guaaagagaccuaccucagguu

SEQ ID NO: 3840875 - RNA, 14 nt, Human
guaaagauuucugu

SEQ ID NO: 3840876 - RNA, 16 nt, Human
guaaagcauuccaaca

SEQ ID NO: 3840877 - RNA, 21 nt, Human
guaaagcccauuuuuaaaaua

SEQ ID NO: 3840878 - RNA, 15 nt, Human
guaaagcuagaaaug

SEQ ID NO: 3840879 - RNA, 15 nt, Human
guaaagggcaaauaa

SEQ ID NO: 3840880 - RNA, 15 nt, Human
guaaaguacuuguag

SEQ ID NO: 3840881 - RNA, 16 nt, Human
guaaaguauguaaaca

SEQ ID NO: 3840882 - RNA, 15 nt, Human
guaaaguauguauua

SEQ ID NO: 3840883 - RNA, 23 nt, Human
guaaaguauguauuauuuacauu

SEQ ID NO: 3840884 - RNA, 14 nt, Human
guaaaguccccaga

SEQ ID NO: 3840885 - RNA, 16 nt, Human
guaaaguccccagaga

SEQ ID NO: 3840886 - RNA, 18 nt, Human
guaaaguccccagagaaa

SEQ ID NO: 3840887 - RNA, 14 nt, Human
guaaagugaagaau

SEQ ID NO: 3840888 - RNA, 19 nt, Human
guaaagugaagaauccuuu

SEQ ID NO: 3840889 - RNA, 17 nt, Human
guaaagugauaauuucu

SEQ ID NO: 3840890 - RNA, 20 nt, Human
guaaaguguaacauaugcaa

SEQ ID NO: 3840891 - RNA, 21 nt, Human
guaaaguguggucccaacagg

SEQ ID NO: 3840892 - RNA, 22 nt, Human
guaaaguguggucccaacagga

SEQ ID NO: 3840893 - RNA, 18 nt, Human
guaaaguuagucuacucu

SEQ ID NO: 3840894 - RNA, 15 nt, Human
guaaauaaaaagaaa

SEQ ID NO: 3840895 - RNA, 16 nt, Human
guaaauaaaggaacca

SEQ ID NO: 3840896 - RNA, 12 nt, Human
guaaauaaugcu

SEQ ID NO: 3840897 - RNA, 13 nt, Human
guaaauaauucuu

SEQ ID NO: 3840898 - RNA, 21 nt, Human
guaaauacaauuuuguuucug

SEQ ID NO: 3840899 - RNA, 16 nt, Human
guaaauaccauugaca

SEQ ID NO: 3840900 - RNA, 21 nt, Human
guaaauaggaaucauucagaa

SEQ ID NO: 3840901 - RNA, 21 nt, Human
guaaauagguuucuaaaaagu

SEQ ID NO: 3840902 - RNA, 23 nt, Human
guaaauagguuucuaaaaaguca

SEQ ID NO: 3840903 - RNA, 15 nt, Human
guaaauaguauuuga

SEQ ID NO: 3840904 - RNA, 19 nt, Human
guaaauauauaaauauaua

SEQ ID NO: 3840905 - RNA, 14 nt, Human
guaaauauucuaua

SEQ ID NO: 3840906 - RNA, 12 nt, Human
guaaauauuuau

SEQ ID NO: 3840907 - RNA, 19 nt, Human
guaaaucagauguugaauu

SEQ ID NO: 3840908 - RNA, 14 nt, Human
guaaaucaguaaga

SEQ ID NO: 3840909 - RNA, 12 nt, Human
guaaaucugcca

SEQ ID NO: 3840910 - RNA, 13 nt, Human
guaaaucugccac

SEQ ID NO: 3840911 - RNA, 22 nt, Human
guaaaugaaguaacuugucuua

SEQ ID NO: 3840912 - RNA, 11 nt, Human
guaaaugccac

SEQ ID NO: 3840913 - RNA, 16 nt, Human
guaaaugguaugucau

SEQ ID NO: 3840914 - RNA, 16 nt, Human
guaaaugguguacaua

SEQ ID NO: 3840915 - RNA, 20 nt, Human
guaaaugguguacauaaugu

SEQ ID NO: 3840916 - RNA, 15 nt, Human
gaaucagugcaaaga

SEQ ID NO: 3840917 - RNA, 17 nt, Human
gaaucaguuuaaaagca

SEQ ID NO: 3840918 - RNA, 19 nt, Human
gaaucauaugauucugcuu

SEQ ID NO: 3840919 - RNA, 16 nt, Human
gaaucaugagccugcu

SEQ ID NO: 3840920 - RNA, 17 nt, Human
gaaucaugagccugcug

SEQ ID NO: 3840921 - RNA, 19 nt, Human
gaaucaugagccugcugga

SEQ ID NO: 3840922 - RNA, 11 nt, Human
gaaucauguag

SEQ ID NO: 3840923 - RNA, 14 nt, Human
gaaucauguaguau

SEQ ID NO: 3840924 - RNA, 21 nt, Human
gaaucaugucaggccugugug

SEQ ID NO: 3840925 - RNA, 21 nt, Human
gaaucauuauuuauuaaauuu

SEQ ID NO: 3840926 - RNA, 21 nt, Human
gaaucauuguccagagcugcu

SEQ ID NO: 3840927 - RNA, 22 nt, Human
gaaucauuucuauuucuccucc

SEQ ID NO: 3840928 - RNA, 12 nt, Human
gaauccaaacuu

SEQ ID NO: 3840929 - RNA, 12 nt, Human
gaauccaagauu

SEQ ID NO: 3840930 - RNA, 16 nt, Human
gaauccaagcgagguc

SEQ ID NO: 3840931 - RNA, 17 nt, Human
gaauccacucccaggca

SEQ ID NO: 3840932 - RNA, 18 nt, Human
gaauccagacccggcugc

SEQ ID NO: 3840933 - RNA, 20 nt, Human
gaauccagacccggcugcgu

SEQ ID NO: 3840934 - RNA, 13 nt, Human
gaauccaugcuug

SEQ ID NO: 3840935 - RNA, 16 nt, Human
gaaucccaaauuugau

SEQ ID NO: 3840936 - RNA, 16 nt, Human
gaaucccacuguauga

SEQ ID NO: 3840937 - RNA, 16 nt, Human
gaauccccgaaggugc

SEQ ID NO: 3840938 - RNA, 16 nt, Human
gaauccccucccuguc

SEQ ID NO: 3840939 - RNA, 17 nt, Human
gaaucccuguucauugu

SEQ ID NO: 3840940 - RNA, 14 nt, Human
gaauccuggcagcc

SEQ ID NO: 3840941 - RNA, 22 nt, Human
gaauccuguccucagcuucuua

SEQ ID NO: 3840942 - RNA, 14 nt, Human
gaauccugucgauu

SEQ ID NO: 3840943 - RNA, 12 nt, Human
gaauccuuucag

SEQ ID NO: 3840944 - RNA, 14 nt, Human
gaaucgaggaacca

SEQ ID NO: 3840945 - RNA, 18 nt, Human
gaaucgaggaaccagagc

SEQ ID NO: 3840946 - RNA, 21 nt, Human
gaaucuagaagaaaugaaauu

SEQ ID NO: 3840947 - RNA, 17 nt, Human
gaaucuauauuuaacaa

SEQ ID NO: 3840948 - RNA, 15 nt, Human
gaaucuauuauacug

SEQ ID NO: 3840949 - RNA, 16 nt, Human
gaaucuauuuaaguaa

SEQ ID NO: 3840950 - RNA, 20 nt, Human
gaaucuauuuaucuucauuu

SEQ ID NO: 3840951 - RNA, 15 nt, Human
gaaucuauuuucuau

SEQ ID NO: 3840952 - RNA, 16 nt, Human
gaaucuauuuucuaug

SEQ ID NO: 3840953 - RNA, 19 nt, Human
gaaucucaagaugggggca

SEQ ID NO: 3840954 - RNA, 23 nt, Human
gaaucucaguugauuuucuggau

SEQ ID NO: 3840955 - RNA, 19 nt, Human
gaaucucauaauuuauaca

SEQ ID NO: 3840956 - RNA, 18 nt, Human
gaaucucccacuccagcg

SEQ ID NO: 3840957 - RNA, 14 nt, Human
gaaucugaauguaa

SEQ ID NO: 3840958 - RNA, 22 nt, Human
gaaucugcaauucaaaaguucc

SEQ ID NO: 3840959 - RNA, 16 nt, Human
gaaucuggagaccagg

SEQ ID NO: 3840960 - RNA, 16 nt, Human
gaaucuguauauauuu

SEQ ID NO: 3840961 - RNA, 16 nt, Human
gaaucuguaugauucu

SEQ ID NO: 3840962 - RNA, 14 nt, Human
gaaucugugugaaa

SEQ ID NO: 3840963 - RNA, 15 nt, Human
gaaucuugguuugcc

SEQ ID NO: 3840964 - RNA, 15 nt, Human
gaaucuugucucaau

SEQ ID NO: 3840965 - RNA, 18 nt, Human
gaaucuugucucaaugcu

SEQ ID NO: 3840966 - RNA, 20 nt, Human
gaaucuugucucaaugcuca

SEQ ID NO: 3840967 - RNA, 22 nt, Human
gaaucuugucucaaugcucaua

SEQ ID NO: 3840968 - RNA, 13 nt, Human
gaaucuuuaauua

SEQ ID NO: 3840969 - RNA, 18 nt, Human
gaaucuuuauugagaaag

SEQ ID NO: 3840970 - RNA, 22 nt, Human
gaaucuuuauugagaaagagca

SEQ ID NO: 3840971 - RNA, 14 nt, Human
gaaugaaaaaugaa

SEQ ID NO: 3840972 - RNA, 19 nt, Human
gaaugaaaaaugaaagaug

SEQ ID NO: 3840973 - RNA, 20 nt, Human
gaaugaaaauaacugaauuu

SEQ ID NO: 3840974 - RNA, 16 nt, Human
gaaugaaacccccaca

SEQ ID NO: 3840975 - RNA, 18 nt, Human
gaaugaaauacuguuuga

SEQ ID NO: 3840976 - RNA, 16 nt, Human
gaaugaaauugcugaa

SEQ ID NO: 3840977 - RNA, 18 nt, Human
gaaugaaccacaucuugc

SEQ ID NO: 3840978 - RNA, 22 nt, Human
gaaugaaccacaucuugcucug

SEQ ID NO: 3840979 - RNA, 12 nt, Human
guacaguguuac

SEQ ID NO: 3840980 - RNA, 16 nt, Human
guacaguguucuguuu

SEQ ID NO: 3840981 - RNA, 22 nt, Human
guacaguucaguuccucuuugc

SEQ ID NO: 3840982 - RNA, 12 nt, Human
guacaguucuuc

SEQ ID NO: 3840983 - RNA, 12 nt, Human
guacaguuuuua

SEQ ID NO: 3840984 - RNA, 22 nt, Human
guacauaaaggugguaugugug

SEQ ID NO: 3840985 - RNA, 20 nt, Human
guacauaaauugcauaaagc

SEQ ID NO: 3840986 - RNA, 22 nt, Human
guacauaaauugcauaaagcau

SEQ ID NO: 3840987 - RNA, 23 nt, Human
guacauaauacacuugcccugcu

SEQ ID NO: 3840988 - RNA, 18 nt, Human
guacauaauacugaacca

SEQ ID NO: 3840989 - RNA, 20 nt, Human
guacauaaugcgugcauacc

SEQ ID NO: 3840990 - RNA, 14 nt, Human
guacauacuuuuug

SEQ ID NO: 3840991 - RNA, 13 nt, Human
guacauagccuau

SEQ ID NO: 3840992 - RNA, 22 nt, Human
guacauagccuauauuuacagu

SEQ ID NO: 3840993 - RNA, 14 nt, Human
guacauaggcagca

SEQ ID NO: 3840994 - RNA, 18 nt, Human
guacauauguaaaauaaa

SEQ ID NO: 3840995 - RNA, 14 nt, Human
guacauaugugcug

SEQ ID NO: 3840996 - RNA, 19 nt, Human
guacauauuuauuuucuuu

SEQ ID NO: 3840997 - RNA, 20 nt, Human
guacauauuuguggaauaau

SEQ ID NO: 3840998 - RNA, 17 nt, Human
guacaucccauguaaca

SEQ ID NO: 3840999 - RNA, 20 nt, Human
guacaucccauguaacagaa

SEQ ID NO: 3841000 - RNA, 23 nt, Human
guacaucccauguaacagaaagg

SEQ ID NO: 3841001 - RNA, 14 nt, Human
guacaucuggccuu

SEQ ID NO: 3841002 - RNA, 11 nt, Human
guacaugaaau

SEQ ID NO: 3841003 - RNA, 11 nt, Human
guacaugagaa

SEQ ID NO: 3841004 - RNA, 13 nt, Human
guacaugugaggc

SEQ ID NO: 3841005 - RNA, 19 nt, Human
guacauguguagccugugc

SEQ ID NO: 3841006 - RNA, 18 nt, Human
guacauguucgggugugg

SEQ ID NO: 3841007 - RNA, 21 nt, Human
guacauguucggguguggguu

SEQ ID NO: 3841008 - RNA, 15 nt, Human
guacauucucaguuu

SEQ ID NO: 3841009 - RNA, 14 nt, Human
guacauuuaaauuu

SEQ ID NO: 3841010 - RNA, 14 nt, Human
guacauuuaugauu

SEQ ID NO: 3841011 - RNA, 20 nt, Human
guacauuuaugauuuaauaa

SEQ ID NO: 3841012 - RNA, 21 nt, Human
guacauuuaugauuuaauaaa

SEQ ID NO: 3841013 - RNA, 18 nt, Human
guacauuucuaagucaaa

SEQ ID NO: 3841014 - RNA, 15 nt, Human
guacauuuuguaaca

SEQ ID NO: 3841015 - RNA, 18 nt, Human
guacauuuuguuguaaaa

SEQ ID NO: 3841016 - RNA, 19 nt, Human
guacauuuuguuguaaaaa

SEQ ID NO: 3841017 - RNA, 22 nt, Human
guacauuuuguuguaaaaagaa

SEQ ID NO: 3841018 - RNA, 19 nt, Human
guacauuuuucaacuuuga

SEQ ID NO: 3841019 - RNA, 20 nt, Human
guacauuuuucaacuuugaa

SEQ ID NO: 3841020 - RNA, 21 nt, Human
guacauuuuucaacuuugaau

SEQ ID NO: 3841021 - RNA, 16 nt, Human
guaccaaaauuuuaaa

SEQ ID NO: 3841022 - RNA, 21 nt, Human
guaccaaaguuuuaucaaguu

SEQ ID NO: 3841023 - RNA, 20 nt, Human
guaccaagacuacuagggaa

SEQ ID NO: 3841024 - RNA, 23 nt, Human
guaccaagacuacuagggaaaug

SEQ ID NO: 3841025 - RNA, 16 nt, Human
guaccacuuuugcaaa

SEQ ID NO: 3841026 - RNA, 16 nt, Human
guaccagauaacuuuu

SEQ ID NO: 3841027 - RNA, 16 nt, Human
guaccagcccagaugu

SEQ ID NO: 3841028 - RNA, 13 nt, Human
guaccagccccac

SEQ ID NO: 3841029 - RNA, 16 nt, Human
guaccagccccacccu

SEQ ID NO: 3841030 - RNA, 16 nt, Human
guaccagcccuggggc

SEQ ID NO: 3841031 - RNA, 17 nt, Human
guaccagcccuggggcu

SEQ ID NO: 3841032 - RNA, 14 nt, Human
guaccagcugcgcu

SEQ ID NO: 3841033 - RNA, 16 nt, Human
guaccagcugcgcuug

SEQ ID NO: 3841034 - RNA, 19 nt, Human
guaccagcugcgcuugcuu

SEQ ID NO: 3841035 - RNA, 18 nt, Human
guaccaggucuccuccac

SEQ ID NO: 3841036 - RNA, 11 nt, Human
guaccaguuaa

SEQ ID NO: 3841037 - RNA, 16 nt, Human
guaccaguuaauuuuu

SEQ ID NO: 3841038 - RNA, 22 nt, Human
guaccauuuaauggggaggaca

SEQ ID NO: 3841039 - RNA, 19 nt, Human
guaccauuuauacaaauua

SEQ ID NO: 3841040 - RNA, 21 nt, Human
guaccauuuauacaaauuaga

SEQ ID NO: 3841041 - RNA, 18 nt, Human
guacccaaaagcucagcc

SEQ ID NO: 3841042 - RNA, 22 nt, Human
guacccaauagcugcccauuuc

SEQ ID NO: 3841043 - RNA, 14 nt, Human
guacccaccugagc

SEQ ID NO: 3841044 - RNA, 15 nt, Human
guacccacugcucug

SEQ ID NO: 3841045 - RNA, 20 nt, Human
guacccagccaucugcccag

SEQ ID NO: 3841046 - RNA, 17 nt, Human
guacccaucuaguacuu

SEQ ID NO: 3841047 - RNA, 13 nt, Human
guaccccacccuc

SEQ ID NO: 3841048 - RNA, 13 nt, Human
guacccccaggac

SEQ ID NO: 3841049 - RNA, 13 nt, Human
guacccccgccca

SEQ ID NO: 3841050 - RNA, 19 nt, Human
guacccccgcccaggcugg

SEQ ID NO: 3841051 - RNA, 17 nt, Human
guacccggggcccaggg

SEQ ID NO: 3841052 - RNA, 18 nt, Human
guacccggggcccagggc

SEQ ID NO: 3841053 - RNA, 17 nt, Human
guacccucucagcucca

SEQ ID NO: 3841054 - RNA, 13 nt, Human
guaccuaagggag

SEQ ID NO: 3841055 - RNA, 19 nt, Human
guaccuauaaaguaaagcu

SEQ ID NO: 3841056 - RNA, 21 nt, Human
guaccuauaaaguaaagcuaa

SEQ ID NO: 3841057 - RNA, 14 nt, Human
guaccuauuuucau

SEQ ID NO: 3841058 - RNA, 20 nt, Human
guaccuccccugccuugcug

SEQ ID NO: 3841059 - RNA, 16 nt, Human
guaccuccucucagug

SEQ ID NO: 3841060 - RNA, 21 nt, Human
guaccucuugagccuugaacu

SEQ ID NO: 3841061 - RNA, 12 nt, Human
guaccugagggu

SEQ ID NO: 3841062 - RNA, 15 nt, Human
guaccugagggucug

SEQ ID NO: 3841063 - RNA, 19 nt, Human
guaccuguuccuuagaccu

SEQ ID NO: 3841064 - RNA, 23 nt, Human
guaccuugaacacugggggaggg

SEQ ID NO: 3841065 - RNA, 18 nt, Human
guaccuugaccuuuguac

SEQ ID NO: 3841066 - RNA, 19 nt, Human
guaccuugaccuuuguaca

SEQ ID NO: 3841067 - RNA, 13 nt, Human
guaccuuugucac

SEQ ID NO: 3841068 - RNA, 23 nt, Human
guaccuuuuuuguuuuuucaaaa

SEQ ID NO: 3841069 - RNA, 23 nt, Human
guacgaaccuacaguuuuaacug

SEQ ID NO: 3841070 - RNA, 15 nt, Human
guacgaagaguauuu

SEQ ID NO: 3841071 - RNA, 21 nt, Human
guacgacucuuuuccaaacac

SEQ ID NO: 3841072 - RNA, 15 nt, Human
guacgaugacagugu

SEQ ID NO: 3841073 - RNA, 17 nt, Human
guacggacauaaaagca

SEQ ID NO: 3841074 - RNA, 14 nt, Human
guacgucugacagg

SEQ ID NO: 3841075 - RNA, 15 nt, Human
guacguggagaggga

SEQ ID NO: 3841076 - RNA, 17 nt, Human
guacguugugcauuugg

SEQ ID NO: 3841077 - RNA, 14 nt, Human
guacguuuguaugu

SEQ ID NO: 3841078 - RNA, 22 nt, Human
guacuaacuccuaggaaaauac

SEQ ID NO: 3841079 - RNA, 15 nt, Human
guacuaaggaaucuu

SEQ ID NO: 3841080 - RNA, 23 nt, Human
guacuaaggaaucuuucugcuuu

SEQ ID NO: 3841081 - RNA, 17 nt, Human
guacuaauauuucugua

SEQ ID NO: 3841082 - RNA, 12 nt, Human
guacuacaauuu

SEQ ID NO: 3841083 - RNA, 23 nt, Human
guacuacacauuuuuaaauuguu

SEQ ID NO: 3841084 - RNA, 18 nt, Human
guacuaggauacugcugc

SEQ ID NO: 3841085 - RNA, 22 nt, Human
guacuaggauacugcugcguca

SEQ ID NO: 3841086 - RNA, 17 nt, Human
guacuaguacuguguac

SEQ ID NO: 3841087 - RNA, 17 nt, Human
guacuaguguucuguuu

SEQ ID NO: 3841088 - RNA, 17 nt, Human
guacuaguuacacaucu

SEQ ID NO: 3841089 - RNA, 21 nt, Human
guacuauaaugaaaacauccu

SEQ ID NO: 3841090 - RNA, 21 nt, Human
guacuauaucuguuuuacugc

SEQ ID NO: 3841091 - RNA, 21 nt, Human
guacuaucugugcguagaagu

SEQ ID NO: 3841092 - RNA, 17 nt, Human
guacucaggaggcugag

SEQ ID NO: 3841093 - RNA, 14 nt, Human
guacucauuaaaaa

SEQ ID NO: 3841094 - RNA, 21 nt, Human
guacuccacacugcacaauaa

SEQ ID NO: 3841095 - RNA, 16 nt, Human
guacucccucucagga

SEQ ID NO: 3841096 - RNA, 15 nt, Human
guacuccugcaaaau

SEQ ID NO: 3841097 - RNA, 16 nt, Human
guacuccugcaaaauu

SEQ ID NO: 3841098 - RNA, 21 nt, Human
guacucucaucacuacaguau

SEQ ID NO: 3841099 - RNA, 11 nt, Human
guacucuccua

SEQ ID NO: 3841100 - RNA, 14 nt, Human
guacucugaaacac

SEQ ID NO: 3841101 - RNA, 21 nt, Human
guacucugaaacacacugaaa

SEQ ID NO: 3841102 - RNA, 13 nt, Human
guacucuggccuc

SEQ ID NO: 3841103 - RNA, 14 nt, Human
guacucuggccucu

SEQ ID NO: 3841104 - RNA, 13 nt, Human
guacucuuccgaa

SEQ ID NO: 3841105 - RNA, 22 nt, Human
guacucuuccgaaaaauccucu

SEQ ID NO: 3841106 - RNA, 14 nt, Human
guacugaauuuuuu

SEQ ID NO: 3841107 - RNA, 19 nt, Human
guacugaauuuuuuuguaa

SEQ ID NO: 3841108 - RNA, 20 nt, Human
guacugaauuuuuuuguaau

SEQ ID NO: 3841109 - RNA, 18 nt, Human
guacugacuuugcuugcu

SEQ ID NO: 3841110 - RNA, 17 nt, Human
guacugagcagugauau

SEQ ID NO: 3841111 - RNA, 17 nt, Human
guacugauugagaaguu

SEQ ID NO: 3841112 - RNA, 20 nt, Human
guacugauuucaguaagucu

SEQ ID NO: 3841113 - RNA, 19 nt, Human
guacugccccccaugagga

SEQ ID NO: 3841114 - RNA, 16 nt, Human
guacugccugcuuggg

SEQ ID NO: 3841115 - RNA, 17 nt, Human
guacugcucaggcugca

SEQ ID NO: 3841116 - RNA, 23 nt, Human
gacacagcagcuucaccagagca

SEQ ID NO: 3841117 - RNA, 13 nt, Human
gacacagcguccc

SEQ ID NO: 3841118 - RNA, 21 nt, Human
gacacagcgucccuagcagug

SEQ ID NO: 3841119 - RNA, 22 nt, Human
gacacagcgucccuagcaguga

SEQ ID NO: 3841120 - RNA, 13 nt, Human
gacacagcucuuc

SEQ ID NO: 3841121 - RNA, 16 nt, Human
gacacagcucuucucc

SEQ ID NO: 3841122 - RNA, 17 nt, Human
gacacagcucuucucca

SEQ ID NO: 3841123 - RNA, 16 nt, Human
gacaucacaggguggg

SEQ ID NO: 3841124 - RNA, 19 nt, Human
gacaucacagggugggccu

SEQ ID NO: 3841125 - RNA, 13 nt, Human
gacaucacuggca

SEQ ID NO: 3841126 - RNA, 11 nt, Human
gacaucacugu

SEQ ID NO: 3841127 - RNA, 22 nt, Human
gacaucacuuguacaaaauaaa

SEQ ID NO: 3841128 - RNA, 15 nt, Human
gacaucagccagcug

SEQ ID NO: 3841129 - RNA, 13 nt, Human
gacaucagcuggu

SEQ ID NO: 3841130 - RNA, 19 nt, Human
gacaucaguggcauggcuc

SEQ ID NO: 3841131 - RNA, 13 nt, Human
gacauccaggagg

SEQ ID NO: 3841132 - RNA, 14 nt, Human
guacuggauuuaac

SEQ ID NO: 3841133 - RNA, 16 nt, Human
guacuggcaugguacg

SEQ ID NO: 3841134 - RNA, 19 nt, Human
guacuggcugauggaguaa

SEQ ID NO: 3841135 - RNA, 20 nt, Human
guacugggauuacaggcgug

SEQ ID NO: 3841136 - RNA, 21 nt, Human
guacuggggguugcgggggga

SEQ ID NO: 3841137 - RNA, 15 nt, Human
guacugguaagauug

SEQ ID NO: 3841138 - RNA, 19 nt, Human
guacuguaauaauaccuca

SEQ ID NO: 3841139 - RNA, 12 nt, Human
guacuguacuaa

SEQ ID NO: 3841140 - RNA, 16 nt, Human
guacuguauagacagu

SEQ ID NO: 3841141 - RNA, 18 nt, Human
guacuguaugaucaaaug

SEQ ID NO: 3841142 - RNA, 23 nt, Human
guacuguaugaucaaauguuuaa

SEQ ID NO: 3841143 - RNA, 15 nt, Human
guacuguaugugaug

SEQ ID NO: 3841144 - RNA, 16 nt, Human
guacugugggcaauuu

SEQ ID NO: 3841145 - RNA, 17 nt, Human
guacugugggcaauuua

SEQ ID NO: 3841146 - RNA, 20 nt, Human
guacugugggcaauuuagaa

SEQ ID NO: 3841147 - RNA, 22 nt, Human
guacugugggcaauuuagaaaa

SEQ ID NO: 3841148 - RNA, 17 nt, Human
guacuguucggaagggg

SEQ ID NO: 3841149 - RNA, 22 nt, Human
guacuguucggaagggguuccu

SEQ ID NO: 3841150 - RNA, 14 nt, Human
guacuuaacuauuc

SEQ ID NO: 3841151 - RNA, 19 nt, Human
guacuuagaguuucuguuu

SEQ ID NO: 3841152 - RNA, 15 nt, Human
guacuuauuacugcu

SEQ ID NO: 3841153 - RNA, 19 nt, Human
guacuucagcaagagagaa

SEQ ID NO: 3841154 - RNA, 21 nt, Human
guacuucagcaagagagaacc

SEQ ID NO: 3841155 - RNA, 15 nt, Human
guacuucaugcuguc

SEQ ID NO: 3841156 - RNA, 16 nt, Human
guacuucuccacccug

SEQ ID NO: 3841157 - RNA, 15 nt, Human
guacuucuucuguaa

SEQ ID NO: 3841158 - RNA, 18 nt, Human
guacuucuucuguaauau

SEQ ID NO: 3841159 - RNA, 18 nt, Human
guacuucuugaauauaaa

SEQ ID NO: 3841160 - RNA, 19 nt, Human
guacuucuugaauauaaaa

SEQ ID NO: 3841161 - RNA, 22 nt, Human
guacuugaaaucuaggauuauu

SEQ ID NO: 3841162 - RNA, 22 nt, Human
guacuugcucuugaugccuggc

SEQ ID NO: 3841163 - RNA, 21 nt, Human
guacuugcugcuauuuuacug

SEQ ID NO: 3841164 - RNA, 15 nt, Human
guacuuggccuuugg

SEQ ID NO: 3841165 - RNA, 13 nt, Human
guacuugguccaa

SEQ ID NO: 3841166 - RNA, 19 nt, Human
guacuugguccaacugcaa

SEQ ID NO: 3841167 - RNA, 12 nt, Human
guacuuguaguu

SEQ ID NO: 3841168 - RNA, 23 nt, Human
guacuuuauuuucuauaauuuaa

SEQ ID NO: 3841169 - RNA, 12 nt, Human
guacuuucuguu

SEQ ID NO: 3841170 - RNA, 13 nt, Human
guacuuucuguua

SEQ ID NO: 3841171 - RNA, 20 nt, Human
guacuuugauucacauguuu

SEQ ID NO: 3841172 - RNA, 14 nt, Human
guacuuuggaggcc

SEQ ID NO: 3841173 - RNA, 16 nt, Human
guacuuuuggaaucua

SEQ ID NO: 3841174 - RNA, 22 nt, Human
guacuuuuggaaucuagaagaa

SEQ ID NO: 3841175 - RNA, 15 nt, Human
guacuuuuugugaag

SEQ ID NO: 3841176 - RNA, 12 nt, Human
guagaaaaacau

SEQ ID NO: 3841177 - RNA, 18 nt, Human
guagaaaagaacuggaaa

SEQ ID NO: 3841178 - RNA, 20 nt, Human
guagaaaagggaacugaaca

SEQ ID NO: 3841179 - RNA, 13 nt, Human
guagaaaauguga

SEQ ID NO: 3841180 - RNA, 15 nt, Human
guagaaaaugugacc

SEQ ID NO: 3841181 - RNA, 19 nt, Human
guagaaacugcagggaaaa

SEQ ID NO: 3841182 - RNA, 17 nt, Human
guagaaaggccuuuaaa

SEQ ID NO: 3841183 - RNA, 22 nt, Human
guagaaaggggcccaguccugg

SEQ ID NO: 3841184 - RNA, 17 nt, Human
guagaaaugguuguauu

SEQ ID NO: 3841185 - RNA, 20 nt, Human
guagaaaugguuguauuaga

SEQ ID NO: 3841186 - RNA, 23 nt, Human
guagaaauuuuacaauaggugcu

SEQ ID NO: 3841187 - RNA, 22 nt, Human
guagaacacaaggucauuugcu

SEQ ID NO: 3841188 - RNA, 22 nt, Human
guagaacgccagggaccccaga

SEQ ID NO: 3841189 - RNA, 18 nt, Human
guagaacucacucugggc

SEQ ID NO: 3841190 - RNA, 20 nt, Human
guagaacucacucugggcug

SEQ ID NO: 3841191 - RNA, 14 nt, Human
guagaacuuuguau

SEQ ID NO: 3841192 - RNA, 21 nt, Human
guagaacuuuguauaguuaug

SEQ ID NO: 3841193 - RNA, 13 nt, Human
guagaagagggau

SEQ ID NO: 3841194 - RNA, 18 nt, Human
guagaagcccuucuaccu

SEQ ID NO: 3841195 - RNA, 14 nt, Human
guagaagggaaagc

SEQ ID NO: 3841196 - RNA, 17 nt, Human
guagaaggguuauauuu

SEQ ID NO: 3841197 - RNA, 15 nt, Human
guagaaggucggagg

SEQ ID NO: 3841198 - RNA, 21 nt, Human
guagaagucuuagauguauau

SEQ ID NO: 3841199 - RNA, 15 nt, Human
guagaaguuuuugua

SEQ ID NO: 3841200 - RNA, 19 nt, Human
guagaauagccuguggccu

SEQ ID NO: 3841201 - RNA, 14 nt, Human
guagaaucugugua

SEQ ID NO: 3841202 - RNA, 22 nt, Human
guagaaugaccuuguaauguaa

SEQ ID NO: 3841203 - RNA, 19 nt, Human
guagaauguaaagcuuguc

SEQ ID NO: 3841204 - RNA, 21 nt, Human
guagaauguaaagcuugucug

SEQ ID NO: 3841205 - RNA, 20 nt, Human
guagaauguauuguaccuuu

SEQ ID NO: 3841206 - RNA, 16 nt, Human
guagaauuguuauaga

SEQ ID NO: 3841207 - RNA, 15 nt, Human
guagacaucuguccu

SEQ ID NO: 3841208 - RNA, 15 nt, Human
guagacauuuauaac

SEQ ID NO: 3841209 - RNA, 21 nt, Human
guagacauuuuaacaagaaga

SEQ ID NO: 3841210 - RNA, 22 nt, Human
guagacauuuuaacaagaagau

SEQ ID NO: 3841211 - RNA, 15 nt, Human
guagaccccuggcug

SEQ ID NO: 3841212 - RNA, 16 nt, Human
guagaccccuggcugg

SEQ ID NO: 3841213 - RNA, 16 nt, Human
guagaccuagggagga

SEQ ID NO: 3841214 - RNA, 21 nt, Human
guagaccugucuccuggcggu

SEQ ID NO: 3841215 - RNA, 16 nt, Human
guagacuauauacaug

SEQ ID NO: 3841216 - RNA, 11 nt, Human
guagagacagg

SEQ ID NO: 3841217 - RNA, 13 nt, Human
guagagacagggu

SEQ ID NO: 3841218 - RNA, 23 nt, Human
guagagacaggguuucaccaugu

SEQ ID NO: 3841219 - RNA, 17 nt, Human
guagagauggaggagga

SEQ ID NO: 3841220 - RNA, 15 nt, Human
guagaggaaggaugc

SEQ ID NO: 3841221 - RNA, 15 nt, Human
guagaggcuuguuua

SEQ ID NO: 3841222 - RNA, 19 nt, Human
guagagguacacuugugaa

SEQ ID NO: 3841223 - RNA, 15 nt, Human
guagagucaucucca

SEQ ID NO: 3841224 - RNA, 23 nt, Human
guagagucaucuccaucagcugu

SEQ ID NO: 3841225 - RNA, 14 nt, Human
guagagucugaggg

SEQ ID NO: 3841226 - RNA, 15 nt, Human
guagagugggagcug

SEQ ID NO: 3841227 - RNA, 20 nt, Human
guagaguguagacuguggcu

SEQ ID NO: 3841228 - RNA, 14 nt, Human
guagaguuaagaag

SEQ ID NO: 3841229 - RNA, 23 nt, Human
guagaguugcugagagggcucga

SEQ ID NO: 3841230 - RNA, 21 nt, Human
guagauaaguguucugucuga

SEQ ID NO: 3841231 - RNA, 23 nt, Human
guagauaguaugcacuauauaca

SEQ ID NO: 3841232 - RNA, 13 nt, Human
guagauauuacuu

SEQ ID NO: 3841233 - RNA, 14 nt, Human
guagauauuuggcu

SEQ ID NO: 3841234 - RNA, 17 nt, Human
guagaucaccagaauaa

SEQ ID NO: 3841235 - RNA, 19 nt, Human
guagaucaccagaauaaac

SEQ ID NO: 3841236 - RNA, 17 nt, Human
guagaucagagcagcag

SEQ ID NO: 3841237 - RNA, 17 nt, Human
guagaucaguggucucc

SEQ ID NO: 3841238 - RNA, 15 nt, Human
guagauccauuucca

SEQ ID NO: 3841239 - RNA, 23 nt, Human
guagaugaaaaagcauguacagu

SEQ ID NO: 3841240 - RNA, 14 nt, Human
guagauuaaaaauu

SEQ ID NO: 3841241 - RNA, 13 nt, Human
guagauucugugg

SEQ ID NO: 3841242 - RNA, 19 nt, Human
guagauucuguggaacaag

SEQ ID NO: 3841243 - RNA, 21 nt, Human
guagauugcagaaaauucugu

SEQ ID NO: 3841244 - RNA, 23 nt, Human
guagauugcagaaaauucugugc

SEQ ID NO: 3841245 - RNA, 16 nt, Human
guagauugcuucugua

SEQ ID NO: 3841246 - RNA, 16 nt, Human
guagauuuauuucauc

SEQ ID NO: 3841247 - RNA, 16 nt, Human
guagauuugauuuuuu

SEQ ID NO: 3841248 - RNA, 21 nt, Human
guagauuuuaaaaguuauuaa

SEQ ID NO: 3841249 - RNA, 13 nt, Human
guagauuuucuuu

SEQ ID NO: 3841250 - RNA, 15 nt, Human
guagauuuucuuuaa

SEQ ID NO: 3841251 - RNA, 20 nt, Human
guagcaaacccugucaaaca

SEQ ID NO: 3841252 - RNA, 20 nt, Human
guagcaaguucuagagaaga

SEQ ID NO: 3841253 - RNA, 12 nt, Human
guagcacaggcu

SEQ ID NO: 3841254 - RNA, 17 nt, Human
guagcacucaggcucuc

SEQ ID NO: 3841255 - RNA, 14 nt, Human
guagcacugacaga

SEQ ID NO: 3841256 - RNA, 15 nt, Human
guagcacugacagau

SEQ ID NO: 3841257 - RNA, 15 nt, Human
guagcagaguuaaau

SEQ ID NO: 3841258 - RNA, 14 nt, Human
guagcagcuggacu

SEQ ID NO: 3841259 - RNA, 17 nt, Human
guagcaugcuuguugca

SEQ ID NO: 3841260 - RNA, 21 nt, Human
guagcauguugagccaggccu

SEQ ID NO: 3841261 - RNA, 21 nt, Human
guagcauucuuuggaguuaaa

SEQ ID NO: 3841262 - RNA, 20 nt, Human
guagcauuuacugugucuuu

SEQ ID NO: 3841263 - RNA, 15 nt, Human
guagcauuucauucu

SEQ ID NO: 3841264 - RNA, 19 nt, Human
guagccaaggugggcugag

SEQ ID NO: 3841265 - RNA, 16 nt, Human
guagccacaccaggau

SEQ ID NO: 3841266 - RNA, 21 nt, Human
guagccaccugaguuccugag

SEQ ID NO: 3841267 - RNA, 15 nt, Human
guagccagcacacag

SEQ ID NO: 3841268 - RNA, 22 nt, Human
guaacagaaagggcaacaauaa

SEQ ID NO: 3841269 - RNA, 14 nt, Human
guaacagaacagcu

SEQ ID NO: 3841270 - RNA, 13 nt, Human
guaacagcuccuu

SEQ ID NO: 3841271 - RNA, 22 nt, Human
guaacaggaaaauuuuaaaaau

SEQ ID NO: 3841272 - RNA, 13 nt, Human
guaacauccuuuc

SEQ ID NO: 3841273 - RNA, 17 nt, Human
guaacauucauguucua

SEQ ID NO: 3841274 - RNA, 14 nt, Human
guaacauuugcugu

SEQ ID NO: 3841275 - RNA, 11 nt, Human
guaaccagcca

SEQ ID NO: 3841276 - RNA, 13 nt, Human
guaaccagccaga

SEQ ID NO: 3841277 - RNA, 20 nt, Human
guaaccagccagauccucuu

SEQ ID NO: 3841278 - RNA, 20 nt, Human
guaaccauuuuauaaagugc

SEQ ID NO: 3841279 - RNA, 15 nt, Human
guaaccucagcucug

SEQ ID NO: 3841280 - RNA, 12 nt, Human
guaacuacuuua

SEQ ID NO: 3841281 - RNA, 14 nt, Human
guaacuacuuuaua

SEQ ID NO: 3841282 - RNA, 22 nt, Human
guaacuauagacuggaaaaaau

SEQ ID NO: 3841283 - RNA, 14 nt, Human
guaacuauguuuua

SEQ ID NO: 3841284 - RNA, 12 nt, Human
guaacuccacca

SEQ ID NO: 3841285 - RNA, 23 nt, Human
guaacucuaauucccauuuugca

SEQ ID NO: 3841286 - RNA, 14 nt, Human
guaacucuguaauu

SEQ ID NO: 3841287 - RNA, 13 nt, Human
guaacugacaacu

SEQ ID NO: 3841288 - RNA, 19 nt, Human
guaacugcauugagaacug

SEQ ID NO: 3841289 - RNA, 16 nt, Human
guaacugccuagaaac

SEQ ID NO: 3841290 - RNA, 20 nt, Human
guaacugccuagaaacaaca

SEQ ID NO: 3841291 - RNA, 22 nt, Human
guaacugcucuugggcaauauu

SEQ ID NO: 3841292 - RNA, 14 nt, Human
guaacugcugaaaa

SEQ ID NO: 3841293 - RNA, 14 nt, Human
guaacugcuuucug

SEQ ID NO: 3841294 - RNA, 23 nt, Human
guaacugucaggcugaaaacaau

SEQ ID NO: 3841295 - RNA, 20 nt, Human
guaacuguccguaguaucag

SEQ ID NO: 3841296 - RNA, 19 nt, Human
guaacuguuaaauugcugu

SEQ ID NO: 3841297 - RNA, 13 nt, Human
guaacuguuacca

SEQ ID NO: 3841298 - RNA, 20 nt, Human
guaacuguuaccauuggaaa

SEQ ID NO: 3841299 - RNA, 14 nt, Human
guaacuuauauuga

SEQ ID NO: 3841300 - RNA, 22 nt, Human
guaacuuauauugaagacaauu

SEQ ID NO: 3841301 - RNA, 19 nt, Human
guaacuuccaaauaaauaa

SEQ ID NO: 3841302 - RNA, 18 nt, Human
guaacuucuuauggaauu

SEQ ID NO: 3841303 - RNA, 18 nt, Human
guaacuuggauguagcca

SEQ ID NO: 3841304 - RNA, 12 nt, Human
guaacuuuaugu

SEQ ID NO: 3841305 - RNA, 14 nt, Human
guaacuuuugugaa

SEQ ID NO: 3841306 - RNA, 17 nt, Human
guaagaaaagugguugu

SEQ ID NO: 3841307 - RNA, 14 nt, Human
guaagaaaauauuu

SEQ ID NO: 3841308 - RNA, 19 nt, Human
guaagaaaaugcuagaaga

SEQ ID NO: 3841309 - RNA, 20 nt, Human
guaagaaacacacugaggca

SEQ ID NO: 3841310 - RNA, 20 nt, Human
guaagaaagugaagcaaauc

SEQ ID NO: 3841311 - RNA, 13 nt, Human
guaagaaauacag

SEQ ID NO: 3841312 - RNA, 16 nt, Human
guaagaaauacagacu

SEQ ID NO: 3841313 - RNA, 12 nt, Human
guaagaaauacu

SEQ ID NO: 3841314 - RNA, 17 nt, Human
guaagaaccuugccuga

SEQ ID NO: 3841315 - RNA, 15 nt, Human
guaagacaaagguuu

SEQ ID NO: 3841316 - RNA, 19 nt, Human
guaagaccggaagcuccug

SEQ ID NO: 3841317 - RNA, 14 nt, Human
guaagagacagaau

SEQ ID NO: 3841318 - RNA, 23 nt, Human
guaagagacagaauguaucugug

SEQ ID NO: 3841319 - RNA, 20 nt, Human
guaagagcaccuuccucacu

SEQ ID NO: 3841320 - RNA, 13 nt, Human
guaagaggcugga

SEQ ID NO: 3841321 - RNA, 17 nt, Human
guaagaguguagaagca

SEQ ID NO: 3841322 - RNA, 22 nt, Human
guaagauaucucaaugaaccau

SEQ ID NO: 3841323 - RNA, 13 nt, Human
guaagaucacugu

SEQ ID NO: 3841324 - RNA, 18 nt, Human
guaagaucacuguuuaga

SEQ ID NO: 3841325 - RNA, 12 nt, Human
guaagaugcugg

SEQ ID NO: 3841326 - RNA, 20 nt, Human
guaagaugcuggguuggugc

SEQ ID NO: 3841327 - RNA, 17 nt, Human
guaagauugauaucuau

SEQ ID NO: 3841328 - RNA, 13 nt, Human
guaagauuguuau

SEQ ID NO: 3841329 - RNA, 17 nt, Human
guaagauuuugaaaacu

SEQ ID NO: 3841330 - RNA, 13 nt, Human
guaagccaaagaa

SEQ ID NO: 3841331 - RNA, 22 nt, Human
guaagccaaagaaaugaacauu

SEQ ID NO: 3841332 - RNA, 13 nt, Human
guaagcucuggcu

SEQ ID NO: 3841333 - RNA, 17 nt, Human
guaagcugcucuauugu

SEQ ID NO: 3841334 - RNA, 19 nt, Human
guaagcuguuuauuuuaua

SEQ ID NO: 3841335 - RNA, 22 nt, Human
guaagcuguuugguuuuaaaau

SEQ ID NO: 3841336 - RNA, 17 nt, Human
guaagcuuccaggaaaa

SEQ ID NO: 3841337 - RNA, 21 nt, Human
guaaggaauaccugucccccu

SEQ ID NO: 3841338 - RNA, 15 nt, Human
guaaggaaugcuugg

SEQ ID NO: 3841339 - RNA, 23 nt, Human
guaaggcagggucccauuucuca

SEQ ID NO: 3841340 - RNA, 14 nt, Human
guaaggcucuagau

SEQ ID NO: 3841341 - RNA, 16 nt, Human
guaaggcucuagauca

SEQ ID NO: 3841342 - RNA, 13 nt, Human
guaaggcugugua

SEQ ID NO: 3841343 - RNA, 17 nt, Human
guaagggaaacugccag

SEQ ID NO: 3841344 - RNA, 16 nt, Human
guauuucauguggcug

SEQ ID NO: 3841345 - RNA, 22 nt, Human
guauuucuuauacgcuuuucuu

SEQ ID NO: 3841346 - RNA, 20 nt, Human
guauuugaaaacagaaauug

SEQ ID NO: 3841347 - RNA, 17 nt, Human
guauuugaaagugccuu

SEQ ID NO: 3841348 - RNA, 21 nt, Human
guauuugaauuaaaacuucuu

SEQ ID NO: 3841349 - RNA, 23 nt, Human
guauuugaauuaaaacuucuuaa

SEQ ID NO: 3841350 - RNA, 21 nt, Human
guauuugagaguucuaaauuu

SEQ ID NO: 3841351 - RNA, 19 nt, Human
guauuugauucaaaauauu

SEQ ID NO: 3841352 - RNA, 17 nt, Human
guauuuggaauuagaac

SEQ ID NO: 3841353 - RNA, 12 nt, Human
guauuuggguuu

SEQ ID NO: 3841354 - RNA, 20 nt, Human
guauuugugacuaauuguau

SEQ ID NO: 3841355 - RNA, 17 nt, Human
guauuuguuaauuuaga

SEQ ID NO: 3841356 - RNA, 22 nt, Human
guauuuguuaauuuagaaaacu

SEQ ID NO: 3841357 - RNA, 17 nt, Human
guauuuuaaaagaauga

SEQ ID NO: 3841358 - RNA, 13 nt, Human
guauuuuaaucac

SEQ ID NO: 3841359 - RNA, 20 nt, Human
guauuuuagugaacuugaaa

SEQ ID NO: 3841360 - RNA, 23 nt, Human
guauuuuaguggacccugaaaug

SEQ ID NO: 3841361 - RNA, 23 nt, Human
guauuuuaucuuugauucuccuu

SEQ ID NO: 3841362 - RNA, 15 nt, Human
guauuuuauguaugu

SEQ ID NO: 3841363 - RNA, 23 nt, Human
guauuuuauguauguuuacacug

SEQ ID NO: 3841364 - RNA, 13 nt, Human
guauuuucaauag

SEQ ID NO: 3841365 - RNA, 16 nt, Human
guauuuucaugaaaau

SEQ ID NO: 3841366 - RNA, 19 nt, Human
guauuuucaugaaaauacc

SEQ ID NO: 3841367 - RNA, 16 nt, Human
guauuuucuucucugu

SEQ ID NO: 3841368 - RNA, 13 nt, Human
guauuuugaaaau

SEQ ID NO: 3841369 - RNA, 12 nt, Human
guauuuugaagu

SEQ ID NO: 3841370 - RNA, 18 nt, Human
guauuuugaaguuuacau

SEQ ID NO: 3841371 - RNA, 16 nt, Human
guauuuugaauaccau

SEQ ID NO: 3841372 - RNA, 17 nt, Human
guauuuuggagaaauua

SEQ ID NO: 3841373 - RNA, 23 nt, Human
guauuuugugugaccaacugugu

SEQ ID NO: 3841374 - RNA, 18 nt, Human
guauuuuuaaugggggua

SEQ ID NO: 3841375 - RNA, 22 nt, Human
guauuuuuagaauaagaauuug

SEQ ID NO: 3841376 - RNA, 18 nt, Human
guauuuuuauacaaaccu

SEQ ID NO: 3841377 - RNA, 18 nt, Human
guauuuuucaauaaagca

SEQ ID NO: 3841378 - RNA, 21 nt, Human
guauuuuucaauaaagcauuu

SEQ ID NO: 3841379 - RNA, 19 nt, Human
guauuuuucaauaauaaaa

SEQ ID NO: 3841380 - RNA, 17 nt, Human
guauuuuucuuuaacca

SEQ ID NO: 3841381 - RNA, 15 nt, Human
guauuuuugacagaa

SEQ ID NO: 3841382 - RNA, 14 nt, Human
guauuuuuuuacua

SEQ ID NO: 3841383 - RNA, 17 nt, Human
guauuuuuuuacuaaua

SEQ ID NO: 3841384 - RNA, 23 nt, Human
guauuuuuuuaucuugggacugg

SEQ ID NO: 3841385 - RNA, 17 nt, Human
guauuuuuuuguaauug

SEQ ID NO: 3841386 - RNA, 18 nt, Human
guauuuuuuuuucuaaga

SEQ ID NO: 3841387 - RNA, 23 nt, Human
gucaaaaaguuugguucuguguc

SEQ ID NO: 3841388 - RNA, 13 nt, Human
gucaaaaauuaaa

SEQ ID NO: 3841389 - RNA, 16 nt, Human
gucaaaacucaaaugc

SEQ ID NO: 3841390 - RNA, 15 nt, Human
gucaaaaggugccug

SEQ ID NO: 3841391 - RNA, 15 nt, Human
gucaaaaguuggacu

SEQ ID NO: 3841392 - RNA, 21 nt, Human
gucaaaaguuggacuaaaugc

SEQ ID NO: 3841393 - RNA, 18 nt, Human
gucaaaauagugccacua

SEQ ID NO: 3841394 - RNA, 20 nt, Human
gucaaacaaacucucugaac

SEQ ID NO: 3841395 - RNA, 16 nt, Human
gucaaacaaagccaga

SEQ ID NO: 3841396 - RNA, 17 nt, Human
gucaaacaaagccagaa

SEQ ID NO: 3841397 - RNA, 12 nt, Human
gucaaacaaaua

SEQ ID NO: 3841398 - RNA, 15 nt, Human
gucaaacaugaagug

SEQ ID NO: 3841399 - RNA, 11 nt, Human
gucaaacauua

SEQ ID NO: 3841400 - RNA, 19 nt, Human
gucaaacauuaguacuuua

SEQ ID NO: 3841401 - RNA, 20 nt, Human
gucaaacuguagaaaugaug

SEQ ID NO: 3841402 - RNA, 13 nt, Human
gucaaacuuggau

SEQ ID NO: 3841403 - RNA, 12 nt, Human
gucaaagaaaug

SEQ ID NO: 3841404 - RNA, 22 nt, Human
gucaaagcuuugacucuauaag

SEQ ID NO: 3841405 - RNA, 13 nt, Human
gucaaaguaaaac

SEQ ID NO: 3841406 - RNA, 18 nt, Human
gucaaaguggugagaggc

SEQ ID NO: 3841407 - RNA, 14 nt, Human
gucaaauaaacacu

SEQ ID NO: 3841408 - RNA, 15 nt, Human
gucaaauaaacacug

SEQ ID NO: 3841409 - RNA, 22 nt, Human
gucaaaugcauacaaguuucau

SEQ ID NO: 3841410 - RNA, 20 nt, Human
gucaacagaaugaaaaauga

SEQ ID NO: 3841411 - RNA, 18 nt, Human
gucaacagagaaggcagg

SEQ ID NO: 3841412 - RNA, 23 nt, Human
gucaacagagaaggcaggaaugu

SEQ ID NO: 3841413 - RNA, 21 nt, Human
guacagugguucuacaaucua

SEQ ID NO: 3841414 - RNA, 22 nt, Human
guacagugucuuuuuuuguaua

SEQ ID NO: 3841415 - RNA, 16 nt, Human
guacaguguguaaagu

SEQ ID NO: 3841416 - RNA, 14 nt, Human
guacaguguucugu

SEQ ID NO: 3841417 - RNA, 17 nt, Human
guacaguguucuguuua

SEQ ID NO: 3841418 - RNA, 14 nt, Human
guacaguuaucuaa

SEQ ID NO: 3841419 - RNA, 23 nt, Human
guacaguucaguuccucuuugca

SEQ ID NO: 3841420 - RNA, 23 nt, Human
guacaguugcuguugugugauca

SEQ ID NO: 3841421 - RNA, 20 nt, Human
guacaguugggaaaauaugu

SEQ ID NO: 3841422 - RNA, 21 nt, Human
guacaguugggaaaauauguc

SEQ ID NO: 3841423 - RNA, 15 nt, Human
guacaguuugcugua

SEQ ID NO: 3841424 - RNA, 16 nt, Human
guacaguuuguuuaca

SEQ ID NO: 3841425 - RNA, 18 nt, Human
guacaguuuguuuacaca

SEQ ID NO: 3841426 - RNA, 19 nt, Human
guacaguuuguuuacacac

SEQ ID NO: 3841427 - RNA, 12 nt, Human
guacauaaaaga

SEQ ID NO: 3841428 - RNA, 15 nt, Human
guacauaaacaauga

SEQ ID NO: 3841429 - RNA, 21 nt, Human
guacauaaauugcauaaagca

SEQ ID NO: 3841430 - RNA, 22 nt, Human
guacauaauacacuugcccugc

SEQ ID NO: 3841431 - RNA, 14 nt, Human
guacauaauacuga

SEQ ID NO: 3841432 - RNA, 19 nt, Human
guacauacccuggccgccc

SEQ ID NO: 3841433 - RNA, 17 nt, Human
guacauacgauuuaagg

SEQ ID NO: 3841434 - RNA, 13 nt, Human
guacauacuuuuu

SEQ ID NO: 3841435 - RNA, 18 nt, Human
guacauaguuauuuauuu

SEQ ID NO: 3841436 - RNA, 21 nt, Human
guacaucccauguaacagaaa

SEQ ID NO: 3841437 - RNA, 22 nt, Human
guacaucccauguaacagaaag

SEQ ID NO: 3841438 - RNA, 18 nt, Human
guacaucuauuuuggauu

SEQ ID NO: 3841439 - RNA, 22 nt, Human
guacaucuggcuuauuuuaaug

SEQ ID NO: 3841440 - RNA, 15 nt, Human
guacaugaaaacaca

SEQ ID NO: 3841441 - RNA, 18 nt, Human
guacaugaaaacacauuu

SEQ ID NO: 3841442 - RNA, 20 nt, Human
guacaugaaaacacauuuuu

SEQ ID NO: 3841443 - RNA, 19 nt, Human
guacaugaaauuuuuguaa

SEQ ID NO: 3841444 - RNA, 16 nt, Human
guacauggcagaguuu

SEQ ID NO: 3841445 - RNA, 18 nt, Human
guacauucaauguuuaug

SEQ ID NO: 3841446 - RNA, 15 nt, Human
guacauuuaaaauug

SEQ ID NO: 3841447 - RNA, 13 nt, Human
guacauuuaaauu

SEQ ID NO: 3841448 - RNA, 15 nt, Human
guacauuuauaauug

SEQ ID NO: 3841449 - RNA, 18 nt, Human
guacauuuaugauuuaau

SEQ ID NO: 3841450 - RNA, 19 nt, Human
guacauuuaugauuuaaua

SEQ ID NO: 3841451 - RNA, 14 nt, Human
guacauuucccugu

SEQ ID NO: 3841452 - RNA, 17 nt, Human
guacauuucugaaauga

SEQ ID NO: 3841453 - RNA, 15 nt, Human
guacauuuggagaca

SEQ ID NO: 3841454 - RNA, 16 nt, Human
guacauuuuguuguaa

SEQ ID NO: 3841455 - RNA, 21 nt, Human
guacauuuuguuguaaaaaga

SEQ ID NO: 3841456 - RNA, 23 nt, Human
guacauuuuguuguaaaaagaaa

SEQ ID NO: 3841457 - RNA, 16 nt, Human
guacauuuuucaacuu

SEQ ID NO: 3841458 - RNA, 22 nt, Human
guacauuuuucaacuuugaaua

SEQ ID NO: 3841459 - RNA, 19 nt, Human
guacauuuuuugaaaugcu

SEQ ID NO: 3841460 - RNA, 20 nt, Human
guacauuuuuugaaaugcug

SEQ ID NO: 3841461 - RNA, 13 nt, Human
guaccaaaguuuu

SEQ ID NO: 3841462 - RNA, 18 nt, Human
guaccaaaguuuuaucaa

SEQ ID NO: 3841463 - RNA, 17 nt, Human
guaccaaccauccaauu

SEQ ID NO: 3841464 - RNA, 21 nt, Human
guaccaaucauuuuaauuauu

SEQ ID NO: 3841465 - RNA, 14 nt, Human
guaccacucaggcc

SEQ ID NO: 3841466 - RNA, 19 nt, Human
guaccacugaaucuguaca

SEQ ID NO: 3841467 - RNA, 17 nt, Human
guaccagcugcgcuugc

SEQ ID NO: 3841468 - RNA, 22 nt, Human
guaccaggucuccuccaccgcc

SEQ ID NO: 3841469 - RNA, 22 nt, Human
guaccaguuaauuuuuccaacu

SEQ ID NO: 3841470 - RNA, 21 nt, Human
guaccaugugcuacaggggcc

SEQ ID NO: 3841471 - RNA, 14 nt, Human
guaccauuaaaaua

SEQ ID NO: 3841472 - RNA, 18 nt, Human
guaccauuaaaauaugca

SEQ ID NO: 3841473 - RNA, 23 nt, Human
guaccauuuaauggggaggacaa

SEQ ID NO: 3841474 - RNA, 13 nt, Human
guacccacugcuc

SEQ ID NO: 3841475 - RNA, 14 nt, Human
guacccacugcucu

SEQ ID NO: 3841476 - RNA, 16 nt, Human
guacccacugcucugg

SEQ ID NO: 3841477 - RNA, 20 nt, Human
guacccacuuagucauguaa

SEQ ID NO: 3841478 - RNA, 15 nt, Human
guacccagccaucug

SEQ ID NO: 3841479 - RNA, 21 nt, Human
guacccagccaucugcccagg

SEQ ID NO: 3841480 - RNA, 14 nt, Human
guaccccacccuca

SEQ ID NO: 3841481 - RNA, 19 nt, Human
guaccccacccucagcacc

SEQ ID NO: 3841482 - RNA, 17 nt, Human
guaccccagcucugcuu

SEQ ID NO: 3841483 - RNA, 18 nt, Human
guaccccagcucugcuug

SEQ ID NO: 3841484 - RNA, 19 nt, Human
guaccccagcucugcuugc

SEQ ID NO: 3841485 - RNA, 14 nt, Human
guacccccaggacc

SEQ ID NO: 3841486 - RNA, 15 nt, Human
guacccccaggacca

SEQ ID NO: 3841487 - RNA, 16 nt, Human
guacccccaggaccag

SEQ ID NO: 3841488 - RNA, 20 nt, Human
guacccccgcccaggcuggc

SEQ ID NO: 3841489 - RNA, 23 nt, Human
guacccccgcccaggcuggccag

SEQ ID NO: 3841490 - RNA, 12 nt, Human
guacccccuucu

SEQ ID NO: 3841491 - RNA, 17 nt, Human
guacccuccuggcucuu

SEQ ID NO: 3841492 - RNA, 19 nt, Human
guacccucucagcuccagg

SEQ ID NO: 3841493 - RNA, 16 nt, Human
guacccucugaaauac

SEQ ID NO: 3841494 - RNA, 15 nt, Human
guacccucuggaggg

SEQ ID NO: 3841495 - RNA, 23 nt, Human
guaccgccuugcacacucagaag

SEQ ID NO: 3841496 - RNA, 13 nt, Human
guaccuauaaagu

SEQ ID NO: 3841497 - RNA, 14 nt, Human
guaccuauaaagua

SEQ ID NO: 3841498 - RNA, 20 nt, Human
guaccuauaaaguaaagcua

SEQ ID NO: 3841499 - RNA, 18 nt, Human
guaccuauuuucauugua

SEQ ID NO: 3841500 - RNA, 14 nt, Human
guaccucaucccau

SEQ ID NO: 3841501 - RNA, 18 nt, Human
guaccuccccugccuugc

SEQ ID NO: 3841502 - RNA, 13 nt, Human
guaccuccucuca

SEQ ID NO: 3841503 - RNA, 21 nt, Human
guaccucuggcugacuaaauu

SEQ ID NO: 3841504 - RNA, 14 nt, Human
guaccugaaaagua

SEQ ID NO: 3841505 - RNA, 18 nt, Human
guaccugaaaaguaacuu

SEQ ID NO: 3841506 - RNA, 14 nt, Human
guaccugagggucu

SEQ ID NO: 3841507 - RNA, 15 nt, Human
guaccugauguaccu

SEQ ID NO: 3841508 - RNA, 17 nt, Human
guaccugcccccaaucc

SEQ ID NO: 3841509 - RNA, 15 nt, Human
guaccuggaggagga

SEQ ID NO: 3841510 - RNA, 16 nt, Human
guaccuggguccccag

SEQ ID NO: 3841511 - RNA, 12 nt, Human
guaccuggugga

SEQ ID NO: 3841512 - RNA, 21 nt, Human
guaccuucagaauaagcuucc

SEQ ID NO: 3841513 - RNA, 22 nt, Human
gacuaauuguauaacagguuau

SEQ ID NO: 3841514 - RNA, 12 nt, Human
gacuaauuucaa

SEQ ID NO: 3841515 - RNA, 13 nt, Human
gacuaauuucaaa

SEQ ID NO: 3841516 - RNA, 18 nt, Human
gacuaauuuuacauguuu

SEQ ID NO: 3841517 - RNA, 12 nt, Human
gacuacaggcac

SEQ ID NO: 3841518 - RNA, 18 nt, Human
gacuacaggcacccacca

SEQ ID NO: 3841519 - RNA, 14 nt, Human
gacuacaggcguga

SEQ ID NO: 3841520 - RNA, 13 nt, Human
gacuacaggugug

SEQ ID NO: 3841521 - RNA, 18 nt, Human
gacuacucccccaggugg

SEQ ID NO: 3841522 - RNA, 23 nt, Human
gacuacugggcaaagaguguaga

SEQ ID NO: 3841523 - RNA, 21 nt, Human
gacuacuuagcauccuaagaa

SEQ ID NO: 3841524 - RNA, 18 nt, Human
gacuacuugggagcaccg

SEQ ID NO: 3841525 - RNA, 20 nt, Human
gacuacuugggagcaccgcc

SEQ ID NO: 3841526 - RNA, 20 nt, Human
gacuagaaccuggagggcug

SEQ ID NO: 3841527 - RNA, 16 nt, Human
gacuagaauucuagug

SEQ ID NO: 3841528 - RNA, 14 nt, Human
gacuagacacacaa

SEQ ID NO: 3841529 - RNA, 12 nt, Human
gacuagagaaac

SEQ ID NO: 3841530 - RNA, 18 nt, Human
gacuagagcuuucuuuca

SEQ ID NO: 3841531 - RNA, 15 nt, Human
gacuagaggcaggga

SEQ ID NO: 3841532 - RNA, 20 nt, Human
gacuagaggcagggagggga

SEQ ID NO: 3841533 - RNA, 22 nt, Human
gacuagaggcagggaggggacu

SEQ ID NO: 3841534 - RNA, 16 nt, Human
gacuagaggcuugcau

SEQ ID NO: 3841535 - RNA, 17 nt, Human
gacuagagggaccucuc

SEQ ID NO: 3841536 - RNA, 20 nt, Human
gacuagagggaccucuccca

SEQ ID NO: 3841537 - RNA, 17 nt, Human
gacuagauguaguauuu

SEQ ID NO: 3841538 - RNA, 23 nt, Human
gacuagccccuguggagacuggg

SEQ ID NO: 3841539 - RNA, 18 nt, Human
gacuagggauucaggcug

SEQ ID NO: 3841540 - RNA, 15 nt, Human
gacuaggguccuggg

SEQ ID NO: 3841541 - RNA, 16 nt, Human
gacuaggguccugggg

SEQ ID NO: 3841542 - RNA, 13 nt, Human
gacuaguacaaau

SEQ ID NO: 3841543 - RNA, 14 nt, Human
gacuaguacaaauu

SEQ ID NO: 3841544 - RNA, 17 nt, Human
gacuaguacaaauuaua

SEQ ID NO: 3841545 - RNA, 13 nt, Human
gacuauauacaug

SEQ ID NO: 3841546 - RNA, 19 nt, Human
gacuauauagagauguuuu

SEQ ID NO: 3841547 - RNA, 20 nt, Human
gacuauauauauaaauguau

SEQ ID NO: 3841548 - RNA, 19 nt, Human
gacuauauuugggccugcu

SEQ ID NO: 3841549 - RNA, 22 nt, Human
gacuaucaaacugaagccagaa

SEQ ID NO: 3841550 - RNA, 18 nt, Human
gacuaucugucugguggc

SEQ ID NO: 3841551 - RNA, 17 nt, Human
gacuaucuuacuauuuc

SEQ ID NO: 3841552 - RNA, 16 nt, Human
gacuaugaaugggcaa

SEQ ID NO: 3841553 - RNA, 13 nt, Human
gacuaugacauaa

SEQ ID NO: 3841554 - RNA, 15 nt, Human
gacuauucaaacagu

SEQ ID NO: 3841555 - RNA, 14 nt, Human
gacuauucaguuuu

SEQ ID NO: 3841556 - RNA, 21 nt, Human
gacuauucuugauguaaaauc

SEQ ID NO: 3841557 - RNA, 20 nt, Human
gacuauuuaaacuuauaaau

SEQ ID NO: 3841558 - RNA, 20 nt, Human
gucucuuuuuuacaaaggcu

SEQ ID NO: 3841559 - RNA, 11 nt, Human
gucugaaaugg

SEQ ID NO: 3841560 - RNA, 20 nt, Human
gucugaaggacacuuccugc

SEQ ID NO: 3841561 - RNA, 22 nt, Human
gucugaaggacacuuccugccu

SEQ ID NO: 3841562 - RNA, 16 nt, Human
gucugaagugguuguu

SEQ ID NO: 3841563 - RNA, 14 nt, Human
gucugaauguucug

SEQ ID NO: 3841564 - RNA, 18 nt, Human
gucugaauguucugacau

SEQ ID NO: 3841565 - RNA, 12 nt, Human
gucugacaggca

SEQ ID NO: 3841566 - RNA, 14 nt, Human
gucugacaggcaau

SEQ ID NO: 3841567 - RNA, 18 nt, Human
gucugacaggcaaugcug

SEQ ID NO: 3841568 - RNA, 21 nt, Human
gucugacaggcaaugcuggcu

SEQ ID NO: 3841569 - RNA, 22 nt, Human
gucugacaggcaaugcuggcug

SEQ ID NO: 3841570 - RNA, 14 nt, Human
gucugacccucucc

SEQ ID NO: 3841571 - RNA, 23 nt, Human
gucugagacucucuuaggagcag

SEQ ID NO: 3841572 - RNA, 17 nt, Human
gagaaaccagcuuccuu

SEQ ID NO: 3841573 - RNA, 18 nt, Human
gagaaaccuguaucuuuc

SEQ ID NO: 3841574 - RNA, 23 nt, Human
gagaaaccuuauuguaccucucu

SEQ ID NO: 3841575 - RNA, 19 nt, Human
gagaaacuggcaaagcaga

SEQ ID NO: 3841576 - RNA, 24 nt, Human
gagaaacuuaaauguuauuaucug

SEQ ID NO: 3841577 - RNA, 18 nt, Human
gagaaagaagagacagga

SEQ ID NO: 3841578 - RNA, 18 nt, Human
gagaaagaaguaggcaug

SEQ ID NO: 3841579 - RNA, 17 nt, Human
gagaaagacuauucaaa

SEQ ID NO: 3841580 - RNA, 19 nt, Human
gagaaagagcacuuaagag

SEQ ID NO: 3841581 - RNA, 16 nt, Human
gagaaagaggaagcuu

SEQ ID NO: 3841582 - RNA, 16 nt, Human
gagaaagcauauugac

SEQ ID NO: 3841583 - RNA, 22 nt, Human
gagaaagcugacuuggcuggug

SEQ ID NO: 3841584 - RNA, 18 nt, Human
gagaaaggccugcacaca

SEQ ID NO: 3841585 - RNA, 21 nt, Human
gagaaagggcccugggccugc

SEQ ID NO: 3841586 - RNA, 23 nt, Human
gagaaaguacuucuccacccugc

SEQ ID NO: 3841587 - RNA, 15 nt, Human
gagaaauacaaaaau

SEQ ID NO: 3841588 - RNA, 17 nt, Human
gagaaauauuuuaauuu

SEQ ID NO: 3841589 - RNA, 13 nt, Human
gagaaaugggacu

SEQ ID NO: 3841590 - RNA, 17 nt, Human
gagaaauguaaugcgau

SEQ ID NO: 3841591 - RNA, 23 nt, Human
gagaaauguguagcugcaaaaau

SEQ ID NO: 3841592 - RNA, 17 nt, Human
gagaaauucguguguuu

SEQ ID NO: 3841593 - RNA, 16 nt, Human
gagaaauucuguuaaa

SEQ ID NO: 3841594 - RNA, 17 nt, Human
gagaaauucuguuaaaa

SEQ ID NO: 3841595 - RNA, 14 nt, Human
gagaaauugacaga

SEQ ID NO: 3841596 - RNA, 13 nt, Human
gagaacaaagaug

SEQ ID NO: 3841597 - RNA, 14 nt, Human
gagaacaaagcugu

SEQ ID NO: 3841598 - RNA, 17 nt, Human
gagaacauguugguauu

SEQ ID NO: 3841599 - RNA, 17 nt, Human
gagaaccaaaucuggaa

SEQ ID NO: 3841600 - RNA, 18 nt, Human
gagaaccaaaucuggaag

SEQ ID NO: 3841601 - RNA, 12 nt, Human
gagaaccaccua

SEQ ID NO: 3841602 - RNA, 19 nt, Human
gagaaccacuacaugcagc

SEQ ID NO: 3841603 - RNA, 20 nt, Human
gagaacccagcccacccccg

SEQ ID NO: 3841604 - RNA, 20 nt, Human
gagaacccugcguggggaca

SEQ ID NO: 3841605 - RNA, 20 nt, Human
gagaaccgagcaaagaucaa

SEQ ID NO: 3841606 - RNA, 14 nt, Human
gagaacgcagcccu

SEQ ID NO: 3841607 - RNA, 16 nt, Human
gagaacgcagcccuag

SEQ ID NO: 3841608 - RNA, 16 nt, Human
gagaacuaaagguggc

SEQ ID NO: 3841609 - RNA, 19 nt, Human
gagaacuagaaccuggagg

SEQ ID NO: 3841610 - RNA, 15 nt, Human
gagaacuccuagggu

SEQ ID NO: 3841611 - RNA, 20 nt, Human
gagaacucgcgcucaguaaa

SEQ ID NO: 3841612 - RNA, 14 nt, Human
gagaacucuggcuu

SEQ ID NO: 3841613 - RNA, 20 nt, Human
gagaacuuauggccacagcc

SEQ ID NO: 3841614 - RNA, 14 nt, Human
gagaacuugcugcc

SEQ ID NO: 3841615 - RNA, 17 nt, Human
gagaacuuucauuuuuu

SEQ ID NO: 3841616 - RNA, 15 nt, Human
gagaagaagaaaaaa

SEQ ID NO: 3841617 - RNA, 23 nt, Human
gagaagaauagccuagauaugaa

SEQ ID NO: 3841618 - RNA, 22 nt, Human
gagaagagcuguucacagccag

SEQ ID NO: 3841619 - RNA, 21 nt, Human
gagaagaggcuggugcugugg

SEQ ID NO: 3841620 - RNA, 15 nt, Human
gagaagauaaggucu

SEQ ID NO: 3841621 - RNA, 23 nt, Human
gagaagcaagaaagaaacccgac

SEQ ID NO: 3841622 - RNA, 21 nt, Human
gagaagcacacucuggucuug

SEQ ID NO: 3841623 - RNA, 12 nt, Human
gagaagcacugu

SEQ ID NO: 3841624 - RNA, 14 nt, Human
gagaagcagugagc

SEQ ID NO: 3841625 - RNA, 21 nt, Human
gagaagcaucggagggaauug

SEQ ID NO: 3841626 - RNA, 13 nt, Human
gagaagcaugaaa

SEQ ID NO: 3841627 - RNA, 18 nt, Human
gagaagccaaaagauugg

SEQ ID NO: 3841628 - RNA, 13 nt, Human
gagaagccacagg

SEQ ID NO: 3841629 - RNA, 20 nt, Human
gagaagccacaggccugaga

SEQ ID NO: 3841630 - RNA, 16 nt, Human
gagaagccagcuuguu

SEQ ID NO: 3841631 - RNA, 20 nt, Human
gagaagccagcuuguuuaca

SEQ ID NO: 3841632 - RNA, 17 nt, Human
gagaagccaucaccuca

SEQ ID NO: 3841633 - RNA, 20 nt, Human
gagaagccauugucuucgga

SEQ ID NO: 3841634 - RNA, 17 nt, Human
gagaagcggcuggcagc

SEQ ID NO: 3841635 - RNA, 19 nt, Human
gagaagcuaaaaccugagc

SEQ ID NO: 3841636 - RNA, 13 nt, Human
gagaagcucugaa

SEQ ID NO: 3841637 - RNA, 23 nt, Human
gagaagcugaugcuuugcuucaa

SEQ ID NO: 3841638 - RNA, 13 nt, Human
gagaagcugcuga

SEQ ID NO: 3841639 - RNA, 22 nt, Human
gagaagcuuuugaauaaaaacu

SEQ ID NO: 3841640 - RNA, 15 nt, Human
gagaaggaaagcuuu

SEQ ID NO: 3841641 - RNA, 21 nt, Human
gagaaggaaggagacucaccu

SEQ ID NO: 3841642 - RNA, 16 nt, Human
gagaaggaaugucuuu

SEQ ID NO: 3841643 - RNA, 11 nt, Human
gagaaggcagc

SEQ ID NO: 3841644 - RNA, 16 nt, Human
gagaaggcagccacca

SEQ ID NO: 3841645 - RNA, 12 nt, Human
gagaaggcagga

SEQ ID NO: 3841646 - RNA, 23 nt, Human
gagaaggcaggaauguguggcag

SEQ ID NO: 3841647 - RNA, 22 nt, Human
gagaaggggaggaccucugggc

SEQ ID NO: 3841648 - RNA, 15 nt, Human
gagaagguccuuaau

SEQ ID NO: 3841649 - RNA, 17 nt, Human
gagaagucacagggcag

SEQ ID NO: 3841650 - RNA, 22 nt, Human
gagaagucacagggcaguaccu

SEQ ID NO: 3841651 - RNA, 14 nt, Human
gagaagucucagcu

SEQ ID NO: 3841652 - RNA, 21 nt, Human
gagaagucucagcuaagcuca

SEQ ID NO: 3841653 - RNA, 20 nt, Human
gagaagucuuucaagaauga

SEQ ID NO: 3841654 - RNA, 19 nt, Human
gagaagugaauaacugcaa

SEQ ID NO: 3841655 - RNA, 19 nt, Human
gagaagugaaugcugggac

SEQ ID NO: 3841656 - RNA, 15 nt, Human
gagaagugacaggga

SEQ ID NO: 3841657 - RNA, 16 nt, Human
gagaagugacagggaa

SEQ ID NO: 3841658 - RNA, 19 nt, Human
gagaagugacagggaagcu

SEQ ID NO: 3841659 - RNA, 18 nt, Human
gagaagugacgguuccua

SEQ ID NO: 3841660 - RNA, 18 nt, Human
gagaaguucauauuucuu

SEQ ID NO: 3841661 - RNA, 18 nt, Human
gagaaguuuuguacagag

SEQ ID NO: 3841662 - RNA, 20 nt, Human
gagaauaagagagucauaaa

SEQ ID NO: 3841663 - RNA, 22 nt, Human
gagaauagaaggaaacuagcuu

SEQ ID NO: 3841664 - RNA, 12 nt, Human
gagaauauauac

SEQ ID NO: 3841665 - RNA, 21 nt, Human
gagaauauuuuaaguauugca

SEQ ID NO: 3841666 - RNA, 15 nt, Human
gagaaucacaggcug

SEQ ID NO: 3841667 - RNA, 16 nt, Human
gagaaucacaggcugg

SEQ ID NO: 3841668 - RNA, 15 nt, Human
gagaaucacuugaac

SEQ ID NO: 3841669 - RNA, 17 nt, Human
gagaaucauguuucuuu

SEQ ID NO: 3841670 - RNA, 19 nt, Human
gagaaucauguuucuuuga

SEQ ID NO: 3841671 - RNA, 17 nt, Human
gagaaugaacaaagacc

SEQ ID NO: 3841672 - RNA, 22 nt, Human
gagaaugaacaaagaccaauuu

SEQ ID NO: 3841673 - RNA, 13 nt, Human
gagaaugaggguc

SEQ ID NO: 3841674 - RNA, 20 nt, Human
gagaaugcacaaacagaggc

SEQ ID NO: 3841675 - RNA, 21 nt, Human
gagaaugcacaaacagaggcc

SEQ ID NO: 3841676 - RNA, 23 nt, Human
gagaaugcacaaacagaggccgc

SEQ ID NO: 3841677 - RNA, 20 nt, Human
gagaauggcgugaacccggg

SEQ ID NO: 3841678 - RNA, 19 nt, Human
gagaauggcuuuggucucu

SEQ ID NO: 3841679 - RNA, 21 nt, Human
gagaauguagauauugugaag

SEQ ID NO: 3841680 - RNA, 17 nt, Human
gagaaugucaguaugug

SEQ ID NO: 3841681 - RNA, 16 nt, Human
gagaauguuauaguga

SEQ ID NO: 3841682 - RNA, 17 nt, Human
gagaauguuauagugaa

SEQ ID NO: 3841683 - RNA, 15 nt, Human
gagaauucagcugcc

SEQ ID NO: 3841684 - RNA, 16 nt, Human
gagaauucagcugccc

SEQ ID NO: 3841685 - RNA, 18 nt, Human
gagaauucagcugccccc

SEQ ID NO: 3841686 - RNA, 18 nt, Human
gagaauucuuacauguuu

SEQ ID NO: 3841687 - RNA, 21 nt, Human
gagaauuguaucauuugaaca

SEQ ID NO: 3841688 - RNA, 23 nt, Human
gagaauuucuaaaaagauuagca

SEQ ID NO: 3841689 - RNA, 18 nt, Human
gagacaaaauauuuccca

SEQ ID NO: 3841690 - RNA, 19 nt, Human
gagacaaacaccucccagg

SEQ ID NO: 3841691 - RNA, 22 nt, Human
gagacaaacaccucccaggaga

SEQ ID NO: 3841692 - RNA, 11 nt, Human
gagacaaagcu

SEQ ID NO: 3841693 - RNA, 21 nt, Human
gagacaaugcagaugccagag

SEQ ID NO: 3841694 - RNA, 20 nt, Human
gagacaaugucugcagcccu

SEQ ID NO: 3841695 - RNA, 22 nt, Human
gagacaaugucugcagcccuga

SEQ ID NO: 3841696 - RNA, 20 nt, Human
gagacacaacaacuccuagg

SEQ ID NO: 3841697 - RNA, 17 nt, Human
gagacacaagccuucgg

SEQ ID NO: 3841698 - RNA, 13 nt, Human
gagacacagaugu

SEQ ID NO: 3841699 - RNA, 14 nt, Human
gagacacagauguu

SEQ ID NO: 3841700 - RNA, 17 nt, Human
gagacacagggcaucca

SEQ ID NO: 3841701 - RNA, 21 nt, Human
gagacaccucagagccccgca

SEQ ID NO: 3841702 - RNA, 16 nt, Human
gucaagugaaaaagga

SEQ ID NO: 3841703 - RNA, 18 nt, Human
gucaagugaaaaaggagg

SEQ ID NO: 3841704 - RNA, 17 nt, Human
gucaagugcguccacga

SEQ ID NO: 3841705 - RNA, 14 nt, Human
gucaagugggaucu

SEQ ID NO: 3841706 - RNA, 16 nt, Human
gucaagugggaucugu

SEQ ID NO: 3841707 - RNA, 18 nt, Human
gucaaguuauuaauuucu

SEQ ID NO: 3841708 - RNA, 17 nt, Human
gucaaguuccuuugggu

SEQ ID NO: 3841709 - RNA, 16 nt, Human
gucaaguugugcuugu

SEQ ID NO: 3841710 - RNA, 23 nt, Human
gucaauaaaauccauacauuugu

SEQ ID NO: 3841711 - RNA, 18 nt, Human
gucaauaaacaacagcug

SEQ ID NO: 3841712 - RNA, 20 nt, Human
gucaauaaacagcuucaugc

SEQ ID NO: 3841713 - RNA, 21 nt, Human
gucaauaauuauuugucucag

SEQ ID NO: 3841714 - RNA, 19 nt, Human
gucaauacaguacaggcag

SEQ ID NO: 3841715 - RNA, 20 nt, Human
gucaauacaguacaggcagc

SEQ ID NO: 3841716 - RNA, 18 nt, Human
gucaaucaagucuguuua

SEQ ID NO: 3841717 - RNA, 17 nt, Human
gucaauccccucauuca

SEQ ID NO: 3841718 - RNA, 16 nt, Human
gucaauccugugggug

SEQ ID NO: 3841719 - RNA, 16 nt, Human
gucaauuacaggaagu

SEQ ID NO: 3841720 - RNA, 17 nt, Human
gucaauuuaugaauaua

SEQ ID NO: 3841721 - RNA, 22 nt, Human
gucaauuucccugacuccucua

SEQ ID NO: 3841722 - RNA, 17 nt, Human
gucaauuucuguguugc

SEQ ID NO: 3841723 - RNA, 22 nt, Human
gucaauuucuguguugccaagc

SEQ ID NO: 3841724 - RNA, 23 nt, Human
gucacaaagaacauguagaaaac

SEQ ID NO: 3841725 - RNA, 15 nt, Human
gucacaaauuucucu

SEQ ID NO: 3841726 - RNA, 17 nt, Human
gucacaauguucuuuau

SEQ ID NO: 3841727 - RNA, 16 nt, Human
gucacacacuuuggcu

SEQ ID NO: 3841728 - RNA, 14 nt, Human
gucacacagggcag

SEQ ID NO: 3841729 - RNA, 20 nt, Human
gucacacaguauuacuucug

SEQ ID NO: 3841730 - RNA, 21 nt, Human
gucacacaguauuacuucugc

SEQ ID NO: 3841731 - RNA, 14 nt, Human
gucugagagaggcc

SEQ ID NO: 3841732 - RNA, 15 nt, Human
gucugagccacagca

SEQ ID NO: 3841733 - RNA, 18 nt, Human
gucugaggaauccagacc

SEQ ID NO: 3841734 - RNA, 21 nt, Human
gucugaggaauccagacccgg

SEQ ID NO: 3841735 - RNA, 18 nt, Human
gucugaggccguugcuga

SEQ ID NO: 3841736 - RNA, 20 nt, Human
gucugagggcuuguaguucu

SEQ ID NO: 3841737 - RNA, 21 nt, Human
gucugagggcuuguaguucuu

SEQ ID NO: 3841738 - RNA, 16 nt, Human
gucugagguccugagc

SEQ ID NO: 3841739 - RNA, 21 nt, Human
gucugagguccugagcacugc

SEQ ID NO: 3841740 - RNA, 14 nt, Human
gucugagucauggc

SEQ ID NO: 3841741 - RNA, 21 nt, Human
gucugagucauggccgggugg

SEQ ID NO: 3841742 - RNA, 14 nt, Human
gucugagugaaccu

SEQ ID NO: 3841743 - RNA, 14 nt, Human
gucugauauucaaa

SEQ ID NO: 3841744 - RNA, 21 nt, Human
gucugaucgugacgcugaaua

SEQ ID NO: 3841745 - RNA, 24 nt, Human
gucugaucugugcuuuccagcuca

SEQ ID NO: 3841746 - RNA, 17 nt, Human
gucugauucccaagcuc

SEQ ID NO: 3841747 - RNA, 20 nt, Human
gucugauuggcucacccaag

SEQ ID NO: 3841748 - RNA, 13 nt, Human
gucugauuucuua

SEQ ID NO: 3841749 - RNA, 16 nt, Human
gucugauuugugauga

SEQ ID NO: 3841750 - RNA, 23 nt, Human
gucugcaaaaugaggaauguaua

SEQ ID NO: 3841751 - RNA, 20 nt, Human
gucugcaacuuuaagcagcu

SEQ ID NO: 3841752 - RNA, 19 nt, Human
gucugcagcccggcgccac

SEQ ID NO: 3841753 - RNA, 15 nt, Human
gucugcagcccugag

SEQ ID NO: 3841754 - RNA, 16 nt, Human
gucugcaggugcacca

SEQ ID NO: 3841755 - RNA, 16 nt, Human
gucugcauuggaaaga

SEQ ID NO: 3841756 - RNA, 21 nt, Human
gucugcauuucgguggcuagu

SEQ ID NO: 3841757 - RNA, 21 nt, Human
gucugccaauuuuugccuuca

SEQ ID NO: 3841758 - RNA, 18 nt, Human
gucugccaccauccugcu

SEQ ID NO: 3841759 - RNA, 14 nt, Human
gucugccagccagc

SEQ ID NO: 3841760 - RNA, 15 nt, Human
gucugccagccagca

SEQ ID NO: 3841761 - RNA, 10 nt, Human
gucugccagg

SEQ ID NO: 3841762 - RNA, 12 nt, Human
gucugccagggc

SEQ ID NO: 3841763 - RNA, 13 nt, Human
gucugccagggcc

SEQ ID NO: 3841764 - RNA, 21 nt, Human
gucugccagggccccucuccc

SEQ ID NO: 3841765 - RNA, 16 nt, Human
gucugccauguugccc

SEQ ID NO: 3841766 - RNA, 15 nt, Human
gucugcccccuccug

SEQ ID NO: 3841767 - RNA, 17 nt, Human
gucugccccgcccucau

SEQ ID NO: 3841768 - RNA, 13 nt, Human
gucugccuggagg

SEQ ID NO: 3841769 - RNA, 17 nt, Human
gucugcuauauuuucau

SEQ ID NO: 3841770 - RNA, 16 nt, Human
gucugcuaucauuauu

SEQ ID NO: 3841771 - RNA, 14 nt, Human
gucugcuccagcuc

SEQ ID NO: 3841772 - RNA, 16 nt, Human
gucugcuccagcucug

SEQ ID NO: 3841773 - RNA, 18 nt, Human
gucugcuccagcucuggc

SEQ ID NO: 3841774 - RNA, 17 nt, Human
gucugcuccuuuccccu

SEQ ID NO: 3841775 - RNA, 19 nt, Human
gucugcucgggcccaggcc

SEQ ID NO: 3841776 - RNA, 22 nt, Human
gucugcucgggcccaggccauc

SEQ ID NO: 3841777 - RNA, 15 nt, Human
gucugcucuuucucu

SEQ ID NO: 3841778 - RNA, 22 nt, Human
gucugcucuuucucugccagug

SEQ ID NO: 3841779 - RNA, 15 nt, Human
gucugcugcccucca

SEQ ID NO: 3841780 - RNA, 18 nt, Human
gucugcugcccuccaucc

SEQ ID NO: 3841781 - RNA, 13 nt, Human
gucugcuguagaa

SEQ ID NO: 3841782 - RNA, 14 nt, Human
gucuggaagauggg

SEQ ID NO: 3841783 - RNA, 16 nt, Human
gucuggaaugcagugg

SEQ ID NO: 3841784 - RNA, 14 nt, Human
gucuggacugacag

SEQ ID NO: 3841785 - RNA, 17 nt, Human
gucuggacugacagcau

SEQ ID NO: 3841786 - RNA, 14 nt, Human
gucuggagaagcag

SEQ ID NO: 3841787 - RNA, 23 nt, Human
gucuggagaagcucccaggaaca

SEQ ID NO: 3841788 - RNA, 17 nt, Human
gucuggagaccaccagg

SEQ ID NO: 3841789 - RNA, 21 nt, Human
gucuggagaccaccagggcau

SEQ ID NO: 3841790 - RNA, 18 nt, Human
gucuggaggggccccugc

SEQ ID NO: 3841791 - RNA, 19 nt, Human
gucuggaucaguaaaauua

SEQ ID NO: 3841792 - RNA, 22 nt, Human
gucuggaucugggacccuuucc

SEQ ID NO: 3841793 - RNA, 23 nt, Human
gucuggcaaugccacagcccugu

SEQ ID NO: 3841794 - RNA, 19 nt, Human
gucuggcacagccuggcug

SEQ ID NO: 3841795 - RNA, 20 nt, Human
gucuggcccuagacucgggg

SEQ ID NO: 3841796 - RNA, 13 nt, Human
gucuggcugcaga

SEQ ID NO: 3841797 - RNA, 13 nt, Human
gucuggcuggugu

SEQ ID NO: 3841798 - RNA, 14 nt, Human
gucuggcugguguu

SEQ ID NO: 3841799 - RNA, 16 nt, Human
gucuggcugguguuaa

SEQ ID NO: 3841800 - RNA, 15 nt, Human
gucuggcuucacaga

SEQ ID NO: 3841801 - RNA, 18 nt, Human
gucugggaaaugagcagg

SEQ ID NO: 3841802 - RNA, 21 nt, Human
gucugggacuuccuugcucuc

SEQ ID NO: 3841803 - RNA, 24 nt, Human
gucugggacuuccuugcucucccu

SEQ ID NO: 3841804 - RNA, 17 nt, Human
gucugggagaggcagag

SEQ ID NO: 3841805 - RNA, 22 nt, Human
gucugggcagcugucccuugcu

SEQ ID NO: 3841806 - RNA, 22 nt, Human
gucuggggagcgggucugcucc

SEQ ID NO: 3841807 - RNA, 23 nt, Human
gucuggggagcgggucugcuccc

SEQ ID NO: 3841808 - RNA, 16 nt, Human
gucugggguucagccc

SEQ ID NO: 3841809 - RNA, 23 nt, Human
gucugggguucagccccuccucu

SEQ ID NO: 3841810 - RNA, 13 nt, Human
gucuggugggagg

SEQ ID NO: 3841811 - RNA, 17 nt, Human
gucugguuucaccgagg

SEQ ID NO: 3841812 - RNA, 14 nt, Human
gucugguuucuaga

SEQ ID NO: 3841813 - RNA, 18 nt, Human
gucugguuuuaacaauuu

SEQ ID NO: 3841814 - RNA, 11 nt, Human
gucuguaaaau

SEQ ID NO: 3841815 - RNA, 12 nt, Human
gucuguaaaauc

SEQ ID NO: 3841816 - RNA, 13 nt, Human
gucuguaaaaucu

SEQ ID NO: 3841817 - RNA, 14 nt, Human
gucuguaagcugaa

SEQ ID NO: 3841818 - RNA, 20 nt, Human
gucuguaauaauagacugua

SEQ ID NO: 3841819 - RNA, 12 nt, Human
gucuguaaugac

SEQ ID NO: 3841820 - RNA, 20 nt, Human
gucuguacacguguccugua

SEQ ID NO: 3841821 - RNA, 21 nt, Human
gucuguacacguguccuguag

SEQ ID NO: 3841822 - RNA, 15 nt, Human
gucuguacuaaaaau

SEQ ID NO: 3841823 - RNA, 16 nt, Human
gucuguaucacucugu

SEQ ID NO: 3841824 - RNA, 22 nt, Human
gucuguaucaguggauuuccca

SEQ ID NO: 3841825 - RNA, 23 nt, Human
gucuguaucaguggauuucccau

SEQ ID NO: 3841826 - RNA, 19 nt, Human
gucuguauuuaugugugag

SEQ ID NO: 3841827 - RNA, 22 nt, Human
gucuguccaucugcccgccugc

SEQ ID NO: 3841828 - RNA, 19 nt, Human
gucugucccgggguccugu

SEQ ID NO: 3841829 - RNA, 16 nt, Human
gucugucgugaugggg

SEQ ID NO: 3841830 - RNA, 14 nt, Human
gucugucucuguca

SEQ ID NO: 3841831 - RNA, 16 nt, Human
gucugucugucugucc

SEQ ID NO: 3841832 - RNA, 14 nt, Human
gucugucuucugua

SEQ ID NO: 3841833 - RNA, 15 nt, Human
gucugucuucuguau

SEQ ID NO: 3841834 - RNA, 17 nt, Human
gucugucuuuuaaacuc

SEQ ID NO: 3841835 - RNA, 21 nt, Human
gucugugagaugcuagaacuc

SEQ ID NO: 3841836 - RNA, 13 nt, Human
gucugugccccuu

SEQ ID NO: 3841837 - RNA, 19 nt, Human
gucugugccccuuccgcca

SEQ ID NO: 3841838 - RNA, 20 nt, Human
gucugugccccuuccgccac

SEQ ID NO: 3841839 - RNA, 13 nt, Human
gucuguggaucag

SEQ ID NO: 3841840 - RNA, 21 nt, Human
gucuguggcuuucagccucug

SEQ ID NO: 3841841 - RNA, 13 nt, Human
gucugugugaaug

SEQ ID NO: 3841842 - RNA, 15 nt, Human
gucugugugcugugg

SEQ ID NO: 3841843 - RNA, 17 nt, Human
gucugugugcugugguu

SEQ ID NO: 3841844 - RNA, 20 nt, Human
gucugugugggacuguacac

SEQ ID NO: 3841845 - RNA, 11 nt, Human
gucugugugug

SEQ ID NO: 3841846 - RNA, 13 nt, Human
gugcaacugacac

SEQ ID NO: 3841847 - RNA, 18 nt, Human
gugcaagagacucuggcc

SEQ ID NO: 3841848 - RNA, 22 nt, Human
gugcaagagacucuggccucca

SEQ ID NO: 3841849 - RNA, 14 nt, Human
gugcaagugugugc

SEQ ID NO: 3841850 - RNA, 21 nt, Human
gugcaauaaaucugacccagu

SEQ ID NO: 3841851 - RNA, 14 nt, Human
gugcaauauauuuu

SEQ ID NO: 3841852 - RNA, 18 nt, Human
gugcaaugaccuuucaau

SEQ ID NO: 3841853 - RNA, 13 nt, Human
gugcaauguaaau

SEQ ID NO: 3841854 - RNA, 19 nt, Human
gugcaauguguauaaacaa

SEQ ID NO: 3841855 - RNA, 20 nt, Human
gugcaauguguguauaugga

SEQ ID NO: 3841856 - RNA, 18 nt, Human
gugcaauuucaagguucu

SEQ ID NO: 3841857 - RNA, 19 nt, Human
gugcaauuucaagguucua

SEQ ID NO: 3841858 - RNA, 20 nt, Human
gugcaauuuguuugugcuuc

SEQ ID NO: 3841859 - RNA, 23 nt, Human
gugcaauuuguuugugcuucuaa

SEQ ID NO: 3841860 - RNA, 13 nt, Human
gugcacacacaca

SEQ ID NO: 3841861 - RNA, 17 nt, Human
gugcacacaccagagcc

SEQ ID NO: 3841862 - RNA, 12 nt, Human
gugcacagcugu

SEQ ID NO: 3841863 - RNA, 14 nt, Human
gugcacagcugucc

SEQ ID NO: 3841864 - RNA, 14 nt, Human
gugcacagugauuu

SEQ ID NO: 3841865 - RNA, 18 nt, Human
gugcacaucugugucuug

SEQ ID NO: 3841866 - RNA, 17 nt, Human
gugcacaucuguuuugu

SEQ ID NO: 3841867 - RNA, 19 nt, Human
gugcacccaugggcucuga

SEQ ID NO: 3841868 - RNA, 13 nt, Human
gugcaccugcccc

SEQ ID NO: 3841869 - RNA, 22 nt, Human
gugcaccugggacagggagcag

SEQ ID NO: 3841870 - RNA, 21 nt, Human
gugcaccuguacucaggaggc

SEQ ID NO: 3841871 - RNA, 20 nt, Human
gugcaccuuaccaacuuucu

SEQ ID NO: 3841872 - RNA, 18 nt, Human
gugcacguacacacacau

SEQ ID NO: 3841873 - RNA, 15 nt, Human
gugcacguggagagc

SEQ ID NO: 3841874 - RNA, 16 nt, Human
gugcacguggagagcu

SEQ ID NO: 3841875 - RNA, 21 nt, Human
gugcacguggcauguggccug

SEQ ID NO: 3841876 - RNA, 20 nt, Human
gugcacugcccauggacagg

SEQ ID NO: 3841877 - RNA, 13 nt, Human
gugcacuggcccc

SEQ ID NO: 3841878 - RNA, 16 nt, Human
gugcacuggccccacc

SEQ ID NO: 3841879 - RNA, 13 nt, Human
gugcacugggagg

SEQ ID NO: 3841880 - RNA, 13 nt, Human
gugcacuuuguaa

SEQ ID NO: 3841881 - RNA, 14 nt, Human
gugcacuuuguaaa

SEQ ID NO: 3841882 - RNA, 15 nt, Human
gugcagaaaacauug

SEQ ID NO: 3841883 - RNA, 23 nt, Human
gugcagaagggagcuggcuccag

SEQ ID NO: 3841884 - RNA, 13 nt, Human
gugcagaauguaa

SEQ ID NO: 3841885 - RNA, 14 nt, Human
gugcagaggcugug

SEQ ID NO: 3841886 - RNA, 15 nt, Human
gugcagagguacccu

SEQ ID NO: 3841887 - RNA, 17 nt, Human
gugcagaugagguugcu

SEQ ID NO: 3841888 - RNA, 17 nt, Human
gugcagcauaugaggau

SEQ ID NO: 3841889 - RNA, 20 nt, Human
gugcagcccguguggccccu

SEQ ID NO: 3841890 - RNA, 17 nt, Human
gugcagccgcugagcga

SEQ ID NO: 3841891 - RNA, 15 nt, Human
gugcagccuguccug

SEQ ID NO: 3841892 - RNA, 19 nt, Human
gugcagcgcggcgccgccc

SEQ ID NO: 3841893 - RNA, 22 nt, Human
gugcagcucaaggaaaggccug

SEQ ID NO: 3841894 - RNA, 16 nt, Human
gugcagcugauuuuaa

SEQ ID NO: 3841895 - RNA, 11 nt, Human
gugcaggcagg

SEQ ID NO: 3841896 - RNA, 12 nt, Human
gugcaggcaggc

SEQ ID NO: 3841897 - RNA, 15 nt, Human
gugcaggcuggccag

SEQ ID NO: 3841898 - RNA, 16 nt, Human
gugcaggcuggccagc

SEQ ID NO: 3841899 - RNA, 17 nt, Human
gugcagggacaaagagg

SEQ ID NO: 3841900 - RNA, 15 nt, Human
gugcagggauguggg

SEQ ID NO: 3841901 - RNA, 21 nt, Human
gugcagguagaccugucuccu

SEQ ID NO: 3841902 - RNA, 22 nt, Human
gugcagguagaccugucuccug

SEQ ID NO: 3841903 - RNA, 18 nt, Human
gugcaggugcuauuguua

SEQ ID NO: 3841904 - RNA, 15 nt, Human
gugcagguggggaga

SEQ ID NO: 3841905 - RNA, 15 nt, Human
gugcaguacuuugug

SEQ ID NO: 3841906 - RNA, 13 nt, Human
gugcaguagugca

SEQ ID NO: 3841907 - RNA, 22 nt, Human
gugcaguaucaugcccugugca

SEQ ID NO: 3841908 - RNA, 16 nt, Human
gugcaguccugaucag

SEQ ID NO: 3841909 - RNA, 12 nt, Human
gugcaguccugg

SEQ ID NO: 3841910 - RNA, 24 nt, Human
gugcaguggcgcgaucucagcuca

SEQ ID NO: 3841911 - RNA, 16 nt, Human
gugcaguuauuugcuu

SEQ ID NO: 3841912 - RNA, 24 nt, Human
gugcaguucccccaaccucagacu

SEQ ID NO: 3841913 - RNA, 20 nt, Human
gugcaguugacagcaggugg

SEQ ID NO: 3841914 - RNA, 16 nt, Human
gugcaguugcuguuua

SEQ ID NO: 3841915 - RNA, 17 nt, Human
gugcaguugcuguuuac

SEQ ID NO: 3841916 - RNA, 19 nt, Human
gugcauaaaaacaagaaca

SEQ ID NO: 3841917 - RNA, 14 nt, Human
gugcauagugcugg

SEQ ID NO: 3841918 - RNA, 16 nt, Human
gugcauauuccuuucu

SEQ ID NO: 3841919 - RNA, 14 nt, Human
gugcauauuguaca

SEQ ID NO: 3841920 - RNA, 18 nt, Human
gugcauauuguacacuuu

SEQ ID NO: 3841921 - RNA, 20 nt, Human
gugcaucaggcuuucuuuuu

SEQ ID NO: 3841922 - RNA, 13 nt, Human
gugcaucucagcc

SEQ ID NO: 3841923 - RNA, 18 nt, Human
gugcaucucagcccacau

SEQ ID NO: 3841924 - RNA, 15 nt, Human
gugcaugcucucugc

SEQ ID NO: 3841925 - RNA, 16 nt, Human
gugcaugcucucugca

SEQ ID NO: 3841926 - RNA, 19 nt, Human
gugcaugcucucugcagcc

SEQ ID NO: 3841927 - RNA, 22 nt, Human
gugcaugcugucccuuacguga

SEQ ID NO: 3841928 - RNA, 23 nt, Human
gugcauguaugucuuggacacug

SEQ ID NO: 3841929 - RNA, 15 nt, Human
gugcaugugugugcu

SEQ ID NO: 3841930 - RNA, 23 nt, Human
gugcauuacagagaggagaaaca

SEQ ID NO: 3841931 - RNA, 18 nt, Human
gugcauuagcacagauuu

SEQ ID NO: 3841932 - RNA, 11 nt, Human
guccccuucuc

SEQ ID NO: 3841933 - RNA, 15 nt, Human
gucccggggccagca

SEQ ID NO: 3841934 - RNA, 21 nt, Human
gucccgugcagcuucuguccu

SEQ ID NO: 3841935 - RNA, 21 nt, Human
gucccuacaccccuccccugc

SEQ ID NO: 3841936 - RNA, 21 nt, Human
gucccuaccccauggugcuag

SEQ ID NO: 3841937 - RNA, 20 nt, Human
gucccucaaaugacccaaag

SEQ ID NO: 3841938 - RNA, 23 nt, Human
gucccucaaaugacccaaagacc

SEQ ID NO: 3841939 - RNA, 20 nt, Human
gucccuccacguucaccccu

SEQ ID NO: 3841940 - RNA, 17 nt, Human
gucccucccaccucugu

SEQ ID NO: 3841941 - RNA, 14 nt, Human
gucccuccugggau

SEQ ID NO: 3841942 - RNA, 19 nt, Human
gucccuccuggugucaccc

SEQ ID NO: 3841943 - RNA, 11 nt, Human
gucccucugcc

SEQ ID NO: 3841944 - RNA, 13 nt, Human
gucccucugugua

SEQ ID NO: 3841945 - RNA, 17 nt, Human
gucccugacucucugug

SEQ ID NO: 3841946 - RNA, 18 nt, Human
gucccugacucucuguga

SEQ ID NO: 3841947 - RNA, 19 nt, Human
gucccugcacuugcagacu

SEQ ID NO: 3841948 - RNA, 15 nt, Human
gucccugccaaugga

SEQ ID NO: 3841949 - RNA, 13 nt, Human
gucccugccugga

SEQ ID NO: 3841950 - RNA, 14 nt, Human
gucccugccuggac

SEQ ID NO: 3841951 - RNA, 14 nt, Human
gucccugggccagg

SEQ ID NO: 3841952 - RNA, 17 nt, Human
gucccugguggcagcuc

SEQ ID NO: 3841953 - RNA, 19 nt, Human
gucccugguggcagcucac

SEQ ID NO: 3841954 - RNA, 16 nt, Human
gucccugguuuucagu

SEQ ID NO: 3841955 - RNA, 17 nt, Human
gucccuguuuucugagc

SEQ ID NO: 3841956 - RNA, 18 nt, Human
gucccuuacgugaguccu

SEQ ID NO: 3841957 - RNA, 15 nt, Human
gucccuucaccuccu

SEQ ID NO: 3841958 - RNA, 18 nt, Human
gucccuuccccucccugg

SEQ ID NO: 3841959 - RNA, 21 nt, Human
gucccuugagaccucagccau

SEQ ID NO: 3841960 - RNA, 22 nt, Human
gucccuugagaccucagccaug

SEQ ID NO: 3841961 - RNA, 16 nt, Human
gucccuugaugcacag

SEQ ID NO: 3841962 - RNA, 13 nt, Human
gucccuugccccc

SEQ ID NO: 3841963 - RNA, 15 nt, Human
gucccuugccccccu

SEQ ID NO: 3841964 - RNA, 18 nt, Human
gucccuugccccccuggc

SEQ ID NO: 3841965 - RNA, 21 nt, Human
gucccuugccccccuggccuc

SEQ ID NO: 3841966 - RNA, 13 nt, Human
gucccuugccuca

SEQ ID NO: 3841967 - RNA, 11 nt, Human
gucccuugcug

SEQ ID NO: 3841968 - RNA, 19 nt, Human
gucccuuguauccccugca

SEQ ID NO: 3841969 - RNA, 20 nt, Human
gucccuuguauccccugcag

SEQ ID NO: 3841970 - RNA, 17 nt, Human
gucccuuguuuccagcu

SEQ ID NO: 3841971 - RNA, 17 nt, Human
gucccuuucagagacag

SEQ ID NO: 3841972 - RNA, 15 nt, Human
gucccuuucuucucc

SEQ ID NO: 3841973 - RNA, 20 nt, Human
gucccuuucuucucccccau

SEQ ID NO: 3841974 - RNA, 15 nt, Human
gucccuuucuuggcc

SEQ ID NO: 3841975 - RNA, 17 nt, Human
gucccuuucuuggccag

SEQ ID NO: 3841976 - RNA, 22 nt, Human
gucccuuucuuggccaguuauc

SEQ ID NO: 3841977 - RNA, 21 nt, Human
guccgaaagggacuuggaagc

SEQ ID NO: 3841978 - RNA, 23 nt, Human
guccgcgcgccagcacagaaaca

SEQ ID NO: 3841979 - RNA, 16 nt, Human
guccggaaugccaccc

SEQ ID NO: 3841980 - RNA, 17 nt, Human
guccggacacuccuaga

SEQ ID NO: 3841981 - RNA, 15 nt, Human
guccggcagcuucug

SEQ ID NO: 3841982 - RNA, 17 nt, Human
guccgguguccuuuuca

SEQ ID NO: 3841983 - RNA, 24 nt, Human
guccgguguccuuuucacuacacc

SEQ ID NO: 3841984 - RNA, 14 nt, Human
guccgguguucuaa

SEQ ID NO: 3841985 - RNA, 17 nt, Human
guccgguuuacuuuaac

SEQ ID NO: 3841986 - RNA, 22 nt, Human
guccguaguaucagagaugucc

SEQ ID NO: 3841987 - RNA, 16 nt, Human
guccgugcuaaggacu

SEQ ID NO: 3841988 - RNA, 17 nt, Human
guccgugcuaaggacuu

SEQ ID NO: 3841989 - RNA, 13 nt, Human
guccuaaaacacc

SEQ ID NO: 3841990 - RNA, 15 nt, Human
guccuaaaagcaaaa

SEQ ID NO: 3841991 - RNA, 12 nt, Human
gagccugcaguu

SEQ ID NO: 3841992 - RNA, 13 nt, Human
gagccugccccag

SEQ ID NO: 3841993 - RNA, 13 nt, Human
gagccugccgagc

SEQ ID NO: 3841994 - RNA, 23 nt, Human
gagccugccgagcaaccguggcc

SEQ ID NO: 3841995 - RNA, 13 nt, Human
gagccugccugga

SEQ ID NO: 3841996 - RNA, 16 nt, Human
gagccugccuggagcg

SEQ ID NO: 3841997 - RNA, 18 nt, Human
gagccugcucccccaccc

SEQ ID NO: 3841998 - RNA, 19 nt, Human
gagccugcucccccacccc

SEQ ID NO: 3841999 - RNA, 12 nt, Human
gagccugcugga

SEQ ID NO: 3842000 - RNA, 15 nt, Human
gagccugcuggaagc

SEQ ID NO: 3842001 - RNA, 20 nt, Human
gagccugcuggaagcccagc

SEQ ID NO: 3842002 - RNA, 21 nt, Human
gagccugcuggucacagccuc

SEQ ID NO: 3842003 - RNA, 12 nt, Human
gagccuggagaa

SEQ ID NO: 3842004 - RNA, 17 nt, Human
gagccuggcacaggacu

SEQ ID NO: 3842005 - RNA, 17 nt, Human
gagccuggcccauagaa

SEQ ID NO: 3842006 - RNA, 23 nt, Human
gagccuggcuccguccaggagcc

SEQ ID NO: 3842007 - RNA, 16 nt, Human
gagccuggcugcccau

SEQ ID NO: 3842008 - RNA, 13 nt, Human
gagccuggggcuc

SEQ ID NO: 3842009 - RNA, 23 nt, Human
gagccuggggcucuaacgccuga

SEQ ID NO: 3842010 - RNA, 23 nt, Human
gagccuggucccacgagggugcc

SEQ ID NO: 3842011 - RNA, 12 nt, Human
gagccuggugcc

SEQ ID NO: 3842012 - RNA, 15 nt, Human
gagccuguaaacuuu

SEQ ID NO: 3842013 - RNA, 11 nt, Human
gagccuguccu

SEQ ID NO: 3842014 - RNA, 17 nt, Human
gagccuguccugccugu

SEQ ID NO: 3842015 - RNA, 19 nt, Human
gagccugugccuccucacc

SEQ ID NO: 3842016 - RNA, 14 nt, Human
gagccuguguaaca

SEQ ID NO: 3842017 - RNA, 16 nt, Human
gagccuguguaacagc

SEQ ID NO: 3842018 - RNA, 18 nt, Human
gagccuguguaacagcuc

SEQ ID NO: 3842019 - RNA, 19 nt, Human
gagccuguguaacagcucc

SEQ ID NO: 3842020 - RNA, 20 nt, Human
gagccuucgugcccccccuu

SEQ ID NO: 3842021 - RNA, 22 nt, Human
gagccuucugaggacauuccaa

SEQ ID NO: 3842022 - RNA, 19 nt, Human
gagccuugaacuuugaccu

SEQ ID NO: 3842023 - RNA, 22 nt, Human
gagccuugaacuuugaccucug

SEQ ID NO: 3842024 - RNA, 22 nt, Human
gagccuugguguccaccuggcc

SEQ ID NO: 3842025 - RNA, 23 nt, Human
gagccuuugguucuggccagaau

SEQ ID NO: 3842026 - RNA, 18 nt, Human
gagccuuuuaacugugca

SEQ ID NO: 3842027 - RNA, 15 nt, Human
gagcgacagugagac

SEQ ID NO: 3842028 - RNA, 21 nt, Human
gagcgagacuugguuucaaaa

SEQ ID NO: 3842029 - RNA, 17 nt, Human
gagcgagagaucaaaga

SEQ ID NO: 3842030 - RNA, 18 nt, Human
gagcgaggagaugcuccu

SEQ ID NO: 3842031 - RNA, 18 nt, Human
gagcgcaccugcccccug

SEQ ID NO: 3842032 - RNA, 23 nt, Human
gagcgcccagcuccugacacugc

SEQ ID NO: 3842033 - RNA, 17 nt, Human
gagcgcccgcgcccgcg

SEQ ID NO: 3842034 - RNA, 21 nt, Human
gagcgccgugaguucucaggg

SEQ ID NO: 3842035 - RNA, 22 nt, Human
gagcgccugccccucccagaac

SEQ ID NO: 3842036 - RNA, 21 nt, Human
gagcgcuccugccgcagagcu

SEQ ID NO: 3842037 - RNA, 18 nt, Human
gagcgcuuucuggaaaag

SEQ ID NO: 3842038 - RNA, 13 nt, Human
gagcggaaagcag

SEQ ID NO: 3842039 - RNA, 16 nt, Human
gagcggaaagcagcuc

SEQ ID NO: 3842040 - RNA, 21 nt, Human
gagcggagaaaggaagggcug

SEQ ID NO: 3842041 - RNA, 20 nt, Human
gagcggagacgggaggccug

SEQ ID NO: 3842042 - RNA, 16 nt, Human
gagcgggguaugaaga

SEQ ID NO: 3842043 - RNA, 17 nt, Human
gagcggucucaggcugg

SEQ ID NO: 3842044 - RNA, 22 nt, Human
gagcggucucaggcugguggga

SEQ ID NO: 3842045 - RNA, 23 nt, Human
gagcgguggcccugucccuccca

SEQ ID NO: 3842046 - RNA, 13 nt, Human
gagcgguggggga

SEQ ID NO: 3842047 - RNA, 23 nt, Human
gagcgucaggguuggugugcuga

SEQ ID NO: 3842048 - RNA, 16 nt, Human
gagcgugaaucuguau

SEQ ID NO: 3842049 - RNA, 19 nt, Human
gagcgugagcugagcaggc

SEQ ID NO: 3842050 - RNA, 17 nt, Human
gagcguucaccagugac

SEQ ID NO: 3842051 - RNA, 21 nt, Human
gagcuaaauuacaauugucau

SEQ ID NO: 3842052 - RNA, 15 nt, Human
gagcuaacacuggcc

SEQ ID NO: 3842053 - RNA, 13 nt, Human
gagcuacaaaugc

SEQ ID NO: 3842054 - RNA, 18 nt, Human
gagcuacccgcagaguuc

SEQ ID NO: 3842055 - RNA, 15 nt, Human
gagcuacguauuuaa

SEQ ID NO: 3842056 - RNA, 17 nt, Human
gagcuagaaccuggagg

SEQ ID NO: 3842057 - RNA, 13 nt, Human
gagcuagccagag

SEQ ID NO: 3842058 - RNA, 14 nt, Human
gagcuagccagagg

SEQ ID NO: 3842059 - RNA, 14 nt, Human
gagcuauguauuaa

SEQ ID NO: 3842060 - RNA, 20 nt, Human
gagcuauuaaaacucagccu

SEQ ID NO: 3842061 - RNA, 13 nt, Human
gagcuauugcugu

SEQ ID NO: 3842062 - RNA, 20 nt, Human
gagcuauuuccauuccagaa

SEQ ID NO: 3842063 - RNA, 17 nt, Human
gagcucacaaggcagca

SEQ ID NO: 3842064 - RNA, 18 nt, Human
gagcucacaaggcagcaa

SEQ ID NO: 3842065 - RNA, 16 nt, Human
gagcucacucggcacc

SEQ ID NO: 3842066 - RNA, 15 nt, Human
gagcucagaccccca

SEQ ID NO: 3842067 - RNA, 21 nt, Human
gagcucagacccccacucuca

SEQ ID NO: 3842068 - RNA, 13 nt, Human
gagcucagcgugg

SEQ ID NO: 3842069 - RNA, 20 nt, Human
gagcucaggaaccgaggcag

SEQ ID NO: 3842070 - RNA, 11 nt, Human
gagcucaggau

SEQ ID NO: 3842071 - RNA, 13 nt, Human
gagcucaggauga

SEQ ID NO: 3842072 - RNA, 18 nt, Human
gagcuccaacucagaagg

SEQ ID NO: 3842073 - RNA, 12 nt, Human
gagcuccacucu

SEQ ID NO: 3842074 - RNA, 16 nt, Human
gagcuccacucugcuu

SEQ ID NO: 3842075 - RNA, 22 nt, Human
gagcuccacucugcuucucuga

SEQ ID NO: 3842076 - RNA, 17 nt, Human
gagcuccagacccccag

SEQ ID NO: 3842077 - RNA, 14 nt, Human
gagcuccagcuccu

SEQ ID NO: 3842078 - RNA, 22 nt, Human
gagcuccaguguccugagcuca

SEQ ID NO: 3842079 - RNA, 16 nt, Human
gagcucccaggugcag

SEQ ID NO: 3842080 - RNA, 20 nt, Human
gagcucccaggugcagccag

SEQ ID NO: 3842081 - RNA, 15 nt, Human
gagcuccccucccca

SEQ ID NO: 3842082 - RNA, 19 nt, Human
gagcuccccuccccaacug

SEQ ID NO: 3842083 - RNA, 19 nt, Human
gagcucccggcguggugga

SEQ ID NO: 3842084 - RNA, 12 nt, Human
gagcuccucccu

SEQ ID NO: 3842085 - RNA, 23 nt, Human
gagcuccucccucucaacaccca

SEQ ID NO: 3842086 - RNA, 16 nt, Human
gagcuccucuccugga

SEQ ID NO: 3842087 - RNA, 19 nt, Human
gagcuccucuguccugcuu

SEQ ID NO: 3842088 - RNA, 19 nt, Human
gagcuccuguccccugcua

SEQ ID NO: 3842089 - RNA, 16 nt, Human
gagcucgugggacagu

SEQ ID NO: 3842090 - RNA, 16 nt, Human
gagcucguguauccug

SEQ ID NO: 3842091 - RNA, 18 nt, Human
gagcucguguauccuggg

SEQ ID NO: 3842092 - RNA, 19 nt, Human
gagcucuaugggcagaucu

SEQ ID NO: 3842093 - RNA, 15 nt, Human
gagcucucugcccuu

SEQ ID NO: 3842094 - RNA, 17 nt, Human
gagcucucugcccuuga

SEQ ID NO: 3842095 - RNA, 12 nt, Human
gagcucugagag

SEQ ID NO: 3842096 - RNA, 15 nt, Human
gagcucugagaggcc

SEQ ID NO: 3842097 - RNA, 17 nt, Human
gagcucugagaggcccu

SEQ ID NO: 3842098 - RNA, 19 nt, Human
gagcucugagaggcccugg

SEQ ID NO: 3842099 - RNA, 17 nt, Human
gagcucuggagccaccu

SEQ ID NO: 3842100 - RNA, 17 nt, Human
gagcucuucaggccucc

SEQ ID NO: 3842101 - RNA, 20 nt, Human
gugcgcaucuugccuccagg

SEQ ID NO: 3842102 - RNA, 22 nt, Human
gugcgccgagucugucucuguc

SEQ ID NO: 3842103 - RNA, 14 nt, Human
gugcgccuacagga

SEQ ID NO: 3842104 - RNA, 15 nt, Human
gugcgcucuguggau

SEQ ID NO: 3842105 - RNA, 23 nt, Human
gugcgcugggcacuucccugcug

SEQ ID NO: 3842106 - RNA, 15 nt, Human
gugcggaccacccuc

SEQ ID NO: 3842107 - RNA, 15 nt, Human
gugcguccacgagcu

SEQ ID NO: 3842108 - RNA, 21 nt, Human
gugcgugaaacacaccaggcu

SEQ ID NO: 3842109 - RNA, 13 nt, Human
gugcgugaauauu

SEQ ID NO: 3842110 - RNA, 16 nt, Human
gugcgugccgugugag

SEQ ID NO: 3842111 - RNA, 22 nt, Human
gugcgugccgugugagugugac

SEQ ID NO: 3842112 - RNA, 13 nt, Human
gugcgugugucca

SEQ ID NO: 3842113 - RNA, 14 nt, Human
gugcguguuugcac

SEQ ID NO: 3842114 - RNA, 18 nt, Human
gugcuaaaaaugggacuu

SEQ ID NO: 3842115 - RNA, 20 nt, Human
gugcuaaacguguauguuuu

SEQ ID NO: 3842116 - RNA, 16 nt, Human
gugcuaaauuuucagu

SEQ ID NO: 3842117 - RNA, 12 nt, Human
gugcuaaggacu

SEQ ID NO: 3842118 - RNA, 13 nt, Human
gugcuaaggacuu

SEQ ID NO: 3842119 - RNA, 14 nt, Human
gugcuaaggacuug

SEQ ID NO: 3842120 - RNA, 20 nt, Human
gugcuaaggacuuguuagau

SEQ ID NO: 3842121 - RNA, 14 nt, Human
gugcuaagugugaa

SEQ ID NO: 3842122 - RNA, 18 nt, Human
gugcuaagugugaacugg

SEQ ID NO: 3842123 - RNA, 21 nt, Human
gugcuacaaaaacacagcaag

SEQ ID NO: 3842124 - RNA, 21 nt, Human
gugcuacacccuuuuccagcu

SEQ ID NO: 3842125 - RNA, 20 nt, Human
gugcuacaggggccagaaga

SEQ ID NO: 3842126 - RNA, 21 nt, Human
gugcuacaugacgacaaagcu

SEQ ID NO: 3842127 - RNA, 19 nt, Human
gugcuaggaagaggagugg

SEQ ID NO: 3842128 - RNA, 18 nt, Human
gugcuauaggcuggagaa

SEQ ID NO: 3842129 - RNA, 19 nt, Human
gugcuauggauggcuucua

SEQ ID NO: 3842130 - RNA, 23 nt, Human
gugcuauuguagagccagagguc

SEQ ID NO: 3842131 - RNA, 16 nt, Human
gugcucagaagggcua

SEQ ID NO: 3842132 - RNA, 22 nt, Human
gugcucagaauaaggcaggcau

SEQ ID NO: 3842133 - RNA, 12 nt, Human
gugcucagcccu

SEQ ID NO: 3842134 - RNA, 15 nt, Human
gugcucaggagcccu

SEQ ID NO: 3842135 - RNA, 19 nt, Human
gugcucaggagcccuggga

SEQ ID NO: 3842136 - RNA, 22 nt, Human
gaggcugugugccugggggagu

SEQ ID NO: 3842137 - RNA, 15 nt, Human
gaggcuuaacaaugu

SEQ ID NO: 3842138 - RNA, 14 nt, Human
gaggcuuccuucau

SEQ ID NO: 3842139 - RNA, 22 nt, Human
gaggcuucuccgccagccuccu

SEQ ID NO: 3842140 - RNA, 22 nt, Human
gaggcuucuucagaucagugcu

SEQ ID NO: 3842141 - RNA, 20 nt, Human
gaggcuugcugagaggggcu

SEQ ID NO: 3842142 - RNA, 19 nt, Human
gaggcuugucagagcuggg

SEQ ID NO: 3842143 - RNA, 23 nt, Human
gaggcuuuaugauaauagauucu

SEQ ID NO: 3842144 - RNA, 14 nt, Human
gaggcuuuggauuu

SEQ ID NO: 3842145 - RNA, 16 nt, Human
gaggcuuuggauuuga

SEQ ID NO: 3842146 - RNA, 20 nt, Human
gaggcuuuggauuugacauu

SEQ ID NO: 3842147 - RNA, 11 nt, Human
gaggcuuugug

SEQ ID NO: 3842148 - RNA, 19 nt, Human
gagggaacggaaauaaagg

SEQ ID NO: 3842149 - RNA, 19 nt, Human
gagggaagaguggaggugg

SEQ ID NO: 3842150 - RNA, 14 nt, Human
gagggaagggagcc

SEQ ID NO: 3842151 - RNA, 17 nt, Human
gagggaagggagccaag

SEQ ID NO: 3842152 - RNA, 21 nt, Human
gagggaauccccgaaggugcu

SEQ ID NO: 3842153 - RNA, 22 nt, Human
gagggacaaaggagccugugaa

SEQ ID NO: 3842154 - RNA, 16 nt, Human
gagggacagucucacc

SEQ ID NO: 3842155 - RNA, 23 nt, Human
gagggacagucucaccauuuccc

SEQ ID NO: 3842156 - RNA, 23 nt, Human
gagggacaugcuuagcagucccc

SEQ ID NO: 3842157 - RNA, 19 nt, Human
gagggaccaacugggccca

SEQ ID NO: 3842158 - RNA, 14 nt, Human
gugaacccuggggc

SEQ ID NO: 3842159 - RNA, 18 nt, Human
gugaacccuggggccuga

SEQ ID NO: 3842160 - RNA, 15 nt, Human
gugaaccucaccccg

SEQ ID NO: 3842161 - RNA, 20 nt, Human
gugaacuauuucuacacagu

SEQ ID NO: 3842162 - RNA, 15 nt, Human
gugaacucagccaag

SEQ ID NO: 3842163 - RNA, 18 nt, Human
gugaacucagccaagcac

SEQ ID NO: 3842164 - RNA, 19 nt, Human
gugaacucagccaagcaca

SEQ ID NO: 3842165 - RNA, 22 nt, Human
gugaacucagccaagcacagug

SEQ ID NO: 3842166 - RNA, 16 nt, Human
gugaacugacaggcag

SEQ ID NO: 3842167 - RNA, 19 nt, Human
gugaacuggacccuguugc

SEQ ID NO: 3842168 - RNA, 21 nt, Human
gugaacugugaggguaaaggc

SEQ ID NO: 3842169 - RNA, 15 nt, Human
gugaacuugaaauuu

SEQ ID NO: 3842170 - RNA, 14 nt, Human
gugaacuuggaagc

SEQ ID NO: 3842171 - RNA, 15 nt, Human
gugaacuuguagcug

SEQ ID NO: 3842172 - RNA, 20 nt, Human
gugaacuuguagcuguaaaa

SEQ ID NO: 3842173 - RNA, 21 nt, Human
gugaacuuguagcuguaaaac

SEQ ID NO: 3842174 - RNA, 22 nt, Human
gugaagaaagccuguuguuuaa

SEQ ID NO: 3842175 - RNA, 23 nt, Human
gugaagaaugcacaagaauggau

SEQ ID NO: 3842176 - RNA, 14 nt, Human
gugaagacuccaga

SEQ ID NO: 3842177 - RNA, 19 nt, Human
gugaagagggagaagcaug

SEQ ID NO: 3842178 - RNA, 21 nt, Human
gugaagagugacuaguacaaa

SEQ ID NO: 3842179 - RNA, 20 nt, Human
gugaagauacuuuguauugu

SEQ ID NO: 3842180 - RNA, 10 nt, Human
gugaagccaa

SEQ ID NO: 3842181 - RNA, 20 nt, Human
gugaagccaauucagacagg

SEQ ID NO: 3842182 - RNA, 17 nt, Human
gugaaggcuucucucug

SEQ ID NO: 3842183 - RNA, 18 nt, Human
gugaaggcuucucuguuc

SEQ ID NO: 3842184 - RNA, 16 nt, Human
gugaaguccuucaccu

SEQ ID NO: 3842185 - RNA, 16 nt, Human
gugaagugaaugaaac

SEQ ID NO: 3842186 - RNA, 14 nt, Human
gugaaguugcugcu

SEQ ID NO: 3842187 - RNA, 23 nt, Human
gugaaguugcugcuucucccagg

SEQ ID NO: 3842188 - RNA, 14 nt, Human
gugaaguuuacauu

SEQ ID NO: 3842189 - RNA, 18 nt, Human
gugaauaaccugaggauu

SEQ ID NO: 3842190 - RNA, 15 nt, Human
gugaauaauaaaagu

SEQ ID NO: 3842191 - RNA, 21 nt, Human
gugaauacugcuacagcaauu

SEQ ID NO: 3842192 - RNA, 23 nt, Human
gugaauagccauauuuguaaaau

SEQ ID NO: 3842193 - RNA, 14 nt, Human
gugaauauaaaugu

SEQ ID NO: 3842194 - RNA, 16 nt, Human
gugaauauuguucaua

SEQ ID NO: 3842195 - RNA, 22 nt, Human
gugaauauuuccauauggauuu

SEQ ID NO: 3842196 - RNA, 13 nt, Human
gugaaucaagggu

SEQ ID NO: 3842197 - RNA, 18 nt, Human
gugaaucacguaaagcua

SEQ ID NO: 3842198 - RNA, 15 nt, Human
gugaaucuaaaagcu

SEQ ID NO: 3842199 - RNA, 18 nt, Human
gugaaugaaagauuaaac

SEQ ID NO: 3842200 - RNA, 13 nt, Human
gugaaugaacacu

SEQ ID NO: 3842201 - RNA, 15 nt, Human
gugaaugccagugug

SEQ ID NO: 3842202 - RNA, 19 nt, Human
gugaaugccagugugcuga

SEQ ID NO: 3842203 - RNA, 21 nt, Human
gugaaugcugggacucagccu

SEQ ID NO: 3842204 - RNA, 14 nt, Human
gugaauggcuuugu

SEQ ID NO: 3842205 - RNA, 17 nt, Human
gugaauggcuuuguaua

SEQ ID NO: 3842206 - RNA, 15 nt, Human
gugaaugggaaaaga

SEQ ID NO: 3842207 - RNA, 12 nt, Human
gugaaugggugc

SEQ ID NO: 3842208 - RNA, 14 nt, Human
gugaaugugggcac

SEQ ID NO: 3842209 - RNA, 23 nt, Human
gugaaugugggcacuggcccagg

SEQ ID NO: 3842210 - RNA, 16 nt, Human
gugaauuacuaacuuc

SEQ ID NO: 3842211 - RNA, 16 nt, Human
gugaauuaguuuuaaa

SEQ ID NO: 3842212 - RNA, 19 nt, Human
gugaauuaucccuuuucuu

SEQ ID NO: 3842213 - RNA, 14 nt, Human
gugaauucccucac

SEQ ID NO: 3842214 - RNA, 17 nt, Human
gugaauugauaauaaac

SEQ ID NO: 3842215 - RNA, 19 nt, Human
gugaauugugaccaaguua

SEQ ID NO: 3842216 - RNA, 14 nt, Human
gugaauuguuugaa

SEQ ID NO: 3842217 - RNA, 20 nt, Human
gugaauuuauaccuaccugu

SEQ ID NO: 3842218 - RNA, 19 nt, Human
gugaauuucuucacuguug

SEQ ID NO: 3842219 - RNA, 13 nt, Human
gugaauuugaauc

SEQ ID NO: 3842220 - RNA, 14 nt, Human
gugaauuugaauga

SEQ ID NO: 3842221 - RNA, 13 nt, Human
gugaauuuuuaag

SEQ ID NO: 3842222 - RNA, 14 nt, Human
gugaauuuuucucu

SEQ ID NO: 3842223 - RNA, 23 nt, Human
gugaauuuuugcaauaaugcagu

SEQ ID NO: 3842224 - RNA, 13 nt, Human
gugacaaaaaauu

SEQ ID NO: 3842225 - RNA, 18 nt, Human
gugacaaaauuuuauaag

SEQ ID NO: 3842226 - RNA, 23 nt, Human
gugacaaaccauccaguggaggu

SEQ ID NO: 3842227 - RNA, 16 nt, Human
gugacaagcucacaga

SEQ ID NO: 3842228 - RNA, 14 nt, Human
gugacaaggcccca

SEQ ID NO: 3842229 - RNA, 17 nt, Human
gugacaaggccccagag

SEQ ID NO: 3842230 - RNA, 19 nt, Human
gugacaaggccccagagac

SEQ ID NO: 3842231 - RNA, 12 nt, Human
gugacaauaaaa

SEQ ID NO: 3842232 - RNA, 14 nt, Human
gugacaauaaaaca

SEQ ID NO: 3842233 - RNA, 21 nt, Human
gugacacaaacacacacaaaa

SEQ ID NO: 3842234 - RNA, 21 nt, Human
gugacacacuacaccacacac

SEQ ID NO: 3842235 - RNA, 22 nt, Human
gugacacacuacaccacacaca

SEQ ID NO: 3842236 - RNA, 12 nt, Human
gugacacagcag

SEQ ID NO: 3842237 - RNA, 19 nt, Human
gugacacagcagcuucacc

SEQ ID NO: 3842238 - RNA, 21 nt, Human
gugacacuucagagagcuggu

SEQ ID NO: 3842239 - RNA, 22 nt, Human
gugacacuucagagagcuggua

SEQ ID NO: 3842240 - RNA, 15 nt, Human
gugacagacaggcuc

SEQ ID NO: 3842241 - RNA, 16 nt, Human
gugacagacaggcucu

SEQ ID NO: 3842242 - RNA, 23 nt, Human
gugacagaccacaucuuuaucug

SEQ ID NO: 3842243 - RNA, 12 nt, Human
gugacagaggca

SEQ ID NO: 3842244 - RNA, 20 nt, Human
gugacagagugagacucugu

SEQ ID NO: 3842245 - RNA, 14 nt, Human
gugacagcuuccuu

SEQ ID NO: 3842246 - RNA, 13 nt, Human
gugacagggaagc

SEQ ID NO: 3842247 - RNA, 19 nt, Human
gugacagggaagcuacagg

SEQ ID NO: 3842248 - RNA, 22 nt, Human
gugacagggcggggguggcggc

SEQ ID NO: 3842249 - RNA, 11 nt, Human
gugacagucau

SEQ ID NO: 3842250 - RNA, 13 nt, Human
gugacagucauca

SEQ ID NO: 3842251 - RNA, 18 nt, Human
gugacagucaucaucagg

SEQ ID NO: 3842252 - RNA, 19 nt, Human
gugacagucaucaucaggg

SEQ ID NO: 3842253 - RNA, 20 nt, Human
gugacagucaucaucagggc

SEQ ID NO: 3842254 - RNA, 23 nt, Human
gugacagucaucaucagggccug

SEQ ID NO: 3842255 - RNA, 21 nt, Human
gugacagugagguccuggggg

SEQ ID NO: 3842256 - RNA, 15 nt, Human
gugacagugccuggg

SEQ ID NO: 3842257 - RNA, 12 nt, Human
gugacaguguug

SEQ ID NO: 3842258 - RNA, 15 nt, Human
gugacaucaguggca

SEQ ID NO: 3842259 - RNA, 18 nt, Human
gugacaucggaaaaauaa

SEQ ID NO: 3842260 - RNA, 20 nt, Human
gugacaugcgggcugggcag

SEQ ID NO: 3842261 - RNA, 21 nt, Human
gugacaugcgggcugggcagc

SEQ ID NO: 3842262 - RNA, 22 nt, Human
gugacaugcgggcugggcagcu

SEQ ID NO: 3842263 - RNA, 20 nt, Human
gugacauggugccugagagg

SEQ ID NO: 3842264 - RNA, 13 nt, Human
gugacauguaaca

SEQ ID NO: 3842265 - RNA, 14 nt, Human
gugacaugugaaac

SEQ ID NO: 3842266 - RNA, 16 nt, Human
gugacaugugaaaccu

SEQ ID NO: 3842267 - RNA, 21 nt, Human
gugacauugcaucaaagcauc

SEQ ID NO: 3842268 - RNA, 17 nt, Human
gugacauuuuacauuaa

SEQ ID NO: 3842269 - RNA, 19 nt, Human
gugaccaacuagacauucu

SEQ ID NO: 3842270 - RNA, 13 nt, Human
gugaccaacugug

SEQ ID NO: 3842271 - RNA, 20 nt, Human
gugaccaacuguguuguauu

SEQ ID NO: 3842272 - RNA, 15 nt, Human
gugaccaaugucuug

SEQ ID NO: 3842273 - RNA, 17 nt, Human
gugaccacucugucuug

SEQ ID NO: 3842274 - RNA, 18 nt, Human
gugaccauguuuuguuua

SEQ ID NO: 3842275 - RNA, 14 nt, Human
gugacccaaugauu

SEQ ID NO: 3842276 - RNA, 18 nt, Human
gugacccacuucucauca

SEQ ID NO: 3842277 - RNA, 15 nt, Human
gugaccccagggcac

SEQ ID NO: 3842278 - RNA, 19 nt, Human
gugaccccagggcacagga

SEQ ID NO: 3842279 - RNA, 15 nt, Human
gugacccccagcucc

SEQ ID NO: 3842280 - RNA, 17 nt, Human
gagggggucguggagag

SEQ ID NO: 3842281 - RNA, 19 nt, Human
gagggggucguggagagcu

SEQ ID NO: 3842282 - RNA, 15 nt, Human
gaggggguuacaaac

SEQ ID NO: 3842283 - RNA, 18 nt, Human
gagggguaggcagagccu

SEQ ID NO: 3842284 - RNA, 19 nt, Human
gagggguaggggcugggaa

SEQ ID NO: 3842285 - RNA, 18 nt, Human
gaggggugcagaggcugu

SEQ ID NO: 3842286 - RNA, 14 nt, Human
gaggggugcucugc

SEQ ID NO: 3842287 - RNA, 14 nt, Human
gagggguguggcag

SEQ ID NO: 3842288 - RNA, 21 nt, Human
gagggguguggcuccuuccca

SEQ ID NO: 3842289 - RNA, 15 nt, Human
gagggguuccucccc

SEQ ID NO: 3842290 - RNA, 15 nt, Human
gaggguaaauaaacc

SEQ ID NO: 3842291 - RNA, 16 nt, Human
gaggguaauaaacuua

SEQ ID NO: 3842292 - RNA, 19 nt, Human
gaggguaauaaccagacac

SEQ ID NO: 3842293 - RNA, 17 nt, Human
gaggguacagcugggcu

SEQ ID NO: 3842294 - RNA, 18 nt, Human
gaggguaggcaggauugg

SEQ ID NO: 3842295 - RNA, 13 nt, Human
gagggucagagag

SEQ ID NO: 3842296 - RNA, 15 nt, Human
gagggucagagagga

SEQ ID NO: 3842297 - RNA, 16 nt, Human
gagggucagccagggc

SEQ ID NO: 3842298 - RNA, 18 nt, Human
gagggucagccagggccu

SEQ ID NO: 3842299 - RNA, 17 nt, Human
gaggguccugcagccug

SEQ ID NO: 3842300 - RNA, 18 nt, Human
gaggguccugcagccugc

SEQ ID NO: 3842301 - RNA, 21 nt, Human
gaggguccugcagccugcagg

SEQ ID NO: 3842302 - RNA, 15 nt, Human
gaggguccuggcucc

SEQ ID NO: 3842303 - RNA, 17 nt, Human
gaggguccuggcuccug

SEQ ID NO: 3842304 - RNA, 21 nt, Human
gaggguccuggcuccugaggg

SEQ ID NO: 3842305 - RNA, 17 nt, Human
gagggucuagaggccug

SEQ ID NO: 3842306 - RNA, 21 nt, Human
gagggugaagugaagacaaug

SEQ ID NO: 3842307 - RNA, 18 nt, Human
gagggugacagcuuccuu

SEQ ID NO: 3842308 - RNA, 23 nt, Human
gagggugccguguccccugacag

SEQ ID NO: 3842309 - RNA, 14 nt, Human
gaggguggugaccu

SEQ ID NO: 3842310 - RNA, 21 nt, Human
gaggguggugaccucugccug

SEQ ID NO: 3842311 - RNA, 20 nt, Human
gagggugguucaacaaagaa

SEQ ID NO: 3842312 - RNA, 22 nt, Human
gagggugucccaaaaagaaagg

SEQ ID NO: 3842313 - RNA, 15 nt, Human
gaggguuagggaggg

SEQ ID NO: 3842314 - RNA, 12 nt, Human
gaggguuccugu

SEQ ID NO: 3842315 - RNA, 18 nt, Human
gaggguugauuaaggcag

SEQ ID NO: 3842316 - RNA, 14 nt, Human
gaggguugggcugg

SEQ ID NO: 3842317 - RNA, 17 nt, Human
gaggguuguucuccuag

SEQ ID NO: 3842318 - RNA, 22 nt, Human
gagguaaaagugugagcaguga

SEQ ID NO: 3842319 - RNA, 15 nt, Human
gagguaaagauaugg

SEQ ID NO: 3842320 - RNA, 13 nt, Human
gagguaacagaac

SEQ ID NO: 3842321 - RNA, 18 nt, Human
gagguacacuugugaaua

SEQ ID NO: 3842322 - RNA, 23 nt, Human
gagguagaguuugaaggagguga

SEQ ID NO: 3842323 - RNA, 14 nt, Human
gagguauauuggaa

SEQ ID NO: 3842324 - RNA, 21 nt, Human
guguugccuugaaccacuucc

SEQ ID NO: 3842325 - RNA, 22 nt, Human
guguuggcuugugaucugggaa

SEQ ID NO: 3842326 - RNA, 21 nt, Human
guguugggauacugcagggcc

SEQ ID NO: 3842327 - RNA, 14 nt, Human
guguuggucuguac

SEQ ID NO: 3842328 - RNA, 22 nt, Human
guguugguuuugacuggauauu

SEQ ID NO: 3842329 - RNA, 17 nt, Human
guguuguaauucuucag

SEQ ID NO: 3842330 - RNA, 14 nt, Human
guguuguaugccuu

SEQ ID NO: 3842331 - RNA, 18 nt, Human
guguuguccuuuugucuu

SEQ ID NO: 3842332 - RNA, 20 nt, Human
guguugugauagcuaacauu

SEQ ID NO: 3842333 - RNA, 21 nt, Human
guguuguugcuucuugugaag

SEQ ID NO: 3842334 - RNA, 14 nt, Human
guguuuaagacauu

SEQ ID NO: 3842335 - RNA, 22 nt, Human
guguuuaagacauuuuuggaag

SEQ ID NO: 3842336 - RNA, 14 nt, Human
guguuuacagagau

SEQ ID NO: 3842337 - RNA, 15 nt, Human
guguuuagaauugaa

SEQ ID NO: 3842338 - RNA, 15 nt, Human
guguuuaguugcaga

SEQ ID NO: 3842339 - RNA, 13 nt, Human
guguuuauaaaau

SEQ ID NO: 3842340 - RNA, 16 nt, Human
guguuuaugugcuauu

SEQ ID NO: 3842341 - RNA, 19 nt, Human
guguuuauuaaaauucuga

SEQ ID NO: 3842342 - RNA, 14 nt, Human
guguuuauucuuga

SEQ ID NO: 3842343 - RNA, 16 nt, Human
guguuuauuuuucaua

SEQ ID NO: 3842344 - RNA, 20 nt, Human
guguuuauuuuucauauugu

SEQ ID NO: 3842345 - RNA, 18 nt, Human
guguuuccauauuuuaua

SEQ ID NO: 3842346 - RNA, 23 nt, Human
guguuuccuggcacugcuuccag

SEQ ID NO: 3842347 - RNA, 11 nt, Human
guguuucuagg

SEQ ID NO: 3842348 - RNA, 17 nt, Human
guguuucuauugacuuc

SEQ ID NO: 3842349 - RNA, 13 nt, Human
guguuucucccuc

SEQ ID NO: 3842350 - RNA, 18 nt, Human
guguuucuguaagaaacc

SEQ ID NO: 3842351 - RNA, 13 nt, Human
guguuucuguccu

SEQ ID NO: 3842352 - RNA, 13 nt, Human
guguuucugugca

SEQ ID NO: 3842353 - RNA, 14 nt, Human
guguuucuugccuc

SEQ ID NO: 3842354 - RNA, 16 nt, Human
guguuucuugccucau

SEQ ID NO: 3842355 - RNA, 12 nt, Human
guguuugaagca

SEQ ID NO: 3842356 - RNA, 15 nt, Human
guguuugucauuagc

SEQ ID NO: 3842357 - RNA, 11 nt, Human
guguuuguguu

SEQ ID NO: 3842358 - RNA, 18 nt, Human
guguuuguugcuggcuug

SEQ ID NO: 3842359 - RNA, 15 nt, Human
guguuuuaauuccaa

SEQ ID NO: 3842360 - RNA, 15 nt, Human
guguuuuaauuuaaa

SEQ ID NO: 3842361 - RNA, 18 nt, Human
guguuuucugaauaacau

SEQ ID NO: 3842362 - RNA, 12 nt, Human
guguuuuggucc

SEQ ID NO: 3842363 - RNA, 16 nt, Human
guguuuuguucaccau

SEQ ID NO: 3842364 - RNA, 13 nt, Human
guguuuuguuuug

SEQ ID NO: 3842365 - RNA, 18 nt, Human
guguuuuucauaaagcag

SEQ ID NO: 3842366 - RNA, 18 nt, Human
guguuuuucuauuaaaag

SEQ ID NO: 3842367 - RNA, 21 nt, Human
guguuuuucuauuaaaagacu

SEQ ID NO: 3842368 - RNA, 21 nt, Human
guguuuuuguaaagugugguc

SEQ ID NO: 3842369 - RNA, 15 nt, Human
guguuuuuuaagaug

SEQ ID NO: 3842370 - RNA, 23 nt, Human
guguuuuuucuuuuuuuuuaagu

SEQ ID NO: 3842371 - RNA, 13 nt, Human
guuaaaaaaaaaa

SEQ ID NO: 3842372 - RNA, 21 nt, Human
guuaaaaaaaaaaaaaggaaa

SEQ ID NO: 3842373 - RNA, 14 nt, Human
guuaaaaaaaauaa

SEQ ID NO: 3842374 - RNA, 16 nt, Human
guuaaaaaaaauaaua

SEQ ID NO: 3842375 - RNA, 18 nt, Human
guuaaaaaaaauaauaaa

SEQ ID NO: 3842376 - RNA, 19 nt, Human
guuaaaaaaauggcaguga

SEQ ID NO: 3842377 - RNA, 20 nt, Human
guuaaaaacagauuuggaaa

SEQ ID NO: 3842378 - RNA, 14 nt, Human
guuaaaaagaaaag

SEQ ID NO: 3842379 - RNA, 22 nt, Human
guuaaaaagaaaaguuuauaaa

SEQ ID NO: 3842380 - RNA, 20 nt, Human
guuaaaacuguacauuuaaa

SEQ ID NO: 3842381 - RNA, 22 nt, Human
guuaaaacuguacauuuaaaau

SEQ ID NO: 3842382 - RNA, 23 nt, Human
guuaaaacuguacauuuaaaauu

SEQ ID NO: 3842383 - RNA, 16 nt, Human
guuaaaagaugaaaau

SEQ ID NO: 3842384 - RNA, 19 nt, Human
guuaaaaugugaggaagaa

SEQ ID NO: 3842385 - RNA, 21 nt, Human
guuaaaccauccauguauuuu

SEQ ID NO: 3842386 - RNA, 21 nt, Human
guuaaacuagcauaucugccu

SEQ ID NO: 3842387 - RNA, 12 nt, Human
guuaaagaugca

SEQ ID NO: 3842388 - RNA, 16 nt, Human
guuaaagauguagcaa

SEQ ID NO: 3842389 - RNA, 15 nt, Human
guuaaagcugccggc

SEQ ID NO: 3842390 - RNA, 23 nt, Human
guuaaaggcucgauuuuguaucu

SEQ ID NO: 3842391 - RNA, 18 nt, Human
guuaaaggugaacauugg

SEQ ID NO: 3842392 - RNA, 20 nt, Human
guuaaagucagugggaacgu

SEQ ID NO: 3842393 - RNA, 20 nt, Human
guuaaauaaauuguauauuc

SEQ ID NO: 3842394 - RNA, 19 nt, Human
guuaaauagaguauaugca

SEQ ID NO: 3842395 - RNA, 22 nt, Human
guuaaauauuuacauaugaaau

SEQ ID NO: 3842396 - RNA, 20 nt, Human
guuaaaugaaauuguaaaac

SEQ ID NO: 3842397 - RNA, 13 nt, Human
guuaaauguuuug

SEQ ID NO: 3842398 - RNA, 18 nt, Human
guuaaauguuuuguaaac

SEQ ID NO: 3842399 - RNA, 22 nt, Human
guuaaauguuuuguaaacuuug

SEQ ID NO: 3842400 - RNA, 17 nt, Human
guuaaauuucuggaccu

SEQ ID NO: 3842401 - RNA, 19 nt, Human
guuaacaaugccuauugua

SEQ ID NO: 3842402 - RNA, 18 nt, Human
guuaacacauuuuguaua

SEQ ID NO: 3842403 - RNA, 23 nt, Human
guuaacagaagggagggcagagc

SEQ ID NO: 3842404 - RNA, 12 nt, Human
guuaacagauuu

SEQ ID NO: 3842405 - RNA, 15 nt, Human
guuaacaucaguuuu

SEQ ID NO: 3842406 - RNA, 18 nt, Human
guuaacaucaugaauuua

SEQ ID NO: 3842407 - RNA, 18 nt, Human
guuaacauugaccaagaa

SEQ ID NO: 3842408 - RNA, 23 nt, Human
guuaacauugaccaagaacugca

SEQ ID NO: 3842409 - RNA, 20 nt, Human
guuaaccagaauaaaguucu

SEQ ID NO: 3842410 - RNA, 12 nt, Human
guuaaccuaccu

SEQ ID NO: 3842411 - RNA, 16 nt, Human
guuaacuauguacaau

SEQ ID NO: 3842412 - RNA, 21 nt, Human
guuaacuauuuuauuuucuaa

SEQ ID NO: 3842413 - RNA, 14 nt, Human
guuaacugaauacc

SEQ ID NO: 3842414 - RNA, 16 nt, Human
guuaagaaaaaaauaa

SEQ ID NO: 3842415 - RNA, 15 nt, Human
guuaagaagcuguug

SEQ ID NO: 3842416 - RNA, 17 nt, Human
guuaagaagcuguugua

SEQ ID NO: 3842417 - RNA, 19 nt, Human
guuaagaagcuguuguaca

SEQ ID NO: 3842418 - RNA, 22 nt, Human
guuaagacaugauuuccuugaa

SEQ ID NO: 3842419 - RNA, 15 nt, Human
guuaagacuugacag

SEQ ID NO: 3842420 - RNA, 17 nt, Human
guuaagagaaacuuuau

SEQ ID NO: 3842421 - RNA, 22 nt, Human
guuaagagaaacuuuauacauu

SEQ ID NO: 3842422 - RNA, 17 nt, Human
guuaagagaaaugagcu

SEQ ID NO: 3842423 - RNA, 19 nt, Human
guuaagcagccgccacauc

SEQ ID NO: 3842424 - RNA, 15 nt, Human
guggaguggggcagu

SEQ ID NO: 3842425 - RNA, 17 nt, Human
guggaguucaucuugaa

SEQ ID NO: 3842426 - RNA, 14 nt, Human
guggauaacaaaga

SEQ ID NO: 3842427 - RNA, 21 nt, Human
guggauagaugcccugcuaga

SEQ ID NO: 3842428 - RNA, 13 nt, Human
guggauauaaaua

SEQ ID NO: 3842429 - RNA, 15 nt, Human
guggauauaaauaua

SEQ ID NO: 3842430 - RNA, 16 nt, Human
guggauauaaauauau

SEQ ID NO: 3842431 - RNA, 14 nt, Human
guggaucacagagg

SEQ ID NO: 3842432 - RNA, 16 nt, Human
guggaucacagaggcu

SEQ ID NO: 3842433 - RNA, 15 nt, Human
guggaucaccugagg

SEQ ID NO: 3842434 - RNA, 21 nt, Human
guggaucacgaggucaggaga

SEQ ID NO: 3842435 - RNA, 22 nt, Human
guggaucacgaggucaggagau

SEQ ID NO: 3842436 - RNA, 16 nt, Human
guggaugcaauuuuuc

SEQ ID NO: 3842437 - RNA, 21 nt, Human
guggaugccacagcccagcuu

SEQ ID NO: 3842438 - RNA, 18 nt, Human
guggaugccgauuucugu

SEQ ID NO: 3842439 - RNA, 20 nt, Human
guggaugccgauuucuguaa

SEQ ID NO: 3842440 - RNA, 20 nt, Human
guggaugccugguggcagcu

SEQ ID NO: 3842441 - RNA, 21 nt, Human
guggaugccugguggcagcug

SEQ ID NO: 3842442 - RNA, 22 nt, Human
guggauggccccagcacagcuu

SEQ ID NO: 3842443 - RNA, 18 nt, Human
guggauggccguggaugc

SEQ ID NO: 3842444 - RNA, 21 nt, Human
guggauggguuuuaugagaug

SEQ ID NO: 3842445 - RNA, 15 nt, Human
guggaugucuuccuu

SEQ ID NO: 3842446 - RNA, 19 nt, Human
guggaugucuuccuuggag

SEQ ID NO: 3842447 - RNA, 17 nt, Human
guggauuauuucauuuu

SEQ ID NO: 3842448 - RNA, 18 nt, Human
guggauuuaacagaaaug

SEQ ID NO: 3842449 - RNA, 20 nt, Human
guggauuuaacagaaaugua

SEQ ID NO: 3842450 - RNA, 23 nt, Human
guggauuuaacagaaauguacag

SEQ ID NO: 3842451 - RNA, 21 nt, Human
guggauuuugguuuuguuccc

SEQ ID NO: 3842452 - RNA, 21 nt, Human
guggcaaagcagcaacuauuc

SEQ ID NO: 3842453 - RNA, 14 nt, Human
guggcaaccugcuu

SEQ ID NO: 3842454 - RNA, 15 nt, Human
guggcaagaccaaaa

SEQ ID NO: 3842455 - RNA, 17 nt, Human
guggcaagaguguggag

SEQ ID NO: 3842456 - RNA, 13 nt, Human
guggcaaggcugu

SEQ ID NO: 3842457 - RNA, 20 nt, Human
guggcaccagcgaagggagu

SEQ ID NO: 3842458 - RNA, 15 nt, Human
guggcaccugucugc

SEQ ID NO: 3842459 - RNA, 18 nt, Human
guggcaccugucugcucc

SEQ ID NO: 3842460 - RNA, 20 nt, Human
guggcaccugucugcuccag

SEQ ID NO: 3842461 - RNA, 22 nt, Human
guggcacucagucucucuucuc

SEQ ID NO: 3842462 - RNA, 12 nt, Human
guggcacugcca

SEQ ID NO: 3842463 - RNA, 21 nt, Human
guggcacugguagguugggac

SEQ ID NO: 3842464 - RNA, 22 nt, Human
guggcacugguagguugggaca

SEQ ID NO: 3842465 - RNA, 13 nt, Human
guggcagagagag

SEQ ID NO: 3842466 - RNA, 17 nt, Human
guggcagagagagagaa

SEQ ID NO: 3842467 - RNA, 15 nt, Human
guggcagaguuacag

SEQ ID NO: 3842468 - RNA, 19 nt, Human
guggcagcaacggcacagc

SEQ ID NO: 3842469 - RNA, 14 nt, Human
guggcagcccagcc

SEQ ID NO: 3842470 - RNA, 15 nt, Human
guggcagcccagcca

SEQ ID NO: 3842471 - RNA, 18 nt, Human
guggcagcccagccagcg

SEQ ID NO: 3842472 - RNA, 19 nt, Human
guggcagcugcgguccacc

SEQ ID NO: 3842473 - RNA, 12 nt, Human
guggcagcugcu

SEQ ID NO: 3842474 - RNA, 13 nt, Human
guggcaggaccag

SEQ ID NO: 3842475 - RNA, 15 nt, Human
guggcaggcagaggc

SEQ ID NO: 3842476 - RNA, 23 nt, Human
guggcaggcagaggcccaggcug

SEQ ID NO: 3842477 - RNA, 24 nt, Human
guggcaggcagaggcccaggcugc

SEQ ID NO: 3842478 - RNA, 18 nt, Human
guggcagggccuagcugc

SEQ ID NO: 3842479 - RNA, 22 nt, Human
guggcagggccuagcugcuaca

SEQ ID NO: 3842480 - RNA, 23 nt, Human
guggcagggccuagcugcuacaa

SEQ ID NO: 3842481 - RNA, 20 nt, Human
guggcaggggacaggagucc

SEQ ID NO: 3842482 - RNA, 23 nt, Human
guggcagguggaggugucaggcu

SEQ ID NO: 3842483 - RNA, 17 nt, Human
guggcagugcagcaacc

SEQ ID NO: 3842484 - RNA, 17 nt, Human
guggcagugggagcugc

SEQ ID NO: 3842485 - RNA, 21 nt, Human
guggcagugggagcugccugu

SEQ ID NO: 3842486 - RNA, 16 nt, Human
guggcaugcaccugca

SEQ ID NO: 3842487 - RNA, 18 nt, Human
guggcauguggccugugg

SEQ ID NO: 3842488 - RNA, 18 nt, Human
guggcauuggcagcaggu

SEQ ID NO: 3842489 - RNA, 18 nt, Human
guggccaagagaaacuuc

SEQ ID NO: 3842490 - RNA, 15 nt, Human
guggccaaggagcug

SEQ ID NO: 3842491 - RNA, 17 nt, Human
guggccaaggagcugcu

SEQ ID NO: 3842492 - RNA, 19 nt, Human
guggccaaggagcugcuau

SEQ ID NO: 3842493 - RNA, 22 nt, Human
guggccacaauccacgcuucuc

SEQ ID NO: 3842494 - RNA, 16 nt, Human
guggccacagcgccag

SEQ ID NO: 3842495 - RNA, 17 nt, Human
guggccacagcgccagc

SEQ ID NO: 3842496 - RNA, 13 nt, Human
guggccaccagua

SEQ ID NO: 3842497 - RNA, 17 nt, Human
guggccagaccagagcu

SEQ ID NO: 3842498 - RNA, 18 nt, Human
guggccagaccagagcuc

SEQ ID NO: 3842499 - RNA, 13 nt, Human
guggccagaggug

SEQ ID NO: 3842500 - RNA, 11 nt, Human
guggccagccc

SEQ ID NO: 3842501 - RNA, 14 nt, Human
guggccagccugga

SEQ ID NO: 3842502 - RNA, 13 nt, Human
guggccaggaggu

SEQ ID NO: 3842503 - RNA, 15 nt, Human
guggccaucccugug

SEQ ID NO: 3842504 - RNA, 17 nt, Human
guggccaucccugugag

SEQ ID NO: 3842505 - RNA, 20 nt, Human
guggccaugacccugccucu

SEQ ID NO: 3842506 - RNA, 21 nt, Human
guggccaugacccugccucuc

SEQ ID NO: 3842507 - RNA, 13 nt, Human
guggccaugcucc

SEQ ID NO: 3842508 - RNA, 18 nt, Human
guggccaugcuccucuuc

SEQ ID NO: 3842509 - RNA, 23 nt, Human
guggccauuuagccaccaucuuu

SEQ ID NO: 3842510 - RNA, 18 nt, Human
guggcccaaggcuggcag

SEQ ID NO: 3842511 - RNA, 17 nt, Human
guggcccauccccccuc

SEQ ID NO: 3842512 - RNA, 21 nt, Human
guggcccauccccccucacca

SEQ ID NO: 3842513 - RNA, 19 nt, Human
guggccccacccugggccc

SEQ ID NO: 3842514 - RNA, 21 nt, Human
guggccccacccugggcccug

SEQ ID NO: 3842515 - RNA, 14 nt, Human
guggccccagccug

SEQ ID NO: 3842516 - RNA, 17 nt, Human
guggccccagccuggcc

SEQ ID NO: 3842517 - RNA, 19 nt, Human
guggccccagccuggccca

SEQ ID NO: 3842518 - RNA, 16 nt, Human
guggccccguuucugg

SEQ ID NO: 3842519 - RNA, 23 nt, Human
guggccccguuucugguggucug

SEQ ID NO: 3842520 - RNA, 17 nt, Human
guggcccgacagccugg

SEQ ID NO: 3842521 - RNA, 18 nt, Human
guggcccgacagccuggc

SEQ ID NO: 3842522 - RNA, 22 nt, Human
guggcccgguugaacucacucc

SEQ ID NO: 3842523 - RNA, 15 nt, Human
guggcccucuccccu

SEQ ID NO: 3842524 - RNA, 19 nt, Human
guggcccucuccccugccc

SEQ ID NO: 3842525 - RNA, 19 nt, Human
guggcccucucccuuaccc

SEQ ID NO: 3842526 - RNA, 11 nt, Human
guggcccuggc

SEQ ID NO: 3842527 - RNA, 18 nt, Human
guggcccuggccugcugg

SEQ ID NO: 3842528 - RNA, 21 nt, Human
guggcccugucccucccaccu

SEQ ID NO: 3842529 - RNA, 22 nt, Human
guggcccugucccucccaccuc

SEQ ID NO: 3842530 - RNA, 23 nt, Human
guugcauagcaguauauguuaau

SEQ ID NO: 3842531 - RNA, 16 nt, Human
guugcaugauguauuu

SEQ ID NO: 3842532 - RNA, 16 nt, Human
guugcauguaguaaca

SEQ ID NO: 3842533 - RNA, 20 nt, Human
guugcauguaguaacacuaa

SEQ ID NO: 3842534 - RNA, 23 nt, Human
guugcauuuguuuuguuuacaga

SEQ ID NO: 3842535 - RNA, 21 nt, Human
guugccaagaacugaaaacau

SEQ ID NO: 3842536 - RNA, 16 nt, Human
guugccaagacaaauc

SEQ ID NO: 3842537 - RNA, 17 nt, Human
guugccaagacaaauca

SEQ ID NO: 3842538 - RNA, 14 nt, Human
guugccacaggaca

SEQ ID NO: 3842539 - RNA, 17 nt, Human
guugccacaggccuccc

SEQ ID NO: 3842540 - RNA, 14 nt, Human
guugccagucaccc

SEQ ID NO: 3842541 - RNA, 16 nt, Human
guugccaguuguccuc

SEQ ID NO: 3842542 - RNA, 14 nt, Human
guugcccaggcagg

SEQ ID NO: 3842543 - RNA, 15 nt, Human
guugcccaggcaggu

SEQ ID NO: 3842544 - RNA, 17 nt, Human
guugcccaggcaggucu

SEQ ID NO: 3842545 - RNA, 12 nt, Human
guugcccaggcu

SEQ ID NO: 3842546 - RNA, 16 nt, Human
guugcccaggcuggcg

SEQ ID NO: 3842547 - RNA, 11 nt, Human
guugccccaga

SEQ ID NO: 3842548 - RNA, 17 nt, Human
guugccuaaguauuaaa

SEQ ID NO: 3842549 - RNA, 18 nt, Human
guugccuaaguauuaaaa

SEQ ID NO: 3842550 - RNA, 21 nt, Human
guugccuaaguauuaaaacau

SEQ ID NO: 3842551 - RNA, 14 nt, Human
guugccugucgcuu

SEQ ID NO: 3842552 - RNA, 19 nt, Human
guugccuugaaccacuucc

SEQ ID NO: 3842553 - RNA, 12 nt, Human
guugccuuuuau

SEQ ID NO: 3842554 - RNA, 23 nt, Human
guugcguggacucugcacauguc

SEQ ID NO: 3842555 - RNA, 21 nt, Human
guugcuaacugaacuuugaag

SEQ ID NO: 3842556 - RNA, 22 nt, Human
guugcuaagaagcgagcacuga

SEQ ID NO: 3842557 - RNA, 22 nt, Human
guugcuaagccccagcaagcaa

SEQ ID NO: 3842558 - RNA, 22 nt, Human
guugcucagcaaggggcucugc

SEQ ID NO: 3842559 - RNA, 23 nt, Human
guugcucuaugcuuuccaaaccu

SEQ ID NO: 3842560 - RNA, 13 nt, Human
guugcugaauagg

SEQ ID NO: 3842561 - RNA, 15 nt, Human
guugcugacuuagaa

SEQ ID NO: 3842562 - RNA, 18 nt, Human
guugcugcuucucccagg

SEQ ID NO: 3842563 - RNA, 23 nt, Human
guugcugcuucucccaggcaagg

SEQ ID NO: 3842564 - RNA, 22 nt, Human
guugcugggagcugaaaaauca

SEQ ID NO: 3842565 - RNA, 14 nt, Human
guugcugguacaca

SEQ ID NO: 3842566 - RNA, 16 nt, Human
guugcugguugcugug

SEQ ID NO: 3842567 - RNA, 17 nt, Human
guugcugguugcugugu

SEQ ID NO: 3842568 - RNA, 18 nt, Human
guugcugguugcugugug

SEQ ID NO: 3842569 - RNA, 17 nt, Human
guugcugucagucuuga

SEQ ID NO: 3842570 - RNA, 16 nt, Human
guugcugugugguuug

SEQ ID NO: 3842571 - RNA, 15 nt, Human
guugcuguuucacaa

SEQ ID NO: 3842572 - RNA, 23 nt, Human
guugcuguuuuccucccuucugc

SEQ ID NO: 3842573 - RNA, 15 nt, Human
guugcuuacaauuuu

SEQ ID NO: 3842574 - RNA, 16 nt, Human
guugcuucuugugaag

SEQ ID NO: 3842575 - RNA, 17 nt, Human
guugcuucuugugaagg

SEQ ID NO: 3842576 - RNA, 21 nt, Human
guugcuugccugauauaaaug

SEQ ID NO: 3842577 - RNA, 14 nt, Human
guugcuugucuucu

SEQ ID NO: 3842578 - RNA, 16 nt, Human
guugcuuuguugcacu

SEQ ID NO: 3842579 - RNA, 20 nt, Human
guuggaaaagaauacagaaa

SEQ ID NO: 3842580 - RNA, 14 nt, Human
guuggaaacacuaa

SEQ ID NO: 3842581 - RNA, 23 nt, Human
guuggaaacacuaaauguuaaag

SEQ ID NO: 3842582 - RNA, 23 nt, Human
guuggaaauagaaauuuccagag

SEQ ID NO: 3842583 - RNA, 18 nt, Human
guuggaaauauucaugcu

SEQ ID NO: 3842584 - RNA, 14 nt, Human
guuggaagagaauc

SEQ ID NO: 3842585 - RNA, 16 nt, Human
guuggaagagaaucac

SEQ ID NO: 3842586 - RNA, 23 nt, Human
guuggaaucacuguuuagaacac

SEQ ID NO: 3842587 - RNA, 22 nt, Human
guuggaauggauuuuucuuuaa

SEQ ID NO: 3842588 - RNA, 17 nt, Human
guuggaauuaaaacaau

SEQ ID NO: 3842589 - RNA, 14 nt, Human
guuggaccccagag

SEQ ID NO: 3842590 - RNA, 17 nt, Human
guuggaccccagagauu

SEQ ID NO: 3842591 - RNA, 13 nt, Human
guuggacuaaaug

SEQ ID NO: 3842592 - RNA, 14 nt, Human
guuggacuaaaugc

SEQ ID NO: 3842593 - RNA, 23 nt, Human
guuggacuuuucguuaacauuga

SEQ ID NO: 3842594 - RNA, 19 nt, Human
guuggagccacucuguucc

SEQ ID NO: 3842595 - RNA, 14 nt, Human
guuggagccugcag

SEQ ID NO: 3842596 - RNA, 22 nt, Human
guuggaggugauuccagugaag

SEQ ID NO: 3842597 - RNA, 16 nt, Human
guuggaguagaaugua

SEQ ID NO: 3842598 - RNA, 20 nt, Human
guuggaguagaauguaguuu

SEQ ID NO: 3842599 - RNA, 20 nt, Human
guuggaguucauucauauua

SEQ ID NO: 3842600 - RNA, 22 nt, Human
guuggaguuugagguuggaaaa

SEQ ID NO: 3842601 - RNA, 12 nt, Human
guuggauuuguu

SEQ ID NO: 3842602 - RNA, 18 nt, Human
guuggcaaaaaggcagga

SEQ ID NO: 3842603 - RNA, 18 nt, Human
guuggcaccuucccccuc

SEQ ID NO: 3842604 - RNA, 20 nt, Human
guuggcacucacagaccugg

SEQ ID NO: 3842605 - RNA, 20 nt, Human
guuggcagaaauacagucuu

SEQ ID NO: 3842606 - RNA, 23 nt, Human
guuggcagaugcagcucuuccug

SEQ ID NO: 3842607 - RNA, 15 nt, Human
guuggcaggcuggcc

SEQ ID NO: 3842608 - RNA, 22 nt, Human
guuggcagugagugagccuggc

SEQ ID NO: 3842609 - RNA, 15 nt, Human
guuggccaggcuggu

SEQ ID NO: 3842610 - RNA, 18 nt, Human
guuggccaggcuggucuc

SEQ ID NO: 3842611 - RNA, 23 nt, Human
guuggccauauuuaccucagccu

SEQ ID NO: 3842612 - RNA, 19 nt, Human
guuggcgcacccuccccuc

SEQ ID NO: 3842613 - RNA, 24 nt, Human
guuggcguaggcuacagagaagcc

SEQ ID NO: 3842614 - RNA, 15 nt, Human
guuggcuagauuaac

SEQ ID NO: 3842615 - RNA, 12 nt, Human
guuggcuggccu

SEQ ID NO: 3842616 - RNA, 17 nt, Human
guuggcugggaacucac

SEQ ID NO: 3842617 - RNA, 13 nt, Human
guuggcugggccc

SEQ ID NO: 3842618 - RNA, 23 nt, Human
guuggcugggggccucagugcca

SEQ ID NO: 3842619 - RNA, 11 nt, Human
guuggcugggu

SEQ ID NO: 3842620 - RNA, 17 nt, Human
guuggcuuaccuggccc

SEQ ID NO: 3842621 - RNA, 23 nt, Human
guugggacccaguggcagggcac

SEQ ID NO: 3842622 - RNA, 18 nt, Human
guugggacuacaggcgug

SEQ ID NO: 3842623 - RNA, 21 nt, Human
guugggagaaugucaguaugu

SEQ ID NO: 3842624 - RNA, 20 nt, Human
guugggagagggcgcaggcc

SEQ ID NO: 3842625 - RNA, 16 nt, Human
guugggagcacuggag

SEQ ID NO: 3842626 - RNA, 16 nt, Human
guugggauuccugacc

SEQ ID NO: 3842627 - RNA, 20 nt, Human
guugggauuccugacccagg

SEQ ID NO: 3842628 - RNA, 23 nt, Human
guugggauuccugacccaggccg

SEQ ID NO: 3842629 - RNA, 18 nt, Human
guugggccauacuggccu

SEQ ID NO: 3842630 - RNA, 19 nt, Human
guugggccauacuggccuc

SEQ ID NO: 3842631 - RNA, 17 nt, Human
guugggcccagaucugg

SEQ ID NO: 3842632 - RNA, 17 nt, Human
guugggcuggugucacc

SEQ ID NO: 3842633 - RNA, 23 nt, Human
guuggggaaacagcaucuccaag

SEQ ID NO: 3842634 - RNA, 18 nt, Human
guuggggaagggccugcc

SEQ ID NO: 3842635 - RNA, 21 nt, Human
guugggguggguauaaaagau

SEQ ID NO: 3842636 - RNA, 14 nt, Human
guugggucaccaga

SEQ ID NO: 3842637 - RNA, 15 nt, Human
guuggguucaucuga

SEQ ID NO: 3842638 - RNA, 14 nt, Human
guugguaaacaguu

SEQ ID NO: 3842639 - RNA, 14 nt, Human
guuggucaggcugg

SEQ ID NO: 3842640 - RNA, 23 nt, Human
guugguccagagcggaggcugug

SEQ ID NO: 3842641 - RNA, 18 nt, Human
guugguguuccacguguu

SEQ ID NO: 3842642 - RNA, 15 nt, Human
guugguguugcagaa

SEQ ID NO: 3842643 - RNA, 19 nt, Human
guugguuccaagcccugga

SEQ ID NO: 3842644 - RNA, 22 nt, Human
guugguuccaagucuuugcuau

SEQ ID NO: 3842645 - RNA, 18 nt, Human
guugguugcacuuuguag

SEQ ID NO: 3842646 - RNA, 14 nt, Human
guugguuuacuuuc

SEQ ID NO: 3842647 - RNA, 16 nt, Human
guuguaaaccaaguga

SEQ ID NO: 3842648 - RNA, 17 nt, Human
guuguaaagcaauaaaa

SEQ ID NO: 3842649 - RNA, 21 nt, Human
guuguaaaguauguauuauuu

SEQ ID NO: 3842650 - RNA, 18 nt, Human
guuguaaauaauuuauuu

SEQ ID NO: 3842651 - RNA, 20 nt, Human
guuguaaauauuuauguaaa

SEQ ID NO: 3842652 - RNA, 22 nt, Human
guuguaaauuggcauggaaauu

SEQ ID NO: 3842653 - RNA, 13 nt, Human
guuguaacuaggc

SEQ ID NO: 3842654 - RNA, 23 nt, Human
guuguacaaauaaagucccaggu

SEQ ID NO: 3842655 - RNA, 16 nt, Human
guuguacauuuaugau

SEQ ID NO: 3842656 - RNA, 14 nt, Human
guuguaccaaguga

SEQ ID NO: 3842657 - RNA, 16 nt, Human
guuguacuguauguga

SEQ ID NO: 3842658 - RNA, 14 nt, Human
guuguacuucauuu

SEQ ID NO: 3842659 - RNA, 18 nt, Human
guuguacuuuggaauucu

SEQ ID NO: 3842660 - RNA, 20 nt, Human
guuguagaauguauuguacc

SEQ ID NO: 3842661 - RNA, 20 nt, Human
guuguagagaaaacaugcag

SEQ ID NO: 3842662 - RNA, 16 nt, Human
guuguagauacaauca

SEQ ID NO: 3842663 - RNA, 18 nt, Human
guuguagauacaaucagc

SEQ ID NO: 3842664 - RNA, 21 nt, Human
guuguagauacaaucagcugc

SEQ ID NO: 3842665 - RNA, 14 nt, Human
guuguaguaaagaa

SEQ ID NO: 3842666 - RNA, 12 nt, Human
guuguauaauuu

SEQ ID NO: 3842667 - RNA, 23 nt, Human
guuguauacuuccuuaugcuucu

SEQ ID NO: 3842668 - RNA, 14 nt, Human
guuguaugccuuua

SEQ ID NO: 3842669 - RNA, 16 nt, Human
guuguauuaacaaaag

SEQ ID NO: 3842670 - RNA, 14 nt, Human
guuguauucuuuga

SEQ ID NO: 3842671 - RNA, 23 nt, Human
guuguauuuuaacucauaccuuu

SEQ ID NO: 3842672 - RNA, 16 nt, Human
guugucaaagagaggg

SEQ ID NO: 3842673 - RNA, 14 nt, Human
guugucaagaauag

SEQ ID NO: 3842674 - RNA, 15 nt, Human
guugucaauauuaaa

SEQ ID NO: 3842675 - RNA, 19 nt, Human
guugucaauauuaaauaca

SEQ ID NO: 3842676 - RNA, 16 nt, Human
guugucaccagaucug

SEQ ID NO: 3842677 - RNA, 21 nt, Human
guugucacugcuuuuggccug

SEQ ID NO: 3842678 - RNA, 22 nt, Human
gauagcagccuggcuccccugg

SEQ ID NO: 3842679 - RNA, 13 nt, Human
gauagcauugcuu

SEQ ID NO: 3842680 - RNA, 14 nt, Human
gauagccuguggcc

SEQ ID NO: 3842681 - RNA, 20 nt, Human
gauagcuaacauuuuaaaua

SEQ ID NO: 3842682 - RNA, 23 nt, Human
gauagcuucaccccaaucccagc

SEQ ID NO: 3842683 - RNA, 17 nt, Human
gauaggaaggucauuuc

SEQ ID NO: 3842684 - RNA, 22 nt, Human
gauaggaaggucauuuccaugu

SEQ ID NO: 3842685 - RNA, 23 nt, Human
gauaggccugugggccagauugc

SEQ ID NO: 3842686 - RNA, 16 nt, Human
gauaggccuucuugug

SEQ ID NO: 3842687 - RNA, 14 nt, Human
gauaggcucugcac

SEQ ID NO: 3842688 - RNA, 20 nt, Human
gauaggcucugcacagaugg

SEQ ID NO: 3842689 - RNA, 15 nt, Human
gauaguaacaaugaa

SEQ ID NO: 3842690 - RNA, 17 nt, Human
gauaguacuaagcauuu

SEQ ID NO: 3842691 - RNA, 19 nt, Human
gauagugggauuuccagaa

SEQ ID NO: 3842692 - RNA, 23 nt, Human
gauaguggggagacuucuuggcu

SEQ ID NO: 3842693 - RNA, 20 nt, Human
gauagugucccacggugccu

SEQ ID NO: 3842694 - RNA, 17 nt, Human
gauaguuacuguuguga

SEQ ID NO: 3842695 - RNA, 15 nt, Human
gauaguugcuauuuu

SEQ ID NO: 3842696 - RNA, 22 nt, Human
gauaguuuucauccauaacuga

SEQ ID NO: 3842697 - RNA, 15 nt, Human
gauauaaauaaaaca

SEQ ID NO: 3842698 - RNA, 22 nt, Human
gauauaaauauauauaaauaua

SEQ ID NO: 3842699 - RNA, 16 nt, Human
gauauaacuuuagaaa

SEQ ID NO: 3842700 - RNA, 15 nt, Human
gauauaagugugugu

SEQ ID NO: 3842701 - RNA, 14 nt, Human
gauauaaucuuuca

SEQ ID NO: 3842702 - RNA, 21 nt, Human
gauauacagaugaaaauuuga

SEQ ID NO: 3842703 - RNA, 14 nt, Human
gauauacaugaaaa

SEQ ID NO: 3842704 - RNA, 16 nt, Human
gauauaccaaauuaaa

SEQ ID NO: 3842705 - RNA, 18 nt, Human
gauauacuuuuuucuuau

SEQ ID NO: 3842706 - RNA, 16 nt, Human
gauauagaacagugcu

SEQ ID NO: 3842707 - RNA, 15 nt, Human
gauauagaauugcaa

SEQ ID NO: 3842708 - RNA, 16 nt, Human
gauauagccagaaaaa

SEQ ID NO: 3842709 - RNA, 23 nt, Human
gauauaggucagugaggcccagg

SEQ ID NO: 3842710 - RNA, 24 nt, Human
gauauaguuuuacuuuuaaacugu

SEQ ID NO: 3842711 - RNA, 18 nt, Human
guuguggguucuauguuu

SEQ ID NO: 3842712 - RNA, 17 nt, Human
guuguggugcugacaaa

SEQ ID NO: 3842713 - RNA, 14 nt, Human
guugugguuaaucu

SEQ ID NO: 3842714 - RNA, 21 nt, Human
guuguguaagagaauguugaa

SEQ ID NO: 3842715 - RNA, 16 nt, Human
guuguguacucuggcc

SEQ ID NO: 3842716 - RNA, 12 nt, Human
guugugucuuuu

SEQ ID NO: 3842717 - RNA, 19 nt, Human
guuguuacuaacuaaacuc

SEQ ID NO: 3842718 - RNA, 14 nt, Human
guuguuagagaaaa

SEQ ID NO: 3842719 - RNA, 18 nt, Human
guuguucuguuaacugaa

SEQ ID NO: 3842720 - RNA, 19 nt, Human
guuguucuuggcaauaaau

SEQ ID NO: 3842721 - RNA, 21 nt, Human
guuguucuuggcaauaaauuu

SEQ ID NO: 3842722 - RNA, 10 nt, Human
guuguucuuu

SEQ ID NO: 3842723 - RNA, 15 nt, Human
guuguucuuucagaa

SEQ ID NO: 3842724 - RNA, 23 nt, Human
guuguucuuuucccccaaagugg

SEQ ID NO: 3842725 - RNA, 24 nt, Human
guuguuguuaaugaaaaugucaga

SEQ ID NO: 3842726 - RNA, 12 nt, Human
guuguuucagug

SEQ ID NO: 3842727 - RNA, 23 nt, Human
guuguuucagugaauaugccugu

SEQ ID NO: 3842728 - RNA, 14 nt, Human
guuguuucuguucc

SEQ ID NO: 3842729 - RNA, 17 nt, Human
guuguuucuguuccaaa

SEQ ID NO: 3842730 - RNA, 11 nt, Human
guuguuucuuu

SEQ ID NO: 3842731 - RNA, 14 nt, Human
guuguuucuuucua

SEQ ID NO: 3842732 - RNA, 23 nt, Human
guuguuugaaaauauuaucuuug

SEQ ID NO: 3842733 - RNA, 20 nt, Human
guuguuuguaaauaagagau

SEQ ID NO: 3842734 - RNA, 13 nt, Human
guuguuugugccu

SEQ ID NO: 3842735 - RNA, 12 nt, Human
guuguuuguuua

SEQ ID NO: 3842736 - RNA, 20 nt, Human
guuuaaaacuaguuagauuc

SEQ ID NO: 3842737 - RNA, 11 nt, Human
guuuaaaacuu

SEQ ID NO: 3842738 - RNA, 13 nt, Human
guuuaaaagaaaa

SEQ ID NO: 3842739 - RNA, 18 nt, Human
guuuaaaagaaaaaauga

SEQ ID NO: 3842740 - RNA, 19 nt, Human
guuuaaaagacacacuugu

SEQ ID NO: 3842741 - RNA, 22 nt, Human
guuuaaaauaaaaugaaaauug

SEQ ID NO: 3842742 - RNA, 13 nt, Human
guuuaaaauguaa

SEQ ID NO: 3842743 - RNA, 21 nt, Human
guuuaaaauguaauuuaaaug

SEQ ID NO: 3842744 - RNA, 21 nt, Human
guuuaaacugauucauaauaa

SEQ ID NO: 3842745 - RNA, 17 nt, Human
guuuaaacuucucugaa

SEQ ID NO: 3842746 - RNA, 23 nt, Human
guuuaaacuucucugaagggagg

SEQ ID NO: 3842747 - RNA, 15 nt, Human
guuuaaagagagguu

SEQ ID NO: 3842748 - RNA, 13 nt, Human
guuuaaaguucug

SEQ ID NO: 3842749 - RNA, 17 nt, Human
guuuaaaguucugugua

SEQ ID NO: 3842750 - RNA, 16 nt, Human
guuuaaauaaaguauc

SEQ ID NO: 3842751 - RNA, 19 nt, Human
guuuaaauaaaguaucaug

SEQ ID NO: 3842752 - RNA, 23 nt, Human
guuuaaauaaaguaucaugcauu

SEQ ID NO: 3842753 - RNA, 19 nt, Human
guuuaaaugaacaagagaa

SEQ ID NO: 3842754 - RNA, 22 nt, Human
guuuaacauuugccuugcagaa

SEQ ID NO: 3842755 - RNA, 23 nt, Human
guuuaaccaaaaagaccagacua

SEQ ID NO: 3842756 - RNA, 22 nt, Human
guuuaacggcacuguggccuug

SEQ ID NO: 3842757 - RNA, 22 nt, Human
guuuaacuuaaucaauuaauuu

SEQ ID NO: 3842758 - RNA, 21 nt, Human
guuuaagaaaaguauuuugaa

SEQ ID NO: 3842759 - RNA, 22 nt, Human
guuuaagaaaaguauuuugaag

SEQ ID NO: 3842760 - RNA, 21 nt, Human
guuuaagauuuaauuugccaa

SEQ ID NO: 3842761 - RNA, 12 nt, Human
guuuaaguguug

SEQ ID NO: 3842762 - RNA, 13 nt, Human
guuuaauauuaaa

SEQ ID NO: 3842763 - RNA, 15 nt, Human
guuuaauauuaaagc

SEQ ID NO: 3842764 - RNA, 12 nt, Human
guuuaauauuua

SEQ ID NO: 3842765 - RNA, 15 nt, Human
guuuaauauuuaaac

SEQ ID NO: 3842766 - RNA, 20 nt, Human
guuuaaucauaguuacugug

SEQ ID NO: 3842767 - RNA, 17 nt, Human
guuuaaucauauaaaua

SEQ ID NO: 3842768 - RNA, 12 nt, Human
guuuaaugguag

SEQ ID NO: 3842769 - RNA, 17 nt, Human
guuuaaugguaguuuua

SEQ ID NO: 3842770 - RNA, 23 nt, Human
guuuaauugaaagaauguaaagc

SEQ ID NO: 3842771 - RNA, 19 nt, Human
guuuaauuguuuguccuca

SEQ ID NO: 3842772 - RNA, 18 nt, Human
guuuaauuuuuauuucuu

SEQ ID NO: 3842773 - RNA, 18 nt, Human
guuuacaagcccccccuu

SEQ ID NO: 3842774 - RNA, 16 nt, Human
guuuacaaguguauau

SEQ ID NO: 3842775 - RNA, 15 nt, Human
guuuacaauuuacaa

SEQ ID NO: 3842776 - RNA, 19 nt, Human
guuuacaauuuacaaagug

SEQ ID NO: 3842777 - RNA, 15 nt, Human
guuuacacugucaaa

SEQ ID NO: 3842778 - RNA, 18 nt, Human
guuuacacugucaaacau

SEQ ID NO: 3842779 - RNA, 18 nt, Human
guuuacagaaaaaucuug

SEQ ID NO: 3842780 - RNA, 11 nt, Human
guuuacagaau

SEQ ID NO: 3842781 - RNA, 15 nt, Human
guuuacaguaaauaa

SEQ ID NO: 3842782 - RNA, 19 nt, Human
guuuacaguaaauaaauug

SEQ ID NO: 3842783 - RNA, 17 nt, Human
guuuacagugaagaaag

SEQ ID NO: 3842784 - RNA, 19 nt, Human
guuuacaugcuuauuccau

SEQ ID NO: 3842785 - RNA, 13 nt, Human
guuuacaugugua

SEQ ID NO: 3842786 - RNA, 17 nt, Human
guuuacauuuaaagcau

SEQ ID NO: 3842787 - RNA, 15 nt, Human
guuuacauuuuaugg

SEQ ID NO: 3842788 - RNA, 12 nt, Human
guuuacauuuuu

SEQ ID NO: 3842789 - RNA, 20 nt, Human
guuuacauuuuuauuuauga

SEQ ID NO: 3842790 - RNA, 15 nt, Human
guuuaccagaaagca

SEQ ID NO: 3842791 - RNA, 15 nt, Human
guuuaccaguugccu

SEQ ID NO: 3842792 - RNA, 18 nt, Human
guuuaccaguugccuuuu

SEQ ID NO: 3842793 - RNA, 16 nt, Human
guuuaccauuuuucau

SEQ ID NO: 3842794 - RNA, 16 nt, Human
guuuacccgguuucuu

SEQ ID NO: 3842795 - RNA, 20 nt, Human
guuuacuaugccugugucuu

SEQ ID NO: 3842796 - RNA, 22 nt, Human
guuuacuuaaagauuuaucaaa

SEQ ID NO: 3842797 - RNA, 16 nt, Human
guuuacuuguuucaga

SEQ ID NO: 3842798 - RNA, 15 nt, Human
guuuacuuucaaauc

SEQ ID NO: 3842799 - RNA, 16 nt, Human
guuuagaacacacaca

SEQ ID NO: 3842800 - RNA, 14 nt, Human
guuuagaagcugag

SEQ ID NO: 3842801 - RNA, 15 nt, Human
guuuagaagcugaga

SEQ ID NO: 3842802 - RNA, 16 nt, Human
guuuagaauugaaggu

SEQ ID NO: 3842803 - RNA, 15 nt, Human
guuuagaccaaggaa

SEQ ID NO: 3842804 - RNA, 20 nt, Human
guuuagauuuaugguuguua

SEQ ID NO: 3842805 - RNA, 12 nt, Human
guuuagccugga

SEQ ID NO: 3842806 - RNA, 13 nt, Human
guuuagcucugag

SEQ ID NO: 3842807 - RNA, 14 nt, Human
guuuagcugacaaa

SEQ ID NO: 3842808 - RNA, 20 nt, Human
guuuagcuggaaaaguaugu

SEQ ID NO: 3842809 - RNA, 21 nt, Human
guuuagcuggaaaaguauguu

SEQ ID NO: 3842810 - RNA, 19 nt, Human
guuuaggaacuacugagga

SEQ ID NO: 3842811 - RNA, 14 nt, Human
guuuaggcuauuug

SEQ ID NO: 3842812 - RNA, 23 nt, Human
guuuaggcuauuuguaaaucugc

SEQ ID NO: 3842813 - RNA, 21 nt, Human
guuuaggcugguggcccagga

SEQ ID NO: 3842814 - RNA, 15 nt, Human
guuuaggugaauuaa

SEQ ID NO: 3842815 - RNA, 19 nt, Human
guuuauaaaauauaaacaa

SEQ ID NO: 3842816 - RNA, 14 nt, Human
guuuauaaacagaa

SEQ ID NO: 3842817 - RNA, 13 nt, Human
guuuauaaaucuu

SEQ ID NO: 3842818 - RNA, 17 nt, Human
guuuauaacuauucagu

SEQ ID NO: 3842819 - RNA, 19 nt, Human
guuuauaacuauucaguug

SEQ ID NO: 3842820 - RNA, 13 nt, Human
guuuauaauaaaa

SEQ ID NO: 3842821 - RNA, 15 nt, Human
guuuauacacugugu

SEQ ID NO: 3842822 - RNA, 15 nt, Human
guuuauacaguacag

SEQ ID NO: 3842823 - RNA, 15 nt, Human
guuuauaccuuugcc

SEQ ID NO: 3842824 - RNA, 19 nt, Human
guuuauaucuccuuuguau

SEQ ID NO: 3842825 - RNA, 21 nt, Human
guuuauauggaagaaaguaag

SEQ ID NO: 3842826 - RNA, 15 nt, Human
guuuaucagauacau

SEQ ID NO: 3842827 - RNA, 18 nt, Human
guuuaucagauacaucac

SEQ ID NO: 3842828 - RNA, 21 nt, Human
guuuaucagauacaucacugc

SEQ ID NO: 3842829 - RNA, 14 nt, Human
guuuaucauucaag

SEQ ID NO: 3842830 - RNA, 16 nt, Human
guuuaucauucaagug

SEQ ID NO: 3842831 - RNA, 17 nt, Human
guuuaucccuuaagaau

SEQ ID NO: 3842832 - RNA, 22 nt, Human
guuuaucgcccuggcaggcagg

SEQ ID NO: 3842833 - RNA, 17 nt, Human
guuuaucuagauguaaa

SEQ ID NO: 3842834 - RNA, 18 nt, Human
guuuaugagaugcugguu

SEQ ID NO: 3842835 - RNA, 14 nt, Human
guuuaugauuccac

SEQ ID NO: 3842836 - RNA, 23 nt, Human
guuuauggccacauuuaauaucu

SEQ ID NO: 3842837 - RNA, 20 nt, Human
guuuauguaaacaaaucuuu

SEQ ID NO: 3842838 - RNA, 15 nt, Human
guuuauguaauuuca

SEQ ID NO: 3842839 - RNA, 19 nt, Human
guuuaugucccuucacaua

SEQ ID NO: 3842840 - RNA, 15 nt, Human
guuuaugucuaaaga

SEQ ID NO: 3842841 - RNA, 22 nt, Human
guuuauguuccauuaaacgauu

SEQ ID NO: 3842842 - RNA, 23 nt, Human
guuuauguuuugguccacuuuuc

SEQ ID NO: 3842843 - RNA, 15 nt, Human
gaucagccugggcaa

SEQ ID NO: 3842844 - RNA, 16 nt, Human
gaucagcguggccuug

SEQ ID NO: 3842845 - RNA, 17 nt, Human
gaucagcguggccuugu

SEQ ID NO: 3842846 - RNA, 23 nt, Human
gaucagcuuauugucuagugaaa

SEQ ID NO: 3842847 - RNA, 17 nt, Human
gaucaggaagagaagga

SEQ ID NO: 3842848 - RNA, 15 nt, Human
gaucaggcacagguc

SEQ ID NO: 3842849 - RNA, 15 nt, Human
gaucaggcucccagg

SEQ ID NO: 3842850 - RNA, 14 nt, Human
gaucagguggggag

SEQ ID NO: 3842851 - RNA, 23 nt, Human
gaucaguccuuugaucaguauaa

SEQ ID NO: 3842852 - RNA, 22 nt, Human
gaucagucugauucccaagcuc

SEQ ID NO: 3842853 - RNA, 21 nt, Human
gaucaguuaagaaauuucaca

SEQ ID NO: 3842854 - RNA, 19 nt, Human
gaucauaagugaauuuaua

SEQ ID NO: 3842855 - RNA, 16 nt, Human
gaucauagauuucuga

SEQ ID NO: 3842856 - RNA, 20 nt, Human
guuuuucuauuaaaagacuc

SEQ ID NO: 3842857 - RNA, 18 nt, Human
guuuuucugugugucagu

SEQ ID NO: 3842858 - RNA, 17 nt, Human
guuuuugaaacagaacc

SEQ ID NO: 3842859 - RNA, 14 nt, Human
guuuuugagauauu

SEQ ID NO: 3842860 - RNA, 16 nt, Human
guuuuugagauauuaa

SEQ ID NO: 3842861 - RNA, 19 nt, Human
guuuuugauagcauuguaa

SEQ ID NO: 3842862 - RNA, 16 nt, Human
guuuuuguaaagugug

SEQ ID NO: 3842863 - RNA, 14 nt, Human
guuuuuguaaauua

SEQ ID NO: 3842864 - RNA, 23 nt, Human
guuuuuguucuuaauugcacucu

SEQ ID NO: 3842865 - RNA, 17 nt, Human
guuuuuguuuuguugca

SEQ ID NO: 3842866 - RNA, 19 nt, Human
guuuuuuaagauaguguaa

SEQ ID NO: 3842867 - RNA, 16 nt, Human
guuuuuuagaucaaau

SEQ ID NO: 3842868 - RNA, 16 nt, Human
guuuuuuaguugaauu

SEQ ID NO: 3842869 - RNA, 22 nt, Human
guuuuuucaucuucaguugucu

SEQ ID NO: 3842870 - RNA, 20 nt, Human
guuuuuuccucagugcauuu

SEQ ID NO: 3842871 - RNA, 16 nt, Human
guuuuuuccuuugcuc

SEQ ID NO: 3842872 - RNA, 21 nt, Human
guuuuuucuuccuuuucacug

SEQ ID NO: 3842873 - RNA, 9 nt, Human
guuuuuuga

SEQ ID NO: 3842874 - RNA, 17 nt, Human
guuuuuugaaguguugg

SEQ ID NO: 3842875 - RNA, 14 nt, Human
guuuuuuguaccaa

SEQ ID NO: 3842876 - RNA, 18 nt, Human
guuuuuuguucuugcgau

SEQ ID NO: 3842877 - RNA, 16 nt, Human
guuuuuuuccuguuuc

SEQ ID NO: 3842878 - RNA, 14 nt, Human
guuuuuuucuaaua

SEQ ID NO: 3842879 - RNA, 12 nt, Human
guuuuuuucuau

SEQ ID NO: 3842880 - RNA, 19 nt, Human
guuuuuuuguauaguaaag

SEQ ID NO: 3842881 - RNA, 15 nt, Human
guuuuuuuuuaaaga

SEQ ID NO: 3842882 - RNA, 23 nt, Human
guuuuuuuuuauacacuguaaug

SEQ ID NO: 3842883 - RNA, 19 nt, Human
guuuuuuuuuccuguccuu

SEQ ID NO: 3842884 - RNA, 17 nt, Human
guuuuuuuuuucuuguc

SEQ ID NO: 3842885 - RNA, 21 nt, Human
guuuuuuuuuucuugucuaua

SEQ ID NO: 3842886 - RNA, 16 nt, Human
guuuuuuuuuuuaaaa

SEQ ID NO: 3842887 - RNA, 20 nt, Human
guuuuuuuuuuuuuuaugug

SEQ ID NO: 3842888 - RNA, 21 nt, Human
guuacagaaaguggugcucag

SEQ ID NO: 3842889 - RNA, 13 nt, Human
guuacagacaaag

SEQ ID NO: 3842890 - RNA, 17 nt, Human
guuacagagaccuaugu

SEQ ID NO: 3842891 - RNA, 18 nt, Human
guuacagccuguuaguaa

SEQ ID NO: 3842892 - RNA, 21 nt, Human
guuacagccuguuaguaacau

SEQ ID NO: 3842893 - RNA, 21 nt, Human
guuacagcgagaggcagagaa

SEQ ID NO: 3842894 - RNA, 22 nt, Human
guuacaggcaccgagaauguug

SEQ ID NO: 3842895 - RNA, 16 nt, Human
guuacaguaaugucau

SEQ ID NO: 3842896 - RNA, 18 nt, Human
guuacauaagauaaaugu

SEQ ID NO: 3842897 - RNA, 17 nt, Human
guuacaucacaguguuu

SEQ ID NO: 3842898 - RNA, 13 nt, Human
guuacauuaaugu

SEQ ID NO: 3842899 - RNA, 23 nt, Human
guuacauugcuggucuuguaaga

SEQ ID NO: 3842900 - RNA, 13 nt, Human
guuaccauucaca

SEQ ID NO: 3842901 - RNA, 20 nt, Human
guuaccauuggaaauuucac

SEQ ID NO: 3842902 - RNA, 16 nt, Human
guuacccaaauuaaga

SEQ ID NO: 3842903 - RNA, 20 nt, Human
guuacccaggguggagugca

SEQ ID NO: 3842904 - RNA, 17 nt, Human
guuacccuccuguaaau

SEQ ID NO: 3842905 - RNA, 16 nt, Human
guuaccgccugucucu

SEQ ID NO: 3842906 - RNA, 20 nt, Human
guuaccuaaaguauuuuuau

SEQ ID NO: 3842907 - RNA, 15 nt, Human
guuaccuccuauaaa

SEQ ID NO: 3842908 - RNA, 21 nt, Human
guuaccucuauauaccaaagc

SEQ ID NO: 3842909 - RNA, 13 nt, Human
guuaccuguagau

SEQ ID NO: 3842910 - RNA, 23 nt, Human
guuaccuuucuaggucaaggccu

SEQ ID NO: 3842911 - RNA, 23 nt, Human
guuacgcacacguacuuaaauga

SEQ ID NO: 3842912 - RNA, 18 nt, Human
guuacguagccuaaggcu

SEQ ID NO: 3842913 - RNA, 13 nt, Human
guuacucagcccu

SEQ ID NO: 3842914 - RNA, 14 nt, Human
guuacucagggcuc

SEQ ID NO: 3842915 - RNA, 18 nt, Human
guuacucuccaaccugga

SEQ ID NO: 3842916 - RNA, 22 nt, Human
guuacucuccaaccuggacaac

SEQ ID NO: 3842917 - RNA, 11 nt, Human
guuacucucuu

SEQ ID NO: 3842918 - RNA, 15 nt, Human
guuacucucuugcac

SEQ ID NO: 3842919 - RNA, 21 nt, Human
guuacucucuugcaccaaauu

SEQ ID NO: 3842920 - RNA, 14 nt, Human
guuacucugguucu

SEQ ID NO: 3842921 - RNA, 18 nt, Human
guuacugaucaugcauug

SEQ ID NO: 3842922 - RNA, 22 nt, Human
guuacuggauuuguuguucuuu

SEQ ID NO: 3842923 - RNA, 9 nt, Human
guuacuguu

SEQ ID NO: 3842924 - RNA, 13 nt, Human
guuacuguucuug

SEQ ID NO: 3842925 - RNA, 14 nt, Human
guuacuguucuugc

SEQ ID NO: 3842926 - RNA, 15 nt, Human
guuacuguucuugcu

SEQ ID NO: 3842927 - RNA, 16 nt, Human
guuacuguucuugcug

SEQ ID NO: 3842928 - RNA, 22 nt, Human
guuacuguucuugcugcuagaa

SEQ ID NO: 3842929 - RNA, 23 nt, Human
guuacuucacuuuaauucucaug

SEQ ID NO: 3842930 - RNA, 14 nt, Human
guuacuucucuaau

SEQ ID NO: 3842931 - RNA, 14 nt, Human
guuacuucugaggu

SEQ ID NO: 3842932 - RNA, 16 nt, Human
guuacuugaaauacca

SEQ ID NO: 3842933 - RNA, 19 nt, Human
guuacuugaaauaccagug

SEQ ID NO: 3842934 - RNA, 20 nt, Human
guuacuuuccaauucuccuu

SEQ ID NO: 3842935 - RNA, 18 nt, Human
guuacuuucuuaauguga

SEQ ID NO: 3842936 - RNA, 17 nt, Human
guuacuuuuccuugcau

SEQ ID NO: 3842937 - RNA, 14 nt, Human
guuagaaugaggag

SEQ ID NO: 3842938 - RNA, 15 nt, Human
guuagaaugaggagg

SEQ ID NO: 3842939 - RNA, 15 nt, Human
guuagaauguaaggu

SEQ ID NO: 3842940 - RNA, 22 nt, Human
guuagaccgcucucuuuucugu

SEQ ID NO: 3842941 - RNA, 22 nt, Human
guuagacugacuuguuugucuu

SEQ ID NO: 3842942 - RNA, 20 nt, Human
guuagagaacuaaacuaguu

SEQ ID NO: 3842943 - RNA, 15 nt, Human
guuagagaauaaauu

SEQ ID NO: 3842944 - RNA, 20 nt, Human
guuagagacuuuuuucuagu

SEQ ID NO: 3842945 - RNA, 22 nt, Human
guuagagagggaccauguguca

SEQ ID NO: 3842946 - RNA, 17 nt, Human
guuagaggaaaaauauu

SEQ ID NO: 3842947 - RNA, 14 nt, Human
guuagagggaacag

SEQ ID NO: 3842948 - RNA, 22 nt, Human
guuagaguccaacguggggcag

SEQ ID NO: 3842949 - RNA, 21 nt, Human
guuagauuuuguauucagggg

SEQ ID NO: 3842950 - RNA, 15 nt, Human
guuagcaaacuuugu

SEQ ID NO: 3842951 - RNA, 11 nt, Human
guuagcugagc

SEQ ID NO: 3842952 - RNA, 21 nt, Human
guuaggaaauaaaaccuuuca

SEQ ID NO: 3842953 - RNA, 23 nt, Human
guuaggaaauaaaaccuuucaaa

SEQ ID NO: 3842954 - RNA, 15 nt, Human
guuaggaaugagaag

SEQ ID NO: 3842955 - RNA, 20 nt, Human
guuaggagugggugacaaga

SEQ ID NO: 3842956 - RNA, 18 nt, Human
guuaggcauuaauguuuc

SEQ ID NO: 3842957 - RNA, 20 nt, Human
guuaggcauugugggaaggg

SEQ ID NO: 3842958 - RNA, 16 nt, Human
guuaggcugggcccag

SEQ ID NO: 3842959 - RNA, 15 nt, Human
guuagggaaaacauu

SEQ ID NO: 3842960 - RNA, 14 nt, Human
guuagggaagagaa

SEQ ID NO: 3842961 - RNA, 11 nt, Human
guuagggaggg

SEQ ID NO: 3842962 - RNA, 13 nt, Human
guuagggaggggu

SEQ ID NO: 3842963 - RNA, 22 nt, Human
guuaggggccuuagggcacugg

SEQ ID NO: 3842964 - RNA, 13 nt, Human
guuaguaaucugu

SEQ ID NO: 3842965 - RNA, 17 nt, Human
guuaguaaucuguauaa

SEQ ID NO: 3842966 - RNA, 16 nt, Human
guuaguagcauguuga

SEQ ID NO: 3842967 - RNA, 17 nt, Human
guuaguaucuaacaugu

SEQ ID NO: 3842968 - RNA, 22 nt, Human
guuagucauuugcugagcaugu

SEQ ID NO: 3842969 - RNA, 22 nt, Human
guuagucgugagcucuugugag

SEQ ID NO: 3842970 - RNA, 16 nt, Human
guuagucuacucuuaa

SEQ ID NO: 3842971 - RNA, 17 nt, Human
guuaguuaccuuauagu

SEQ ID NO: 3842972 - RNA, 13 nt, Human
guuaguucccaac

SEQ ID NO: 3842973 - RNA, 22 nt, Human
guuaguuucuccaagcaggaca

SEQ ID NO: 3842974 - RNA, 17 nt, Human
guuaguuuguauauauu

SEQ ID NO: 3842975 - RNA, 14 nt, Human
guuaguuuuuacuu

SEQ ID NO: 3842976 - RNA, 15 nt, Human
guuauaaaaaauggu

SEQ ID NO: 3842977 - RNA, 16 nt, Human
guuauaaaaaaugguu

SEQ ID NO: 3842978 - RNA, 14 nt, Human
guuauaaaagugau

SEQ ID NO: 3842979 - RNA, 16 nt, Human
guuauaaaagugauug

SEQ ID NO: 3842980 - RNA, 11 nt, Human
guuauaaaauu

SEQ ID NO: 3842981 - RNA, 15 nt, Human
guuauaaagauacag

SEQ ID NO: 3842982 - RNA, 14 nt, Human
guuauaacuuaaug

SEQ ID NO: 3842983 - RNA, 17 nt, Human
guuauaaugaaugacuu

SEQ ID NO: 3842984 - RNA, 12 nt, Human
guuauaauuuuu

SEQ ID NO: 3842985 - RNA, 23 nt, Human
guuauaauuuuuuuuaaaauaga

SEQ ID NO: 3842986 - RNA, 20 nt, Human
guuauacaaccuucauuuaa

SEQ ID NO: 3842987 - RNA, 17 nt, Human
guuauacaguuauaaaa

SEQ ID NO: 3842988 - RNA, 18 nt, Human
guuauacaugacacugaa

SEQ ID NO: 3842989 - RNA, 20 nt, Human
guuauacaugacacugaaau

SEQ ID NO: 3842990 - RNA, 19 nt, Human
guuauacugucgguuuuuu

SEQ ID NO: 3842991 - RNA, 16 nt, Human
guuauagugcaauaua

SEQ ID NO: 3842992 - RNA, 13 nt, Human
guuauauaaagag

SEQ ID NO: 3842993 - RNA, 14 nt, Human
guuauauaaagaga

SEQ ID NO: 3842994 - RNA, 22 nt, Human
guuauauaaagagaaaauugaa

SEQ ID NO: 3842995 - RNA, 23 nt, Human
guuauauaaagagaaaauugaau

SEQ ID NO: 3842996 - RNA, 13 nt, Human
guuauauaaaugg

SEQ ID NO: 3842997 - RNA, 22 nt, Human
guuauauauggggaugguaguu

SEQ ID NO: 3842998 - RNA, 16 nt, Human
guuauaucauauguau

SEQ ID NO: 3842999 - RNA, 14 nt, Human
guuauaugaauaua

SEQ ID NO: 3843000 - RNA, 19 nt, Human
guuauauugaaaaaauaga

SEQ ID NO: 3843001 - RNA, 20 nt, Human
guuccuguucaguaauaaaa

SEQ ID NO: 3843002 - RNA, 15 nt, Human
guuccuucugggcau

SEQ ID NO: 3843003 - RNA, 18 nt, Human
guuccuuggccaugcaga

SEQ ID NO: 3843004 - RNA, 13 nt, Human
guuccuuucuuuu

SEQ ID NO: 3843005 - RNA, 14 nt, Human
guuccuuuuuauga

SEQ ID NO: 3843006 - RNA, 16 nt, Human
guucgagaccagccug

SEQ ID NO: 3843007 - RNA, 17 nt, Human
guucgagaccagccugg

SEQ ID NO: 3843008 - RNA, 19 nt, Human
guucgagaccagccuggcc

SEQ ID NO: 3843009 - RNA, 16 nt, Human
guucgagaccagucug

SEQ ID NO: 3843010 - RNA, 19 nt, Human
guucgagaccagucuggcc

SEQ ID NO: 3843011 - RNA, 13 nt, Human
guucgcagccacc

SEQ ID NO: 3843012 - RNA, 19 nt, Human
guucgcagccacccugagg

SEQ ID NO: 3843013 - RNA, 14 nt, Human
guucgcauggucac

SEQ ID NO: 3843014 - RNA, 20 nt, Human
guucgcauggucacacacug

SEQ ID NO: 3843015 - RNA, 16 nt, Human
guucgggugugcaaug

SEQ ID NO: 3843016 - RNA, 17 nt, Human
guucgguuuuuuuccug

SEQ ID NO: 3843017 - RNA, 19 nt, Human
guucgguuuuuuuccuguu

SEQ ID NO: 3843018 - RNA, 22 nt, Human
guucuaaaaucuuauuuuucaa

SEQ ID NO: 3843019 - RNA, 23 nt, Human
guucuaaagauggaaaaaccacc

SEQ ID NO: 3843020 - RNA, 16 nt, Human
guucuaaaguucuaag

SEQ ID NO: 3843021 - RNA, 18 nt, Human
guucuaaaguucuaagau

SEQ ID NO: 3843022 - RNA, 19 nt, Human
guucuaaaguucuaagauu

SEQ ID NO: 3843023 - RNA, 21 nt, Human
guucuaaaguucuaagauucu

SEQ ID NO: 3843024 - RNA, 15 nt, Human
guucuaagacucaaa

SEQ ID NO: 3843025 - RNA, 21 nt, Human
guucuaagacucaaauguucu

SEQ ID NO: 3843026 - RNA, 21 nt, Human
guucuaagaugugauauucua

SEQ ID NO: 3843027 - RNA, 15 nt, Human
guucuaagauucuaa

SEQ ID NO: 3843028 - RNA, 20 nt, Human
guucuaagauucuaaugaug

SEQ ID NO: 3843029 - RNA, 11 nt, Human
guucuaaggcc

SEQ ID NO: 3843030 - RNA, 21 nt, Human
guucuaaggccuaggauucua

SEQ ID NO: 3843031 - RNA, 11 nt, Human
guucuaaggcu

SEQ ID NO: 3843032 - RNA, 14 nt, Human
guucuaaggcucug

SEQ ID NO: 3843033 - RNA, 14 nt, Human
guucuaagggggag

SEQ ID NO: 3843034 - RNA, 22 nt, Human
guucuaaguuucuaagauucua

SEQ ID NO: 3843035 - RNA, 17 nt, Human
guucuaauaauuucuaa

SEQ ID NO: 3843036 - RNA, 18 nt, Human
guucuaauuuuggaugga

SEQ ID NO: 3843037 - RNA, 15 nt, Human
guucuacaaucuauu

SEQ ID NO: 3843038 - RNA, 16 nt, Human
guucuacacucaucuu

SEQ ID NO: 3843039 - RNA, 21 nt, Human
guucuagaaaaacaggcacuu

SEQ ID NO: 3843040 - RNA, 22 nt, Human
guucuagacauggagguucuaa

SEQ ID NO: 3843041 - RNA, 23 nt, Human
guucuagacauggagguucuaag

SEQ ID NO: 3843042 - RNA, 23 nt, Human
guucuagcacuucaucuggcugc

SEQ ID NO: 3843043 - RNA, 22 nt, Human
guucuagcauggcauauuuuuc

SEQ ID NO: 3843044 - RNA, 19 nt, Human
guucuagcauggcugccaa

SEQ ID NO: 3843045 - RNA, 22 nt, Human
guucuaggcacuguaguucuaa

SEQ ID NO: 3843046 - RNA, 16 nt, Human
guucuagguuucaaag

SEQ ID NO: 3843047 - RNA, 19 nt, Human
guucuagguuucaaagaug

SEQ ID NO: 3843048 - RNA, 14 nt, Human
guucuagucucucu

SEQ ID NO: 3843049 - RNA, 17 nt, Human
guucuaguguuuucaau

SEQ ID NO: 3843050 - RNA, 14 nt, Human
guucuaguugcuug

SEQ ID NO: 3843051 - RNA, 13 nt, Human
guucuaguuuuca

SEQ ID NO: 3843052 - RNA, 14 nt, Human
guucuaguuuucag

SEQ ID NO: 3843053 - RNA, 15 nt, Human
guucuaguuuucagu

SEQ ID NO: 3843054 - RNA, 14 nt, Human
guucuauccaaaca

SEQ ID NO: 3843055 - RNA, 16 nt, Human
guucuaugguuaugaa

SEQ ID NO: 3843056 - RNA, 20 nt, Human
guucuaugguuaugaaagaa

SEQ ID NO: 3843057 - RNA, 15 nt, Human
guucuauuuaaugga

SEQ ID NO: 3843058 - RNA, 11 nt, Human
uaaaacuaaga

SEQ ID NO: 3843059 - RNA, 16 nt, Human
uaaaacucacugugau

SEQ ID NO: 3843060 - RNA, 20 nt, Human
uaaaacugaagucugaaauu

SEQ ID NO: 3843061 - RNA, 13 nt, Human
uaaaacugaauug

SEQ ID NO: 3843062 - RNA, 14 nt, Human
uaaaacugauguga

SEQ ID NO: 3843063 - RNA, 10 nt, Human
uaaaacugcg

SEQ ID NO: 3843064 - RNA, 13 nt, Human
uaaaacugcuuuu

SEQ ID NO: 3843065 - RNA, 21 nt, Human
uaaaacugcuuuuuuuuuucc

SEQ ID NO: 3843066 - RNA, 18 nt, Human
uaaaacuggcuuuggcuu

SEQ ID NO: 3843067 - RNA, 20 nt, Human
uaaaacugggccuguagcuc

SEQ ID NO: 3843068 - RNA, 13 nt, Human
uaaaacuguacuu

SEQ ID NO: 3843069 - RNA, 14 nt, Human
uaaaacuguacuuu

SEQ ID NO: 3843070 - RNA, 15 nt, Human
uaaaacuguacuuug

SEQ ID NO: 3843071 - RNA, 17 nt, Human
uaaaacuguacuuugau

SEQ ID NO: 3843072 - RNA, 16 nt, Human
uaaaacugucacuguu

SEQ ID NO: 3843073 - RNA, 17 nt, Human
uaaaacuguuaaagucu

SEQ ID NO: 3843074 - RNA, 15 nt, Human
uaaaacuucuuaaau

SEQ ID NO: 3843075 - RNA, 19 nt, Human
uaaaacuucuuaaauaucu

SEQ ID NO: 3843076 - RNA, 20 nt, Human
uaaaacuucuuaaauaucuu

SEQ ID NO: 3843077 - RNA, 21 nt, Human
uaaaacuucuuaaauaucuuu

SEQ ID NO: 3843078 - RNA, 22 nt, Human
uaaaacuugauguguuaucucu

SEQ ID NO: 3843079 - RNA, 17 nt, Human
uaaaacuuuauuuuaua

SEQ ID NO: 3843080 - RNA, 14 nt, Human
uaaaacuuugcugc

SEQ ID NO: 3843081 - RNA, 12 nt, Human
uaaaacuuuuua

SEQ ID NO: 3843082 - RNA, 15 nt, Human
uaaaacuuuuuaaaa

SEQ ID NO: 3843083 - RNA, 13 nt, Human
uaaaacuuuuuau

SEQ ID NO: 3843084 - RNA, 23 nt, Human
uaaaagaaaaagaaaaaaaaagu

SEQ ID NO: 3843085 - RNA, 12 nt, Human
uaaaagaaaauu

SEQ ID NO: 3843086 - RNA, 17 nt, Human
uaaaagaaacccugcac

SEQ ID NO: 3843087 - RNA, 17 nt, Human
uaaaagaaacuuucuuu

SEQ ID NO: 3843088 - RNA, 14 nt, Human
uaaaagaaauaaac

SEQ ID NO: 3843089 - RNA, 15 nt, Human
uaaaagaaauuuauu

SEQ ID NO: 3843090 - RNA, 18 nt, Human
uaaaagaacaguaaacau

SEQ ID NO: 3843091 - RNA, 21 nt, Human
uaaaagaagaaauaguucugu

SEQ ID NO: 3843092 - RNA, 15 nt, Human
uaaaagacaagacuu

SEQ ID NO: 3843093 - RNA, 12 nt, Human
uaaaagacucau

SEQ ID NO: 3843094 - RNA, 13 nt, Human
uaaaagacucauc

SEQ ID NO: 3843095 - RNA, 14 nt, Human
uaaaagacucaucc

SEQ ID NO: 3843096 - RNA, 13 nt, Human
uaaaagacuuuuu

SEQ ID NO: 3843097 - RNA, 19 nt, Human
uaaaagagacaaacuguaa

SEQ ID NO: 3843098 - RNA, 19 nt, Human
uaaaagagagagagagaaa

SEQ ID NO: 3843099 - RNA, 20 nt, Human
uaaaagauacaguuacucag

SEQ ID NO: 3843100 - RNA, 13 nt, Human
uaaaagauauaag

SEQ ID NO: 3843101 - RNA, 18 nt, Human
uaaaagauauaagugcug

SEQ ID NO: 3843102 - RNA, 13 nt, Human
uaaaagaucgcag

SEQ ID NO: 3843103 - RNA, 23 nt, Human
uaaaagaucuucaaaaguaaugc

SEQ ID NO: 3843104 - RNA, 14 nt, Human
uaaaagaugaaaau

SEQ ID NO: 3843105 - RNA, 12 nt, Human
uaaaagaugcuu

SEQ ID NO: 3843106 - RNA, 22 nt, Human
uaaaagauggggucuguaaaau

SEQ ID NO: 3843107 - RNA, 13 nt, Human
uaaaagauucacc

SEQ ID NO: 3843108 - RNA, 12 nt, Human
uaaaagcaaaaa

SEQ ID NO: 3843109 - RNA, 13 nt, Human
uaaaagcaaaaua

SEQ ID NO: 3843110 - RNA, 16 nt, Human
uaaaagcaacaucagc

SEQ ID NO: 3843111 - RNA, 18 nt, Human
uaaaagcaacaucagcuu

SEQ ID NO: 3843112 - RNA, 18 nt, Human
uaaaagcagcauaaagaa

SEQ ID NO: 3843113 - RNA, 21 nt, Human
uaaaagcagcauaaagaauuu

SEQ ID NO: 3843114 - RNA, 17 nt, Human
uaaaagcaggcuucuau

SEQ ID NO: 3843115 - RNA, 18 nt, Human
uaaaagcauaaaugcaaa

SEQ ID NO: 3843116 - RNA, 15 nt, Human
uaaaagcauuuugua

SEQ ID NO: 3843117 - RNA, 13 nt, Human
uaaaagccacaua

SEQ ID NO: 3843118 - RNA, 15 nt, Human
uaaaagccacauaga

SEQ ID NO: 3843119 - RNA, 16 nt, Human
uaaaagcccaggagcc

SEQ ID NO: 3843120 - RNA, 19 nt, Human
uaaaagcccaggagcccau

SEQ ID NO: 3843121 - RNA, 12 nt, Human
uaaaagccugcu

SEQ ID NO: 3843122 - RNA, 14 nt, Human
uaaaaggaagccaa

SEQ ID NO: 3843123 - RNA, 18 nt, Human
uaaaaggaagcuuacaug

SEQ ID NO: 3843124 - RNA, 12 nt, Human
uaaaaggcccag

SEQ ID NO: 3843125 - RNA, 14 nt, Human
uaaaaggcccagag

SEQ ID NO: 3843126 - RNA, 18 nt, Human
uaaaaggcuugaagcugu

SEQ ID NO: 3843127 - RNA, 21 nt, Human
uaaaagggacugagaaauuua

SEQ ID NO: 3843128 - RNA, 19 nt, Human
uaaaagggauuacccaagc

SEQ ID NO: 3843129 - RNA, 20 nt, Human
uaaaagggcucuuuagccag

SEQ ID NO: 3843130 - RNA, 14 nt, Human
uaaaaguaaacauu

SEQ ID NO: 3843131 - RNA, 22 nt, Human
uaaaagucacaauguucuuuau

SEQ ID NO: 3843132 - RNA, 23 nt, Human
uaaaagucacaauguucuuuaua

SEQ ID NO: 3843133 - RNA, 21 nt, Human
uaaaagucauuuaacugaaga

SEQ ID NO: 3843134 - RNA, 19 nt, Human
uaaaagugaaugaaagauu

SEQ ID NO: 3843135 - RNA, 15 nt, Human
uaaaagugaucuaca

SEQ ID NO: 3843136 - RNA, 22 nt, Human
uaaaagugggcuugauucugca

SEQ ID NO: 3843137 - RNA, 14 nt, Human
uaaaagugugagca

SEQ ID NO: 3843138 - RNA, 17 nt, Human
uaaaaguuauuaauauu

SEQ ID NO: 3843139 - RNA, 21 nt, Human
uaaaaguucauaacagugcca

SEQ ID NO: 3843140 - RNA, 17 nt, Human
uaaaaguugcauuuuaa

SEQ ID NO: 3843141 - RNA, 13 nt, Human
uaaaaguuucaau

SEQ ID NO: 3843142 - RNA, 15 nt, Human
uaaaaguuucaaugu

SEQ ID NO: 3843143 - RNA, 19 nt, Human
uaaaaguuucaaugugauu

SEQ ID NO: 3843144 - RNA, 20 nt, Human
uaaaaguuugaaaagcaaua

SEQ ID NO: 3843145 - RNA, 22 nt, Human
uaaaaguuuuuuauuaugcauu

SEQ ID NO: 3843146 - RNA, 21 nt, Human
uaaaauaaaaauucugaaugu

SEQ ID NO: 3843147 - RNA, 20 nt, Human
gcaaauuucaaaagacaugu

SEQ ID NO: 3843148 - RNA, 14 nt, Human
gcaacaaaauacau

SEQ ID NO: 3843149 - RNA, 23 nt, Human
gcaacaaacugcacaugauuuca

SEQ ID NO: 3843150 - RNA, 21 nt, Human
gcaacaacaauugguaaaacu

SEQ ID NO: 3843151 - RNA, 22 nt, Human
gcaacaacaauugguaaaacuc

SEQ ID NO: 3843152 - RNA, 23 nt, Human
gcaacaauucucccgggacucug

SEQ ID NO: 3843153 - RNA, 16 nt, Human
gcaacaauuuucagau

SEQ ID NO: 3843154 - RNA, 17 nt, Human
gcaacacaagcuggaag

SEQ ID NO: 3843155 - RNA, 12 nt, Human
gcaacacacaga

SEQ ID NO: 3843156 - RNA, 14 nt, Human
gcaacacacaugcu

SEQ ID NO: 3843157 - RNA, 16 nt, Human
gcaacacagaggaauu

SEQ ID NO: 3843158 - RNA, 15 nt, Human
gcaacacagccuggg

SEQ ID NO: 3843159 - RNA, 16 nt, Human
gcaacacagccugggc

SEQ ID NO: 3843160 - RNA, 15 nt, Human
gcaacagaaaaaugg

SEQ ID NO: 3843161 - RNA, 13 nt, Human
gcaacagacaagu

SEQ ID NO: 3843162 - RNA, 15 nt, Human
gcaacagaucaguaa

SEQ ID NO: 3843163 - RNA, 17 nt, Human
gcaacagaucuggaacc

SEQ ID NO: 3843164 - RNA, 19 nt, Human
gcaacagcaaaucacgacc

SEQ ID NO: 3843165 - RNA, 21 nt, Human
gcaacaggaaucaagagcugc

SEQ ID NO: 3843166 - RNA, 13 nt, Human
gcaacagguuuua

SEQ ID NO: 3843167 - RNA, 14 nt, Human
gcaacaugaugagg

SEQ ID NO: 3843168 - RNA, 16 nt, Human
gcaacaugaugaggua

SEQ ID NO: 3843169 - RNA, 21 nt, Human
gcaacauuguucaccuuugua

SEQ ID NO: 3843170 - RNA, 23 nt, Human
gcaacauuuacaguccuucaaaa

SEQ ID NO: 3843171 - RNA, 15 nt, Human
gcaaccaaacuccca

SEQ ID NO: 3843172 - RNA, 18 nt, Human
gcaaccaccaccaaccac

SEQ ID NO: 3843173 - RNA, 14 nt, Human
gcaaccacuaagaa

SEQ ID NO: 3843174 - RNA, 16 nt, Human
gcaaccagagcacugu

SEQ ID NO: 3843175 - RNA, 17 nt, Human
gcaaccagagcacugua

SEQ ID NO: 3843176 - RNA, 17 nt, Human
gcaaccagggagcugca

SEQ ID NO: 3843177 - RNA, 23 nt, Human
gcaaccagggagcugcaggggca

SEQ ID NO: 3843178 - RNA, 16 nt, Human
gcaaccaguuggcuag

SEQ ID NO: 3843179 - RNA, 16 nt, Human
gcaacccaaggacuga

SEQ ID NO: 3843180 - RNA, 22 nt, Human
gcaaccccaguucugcuccucu

SEQ ID NO: 3843181 - RNA, 15 nt, Human
gcaacccccagccug

SEQ ID NO: 3843182 - RNA, 17 nt, Human
gcaacccccagccugcu

SEQ ID NO: 3843183 - RNA, 21 nt, Human
gcaaccccuggaccccagccu

SEQ ID NO: 3843184 - RNA, 22 nt, Human
gcaaccccuggaccccagccuc

SEQ ID NO: 3843185 - RNA, 22 nt, Human
gcaacccgugccaaguccaggu

SEQ ID NO: 3843186 - RNA, 12 nt, Human
gcaacccuccua

SEQ ID NO: 3843187 - RNA, 22 nt, Human
gcaacccuggugaccagcacca

SEQ ID NO: 3843188 - RNA, 19 nt, Human
gcaaccuaccuguugagca

SEQ ID NO: 3843189 - RNA, 12 nt, Human
gcaaccucccaa

SEQ ID NO: 3843190 - RNA, 16 nt, Human
gcaaccucuuggccug

SEQ ID NO: 3843191 - RNA, 23 nt, Human
gcaaccucuuggccugaucagac

SEQ ID NO: 3843192 - RNA, 20 nt, Human
gcaaccuucgccaccugggu

SEQ ID NO: 3843193 - RNA, 16 nt, Human
gcaacgaucacaaaug

SEQ ID NO: 3843194 - RNA, 23 nt, Human
gcaacgaucacaaaugacuuuau

SEQ ID NO: 3843195 - RNA, 22 nt, Human
gcaacgccgugggcugcguccu

SEQ ID NO: 3843196 - RNA, 22 nt, Human
gcaacuacccaaaacaagccug

SEQ ID NO: 3843197 - RNA, 23 nt, Human
gcaacuaucagacuaagccagca

SEQ ID NO: 3843198 - RNA, 13 nt, Human
gcaacugaggcag

SEQ ID NO: 3843199 - RNA, 18 nt, Human
gcaacuguuaugaaauaa

SEQ ID NO: 3843200 - RNA, 14 nt, Human
gcaacuucuucucc

SEQ ID NO: 3843201 - RNA, 18 nt, Human
gcaacuucuucuccaucc

SEQ ID NO: 3843202 - RNA, 15 nt, Human
gcaacuugaaauuau

SEQ ID NO: 3843203 - RNA, 19 nt, Human
gcaacuuguccuagcacag

SEQ ID NO: 3843204 - RNA, 22 nt, Human
gcaacuuguccuagcacagaug

SEQ ID NO: 3843205 - RNA, 19 nt, Human
gcaacuugucuuuuucugg

SEQ ID NO: 3843206 - RNA, 23 nt, Human
gcaacuuucuggggccuaauaaa

SEQ ID NO: 3843207 - RNA, 20 nt, Human
gcaacuuuuguguaaugaaa

SEQ ID NO: 3843208 - RNA, 19 nt, Human
gcaagaaaaaaaaaugcca

SEQ ID NO: 3843209 - RNA, 17 nt, Human
gcaagaaagaaacccga

SEQ ID NO: 3843210 - RNA, 16 nt, Human
gcaagaacucaucacu

SEQ ID NO: 3843211 - RNA, 21 nt, Human
gcaagaagaucacgcuccccg

SEQ ID NO: 3843212 - RNA, 14 nt, Human
gcaagaaggaauug

SEQ ID NO: 3843213 - RNA, 17 nt, Human
gcaagaauugaagcagg

SEQ ID NO: 3843214 - RNA, 14 nt, Human
gcaagacgcugugc

SEQ ID NO: 3843215 - RNA, 18 nt, Human
gcaagacuguugcucaaa

SEQ ID NO: 3843216 - RNA, 13 nt, Human
gcaagagagaacc

SEQ ID NO: 3843217 - RNA, 14 nt, Human
gcaagagagauguu

SEQ ID NO: 3843218 - RNA, 17 nt, Human
gcaagagagauguuuug

SEQ ID NO: 3843219 - RNA, 22 nt, Human
gcaagagauauuuugggcaugu

SEQ ID NO: 3843220 - RNA, 13 nt, Human
gcaagagccuugg

SEQ ID NO: 3843221 - RNA, 23 nt, Human
gcaagagccuugguguccaccug

SEQ ID NO: 3843222 - RNA, 20 nt, Human
gcaagaggggguggaggggu

SEQ ID NO: 3843223 - RNA, 23 nt, Human
gcaagaggggguggaggggugug

SEQ ID NO: 3843224 - RNA, 13 nt, Human
gcaagauauuuau

SEQ ID NO: 3843225 - RNA, 19 nt, Human
gcaagauggcacagggcau

SEQ ID NO: 3843226 - RNA, 22 nt, Human
gcaagauggcacagggcaugaa

SEQ ID NO: 3843227 - RNA, 23 nt, Human
gcaagauggggagugagaggcug

SEQ ID NO: 3843228 - RNA, 21 nt, Human
gcaagaugugaauuauugaca

SEQ ID NO: 3843229 - RNA, 21 nt, Human
gcaagcaacuugcaggcucca

SEQ ID NO: 3843230 - RNA, 22 nt, Human
gcaagcaacuugcaggcuccau

SEQ ID NO: 3843231 - RNA, 20 nt, Human
gcaagcaauccuagguaggg

SEQ ID NO: 3843232 - RNA, 17 nt, Human
gcaagcaccauccccuc

SEQ ID NO: 3843233 - RNA, 15 nt, Human
gcaagcaccuccugc

SEQ ID NO: 3843234 - RNA, 16 nt, Human
gcaagcaccuccugcc

SEQ ID NO: 3843235 - RNA, 13 nt, Human
gcaagcagaggac

SEQ ID NO: 3843236 - RNA, 16 nt, Human
gcaagcagaggaccag

SEQ ID NO: 3843237 - RNA, 22 nt, Human
gcaagcaguuucaauaaaguuu

SEQ ID NO: 3843238 - RNA, 11 nt, Human
gcaagcaugcu

SEQ ID NO: 3843239 - RNA, 20 nt, Human
gcaagccaggcucacucaca

SEQ ID NO: 3843240 - RNA, 16 nt, Human
gcaagccccucuuucu

SEQ ID NO: 3843241 - RNA, 15 nt, Human
gcaagcccuguugac

SEQ ID NO: 3843242 - RNA, 23 nt, Human
gcaagcccuguugacacaggucu

SEQ ID NO: 3843243 - RNA, 24 nt, Human
gcaagccugcguucuugugacaga

SEQ ID NO: 3843244 - RNA, 19 nt, Human
gcaagcuagaaccuggagg

SEQ ID NO: 3843245 - RNA, 17 nt, Human
gcaagcugaaauuuuag

SEQ ID NO: 3843246 - RNA, 17 nt, Human
gcaagcugauuaaauga

SEQ ID NO: 3843247 - RNA, 19 nt, Human
gcaagcugauuaaaugaca

SEQ ID NO: 3843248 - RNA, 12 nt, Human
gcaagcuggccu

SEQ ID NO: 3843249 - RNA, 14 nt, Human
gcaagcuggccucu

SEQ ID NO: 3843250 - RNA, 17 nt, Human
gcaagcuggcggcuggg

SEQ ID NO: 3843251 - RNA, 23 nt, Human
gcaagcuuaauggcugauaauuu

SEQ ID NO: 3843252 - RNA, 21 nt, Human
gcaagcuuggcuguagaagga

SEQ ID NO: 3843253 - RNA, 9 nt, Human
gcaaggaaa

SEQ ID NO: 3843254 - RNA, 16 nt, Human
gcaaggaaaaacaggu

SEQ ID NO: 3843255 - RNA, 19 nt, Human
gcaaggaaaaagaaaauaa

SEQ ID NO: 3843256 - RNA, 20 nt, Human
gcaaggaagguaaaaaguua

SEQ ID NO: 3843257 - RNA, 21 nt, Human
gcaaggacacagaugaaacac

SEQ ID NO: 3843258 - RNA, 21 nt, Human
gcaaggaccaggacucccucc

SEQ ID NO: 3843259 - RNA, 19 nt, Human
gcaaggaggcuggcugggg

SEQ ID NO: 3843260 - RNA, 14 nt, Human
gcaaggcaccugca

SEQ ID NO: 3843261 - RNA, 15 nt, Human
gcaaggcagccgugg

SEQ ID NO: 3843262 - RNA, 19 nt, Human
gcaaggcaggugccuccag

SEQ ID NO: 3843263 - RNA, 20 nt, Human
gcaaggcaggugccuccagg

SEQ ID NO: 3843264 - RNA, 14 nt, Human
gcaaggcccacagg

SEQ ID NO: 3843265 - RNA, 18 nt, Human
uaaaguuucaaaaaucug

SEQ ID NO: 3843266 - RNA, 24 nt, Human
uaaaguuucaaaaaucugaagauu

SEQ ID NO: 3843267 - RNA, 17 nt, Human
uaaaguuugcuuagaaa

SEQ ID NO: 3843268 - RNA, 20 nt, Human
uaaauaaaaaauaauaauac

SEQ ID NO: 3843269 - RNA, 16 nt, Human
uaaauaaaaagaaagg

SEQ ID NO: 3843270 - RNA, 17 nt, Human
uaaauaaaaagaaaggc

SEQ ID NO: 3843271 - RNA, 14 nt, Human
uaaauaaaacccuu

SEQ ID NO: 3843272 - RNA, 20 nt, Human
uaaauaaaagaaaugcacaa

SEQ ID NO: 3843273 - RNA, 19 nt, Human
uaaauaaaagcagcaucug

SEQ ID NO: 3843274 - RNA, 20 nt, Human
uaaauaaaagcagcaucugc

SEQ ID NO: 3843275 - RNA, 19 nt, Human
uaaauaaaagugaucaaua

SEQ ID NO: 3843276 - RNA, 11 nt, Human
uaaauaaaaua

SEQ ID NO: 3843277 - RNA, 12 nt, Human
uaaauaaaauaa

SEQ ID NO: 3843278 - RNA, 14 nt, Human
uaaauaaaauaacc

SEQ ID NO: 3843279 - RNA, 14 nt, Human
uaaauaaaaucaau

SEQ ID NO: 3843280 - RNA, 15 nt, Human
uaaauaaaaugacca

SEQ ID NO: 3843281 - RNA, 22 nt, Human
uaaauaaaaugcacaaaacuuu

SEQ ID NO: 3843282 - RNA, 21 nt, Human
uaaauaaaaugcuagguucua

SEQ ID NO: 3843283 - RNA, 22 nt, Human
uaaauaaaaugcuagguucuac

SEQ ID NO: 3843284 - RNA, 13 nt, Human
uaaauaaaauuug

SEQ ID NO: 3843285 - RNA, 18 nt, Human
uaaauaaacacauagauu

SEQ ID NO: 3843286 - RNA, 15 nt, Human
uaaauaaaccacugu

SEQ ID NO: 3843287 - RNA, 13 nt, Human
uaaauaaacccuu

SEQ ID NO: 3843288 - RNA, 20 nt, Human
uaaauaaacuguugcucguu

SEQ ID NO: 3843289 - RNA, 14 nt, Human
uaaauaaacuuuuu

SEQ ID NO: 3843290 - RNA, 15 nt, Human
uaaauaaacuuuuuu

SEQ ID NO: 3843291 - RNA, 22 nt, Human
gcaaggucuggccucagguggg

SEQ ID NO: 3843292 - RNA, 14 nt, Human
gcaaggugcucaca

SEQ ID NO: 3843293 - RNA, 18 nt, Human
gcaagguggaguggaugc

SEQ ID NO: 3843294 - RNA, 13 nt, Human
gcaagguuccaca

SEQ ID NO: 3843295 - RNA, 16 nt, Human
gcaagguuccacagag

SEQ ID NO: 3843296 - RNA, 17 nt, Human
gcaagguuccacagagu

SEQ ID NO: 3843297 - RNA, 23 nt, Human
gcaagguuccacagaguaagaca

SEQ ID NO: 3843298 - RNA, 22 nt, Human
gcaagguuuaggcugguggccc

SEQ ID NO: 3843299 - RNA, 14 nt, Human
gcaaguagauaaau

SEQ ID NO: 3843300 - RNA, 20 nt, Human
gcaaguauuagaauaccaca

SEQ ID NO: 3843301 - RNA, 18 nt, Human
gcaagucagaauagaaau

SEQ ID NO: 3843302 - RNA, 14 nt, Human
gcaagucauguaaa

SEQ ID NO: 3843303 - RNA, 15 nt, Human
gcaaguccuuuugua

SEQ ID NO: 3843304 - RNA, 11 nt, Human
gcaagucucuu

SEQ ID NO: 3843305 - RNA, 18 nt, Human
gcaagucugagggucugg

SEQ ID NO: 3843306 - RNA, 17 nt, Human
gcaagucuggaucuggg

SEQ ID NO: 3843307 - RNA, 22 nt, Human
gcaagugagcaaaccugcccca

SEQ ID NO: 3843308 - RNA, 20 nt, Human
gcaagugauugggacagagg

SEQ ID NO: 3843309 - RNA, 17 nt, Human
gcaagugucugugugca

SEQ ID NO: 3843310 - RNA, 13 nt, Human
gcaagugugaaua

SEQ ID NO: 3843311 - RNA, 16 nt, Human
gcaagugugaauacug

SEQ ID NO: 3843312 - RNA, 19 nt, Human
gcaagugugaauacugcuu

SEQ ID NO: 3843313 - RNA, 16 nt, Human
gcaaguucaauuuguu

SEQ ID NO: 3843314 - RNA, 19 nt, Human
gcaaguuuuccauauuuuu

SEQ ID NO: 3843315 - RNA, 19 nt, Human
gcaaguuuucccugaaguu

SEQ ID NO: 3843316 - RNA, 17 nt, Human
gcaauaaaagcccagga

SEQ ID NO: 3843317 - RNA, 18 nt, Human
gcaauaaaagcccaggag

SEQ ID NO: 3843318 - RNA, 16 nt, Human
gcaauaaaauuauuug

SEQ ID NO: 3843319 - RNA, 18 nt, Human
gcaauaaaauuauuugca

SEQ ID NO: 3843320 - RNA, 19 nt, Human
gcaauaaacgcauuaucag

SEQ ID NO: 3843321 - RNA, 16 nt, Human
gcaauaaaucugaccc

SEQ ID NO: 3843322 - RNA, 12 nt, Human
gcaauaaaugaa

SEQ ID NO: 3843323 - RNA, 13 nt, Human
gcaauaaauuuug

SEQ ID NO: 3843324 - RNA, 20 nt, Human
gcaauaaccucaaagugacu

SEQ ID NO: 3843325 - RNA, 15 nt, Human
gcaauaacuucugac

SEQ ID NO: 3843326 - RNA, 17 nt, Human
gcaauaacuucugaccu

SEQ ID NO: 3843327 - RNA, 14 nt, Human
gcaauaaugcagua

SEQ ID NO: 3843328 - RNA, 19 nt, Human
gcaauaaugcaguauggua

SEQ ID NO: 3843329 - RNA, 21 nt, Human
gcaauaauggucccauccagg

SEQ ID NO: 3843330 - RNA, 22 nt, Human
gcaauaauggucccauccaggc

SEQ ID NO: 3843331 - RNA, 17 nt, Human
gcaauacaaguuucauc

SEQ ID NO: 3843332 - RNA, 13 nt, Human
gcaauaccaagua

SEQ ID NO: 3843333 - RNA, 12 nt, Human
gcaauagaaaca

SEQ ID NO: 3843334 - RNA, 19 nt, Human
gcaauagaagugcuccccu

SEQ ID NO: 3843335 - RNA, 11 nt, Human
gcaauagagac

SEQ ID NO: 3843336 - RNA, 15 nt, Human
gcaauagagacugua

SEQ ID NO: 3843337 - RNA, 18 nt, Human
gcaauagucaaauugugu

SEQ ID NO: 3843338 - RNA, 22 nt, Human
gcaauagucaaauugugugaaa

SEQ ID NO: 3843339 - RNA, 20 nt, Human
gcaauaguguguucugauua

SEQ ID NO: 3843340 - RNA, 14 nt, Human
gcaauauagaaaca

SEQ ID NO: 3843341 - RNA, 23 nt, Human
gcaauauaucuaaauugaauaau

SEQ ID NO: 3843342 - RNA, 12 nt, Human
gcaauauauuuu

SEQ ID NO: 3843343 - RNA, 15 nt, Human
gcaauauauuuugua

SEQ ID NO: 3843344 - RNA, 17 nt, Human
gcaauauauuuuguaug

SEQ ID NO: 3843345 - RNA, 20 nt, Human
gcaauauauuuuguaugcaa

SEQ ID NO: 3843346 - RNA, 17 nt, Human
gcaauauucucuguaca

SEQ ID NO: 3843347 - RNA, 19 nt, Human
gcaauauucucuguacaua

SEQ ID NO: 3843348 - RNA, 22 nt, Human
gcaauauucucuguacauauua

SEQ ID NO: 3843349 - RNA, 22 nt, Human
gcaauauuuaaggagauguaag

SEQ ID NO: 3843350 - RNA, 17 nt, Human
gcaaucaaaucugcuuu

SEQ ID NO: 3843351 - RNA, 19 nt, Human
gcaaucaagguuauaauuu

SEQ ID NO: 3843352 - RNA, 14 nt, Human
gcaauccuccugag

SEQ ID NO: 3843353 - RNA, 15 nt, Human
gcaaugaaaaauucu

SEQ ID NO: 3843354 - RNA, 23 nt, Human
gcaaugaaaagucguuuuccaaa

SEQ ID NO: 3843355 - RNA, 23 nt, Human
gcaaugaaagguacuauauuugc

SEQ ID NO: 3843356 - RNA, 17 nt, Human
gcaaugaagucucugaa

SEQ ID NO: 3843357 - RNA, 20 nt, Human
gcaaugaccuuucaauagga

SEQ ID NO: 3843358 - RNA, 23 nt, Human
gcaaugaccuuucaauaggaaaa

SEQ ID NO: 3843359 - RNA, 17 nt, Human
gcaaugauguccagaag

SEQ ID NO: 3843360 - RNA, 14 nt, Human
gcaaugauuacucu

SEQ ID NO: 3843361 - RNA, 17 nt, Human
gcaaugccacagcccug

SEQ ID NO: 3843362 - RNA, 19 nt, Human
gcaaugccacagcccuguc

SEQ ID NO: 3843363 - RNA, 15 nt, Human
gcaaugccaucaucu

SEQ ID NO: 3843364 - RNA, 18 nt, Human
gcaaugccaucaucuccu

SEQ ID NO: 3843365 - RNA, 13 nt, Human
gcaaugcuggcug

SEQ ID NO: 3843366 - RNA, 14 nt, Human
gcaaugcuggcugu

SEQ ID NO: 3843367 - RNA, 13 nt, Human
gcaauguaaauau

SEQ ID NO: 3843368 - RNA, 23 nt, Human
gcaauguaaauauuuuaaagaau

SEQ ID NO: 3843369 - RNA, 15 nt, Human
gcaauguaucccuuc

SEQ ID NO: 3843370 - RNA, 22 nt, Human
gcaauguaucccuucucacagc

SEQ ID NO: 3843371 - RNA, 20 nt, Human
gcaaugucaggaacagaagg

SEQ ID NO: 3843372 - RNA, 19 nt, Human
gcaaugucugagugaaccu

SEQ ID NO: 3843373 - RNA, 17 nt, Human
gcaaugugaaaaaucug

SEQ ID NO: 3843374 - RNA, 16 nt, Human
gcaauguguguauaug

SEQ ID NO: 3843375 - RNA, 20 nt, Human
gcaauguuaauuuaguggaa

SEQ ID NO: 3843376 - RNA, 15 nt, Human
gcaauguuuugcuuu

SEQ ID NO: 3843377 - RNA, 22 nt, Human
gcaauuaaacuuccaaagaaag

SEQ ID NO: 3843378 - RNA, 14 nt, Human
gcaauuaugaaaau

SEQ ID NO: 3843379 - RNA, 14 nt, Human
gcaauucauaaaaa

SEQ ID NO: 3843380 - RNA, 11 nt, Human
gcaauuccaau

SEQ ID NO: 3843381 - RNA, 15 nt, Human
gcaauucuccugccu

SEQ ID NO: 3843382 - RNA, 19 nt, Human
gcaauucuccugccucagc

SEQ ID NO: 3843383 - RNA, 18 nt, Human
gcaauugaauuaaauuag

SEQ ID NO: 3843384 - RNA, 13 nt, Human
gcaauugccuuuu

SEQ ID NO: 3843385 - RNA, 14 nt, Human
gcaauugggauggc

SEQ ID NO: 3843386 - RNA, 22 nt, Human
gcaauugucuauuuaucuuuua

SEQ ID NO: 3843387 - RNA, 13 nt, Human
gcaauuuaaaugu

SEQ ID NO: 3843388 - RNA, 19 nt, Human
gcaauuuaacuagacacag

SEQ ID NO: 3843389 - RNA, 19 nt, Human
gcaauuuauacaauaucau

SEQ ID NO: 3843390 - RNA, 18 nt, Human
gcaauuucaagguucuaa

SEQ ID NO: 3843391 - RNA, 23 nt, Human
gcaauuuuauaaggacuuccuga

SEQ ID NO: 3843392 - RNA, 10 nt, Human
gcaauuuucc

SEQ ID NO: 3843393 - RNA, 13 nt, Human
gcaauuuuccuug

SEQ ID NO: 3843394 - RNA, 15 nt, Human
gcaauuuuccuugaa

SEQ ID NO: 3843395 - RNA, 20 nt, Human
gcacaaaaugauggcagugg

SEQ ID NO: 3843396 - RNA, 23 nt, Human
gcacaaaauucgaccugauuuac

SEQ ID NO: 3843397 - RNA, 14 nt, Human
gcacaaacagaggc

SEQ ID NO: 3843398 - RNA, 15 nt, Human
gcacaaacagaggcc

SEQ ID NO: 3843399 - RNA, 16 nt, Human
gcacaaacagaggccg

SEQ ID NO: 3843400 - RNA, 22 nt, Human
gcacaaacuuuaggguaaaaau

SEQ ID NO: 3843401 - RNA, 18 nt, Human
gcacaaagacccuggcuu

SEQ ID NO: 3843402 - RNA, 16 nt, Human
gcacaaagggcccaga

SEQ ID NO: 3843403 - RNA, 14 nt, Human
gcacaaauauuuau

SEQ ID NO: 3843404 - RNA, 16 nt, Human
gcacaaauauuuauuu

SEQ ID NO: 3843405 - RNA, 19 nt, Human
gcacaaauuaguuauauau

SEQ ID NO: 3843406 - RNA, 18 nt, Human
gcacaaccuucaagcugc

SEQ ID NO: 3843407 - RNA, 11 nt, Human
gcacaagaagc

SEQ ID NO: 3843408 - RNA, 18 nt, Human
gcacaagaaucacuugaa

SEQ ID NO: 3843409 - RNA, 12 nt, Human
gcacaagacuga

SEQ ID NO: 3843410 - RNA, 20 nt, Human
gcacaagacugacgccaggg

SEQ ID NO: 3843411 - RNA, 21 nt, Human
gcacaagcagagugcacagcu

SEQ ID NO: 3843412 - RNA, 22 nt, Human
gcacaagccacaagucuuccag

SEQ ID NO: 3843413 - RNA, 13 nt, Human
gcacaagccaggg

SEQ ID NO: 3843414 - RNA, 17 nt, Human
gcacaagccagggugug

SEQ ID NO: 3843415 - RNA, 23 nt, Human
gcacaagcuccaagcucccaggc

SEQ ID NO: 3843416 - RNA, 22 nt, Human
gcacaagcugcacccucaggca

SEQ ID NO: 3843417 - RNA, 17 nt, Human
gcacaaguguaaugaau

SEQ ID NO: 3843418 - RNA, 11 nt, Human
gcacaauaaau

SEQ ID NO: 3843419 - RNA, 19 nt, Human
gcacaauaacuccucccag

SEQ ID NO: 3843420 - RNA, 15 nt, Human
gcacaauaguaaccu

SEQ ID NO: 3843421 - RNA, 17 nt, Human
gcacaauauugaacuuu

SEQ ID NO: 3843422 - RNA, 19 nt, Human
gcacaauauugaacuuuuu

SEQ ID NO: 3843423 - RNA, 22 nt, Human
gcacaaucucggcucacugcau

SEQ ID NO: 3843424 - RNA, 16 nt, Human
gcacaauucuguuuua

SEQ ID NO: 3843425 - RNA, 14 nt, Human
gcacaauuugcacu

SEQ ID NO: 3843426 - RNA, 19 nt, Human
gcacaauuugcacuaaauc

SEQ ID NO: 3843427 - RNA, 12 nt, Human
gcacacacacac

SEQ ID NO: 3843428 - RNA, 21 nt, Human
gcacacacacacacacacauc

SEQ ID NO: 3843429 - RNA, 19 nt, Human
gcacacacacacacaggag

SEQ ID NO: 3843430 - RNA, 15 nt, Human
gcacacacacacaua

SEQ ID NO: 3843431 - RNA, 16 nt, Human
gcacacaccucagagg

SEQ ID NO: 3843432 - RNA, 15 nt, Human
guuuggggagcagag

SEQ ID NO: 3843433 - RNA, 20 nt, Human
guuuggggagcagagacacu

SEQ ID NO: 3843434 - RNA, 18 nt, Human
guuuggggaugagaaagg

SEQ ID NO: 3843435 - RNA, 18 nt, Human
guuuggggcaagucaugu

SEQ ID NO: 3843436 - RNA, 12 nt, Human
uaaggugcaguu

SEQ ID NO: 3843437 - RNA, 13 nt, Human
uaaggugccuucu

SEQ ID NO: 3843438 - RNA, 21 nt, Human
uaagguuaucuacuuuuacuc

SEQ ID NO: 3843439 - RNA, 21 nt, Human
uaagguuauuuauuuaaaugu

SEQ ID NO: 3843440 - RNA, 22 nt, Human
uaagguuucguuucuguauaca

SEQ ID NO: 3843441 - RNA, 16 nt, Human
uaaguaaaaccacagc

SEQ ID NO: 3843442 - RNA, 18 nt, Human
uaaguaaaucucuucugu

SEQ ID NO: 3843443 - RNA, 22 nt, Human
uaaguaaaucucuucuguguuu

SEQ ID NO: 3843444 - RNA, 20 nt, Human
uaaguaacuucacauuaaaa

SEQ ID NO: 3843445 - RNA, 13 nt, Human
uaaguaagaaaau

SEQ ID NO: 3843446 - RNA, 20 nt, Human
uaaguaagaaaauauuuugu

SEQ ID NO: 3843447 - RNA, 20 nt, Human
uaaguaaucaauaaagaaaa

SEQ ID NO: 3843448 - RNA, 20 nt, Human
uaaguaaugauaacuggaaa

SEQ ID NO: 3843449 - RNA, 22 nt, Human
uaaguaauguggaagaaaaugg

SEQ ID NO: 3843450 - RNA, 13 nt, Human
uaaguacagagaa

SEQ ID NO: 3843451 - RNA, 18 nt, Human
uaaguacagagaagccau

SEQ ID NO: 3843452 - RNA, 22 nt, Human
uaaguacagagaagccaucacc

SEQ ID NO: 3843453 - RNA, 19 nt, Human
uaaguacuacacauuuuua

SEQ ID NO: 3843454 - RNA, 14 nt, Human
uaaguacuguguac

SEQ ID NO: 3843455 - RNA, 16 nt, Human
uaaguacuguuuacca

SEQ ID NO: 3843456 - RNA, 15 nt, Human
uaaguagauaagcag

SEQ ID NO: 3843457 - RNA, 16 nt, Human
uaaguauaaaauacaa

SEQ ID NO: 3843458 - RNA, 14 nt, Human
uaaguauacaguuc

SEQ ID NO: 3843459 - RNA, 20 nt, Human
uaaguauacaguucaauaaa

SEQ ID NO: 3843460 - RNA, 15 nt, Human
uaaguauaucaugua

SEQ ID NO: 3843461 - RNA, 22 nt, Human
uaaguauaucauguaaagaaau

SEQ ID NO: 3843462 - RNA, 17 nt, Human
uaaguaucaaguauaga

SEQ ID NO: 3843463 - RNA, 20 nt, Human
uaaguaucaaguauagaaaa

SEQ ID NO: 3843464 - RNA, 16 nt, Human
uaaguauucaagaaag

SEQ ID NO: 3843465 - RNA, 21 nt, Human
uaaguauucuuauuuaaugaa

SEQ ID NO: 3843466 - RNA, 19 nt, Human
uaaguauugcaucuguaua

SEQ ID NO: 3843467 - RNA, 20 nt, Human
uaaguauuuagguuuuuguu

SEQ ID NO: 3843468 - RNA, 13 nt, Human
uaaguauuuauau

SEQ ID NO: 3843469 - RNA, 18 nt, Human
uaaguauuuauauauuua

SEQ ID NO: 3843470 - RNA, 23 nt, Human
uaaguauuuauauauuuauaacu

SEQ ID NO: 3843471 - RNA, 15 nt, Human
uaagucaaccugccu

SEQ ID NO: 3843472 - RNA, 17 nt, Human
uaagucaaccugccuga

SEQ ID NO: 3843473 - RNA, 16 nt, Human
uaagucaacuuagcau

SEQ ID NO: 3843474 - RNA, 23 nt, Human
uaagucagaaacuaaaacaaaua

SEQ ID NO: 3843475 - RNA, 14 nt, Human
uaagucagaacagc

SEQ ID NO: 3843476 - RNA, 19 nt, Human
uaagucaguauggucuaac

SEQ ID NO: 3843477 - RNA, 18 nt, Human
uaagucauguauguuucu

SEQ ID NO: 3843478 - RNA, 13 nt, Human
uaagucccuguca

SEQ ID NO: 3843479 - RNA, 15 nt, Human
uaaguccuacuuuua

SEQ ID NO: 3843480 - RNA, 20 nt, Human
uaaguccuacuuuuaaagaa

SEQ ID NO: 3843481 - RNA, 21 nt, Human
uaagucuaucugguauuaaau

SEQ ID NO: 3843482 - RNA, 22 nt, Human
uaagucuaucugguauuaaaug

SEQ ID NO: 3843483 - RNA, 11 nt, Human
uaagucucugu

SEQ ID NO: 3843484 - RNA, 19 nt, Human
uaagucucuuuuuuacaaa

SEQ ID NO: 3843485 - RNA, 20 nt, Human
uaagucucuuuuuuacaaag

SEQ ID NO: 3843486 - RNA, 21 nt, Human
uaagucucuuuuuuacaaagg

SEQ ID NO: 3843487 - RNA, 19 nt, Human
uaagucuguuuuaugacuu

SEQ ID NO: 3843488 - RNA, 17 nt, Human
uaagucuugccuauauu

SEQ ID NO: 3843489 - RNA, 13 nt, Human
uaagugaaauuua

SEQ ID NO: 3843490 - RNA, 14 nt, Human
uaagugaauuuaua

SEQ ID NO: 3843491 - RNA, 15 nt, Human
uaagugagagagaca

SEQ ID NO: 3843492 - RNA, 23 nt, Human
uaagugaggaugaaaaaauaaca

SEQ ID NO: 3843493 - RNA, 18 nt, Human
uaagugauuuuuuugucc

SEQ ID NO: 3843494 - RNA, 19 nt, Human
uaagugcacacagaaauau

SEQ ID NO: 3843495 - RNA, 22 nt, Human
uaagugcacacagaaauauaua

SEQ ID NO: 3843496 - RNA, 15 nt, Human
uaagugcccucuccc

SEQ ID NO: 3843497 - RNA, 21 nt, Human
uaagugcccucucccacccuc

SEQ ID NO: 3843498 - RNA, 15 nt, Human
uaagugccuacauua

SEQ ID NO: 3843499 - RNA, 21 nt, Human
uaaagccugcuuuuuaagugu

SEQ ID NO: 3843500 - RNA, 17 nt, Human
uaaagcgauauacagau

SEQ ID NO: 3843501 - RNA, 21 nt, Human
uaaagcguuugcacagaucaa

SEQ ID NO: 3843502 - RNA, 15 nt, Human
uaaagcuaaaauaac

SEQ ID NO: 3843503 - RNA, 19 nt, Human
uaaagcuacugauuuccuu

SEQ ID NO: 3843504 - RNA, 14 nt, Human
uaaagcugaaaacu

SEQ ID NO: 3843505 - RNA, 21 nt, Human
uaaagcugccuguaguuagga

SEQ ID NO: 3843506 - RNA, 22 nt, Human
uaaagcuuacucuguccauuua

SEQ ID NO: 3843507 - RNA, 19 nt, Human
uaaagcuugcaacaaaauu

SEQ ID NO: 3843508 - RNA, 17 nt, Human
uaaaggaaaagacacau

SEQ ID NO: 3843509 - RNA, 20 nt, Human
uaaaggaagcacucuguaua

SEQ ID NO: 3843510 - RNA, 14 nt, Human
uaaaggacuguaau

SEQ ID NO: 3843511 - RNA, 22 nt, Human
uaaaggagaaggcaugaaauug

SEQ ID NO: 3843512 - RNA, 17 nt, Human
uaaaggaguuuauguuc

SEQ ID NO: 3843513 - RNA, 14 nt, Human
uaaaggauaaagaa

SEQ ID NO: 3843514 - RNA, 16 nt, Human
uaaaggcaaaggcaau

SEQ ID NO: 3843515 - RNA, 15 nt, Human
uaaaggcagcuguug

SEQ ID NO: 3843516 - RNA, 14 nt, Human
uaaaggcaguuuuc

SEQ ID NO: 3843517 - RNA, 17 nt, Human
uaaaggcaguuuucuaa

SEQ ID NO: 3843518 - RNA, 16 nt, Human
uaaaggcccagccccu

SEQ ID NO: 3843519 - RNA, 21 nt, Human
uaaaggcccuaucuguuuaca

SEQ ID NO: 3843520 - RNA, 20 nt, Human
uaaaggccucugccucacaa

SEQ ID NO: 3843521 - RNA, 20 nt, Human
uaaaggccucuuccuugcug

SEQ ID NO: 3843522 - RNA, 21 nt, Human
uaaaggcuaccuuuguauucu

SEQ ID NO: 3843523 - RNA, 18 nt, Human
uaaaggcucgauuuugua

SEQ ID NO: 3843524 - RNA, 17 nt, Human
uaaagggaagaaaacac

SEQ ID NO: 3843525 - RNA, 23 nt, Human
uaaagggaagaaaacacuguuau

SEQ ID NO: 3843526 - RNA, 18 nt, Human
uaaagggcccaaugaauu

SEQ ID NO: 3843527 - RNA, 14 nt, Human
uaaagggccugccu

SEQ ID NO: 3843528 - RNA, 22 nt, Human
uaaaggggagaccucagaagua

SEQ ID NO: 3843529 - RNA, 14 nt, Human
uaaaggggggaggg

SEQ ID NO: 3843530 - RNA, 18 nt, Human
uaaaggggucugaaauuu

SEQ ID NO: 3843531 - RNA, 19 nt, Human
uaaagguccacaggucuag

SEQ ID NO: 3843532 - RNA, 21 nt, Human
uaaagguccacaggucuagac

SEQ ID NO: 3843533 - RNA, 14 nt, Human
uaaagguguauuua

SEQ ID NO: 3843534 - RNA, 22 nt, Human
uaaagguuacaagccugcacaa

SEQ ID NO: 3843535 - RNA, 20 nt, Human
uaaagguuaccgauuucaaa

SEQ ID NO: 3843536 - RNA, 21 nt, Human
uaaaguaaaaagggaauuaug

SEQ ID NO: 3843537 - RNA, 14 nt, Human
uaaaguaaagcuaa

SEQ ID NO: 3843538 - RNA, 20 nt, Human
uaaaguaauuguuccagaga

SEQ ID NO: 3843539 - RNA, 19 nt, Human
uaaaguacugagcagugau

SEQ ID NO: 3843540 - RNA, 22 nt, Human
uaaaguacugagcagugauauu

SEQ ID NO: 3843541 - RNA, 15 nt, Human
uaaaguacuugagug

SEQ ID NO: 3843542 - RNA, 21 nt, Human
uaaaguaguaaaagaagaaau

SEQ ID NO: 3843543 - RNA, 18 nt, Human
uaaaguauagagagaagu

SEQ ID NO: 3843544 - RNA, 17 nt, Human
uaaaguauauauuuauu

SEQ ID NO: 3843545 - RNA, 16 nt, Human
uaaaguaucaugcauu

SEQ ID NO: 3843546 - RNA, 17 nt, Human
uaaaguaucaugcauuc

SEQ ID NO: 3843547 - RNA, 15 nt, Human
uaaaguaugaaucua

SEQ ID NO: 3843548 - RNA, 19 nt, Human
uaaaguaugaaucuaugcc

SEQ ID NO: 3843549 - RNA, 21 nt, Human
uaaaguaugcauuauuaaauu

SEQ ID NO: 3843550 - RNA, 13 nt, Human
uaaaguauguaaa

SEQ ID NO: 3843551 - RNA, 15 nt, Human
uaaaguauguaaaca

SEQ ID NO: 3843552 - RNA, 16 nt, Human
uaaaguauguaaacag

SEQ ID NO: 3843553 - RNA, 14 nt, Human
uaaaguauucuucu

SEQ ID NO: 3843554 - RNA, 14 nt, Human
uaaaguauuuaauu

SEQ ID NO: 3843555 - RNA, 21 nt, Human
uaaaguauuuaauuagugcua

SEQ ID NO: 3843556 - RNA, 13 nt, Human
uaaagucagaugg

SEQ ID NO: 3843557 - RNA, 15 nt, Human
uaaagucagauggaa

SEQ ID NO: 3843558 - RNA, 13 nt, Human
uaaagucccaggu

SEQ ID NO: 3843559 - RNA, 16 nt, Human
uaaagucuauggacag

SEQ ID NO: 3843560 - RNA, 21 nt, Human
uaaagucuguugauuaaagau

SEQ ID NO: 3843561 - RNA, 19 nt, Human
uaaagucuugcuguggucu

SEQ ID NO: 3843562 - RNA, 16 nt, Human
uaaagugaagaauccu

SEQ ID NO: 3843563 - RNA, 14 nt, Human
uaaagugaauuguu

SEQ ID NO: 3843564 - RNA, 17 nt, Human
uaaagugacccugcucu

SEQ ID NO: 3843565 - RNA, 18 nt, Human
uaaagugagaaaacugug

SEQ ID NO: 3843566 - RNA, 20 nt, Human
uaaagugagcucuaugggca

SEQ ID NO: 3843567 - RNA, 11 nt, Human
uaaagugauua

SEQ ID NO: 3843568 - RNA, 22 nt, Human
uaaagugauuaaacgugcagac

SEQ ID NO: 3843569 - RNA, 17 nt, Human
uaaagugcuaagguucu

SEQ ID NO: 3843570 - RNA, 15 nt, Human
uaaagugcuugugua

SEQ ID NO: 3843571 - RNA, 17 nt, Human
uaaagugcuuguguaau

SEQ ID NO: 3843572 - RNA, 21 nt, Human
uaaaguggguuauucuggagu

SEQ ID NO: 3843573 - RNA, 12 nt, Human
uaaaguguaaua

SEQ ID NO: 3843574 - RNA, 18 nt, Human
uaaaguguaauaauauga

SEQ ID NO: 3843575 - RNA, 13 nt, Human
uaaaguguauuau

SEQ ID NO: 3843576 - RNA, 14 nt, Human
uaaaguguauuuuu

SEQ ID NO: 3843577 - RNA, 19 nt, Human
uaaaguguauuuuuuuacu

SEQ ID NO: 3843578 - RNA, 17 nt, Human
uaaaguguccauugaca

SEQ ID NO: 3843579 - RNA, 18 nt, Human
uaaaguguccauugacau

SEQ ID NO: 3843580 - RNA, 22 nt, Human
uaaaucaugaugcuagccagca

SEQ ID NO: 3843581 - RNA, 22 nt, Human
uaaaucauguuaauccuagcug

SEQ ID NO: 3843582 - RNA, 16 nt, Human
uaaaucauguugauca

SEQ ID NO: 3843583 - RNA, 12 nt, Human
uaaaucauuuua

SEQ ID NO: 3843584 - RNA, 15 nt, Human
uaaaucauuuuaugu

SEQ ID NO: 3843585 - RNA, 14 nt, Human
uaaauccauuugga

SEQ ID NO: 3843586 - RNA, 19 nt, Human
uaaauccauuuggaaaucu

SEQ ID NO: 3843587 - RNA, 23 nt, Human
uaaauccauuuggaaaucuuuaa

SEQ ID NO: 3843588 - RNA, 23 nt, Human
uaaaucccauuauucaaaguugc

SEQ ID NO: 3843589 - RNA, 23 nt, Human
uaaaucccauucauaacuuucau

SEQ ID NO: 3843590 - RNA, 16 nt, Human
uaaauccugaagagca

SEQ ID NO: 3843591 - RNA, 14 nt, Human
uaaauccuguugaa

SEQ ID NO: 3843592 - RNA, 15 nt, Human
uaaauccuguugaaa

SEQ ID NO: 3843593 - RNA, 17 nt, Human
uaaauccuguugaaaag

SEQ ID NO: 3843594 - RNA, 23 nt, Human
uaaauccuguugaaaagccaugu

SEQ ID NO: 3843595 - RNA, 17 nt, Human
uaaauccuuuuucuuua

SEQ ID NO: 3843596 - RNA, 13 nt, Human
uaaaucuacacac

SEQ ID NO: 3843597 - RNA, 21 nt, Human
uaaaucuaguauacauugucu

SEQ ID NO: 3843598 - RNA, 16 nt, Human
uaaaucuauuuauuaa

SEQ ID NO: 3843599 - RNA, 19 nt, Human
uaaaucuccaaaauaaaac

SEQ ID NO: 3843600 - RNA, 16 nt, Human
uaaaucuccuauuuuu

SEQ ID NO: 3843601 - RNA, 15 nt, Human
uaaaucucuaauaug

SEQ ID NO: 3843602 - RNA, 14 nt, Human
uaaaucucuucugu

SEQ ID NO: 3843603 - RNA, 21 nt, Human
uaaaucuguccaacugagaag

SEQ ID NO: 3843604 - RNA, 17 nt, Human
uaaaucugugaacuuga

SEQ ID NO: 3843605 - RNA, 21 nt, Human
uaaaucugugaacuugaaauu

SEQ ID NO: 3843606 - RNA, 20 nt, Human
uaaaucuguugccaagcugg

SEQ ID NO: 3843607 - RNA, 16 nt, Human
uaaaucuuaauguucc

SEQ ID NO: 3843608 - RNA, 17 nt, Human
uaaaucuuaauguuccu

SEQ ID NO: 3843609 - RNA, 19 nt, Human
uaaaucuuaauguuccuca

SEQ ID NO: 3843610 - RNA, 14 nt, Human
uaaaucuuuuacaa

SEQ ID NO: 3843611 - RNA, 23 nt, Human
uaaaucuuuuauaggauuuauuu

SEQ ID NO: 3843612 - RNA, 13 nt, Human
uaaaugaaaaaau

SEQ ID NO: 3843613 - RNA, 14 nt, Human
uaaaugaaagaaaa

SEQ ID NO: 3843614 - RNA, 13 nt, Human
uaaaugaacaaga

SEQ ID NO: 3843615 - RNA, 17 nt, Human
uaaaugaacaagagaag

SEQ ID NO: 3843616 - RNA, 23 nt, Human
uaaaugaagcagcuuuaaacaaa

SEQ ID NO: 3843617 - RNA, 22 nt, Human
uaaaugaaguaacuugucuuaa

SEQ ID NO: 3843618 - RNA, 23 nt, Human
uaaaugaaguuuauacaguacag

SEQ ID NO: 3843619 - RNA, 13 nt, Human
uaaaugacacuca

SEQ ID NO: 3843620 - RNA, 16 nt, Human
uaaaugacucuucccu

SEQ ID NO: 3843621 - RNA, 18 nt, Human
uaaaugagcuauguauua

SEQ ID NO: 3843622 - RNA, 17 nt, Human
uaaaugaggggccucag

SEQ ID NO: 3843623 - RNA, 14 nt, Human
uaaaugauguugaa

SEQ ID NO: 3843624 - RNA, 17 nt, Human
uaaaugauuucauucaa

SEQ ID NO: 3843625 - RNA, 21 nt, Human
uaaaugcaaaguucuguguuu

SEQ ID NO: 3843626 - RNA, 13 nt, Human
uaaaugcagccca

SEQ ID NO: 3843627 - RNA, 14 nt, Human
uaaaugcauuauag

SEQ ID NO: 3843628 - RNA, 13 nt, Human
uaaaugcccagcc

SEQ ID NO: 3843629 - RNA, 14 nt, Human
uaaaugcccagccc

SEQ ID NO: 3843630 - RNA, 16 nt, Human
uaaaugcccagccccu

SEQ ID NO: 3843631 - RNA, 14 nt, Human
uaaaugccuaguuu

SEQ ID NO: 3843632 - RNA, 17 nt, Human
uaaaugccuaguuuuua

SEQ ID NO: 3843633 - RNA, 15 nt, Human
uaaaugcuauuuuuu

SEQ ID NO: 3843634 - RNA, 17 nt, Human
uaaaugcugcuuuuucu

SEQ ID NO: 3843635 - RNA, 13 nt, Human
uaaaugcuuaugu

SEQ ID NO: 3843636 - RNA, 21 nt, Human
uaaaugcuuugugugauugaa

SEQ ID NO: 3843637 - RNA, 16 nt, Human
uaaauggaaacugaaa

SEQ ID NO: 3843638 - RNA, 16 nt, Human
uaaauggccucaugug

SEQ ID NO: 3843639 - RNA, 20 nt, Human
uaaauggcuuccuggcaaua

SEQ ID NO: 3843640 - RNA, 15 nt, Human
uaaaugggaacauuu

SEQ ID NO: 3843641 - RNA, 17 nt, Human
uaaauggggcucacaaa

SEQ ID NO: 3843642 - RNA, 20 nt, Human
uaaaugguauagcaaauguu

SEQ ID NO: 3843643 - RNA, 17 nt, Human
uaaaugguguacauaau

SEQ ID NO: 3843644 - RNA, 12 nt, Human
uaaauguaaacu

SEQ ID NO: 3843645 - RNA, 14 nt, Human
uaaauguaaacuca

SEQ ID NO: 3843646 - RNA, 15 nt, Human
uaaauguaaacucag

SEQ ID NO: 3843647 - RNA, 17 nt, Human
uaaauguaaagacaaaa

SEQ ID NO: 3843648 - RNA, 17 nt, Human
uaaauguaacagucuga

SEQ ID NO: 3843649 - RNA, 18 nt, Human
uaaauguaacagucugau

SEQ ID NO: 3843650 - RNA, 19 nt, Human
uaaauguaacagucugauc

SEQ ID NO: 3843651 - RNA, 16 nt, Human
uaaauguaagaaucau

SEQ ID NO: 3843652 - RNA, 23 nt, Human
uaaauguagcuucagucauuaaa

SEQ ID NO: 3843653 - RNA, 16 nt, Human
uaaauguagguaugaa

SEQ ID NO: 3843654 - RNA, 13 nt, Human
uaaauguauaccu

SEQ ID NO: 3843655 - RNA, 13 nt, Human
uaaauguauacua

SEQ ID NO: 3843656 - RNA, 17 nt, Human
uaaauguauacuauagu

SEQ ID NO: 3843657 - RNA, 17 nt, Human
uaaauguauauacacau

SEQ ID NO: 3843658 - RNA, 17 nt, Human
uaaaugucaaaugugaa

SEQ ID NO: 3843659 - RNA, 15 nt, Human
uaaaugucucacuga

SEQ ID NO: 3843660 - RNA, 17 nt, Human
uaaaugucucacugagc

SEQ ID NO: 3843661 - RNA, 14 nt, Human
uaaaugucuuauau

SEQ ID NO: 3843662 - RNA, 18 nt, Human
uaaaugucuuuaaugcaa

SEQ ID NO: 3843663 - RNA, 22 nt, Human
uaaaugucuuuguaagucagug

SEQ ID NO: 3843664 - RNA, 15 nt, Human
uaaaugugaauuacu

SEQ ID NO: 3843665 - RNA, 16 nt, Human
uaauagacaauuuauu

SEQ ID NO: 3843666 - RNA, 22 nt, Human
uaauagacaauuuauuauggca

SEQ ID NO: 3843667 - RNA, 22 nt, Human
uaauagauguuugauagauuuu

SEQ ID NO: 3843668 - RNA, 18 nt, Human
uaauagauugugaauaau

SEQ ID NO: 3843669 - RNA, 23 nt, Human
uaauagauuuuuucagacuuguc

SEQ ID NO: 3843670 - RNA, 14 nt, Human
uaauagcagccuuu

SEQ ID NO: 3843671 - RNA, 18 nt, Human
uaauagcuuuuauuguau

SEQ ID NO: 3843672 - RNA, 16 nt, Human
uaauagggaauauauc

SEQ ID NO: 3843673 - RNA, 20 nt, Human
uaauagggcaauuaauuccu

SEQ ID NO: 3843674 - RNA, 17 nt, Human
uaauaguguuaaucaau

SEQ ID NO: 3843675 - RNA, 21 nt, Human
uaauaguucagguaacaggca

SEQ ID NO: 3843676 - RNA, 17 nt, Human
uaauaguuugucuauuu

SEQ ID NO: 3843677 - RNA, 19 nt, Human
uaauaguuugucuauuuua

SEQ ID NO: 3843678 - RNA, 20 nt, Human
uaauaguuugucuauuuuaa

SEQ ID NO: 3843679 - RNA, 16 nt, Human
uaauauaaaagaucuu

SEQ ID NO: 3843680 - RNA, 14 nt, Human
uaauauaaaguugg

SEQ ID NO: 3843681 - RNA, 15 nt, Human
uaauauaaaguuuua

SEQ ID NO: 3843682 - RNA, 22 nt, Human
uaauauaaaguuuuauauauua

SEQ ID NO: 3843683 - RNA, 12 nt, Human
uaauauaaaugc

SEQ ID NO: 3843684 - RNA, 14 nt, Human
uaauauaaauucac

SEQ ID NO: 3843685 - RNA, 21 nt, Human
uaauauaaauucacuuucauu

SEQ ID NO: 3843686 - RNA, 22 nt, Human
uaauauaacugccuuaaaacuu

SEQ ID NO: 3843687 - RNA, 22 nt, Human
uaauauaaguuucuuugcuuca

SEQ ID NO: 3843688 - RNA, 19 nt, Human
uaauauaauggaagagaaa

SEQ ID NO: 3843689 - RNA, 20 nt, Human
uaauauaauggaagagaaau

SEQ ID NO: 3843690 - RNA, 16 nt, Human
uaauauagcugagacu

SEQ ID NO: 3843691 - RNA, 19 nt, Human
uaauauauauauauaucag

SEQ ID NO: 3843692 - RNA, 22 nt, Human
uaauauauauauauaucaguuu

SEQ ID NO: 3843693 - RNA, 16 nt, Human
uaauauauauuaucuu

SEQ ID NO: 3843694 - RNA, 19 nt, Human
uaauauauauuaucuuuuc

SEQ ID NO: 3843695 - RNA, 17 nt, Human
uaauauaucccagaaau

SEQ ID NO: 3843696 - RNA, 20 nt, Human
uaauauauguauuauuuaua

SEQ ID NO: 3843697 - RNA, 12 nt, Human
uaauauauuaaa

SEQ ID NO: 3843698 - RNA, 21 nt, Human
uaauauauuaaaauuccaaau

SEQ ID NO: 3843699 - RNA, 21 nt, Human
uaauauauucugaagcaacau

SEQ ID NO: 3843700 - RNA, 12 nt, Human
uaauauauugcu

SEQ ID NO: 3843701 - RNA, 14 nt, Human
uaauauauugcugc

SEQ ID NO: 3843702 - RNA, 18 nt, Human
uaauauauuuaaagggaa

SEQ ID NO: 3843703 - RNA, 13 nt, Human
uaauauauuuucu

SEQ ID NO: 3843704 - RNA, 21 nt, Human
uaauauauuuucuguuuucuu

SEQ ID NO: 3843705 - RNA, 21 nt, Human
uaauaucaaaugcaguauauu

SEQ ID NO: 3843706 - RNA, 14 nt, Human
uaauaucacucauu

SEQ ID NO: 3843707 - RNA, 18 nt, Human
uaauaucacucauuaauu

SEQ ID NO: 3843708 - RNA, 20 nt, Human
uaauauccaggucaacagaa

SEQ ID NO: 3843709 - RNA, 23 nt, Human
uaauaucccacugggagaaagga

SEQ ID NO: 3843710 - RNA, 17 nt, Human
uaauaucccuacaugua

SEQ ID NO: 3843711 - RNA, 18 nt, Human
uaauaucccuacauguau

SEQ ID NO: 3843712 - RNA, 15 nt, Human
uaauaucuaaaguua

SEQ ID NO: 3843713 - RNA, 21 nt, Human
uaauaucuaaaguuauauuuc

SEQ ID NO: 3843714 - RNA, 16 nt, Human
uaauaucuucauuucu

SEQ ID NO: 3843715 - RNA, 15 nt, Human
uaauaucuuucugca

SEQ ID NO: 3843716 - RNA, 19 nt, Human
uaauaucuuucugcacaca

SEQ ID NO: 3843717 - RNA, 16 nt, Human
uaauaugaaaacuuau

SEQ ID NO: 3843718 - RNA, 14 nt, Human
uaauaugaaauuuu

SEQ ID NO: 3843719 - RNA, 15 nt, Human
uaauaugcaaagucu

SEQ ID NO: 3843720 - RNA, 19 nt, Human
uaauaugcacacauuuuuu

SEQ ID NO: 3843721 - RNA, 22 nt, Human
uaauaugcugcaacaaaaugua

SEQ ID NO: 3843722 - RNA, 12 nt, Human
uaauauggauuu

SEQ ID NO: 3843723 - RNA, 16 nt, Human
uaauauggcaaaaaug

SEQ ID NO: 3843724 - RNA, 20 nt, Human
uaauauggcuaugcuuaaaa

SEQ ID NO: 3843725 - RNA, 20 nt, Human
uacacuaaggguguaaguaa

SEQ ID NO: 3843726 - RNA, 18 nt, Human
uacacucaggcuuucacu

SEQ ID NO: 3843727 - RNA, 13 nt, Human
uacacucuccugg

SEQ ID NO: 3843728 - RNA, 14 nt, Human
uacacucuccuggg

SEQ ID NO: 3843729 - RNA, 15 nt, Human
uacacucuccugggc

SEQ ID NO: 3843730 - RNA, 17 nt, Human
uacacucuccugggccc

SEQ ID NO: 3843731 - RNA, 18 nt, Human
uacacucuccugggcccc

SEQ ID NO: 3843732 - RNA, 15 nt, Human
uacacucugcuguuu

SEQ ID NO: 3843733 - RNA, 23 nt, Human
uacacucugcuguuugacaccuc

SEQ ID NO: 3843734 - RNA, 23 nt, Human
uacacugacaccuuugcaggcau

SEQ ID NO: 3843735 - RNA, 20 nt, Human
uacacugcaaucauauguga

SEQ ID NO: 3843736 - RNA, 17 nt, Human
uacacugccugccuuaa

SEQ ID NO: 3843737 - RNA, 15 nt, Human
uacacugccuguaua

SEQ ID NO: 3843738 - RNA, 18 nt, Human
uacacugccuguauacuu

SEQ ID NO: 3843739 - RNA, 20 nt, Human
uacacugccuguauacuuua

SEQ ID NO: 3843740 - RNA, 23 nt, Human
uacacugccuguauacuuuagua

SEQ ID NO: 3843741 - RNA, 19 nt, Human
uacacuggaggagagaaga

SEQ ID NO: 3843742 - RNA, 22 nt, Human
uacacugggagaggugccagca

SEQ ID NO: 3843743 - RNA, 21 nt, Human
uacacugguuugagcuuagug

SEQ ID NO: 3843744 - RNA, 15 nt, Human
uacacuguaccauau

SEQ ID NO: 3843745 - RNA, 20 nt, Human
uacacuguauguuauagaac

SEQ ID NO: 3843746 - RNA, 16 nt, Human
uacacuguauuuguau

SEQ ID NO: 3843747 - RNA, 15 nt, Human
uacacugucaaacau

SEQ ID NO: 3843748 - RNA, 22 nt, Human
uacacugugacuuaagaagccu

SEQ ID NO: 3843749 - RNA, 18 nt, Human
uacacuguuagaacacua

SEQ ID NO: 3843750 - RNA, 21 nt, Human
uacacuguuagaacacuauuu

SEQ ID NO: 3843751 - RNA, 23 nt, Human
uacacuguuagaacacuauuuuc

SEQ ID NO: 3843752 - RNA, 13 nt, Human
uacacuguuauuu

SEQ ID NO: 3843753 - RNA, 21 nt, Human
uacacuguuauuuucagcaug

SEQ ID NO: 3843754 - RNA, 18 nt, Human
uacacuguuucaaacuuu

SEQ ID NO: 3843755 - RNA, 22 nt, Human
uacacuguuucaaacuuuacua

SEQ ID NO: 3843756 - RNA, 14 nt, Human
uacacuuacuguug

SEQ ID NO: 3843757 - RNA, 14 nt, Human
uacacuugcccugc

SEQ ID NO: 3843758 - RNA, 16 nt, Human
uacacuugcccugcuc

SEQ ID NO: 3843759 - RNA, 21 nt, Human
uacacuugcccugcucccucu

SEQ ID NO: 3843760 - RNA, 16 nt, Human
uacacuuguauaaaug

SEQ ID NO: 3843761 - RNA, 17 nt, Human
uacacuuguauaaaugu

SEQ ID NO: 3843762 - RNA, 18 nt, Human
uacacuuguauaaaugua

SEQ ID NO: 3843763 - RNA, 21 nt, Human
uacacuuguauaaauguauau

SEQ ID NO: 3843764 - RNA, 22 nt, Human
uacacuuguauaaauguauaua

SEQ ID NO: 3843765 - RNA, 13 nt, Human
uacacuugugaau

SEQ ID NO: 3843766 - RNA, 23 nt, Human
uacacuuuaugccggaugugcuu

SEQ ID NO: 3843767 - RNA, 20 nt, Human
uacagaaaaaccuuggguua

SEQ ID NO: 3843768 - RNA, 15 nt, Human
uacagaaaaagacuu

SEQ ID NO: 3843769 - RNA, 15 nt, Human
uacagaaaaaucuug

SEQ ID NO: 3843770 - RNA, 14 nt, Human
uacagaaagcugcc

SEQ ID NO: 3843771 - RNA, 16 nt, Human
uacagaaauauccaug

SEQ ID NO: 3843772 - RNA, 17 nt, Human
uacagaaauuagccggg

SEQ ID NO: 3843773 - RNA, 23 nt, Human
uacagaacccauuccauuuaucu

SEQ ID NO: 3843774 - RNA, 19 nt, Human
uacagaacuucagaaagac

SEQ ID NO: 3843775 - RNA, 11 nt, Human
uacagaaucau

SEQ ID NO: 3843776 - RNA, 18 nt, Human
uacagaaucuuguuuuga

SEQ ID NO: 3843777 - RNA, 16 nt, Human
uacagaauuugaauua

SEQ ID NO: 3843778 - RNA, 13 nt, Human
uacagacaaagcg

SEQ ID NO: 3843779 - RNA, 15 nt, Human
uacagacaaagcgug

SEQ ID NO: 3843780 - RNA, 22 nt, Human
uacagacaacaaaccuguuucu

SEQ ID NO: 3843781 - RNA, 14 nt, Human
uacagacacuaagu

SEQ ID NO: 3843782 - RNA, 15 nt, Human
uacagacauauuuaa

SEQ ID NO: 3843783 - RNA, 19 nt, Human
uacagacauauuuaacugg

SEQ ID NO: 3843784 - RNA, 21 nt, Human
uacagaccgaacuguuguaua

SEQ ID NO: 3843785 - RNA, 15 nt, Human
uacagaccugcuuuu

SEQ ID NO: 3843786 - RNA, 21 nt, Human
uacagaccugcuuuuugaaau

SEQ ID NO: 3843787 - RNA, 23 nt, Human
uacagaccugcuuuuugaaauga

SEQ ID NO: 3843788 - RNA, 19 nt, Human
uacagacuggauguaccac

SEQ ID NO: 3843789 - RNA, 15 nt, Human
uacagagaaagaaau

SEQ ID NO: 3843790 - RNA, 22 nt, Human
uacagagaacuaacacuauuuu

SEQ ID NO: 3843791 - RNA, 13 nt, Human
uacagagaagcca

SEQ ID NO: 3843792 - RNA, 14 nt, Human
uacagagaagccag

SEQ ID NO: 3843793 - RNA, 15 nt, Human
uacagagaagccagc

SEQ ID NO: 3843794 - RNA, 18 nt, Human
uacagagaagccaucacc

SEQ ID NO: 3843795 - RNA, 23 nt, Human
uacagagaagccaucaccucaga

SEQ ID NO: 3843796 - RNA, 16 nt, Human
uacagagaagccuuca

SEQ ID NO: 3843797 - RNA, 20 nt, Human
uacagagaagccuucaagcu

SEQ ID NO: 3843798 - RNA, 13 nt, Human
uacagagaaggaa

SEQ ID NO: 3843799 - RNA, 23 nt, Human
uacagagaaggaaugucuuuggu

SEQ ID NO: 3843800 - RNA, 21 nt, Human
uacagagaagucacagggcag

SEQ ID NO: 3843801 - RNA, 18 nt, Human
uacagagaggagaaacac

SEQ ID NO: 3843802 - RNA, 22 nt, Human
uacagagaugucucuuauaucu

SEQ ID NO: 3843803 - RNA, 23 nt, Human
uacagagcccacgcccccacugg

SEQ ID NO: 3843804 - RNA, 13 nt, Human
uacagagcugugg

SEQ ID NO: 3843805 - RNA, 11 nt, Human
uacagaggaaa

SEQ ID NO: 3843806 - RNA, 14 nt, Human
uacagaggacagua

SEQ ID NO: 3843807 - RNA, 18 nt, Human
uacagaggccaugggccu

SEQ ID NO: 3843808 - RNA, 20 nt, Human
uacagauaggccuucuugug

SEQ ID NO: 3843809 - RNA, 14 nt, Human
uacagaugaaaauu

SEQ ID NO: 3843810 - RNA, 16 nt, Human
uacagaugugggccac

SEQ ID NO: 3843811 - RNA, 17 nt, Human
uacagauugcugcuucu

SEQ ID NO: 3843812 - RNA, 17 nt, Human
uacagauuuauuccuuu

SEQ ID NO: 3843813 - RNA, 19 nt, Human
uacagauuuauuccuuugu

SEQ ID NO: 3843814 - RNA, 23 nt, Human
uacagauuuugauagcaaagcga

SEQ ID NO: 3843815 - RNA, 12 nt, Human
uacagcaaauuu

SEQ ID NO: 3843816 - RNA, 14 nt, Human
uacagcaaauuuau

SEQ ID NO: 3843817 - RNA, 15 nt, Human
uacagcaaauuuaua

SEQ ID NO: 3843818 - RNA, 22 nt, Human
uacagcaacaauuuaugaauug

SEQ ID NO: 3843819 - RNA, 22 nt, Human
uacagcaaggagauuuacaacu

SEQ ID NO: 3843820 - RNA, 19 nt, Human
uacagcacuacucugugcc

SEQ ID NO: 3843821 - RNA, 22 nt, Human
uacagcacuacugggugucauu

SEQ ID NO: 3843822 - RNA, 14 nt, Human
uacagcagcaagaa

SEQ ID NO: 3843823 - RNA, 16 nt, Human
uacagcagcaagaaaa

SEQ ID NO: 3843824 - RNA, 22 nt, Human
uacagcagcaagaaaaaaaaau

SEQ ID NO: 3843825 - RNA, 20 nt, Human
uacagcgagaggcagagaaa

SEQ ID NO: 3843826 - RNA, 21 nt, Human
uacagcucagaaguuucuucu

SEQ ID NO: 3843827 - RNA, 21 nt, Human
uacagcucauuaaacuuuuuu

SEQ ID NO: 3843828 - RNA, 11 nt, Human
uacagcucccc

SEQ ID NO: 3843829 - RNA, 14 nt, Human
uacagcucccccag

SEQ ID NO: 3843830 - RNA, 20 nt, Human
uacagcucuggccacaacag

SEQ ID NO: 3843831 - RNA, 15 nt, Human
uacagcugagcuaug

SEQ ID NO: 3843832 - RNA, 13 nt, Human
uacagcugccugc

SEQ ID NO: 3843833 - RNA, 10 nt, Human
uacagcuggg

SEQ ID NO: 3843834 - RNA, 21 nt, Human
uacagcuggguggcacugcca

SEQ ID NO: 3843835 - RNA, 14 nt, Human
uacagcuguauugu

SEQ ID NO: 3843836 - RNA, 12 nt, Human
uacagcuguguu

SEQ ID NO: 3843837 - RNA, 20 nt, Human
uacagcuugaccgugaggcc

SEQ ID NO: 3843838 - RNA, 21 nt, Human
uacagcuugaccgugaggcca

SEQ ID NO: 3843839 - RNA, 17 nt, Human
uacaggaaaagcugcug

SEQ ID NO: 3843840 - RNA, 18 nt, Human
uacaggaaaagcugcuga

SEQ ID NO: 3843841 - RNA, 13 nt, Human
uacaggaaguacu

SEQ ID NO: 3843842 - RNA, 20 nt, Human
uacaggauuugaacucagau

SEQ ID NO: 3843843 - RNA, 16 nt, Human
uacaggcacccaccau

SEQ ID NO: 3843844 - RNA, 14 nt, Human
uacaggcaccgaga

SEQ ID NO: 3843845 - RNA, 20 nt, Human
uacaggcaccgagaauguug

SEQ ID NO: 3843846 - RNA, 14 nt, Human
uacaggcagucucu

SEQ ID NO: 3843847 - RNA, 15 nt, Human
uacaggcauagaguu

SEQ ID NO: 3843848 - RNA, 19 nt, Human
uacaggcccugcuccugca

SEQ ID NO: 3843849 - RNA, 22 nt, Human
uacaggcgugagccaccgugcc

SEQ ID NO: 3843850 - RNA, 15 nt, Human
uacaggcuccugcca

SEQ ID NO: 3843851 - RNA, 21 nt, Human
uacaggcuggcgcagaacgaa

SEQ ID NO: 3843852 - RNA, 13 nt, Human
uacagggagccuc

SEQ ID NO: 3843853 - RNA, 15 nt, Human
uacagggagccuccu

SEQ ID NO: 3843854 - RNA, 20 nt, Human
uacagggagccuccugccca

SEQ ID NO: 3843855 - RNA, 16 nt, Human
uacagggagcugggac

SEQ ID NO: 3843856 - RNA, 22 nt, Human
uacagggcgagacucugucuca

SEQ ID NO: 3843857 - RNA, 14 nt, Human
uacagggggucugg

SEQ ID NO: 3843858 - RNA, 22 nt, Human
uacagggggucuggcugguguu

SEQ ID NO: 3843859 - RNA, 20 nt, Human
uacagguacuuugucuaaga

SEQ ID NO: 3843860 - RNA, 22 nt, Human
uacaggugugugccaccacacc

SEQ ID NO: 3843861 - RNA, 16 nt, Human
uacaguaacuuuaugu

SEQ ID NO: 3843862 - RNA, 17 nt, Human
uacaguaacuuuaugug

SEQ ID NO: 3843863 - RNA, 20 nt, Human
uacaguaacuuuauguguaa

SEQ ID NO: 3843864 - RNA, 23 nt, Human
uacaguaacuuuauguguaaaua

SEQ ID NO: 3843865 - RNA, 21 nt, Human
uacaguaagcugcucuauugu

SEQ ID NO: 3843866 - RNA, 17 nt, Human
uacaguaaugucauaaa

SEQ ID NO: 3843867 - RNA, 18 nt, Human
uacaguaaugucauaaag

SEQ ID NO: 3843868 - RNA, 15 nt, Human
uacaguaggagccca

SEQ ID NO: 3843869 - RNA, 22 nt, Human
gcaggcuggcagcucuccaguc

SEQ ID NO: 3843870 - RNA, 23 nt, Human
gcaggcuggcagcucuccaguca

SEQ ID NO: 3843871 - RNA, 12 nt, Human
gcaggcuggcca

SEQ ID NO: 3843872 - RNA, 14 nt, Human
gcaggcuggccagc

SEQ ID NO: 3843873 - RNA, 16 nt, Human
gcaggcuggccagccg

SEQ ID NO: 3843874 - RNA, 20 nt, Human
gcaggcuggccagccgcucu

SEQ ID NO: 3843875 - RNA, 14 nt, Human
gcaggcuggccagu

SEQ ID NO: 3843876 - RNA, 16 nt, Human
gcaggcuggcccugcc

SEQ ID NO: 3843877 - RNA, 18 nt, Human
gcaggcuggcccugcccu

SEQ ID NO: 3843878 - RNA, 19 nt, Human
gcaggcuggcccugcccug

SEQ ID NO: 3843879 - RNA, 20 nt, Human
gcaggcuggcccugcccugg

SEQ ID NO: 3843880 - RNA, 14 nt, Human
uacaguauaauuaa

SEQ ID NO: 3843881 - RNA, 18 nt, Human
uacaguauaauuaacaug

SEQ ID NO: 3843882 - RNA, 23 nt, Human
uacaguauaauuaacauguuaaa

SEQ ID NO: 3843883 - RNA, 16 nt, Human
uacaguaugcuugcuc

SEQ ID NO: 3843884 - RNA, 13 nt, Human
uacagucugucau

SEQ ID NO: 3843885 - RNA, 12 nt, Human
uacagucugucu

SEQ ID NO: 3843886 - RNA, 13 nt, Human
uacagucugucuu

SEQ ID NO: 3843887 - RNA, 21 nt, Human
uacagucugucuucuguauau

SEQ ID NO: 3843888 - RNA, 15 nt, Human
uacagucuuccacaa

SEQ ID NO: 3843889 - RNA, 18 nt, Human
uacagucuuccauuugca

SEQ ID NO: 3843890 - RNA, 13 nt, Human
uacagucuuguau

SEQ ID NO: 3843891 - RNA, 15 nt, Human
uacagugaaaaugua

SEQ ID NO: 3843892 - RNA, 23 nt, Human
uacagugaaaauguaagcuguuu

SEQ ID NO: 3843893 - RNA, 21 nt, Human
uacagugguuuuauacugaag

SEQ ID NO: 3843894 - RNA, 23 nt, Human
uacaguuacucagaauucucuag

SEQ ID NO: 3843895 - RNA, 22 nt, Human
uacaguucaguuccucuuugca

SEQ ID NO: 3843896 - RNA, 11 nt, Human
uacaguucuuc

SEQ ID NO: 3843897 - RNA, 17 nt, Human
uacaguugaaaaacagc

SEQ ID NO: 3843898 - RNA, 19 nt, Human
uacaguugaaaaacagcug

SEQ ID NO: 3843899 - RNA, 20 nt, Human
uacaguugaaaaacagcuga

SEQ ID NO: 3843900 - RNA, 19 nt, Human
uacaguuggaaauccaucc

SEQ ID NO: 3843901 - RNA, 15 nt, Human
uacaguuguuggccu

SEQ ID NO: 3843902 - RNA, 17 nt, Human
uacaguuugcuguacua

SEQ ID NO: 3843903 - RNA, 21 nt, Human
uacaguuugcuguacuagaga

SEQ ID NO: 3843904 - RNA, 22 nt, Human
uacaguuuggggcaagucaugu

SEQ ID NO: 3843905 - RNA, 17 nt, Human
uacaguuugucacauga

SEQ ID NO: 3843906 - RNA, 21 nt, Human
uacaguuuguuaguaugaggc

SEQ ID NO: 3843907 - RNA, 16 nt, Human
uacaguuuguuuacac

SEQ ID NO: 3843908 - RNA, 14 nt, Human
uacaguuuuaacug

SEQ ID NO: 3843909 - RNA, 15 nt, Human
uacaguuuuaacugu

SEQ ID NO: 3843910 - RNA, 20 nt, Human
uacaguuuuaacuguggaua

SEQ ID NO: 3843911 - RNA, 15 nt, Human
uacaguuuuccuaaa

SEQ ID NO: 3843912 - RNA, 13 nt, Human
uacauaaaagaaa

SEQ ID NO: 3843913 - RNA, 12 nt, Human
uacauaaacauc

SEQ ID NO: 3843914 - RNA, 13 nt, Human
uacauaaacauca

SEQ ID NO: 3843915 - RNA, 14 nt, Human
uacauaaagacuaa

SEQ ID NO: 3843916 - RNA, 21 nt, Human
uacauaaaggugguaugugug

SEQ ID NO: 3843917 - RNA, 19 nt, Human
uacauaacaagaaaaucaa

SEQ ID NO: 3843918 - RNA, 19 nt, Human
uacauaacuaaauuugaua

SEQ ID NO: 3843919 - RNA, 17 nt, Human
uacauaacugaaaaugu

SEQ ID NO: 3843920 - RNA, 16 nt, Human
uacauaacugccuuga

SEQ ID NO: 3843921 - RNA, 16 nt, Human
uacauaagauaaaugu

SEQ ID NO: 3843922 - RNA, 18 nt, Human
uacauaagauaaaugugc

SEQ ID NO: 3843923 - RNA, 16 nt, Human
uacauaaguaauucaa

SEQ ID NO: 3843924 - RNA, 17 nt, Human
uacauaaguaauucaag

SEQ ID NO: 3843925 - RNA, 15 nt, Human
uacauaaguuuagga

SEQ ID NO: 3843926 - RNA, 17 nt, Human
uacauaaugcgugcaua

SEQ ID NO: 3843927 - RNA, 19 nt, Human
uacauaaugcgugcauacc

SEQ ID NO: 3843928 - RNA, 20 nt, Human
uacauaaugcgugcauacca

SEQ ID NO: 3843929 - RNA, 23 nt, Human
uacauaaugggccacugaaaucu

SEQ ID NO: 3843930 - RNA, 16 nt, Human
uacauaauucacucug

SEQ ID NO: 3843931 - RNA, 19 nt, Human
uacauaauuuuuuauucaa

SEQ ID NO: 3843932 - RNA, 22 nt, Human
uacauaauuuuuuauucaaguu

SEQ ID NO: 3843933 - RNA, 13 nt, Human
uacauacacugua

SEQ ID NO: 3843934 - RNA, 14 nt, Human
uacauacacuugua

SEQ ID NO: 3843935 - RNA, 23 nt, Human
uacauaccacgcuagggcuggcu

SEQ ID NO: 3843936 - RNA, 16 nt, Human
uacauacgauuuaagg

SEQ ID NO: 3843937 - RNA, 17 nt, Human
uacauacgauuuaaggu

SEQ ID NO: 3843938 - RNA, 20 nt, Human
uacauacuaugaaauaugua

SEQ ID NO: 3843939 - RNA, 15 nt, Human
uacauagccuauauu

SEQ ID NO: 3843940 - RNA, 20 nt, Human
uacauagccuauauuuacag

SEQ ID NO: 3843941 - RNA, 21 nt, Human
uacauagugcuaacaugaaga

SEQ ID NO: 3843942 - RNA, 22 nt, Human
uacauagugcuaacaugaagac

SEQ ID NO: 3843943 - RNA, 21 nt, Human
uacauagugcugcugugugcu

SEQ ID NO: 3843944 - RNA, 21 nt, Human
uacauaguuuuaaacucauuu

SEQ ID NO: 3843945 - RNA, 11 nt, Human
uacauauauau

SEQ ID NO: 3843946 - RNA, 14 nt, Human
uacauauauuuuua

SEQ ID NO: 3843947 - RNA, 22 nt, Human
uacauauauuuuuaaaaaauga

SEQ ID NO: 3843948 - RNA, 20 nt, Human
uacauaucaccucauggccu

SEQ ID NO: 3843949 - RNA, 19 nt, Human
uacauaucccuuccagaug

SEQ ID NO: 3843950 - RNA, 22 nt, Human
uacauaucgcugacuucaugga

SEQ ID NO: 3843951 - RNA, 16 nt, Human
uacauaucuuuauuaa

SEQ ID NO: 3843952 - RNA, 16 nt, Human
uacauauggauguuac

SEQ ID NO: 3843953 - RNA, 20 nt, Human
uacauauggauguuacucuc

SEQ ID NO: 3843954 - RNA, 15 nt, Human
uacauauguaaaaua

SEQ ID NO: 3843955 - RNA, 21 nt, Human
uacauauguagacuauauaca

SEQ ID NO: 3843956 - RNA, 22 nt, Human
uacauauguagacuauauacau

SEQ ID NO: 3843957 - RNA, 17 nt, Human
uacauauguauacaugu

SEQ ID NO: 3843958 - RNA, 18 nt, Human
uacauauguauacaugug

SEQ ID NO: 3843959 - RNA, 23 nt, Human
uacauauguauacaugugccaug

SEQ ID NO: 3843960 - RNA, 21 nt, Human
uacauaugugcuggaauucua

SEQ ID NO: 3843961 - RNA, 19 nt, Human
uacauauuaggaaaauaug

SEQ ID NO: 3843962 - RNA, 15 nt, Human
uacauauucuuuaaa

SEQ ID NO: 3843963 - RNA, 12 nt, Human
uacauauugaau

SEQ ID NO: 3843964 - RNA, 17 nt, Human
uacauauuugagacuag

SEQ ID NO: 3843965 - RNA, 16 nt, Human
uacauauuuguggaau

SEQ ID NO: 3843966 - RNA, 17 nt, Human
uacauauuuuuguagca

SEQ ID NO: 3843967 - RNA, 13 nt, Human
uacaucacugcuu

SEQ ID NO: 3843968 - RNA, 18 nt, Human
uacaucaguuauucauuc

SEQ ID NO: 3843969 - RNA, 20 nt, Human
uacaucauuucuuuuuggga

SEQ ID NO: 3843970 - RNA, 17 nt, Human
uacaucccauguaacag

SEQ ID NO: 3843971 - RNA, 19 nt, Human
uacaucccauguaacagaa

SEQ ID NO: 3843972 - RNA, 20 nt, Human
uacaucccuuaccugggaaa

SEQ ID NO: 3843973 - RNA, 13 nt, Human
uacauccugggua

SEQ ID NO: 3843974 - RNA, 12 nt, Human
uacauccuugug

SEQ ID NO: 3843975 - RNA, 18 nt, Human
uacaucuauuuuggauug

SEQ ID NO: 3843976 - RNA, 19 nt, Human
uacaucugagguccuguga

SEQ ID NO: 3843977 - RNA, 14 nt, Human
uacaucuggcuuau

SEQ ID NO: 3843978 - RNA, 23 nt, Human
uacaucuggcuuauuuuaaugug

SEQ ID NO: 3843979 - RNA, 18 nt, Human
uacaucuuuuuucacaaa

SEQ ID NO: 3843980 - RNA, 17 nt, Human
uacaugaaaacacauuu

SEQ ID NO: 3843981 - RNA, 23 nt, Human
uacaugaaaacacauuuuucuua

SEQ ID NO: 3843982 - RNA, 14 nt, Human
uacaugaaauucaa

SEQ ID NO: 3843983 - RNA, 18 nt, Human
uacaugaagcuucaugca

SEQ ID NO: 3843984 - RNA, 18 nt, Human
uacaugaauugcauuuua

SEQ ID NO: 3843985 - RNA, 19 nt, Human
uacaugacacugaaaugcc

SEQ ID NO: 3843986 - RNA, 18 nt, Human
uacaugagaacaaacaga

SEQ ID NO: 3843987 - RNA, 13 nt, Human
uacaugagaacag

SEQ ID NO: 3843988 - RNA, 17 nt, Human
uacaugagaacagacug

SEQ ID NO: 3843989 - RNA, 23 nt, Human
uacaugaggaacuguagaugaug

SEQ ID NO: 3843990 - RNA, 21 nt, Human
uacaugagguacugagaguga

SEQ ID NO: 3843991 - RNA, 22 nt, Human
uacaugagguacugagagugaa

SEQ ID NO: 3843992 - RNA, 17 nt, Human
uacaugaugauuucaga

SEQ ID NO: 3843993 - RNA, 19 nt, Human
uacaugcaauuuauuaaaa

SEQ ID NO: 3843994 - RNA, 17 nt, Human
uacaugcagcccaugcc

SEQ ID NO: 3843995 - RNA, 21 nt, Human
uacaugcauacuucaaaagua

SEQ ID NO: 3843996 - RNA, 14 nt, Human
uacaugcauuugag

SEQ ID NO: 3843997 - RNA, 14 nt, Human
uacaugccagugac

SEQ ID NO: 3843998 - RNA, 17 nt, Human
uacaugcuaagagaagu

SEQ ID NO: 3843999 - RNA, 15 nt, Human
uacaugcucuuagaa

SEQ ID NO: 3844000 - RNA, 12 nt, Human
uacaugcugcua

SEQ ID NO: 3844001 - RNA, 14 nt, Human
uacaugcugggguc

SEQ ID NO: 3844002 - RNA, 12 nt, Human
uacaugcuuauu

SEQ ID NO: 3844003 - RNA, 17 nt, Human
uacaugcuuauuccaug

SEQ ID NO: 3844004 - RNA, 14 nt, Human
uacaugcuuguuga

SEQ ID NO: 3844005 - RNA, 15 nt, Human
uacaugcuuugugaa

SEQ ID NO: 3844006 - RNA, 14 nt, Human
uacauggaauaaca

SEQ ID NO: 3844007 - RNA, 13 nt, Human
uacaugggacuau

SEQ ID NO: 3844008 - RNA, 19 nt, Human
uacaugggacuaugcuuuu

SEQ ID NO: 3844009 - RNA, 19 nt, Human
uacauguauuaaauuacau

SEQ ID NO: 3844010 - RNA, 22 nt, Human
uacauguauuauuucauuaugu

SEQ ID NO: 3844011 - RNA, 16 nt, Human
uacaugugcacauugu

SEQ ID NO: 3844012 - RNA, 13 nt, Human
uacaugugggagc

SEQ ID NO: 3844013 - RNA, 21 nt, Human
uaauucagcacugauuucaca

SEQ ID NO: 3844014 - RNA, 15 nt, Human
uaauucagcucuuga

SEQ ID NO: 3844015 - RNA, 17 nt, Human
uaauucaggcauauuuu

SEQ ID NO: 3844016 - RNA, 14 nt, Human
uaauucagguuuuu

SEQ ID NO: 3844017 - RNA, 13 nt, Human
uaauucauguugc

SEQ ID NO: 3844018 - RNA, 15 nt, Human
uaauuccaauaugau

SEQ ID NO: 3844019 - RNA, 20 nt, Human
uaauuccaauaugaugacuc

SEQ ID NO: 3844020 - RNA, 10 nt, Human
uaauuccaug

SEQ ID NO: 3844021 - RNA, 19 nt, Human
uaauucccauuuugcaaaa

SEQ ID NO: 3844022 - RNA, 23 nt, Human
uaauucccauuuugcaaaauuuc

SEQ ID NO: 3844023 - RNA, 22 nt, Human
uaauuccguagguuauuuucag

SEQ ID NO: 3844024 - RNA, 16 nt, Human
uaauuccuacagcacu

SEQ ID NO: 3844025 - RNA, 21 nt, Human
uaauuccuacagcacuacugg

SEQ ID NO: 3844026 - RNA, 22 nt, Human
uaauuccucucacuaaacuuua

SEQ ID NO: 3844027 - RNA, 20 nt, Human
uaauuccuucagcacuuuag

SEQ ID NO: 3844028 - RNA, 12 nt, Human
uaauucuaaagg

SEQ ID NO: 3844029 - RNA, 11 nt, Human
uaauucuaaau

SEQ ID NO: 3844030 - RNA, 18 nt, Human
uaauucuaaaugaauguu

SEQ ID NO: 3844031 - RNA, 17 nt, Human
uaauucuaaccagagca

SEQ ID NO: 3844032 - RNA, 22 nt, Human
uaauucuaaccagagcaagcuu

SEQ ID NO: 3844033 - RNA, 13 nt, Human
uaauucuaaggaa

SEQ ID NO: 3844034 - RNA, 21 nt, Human
uaauucuaaggaauaugagcu

SEQ ID NO: 3844035 - RNA, 23 nt, Human
uaauucuauuaaagugcuaaggu

SEQ ID NO: 3844036 - RNA, 19 nt, Human
uaauucucagaaaggcaag

SEQ ID NO: 3844037 - RNA, 16 nt, Human
uaauucucuuucaaag

SEQ ID NO: 3844038 - RNA, 20 nt, Human
uaauucugaaguuauauuuc

SEQ ID NO: 3844039 - RNA, 23 nt, Human
uaauucugaaguuauauuuccua

SEQ ID NO: 3844040 - RNA, 17 nt, Human
uaauucugaguuuugug

SEQ ID NO: 3844041 - RNA, 15 nt, Human
uaauucuguaaaugu

SEQ ID NO: 3844042 - RNA, 18 nt, Human
uaauucuuagcucauucu

SEQ ID NO: 3844043 - RNA, 19 nt, Human
uaauucuuauuccauauua

SEQ ID NO: 3844044 - RNA, 14 nt, Human
uaauucuuauucuu

SEQ ID NO: 3844045 - RNA, 17 nt, Human
uaauucuuauuuugugg

SEQ ID NO: 3844046 - RNA, 22 nt, Human
uaauucuucagcguaaaauggu

SEQ ID NO: 3844047 - RNA, 13 nt, Human
uaauucuucaguu

SEQ ID NO: 3844048 - RNA, 15 nt, Human
uaauucuuguauauu

SEQ ID NO: 3844049 - RNA, 11 nt, Human
uaauucuuuaa

SEQ ID NO: 3844050 - RNA, 12 nt, Human
uaauucuuuaau

SEQ ID NO: 3844051 - RNA, 12 nt, Human
uaauucuuucaa

SEQ ID NO: 3844052 - RNA, 21 nt, Human
uaauucuuucaauacagauau

SEQ ID NO: 3844053 - RNA, 11 nt, Human
uaauucuuugc

SEQ ID NO: 3844054 - RNA, 16 nt, Human
uaauucuuugcaaaaa

SEQ ID NO: 3844055 - RNA, 17 nt, Human
uaauucuuugcaaaaau

SEQ ID NO: 3844056 - RNA, 21 nt, Human
uaauucuuugcaaaaauccaa

SEQ ID NO: 3844057 - RNA, 18 nt, Human
uaauucuuuuuuauuaau

SEQ ID NO: 3844058 - RNA, 20 nt, Human
uaauucuuuuuuauuaauca

SEQ ID NO: 3844059 - RNA, 23 nt, Human
uaauugaaaagaaguagugucug

SEQ ID NO: 3844060 - RNA, 22 nt, Human
uaauugaauuuucaagcaucuc

SEQ ID NO: 3844061 - RNA, 20 nt, Human
uaauugacaggauuauugga

SEQ ID NO: 3844062 - RNA, 22 nt, Human
uaauugacaggauuauuggaaa

SEQ ID NO: 3844063 - RNA, 21 nt, Human
uaauugagaagcguauguuuu

SEQ ID NO: 3844064 - RNA, 19 nt, Human
uaauugauuucaagaccuu

SEQ ID NO: 3844065 - RNA, 21 nt, Human
uaauugcaaaaacauagaaau

SEQ ID NO: 3844066 - RNA, 22 nt, Human
uaauugcagauaacuuugacuu

SEQ ID NO: 3844067 - RNA, 13 nt, Human
uaauugcauucau

SEQ ID NO: 3844068 - RNA, 22 nt, Human
uaauugcauucaucuuguguuu

SEQ ID NO: 3844069 - RNA, 12 nt, Human
uaauugcuauuu

SEQ ID NO: 3844070 - RNA, 12 nt, Human
uaauugcugcaa

SEQ ID NO: 3844071 - RNA, 22 nt, Human
uaauugcugugugucccaggca

SEQ ID NO: 3844072 - RNA, 17 nt, Human
uaauugcuguugaaagc

SEQ ID NO: 3844073 - RNA, 21 nt, Human
uaauugcuguugaaagcaaaa

SEQ ID NO: 3844074 - RNA, 16 nt, Human
uaauugcuuacauuuu

SEQ ID NO: 3844075 - RNA, 20 nt, Human
uaauugcuuauuuauuguau

SEQ ID NO: 3844076 - RNA, 22 nt, Human
uaauugcuuauuuauuguauuc

SEQ ID NO: 3844077 - RNA, 20 nt, Human
uaauuggaagaaauuccugu

SEQ ID NO: 3844078 - RNA, 17 nt, Human
uaauuggauuuccuaau

SEQ ID NO: 3844079 - RNA, 23 nt, Human
uaauuggauuuccuaauacuguc

SEQ ID NO: 3844080 - RNA, 18 nt, Human
uaauugggccagcuuuuc

SEQ ID NO: 3844081 - RNA, 21 nt, Human
uaauugggccagcuuuucaaa

SEQ ID NO: 3844082 - RNA, 18 nt, Human
uaauugguccgaucuuug

SEQ ID NO: 3844083 - RNA, 15 nt, Human
uaauuguaaacugua

SEQ ID NO: 3844084 - RNA, 19 nt, Human
uaauuguaucguauagcug

SEQ ID NO: 3844085 - RNA, 14 nt, Human
uaauugucaugguu

SEQ ID NO: 3844086 - RNA, 23 nt, Human
uaauugugauuagacagaacacc

SEQ ID NO: 3844087 - RNA, 22 nt, Human
uaauugugcaagcuuuuccuaa

SEQ ID NO: 3844088 - RNA, 21 nt, Human
uaauugugugauauuucagaa

SEQ ID NO: 3844089 - RNA, 13 nt, Human
uaauuguguuuac

SEQ ID NO: 3844090 - RNA, 16 nt, Human
gcaugcuggggcaagu

SEQ ID NO: 3844091 - RNA, 11 nt, Human
gcauggaaauu

SEQ ID NO: 3844092 - RNA, 13 nt, Human
gcauggaauuugu

SEQ ID NO: 3844093 - RNA, 17 nt, Human
gcauggaauuuguaagu

SEQ ID NO: 3844094 - RNA, 22 nt, Human
gcauggacauuuagaagaaaga

SEQ ID NO: 3844095 - RNA, 16 nt, Human
gcauggaccuaacauu

SEQ ID NO: 3844096 - RNA, 17 nt, Human
gcauggaccuaacauuc

SEQ ID NO: 3844097 - RNA, 18 nt, Human
gcauggaguguguauugu

SEQ ID NO: 3844098 - RNA, 14 nt, Human
gcauggauuucugu

SEQ ID NO: 3844099 - RNA, 22 nt, Human
gcauggcaccugucgcccagug

SEQ ID NO: 3844100 - RNA, 15 nt, Human
gcauggcacuugcau

SEQ ID NO: 3844101 - RNA, 20 nt, Human
gcauggcacuugcaucugug

SEQ ID NO: 3844102 - RNA, 19 nt, Human
gcauggcagggggcugcug

SEQ ID NO: 3844103 - RNA, 18 nt, Human
gcauggcauauuuuucac

SEQ ID NO: 3844104 - RNA, 18 nt, Human
gcauggcauccuccagcc

SEQ ID NO: 3844105 - RNA, 19 nt, Human
gcauggcauccuccagccc

SEQ ID NO: 3844106 - RNA, 17 nt, Human
gcauggccagcagcuug

SEQ ID NO: 3844107 - RNA, 17 nt, Human
gcauggccagguggcca

SEQ ID NO: 3844108 - RNA, 13 nt, Human
gcauggcccuggg

SEQ ID NO: 3844109 - RNA, 17 nt, Human
gcauggcccuggggucc

SEQ ID NO: 3844110 - RNA, 22 nt, Human
gcauggcccuggggucccacga

SEQ ID NO: 3844111 - RNA, 22 nt, Human
gcauggcguagagggugcugcc

SEQ ID NO: 3844112 - RNA, 21 nt, Human
gcauggcuccagucugcugcc

SEQ ID NO: 3844113 - RNA, 17 nt, Human
gcauggcuuuauuuguu

SEQ ID NO: 3844114 - RNA, 20 nt, Human
gcaugggaaagccaccucuc

SEQ ID NO: 3844115 - RNA, 19 nt, Human
gcaugggaaugaaugucag

SEQ ID NO: 3844116 - RNA, 22 nt, Human
gcaugggccuggccaccucucu

SEQ ID NO: 3844117 - RNA, 13 nt, Human
gcaugggcuugcu

SEQ ID NO: 3844118 - RNA, 23 nt, Human
gcauggggauaaaggagaaggca

SEQ ID NO: 3844119 - RNA, 18 nt, Human
gcauggggugggccucug

SEQ ID NO: 3844120 - RNA, 17 nt, Human
gcaugguaccagcccug

SEQ ID NO: 3844121 - RNA, 22 nt, Human
gcaugguaccagcccuggggcu

SEQ ID NO: 3844122 - RNA, 23 nt, Human
gcaugguaccagcccuggggcug

SEQ ID NO: 3844123 - RNA, 18 nt, Human
gcauggucacacacugau

SEQ ID NO: 3844124 - RNA, 15 nt, Human
gcaugguccauucuc

SEQ ID NO: 3844125 - RNA, 18 nt, Human
gcauggucccugccuuag

SEQ ID NO: 3844126 - RNA, 16 nt, Human
gcaugguggccagagg

SEQ ID NO: 3844127 - RNA, 19 nt, Human
gcaugguggcgcaagccug

SEQ ID NO: 3844128 - RNA, 22 nt, Human
gcauggugguugggacccagug

SEQ ID NO: 3844129 - RNA, 15 nt, Human
gcaugguguucuccu

SEQ ID NO: 3844130 - RNA, 16 nt, Human
gcaugguguucuccug

SEQ ID NO: 3844131 - RNA, 17 nt, Human
gcaugguguucuccugc

SEQ ID NO: 3844132 - RNA, 18 nt, Human
gcaugguguucuccugcu

SEQ ID NO: 3844133 - RNA, 20 nt, Human
gcaugguguucuccugcugc

SEQ ID NO: 3844134 - RNA, 19 nt, Human
gcauguaaauguaaacuca

SEQ ID NO: 3844135 - RNA, 11 nt, Human
gcauguacagu

SEQ ID NO: 3844136 - RNA, 20 nt, Human
gcauguacaguguucuguuu

SEQ ID NO: 3844137 - RNA, 20 nt, Human
gcauguaccauuugcauggc

SEQ ID NO: 3844138 - RNA, 22 nt, Human
gcauguacccuaaggucauuac

SEQ ID NO: 3844139 - RNA, 16 nt, Human
gcauguaguaacacua

SEQ ID NO: 3844140 - RNA, 17 nt, Human
gcauguaguaacacuaa

SEQ ID NO: 3844141 - RNA, 19 nt, Human
gcauguauaguugcuuuug

SEQ ID NO: 3844142 - RNA, 14 nt, Human
gcauguaugucuug

SEQ ID NO: 3844143 - RNA, 15 nt, Human
gcauguaugucuugg

SEQ ID NO: 3844144 - RNA, 21 nt, Human
gcaugucagacagaacuugaa

SEQ ID NO: 3844145 - RNA, 16 nt, Human
gcaugucccaucacgu

SEQ ID NO: 3844146 - RNA, 23 nt, Human
gcaugucccuaccgagucucuuc

SEQ ID NO: 3844147 - RNA, 14 nt, Human
gcaugucuuuuaaa

SEQ ID NO: 3844148 - RNA, 19 nt, Human
gcaugucuuuuuuucuguu

SEQ ID NO: 3844149 - RNA, 12 nt, Human
gcaugugaagaa

SEQ ID NO: 3844150 - RNA, 20 nt, Human
gcaugugaucacgccuggcu

SEQ ID NO: 3844151 - RNA, 19 nt, Human
gcaugugaugagaggaaau

SEQ ID NO: 3844152 - RNA, 21 nt, Human
gcaugugaugagaggaaauca

SEQ ID NO: 3844153 - RNA, 14 nt, Human
gcaugugcccuccu

SEQ ID NO: 3844154 - RNA, 16 nt, Human
gcauguggccuguggc

SEQ ID NO: 3844155 - RNA, 13 nt, Human
gcaugugggcuuc

SEQ ID NO: 3844156 - RNA, 14 nt, Human
gccaccugcggugc

SEQ ID NO: 3844157 - RNA, 22 nt, Human
gccaccugcggugcuaucuccc

SEQ ID NO: 3844158 - RNA, 15 nt, Human
gccaccuggaccccu

SEQ ID NO: 3844159 - RNA, 19 nt, Human
gccaccuggaccccugcau

SEQ ID NO: 3844160 - RNA, 20 nt, Human
gccaccuggcucucaccucu

SEQ ID NO: 3844161 - RNA, 16 nt, Human
gccaccuggggcaguc

SEQ ID NO: 3844162 - RNA, 19 nt, Human
gccaccugucccaccucaa

SEQ ID NO: 3844163 - RNA, 17 nt, Human
gccacgcagccaggaca

SEQ ID NO: 3844164 - RNA, 15 nt, Human
gccacgcuccagcug

SEQ ID NO: 3844165 - RNA, 16 nt, Human
gccacgcuccagcugc

SEQ ID NO: 3844166 - RNA, 23 nt, Human
gccacgggugccagaagcuacug

SEQ ID NO: 3844167 - RNA, 14 nt, Human
gccacgugccaggc

SEQ ID NO: 3844168 - RNA, 16 nt, Human
gccacgugccaggccc

SEQ ID NO: 3844169 - RNA, 18 nt, Human
gccacgugccaggcccgg

SEQ ID NO: 3844170 - RNA, 21 nt, Human
gccacguguuuagaccuagau

SEQ ID NO: 3844171 - RNA, 16 nt, Human
gccacguuccuuacug

SEQ ID NO: 3844172 - RNA, 22 nt, Human
gccacguucuuacuaguuuccc

SEQ ID NO: 3844173 - RNA, 14 nt, Human
gccacuaagcagag

SEQ ID NO: 3844174 - RNA, 19 nt, Human
gccacuaagcagaggaggg

SEQ ID NO: 3844175 - RNA, 17 nt, Human
gccacuacacuccagcc

SEQ ID NO: 3844176 - RNA, 19 nt, Human
gccacuacacuccagccug

SEQ ID NO: 3844177 - RNA, 20 nt, Human
gccacuacacuccagccuga

SEQ ID NO: 3844178 - RNA, 23 nt, Human
gccacuacacuccagccugagca

SEQ ID NO: 3844179 - RNA, 23 nt, Human
gccacuacauuugcuccauccuc

SEQ ID NO: 3844180 - RNA, 13 nt, Human
gccacuaggcugg

SEQ ID NO: 3844181 - RNA, 15 nt, Human
gccacuaggcugggu

SEQ ID NO: 3844182 - RNA, 20 nt, Human
gccacuaggcugggugccca

SEQ ID NO: 3844183 - RNA, 21 nt, Human
gccacuaggcugggugcccac

SEQ ID NO: 3844184 - RNA, 20 nt, Human
gccacuauuguuagucucuu

SEQ ID NO: 3844185 - RNA, 21 nt, Human
gccacuauuguuagucucuug

SEQ ID NO: 3844186 - RNA, 22 nt, Human
gccacucagaguucuauacugu

SEQ ID NO: 3844187 - RNA, 15 nt, Human
gccacucagcuuccu

SEQ ID NO: 3844188 - RNA, 12 nt, Human
gccacucauuuc

SEQ ID NO: 3844189 - RNA, 13 nt, Human
gccacucauuuca

SEQ ID NO: 3844190 - RNA, 16 nt, Human
gccacucauuucaucu

SEQ ID NO: 3844191 - RNA, 16 nt, Human
gccacuccagaccccu

SEQ ID NO: 3844192 - RNA, 18 nt, Human
gccacuccagaccccugg

SEQ ID NO: 3844193 - RNA, 20 nt, Human
gccacuccagaccccuggcu

SEQ ID NO: 3844194 - RNA, 22 nt, Human
gccacucccggcacuccaugcu

SEQ ID NO: 3844195 - RNA, 14 nt, Human
gccacuccucugac

SEQ ID NO: 3844196 - RNA, 15 nt, Human
gccacuccucugacu

SEQ ID NO: 3844197 - RNA, 23 nt, Human
gccacuccucugacucagggcuc

SEQ ID NO: 3844198 - RNA, 18 nt, Human
gccacuccuuccugcccc

SEQ ID NO: 3844199 - RNA, 20 nt, Human
gccacucgggaggcugagac

SEQ ID NO: 3844200 - RNA, 22 nt, Human
gccacucuaccagugcaggcug

SEQ ID NO: 3844201 - RNA, 13 nt, Human
gccacucugccuc

SEQ ID NO: 3844202 - RNA, 17 nt, Human
gccacucugccucugcc

SEQ ID NO: 3844203 - RNA, 21 nt, Human
gccacucugccucugccugca

SEQ ID NO: 3844204 - RNA, 13 nt, Human
gccacugaagagg

SEQ ID NO: 3844205 - RNA, 15 nt, Human
gccacugaagcuggg

SEQ ID NO: 3844206 - RNA, 19 nt, Human
gccacugacugcagggaca

SEQ ID NO: 3844207 - RNA, 15 nt, Human
gccacugcacagagc

SEQ ID NO: 3844208 - RNA, 22 nt, Human
gccacugcaccgggccacagag

SEQ ID NO: 3844209 - RNA, 23 nt, Human
gccacugcaccgggccacagaga

SEQ ID NO: 3844210 - RNA, 22 nt, Human
gccacugcacuccagccugggc

SEQ ID NO: 3844211 - RNA, 15 nt, Human
gccacugcacuccgg

SEQ ID NO: 3844212 - RNA, 17 nt, Human
gccacugcccgagcugg

SEQ ID NO: 3844213 - RNA, 21 nt, Human
gccacugcccgagcuggugca

SEQ ID NO: 3844214 - RNA, 16 nt, Human
gccacugccucuuccu

SEQ ID NO: 3844215 - RNA, 22 nt, Human
gccacugccuucgcuucuugcc

SEQ ID NO: 3844216 - RNA, 12 nt, Human
gccacugcuccc

SEQ ID NO: 3844217 - RNA, 15 nt, Human
gccacugcuccgugg

SEQ ID NO: 3844218 - RNA, 19 nt, Human
gccacugcucuccagccug

SEQ ID NO: 3844219 - RNA, 16 nt, Human
gccacuguuguuuugg

SEQ ID NO: 3844220 - RNA, 18 nt, Human
gccacuuaaaauguucac

SEQ ID NO: 3844221 - RNA, 15 nt, Human
gccacuucccaggua

SEQ ID NO: 3844222 - RNA, 14 nt, Human
gccacuucugggug

SEQ ID NO: 3844223 - RNA, 23 nt, Human
gccacuucuggguggggcagugg

SEQ ID NO: 3844224 - RNA, 15 nt, Human
gccacuucuguccau

SEQ ID NO: 3844225 - RNA, 16 nt, Human
gccacuucuguccaua

SEQ ID NO: 3844226 - RNA, 17 nt, Human
gccacuucuguccauau

SEQ ID NO: 3844227 - RNA, 19 nt, Human
gccacuuuaagagagaaau

SEQ ID NO: 3844228 - RNA, 22 nt, Human
gccacuuuaagagagaaaucug

SEQ ID NO: 3844229 - RNA, 20 nt, Human
gccacuuuacccaccuagaa

SEQ ID NO: 3844230 - RNA, 22 nt, Human
gccacuuuacccaccuagaaca

SEQ ID NO: 3844231 - RNA, 23 nt, Human
gccacuuuacccaccuagaacac

SEQ ID NO: 3844232 - RNA, 18 nt, Human
gccacuuuccaagucacu

SEQ ID NO: 3844233 - RNA, 23 nt, Human
gccacuuugguacauggccagug

SEQ ID NO: 3844234 - RNA, 23 nt, Human
gccacuuuuuuuuuuaaucucca

SEQ ID NO: 3844235 - RNA, 16 nt, Human
gccagaacaguuugua

SEQ ID NO: 3844236 - RNA, 14 nt, Human
gccagaaccccgag

SEQ ID NO: 3844237 - RNA, 15 nt, Human
gccagaaccccgagc

SEQ ID NO: 3844238 - RNA, 17 nt, Human
gccagaaccuggagggc

SEQ ID NO: 3844239 - RNA, 17 nt, Human
gccagaagauccccuca

SEQ ID NO: 3844240 - RNA, 21 nt, Human
gccagaagcugagcaccaggg

SEQ ID NO: 3844241 - RNA, 18 nt, Human
gccagaagggggccauga

SEQ ID NO: 3844242 - RNA, 14 nt, Human
gccagaaguaccag

SEQ ID NO: 3844243 - RNA, 17 nt, Human
gccagaaguaccagacu

SEQ ID NO: 3844244 - RNA, 21 nt, Human
gccagaaguaccagacuagau

SEQ ID NO: 3844245 - RNA, 16 nt, Human
gccagaaguagcuuug

SEQ ID NO: 3844246 - RNA, 20 nt, Human
gccagaagucaaggcuuaga

SEQ ID NO: 3844247 - RNA, 22 nt, Human
gccagaagucaaggcuuagacc

SEQ ID NO: 3844248 - RNA, 22 nt, Human
gccagaaucagcacagauaaaa

SEQ ID NO: 3844249 - RNA, 16 nt, Human
gccagacacaggcccu

SEQ ID NO: 3844250 - RNA, 13 nt, Human
gccagacacucug

SEQ ID NO: 3844251 - RNA, 18 nt, Human
gccagaccagcaggcugg

SEQ ID NO: 3844252 - RNA, 13 nt, Human
gccagaccaugga

SEQ ID NO: 3844253 - RNA, 17 nt, Human
gccagaccauggacacu

SEQ ID NO: 3844254 - RNA, 21 nt, Human
gccagaccugcagacgcccag

SEQ ID NO: 3844255 - RNA, 23 nt, Human
gccagacggcacccacccagcac

SEQ ID NO: 3844256 - RNA, 18 nt, Human
gccagacuggcacaguuu

SEQ ID NO: 3844257 - RNA, 19 nt, Human
gccagacuggcacaguuuu

SEQ ID NO: 3844258 - RNA, 10 nt, Human
gccagagaag

SEQ ID NO: 3844259 - RNA, 15 nt, Human
gccagagaagugaca

SEQ ID NO: 3844260 - RNA, 17 nt, Human
gccagagacacaagccu

SEQ ID NO: 3844261 - RNA, 15 nt, Human
gccagagcccacucc

SEQ ID NO: 3844262 - RNA, 20 nt, Human
gccagagcccacuccaucug

SEQ ID NO: 3844263 - RNA, 24 nt, Human
gccagagcccacuccaucugguag

SEQ ID NO: 3844264 - RNA, 15 nt, Human
gccagagccuggggc

SEQ ID NO: 3844265 - RNA, 17 nt, Human
gccagagccuggggcuc

SEQ ID NO: 3844266 - RNA, 22 nt, Human
gccagagcuacccgcagaguuc

SEQ ID NO: 3844267 - RNA, 17 nt, Human
gccagagcugaagaguu

SEQ ID NO: 3844268 - RNA, 23 nt, Human
gccagaggaacuguccagagagc

SEQ ID NO: 3844269 - RNA, 18 nt, Human
gccagaggaauccuggca

SEQ ID NO: 3844270 - RNA, 22 nt, Human
gccagaggaauccuggcagccc

SEQ ID NO: 3844271 - RNA, 23 nt, Human
gccagaggaauccuggcagccca

SEQ ID NO: 3844272 - RNA, 10 nt, Human
gccagaggag

SEQ ID NO: 3844273 - RNA, 22 nt, Human
gccagaggagagaggacccccu

SEQ ID NO: 3844274 - RNA, 14 nt, Human
gccagaggccccca

SEQ ID NO: 3844275 - RNA, 20 nt, Human
gccagaggcccccagcccag

SEQ ID NO: 3844276 - RNA, 22 nt, Human
gccagaggcucguugacuggcu

SEQ ID NO: 3844277 - RNA, 12 nt, Human
gccagaggcugg

SEQ ID NO: 3844278 - RNA, 20 nt, Human
gccagagggagugacagagg

SEQ ID NO: 3844279 - RNA, 14 nt, Human
gccagaggggaagg

SEQ ID NO: 3844280 - RNA, 12 nt, Human
gccagagguggg

SEQ ID NO: 3844281 - RNA, 16 nt, Human
gccagaggugggcagg

SEQ ID NO: 3844282 - RNA, 22 nt, Human
gccagaggugggcagguggugg

SEQ ID NO: 3844283 - RNA, 17 nt, Human
gccagaguccuuuccaa

SEQ ID NO: 3844284 - RNA, 13 nt, Human
gccagaguggccu

SEQ ID NO: 3844285 - RNA, 14 nt, Human
gccagaguggccug

SEQ ID NO: 3844286 - RNA, 15 nt, Human
gccagaguggccugg

SEQ ID NO: 3844287 - RNA, 18 nt, Human
gccagaguggccuggcca

SEQ ID NO: 3844288 - RNA, 13 nt, Human
gccagaguuccug

SEQ ID NO: 3844289 - RNA, 18 nt, Human
gccagaguuccugcggag

SEQ ID NO: 3844290 - RNA, 11 nt, Human
gccagauccag

SEQ ID NO: 3844291 - RNA, 15 nt, Human
gccagauccagccug

SEQ ID NO: 3844292 - RNA, 16 nt, Human
gccagauccucuuggu

SEQ ID NO: 3844293 - RNA, 22 nt, Human
gccagaugcacaucccuggaag

SEQ ID NO: 3844294 - RNA, 14 nt, Human
gccagaugcaccag

SEQ ID NO: 3844295 - RNA, 15 nt, Human
gccagaugcaccagc

SEQ ID NO: 3844296 - RNA, 11 nt, Human
gccagaugcug

SEQ ID NO: 3844297 - RNA, 15 nt, Human
gccagaugcugaugu

SEQ ID NO: 3844298 - RNA, 12 nt, Human
uacauguuugca

SEQ ID NO: 3844299 - RNA, 22 nt, Human
uacauguuugcaccuuucuagu

SEQ ID NO: 3844300 - RNA, 19 nt, Human
gccaggcuccuuccugucu

SEQ ID NO: 3844301 - RNA, 12 nt, Human
gccaggcucugu

SEQ ID NO: 3844302 - RNA, 16 nt, Human
gccaggcugaccacag

SEQ ID NO: 3844303 - RNA, 20 nt, Human
gccaggcugaccacagcaca

SEQ ID NO: 3844304 - RNA, 14 nt, Human
gccaggcugccaag

SEQ ID NO: 3844305 - RNA, 18 nt, Human
gccaggcugccuggccuu

SEQ ID NO: 3844306 - RNA, 22 nt, Human
gccaggcugcucuugaacuccu

SEQ ID NO: 3844307 - RNA, 13 nt, Human
gccaggcuggguc

SEQ ID NO: 3844308 - RNA, 13 nt, Human
gccaggcuggucu

SEQ ID NO: 3844309 - RNA, 20 nt, Human
gccagggaaagacuggcaag

SEQ ID NO: 3844310 - RNA, 18 nt, Human
gccagggaaguccccgag

SEQ ID NO: 3844311 - RNA, 13 nt, Human
gccagggacagag

SEQ ID NO: 3844312 - RNA, 21 nt, Human
gccagggagacagagcucaca

SEQ ID NO: 3844313 - RNA, 22 nt, Human
gccagggagaccuggacacagg

SEQ ID NO: 3844314 - RNA, 13 nt, Human
gccagggagagcc

SEQ ID NO: 3844315 - RNA, 14 nt, Human
gccagggagcgagu

SEQ ID NO: 3844316 - RNA, 21 nt, Human
gccagggauggggccacagcc

SEQ ID NO: 3844317 - RNA, 20 nt, Human
gccagggcaaugaugaauga

SEQ ID NO: 3844318 - RNA, 12 nt, Human
uagcuccugugg

SEQ ID NO: 3844319 - RNA, 17 nt, Human
uagcucucuaggccucu

SEQ ID NO: 3844320 - RNA, 12 nt, Human
uagcucugagaa

SEQ ID NO: 3844321 - RNA, 13 nt, Human
uagcucugagaac

SEQ ID NO: 3844322 - RNA, 22 nt, Human
uagcucuuuuuuguuuguuucu

SEQ ID NO: 3844323 - RNA, 23 nt, Human
uagcucuuuuuuguuuguuucuu

SEQ ID NO: 3844324 - RNA, 15 nt, Human
uagcugaagaauuga

SEQ ID NO: 3844325 - RNA, 18 nt, Human
uagcugaauguuuuucua

SEQ ID NO: 3844326 - RNA, 12 nt, Human
uagcugagcuca

SEQ ID NO: 3844327 - RNA, 23 nt, Human
uagcugcacagggcagcugggcc

SEQ ID NO: 3844328 - RNA, 21 nt, Human
uagcugcagauaaguggccuu

SEQ ID NO: 3844329 - RNA, 20 nt, Human
uagcugcauuugucuggccu

SEQ ID NO: 3844330 - RNA, 12 nt, Human
uagcugccaagu

SEQ ID NO: 3844331 - RNA, 23 nt, Human
uagcugcccauuucgugagcccc

SEQ ID NO: 3844332 - RNA, 13 nt, Human
uagcugcuacaaa

SEQ ID NO: 3844333 - RNA, 19 nt, Human
uagcugcuacaaagaagac

SEQ ID NO: 3844334 - RNA, 20 nt, Human
uagcugcuacaaagaagaca

SEQ ID NO: 3844335 - RNA, 12 nt, Human
uagcugcuguca

SEQ ID NO: 3844336 - RNA, 17 nt, Human
uagcuggagaggagccc

SEQ ID NO: 3844337 - RNA, 16 nt, Human
uagcuggcaagaaugg

SEQ ID NO: 3844338 - RNA, 18 nt, Human
uagcugggaaagcauaaa

SEQ ID NO: 3844339 - RNA, 11 nt, Human
uagcugggacu

SEQ ID NO: 3844340 - RNA, 14 nt, Human
uagcugggacuaca

SEQ ID NO: 3844341 - RNA, 18 nt, Human
uagcugggggugggccag

SEQ ID NO: 3844342 - RNA, 14 nt, Human
uagcuggugguuuc

SEQ ID NO: 3844343 - RNA, 17 nt, Human
uagcuggugguuucacg

SEQ ID NO: 3844344 - RNA, 18 nt, Human
uagcugguuccugcuaga

SEQ ID NO: 3844345 - RNA, 23 nt, Human
uagcugguuccugcuagaaaugg

SEQ ID NO: 3844346 - RNA, 20 nt, Human
uagcugguuggagagcuaga

SEQ ID NO: 3844347 - RNA, 12 nt, Human
uagcuguaaaac

SEQ ID NO: 3844348 - RNA, 19 nt, Human
uagcuguaaggcaugaagg

SEQ ID NO: 3844349 - RNA, 12 nt, Human
uagcuguacaaa

SEQ ID NO: 3844350 - RNA, 17 nt, Human
uagcuguacuucuugaa

SEQ ID NO: 3844351 - RNA, 23 nt, Human
uagcuguacuucuugaauauaaa

SEQ ID NO: 3844352 - RNA, 12 nt, Human
uagcuguauuga

SEQ ID NO: 3844353 - RNA, 14 nt, Human
uagcuguauugaau

SEQ ID NO: 3844354 - RNA, 16 nt, Human
uagcuguauugaauca

SEQ ID NO: 3844355 - RNA, 21 nt, Human
uagcugucccaucuggucauu

SEQ ID NO: 3844356 - RNA, 22 nt, Human
uagcuguccuuuuuccucucca

SEQ ID NO: 3844357 - RNA, 17 nt, Human
uagcugucuagaguagc

SEQ ID NO: 3844358 - RNA, 15 nt, Human
uagcugugaccugcu

SEQ ID NO: 3844359 - RNA, 17 nt, Human
uagcugugaccugcuga

SEQ ID NO: 3844360 - RNA, 22 nt, Human
uagcugugaccugcugagcucu

SEQ ID NO: 3844361 - RNA, 10 nt, Human
uagcuguggg

SEQ ID NO: 3844362 - RNA, 18 nt, Human
uagcuguggugagguggg

SEQ ID NO: 3844363 - RNA, 20 nt, Human
uagcuguuauuucuauuuuu

SEQ ID NO: 3844364 - RNA, 16 nt, Human
uagcuuaccagaagcu

SEQ ID NO: 3844365 - RNA, 15 nt, Human
uagcuuagaccucag

SEQ ID NO: 3844366 - RNA, 19 nt, Human
uagcuuagaccucagccug

SEQ ID NO: 3844367 - RNA, 13 nt, Human
uagcuuagagccu

SEQ ID NO: 3844368 - RNA, 19 nt, Human
uagcuuaucaauuugucau

SEQ ID NO: 3844369 - RNA, 15 nt, Human
uagcuuaucuacuuc

SEQ ID NO: 3844370 - RNA, 19 nt, Human
uagcuuauuuuuacaguua

SEQ ID NO: 3844371 - RNA, 21 nt, Human
uagcuucaccccaaucccagc

SEQ ID NO: 3844372 - RNA, 12 nt, Human
uagcuucaggaa

SEQ ID NO: 3844373 - RNA, 14 nt, Human
uagcuucagucauu

SEQ ID NO: 3844374 - RNA, 16 nt, Human
uagcuucagucauuaa

SEQ ID NO: 3844375 - RNA, 21 nt, Human
uagcuucagucauuaaauuac

SEQ ID NO: 3844376 - RNA, 22 nt, Human
uagcuucugcuuuucugcccug

SEQ ID NO: 3844377 - RNA, 19 nt, Human
uagcuugcgcauucucaug

SEQ ID NO: 3844378 - RNA, 15 nt, Human
uagcuugggacaaau

SEQ ID NO: 3844379 - RNA, 13 nt, Human
uagcuuguauagu

SEQ ID NO: 3844380 - RNA, 19 nt, Human
uagcuuguauaguguaaaa

SEQ ID NO: 3844381 - RNA, 16 nt, Human
uagcuuuaacuuaaau

SEQ ID NO: 3844382 - RNA, 19 nt, Human
uagcuuuauauauggacau

SEQ ID NO: 3844383 - RNA, 20 nt, Human
uagcuuuauauauggacaug

SEQ ID NO: 3844384 - RNA, 21 nt, Human
uagcuuuauauauggacaugg

SEQ ID NO: 3844385 - RNA, 18 nt, Human
uagcuuuauuuuuuaagu

SEQ ID NO: 3844386 - RNA, 13 nt, Human
uagcuuuguguuu

SEQ ID NO: 3844387 - RNA, 14 nt, Human
uagcuuuguguuug

SEQ ID NO: 3844388 - RNA, 15 nt, Human
uagcuuuguguuugg

SEQ ID NO: 3844389 - RNA, 21 nt, Human
uagcuuuguguuugguuuaca

SEQ ID NO: 3844390 - RNA, 14 nt, Human
uagcuuuuauugua

SEQ ID NO: 3844391 - RNA, 13 nt, Human
uagcuuuucaccu

SEQ ID NO: 3844392 - RNA, 12 nt, Human
uagcuuuugugg

SEQ ID NO: 3844393 - RNA, 19 nt, Human
uagcuuuugugucuuacau

SEQ ID NO: 3844394 - RNA, 15 nt, Human
uagcuuuuuaaaaca

SEQ ID NO: 3844395 - RNA, 18 nt, Human
uagcuuuuuaaaacauua

SEQ ID NO: 3844396 - RNA, 20 nt, Human
uagcuuuuuaauuaagcaaa

SEQ ID NO: 3844397 - RNA, 16 nt, Human
uaggaaaaacugauuu

SEQ ID NO: 3844398 - RNA, 22 nt, Human
uaggaaaagaaaucuauagaaa

SEQ ID NO: 3844399 - RNA, 13 nt, Human
uaggaaaauaaaa

SEQ ID NO: 3844400 - RNA, 13 nt, Human
uaggaaaauauuu

SEQ ID NO: 3844401 - RNA, 14 nt, Human
uaggaaauaaaacc

SEQ ID NO: 3844402 - RNA, 19 nt, Human
uaggaaauaaaaccuuuca

SEQ ID NO: 3844403 - RNA, 20 nt, Human
uaggaaauaaaaccuuucaa

SEQ ID NO: 3844404 - RNA, 18 nt, Human
uaggaaauauuuauuuua

SEQ ID NO: 3844405 - RNA, 20 nt, Human
uaggaaaucuagaaguaguc

SEQ ID NO: 3844406 - RNA, 14 nt, Human
uaggaaaugaaugu

SEQ ID NO: 3844407 - RNA, 18 nt, Human
uaggaaaugaaugugugu

SEQ ID NO: 3844408 - RNA, 19 nt, Human
uaggaaaugaaugugugug

SEQ ID NO: 3844409 - RNA, 21 nt, Human
uaggaaauguuuuuaauaaaa

SEQ ID NO: 3844410 - RNA, 13 nt, Human
uaggaacacuccu

SEQ ID NO: 3844411 - RNA, 14 nt, Human
uaggaacacuccuu

SEQ ID NO: 3844412 - RNA, 16 nt, Human
uaggaacauaugaaaa

SEQ ID NO: 3844413 - RNA, 22 nt, Human
uaggaaccgugguaugucugcc

SEQ ID NO: 3844414 - RNA, 19 nt, Human
uaggaagaaagaagacaaa

SEQ ID NO: 3844415 - RNA, 23 nt, Human
uaggaagaacguuuuuuccucag

SEQ ID NO: 3844416 - RNA, 13 nt, Human
uaggaagacuuug

SEQ ID NO: 3844417 - RNA, 14 nt, Human
uaggaagacuuugg

SEQ ID NO: 3844418 - RNA, 15 nt, Human
uaggaagacuuugga

SEQ ID NO: 3844419 - RNA, 16 nt, Human
uaggaagacuuuggaa

SEQ ID NO: 3844420 - RNA, 17 nt, Human
uaggaagacuuuggaaa

SEQ ID NO: 3844421 - RNA, 19 nt, Human
uaggaagagaaaccaggga

SEQ ID NO: 3844422 - RNA, 22 nt, Human
uaggaagaguagcauuucauuc

SEQ ID NO: 3844423 - RNA, 19 nt, Human
uaggaaggcacuucugccu

SEQ ID NO: 3844424 - RNA, 14 nt, Human
uaggaagguacugu

SEQ ID NO: 3844425 - RNA, 15 nt, Human
uaggaagguacugua

SEQ ID NO: 3844426 - RNA, 23 nt, Human
uaggaaggucauuuccauguaug

SEQ ID NO: 3844427 - RNA, 21 nt, Human
uaggaaggucucauucuucca

SEQ ID NO: 3844428 - RNA, 17 nt, Human
uaggaaguguaacagcu

SEQ ID NO: 3844429 - RNA, 22 nt, Human
uaggaaguugacuuauaguaca

SEQ ID NO: 3844430 - RNA, 22 nt, Human
uaggaauaucaauauaauguuu

SEQ ID NO: 3844431 - RNA, 17 nt, Human
uaggaauauuauauuug

SEQ ID NO: 3844432 - RNA, 23 nt, Human
uaggaauauuauauuuggaugca

SEQ ID NO: 3844433 - RNA, 12 nt, Human
uaggaaucagca

SEQ ID NO: 3844434 - RNA, 22 nt, Human
uaggaaucauucagaaauguug

SEQ ID NO: 3844435 - RNA, 16 nt, Human
uaggaauggaaaggau

SEQ ID NO: 3844436 - RNA, 17 nt, Human
uaggaaugugaaagcac

SEQ ID NO: 3844437 - RNA, 17 nt, Human
uaggaauucaucuuuug

SEQ ID NO: 3844438 - RNA, 21 nt, Human
uaggaauucccagcccaaagc

SEQ ID NO: 3844439 - RNA, 14 nt, Human
uaggaauuguguuu

SEQ ID NO: 3844440 - RNA, 16 nt, Human
uaggaauuguguuuau

SEQ ID NO: 3844441 - RNA, 18 nt, Human
uaggacaaaguauuugaa

SEQ ID NO: 3844442 - RNA, 15 nt, Human
uaggacaaggugcag

SEQ ID NO: 3844443 - RNA, 20 nt, Human
uaggacaaggugcaggcagg

SEQ ID NO: 3844444 - RNA, 18 nt, Human
uaggacaaucaguccccu

SEQ ID NO: 3844445 - RNA, 19 nt, Human
uagaagguucucuccuccc

SEQ ID NO: 3844446 - RNA, 21 nt, Human
uagaaguaacuggugauauau

SEQ ID NO: 3844447 - RNA, 17 nt, Human
uagaaguagaauugaca

SEQ ID NO: 3844448 - RNA, 18 nt, Human
uagaagucuuagauguau

SEQ ID NO: 3844449 - RNA, 24 nt, Human
uagaagucuucaugaaaugcuaug

SEQ ID NO: 3844450 - RNA, 16 nt, Human
uagaagugcuccccuc

SEQ ID NO: 3844451 - RNA, 16 nt, Human
uagaaguggaccagga

SEQ ID NO: 3844452 - RNA, 19 nt, Human
uagaagugggccaggacag

SEQ ID NO: 3844453 - RNA, 20 nt, Human
uagaagugggccaggacagg

SEQ ID NO: 3844454 - RNA, 18 nt, Human
uagaaguuguuugucauc

SEQ ID NO: 3844455 - RNA, 14 nt, Human
uagaaguuugucca

SEQ ID NO: 3844456 - RNA, 22 nt, Human
uagaaguuuuuguacuguaaag

SEQ ID NO: 3844457 - RNA, 14 nt, Human
uagaauaaaauugu

SEQ ID NO: 3844458 - RNA, 15 nt, Human
uagaauaaaauugua

SEQ ID NO: 3844459 - RNA, 19 nt, Human
uagaauaaaggcaguuuuc

SEQ ID NO: 3844460 - RNA, 21 nt, Human
uagaauaaaggcaguuuucua

SEQ ID NO: 3844461 - RNA, 15 nt, Human
uagaauaaaguugaa

SEQ ID NO: 3844462 - RNA, 17 nt, Human
uagaauaagaauuugca

SEQ ID NO: 3844463 - RNA, 17 nt, Human
uagaauaaucuugcuca

SEQ ID NO: 3844464 - RNA, 23 nt, Human
uagaauaccacaggaaccacaag

SEQ ID NO: 3844465 - RNA, 18 nt, Human
uagaauacuuuuuaaaag

SEQ ID NO: 3844466 - RNA, 18 nt, Human
uagaauagcauguuguag

SEQ ID NO: 3844467 - RNA, 18 nt, Human
uagaauauaauuaucgga

SEQ ID NO: 3844468 - RNA, 21 nt, Human
uagaauauaggucucuucucc

SEQ ID NO: 3844469 - RNA, 13 nt, Human
uagaauaugccuu

SEQ ID NO: 3844470 - RNA, 17 nt, Human
uagaauauucagacaaa

SEQ ID NO: 3844471 - RNA, 22 nt, Human
uagaauauucagacaaaaugga

SEQ ID NO: 3844472 - RNA, 20 nt, Human
uagaauauuuauuaccucug

SEQ ID NO: 3844473 - RNA, 15 nt, Human
uagaaucaaucagua

SEQ ID NO: 3844474 - RNA, 14 nt, Human
uagaaucaauuuaa

SEQ ID NO: 3844475 - RNA, 21 nt, Human
uagaaucccagcccccugacc

SEQ ID NO: 3844476 - RNA, 22 nt, Human
uagaaucccagcccccugacca

SEQ ID NO: 3844477 - RNA, 16 nt, Human
uagaaucccuguguua

SEQ ID NO: 3844478 - RNA, 18 nt, Human
uagaaucugcaauucaaa

SEQ ID NO: 3844479 - RNA, 17 nt, Human
uagaaugaaaacucauu

SEQ ID NO: 3844480 - RNA, 15 nt, Human
uagaaugaccuugua

SEQ ID NO: 3844481 - RNA, 16 nt, Human
uagaaugaccuuguaa

SEQ ID NO: 3844482 - RNA, 14 nt, Human
uagaaugagaucug

SEQ ID NO: 3844483 - RNA, 15 nt, Human
uagaauggugauuuu

SEQ ID NO: 3844484 - RNA, 17 nt, Human
uagaauggugauuuuaa

SEQ ID NO: 3844485 - RNA, 21 nt, Human
uagaauggugauuuuaaaugu

SEQ ID NO: 3844486 - RNA, 15 nt, Human
uagaauguaaagcuu

SEQ ID NO: 3844487 - RNA, 13 nt, Human
uagaauguauugu

SEQ ID NO: 3844488 - RNA, 17 nt, Human
uagaauguauuguaccu

SEQ ID NO: 3844489 - RNA, 18 nt, Human
uagaauguguuuucugaa

SEQ ID NO: 3844490 - RNA, 16 nt, Human
uagaauguuucauuug

SEQ ID NO: 3844491 - RNA, 14 nt, Human
uagaauguuuuccu

SEQ ID NO: 3844492 - RNA, 21 nt, Human
uagaauuaaaaaagcauacuu

SEQ ID NO: 3844493 - RNA, 15 nt, Human
uagaauuaacacaug

SEQ ID NO: 3844494 - RNA, 18 nt, Human
uagaauuaacacaugauc

SEQ ID NO: 3844495 - RNA, 16 nt, Human
uagaauuaccauuugu

SEQ ID NO: 3844496 - RNA, 23 nt, Human
uagaauuaguggcacuugcuuuu

SEQ ID NO: 3844497 - RNA, 15 nt, Human
uagaauuaucuaauu

SEQ ID NO: 3844498 - RNA, 19 nt, Human
uagaauuaucuaauuuaua

SEQ ID NO: 3844499 - RNA, 21 nt, Human
uagaauuaucuaauuuauaaa

SEQ ID NO: 3844500 - RNA, 23 nt, Human
uagaauuaucuaauuuauaaaaa

SEQ ID NO: 3844501 - RNA, 16 nt, Human
uagaauuauuuaaaca

SEQ ID NO: 3844502 - RNA, 23 nt, Human
uagaauuauuucacaaauaauag

SEQ ID NO: 3844503 - RNA, 19 nt, Human
uagaauuauuuuucacucu

SEQ ID NO: 3844504 - RNA, 14 nt, Human
uagaauucuguaua

SEQ ID NO: 3844505 - RNA, 16 nt, Human
uagaauucuguauaga

SEQ ID NO: 3844506 - RNA, 21 nt, Human
uagaauucuguauuggauaua

SEQ ID NO: 3844507 - RNA, 16 nt, Human
uagaauugaagguuuu

SEQ ID NO: 3844508 - RNA, 21 nt, Human
uagaauugacauugaaaucua

SEQ ID NO: 3844509 - RNA, 14 nt, Human
uagaauugcauuga

SEQ ID NO: 3844510 - RNA, 19 nt, Human
uagaauuggcugaacucau

SEQ ID NO: 3844511 - RNA, 13 nt, Human
uagaauuguuaua

SEQ ID NO: 3844512 - RNA, 15 nt, Human
uagaauuuauucaau

SEQ ID NO: 3844513 - RNA, 20 nt, Human
uagaauuuauucaauuccuc

SEQ ID NO: 3844514 - RNA, 20 nt, Human
uagaauuugauaugugaaca

SEQ ID NO: 3844515 - RNA, 13 nt, Human
uagaauuugauua

SEQ ID NO: 3844516 - RNA, 18 nt, Human
uagaauuuuuaauguuuu

SEQ ID NO: 3844517 - RNA, 14 nt, Human
uagacaaaguacau

SEQ ID NO: 3844518 - RNA, 15 nt, Human
uagacaaauacucau

SEQ ID NO: 3844519 - RNA, 17 nt, Human
uagacaaauacucaugu

SEQ ID NO: 3844520 - RNA, 19 nt, Human
uagacaaauacucaugugu

SEQ ID NO: 3844521 - RNA, 21 nt, Human
uagacaaauacucauguguau

SEQ ID NO: 3844522 - RNA, 17 nt, Human
uagacaaauagaaaaug

SEQ ID NO: 3844523 - RNA, 19 nt, Human
uagacaaauagaaaauggu

SEQ ID NO: 3844524 - RNA, 20 nt, Human
uauaauguguguauguguau

SEQ ID NO: 3844525 - RNA, 16 nt, Human
uauaauguuaguagaa

SEQ ID NO: 3844526 - RNA, 20 nt, Human
uauaauguuuauuaaaugcu

SEQ ID NO: 3844527 - RNA, 16 nt, Human
uauaauuaacauguua

SEQ ID NO: 3844528 - RNA, 17 nt, Human
uauaauuauguuauuga

SEQ ID NO: 3844529 - RNA, 22 nt, Human
uauaauuauguuauugaaaaaa

SEQ ID NO: 3844530 - RNA, 20 nt, Human
uauaauucacauuguauuca

SEQ ID NO: 3844531 - RNA, 21 nt, Human
uauaauucagaaggaucuuca

SEQ ID NO: 3844532 - RNA, 13 nt, Human
uauaauucccuau

SEQ ID NO: 3844533 - RNA, 12 nt, Human
uauaauucugua

SEQ ID NO: 3844534 - RNA, 15 nt, Human
uauaauucuguaaau

SEQ ID NO: 3844535 - RNA, 19 nt, Human
uauaauucuguacauagcc

SEQ ID NO: 3844536 - RNA, 21 nt, Human
uauaauucuguacauagccua

SEQ ID NO: 3844537 - RNA, 16 nt, Human
uauaauucuuucaaua

SEQ ID NO: 3844538 - RNA, 18 nt, Human
uauaauuguaucagaggc

SEQ ID NO: 3844539 - RNA, 22 nt, Human
uauaauuguaucguauagcugu

SEQ ID NO: 3844540 - RNA, 12 nt, Human
uauaauugugug

SEQ ID NO: 3844541 - RNA, 20 nt, Human
uauaauugugugauauuuca

SEQ ID NO: 3844542 - RNA, 16 nt, Human
uauaauuguugcauag

SEQ ID NO: 3844543 - RNA, 22 nt, Human
uauaauuguuuuaucugaauuu

SEQ ID NO: 3844544 - RNA, 21 nt, Human
uauaauuguuuuuuaucuuuu

SEQ ID NO: 3844545 - RNA, 22 nt, Human
uauaauuguuuuuuaucuuuuc

SEQ ID NO: 3844546 - RNA, 11 nt, Human
uauaauuuaau

SEQ ID NO: 3844547 - RNA, 16 nt, Human
uauaauuuaccuaaga

SEQ ID NO: 3844548 - RNA, 18 nt, Human
uauaauuuaccuaagauu

SEQ ID NO: 3844549 - RNA, 18 nt, Human
uauaauuuaccugaaguc

SEQ ID NO: 3844550 - RNA, 21 nt, Human
uauaauuuaccugaagucuuu

SEQ ID NO: 3844551 - RNA, 19 nt, Human
uauaauuuauuuccacuaa

SEQ ID NO: 3844552 - RNA, 20 nt, Human
uauaauuuccauuuacuuaa

SEQ ID NO: 3844553 - RNA, 16 nt, Human
uauaauuucgagauuu

SEQ ID NO: 3844554 - RNA, 18 nt, Human
uauaauuuuaagauuccu

SEQ ID NO: 3844555 - RNA, 15 nt, Human
uauaauuuugauagu

SEQ ID NO: 3844556 - RNA, 14 nt, Human
uauaauuuugugaa

SEQ ID NO: 3844557 - RNA, 20 nt, Human
uauaauuuuuuuauguuuug

SEQ ID NO: 3844558 - RNA, 20 nt, Human
uauaauuuuuuuauuacuga

SEQ ID NO: 3844559 - RNA, 22 nt, Human
uauacaaaccuaccaaaaugga

SEQ ID NO: 3844560 - RNA, 12 nt, Human
uauacaaauaua

SEQ ID NO: 3844561 - RNA, 16 nt, Human
uauacaaauauauugu

SEQ ID NO: 3844562 - RNA, 16 nt, Human
uauacaaauuaaaaag

SEQ ID NO: 3844563 - RNA, 17 nt, Human
uauacaaauuaaaaaga

SEQ ID NO: 3844564 - RNA, 16 nt, Human
uauacaacaaaggcaa

SEQ ID NO: 3844565 - RNA, 13 nt, Human
uauacaacagugc

SEQ ID NO: 3844566 - RNA, 14 nt, Human
uauacaacagugcu

SEQ ID NO: 3844567 - RNA, 20 nt, Human
uauacaacagugcuaaaaau

SEQ ID NO: 3844568 - RNA, 22 nt, Human
uauacaacccuggcauuauguc

SEQ ID NO: 3844569 - RNA, 17 nt, Human
uauacaaccuucauuua

SEQ ID NO: 3844570 - RNA, 19 nt, Human
uauacaaccuucauuuaaa

SEQ ID NO: 3844571 - RNA, 13 nt, Human
uauacaagauaag

SEQ ID NO: 3844572 - RNA, 17 nt, Human
uauacaagauaagcuuc

SEQ ID NO: 3844573 - RNA, 19 nt, Human
uauacaagauaagcuucca

SEQ ID NO: 3844574 - RNA, 13 nt, Human
uauacaaguacug

SEQ ID NO: 3844575 - RNA, 14 nt, Human
uauacaauauauaa

SEQ ID NO: 3844576 - RNA, 15 nt, Human
uauacaauauauaaa

SEQ ID NO: 3844577 - RNA, 11 nt, Human
uauacacacac

SEQ ID NO: 3844578 - RNA, 19 nt, Human
uauacacacacaaagagag

SEQ ID NO: 3844579 - RNA, 20 nt, Human
uauacacacacaaagagagu

SEQ ID NO: 3844580 - RNA, 12 nt, Human
uauacacacagc

SEQ ID NO: 3844581 - RNA, 11 nt, Human
uauacacauaa

SEQ ID NO: 3844582 - RNA, 17 nt, Human
uauacacauauaccuau

SEQ ID NO: 3844583 - RNA, 21 nt, Human
uauacacgaauagacaucaaa

SEQ ID NO: 3844584 - RNA, 14 nt, Human
uauacacuguaaug

SEQ ID NO: 3844585 - RNA, 22 nt, Human
uauacacuuacacuuuaugcac

SEQ ID NO: 3844586 - RNA, 18 nt, Human
uauacaggcauaaaauag

SEQ ID NO: 3844587 - RNA, 20 nt, Human
uauacaguaacuuuaugugu

SEQ ID NO: 3844588 - RNA, 22 nt, Human
uauacauaacaggguaaauuau

SEQ ID NO: 3844589 - RNA, 17 nt, Human
gcccauguguucccucu

SEQ ID NO: 3844590 - RNA, 14 nt, Human
gcccauguucugcc

SEQ ID NO: 3844591 - RNA, 15 nt, Human
gcccauguucugccc

SEQ ID NO: 3844592 - RNA, 16 nt, Human
gcccauguucugcccc

SEQ ID NO: 3844593 - RNA, 23 nt, Human
gcccauucauuccauucuggaag

SEQ ID NO: 3844594 - RNA, 22 nt, Human
gcccauuccccagccucucuuc

SEQ ID NO: 3844595 - RNA, 16 nt, Human
gcccauuccucaccuu

SEQ ID NO: 3844596 - RNA, 18 nt, Human
gcccauucuacuugcucu

SEQ ID NO: 3844597 - RNA, 15 nt, Human
gcccauucucucucc

SEQ ID NO: 3844598 - RNA, 21 nt, Human
gcccauuuacacuuuugagac

SEQ ID NO: 3844599 - RNA, 18 nt, Human
gcccauuucaauucucaa

SEQ ID NO: 3844600 - RNA, 15 nt, Human
gcccauuucgugagc

SEQ ID NO: 3844601 - RNA, 15 nt, Human
gcccauuucuccaga

SEQ ID NO: 3844602 - RNA, 20 nt, Human
gcccauuuggagggccuggg

SEQ ID NO: 3844603 - RNA, 15 nt, Human
gcccauuugggcaga

SEQ ID NO: 3844604 - RNA, 15 nt, Human
gccccaaaaccacag

SEQ ID NO: 3844605 - RNA, 23 nt, Human
gccccaaaaccacagcccuguca

SEQ ID NO: 3844606 - RNA, 21 nt, Human
gccccaaaacucuccucugcu

SEQ ID NO: 3844607 - RNA, 18 nt, Human
gccccaaacaaauaugca

SEQ ID NO: 3844608 - RNA, 20 nt, Human
gccccaaaggaaaaagcaca

SEQ ID NO: 3844609 - RNA, 15 nt, Human
gccccaaaggaagcu

SEQ ID NO: 3844610 - RNA, 22 nt, Human
gccccaaaguaaaagaaaccac

SEQ ID NO: 3844611 - RNA, 22 nt, Human
gccccaacccaaaccuggagau

SEQ ID NO: 3844612 - RNA, 15 nt, Human
gccccaacccuucuu

SEQ ID NO: 3844613 - RNA, 16 nt, Human
gccccaacccuucuuc

SEQ ID NO: 3844614 - RNA, 13 nt, Human
gccccaaccugcu

SEQ ID NO: 3844615 - RNA, 14 nt, Human
gccccaaccugcug

SEQ ID NO: 3844616 - RNA, 19 nt, Human
gccccaacuccuuccagcu

SEQ ID NO: 3844617 - RNA, 16 nt, Human
gccccaacucgggcuc

SEQ ID NO: 3844618 - RNA, 17 nt, Human
gccccaagaaggcuggg

SEQ ID NO: 3844619 - RNA, 21 nt, Human
gccccaagggguuucuguuuc

SEQ ID NO: 3844620 - RNA, 22 nt, Human
gccccaagggguuucuguuucu

SEQ ID NO: 3844621 - RNA, 16 nt, Human
gccccaaguccugaag

SEQ ID NO: 3844622 - RNA, 20 nt, Human
gccccaaguccugaagaggc

SEQ ID NO: 3844623 - RNA, 18 nt, Human
gccccaaucccuuuauua

SEQ ID NO: 3844624 - RNA, 15 nt, Human
gccccacaccagccc

SEQ ID NO: 3844625 - RNA, 16 nt, Human
gccccacaccuccucu

SEQ ID NO: 3844626 - RNA, 19 nt, Human
gccccacacuggggugccg

SEQ ID NO: 3844627 - RNA, 13 nt, Human
gccccacagccca

SEQ ID NO: 3844628 - RNA, 14 nt, Human
gccccacagcccac

SEQ ID NO: 3844629 - RNA, 15 nt, Human
gccccacauguccag

SEQ ID NO: 3844630 - RNA, 23 nt, Human
gccccacauguccagcaccuugu

SEQ ID NO: 3844631 - RNA, 20 nt, Human
gccccaccaccuaggccacu

SEQ ID NO: 3844632 - RNA, 12 nt, Human
gccccacccaga

SEQ ID NO: 3844633 - RNA, 13 nt, Human
gccccacccagau

SEQ ID NO: 3844634 - RNA, 15 nt, Human
gccccacccaggagg

SEQ ID NO: 3844635 - RNA, 16 nt, Human
gccccacccaggccag

SEQ ID NO: 3844636 - RNA, 15 nt, Human
gccccaccccagggc

SEQ ID NO: 3844637 - RNA, 15 nt, Human
gccccacccucagau

SEQ ID NO: 3844638 - RNA, 19 nt, Human
gccccacccugggcccugg

SEQ ID NO: 3844639 - RNA, 21 nt, Human
gccccaccggcgcgcucuucg

SEQ ID NO: 3844640 - RNA, 11 nt, Human
gccccaccugc

SEQ ID NO: 3844641 - RNA, 16 nt, Human
gccccaccugcagcuc

SEQ ID NO: 3844642 - RNA, 17 nt, Human
gccccaccugccacuag

SEQ ID NO: 3844643 - RNA, 18 nt, Human
gccccaccuggcccucuc

SEQ ID NO: 3844644 - RNA, 21 nt, Human
gccccaccuuuauuaaaaucu

SEQ ID NO: 3844645 - RNA, 22 nt, Human
gccccacucccuugcuggcccc

SEQ ID NO: 3844646 - RNA, 23 nt, Human
gccccacucccuugcuggcccca

SEQ ID NO: 3844647 - RNA, 12 nt, Human
gccccacuccuc

SEQ ID NO: 3844648 - RNA, 23 nt, Human
gccccacugaugcuguucucuuc

SEQ ID NO: 3844649 - RNA, 20 nt, Human
gccccacugccagcagcagc

SEQ ID NO: 3844650 - RNA, 11 nt, Human
gccccagagac

SEQ ID NO: 3844651 - RNA, 17 nt, Human
gccccagagacucagag

SEQ ID NO: 3844652 - RNA, 12 nt, Human
gccccagagcug

SEQ ID NO: 3844653 - RNA, 19 nt, Human
gccccagaggccucucucu

SEQ ID NO: 3844654 - RNA, 19 nt, Human
gccccagaucaccagcccg

SEQ ID NO: 3844655 - RNA, 20 nt, Human
gccccagaucaccagcccgg

SEQ ID NO: 3844656 - RNA, 19 nt, Human
gccccagcaccucagccug

SEQ ID NO: 3844657 - RNA, 23 nt, Human
gccccagcacuaaagcaguggac

SEQ ID NO: 3844658 - RNA, 19 nt, Human
gccccagcacuaacguaaa

SEQ ID NO: 3844659 - RNA, 10 nt, Human
gccccagcca

SEQ ID NO: 3844660 - RNA, 12 nt, Human
gccccagcccac

SEQ ID NO: 3844661 - RNA, 20 nt, Human
gccccagcccacccuccugu

SEQ ID NO: 3844662 - RNA, 16 nt, Human
gccccagcccugcugg

SEQ ID NO: 3844663 - RNA, 17 nt, Human
gccccagcccugcuggg

SEQ ID NO: 3844664 - RNA, 16 nt, Human
gccccagccucccuga

SEQ ID NO: 3844665 - RNA, 11 nt, Human
gccccagccug

SEQ ID NO: 3844666 - RNA, 12 nt, Human
gccccagccugc

SEQ ID NO: 3844667 - RNA, 15 nt, Human
gccccagccugcuag

SEQ ID NO: 3844668 - RNA, 16 nt, Human
gccccagccuggccca

SEQ ID NO: 3844669 - RNA, 18 nt, Human
gccccagccuggcccagc

SEQ ID NO: 3844670 - RNA, 14 nt, Human
gccccagcucuggc

SEQ ID NO: 3844671 - RNA, 11 nt, Human
gccccagcuga

SEQ ID NO: 3844672 - RNA, 11 nt, Human
gccccaggacc

SEQ ID NO: 3844673 - RNA, 18 nt, Human
gccccaggaccagcucag

SEQ ID NO: 3844674 - RNA, 19 nt, Human
gccccaggaccagcucagg

SEQ ID NO: 3844675 - RNA, 15 nt, Human
gccccaggcaggcug

SEQ ID NO: 3844676 - RNA, 20 nt, Human
gccccaggcaggcugugcgc

SEQ ID NO: 3844677 - RNA, 12 nt, Human
gccccaggccug

SEQ ID NO: 3844678 - RNA, 12 nt, Human
gccccagggcac

SEQ ID NO: 3844679 - RNA, 18 nt, Human
gccccaggggaacacugg

SEQ ID NO: 3844680 - RNA, 20 nt, Human
gccccagggucuucccuacc

SEQ ID NO: 3844681 - RNA, 21 nt, Human
gccccagggucuucccuaccu

SEQ ID NO: 3844682 - RNA, 16 nt, Human
gccccagguagaaacu

SEQ ID NO: 3844683 - RNA, 13 nt, Human
gccccagucagcc

SEQ ID NO: 3844684 - RNA, 13 nt, Human
gccccagugccca

SEQ ID NO: 3844685 - RNA, 14 nt, Human
gccccagugcccac

SEQ ID NO: 3844686 - RNA, 16 nt, Human
gccccaucagcuccag

SEQ ID NO: 3844687 - RNA, 17 nt, Human
gccccaucagcuccagc

SEQ ID NO: 3844688 - RNA, 19 nt, Human
gccccaucaggacucuugu

SEQ ID NO: 3844689 - RNA, 18 nt, Human
gccccaucccaaacccuu

SEQ ID NO: 3844690 - RNA, 14 nt, Human
gccccauccuccag

SEQ ID NO: 3844691 - RNA, 12 nt, Human
gccccaucuccc

SEQ ID NO: 3844692 - RNA, 17 nt, Human
gccccaucuccccucag

SEQ ID NO: 3844693 - RNA, 15 nt, Human
gccccaucugcgggg

SEQ ID NO: 3844694 - RNA, 15 nt, Human
gccccaucuucaccc

SEQ ID NO: 3844695 - RNA, 18 nt, Human
gccccaugaccuccagcu

SEQ ID NO: 3844696 - RNA, 16 nt, Human
gccccaugccugucca

SEQ ID NO: 3844697 - RNA, 20 nt, Human
gccccaugccuguccagccu

SEQ ID NO: 3844698 - RNA, 23 nt, Human
gccccaugccuguccagccuggg

SEQ ID NO: 3844699 - RNA, 13 nt, Human
gccccaugcugga

SEQ ID NO: 3844700 - RNA, 14 nt, Human
uauaucaguuugau

SEQ ID NO: 3844701 - RNA, 13 nt, Human
uauaucaugcaaa

SEQ ID NO: 3844702 - RNA, 14 nt, Human
uauaucaugcaaaa

SEQ ID NO: 3844703 - RNA, 20 nt, Human
uauaucaugcuuuaaagugu

SEQ ID NO: 3844704 - RNA, 18 nt, Human
uauaucauguaaagaaau

SEQ ID NO: 3844705 - RNA, 15 nt, Human
uauauccauguacug

SEQ ID NO: 3844706 - RNA, 14 nt, Human
uauaucccagaaau

SEQ ID NO: 3844707 - RNA, 14 nt, Human
uauauccccugcua

SEQ ID NO: 3844708 - RNA, 20 nt, Human
uauauccuuucuaacaaaaa

SEQ ID NO: 3844709 - RNA, 19 nt, Human
uauauccuuuucuguguuu

SEQ ID NO: 3844710 - RNA, 17 nt, Human
uauaucguuaucacugu

SEQ ID NO: 3844711 - RNA, 18 nt, Human
uauaucuaaauugaauaa

SEQ ID NO: 3844712 - RNA, 22 nt, Human
uauaucuagguuuaugacagua

SEQ ID NO: 3844713 - RNA, 23 nt, Human
uauaucugaggaauucuguauag

SEQ ID NO: 3844714 - RNA, 17 nt, Human
uauaucugcuucagugg

SEQ ID NO: 3844715 - RNA, 20 nt, Human
uauaucugggcuggccaguu

SEQ ID NO: 3844716 - RNA, 11 nt, Human
uauaucuguau

SEQ ID NO: 3844717 - RNA, 14 nt, Human
uauaucuguaugua

SEQ ID NO: 3844718 - RNA, 17 nt, Human
uauaucuguuuuacugc

SEQ ID NO: 3844719 - RNA, 21 nt, Human
uauaucuuggcagguaggaau

SEQ ID NO: 3844720 - RNA, 19 nt, Human
uauaugaaaacuauacaac

SEQ ID NO: 3844721 - RNA, 15 nt, Human
uauaugaacauagac

SEQ ID NO: 3844722 - RNA, 16 nt, Human
uauaugagaagaauag

SEQ ID NO: 3844723 - RNA, 17 nt, Human
uauaugagaagaauagc

SEQ ID NO: 3844724 - RNA, 15 nt, Human
uauaugauuuauagu

SEQ ID NO: 3844725 - RNA, 19 nt, Human
uauaugcauauauauaugu

SEQ ID NO: 3844726 - RNA, 22 nt, Human
uauaugcauauauauaugugug

SEQ ID NO: 3844727 - RNA, 17 nt, Human
uauaugccuuuuuccua

SEQ ID NO: 3844728 - RNA, 18 nt, Human
uauaugcuauuucuauau

SEQ ID NO: 3844729 - RNA, 17 nt, Human
uauaugcuuacugauau

SEQ ID NO: 3844730 - RNA, 21 nt, Human
uauaugcuuacugauauauuu

SEQ ID NO: 3844731 - RNA, 17 nt, Human
uauauggaaauucugcu

SEQ ID NO: 3844732 - RNA, 15 nt, Human
uauauggaagaaagu

SEQ ID NO: 3844733 - RNA, 16 nt, Human
uauauggaagaaagua

SEQ ID NO: 3844734 - RNA, 19 nt, Human
uauauggcagaguuguaaa

SEQ ID NO: 3844735 - RNA, 15 nt, Human
gcccuaauucagcca

SEQ ID NO: 3844736 - RNA, 15 nt, Human
gcccuacaccuugag

SEQ ID NO: 3844737 - RNA, 22 nt, Human
gcccuaccagcgcccgcugggc

SEQ ID NO: 3844738 - RNA, 14 nt, Human
gcccuacuauucag

SEQ ID NO: 3844739 - RNA, 15 nt, Human
gcccuagagccugcc

SEQ ID NO: 3844740 - RNA, 21 nt, Human
gcccuagagccugccuggagc

SEQ ID NO: 3844741 - RNA, 21 nt, Human
gcccuaggauaaaaagccagg

SEQ ID NO: 3844742 - RNA, 12 nt, Human
gcccuaggcucc

SEQ ID NO: 3844743 - RNA, 21 nt, Human
gcccuaugggccugccgggcu

SEQ ID NO: 3844744 - RNA, 15 nt, Human
gcccuauuuuugcaa

SEQ ID NO: 3844745 - RNA, 19 nt, Human
gcccucaaaaugacagcca

SEQ ID NO: 3844746 - RNA, 15 nt, Human
gcccucaaggccucc

SEQ ID NO: 3844747 - RNA, 21 nt, Human
gcccucaaggccucccacagu

SEQ ID NO: 3844748 - RNA, 22 nt, Human
gcccucaaggccucccacagug

SEQ ID NO: 3844749 - RNA, 17 nt, Human
gcccucaccacccacuu

SEQ ID NO: 3844750 - RNA, 20 nt, Human
gcccucaccccugcccuggg

SEQ ID NO: 3844751 - RNA, 21 nt, Human
gcccucaccccugguucucau

SEQ ID NO: 3844752 - RNA, 16 nt, Human
gcccucacccuggggc

SEQ ID NO: 3844753 - RNA, 14 nt, Human
gcccucagaacccu

SEQ ID NO: 3844754 - RNA, 18 nt, Human
gcccucagaacccuuggc

SEQ ID NO: 3844755 - RNA, 16 nt, Human
gcccucagaugucccu

SEQ ID NO: 3844756 - RNA, 13 nt, Human
uagucacuuuuuu

SEQ ID NO: 3844757 - RNA, 19 nt, Human
uagucagaauuagcugcuu

SEQ ID NO: 3844758 - RNA, 15 nt, Human
uagucauagaagaac

SEQ ID NO: 3844759 - RNA, 17 nt, Human
uagucauauauuaaaca

SEQ ID NO: 3844760 - RNA, 13 nt, Human
uagucaugugacc

SEQ ID NO: 3844761 - RNA, 19 nt, Human
uagucauuuacuaaacaua

SEQ ID NO: 3844762 - RNA, 13 nt, Human
uagucauuuauuu

SEQ ID NO: 3844763 - RNA, 17 nt, Human
uagucauuuucaagacu

SEQ ID NO: 3844764 - RNA, 21 nt, Human
uaguccaaaaagcuccugggg

SEQ ID NO: 3844765 - RNA, 13 nt, Human
uaguccaaaauua

SEQ ID NO: 3844766 - RNA, 18 nt, Human
uaguccaaugucuuuuua

SEQ ID NO: 3844767 - RNA, 22 nt, Human
uaguccagcuuuguucuucuua

SEQ ID NO: 3844768 - RNA, 21 nt, Human
uagucccccaacucugagccc

SEQ ID NO: 3844769 - RNA, 16 nt, Human
uagucccuuccccucc

SEQ ID NO: 3844770 - RNA, 20 nt, Human
uagucccuuccccucccugg

SEQ ID NO: 3844771 - RNA, 12 nt, Human
uaguccugugaa

SEQ ID NO: 3844772 - RNA, 14 nt, Human
uaguccuuggcaua

SEQ ID NO: 3844773 - RNA, 21 nt, Human
uagucgugagcucuugugagg

SEQ ID NO: 3844774 - RNA, 18 nt, Human
uagucuaaccaaaugcau

SEQ ID NO: 3844775 - RNA, 19 nt, Human
uagucuaaccaaaugcauc

SEQ ID NO: 3844776 - RNA, 23 nt, Human
uagucuaaggaugcuaaaccuua

SEQ ID NO: 3844777 - RNA, 20 nt, Human
uagucuacucuuaagccauc

SEQ ID NO: 3844778 - RNA, 19 nt, Human
uagucucaguuuguguguc

SEQ ID NO: 3844779 - RNA, 21 nt, Human
uagucuccuuugcacugaggg

SEQ ID NO: 3844780 - RNA, 22 nt, Human
uagucuccuuugcacugagggc

SEQ ID NO: 3844781 - RNA, 23 nt, Human
uagucucucuggggccacacaga

SEQ ID NO: 3844782 - RNA, 13 nt, Human
uagucucuugauu

SEQ ID NO: 3844783 - RNA, 21 nt, Human
uagucucuuguauuaaacucu

SEQ ID NO: 3844784 - RNA, 12 nt, Human
uagucucuuuau

SEQ ID NO: 3844785 - RNA, 13 nt, Human
uagucucuuuauu

SEQ ID NO: 3844786 - RNA, 21 nt, Human
uagucugaagugaaguacaga

SEQ ID NO: 3844787 - RNA, 12 nt, Human
uagucugcucac

SEQ ID NO: 3844788 - RNA, 13 nt, Human
uagucuuaccuaa

SEQ ID NO: 3844789 - RNA, 15 nt, Human
uagucuucaagcaga

SEQ ID NO: 3844790 - RNA, 14 nt, Human
uagucuucucauag

SEQ ID NO: 3844791 - RNA, 19 nt, Human
uagucuucucauagcauua

SEQ ID NO: 3844792 - RNA, 12 nt, Human
uagucuuuugcu

SEQ ID NO: 3844793 - RNA, 13 nt, Human
uagucuuuugcuu

SEQ ID NO: 3844794 - RNA, 16 nt, Human
uagucuuuugcuuuug

SEQ ID NO: 3844795 - RNA, 17 nt, Human
uagucuuuugcuuuugc

SEQ ID NO: 3844796 - RNA, 14 nt, Human
uagugaaacuuuuc

SEQ ID NO: 3844797 - RNA, 21 nt, Human
uagugaaaggaagauaaacgu

SEQ ID NO: 3844798 - RNA, 23 nt, Human
uagugaaaugaauauuuaaauaa

SEQ ID NO: 3844799 - RNA, 14 nt, Human
uagugaacuugaaa

SEQ ID NO: 3844800 - RNA, 21 nt, Human
uagugaaggcuucucucugug

SEQ ID NO: 3844801 - RNA, 17 nt, Human
uagugacccggaggcca

SEQ ID NO: 3844802 - RNA, 13 nt, Human
uagugagaagaau

SEQ ID NO: 3844803 - RNA, 19 nt, Human
uagugagaagaauauuguu

SEQ ID NO: 3844804 - RNA, 17 nt, Human
uagugauauuucucuag

SEQ ID NO: 3844805 - RNA, 14 nt, Human
uagugaucacagca

SEQ ID NO: 3844806 - RNA, 15 nt, Human
uagugaucacagcag

SEQ ID NO: 3844807 - RNA, 19 nt, Human
uagugaugaugguucacgu

SEQ ID NO: 3844808 - RNA, 22 nt, Human
uagugauuuuuaugccaccuga

SEQ ID NO: 3844809 - RNA, 14 nt, Human
uagugcaauauauu

SEQ ID NO: 3844810 - RNA, 16 nt, Human
uagugcaauauauuuu

SEQ ID NO: 3844811 - RNA, 15 nt, Human
uagugcagcagggca

SEQ ID NO: 3844812 - RNA, 20 nt, Human
uagugcagcugaaauugaaa

SEQ ID NO: 3844813 - RNA, 21 nt, Human
uagugcagcugaaauugaaaa

SEQ ID NO: 3844814 - RNA, 22 nt, Human
uagugcagcugaaauugaaaag

SEQ ID NO: 3844815 - RNA, 13 nt, Human
uagugcagcugau

SEQ ID NO: 3844816 - RNA, 14 nt, Human
uagugcagcugauu

SEQ ID NO: 3844817 - RNA, 22 nt, Human
uagugcauccaguuaaccaagu

SEQ ID NO: 3844818 - RNA, 16 nt, Human
uagugcaucuuugccu

SEQ ID NO: 3844819 - RNA, 20 nt, Human
uagugcauuguuucuguggg

SEQ ID NO: 3844820 - RNA, 21 nt, Human
uagugcauuguuucugugggc

SEQ ID NO: 3844821 - RNA, 20 nt, Human
uagugccagaauuuuaggaa

SEQ ID NO: 3844822 - RNA, 21 nt, Human
uagugcgauguuucaggaggc

SEQ ID NO: 3844823 - RNA, 14 nt, Human
uagugcugaagcuu

SEQ ID NO: 3844824 - RNA, 18 nt, Human
uagugcugaagcuuauua

SEQ ID NO: 3844825 - RNA, 13 nt, Human
uagugcugcugaa

SEQ ID NO: 3844826 - RNA, 12 nt, Human
uagugcugggau

SEQ ID NO: 3844827 - RNA, 21 nt, Human
uagugcuuaaaaaucauugau

SEQ ID NO: 3844828 - RNA, 15 nt, Human
uagugcuuugagaga

SEQ ID NO: 3844829 - RNA, 14 nt, Human
uaguggaaaaacac

SEQ ID NO: 3844830 - RNA, 17 nt, Human
uaguggacccugaaaug

SEQ ID NO: 3844831 - RNA, 17 nt, Human
uaguggauuacugccau

SEQ ID NO: 3844832 - RNA, 15 nt, Human
uaguggcauggagaa

SEQ ID NO: 3844833 - RNA, 14 nt, Human
uaguggcuucaaaa

SEQ ID NO: 3844834 - RNA, 20 nt, Human
uaguggcuucauuagagcag

SEQ ID NO: 3844835 - RNA, 16 nt, Human
uaguggcuuguccuca

SEQ ID NO: 3844836 - RNA, 19 nt, Human
uaguggucuuuguaagagu

SEQ ID NO: 3844837 - RNA, 14 nt, Human
uaguguaauaagac

SEQ ID NO: 3844838 - RNA, 17 nt, Human
uaguguaauaagacuua

SEQ ID NO: 3844839 - RNA, 23 nt, Human
uaguguacauuucuauaaauaga

SEQ ID NO: 3844840 - RNA, 22 nt, Human
uaguguaccuccucucaguguu

SEQ ID NO: 3844841 - RNA, 18 nt, Human
uaguguaggcuuuacuua

SEQ ID NO: 3844842 - RNA, 15 nt, Human
uaguguaugauuacu

SEQ ID NO: 3844843 - RNA, 14 nt, Human
uagugucacugcuu

SEQ ID NO: 3844844 - RNA, 17 nt, Human
uagugucacuuaccuag

SEQ ID NO: 3844845 - RNA, 17 nt, Human
uaguguccuaugcaaua

SEQ ID NO: 3844846 - RNA, 19 nt, Human
uagugucuggaucaguaaa

SEQ ID NO: 3844847 - RNA, 22 nt, Human
uagugugggaggcuccuguuag

SEQ ID NO: 3844848 - RNA, 19 nt, Human
uaguguguucugauuagaa

SEQ ID NO: 3844849 - RNA, 20 nt, Human
uaguguguucugauuagaaa

SEQ ID NO: 3844850 - RNA, 16 nt, Human
uaguguuaaucaauuu

SEQ ID NO: 3844851 - RNA, 16 nt, Human
uaguguuauaugaaca

SEQ ID NO: 3844852 - RNA, 17 nt, Human
uaguguuauaugaacau

SEQ ID NO: 3844853 - RNA, 18 nt, Human
uaguguuauaugaacaua

SEQ ID NO: 3844854 - RNA, 14 nt, Human
uaguguuauugcca

SEQ ID NO: 3844855 - RNA, 13 nt, Human
uaguguucauaaa

SEQ ID NO: 3844856 - RNA, 16 nt, Human
uaguguuggagaagaa

SEQ ID NO: 3844857 - RNA, 17 nt, Human
uaguguuggagaagaac

SEQ ID NO: 3844858 - RNA, 23 nt, Human
uaguguuggagaagaacugaaau

SEQ ID NO: 3844859 - RNA, 16 nt, Human
uaguguuuuaaaacac

SEQ ID NO: 3844860 - RNA, 18 nt, Human
uaguguuuuaagaaaugu

SEQ ID NO: 3844861 - RNA, 20 nt, Human
uaguguuuuaagaaauguag

SEQ ID NO: 3844862 - RNA, 21 nt, Human
uaguguuuucaauuuuaaaca

SEQ ID NO: 3844863 - RNA, 22 nt, Human
uaguguuuucaauuuuaaacau

SEQ ID NO: 3844864 - RNA, 23 nt, Human
uaguguuuucaauuuuaaacaua

SEQ ID NO: 3844865 - RNA, 21 nt, Human
uaguuaaaaaaaaaaaaagga

SEQ ID NO: 3844866 - RNA, 17 nt, Human
uaguuaaagaaaggaaa

SEQ ID NO: 3844867 - RNA, 21 nt, Human
uaguuaaagaaaggaaaagaa

SEQ ID NO: 3844868 - RNA, 20 nt, Human
uaguuaacacacuaccgaau

SEQ ID NO: 3844869 - RNA, 19 nt, Human
uaguuaagacaugauuucc

SEQ ID NO: 3844870 - RNA, 23 nt, Human
uaguuaagacaugauuuccuuga

SEQ ID NO: 3844871 - RNA, 20 nt, Human
uaguuaaucaucaagagaau

SEQ ID NO: 3844872 - RNA, 13 nt, Human
uaguuaauucugu

SEQ ID NO: 3844873 - RNA, 12 nt, Human
uaguuaauuuau

SEQ ID NO: 3844874 - RNA, 14 nt, Human
uaguuaauuuaucu

SEQ ID NO: 3844875 - RNA, 14 nt, Human
uaguuacagcugug

SEQ ID NO: 3844876 - RNA, 14 nt, Human
uaguuaccuuauag

SEQ ID NO: 3844877 - RNA, 18 nt, Human
uaguuaccuuauaguuac

SEQ ID NO: 3844878 - RNA, 15 nt, Human
uaguuacuauaugcc

SEQ ID NO: 3844879 - RNA, 11 nt, Human
uaguuacugug

SEQ ID NO: 3844880 - RNA, 20 nt, Human
uauauucauucuuuuugaaa

SEQ ID NO: 3844881 - RNA, 21 nt, Human
uauauuccagguuuaaguaga

SEQ ID NO: 3844882 - RNA, 22 nt, Human
uauauuccagguuuaaguagau

SEQ ID NO: 3844883 - RNA, 19 nt, Human
uauauuccauauauuagca

SEQ ID NO: 3844884 - RNA, 18 nt, Human
uauauucccaauagcaac

SEQ ID NO: 3844885 - RNA, 19 nt, Human
uauauuccucuugcauuuc

SEQ ID NO: 3844886 - RNA, 16 nt, Human
uauauucuauuuuaca

SEQ ID NO: 3844887 - RNA, 19 nt, Human
uauauucucagcagagugc

SEQ ID NO: 3844888 - RNA, 17 nt, Human
uauauugaagacaauuu

SEQ ID NO: 3844889 - RNA, 18 nt, Human
uauauugaagacaauuug

SEQ ID NO: 3844890 - RNA, 23 nt, Human
uauauugauaacagcacugacua

SEQ ID NO: 3844891 - RNA, 16 nt, Human
uauauugauaagaucu

SEQ ID NO: 3844892 - RNA, 16 nt, Human
uauauugauccagaaa

SEQ ID NO: 3844893 - RNA, 18 nt, Human
uauauugguaacauccuu

SEQ ID NO: 3844894 - RNA, 21 nt, Human
uauauugguaacauccuuucu

SEQ ID NO: 3844895 - RNA, 19 nt, Human
uauauugguuuuaugauga

SEQ ID NO: 3844896 - RNA, 12 nt, Human
uauauuguaaga

SEQ ID NO: 3844897 - RNA, 15 nt, Human
uauauuguaagaaau

SEQ ID NO: 3844898 - RNA, 12 nt, Human
uauauuguaauu

SEQ ID NO: 3844899 - RNA, 17 nt, Human
uauauuguucacuucuu

SEQ ID NO: 3844900 - RNA, 19 nt, Human
uauauuguucagcaugcaa

SEQ ID NO: 3844901 - RNA, 20 nt, Human
uauauuuaagcaacaucuuu

SEQ ID NO: 3844902 - RNA, 22 nt, Human
uauauuuaaguauucaagaaag

SEQ ID NO: 3844903 - RNA, 11 nt, Human
uauauuuaaug

SEQ ID NO: 3844904 - RNA, 15 nt, Human
uauauuuaaugauaa

SEQ ID NO: 3844905 - RNA, 19 nt, Human
uauauuuaaugcauuaaac

SEQ ID NO: 3844906 - RNA, 12 nt, Human
uauauuuacaaa

SEQ ID NO: 3844907 - RNA, 14 nt, Human
uauauuuacaaaug

SEQ ID NO: 3844908 - RNA, 24 nt, Human
uauauuuacagugaaaauguaagc

SEQ ID NO: 3844909 - RNA, 19 nt, Human
uauauuuacuaaaauggac

SEQ ID NO: 3844910 - RNA, 21 nt, Human
uauauuuacuaaaauggacug

SEQ ID NO: 3844911 - RNA, 23 nt, Human
uauauuuagcuccaaaccuucac

SEQ ID NO: 3844912 - RNA, 14 nt, Human
uauauuuagugcug

SEQ ID NO: 3844913 - RNA, 15 nt, Human
uauauuuauaacuca

SEQ ID NO: 3844914 - RNA, 23 nt, Human
uauauuuauaacucaucauaaaa

SEQ ID NO: 3844915 - RNA, 24 nt, Human
uauauuuauaacucaucauaaaau

SEQ ID NO: 3844916 - RNA, 19 nt, Human
uauauuuauuacuguaaga

SEQ ID NO: 3844917 - RNA, 16 nt, Human
uauauuucacuauuuu

SEQ ID NO: 3844918 - RNA, 18 nt, Human
uauauuuccuauaccauu

SEQ ID NO: 3844919 - RNA, 11 nt, Human
uauauuuccuu

SEQ ID NO: 3844920 - RNA, 16 nt, Human
uauauuuccuuuaugu

SEQ ID NO: 3844921 - RNA, 17 nt, Human
uauauuuccuuuaugug

SEQ ID NO: 3844922 - RNA, 23 nt, Human
uauauuucuauuuuauuaugaag

SEQ ID NO: 3844923 - RNA, 13 nt, Human
uauauuugaaaua

SEQ ID NO: 3844924 - RNA, 16 nt, Human
uauauuugugcuauag

SEQ ID NO: 3844925 - RNA, 14 nt, Human
uauauuuuaauuug

SEQ ID NO: 3844926 - RNA, 18 nt, Human
uauauuuuauauaaagua

SEQ ID NO: 3844927 - RNA, 23 nt, Human
uauauuuucaugacuuuuccaug

SEQ ID NO: 3844928 - RNA, 14 nt, Human
uauauuuuccuaua

SEQ ID NO: 3844929 - RNA, 16 nt, Human
uauauuuucguaugaa

SEQ ID NO: 3844930 - RNA, 20 nt, Human
uauauuuucguaugaaaaug

SEQ ID NO: 3844931 - RNA, 11 nt, Human
uauauuuugac

SEQ ID NO: 3844932 - RNA, 17 nt, Human
uauauuuuguaugcaag

SEQ ID NO: 3844933 - RNA, 22 nt, Human
uauauuuugugugaaauugcau

SEQ ID NO: 3844934 - RNA, 19 nt, Human
uauauuuuuaagauaauaa

SEQ ID NO: 3844935 - RNA, 18 nt, Human
uauauuuuuaauaaaagu

SEQ ID NO: 3844936 - RNA, 13 nt, Human
uauauuuuuauau

SEQ ID NO: 3844937 - RNA, 18 nt, Human
uauauuuuuauauuuagu

SEQ ID NO: 3844938 - RNA, 18 nt, Human
uauauuuuugguugucaa

SEQ ID NO: 3844939 - RNA, 19 nt, Human
uauauuuuugguugucaau

SEQ ID NO: 3844940 - RNA, 21 nt, Human
uauauuuuuguuuguuuugug

SEQ ID NO: 3844941 - RNA, 19 nt, Human
uauauuuuuuguuaaauga

SEQ ID NO: 3844942 - RNA, 16 nt, Human
uauauuuuuuuaacuu

SEQ ID NO: 3844943 - RNA, 21 nt, Human
uauauuuuuuuuuaagcucug

SEQ ID NO: 3844944 - RNA, 19 nt, Human
uaucaaaacuuucuuuucu

SEQ ID NO: 3844945 - RNA, 18 nt, Human
uaucaaaauaaauugaaa

SEQ ID NO: 3844946 - RNA, 22 nt, Human
uaucaaaaugcucuuauuucau

SEQ ID NO: 3844947 - RNA, 16 nt, Human
uaucaaacugaagcca

SEQ ID NO: 3844948 - RNA, 18 nt, Human
uaucaaagaauaagaaaa

SEQ ID NO: 3844949 - RNA, 21 nt, Human
uaucaaagaccuuguguguau

SEQ ID NO: 3844950 - RNA, 21 nt, Human
uaucaaaggcacauggaauau

SEQ ID NO: 3844951 - RNA, 18 nt, Human
uaucaaagucauuaaaga

SEQ ID NO: 3844952 - RNA, 20 nt, Human
uaucaaagucauuaaagaca

SEQ ID NO: 3844953 - RNA, 19 nt, Human
uaucaaauauuagauguga

SEQ ID NO: 3844954 - RNA, 21 nt, Human
uaucaaauauuagaugugauu

SEQ ID NO: 3844955 - RNA, 23 nt, Human
uaucaaauauuagaugugauuua

SEQ ID NO: 3844956 - RNA, 15 nt, Human
uaucaaaucuaccac

SEQ ID NO: 3844957 - RNA, 17 nt, Human
uaucaaccccagacacu

SEQ ID NO: 3844958 - RNA, 19 nt, Human
uaucaacuuccuaaauauu

SEQ ID NO: 3844959 - RNA, 13 nt, Human
uaucaacuuuaau

SEQ ID NO: 3844960 - RNA, 15 nt, Human
uaucaacuuuaauca

SEQ ID NO: 3844961 - RNA, 12 nt, Human
uaucaagaaagu

SEQ ID NO: 3844962 - RNA, 15 nt, Human
uaucaagcuaauaaa

SEQ ID NO: 3844963 - RNA, 17 nt, Human
uaucaaguggcaugugc

SEQ ID NO: 3844964 - RNA, 14 nt, Human
uaucaagugucuuc

SEQ ID NO: 3844965 - RNA, 15 nt, Human
gccggcagccccagc

SEQ ID NO: 3844966 - RNA, 21 nt, Human
gccggcagccccagccugcua

SEQ ID NO: 3844967 - RNA, 11 nt, Human
gccggccagcc

SEQ ID NO: 3844968 - RNA, 13 nt, Human
gccggccagccag

SEQ ID NO: 3844969 - RNA, 14 nt, Human
gccggccagccagc

SEQ ID NO: 3844970 - RNA, 17 nt, Human
gccggccaguggccuuc

SEQ ID NO: 3844971 - RNA, 12 nt, Human
gccggccccagg

SEQ ID NO: 3844972 - RNA, 12 nt, Human
gccggcccuggg

SEQ ID NO: 3844973 - RNA, 14 nt, Human
gccggcccuggggc

SEQ ID NO: 3844974 - RNA, 17 nt, Human
gccggcccugugugcag

SEQ ID NO: 3844975 - RNA, 15 nt, Human
gccggccuccagaac

SEQ ID NO: 3844976 - RNA, 20 nt, Human
gccggccucucuggccuccc

SEQ ID NO: 3844977 - RNA, 15 nt, Human
gccggcgagcccugu

SEQ ID NO: 3844978 - RNA, 13 nt, Human
gccggcuggaaau

SEQ ID NO: 3844979 - RNA, 18 nt, Human
gccggcugugcucagaga

SEQ ID NO: 3844980 - RNA, 19 nt, Human
gccggcuucaugccagcua

SEQ ID NO: 3844981 - RNA, 14 nt, Human
gccgggagccugac

SEQ ID NO: 3844982 - RNA, 16 nt, Human
gccgggcaaacuggcc

SEQ ID NO: 3844983 - RNA, 17 nt, Human
gccgggcacagcugugg

SEQ ID NO: 3844984 - RNA, 22 nt, Human
gccgggcacauugagcugugca

SEQ ID NO: 3844985 - RNA, 17 nt, Human
gccgggcagagcacagc

SEQ ID NO: 3844986 - RNA, 17 nt, Human
gccgggcaggguguggg

SEQ ID NO: 3844987 - RNA, 14 nt, Human
gccgggccccuggg

SEQ ID NO: 3844988 - RNA, 19 nt, Human
gccgggccccugggcuugg

SEQ ID NO: 3844989 - RNA, 12 nt, Human
gccgggccuggg

SEQ ID NO: 3844990 - RNA, 14 nt, Human
gccgggccuguaca

SEQ ID NO: 3844991 - RNA, 15 nt, Human
gccgggccuguacag

SEQ ID NO: 3844992 - RNA, 18 nt, Human
gccgggcgcgguggcuca

SEQ ID NO: 3844993 - RNA, 22 nt, Human
gccgggcgcgguggcucacgcc

SEQ ID NO: 3844994 - RNA, 18 nt, Human
gccgggcugagggccugc

SEQ ID NO: 3844995 - RNA, 20 nt, Human
gccggggaacuggccaagcu

SEQ ID NO: 3844996 - RNA, 23 nt, Human
gccggggaacuggccaagcugag

SEQ ID NO: 3844997 - RNA, 22 nt, Human
gccggggaagagauccaaagac

SEQ ID NO: 3844998 - RNA, 19 nt, Human
gccggggacagaggccugc

SEQ ID NO: 3844999 - RNA, 21 nt, Human
gccggggacagaggccugccc

SEQ ID NO: 3845000 - RNA, 15 nt, Human
gccggggcagccccc

SEQ ID NO: 3845001 - RNA, 15 nt, Human
gccggggcugagacu

SEQ ID NO: 3845002 - RNA, 12 nt, Human
gccgggguggau

SEQ ID NO: 3845003 - RNA, 14 nt, Human
gccgggucugccuc

SEQ ID NO: 3845004 - RNA, 21 nt, Human
gccgggucugccucuucuggg

SEQ ID NO: 3845005 - RNA, 16 nt, Human
gccgguaacuguccug

SEQ ID NO: 3845006 - RNA, 22 nt, Human
gccgguaacuguccuguccugc

SEQ ID NO: 3845007 - RNA, 16 nt, Human
gccggucaggcacaca

SEQ ID NO: 3845008 - RNA, 12 nt, Human
gccggucauuuu

SEQ ID NO: 3845009 - RNA, 18 nt, Human
gccggucugcaagucaga

SEQ ID NO: 3845010 - RNA, 19 nt, Human
gccggucugcaagucagag

SEQ ID NO: 3845011 - RNA, 12 nt, Human
gccgguuccugu

SEQ ID NO: 3845012 - RNA, 14 nt, Human
gccguaccccaccc

SEQ ID NO: 3845013 - RNA, 19 nt, Human
gccguaccccacccucagc

SEQ ID NO: 3845014 - RNA, 15 nt, Human
gccguaguagauguu

SEQ ID NO: 3845015 - RNA, 22 nt, Human
gccguaguagauguucuacuuu

SEQ ID NO: 3845016 - RNA, 15 nt, Human
gccgucaccaccacc

SEQ ID NO: 3845017 - RNA, 18 nt, Human
gccgucaccaccaccccu

SEQ ID NO: 3845018 - RNA, 23 nt, Human
gccgucaccaccaccccuaccac

SEQ ID NO: 3845019 - RNA, 18 nt, Human
gccgucagccaaauguaa

SEQ ID NO: 3845020 - RNA, 18 nt, Human
gccguccucccgggcccu

SEQ ID NO: 3845021 - RNA, 20 nt, Human
gccguccucccgggcccucc

SEQ ID NO: 3845022 - RNA, 18 nt, Human
gccgucuaccugaggggc

SEQ ID NO: 3845023 - RNA, 16 nt, Human
gccgucuccaggggcu

SEQ ID NO: 3845024 - RNA, 21 nt, Human
gccgucuccaggggcugcuuc

SEQ ID NO: 3845025 - RNA, 19 nt, Human
uauuuuucauauugugcca

SEQ ID NO: 3845026 - RNA, 12 nt, Human
uauuuuucauga

SEQ ID NO: 3845027 - RNA, 20 nt, Human
uauuuuucaugauuuugaaa

SEQ ID NO: 3845028 - RNA, 14 nt, Human
uauuuuucuaaggu

SEQ ID NO: 3845029 - RNA, 20 nt, Human
uauuuuucuacauuauugcu

SEQ ID NO: 3845030 - RNA, 14 nt, Human
uauuuuucucauga

SEQ ID NO: 3845031 - RNA, 15 nt, Human
uauuuuucuguuacc

SEQ ID NO: 3845032 - RNA, 13 nt, Human
uauuuuucuuaaa

SEQ ID NO: 3845033 - RNA, 12 nt, Human
uauuuuucuuga

SEQ ID NO: 3845034 - RNA, 22 nt, Human
uauuuuugaaaggcauguuccu

SEQ ID NO: 3845035 - RNA, 23 nt, Human
uauuuuugacagaauauguuuca

SEQ ID NO: 3845036 - RNA, 17 nt, Human
uauuuuugcauggcacu

SEQ ID NO: 3845037 - RNA, 12 nt, Human
uauuuuuggagg

SEQ ID NO: 3845038 - RNA, 13 nt, Human
uauuuuuguacau

SEQ ID NO: 3845039 - RNA, 15 nt, Human
uauuuuuguagcacu

SEQ ID NO: 3845040 - RNA, 23 nt, Human
uauuuuuguagugaccuguuuau

SEQ ID NO: 3845041 - RNA, 19 nt, Human
uauuuuuguuguguucugu

SEQ ID NO: 3845042 - RNA, 13 nt, Human
uauuuuuguuguu

SEQ ID NO: 3845043 - RNA, 12 nt, Human
uauuuuuuaaag

SEQ ID NO: 3845044 - RNA, 13 nt, Human
uauuuuuuaagua

SEQ ID NO: 3845045 - RNA, 21 nt, Human
uauuuuuuaaguauuuauaua

SEQ ID NO: 3845046 - RNA, 12 nt, Human
uauuuuuuaauu

SEQ ID NO: 3845047 - RNA, 15 nt, Human
uauuuuuuaauuauu

SEQ ID NO: 3845048 - RNA, 11 nt, Human
uauuuuuucaa

SEQ ID NO: 3845049 - RNA, 15 nt, Human
uauuuuuucagaccg

SEQ ID NO: 3845050 - RNA, 16 nt, Human
uauuuuuucaguauua

SEQ ID NO: 3845051 - RNA, 19 nt, Human
uauuuuuucuuuucuuuac

SEQ ID NO: 3845052 - RNA, 22 nt, Human
uauuuuuugaggcuaugaauau

SEQ ID NO: 3845053 - RNA, 16 nt, Human
uauuuuuuguauaauu

SEQ ID NO: 3845054 - RNA, 17 nt, Human
uauuuuuuguauaauug

SEQ ID NO: 3845055 - RNA, 17 nt, Human
uauuuuuuuaaaaucac

SEQ ID NO: 3845056 - RNA, 15 nt, Human
uauuuuuuuaaaauu

SEQ ID NO: 3845057 - RNA, 17 nt, Human
uauuuuuuuaacuuuac

SEQ ID NO: 3845058 - RNA, 21 nt, Human
uauuuuuuuaacuuuaccaug

SEQ ID NO: 3845059 - RNA, 15 nt, Human
uauuuuuuuaagcgu

SEQ ID NO: 3845060 - RNA, 14 nt, Human
uauuuuuuuacuaa

SEQ ID NO: 3845061 - RNA, 19 nt, Human
uauuuuuuuagauugagaa

SEQ ID NO: 3845062 - RNA, 19 nt, Human
uauuuuuuuccuuacauaa

SEQ ID NO: 3845063 - RNA, 15 nt, Human
uauuuuuuucuaccu

SEQ ID NO: 3845064 - RNA, 14 nt, Human
uauuuuuuucucuc

SEQ ID NO: 3845065 - RNA, 13 nt, Human
uauuuuuuucuga

SEQ ID NO: 3845066 - RNA, 17 nt, Human
uauuuuuuucugaaauu

SEQ ID NO: 3845067 - RNA, 15 nt, Human
uauuuuuuucugauu

SEQ ID NO: 3845068 - RNA, 17 nt, Human
uauuuuuuucugauugu

SEQ ID NO: 3845069 - RNA, 13 nt, Human
uauuuuuuugaac

SEQ ID NO: 3845070 - RNA, 16 nt, Human
uauuuuuuugcaagug

SEQ ID NO: 3845071 - RNA, 17 nt, Human
uauuuuuuugcaaguga

SEQ ID NO: 3845072 - RNA, 18 nt, Human
uauuuuuuuuaauuguau

SEQ ID NO: 3845073 - RNA, 18 nt, Human
uauuuuuuuuuaagcucu

SEQ ID NO: 3845074 - RNA, 19 nt, Human
uauuuuuuuuucuaagaga

SEQ ID NO: 3845075 - RNA, 15 nt, Human
uauuuuuuuuuuccu

SEQ ID NO: 3845076 - RNA, 17 nt, Human
uauuuuuuuuuucuucu

SEQ ID NO: 3845077 - RNA, 12 nt, Human
ucaaaaaaggca

SEQ ID NO: 3845078 - RNA, 15 nt, Human
ucaaaaacauucuua

SEQ ID NO: 3845079 - RNA, 13 nt, Human
ucaaaaacuauuu

SEQ ID NO: 3845080 - RNA, 13 nt, Human
ucaaaaacuguuu

SEQ ID NO: 3845081 - RNA, 17 nt, Human
ucaaaaagaaaucaaua

SEQ ID NO: 3845082 - RNA, 19 nt, Human
ucaaaaaggcuuauaaaac

SEQ ID NO: 3845083 - RNA, 20 nt, Human
ucaaaaaggcuuauaaaaca

SEQ ID NO: 3845084 - RNA, 21 nt, Human
ucaaaaaggcuuauaaaacag

SEQ ID NO: 3845085 - RNA, 14 nt, Human
ucaaaaaguguuua

SEQ ID NO: 3845086 - RNA, 15 nt, Human
ucaaaaauacaaaau

SEQ ID NO: 3845087 - RNA, 21 nt, Human
ucaaaaauacaaaauaaaaac

SEQ ID NO: 3845088 - RNA, 13 nt, Human
ucaaaaauauaac

SEQ ID NO: 3845089 - RNA, 15 nt, Human
ucaaaacacugugga

SEQ ID NO: 3845090 - RNA, 16 nt, Human
ucaaaacacuguggaa

SEQ ID NO: 3845091 - RNA, 17 nt, Human
ucaaaacacuguggaac

SEQ ID NO: 3845092 - RNA, 16 nt, Human
ucaaaacagauuguuu

SEQ ID NO: 3845093 - RNA, 19 nt, Human
ucaaaacccaucugggcuc

SEQ ID NO: 3845094 - RNA, 20 nt, Human
ucaaaaccuuucaaauauca

SEQ ID NO: 3845095 - RNA, 16 nt, Human
ucaaaacuacaaauca

SEQ ID NO: 3845096 - RNA, 13 nt, Human
ucaaaacugcacu

SEQ ID NO: 3845097 - RNA, 14 nt, Human
ucaaaagacaauuc

SEQ ID NO: 3845098 - RNA, 18 nt, Human
ucaaaagacaauucuuua

SEQ ID NO: 3845099 - RNA, 13 nt, Human
ucaaaagacaugu

SEQ ID NO: 3845100 - RNA, 16 nt, Human
ucaaaagagaugaaag

SEQ ID NO: 3845101 - RNA, 16 nt, Human
ucaaaagauaauauuu

SEQ ID NO: 3845102 - RNA, 13 nt, Human
ucaaaagcauuua

SEQ ID NO: 3845103 - RNA, 17 nt, Human
ucaaaagcauuuaucau

SEQ ID NO: 3845104 - RNA, 11 nt, Human
ucaaaaggaac

SEQ ID NO: 3845105 - RNA, 20 nt, Human
ucaaaagggccaaagaacca

SEQ ID NO: 3845106 - RNA, 20 nt, Human
ucaaaagguauuauacaugu

SEQ ID NO: 3845107 - RNA, 23 nt, Human
ucaaaaguagaacuuuguauagu

SEQ ID NO: 3845108 - RNA, 14 nt, Human
ucaaaaguauuuuc

SEQ ID NO: 3845109 - RNA, 20 nt, Human
ucaaaaguauuuuccuguaa

SEQ ID NO: 3845110 - RNA, 15 nt, Human
ucaaaaguugaaauu

SEQ ID NO: 3845111 - RNA, 13 nt, Human
ucaaaauaaaaac

SEQ ID NO: 3845112 - RNA, 21 nt, Human
ucaaaauaaaaagugacacag

SEQ ID NO: 3845113 - RNA, 19 nt, Human
ucaaaauagaaaaguuauu

SEQ ID NO: 3845114 - RNA, 17 nt, Human
ucaaaauagugccacua

SEQ ID NO: 3845115 - RNA, 21 nt, Human
ucaaaauauuuaaaaaugucu

SEQ ID NO: 3845116 - RNA, 18 nt, Human
ucaaaauauuuguacaua

SEQ ID NO: 3845117 - RNA, 18 nt, Human
ucaaaauauuuuuaaaag

SEQ ID NO: 3845118 - RNA, 23 nt, Human
ucaaaauccaaaaagaaaugaug

SEQ ID NO: 3845119 - RNA, 21 nt, Human
ucaaaaucucuccacuuucag

SEQ ID NO: 3845120 - RNA, 16 nt, Human
ucaaaaugcucuuauu

SEQ ID NO: 3845121 - RNA, 20 nt, Human
ucaaaaugcucuuauuucau

SEQ ID NO: 3845122 - RNA, 21 nt, Human
ucaaaaugcucuuauuucauc

SEQ ID NO: 3845123 - RNA, 12 nt, Human
ucaaaaugcuuc

SEQ ID NO: 3845124 - RNA, 13 nt, Human
ucaaaauguauau

SEQ ID NO: 3845125 - RNA, 22 nt, Human
ucaaaauguuaucuucucaagu

SEQ ID NO: 3845126 - RNA, 14 nt, Human
ucaaaauuaaaucu

SEQ ID NO: 3845127 - RNA, 15 nt, Human
ucaaaauuaaaucug

SEQ ID NO: 3845128 - RNA, 13 nt, Human
ucaaaauuacaua

SEQ ID NO: 3845129 - RNA, 22 nt, Human
ucaaaauuguuuaaaaauucuu

SEQ ID NO: 3845130 - RNA, 19 nt, Human
ucaaacaaacucucugaac

SEQ ID NO: 3845131 - RNA, 15 nt, Human
ucaaacaacacuggu

SEQ ID NO: 3845132 - RNA, 14 nt, Human
ucaaacaagaaugu

SEQ ID NO: 3845133 - RNA, 23 nt, Human
uauccugugacugucucacuuaa

SEQ ID NO: 3845134 - RNA, 17 nt, Human
uauccuuaugccacccc

SEQ ID NO: 3845135 - RNA, 14 nt, Human
uauccuucagccug

SEQ ID NO: 3845136 - RNA, 22 nt, Human
uauccuucaucuuuuaaagaaa

SEQ ID NO: 3845137 - RNA, 22 nt, Human
uauccuuuguggcaccuuuucu

SEQ ID NO: 3845138 - RNA, 21 nt, Human
uaucgaaauaacaauguuaag

SEQ ID NO: 3845139 - RNA, 16 nt, Human
uaucgauguuuuauua

SEQ ID NO: 3845140 - RNA, 17 nt, Human
uaucgccuuuugacagc

SEQ ID NO: 3845141 - RNA, 17 nt, Human
uaucggcacuguacaaa

SEQ ID NO: 3845142 - RNA, 14 nt, Human
uaucgggaacagug

SEQ ID NO: 3845143 - RNA, 17 nt, Human
uaucgggaacaguguuu

SEQ ID NO: 3845144 - RNA, 14 nt, Human
uaucgggagcagug

SEQ ID NO: 3845145 - RNA, 17 nt, Human
uaucgggagcagugucu

SEQ ID NO: 3845146 - RNA, 18 nt, Human
uaucgggagcagugucuu

SEQ ID NO: 3845147 - RNA, 18 nt, Human
uaucguaaaauuaagaaa

SEQ ID NO: 3845148 - RNA, 21 nt, Human
uaucguaaccagccagauccu

SEQ ID NO: 3845149 - RNA, 16 nt, Human
uaucguauucaccuuc

SEQ ID NO: 3845150 - RNA, 12 nt, Human
uaucguuuuugu

SEQ ID NO: 3845151 - RNA, 18 nt, Human
uaucguuuuuguauuuuc

SEQ ID NO: 3845152 - RNA, 13 nt, Human
uaucuaaaagugu

SEQ ID NO: 3845153 - RNA, 13 nt, Human
uaucuaaaguuau

SEQ ID NO: 3845154 - RNA, 14 nt, Human
uaucuaaaguuaua

SEQ ID NO: 3845155 - RNA, 15 nt, Human
uaucuaaauguugaa

SEQ ID NO: 3845156 - RNA, 16 nt, Human
uaucuaaauguugaaa

SEQ ID NO: 3845157 - RNA, 13 nt, Human
uaucuaaauugaa

SEQ ID NO: 3845158 - RNA, 19 nt, Human
uaucuaagaauacagcuuu

SEQ ID NO: 3845159 - RNA, 23 nt, Human
uaucuaagaauacagcuuucuga

SEQ ID NO: 3845160 - RNA, 20 nt, Human
uaucuaaguuaauuuaaagu

SEQ ID NO: 3845161 - RNA, 22 nt, Human
uaucuaaguuaauuuaaaguug

SEQ ID NO: 3845162 - RNA, 20 nt, Human
uaucuaauauauaugaauaa

SEQ ID NO: 3845163 - RNA, 15 nt, Human
uaucuaauuuggauu

SEQ ID NO: 3845164 - RNA, 21 nt, Human
uaucuacaucuuuuuucacaa

SEQ ID NO: 3845165 - RNA, 18 nt, Human
uaucuaccaacuuucaag

SEQ ID NO: 3845166 - RNA, 22 nt, Human
uaucuaccccagacuagaugua

SEQ ID NO: 3845167 - RNA, 20 nt, Human
uaucuacucuccucaucucu

SEQ ID NO: 3845168 - RNA, 17 nt, Human
uaucuacuuccaaacua

SEQ ID NO: 3845169 - RNA, 20 nt, Human
uaucuagcaaucacaacacu

SEQ ID NO: 3845170 - RNA, 18 nt, Human
uaucuagcugcauaucuu

SEQ ID NO: 3845171 - RNA, 22 nt, Human
gccugcccuccccagagcacug

SEQ ID NO: 3845172 - RNA, 12 nt, Human
gccugcccuggu

SEQ ID NO: 3845173 - RNA, 14 nt, Human
gccugccgggcuga

SEQ ID NO: 3845174 - RNA, 12 nt, Human
gccugccucacc

SEQ ID NO: 3845175 - RNA, 22 nt, Human
gccugccuccccugccucacca

SEQ ID NO: 3845176 - RNA, 16 nt, Human
gccugccuggcaggcu

SEQ ID NO: 3845177 - RNA, 15 nt, Human
gccugccuggccccu

SEQ ID NO: 3845178 - RNA, 15 nt, Human
gccugccuucguuaa

SEQ ID NO: 3845179 - RNA, 16 nt, Human
gccugccuugaagcca

SEQ ID NO: 3845180 - RNA, 22 nt, Human
gccugccuuuccauccauggcc

SEQ ID NO: 3845181 - RNA, 23 nt, Human
gccugccuuuccauccauggcca

SEQ ID NO: 3845182 - RNA, 20 nt, Human
gccugccuuuggcacucuga

SEQ ID NO: 3845183 - RNA, 16 nt, Human
gccugcgacccugggg

SEQ ID NO: 3845184 - RNA, 14 nt, Human
gccugcgagggcag

SEQ ID NO: 3845185 - RNA, 21 nt, Human
gccugcgccaccgcccagaga

SEQ ID NO: 3845186 - RNA, 22 nt, Human
gccugcgccaccgcccagagac

SEQ ID NO: 3845187 - RNA, 15 nt, Human
uauuaacaauuaauu

SEQ ID NO: 3845188 - RNA, 19 nt, Human
uauuaacaauuaauugucu

SEQ ID NO: 3845189 - RNA, 15 nt, Human
uauuaacuacauuua

SEQ ID NO: 3845190 - RNA, 19 nt, Human
uauuaacugcucaguguuu

SEQ ID NO: 3845191 - RNA, 22 nt, Human
uauuaacugcucaguguuucau

SEQ ID NO: 3845192 - RNA, 20 nt, Human
uauuaacuuaauaaucaaga

SEQ ID NO: 3845193 - RNA, 17 nt, Human
uauuaacuuuaauguuu

SEQ ID NO: 3845194 - RNA, 16 nt, Human
uauuaagaaagacuau

SEQ ID NO: 3845195 - RNA, 12 nt, Human
uauuaagaauga

SEQ ID NO: 3845196 - RNA, 19 nt, Human
uauuaagauggauucucag

SEQ ID NO: 3845197 - RNA, 20 nt, Human
uauuaagauggauucucaga

SEQ ID NO: 3845198 - RNA, 21 nt, Human
uauuaagauggauucucagau

SEQ ID NO: 3845199 - RNA, 15 nt, Human
uauuaagauuuccaa

SEQ ID NO: 3845200 - RNA, 17 nt, Human
uauuaagauuuccaagu

SEQ ID NO: 3845201 - RNA, 19 nt, Human
uauuaagcaguaaaaacug

SEQ ID NO: 3845202 - RNA, 16 nt, Human
uauuaagcuuuuugga

SEQ ID NO: 3845203 - RNA, 17 nt, Human
uauuaagggauuuagua

SEQ ID NO: 3845204 - RNA, 20 nt, Human
uauuaaguaagucucaaggu

SEQ ID NO: 3845205 - RNA, 13 nt, Human
uauuaauaaaaag

SEQ ID NO: 3845206 - RNA, 14 nt, Human
uauuaauaaauaga

SEQ ID NO: 3845207 - RNA, 21 nt, Human
uauuaauaaauagagcaauua

SEQ ID NO: 3845208 - RNA, 21 nt, Human
uauuaauacaaugaugcuauu

SEQ ID NO: 3845209 - RNA, 23 nt, Human
uauuaauacaaugaugcuauuug

SEQ ID NO: 3845210 - RNA, 15 nt, Human
uauuaauacugguau

SEQ ID NO: 3845211 - RNA, 17 nt, Human
uauuaauagcugccuua

SEQ ID NO: 3845212 - RNA, 20 nt, Human
uauuaauauauaucugcugu

SEQ ID NO: 3845213 - RNA, 14 nt, Human
uauuaauauaugua

SEQ ID NO: 3845214 - RNA, 17 nt, Human
uauuaauauucauugua

SEQ ID NO: 3845215 - RNA, 19 nt, Human
uauuaaucacuguguauau

SEQ ID NO: 3845216 - RNA, 20 nt, Human
uauuaaucacuguguauauu

SEQ ID NO: 3845217 - RNA, 22 nt, Human
uauuaaucacuguguauauuug

SEQ ID NO: 3845218 - RNA, 17 nt, Human
uauuaaucagaagaaaa

SEQ ID NO: 3845219 - RNA, 16 nt, Human
uauuaaucuuggauag

SEQ ID NO: 3845220 - RNA, 12 nt, Human
uauuaaugcacu

SEQ ID NO: 3845221 - RNA, 22 nt, Human
uauuaaugccuuuaaaguauga

SEQ ID NO: 3845222 - RNA, 23 nt, Human
uauuaaugccuuuaaaguaugaa

SEQ ID NO: 3845223 - RNA, 17 nt, Human
uauuaauguuuucaaaa

SEQ ID NO: 3845224 - RNA, 21 nt, Human
uauuaauuguuuugcacuuuu

SEQ ID NO: 3845225 - RNA, 19 nt, Human
uauuaauuuucuacaaaua

SEQ ID NO: 3845226 - RNA, 14 nt, Human
uauuacaaaaacaa

SEQ ID NO: 3845227 - RNA, 21 nt, Human
uauuacacaaauacuuauuca

SEQ ID NO: 3845228 - RNA, 17 nt, Human
uauuacacuguauuugu

SEQ ID NO: 3845229 - RNA, 12 nt, Human
uauuacaguaua

SEQ ID NO: 3845230 - RNA, 16 nt, Human
uauuacaguauaauua

SEQ ID NO: 3845231 - RNA, 21 nt, Human
uauuacaguauaauuaacaug

SEQ ID NO: 3845232 - RNA, 23 nt, Human
uauuacaguggggaaugaagaua

SEQ ID NO: 3845233 - RNA, 14 nt, Human
uauuacauaaauaa

SEQ ID NO: 3845234 - RNA, 18 nt, Human
uauuacauccuuguggca

SEQ ID NO: 3845235 - RNA, 17 nt, Human
uauuacaucuuucacau

SEQ ID NO: 3845236 - RNA, 16 nt, Human
uauuacauggcagugu

SEQ ID NO: 3845237 - RNA, 18 nt, Human
uauuacauguaauuugau

SEQ ID NO: 3845238 - RNA, 16 nt, Human
uauuaccacagacaua

SEQ ID NO: 3845239 - RNA, 14 nt, Human
uauuaccucugaua

SEQ ID NO: 3845240 - RNA, 19 nt, Human
uauuaccucugauaccuca

SEQ ID NO: 3845241 - RNA, 14 nt, Human
uauuacucaguuua

SEQ ID NO: 3845242 - RNA, 17 nt, Human
uauuacugacauuucuu

SEQ ID NO: 3845243 - RNA, 14 nt, Human
uauuacuguaagaa

SEQ ID NO: 3845244 - RNA, 21 nt, Human
uauuacuguuuauuucuguuu

SEQ ID NO: 3845245 - RNA, 23 nt, Human
uauuacuuauuuuugacaguguu

SEQ ID NO: 3845246 - RNA, 14 nt, Human
uauuacuuccauga

SEQ ID NO: 3845247 - RNA, 15 nt, Human
uauuacuuccaugaa

SEQ ID NO: 3845248 - RNA, 18 nt, Human
uauuacuuccaugaauuu

SEQ ID NO: 3845249 - RNA, 18 nt, Human
uauuacuuguaaauauaa

SEQ ID NO: 3845250 - RNA, 21 nt, Human
uauuacuuguaaauauaaaga

SEQ ID NO: 3845251 - RNA, 23 nt, Human
uauuacuuguaaauauaaagacg

SEQ ID NO: 3845252 - RNA, 18 nt, Human
uauuacuuuaucacuuuu

SEQ ID NO: 3845253 - RNA, 23 nt, Human
uauuagaaauuagaaaaaaauua

SEQ ID NO: 3845254 - RNA, 21 nt, Human
uauuagacuucuguuuucaau

SEQ ID NO: 3845255 - RNA, 15 nt, Human
uauuagagugucuuu

SEQ ID NO: 3845256 - RNA, 18 nt, Human
uauuagagugucuuucca

SEQ ID NO: 3845257 - RNA, 15 nt, Human
uauuagaugugauuu

SEQ ID NO: 3845258 - RNA, 17 nt, Human
uauuagccaggaucaug

SEQ ID NO: 3845259 - RNA, 18 nt, Human
uauuagccaggaucaugg

SEQ ID NO: 3845260 - RNA, 14 nt, Human
uauuagcuuuacug

SEQ ID NO: 3845261 - RNA, 14 nt, Human
uauuaguaccauag

SEQ ID NO: 3845262 - RNA, 20 nt, Human
uauuagugauauuucucuag

SEQ ID NO: 3845263 - RNA, 16 nt, Human
uauuagugaugucauc

SEQ ID NO: 3845264 - RNA, 18 nt, Human
uauuaguguuauaugaac

SEQ ID NO: 3845265 - RNA, 22 nt, Human
uauuaguuccccaaauacaaag

SEQ ID NO: 3845266 - RNA, 22 nt, Human
uauuaguucccugucucuugaa

SEQ ID NO: 3845267 - RNA, 14 nt, Human
uauuaguugcuuug

SEQ ID NO: 3845268 - RNA, 14 nt, Human
uauuaguuuugauu

SEQ ID NO: 3845269 - RNA, 13 nt, Human
uauuauaaaaaua

SEQ ID NO: 3845270 - RNA, 23 nt, Human
uauuauaaacaagaaugaagguu

SEQ ID NO: 3845271 - RNA, 14 nt, Human
uauuauaaacugua

SEQ ID NO: 3845272 - RNA, 18 nt, Human
uauuauaaaggauaaaga

SEQ ID NO: 3845273 - RNA, 20 nt, Human
uauuauaaaggauaaagaag

SEQ ID NO: 3845274 - RNA, 23 nt, Human
uauuauaaauauauauaaagaau

SEQ ID NO: 3845275 - RNA, 14 nt, Human
uauuauaaauuaug

SEQ ID NO: 3845276 - RNA, 16 nt, Human
uauuauaaauuauguu

SEQ ID NO: 3845277 - RNA, 20 nt, Human
uauuauaaauuauguuuaua

SEQ ID NO: 3845278 - RNA, 19 nt, Human
uauuauaacaagugugucu

SEQ ID NO: 3845279 - RNA, 20 nt, Human
uauuauaacaagugugucuu

SEQ ID NO: 3845280 - RNA, 15 nt, Human
uauuauaacuuaaaa

SEQ ID NO: 3845281 - RNA, 18 nt, Human
uauuauaagucuuacaua

SEQ ID NO: 3845282 - RNA, 14 nt, Human
uauuauaauuguau

SEQ ID NO: 3845283 - RNA, 13 nt, Human
uauuauacuguau

SEQ ID NO: 3845284 - RNA, 16 nt, Human
uauuauauauauaaua

SEQ ID NO: 3845285 - RNA, 17 nt, Human
uauuauauguacccucu

SEQ ID NO: 3845286 - RNA, 13 nt, Human
uauuauauucauu

SEQ ID NO: 3845287 - RNA, 17 nt, Human
uauuauauuuacaaaug

SEQ ID NO: 3845288 - RNA, 13 nt, Human
uauuauauuugga

SEQ ID NO: 3845289 - RNA, 14 nt, Human
uauuauauuuggau

SEQ ID NO: 3845290 - RNA, 22 nt, Human
uauuaucaaagggauaaagaaa

SEQ ID NO: 3845291 - RNA, 12 nt, Human
uauuaucuuuuc

SEQ ID NO: 3845292 - RNA, 14 nt, Human
uauuaucuuuucau

SEQ ID NO: 3845293 - RNA, 21 nt, Human
uauuaugaaugugaagccuuc

SEQ ID NO: 3845294 - RNA, 22 nt, Human
uauuaugaaugugaagccuucc

SEQ ID NO: 3845295 - RNA, 14 nt, Human
uauuaugagaugcu

SEQ ID NO: 3845296 - RNA, 14 nt, Human
uauuaugauuagcu

SEQ ID NO: 3845297 - RNA, 13 nt, Human
uauuaugcaaauu

SEQ ID NO: 3845298 - RNA, 16 nt, Human
uauuaugcaaauuccc

SEQ ID NO: 3845299 - RNA, 14 nt, Human
uauuaugcauaacu

SEQ ID NO: 3845300 - RNA, 20 nt, Human
uauuaugcauaacugacaaa

SEQ ID NO: 3845301 - RNA, 20 nt, Human
uauuauggaaaacuguguug

SEQ ID NO: 3845302 - RNA, 12 nt, Human
uauuauguaaau

SEQ ID NO: 3845303 - RNA, 22 nt, Human
uauuauguaaaucccauuauuc

SEQ ID NO: 3845304 - RNA, 18 nt, Human
uauuauguagguaagacu

SEQ ID NO: 3845305 - RNA, 15 nt, Human
uauuauguaguuguu

SEQ ID NO: 3845306 - RNA, 19 nt, Human
uauuauguccugugagaug

SEQ ID NO: 3845307 - RNA, 21 nt, Human
uauuaugucucuucugagcua

SEQ ID NO: 3845308 - RNA, 17 nt, Human
uauuauguuguuagaga

SEQ ID NO: 3845309 - RNA, 15 nt, Human
uauuauuaaugcuuu

SEQ ID NO: 3845310 - RNA, 19 nt, Human
uauuauuacuuauuuuuga

SEQ ID NO: 3845311 - RNA, 19 nt, Human
uauuauuagaaauuagaaa

SEQ ID NO: 3845312 - RNA, 15 nt, Human
uauuauuauaaucuu

SEQ ID NO: 3845313 - RNA, 12 nt, Human
uauuauuaucuu

SEQ ID NO: 3845314 - RNA, 18 nt, Human
uauuauucaccauguaaa

SEQ ID NO: 3845315 - RNA, 13 nt, Human
uauugacaaaaug

SEQ ID NO: 3845316 - RNA, 20 nt, Human
uauugacaauaaaauauuau

SEQ ID NO: 3845317 - RNA, 13 nt, Human
uauugacacagaa

SEQ ID NO: 3845318 - RNA, 23 nt, Human
uauugacacagaaaauguugaga

SEQ ID NO: 3845319 - RNA, 11 nt, Human
uauugacacug

SEQ ID NO: 3845320 - RNA, 12 nt, Human
uauugacacuga

SEQ ID NO: 3845321 - RNA, 16 nt, Human
uauugacacugaacuu

SEQ ID NO: 3845322 - RNA, 19 nt, Human
uauugacacugaacuuaau

SEQ ID NO: 3845323 - RNA, 24 nt, Human
uauugacacugaacuuaauaacug

SEQ ID NO: 3845324 - RNA, 17 nt, Human
uauugacauuuguaguu

SEQ ID NO: 3845325 - RNA, 14 nt, Human
uauugaccauuuuu

SEQ ID NO: 3845326 - RNA, 22 nt, Human
uauugacuaacaggccaaagag

SEQ ID NO: 3845327 - RNA, 19 nt, Human
uauugagauuucuuaaaua

SEQ ID NO: 3845328 - RNA, 18 nt, Human
uauugagcagaauucauu

SEQ ID NO: 3845329 - RNA, 15 nt, Human
uauugaggaaaaaua

SEQ ID NO: 3845330 - RNA, 21 nt, Human
uauugaggaaaaauaugugaa

SEQ ID NO: 3845331 - RNA, 17 nt, Human
uauugaggccaagaaua

SEQ ID NO: 3845332 - RNA, 21 nt, Human
uauugaggccaagaauauugc

SEQ ID NO: 3845333 - RNA, 16 nt, Human
uauugaggcuuugugu

SEQ ID NO: 3845334 - RNA, 20 nt, Human
uauugaggcuuuguguugua

SEQ ID NO: 3845335 - RNA, 14 nt, Human
uauugaguuuguag

SEQ ID NO: 3845336 - RNA, 18 nt, Human
uauugauaacagcacuga

SEQ ID NO: 3845337 - RNA, 18 nt, Human
uauugauaagaucuuuua

SEQ ID NO: 3845338 - RNA, 16 nt, Human
uauugauaaguucaua

SEQ ID NO: 3845339 - RNA, 13 nt, Human
uauugauauauau

SEQ ID NO: 3845340 - RNA, 14 nt, Human
uauugauauauauu

SEQ ID NO: 3845341 - RNA, 18 nt, Human
uauugauauauauuauaa

SEQ ID NO: 3845342 - RNA, 17 nt, Human
uauugaugaaaagauuu

SEQ ID NO: 3845343 - RNA, 23 nt, Human
uauugaugaaaagauuuaagcac

SEQ ID NO: 3845344 - RNA, 20 nt, Human
uauugauguacagucuguca

SEQ ID NO: 3845345 - RNA, 19 nt, Human
uauugauucugcuugagaa

SEQ ID NO: 3845346 - RNA, 22 nt, Human
gccugcgcccaccccgcucugc

SEQ ID NO: 3845347 - RNA, 22 nt, Human
gccugcgccugcugcaugcccu

SEQ ID NO: 3845348 - RNA, 17 nt, Human
gccugcggucaaggcca

SEQ ID NO: 3845349 - RNA, 16 nt, Human
gccugcgucuuccgcc

SEQ ID NO: 3845350 - RNA, 17 nt, Human
gccugcguggcugaccc

SEQ ID NO: 3845351 - RNA, 18 nt, Human
gccugcguugguccagag

SEQ ID NO: 3845352 - RNA, 17 nt, Human
gccugcuaauuccccag

SEQ ID NO: 3845353 - RNA, 16 nt, Human
gccugcuagcuagcuc

SEQ ID NO: 3845354 - RNA, 16 nt, Human
gccugcuccagaccug

SEQ ID NO: 3845355 - RNA, 13 nt, Human
gccugcucccagc

SEQ ID NO: 3845356 - RNA, 13 nt, Human
gccugcucccugu

SEQ ID NO: 3845357 - RNA, 18 nt, Human
gccugcugcaugcccucu

SEQ ID NO: 3845358 - RNA, 21 nt, Human
gccugcugcaugcccucucag

SEQ ID NO: 3845359 - RNA, 14 nt, Human
gccugcugcugaga

SEQ ID NO: 3845360 - RNA, 17 nt, Human
gccugcugcugagaacc

SEQ ID NO: 3845361 - RNA, 18 nt, Human
gccugcugcugagaaccu

SEQ ID NO: 3845362 - RNA, 21 nt, Human
gccugcugcugagaaccuggc

SEQ ID NO: 3845363 - RNA, 17 nt, Human
gccugcuggaagcccag

SEQ ID NO: 3845364 - RNA, 19 nt, Human
gccugcuggaagcccagcc

SEQ ID NO: 3845365 - RNA, 13 nt, Human
gccugcuggaggc

SEQ ID NO: 3845366 - RNA, 22 nt, Human
gccugcuggaucucccagggcu

SEQ ID NO: 3845367 - RNA, 10 nt, Human
gccugcuggc

SEQ ID NO: 3845368 - RNA, 13 nt, Human
gccugcugggcuc

SEQ ID NO: 3845369 - RNA, 16 nt, Human
gccugcugggcucucc

SEQ ID NO: 3845370 - RNA, 21 nt, Human
gccugcugggcucuccaccuc

SEQ ID NO: 3845371 - RNA, 17 nt, Human
gccugcuggucacagcc

SEQ ID NO: 3845372 - RNA, 19 nt, Human
gccugcuggucacagccuc

SEQ ID NO: 3845373 - RNA, 23 nt, Human
gccugcugguuuuaucugaguga

SEQ ID NO: 3845374 - RNA, 21 nt, Human
gccugcuuugaauaaaugugu

SEQ ID NO: 3845375 - RNA, 18 nt, Human
gccugcuuuucacugcug

SEQ ID NO: 3845376 - RNA, 20 nt, Human
gccugcuuuucacugcugca

SEQ ID NO: 3845377 - RNA, 18 nt, Human
gccugcuuuuuauggccu

SEQ ID NO: 3845378 - RNA, 17 nt, Human
gccuggaaaccugucug

SEQ ID NO: 3845379 - RNA, 13 nt, Human
gccuggaagacag

SEQ ID NO: 3845380 - RNA, 15 nt, Human
gccuggaagacagag

SEQ ID NO: 3845381 - RNA, 22 nt, Human
gccuggaagacagagaccuccu

SEQ ID NO: 3845382 - RNA, 16 nt, Human
gccuggaagcuuuguc

SEQ ID NO: 3845383 - RNA, 22 nt, Human
gccuggaagcuuuguccccugc

SEQ ID NO: 3845384 - RNA, 14 nt, Human
gccuggacaaaccc

SEQ ID NO: 3845385 - RNA, 16 nt, Human
gccuggacaaacccuu

SEQ ID NO: 3845386 - RNA, 22 nt, Human
gccuggaccucugacagcagca

SEQ ID NO: 3845387 - RNA, 17 nt, Human
gccuggacuuuccugca

SEQ ID NO: 3845388 - RNA, 12 nt, Human
gccuggagaagc

SEQ ID NO: 3845389 - RNA, 16 nt, Human
gccuggagauccuccu

SEQ ID NO: 3845390 - RNA, 19 nt, Human
gccuggagauccuccugca

SEQ ID NO: 3845391 - RNA, 15 nt, Human
gccuggagcacaaag

SEQ ID NO: 3845392 - RNA, 19 nt, Human
gccuggagccccacugccc

SEQ ID NO: 3845393 - RNA, 20 nt, Human
gccuggagccccacugcccu

SEQ ID NO: 3845394 - RNA, 12 nt, Human
gccuggagcccu

SEQ ID NO: 3845395 - RNA, 15 nt, Human
gccuggagcccugga

SEQ ID NO: 3845396 - RNA, 14 nt, Human
gccuggagcuccug

SEQ ID NO: 3845397 - RNA, 20 nt, Human
gccuggagcuccugggaagg

SEQ ID NO: 3845398 - RNA, 13 nt, Human
gccuggaggaccu

SEQ ID NO: 3845399 - RNA, 15 nt, Human
gccuggaggaccuga

SEQ ID NO: 3845400 - RNA, 19 nt, Human
gccuggaggaccugagccu

SEQ ID NO: 3845401 - RNA, 16 nt, Human
gccuggauggggcugc

SEQ ID NO: 3845402 - RNA, 18 nt, Human
gccuggauggggcugcac

SEQ ID NO: 3845403 - RNA, 14 nt, Human
gccuggauucauuu

SEQ ID NO: 3845404 - RNA, 18 nt, Human
gccuggcaagugggugaa

SEQ ID NO: 3845405 - RNA, 13 nt, Human
gccuggcacacau

SEQ ID NO: 3845406 - RNA, 13 nt, Human
gccuggcacagga

SEQ ID NO: 3845407 - RNA, 16 nt, Human
gccuggcacaggacug

SEQ ID NO: 3845408 - RNA, 18 nt, Human
gccuggcacagggcagug

SEQ ID NO: 3845409 - RNA, 14 nt, Human
gccuggcacagugu

SEQ ID NO: 3845410 - RNA, 16 nt, Human
gccuggcacagugucu

SEQ ID NO: 3845411 - RNA, 22 nt, Human
gccuggcacagugucugggcug

SEQ ID NO: 3845412 - RNA, 18 nt, Human
gccuggcacaucagaaag

SEQ ID NO: 3845413 - RNA, 22 nt, Human
gccuggcagaacugagcuccuc

SEQ ID NO: 3845414 - RNA, 22 nt, Human
gccuggcagccgugccuucagc

SEQ ID NO: 3845415 - RNA, 14 nt, Human
gccuggcaggcugu

SEQ ID NO: 3845416 - RNA, 19 nt, Human
gccuggcagggaggucagg

SEQ ID NO: 3845417 - RNA, 20 nt, Human
gccuggcagggaggucaggc

SEQ ID NO: 3845418 - RNA, 20 nt, Human
gccuggcauucuuguacagu

SEQ ID NO: 3845419 - RNA, 16 nt, Human
gccuggccaccucucu

SEQ ID NO: 3845420 - RNA, 19 nt, Human
gccuggccaccucucuccu

SEQ ID NO: 3845421 - RNA, 23 nt, Human
gccuggccacgcagccaggacac

SEQ ID NO: 3845422 - RNA, 13 nt, Human
gccuggccacgcc

SEQ ID NO: 3845423 - RNA, 17 nt, Human
gccuggccagacacagg

SEQ ID NO: 3845424 - RNA, 21 nt, Human
gccuggccagacacaggcccu

SEQ ID NO: 3845425 - RNA, 14 nt, Human
gccuggccagaugc

SEQ ID NO: 3845426 - RNA, 23 nt, Human
gccuggccagcagguccccagcu

SEQ ID NO: 3845427 - RNA, 12 nt, Human
gccuggccaggc

SEQ ID NO: 3845428 - RNA, 23 nt, Human
gccuggccaggcagaucugugcc

SEQ ID NO: 3845429 - RNA, 15 nt, Human
gccuggccagugccc

SEQ ID NO: 3845430 - RNA, 17 nt, Human
gccuggcccagcucccc

SEQ ID NO: 3845431 - RNA, 22 nt, Human
gccuggcccauguauggccagg

SEQ ID NO: 3845432 - RNA, 16 nt, Human
gccuggccccaugguc

SEQ ID NO: 3845433 - RNA, 16 nt, Human
gccuggccccucaggg

SEQ ID NO: 3845434 - RNA, 16 nt, Human
gccuggcccugcccug

SEQ ID NO: 3845435 - RNA, 17 nt, Human
gccuggcccugcccuga

SEQ ID NO: 3845436 - RNA, 15 nt, Human
gccuggccggcaacc

SEQ ID NO: 3845437 - RNA, 13 nt, Human
gccuggccggcca

SEQ ID NO: 3845438 - RNA, 15 nt, Human
gccuggccggccagc

SEQ ID NO: 3845439 - RNA, 15 nt, Human
gccuggccuccaggc

SEQ ID NO: 3845440 - RNA, 14 nt, Human
gccuggccugagcu

SEQ ID NO: 3845441 - RNA, 20 nt, Human
gccuggccugagcugggaug

SEQ ID NO: 3845442 - RNA, 15 nt, Human
gccuggccuggcccu

SEQ ID NO: 3845443 - RNA, 16 nt, Human
gccuggccuggcccug

SEQ ID NO: 3845444 - RNA, 15 nt, Human
gccuggcgggauggg

SEQ ID NO: 3845445 - RNA, 22 nt, Human
gccuggcgggaugggccaccgc

SEQ ID NO: 3845446 - RNA, 23 nt, Human
gccuggcucacacuuggcucuga

SEQ ID NO: 3845447 - RNA, 23 nt, Human
gccuggcuccaaacccucgaggc

SEQ ID NO: 3845448 - RNA, 19 nt, Human
gccuggcucccacaggcag

SEQ ID NO: 3845449 - RNA, 21 nt, Human
gccuggcucccacaggcagcu

SEQ ID NO: 3845450 - RNA, 16 nt, Human
gccuggcucccaggac

SEQ ID NO: 3845451 - RNA, 15 nt, Human
gccuggcuccccugg

SEQ ID NO: 3845452 - RNA, 12 nt, Human
gccuggcucccu

SEQ ID NO: 3845453 - RNA, 22 nt, Human
gccuggcucccucacucucagg

SEQ ID NO: 3845454 - RNA, 16 nt, Human
gccuggcuccguccag

SEQ ID NO: 3845455 - RNA, 10 nt, Human
gccuggcucu

SEQ ID NO: 3845456 - RNA, 21 nt, Human
gccuggcucuugugcuggaug

SEQ ID NO: 3845457 - RNA, 17 nt, Human
gccuggcuggcugaggg

SEQ ID NO: 3845458 - RNA, 20 nt, Human
gccuggcuggcugagggcag

SEQ ID NO: 3845459 - RNA, 16 nt, Human
gccugggaaagccccu

SEQ ID NO: 3845460 - RNA, 16 nt, Human
ucacuguggugucugu

SEQ ID NO: 3845461 - RNA, 14 nt, Human
ucacuguguauauu

SEQ ID NO: 3845462 - RNA, 18 nt, Human
ucacuguguauauuugau

SEQ ID NO: 3845463 - RNA, 17 nt, Human
ucacuguucccucugcu

SEQ ID NO: 3845464 - RNA, 20 nt, Human
ucacuguucccucugcuccu

SEQ ID NO: 3845465 - RNA, 22 nt, Human
ucacuguucccucugcuccugg

SEQ ID NO: 3845466 - RNA, 22 nt, Human
ucacuguucuauucaucucaag

SEQ ID NO: 3845467 - RNA, 19 nt, Human
ucacuguugaaaauuauuu

SEQ ID NO: 3845468 - RNA, 14 nt, Human
ucacuguugcccag

SEQ ID NO: 3845469 - RNA, 19 nt, Human
ucacuguugcccaggcugg

SEQ ID NO: 3845470 - RNA, 23 nt, Human
ucacuguugcccaggcuggcgug

SEQ ID NO: 3845471 - RNA, 12 nt, Human
ucacuguuuaga

SEQ ID NO: 3845472 - RNA, 17 nt, Human
ucacuguuuagaacaca

SEQ ID NO: 3845473 - RNA, 15 nt, Human
ucacuguuucacuac

SEQ ID NO: 3845474 - RNA, 13 nt, Human
ucacuuaaaacac

SEQ ID NO: 3845475 - RNA, 18 nt, Human
ucacuuaaaaugugcagu

SEQ ID NO: 3845476 - RNA, 22 nt, Human
ucacuuaaacuugcaucacuua

SEQ ID NO: 3845477 - RNA, 13 nt, Human
ucacuuacuauug

SEQ ID NO: 3845478 - RNA, 22 nt, Human
ucacuuacuguuucugucagga

SEQ ID NO: 3845479 - RNA, 21 nt, Human
ucacuuaggaaauggcuuugu

SEQ ID NO: 3845480 - RNA, 19 nt, Human
ucacuuaucccaagagaau

SEQ ID NO: 3845481 - RNA, 16 nt, Human
ucacuucauaauccag

SEQ ID NO: 3845482 - RNA, 15 nt, Human
ucacuucaucuucuc

SEQ ID NO: 3845483 - RNA, 20 nt, Human
ucacuucaucuucucagcuc

SEQ ID NO: 3845484 - RNA, 19 nt, Human
ucacuuccauacagcucua

SEQ ID NO: 3845485 - RNA, 22 nt, Human
ucacuucgcgugcccucgcugc

SEQ ID NO: 3845486 - RNA, 19 nt, Human
ucacuucggccagagcuga

SEQ ID NO: 3845487 - RNA, 16 nt, Human
ucacuucgugggaucu

SEQ ID NO: 3845488 - RNA, 16 nt, Human
ucacuucuaaaugcau

SEQ ID NO: 3845489 - RNA, 14 nt, Human
ucacuucuuucccu

SEQ ID NO: 3845490 - RNA, 19 nt, Human
ucacuucuuucccuuccuc

SEQ ID NO: 3845491 - RNA, 10 nt, Human
ucacuugagu

SEQ ID NO: 3845492 - RNA, 18 nt, Human
ucacuugaugugccauuu

SEQ ID NO: 3845493 - RNA, 14 nt, Human
ucacuugauucaua

SEQ ID NO: 3845494 - RNA, 13 nt, Human
ucacuugcauguc

SEQ ID NO: 3845495 - RNA, 18 nt, Human
ucacuugugcuuugcucu

SEQ ID NO: 3845496 - RNA, 20 nt, Human
ucacuugugcuuugcucuug

SEQ ID NO: 3845497 - RNA, 13 nt, Human
ucacuuguguuuu

SEQ ID NO: 3845498 - RNA, 16 nt, Human
ucacuuuaauucucau

SEQ ID NO: 3845499 - RNA, 22 nt, Human
ucacuuuaauucucaugugauc

SEQ ID NO: 3845500 - RNA, 19 nt, Human
ucacuuucacauagauguc

SEQ ID NO: 3845501 - RNA, 14 nt, Human
ucacuuucauuuuu

SEQ ID NO: 3845502 - RNA, 14 nt, Human
ucacuuugcucuga

SEQ ID NO: 3845503 - RNA, 15 nt, Human
ucacuuugcucuggg

SEQ ID NO: 3845504 - RNA, 19 nt, Human
ucacuuugucuaacucaga

SEQ ID NO: 3845505 - RNA, 13 nt, Human
ucacuuuuaggga

SEQ ID NO: 3845506 - RNA, 13 nt, Human
ucacuuuugcaag

SEQ ID NO: 3845507 - RNA, 22 nt, Human
ucacuuuuuaugcuauuucugu

SEQ ID NO: 3845508 - RNA, 14 nt, Human
ucacuuuuucugau

SEQ ID NO: 3845509 - RNA, 16 nt, Human
ucacuuuuucugauaa

SEQ ID NO: 3845510 - RNA, 15 nt, Human
ucacuuuuugaacua

SEQ ID NO: 3845511 - RNA, 21 nt, Human
ucacuuuuugaacuaagaaac

SEQ ID NO: 3845512 - RNA, 22 nt, Human
ucacuuuuugaggcaaaagaag

SEQ ID NO: 3845513 - RNA, 22 nt, Human
gccugggguggggucaugcccu

SEQ ID NO: 3845514 - RNA, 22 nt, Human
gccugggguguuaguggcaccg

SEQ ID NO: 3845515 - RNA, 21 nt, Human
gccugggucucaccggcucuc

SEQ ID NO: 3845516 - RNA, 16 nt, Human
gccugggucugugucu

SEQ ID NO: 3845517 - RNA, 23 nt, Human
gccugggucugugucucuuuucu

SEQ ID NO: 3845518 - RNA, 17 nt, Human
gccugggugcuggcugc

SEQ ID NO: 3845519 - RNA, 19 nt, Human
gccuggguggaucggccuc

SEQ ID NO: 3845520 - RNA, 19 nt, Human
gccuggguggggcugcucc

SEQ ID NO: 3845521 - RNA, 23 nt, Human
gccuggguggggcugcuccucca

SEQ ID NO: 3845522 - RNA, 24 nt, Human
gccuggguggggcugcuccuccag

SEQ ID NO: 3845523 - RNA, 15 nt, Human
gccuggguugggggc

SEQ ID NO: 3845524 - RNA, 23 nt, Human
gccugguaggaaagggcaagucu

SEQ ID NO: 3845525 - RNA, 21 nt, Human
gccuggucccacgagggugcc

SEQ ID NO: 3845526 - RNA, 12 nt, Human
gccuggucuccu

SEQ ID NO: 3845527 - RNA, 16 nt, Human
gccuggucuccugccc

SEQ ID NO: 3845528 - RNA, 22 nt, Human
gccuggugaugcgcaguugcug

SEQ ID NO: 3845529 - RNA, 20 nt, Human
gccuggugcccagcacaugu

SEQ ID NO: 3845530 - RNA, 20 nt, Human
gccuggugcuuccaaauauu

SEQ ID NO: 3845531 - RNA, 16 nt, Human
gccugguggcagcugc

SEQ ID NO: 3845532 - RNA, 15 nt, Human
gccuggugggccucc

SEQ ID NO: 3845533 - RNA, 16 nt, Human
gccuggugguuuucaa

SEQ ID NO: 3845534 - RNA, 14 nt, Human
gccugguuagaggc

SEQ ID NO: 3845535 - RNA, 14 nt, Human
gccugguuuagccu

SEQ ID NO: 3845536 - RNA, 15 nt, Human
gccuguaaucccagc

SEQ ID NO: 3845537 - RNA, 17 nt, Human
gccuguaaucccagcac

SEQ ID NO: 3845538 - RNA, 18 nt, Human
gccuguaaucccagcacu

SEQ ID NO: 3845539 - RNA, 15 nt, Human
gccuguaauccuagc

SEQ ID NO: 3845540 - RNA, 12 nt, Human
gccuguacaguc

SEQ ID NO: 3845541 - RNA, 17 nt, Human
gccuguacagucugucu

SEQ ID NO: 3845542 - RNA, 16 nt, Human
gccuguacugccugcu

SEQ ID NO: 3845543 - RNA, 20 nt, Human
gccuguagaauagccugugg

SEQ ID NO: 3845544 - RNA, 17 nt, Human
gccuguagaguugcuga

SEQ ID NO: 3845545 - RNA, 14 nt, Human
gccuguaguuagga

SEQ ID NO: 3845546 - RNA, 16 nt, Human
gccuguaguuaggaaa

SEQ ID NO: 3845547 - RNA, 18 nt, Human
gccuguauacuuuaguau

SEQ ID NO: 3845548 - RNA, 14 nt, Human
gccugucaagaggc

SEQ ID NO: 3845549 - RNA, 20 nt, Human
gccugucagauccaggagcu

SEQ ID NO: 3845550 - RNA, 21 nt, Human
gccugucagauccaggagcuc

SEQ ID NO: 3845551 - RNA, 17 nt, Human
gccugucagcuaaagaa

SEQ ID NO: 3845552 - RNA, 19 nt, Human
gccugucauccuuggucuu

SEQ ID NO: 3845553 - RNA, 18 nt, Human
gccuguccacaggcuucu

SEQ ID NO: 3845554 - RNA, 12 nt, Human
gccuguccagcc

SEQ ID NO: 3845555 - RNA, 13 nt, Human
gccuguccagccu

SEQ ID NO: 3845556 - RNA, 17 nt, Human
gccuguccagccugggc

SEQ ID NO: 3845557 - RNA, 13 nt, Human
gccugucccccug

SEQ ID NO: 3845558 - RNA, 14 nt, Human
gccugucccucuca

SEQ ID NO: 3845559 - RNA, 18 nt, Human
gccugucccuggccaucu

SEQ ID NO: 3845560 - RNA, 21 nt, Human
gccugucccuggccaucucug

SEQ ID NO: 3845561 - RNA, 22 nt, Human
gccuguccuccaacaccaagca

SEQ ID NO: 3845562 - RNA, 13 nt, Human
gccuguccugccu

SEQ ID NO: 3845563 - RNA, 18 nt, Human
gccugucucauccccagg

SEQ ID NO: 3845564 - RNA, 19 nt, Human
gccugucucauccccaggg

SEQ ID NO: 3845565 - RNA, 19 nt, Human
gccugucucuuuaagggca

SEQ ID NO: 3845566 - RNA, 15 nt, Human
gccugucugccccag

SEQ ID NO: 3845567 - RNA, 12 nt, Human
gccugucugucu

SEQ ID NO: 3845568 - RNA, 16 nt, Human
gccugugaacccagga

SEQ ID NO: 3845569 - RNA, 17 nt, Human
gccugugaacccaggac

SEQ ID NO: 3845570 - RNA, 19 nt, Human
gccugugaacccaggacaa

SEQ ID NO: 3845571 - RNA, 21 nt, Human
gccugugaacccaggacaagc

SEQ ID NO: 3845572 - RNA, 23 nt, Human
gccugugacauacccccuccccc

SEQ ID NO: 3845573 - RNA, 23 nt, Human
gccugugagcuaggaauuguguu

SEQ ID NO: 3845574 - RNA, 24 nt, Human
gccugugaggugcagagugcccag

SEQ ID NO: 3845575 - RNA, 10 nt, Human
gccugugcca

SEQ ID NO: 3845576 - RNA, 16 nt, Human
gccugugccucuggga

SEQ ID NO: 3845577 - RNA, 18 nt, Human
gccugugccucugggacu

SEQ ID NO: 3845578 - RNA, 20 nt, Human
gccugugccuuuugccaucc

SEQ ID NO: 3845579 - RNA, 23 nt, Human
gccugugcugcccgucuucagcc

SEQ ID NO: 3845580 - RNA, 24 nt, Human
gccuguggaaucuggagugagggg

SEQ ID NO: 3845581 - RNA, 23 nt, Human
gccuguggcgccgucuccagggg

SEQ ID NO: 3845582 - RNA, 23 nt, Human
gccuguggcugucggugggacuc

SEQ ID NO: 3845583 - RNA, 16 nt, Human
gccugugguucugaga

SEQ ID NO: 3845584 - RNA, 16 nt, Human
gccuguguaacagcuc

SEQ ID NO: 3845585 - RNA, 22 nt, Human
gccuguguaacagcuccuuggg

SEQ ID NO: 3845586 - RNA, 15 nt, Human
gccuguguagcugug

SEQ ID NO: 3845587 - RNA, 16 nt, Human
gccuguguagcuguga

SEQ ID NO: 3845588 - RNA, 12 nt, Human
gccuguguccau

SEQ ID NO: 3845589 - RNA, 14 nt, Human
gccuguguccaugc

SEQ ID NO: 3845590 - RNA, 21 nt, Human
gccugugucccaugacccacc

SEQ ID NO: 3845591 - RNA, 22 nt, Human
gccugugucccaugacccaccc

SEQ ID NO: 3845592 - RNA, 13 nt, Human
gccugugucuuua

SEQ ID NO: 3845593 - RNA, 22 nt, Human
gccugugugacaucaguggcau

SEQ ID NO: 3845594 - RNA, 23 nt, Human
gccuguguggccacuucugucca

SEQ ID NO: 3845595 - RNA, 18 nt, Human
gccuguguucuuccuggc

SEQ ID NO: 3845596 - RNA, 22 nt, Human
gccuguuagacucuuacuuuuu

SEQ ID NO: 3845597 - RNA, 21 nt, Human
gccuguuagcaugcuggugag

SEQ ID NO: 3845598 - RNA, 14 nt, Human
gccuguucagcucc

SEQ ID NO: 3845599 - RNA, 17 nt, Human
gccuguucagcuccagc

SEQ ID NO: 3845600 - RNA, 19 nt, Human
gccuguucagcuccagcuc

SEQ ID NO: 3845601 - RNA, 11 nt, Human
gccuguucagu

SEQ ID NO: 3845602 - RNA, 19 nt, Human
gccuguucaguuacagaaa

SEQ ID NO: 3845603 - RNA, 24 nt, Human
gccuguucaguuacagaaaguggu

SEQ ID NO: 3845604 - RNA, 12 nt, Human
ucaacugggcug

SEQ ID NO: 3845605 - RNA, 23 nt, Human
ucaacugucuuccucaaaauaaa

SEQ ID NO: 3845606 - RNA, 19 nt, Human
ucaacuuaacuaucaucuu

SEQ ID NO: 3845607 - RNA, 20 nt, Human
ucaacuuagucaauaagaaa

SEQ ID NO: 3845608 - RNA, 16 nt, Human
ucaacuugcaaaauca

SEQ ID NO: 3845609 - RNA, 19 nt, Human
ucaacuugcaaaaucaguu

SEQ ID NO: 3845610 - RNA, 16 nt, Human
ucaacuuuguaaaaau

SEQ ID NO: 3845611 - RNA, 17 nt, Human
ucaacuuuuuauugccu

SEQ ID NO: 3845612 - RNA, 19 nt, Human
ucaacuuuuuauugccuuc

SEQ ID NO: 3845613 - RNA, 18 nt, Human
ucaagaaaaauuauugua

SEQ ID NO: 3845614 - RNA, 23 nt, Human
ucaagaaaacaggcacugcccug

SEQ ID NO: 3845615 - RNA, 15 nt, Human
ucaagaaacagccag

SEQ ID NO: 3845616 - RNA, 16 nt, Human
ucaagaaacagccagc

SEQ ID NO: 3845617 - RNA, 17 nt, Human
ucaagaaacagccagca

SEQ ID NO: 3845618 - RNA, 12 nt, Human
ucaagaaacuga

SEQ ID NO: 3845619 - RNA, 17 nt, Human
ucaagaaacugaggaau

SEQ ID NO: 3845620 - RNA, 18 nt, Human
ucaagaaacugaggaauu

SEQ ID NO: 3845621 - RNA, 17 nt, Human
ucaagaaauaaguuuuu

SEQ ID NO: 3845622 - RNA, 14 nt, Human
ucaagaaccuggaa

SEQ ID NO: 3845623 - RNA, 12 nt, Human
ucaagaagacau

SEQ ID NO: 3845624 - RNA, 20 nt, Human
ucaagaagggcugcaugaug

SEQ ID NO: 3845625 - RNA, 22 nt, Human
ucaagaaguucuuugauucugu

SEQ ID NO: 3845626 - RNA, 19 nt, Human
ucaagaauagcauuguaaa

SEQ ID NO: 3845627 - RNA, 21 nt, Human
ucaagacauagcauccaagug

SEQ ID NO: 3845628 - RNA, 17 nt, Human
ucaagacauuaaaucua

SEQ ID NO: 3845629 - RNA, 16 nt, Human
ucaagaccagccuggc

SEQ ID NO: 3845630 - RNA, 16 nt, Human
ucaagaccuucucccc

SEQ ID NO: 3845631 - RNA, 16 nt, Human
ucaagacugaauucca

SEQ ID NO: 3845632 - RNA, 15 nt, Human
ucaagagauuuaauu

SEQ ID NO: 3845633 - RNA, 18 nt, Human
ucaagagauuuaauuaau

SEQ ID NO: 3845634 - RNA, 17 nt, Human
ucaagagccuuaaaaca
